United States Patent 10,006,042 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 5

SEQ ID NO: 7311 - DNA, 1538 bp, Euonymus alatus
aaccaccacctttcgagctcactaagcgaagatgtgtaaactctgaagaggattctctgtctctgaaagaaagacattttagctaacaagtattgtatctcatacactggagtgaacctcggtaagttgtgatttcactattgtctgacaagaacatcttccataaaccctaaccagcaaatctcaattaactttacgggaacgagattatctttggcaaaccctagcaacagctgcaacccttacaacgatggcggaagcagaggcaagatcaactgcagcagctggtggtggggaggaggtatcgttgaaagataaagggaatgaattctttaaggccggaaactacctcaaagccgccgctctctatactcaagctatcaaacttgacccttccaatccctcgctttatagcaaccgagctgcagcatttctgcagttggcaaagctaaataaggcacttgctgattccgagacaacaattgcattgaacccccagtgggaaaagggatattttagaaaaggatgcatattagaggccatggaacgatatgatgatgcattagctgctttccaaactgctttacaatacagcacacagagtgcagaagtgtcaagaaagattaagcggatttcacagttggcaaaagataaaaacgaagcccaggaagtggaaaacttgagatcaaatgttgacatggcaaagcatttggatactttgagatctgaattgtctgaaaagcttggatctgaagatagcttcaaagagatgttttcattcattgttgaaacaatggaaatggctgtaaaatcatggcatgaaaatgctaaagtagatcccagagtttattttcttcttgacaaggaaaagacacaaattgataaatatgctccagctgtcaatattgacaaggcatttgaatcaccccacacgcatggcagttgtttttcatttcttaggcaatatgccgaagaatctttctccaaagctgcttgtttagtgacacctaaaagtattatatcttacccacaggtttggaaaggtcaaggaccaaggaaatggaggcatgggcagcatgatggtttctttgttcaatttgagtcaccttttttgcggaaaatttggttcattcctagtttgcatgaaaaggggcaaacattgtgcagggacccagacgcacttgacatcagcgcacatgaagttattccacgcattttcaaggaacattcaatgggagcataagtgctaaaaggattacttatggaattgggggcctgtgatttgccttgacgtggcatccaagttcctgtttagatgcggtaaactttcgaaagaagatccttttcttagctgtgcctggcctgtgatcaattttggcgtatttatatgatttttgggctttctttaagtgattgcatagaactgacattctccatctgtctgatcttgtatttttttttgtgacaaggttttggcccttatcacttgtttaaaattagaatgctaatgttttcagtgcaagtagttcaatcagatg

SEQ ID NO: 7312 - DNA, 1622 bp, Cicer arietinum
ttttttggcaaaaaagagaataatttatatattaaaagcatccaagaactgaagggaaggtttttgaaggacccaaaaattgggtaaaccctacaaacattttacaaccgaatcaatcacaaacacaatctttattcattcataagcttaaaaaagaacacaaaagagacatcatcgatggcagaaacaaaagaaggatcaaatacggagatgtctttgaaggatcaaggcaacgagtttttcaagtcaggaaaatatctcaaagctgctgcactctacactcaagctataaaaaaagacccttcaaatcccacactttatagtaaccgtgctgcagcattgctgcaattggataagcttaacaaagctctcgacgatgctgaaatgacaattaaattaaaaccccaatgggaaaagggacattttcggaaggggtgcatattggaggccatgaaacgatatgatgatgctttagcttcctttcagatagcttcgcagtataacccacaaagtcaagaagtatcgaagaagataaagaagataaaccaactcgtgaaagatagcaagcgagctcaagaagtcgagaatttgagatcgaatattgacatggccaaacatttagatacattcaaatctgaaatgtctgaaaagtatggatcggaagaaagctggaaagacattttctcattccttgttgagaccatggagactgctgtaaaatcatggcatggaacttcttcagtggatgctagagtttactttcttcctgataaggaaaagacgcaaactgataagtatcccccaattgtgaatattgataaggcctttgaatcaccacaaacacacagcagctgtttttcatttcttcggcagtatgccgaggagtctttctccaaagcagcatgcttagtggctgcgaaaaacatcattgcttatccacaggtctggaaaggacaaggatcaaggaaatggaaacatgcacagaatgatggtttttttgttcaatttgagtctccttccctgcgaaaattgtggtttatttccagttcgaatgaaaagggacagacactgtgcagggagccagaagttttggacattggtgctcatgaagttgttcctcgcctgttcaaagaaaagacgtctcgtgcttaatgtattttactaacatttggcgaatatctataaaaatgacaggctcacaggaagtttcagttcctatcttttgttgtctcttcggagtgtaacatatggatgtcaagatattctacatatttttgttttttattttattttttttattttttaaattatccaagccttcaaggagttgcaattttggcaattatttccatggtttgttttttattgccaaggcttgtttggaagcagtaggtatagatcttgtatctgaattctgtggttgagtgatgaatattgaatatgcattgttggagaataatgctctagttagatcaatttatttttgtgtctgcttttttaagtttatctcatgatatgaatacctatgtatgattagtatatggatatatttataaaaatactgtgacatgtctataagttatatttagttcattttggtaagctctctataacagtttaca

SEQ ID NO: 7313 - DNA, 2254 bp, Gossypium raimondii
agaaaaacgaggaaaattgtcttaactctaatatcgtgttagattcacccactgactcagccgcgtttttttattttttcttcctatcgtagtgaaaattttctggttttttttttcgagttaagacctctcaaacaagaagatgatgatgatgaacaagaactggaagtttgtaagactaagacaagagtttcaagttggtgttttgctgcttttattatgtcaaagtttggcttgttggtcgttgaatgaagaaggatttgctttgttgagactaagagagagagtggtgaatgatccatttggtgctttgtgggcttggaaggaagaagatggagagattaaccattgttcttggtttggtgtcgagtgctgtgatggcaaagttattgctttgaatttgaaagatctttgtcttgaaggaacactggcacctgagcttggaactctaattcatattaagtctattatcttgcggaacaactcttttaccggaactatccccgaagggatcagcaaactgaaggaattagaggtgttagacttgggatacaataatttcaatgaatcgcttccatctggactcagcagcgatctctccttaacaatccagaacagtgaccgatctgaaggtgcagtgctaaggaaattgctgcaagaaacggcaaacacttctgcaaagtcaccaaaagctccaactcatcctgcatcttctgaactgtccacaaatagtacatatttaagggatgctcctgttccacgacctcccccctctcctgttccacaacctccctctgctcctgcttctaaaccttctggaaatgatacagtacctaatacttctgctccatcaccgtcgggaagcaatccttctatttctgactctaagtcaagtcatgaagcagcaatactagtcggaagcatagggggtggtacatttcttctaatattaataatcattgcctatcttttgaaaacttacaaggtatctactgtgaaaccttgggccacagggctaagtggacaacttcagaaagcatttgtaactggtgtaccaaagctgaagcgatcagagcttgaagcagcctgcgaagatttcagcaatgtaattggttctacaatgattgggacggtgtacaaagggacactgtctaatggagttgaaatagctgtggtctctgttccagttgaatctaccaaagattggtcgaagaatttagaaacacaattcaggaagaagattgacacattatcaaaggtcaaccacaaaaattttgttaaccttcttggatattgtgaggaagataatcctttcactaggatgttggtttttgaatatgctccaaatggcactctctttgagcatttacacattaaagaatctgagcatttggactgggctatgaggttgagaattataatgggcatggcttactgcctcgagcacatgcaccagctaaacccacccgtaccccataacaacctgtcgtcctcagctgtcagtctaacagaagattatgctgccaaaatctcagattcatgtttctggaatgagttgactgcatcagacagggaagcagacggaataaacctttcggataccacaatggcaagcctagaaagtaacgtatatacctttggcgtattattatttgaaatagtaacgggtaggatgccttacttggtggataatggttcatctgaggacatggcatcagactatttgagaagggagcaagccctcgtagagatggtcgatcctactctaaactctttcgacaaggaccaatttgacctgatcggggaggtcataaaatcttgcatcgaccctgagcctggacacagaccggatatgagaggagtcagtgcaagattgagagagattactgcaatcactcctgataatgcgatccccaaactttctcctctttggtgggcagagcttgagatcatgtctactgaagcaagctagaggctgaacttgacgttgtaagtaagaaacttggatgtttttttcttgttcttcatgtcagtggagaggcaaaaataagtttgcctgtaggttggtactgtttgtatttatttcaagataatggaaagtttgttgtatatattcgagagagaaaatgtggtcctttgttttgggccatcagtgtgaaaatacataacagaaaggcataatggcaatcctcttgatttctatttgttcattgttaccaccattttttgcagcgatgaatcaatttgttttggg

SEQ ID NO: 7314 - DNA, 2306 bp, Gossypium raimondii
catagttcagtgagtcttttgagtgtacgcgttttcaaaaccagaacaaatagaaaaacgaggaaaattgtcttaactctaatatcgtgttagattcacccactgactcagccgcgtttttttattttttcttcctatcgtagtgaaaattttctggtttttttttcgagttaagaccctcaaacaagaagatgatgatgatgaacaagaactggaagtttgtaagactaagacaagagtttcaagttggtgttttgctgcttttattatgtcaaagtttggcttgttggtcgttgaatgaagaaggatttgctttgttgagactaagagagagagtggtgaatgatccatttggtgctttgtgggcttggaaggaagaagatggagagattaaccattgttcttggtttggtgtcgagtgctgtgatggcaaagttattgctttgaatttgaaagatctttgtcttgaaggaacactggcacctgagcttggaactctaattcatattaagtctattatcttgcggaacaactcttttaccggaactatccccgaagggatcagcaaactgaaggaattagaggtgttagacttgggatacaataatttcaatgaatcgcttccatctggactcagcagcgatctctccttaacaatccagaacagtgaccgatctgaaggtgcagtgctaaggaaattgctgcaagaaacggcaaacacttctgcaaagtcaccaaaagctccaactcatcctgcatcttctgaactgtccacaaatagtacatatttaagggatgctcctgttccacgacctcccccctctcctgttccacgacctccctctgctcctgcttctaaaccttctggaaatgatacagtacctaatacttctgctccatcaccgtcgggaagcaatccttctatttctgactctaagtcaagtcatgaagcagcaatactagtcggaagcatagggggtggtacatttcttctaatattaataatcattgcctatcttttgaaaacttacaaggtatctactgtgaaaccttgggccacagggctaagtggacaacttcagaaagcatttgtaactggtgtaccaaagctgaagcgatcagagcttgaagcagcctgcgaagatttcagcaatgtaattggttctacaatgattgggacggtgtacaaagggacactgtctaatggagttgaaatagctgtggtctctgttccagttgaatctaccaaagattggtcgaagaatttagaaacacaattcaggaagaagattgacacattatcaaaggtcaaccacaaaaattttgttaaccttcttggatattgtgaggaagataatcctttcactaggatgttggtttttgaatatgctccaaatggcactctctttgagcatttacacattaaagaatctgagcatttggactgggctatgaggttgagaattataatgggcatggcttactgcctcgagcacatgcaccagctaaacccacccgtaccccataacaacctgtcgtcctcagctgtcagtctaacagaagattatgctgccaaaatctcagattcatgtttctggaatgagttgactgcatcagacagggaagcagacggaataaacctttcggataccacaatggcaagcctagaaagtaacgtatatacctttggcgtattattatttgaaatagtaacgggtaggatgccttacttggtggataatggttcatctgaggacatggcatcagactatttgagaagggagcaagccctcgtagagatggtcgatcctactctaaactctttcgacaaggaccaatttgacctgatcggggaggtcataaaatcttgcatcgaccctgagcctggacacagaccggatatgagaggagtcagtgcaagattgagagagattactgcaatcactcctgataatgcgatccccaaactttctcctctttggtgggcagagcttgagatcatgtctactgaagcaagctagaggctgaacttgacgttgtaagtaagaaacttggatgtttttttcttgttcttcatgtcagtgcagaggcaaaaataagtttgcctgtaggttggtactggttgtatttatttcaaggtaatggaaagtttgttgtatatattcgagagagaaaatgtggtcctttgttttgggccatcagtgtgaaaatacataacagaaaggcataatggcaatcctcttgatttctatttgttcattgttaccaccgttttttgcagcgatgaatcaatttgttttgggcta

SEQ ID NO: 7315 - DNA, 2183 bp, Gossypium hirsutum
tttttcttcctatcgtagtgaaaattttctgggtttttttcgagttaagacctctcaaacaagaagatgatgatgatgaacaagaactggaagtttgtaagactaagacaagagtttcaagttggtgttttgctgcttttattatgtcaaagtttggcttgttggtcgttgaatgaagaaggatttgctttgttgagactaagagagagagtggtgaatgatccatttggtgctttgtgggcttggaaggaagaagatggagagattaaccattgttcttggtttggtgtcgagtgctgtgatggcaaagttattgctttgaatttgaaagatctttgtcttgaaggaacactggcacctgagcttggaactctaattcatattaagtctattatcttgcggaacaactcttttaccggaactatccccgaagggatcagcaaactgaaggaattagaggtgttagacttgggatacaataatttcaatgaatcgcttccatctggactcagcagcgatctctccttaacaatccagaacagtgaccgatctgaaggtgcagtgctaaggaaattgctgcaagaaacggaaaacacttctgcaaagtcaccaaaagctccaactcatcctgcatcttctgaactgtccacaaatagtacatatttaagggatgctcctgttccacgacctctccccactcctgttccacgacctccctctgctcctgcttctaaaccttctggaaatgatacagtacctaatacttctgctccatcaccgtcgggaagcaatccttctatttctgactctaagtcaagtcatgaagcagcaatactagtcggaagcatagggggtggtacatttcttctaatattaataatcattgcctatcttttgaaaacttacaaggtatctactgtgaaaccttgggccacagggctaagtggacaacttcagaaagcatttgtaactggtgtaccaaagctgaagcgatcggagcttgaagcagcctgcgaagatttcagcaatgtaattggttctacaatgattgggacggtgtacaaagggacactgtctaatggagttgaaatagctgtggtctctgttccagttgaatctaccaaagattggtcgaagaatttagaaacacaattcaggaagaagattgacacattatcaaaggtcaaccacaaaaattttgttaatcttcttggatattgtgaggaagataatcctttcactaggatgttggtttttgaatatgctccaaatggcactctctttgagcatttacacattaaagaatctgagcatttggactgggctatgaggttgagaattataatgggcatggcttactgcctcgagcacatgcaccagctaaacccacccgtaccccataacaacctgtcgtcctcagctgtcagtctaacagaagattatgctgccaaaatctcagattcatgtttctggaatgagttgactgcatcagacagggaagcagacggaataaacctttcggataccacaatggcaagcctagaaagtaacgtatatacctttggcgtattattatttgaaatagtaacgggtaggatgccttacttggtggataatggttcatctgaggacatggcatcagactatttgagaagggagcaagccctcgtagagatggtcgatcctactctaaactcttttgacaaggaccaatttgacctgatcggggaggtcataaaatcttgcatcgaccctgagcctggacacagaccggatatgagaggagtcagtgcaagattgagagagattactgcaatcactcctgataatgcaatccccaaactttctcctctttggtgggcagagcttgagatcatgtctactgaagcaagctagaggctgaacttgacgttgtaagtaagaaacttggatgtttttttcttgttcttcatgtcagtgcagaggcaaaaataagcttgcctgtaggttggtactggttgtatttatttcaaggtaatggaaagtttgttgtatatattcgagagagaaaatgtggtcctttgttttgggccatcagtgtgaaaatacataacagaaaggcataatggcaatcctcttgatttctatttgttcattgttaccaccattttttgcagcgatgaatcaatttgttttgggctaac

SEQ ID NO: 7316 - DNA, 1040 bp, Gossypium raimondii
atccataacatttttgttcaaggaccacttcttcccttccattttactttgttttagttgccataacgtcaccttccaatacaacccacaatgaggcaacaatatgtcttcactactctcacgttgctcatcctgttttccctcagttgttcaacaacattagcccaagctccggcactggctccagcaccttctggtccgacaaacgtcaccaagatcctcgaaaaagccggtcaattcaccctcttcattcgtcttctaaagtccactcaagtggccaaccagctgctcggtcagctcaacaattccaacaatggtatgaccgtttttgcaccaacggacaatgctttctccagccttaaatcgggcacattgaattcactcaccgatgaacaaaaagtggagctggtgcaattccacatcgtcccaacatacctcacctcgtctcagttccaaaccattagcaatcctttgagaacccaagctggtgatagtggcgatggcaagttccctctcaatatcaccacttcggggaactccgtgaatataacaacagggttgacaaacaccagtgtttccggcactatttacactgatggtcagcttgctgtttatcaaatcgatcaagttcttcaaccattgcaaatatttgcacctaggcctccagctccagcaccggcaccggcaaagtcgaagaataagaaggctaccaccgttgctgatagccccgatgttaccccagctgataactccaaagcggccaccttgcaaaatgttggtttgtttggagttgctgctctagttattgcactttctttgtgaccatgaaaatggagaaaagaagaagacagtgattttgatggtgatcaagatggcgagtgttttttaatttttcaataattatcatttaaaaaatttatgttctgtatgaagattgaattttgagtttgtgttgttgatttcatttatttttgttttgaaattttctttgttatctcttatttctcaattgtaattgtgaattttgtggcactttcttc

SEQ ID NO: 7317 - DNA, 1117 bp, Gossypium hirsutum
cgtagtgttttttgttcaaggaccacttcttcccttccattttactttgttttagttgccataacgtcaccttccaatacaacccacaatgaggcaacaatatgtcttcactactctcacgttgctcatcctgttttccctcagttgttcaacaacattagcccaagctccggcactggctccagcaccttctggtccgacaaacgtcaccaagatcctcgaaaaagccggtcaattcaccctcttcattcgtcttctaaagtccactcaagtggccaaccagctgctcggtcagctcaacaattccaacaatggtatgaccgtttttgcaccaacggacaatgctttctccagccttaaatcgggcacattgaattcactcaccgatgaacaaaaagtggagctggtgcaattccacatcgtcccaacatacctcacctcgtctcagttccaaaccattagcaatcctttgagaacccaagctggtgatagtggcgatggcaagttccctctcaatatcaccacttcggggaactccgtgaatataacaacagggttgacaaacaccagtgtttccggcactatttacactgatggtcagcttgctgtttatcaaatcgatcaagttcttcaaccattgcaaatatttgcacctaggcctccagctccagcaccggcaccggcaaagtcgaagaataagaaggctaccaccgttgctgatagccccgatgttaccccagctgataactccaaagcggccaccttgcaaaatgttggtttgtttggagttgctgctctagttattgcactttctttgtgaccatgaaaatggagaaaagaagaagacagtgattttgatggtgatcaagatggcgagtgttttttattttttcaataattatcatttaaaaaatttatgttctgtatgaagattgaattttgagtttgtcttgttgatttcatttatttttgttttgaaattttctttgttatctcttatttctcaattgtaattgtgaattttgtggcactttcttcctcctttctctttttaagattttgcatcattgcatgtttttgaaaacctttattttcaaatattcatattttatttaga

SEQ ID NO: 7318 - DNA, 729 bp, Gossypium hirsutum
atgaggcaacaatatgtcttcactactctcacgttgctcatcctgttttccctcagttgttcaacaacattagcccaagctccggcactggctccagcaccttctggtccgacaaacgtcaccaagatcctcgaaaaagccggtcaattcaccctcttcattcgtcttctaaagtccactcaagtggccaaccagctgctcggtcagctcaacaattccaacaatggtatgaccgtttttgcaccaacggacaatgctttctccagccttaaatcgggcacattgaattcactcaccgatgaacaaaaagtggagctggtgcaattccacatcgtcccaacatacctcacctcgtctcagttccaaaccattagcaatcctttgagaacccaagctggtgatagtggcgatggcaagttccctctcaatatcaccacttcggggaactccgtgaatataacaacagggttgacaaacaccagtgtttccggcactatttacactgatggtcagcttgctgtttatcaaatcgatcaagttcttcaaccattgcaaatatttgcacctaggcctccagctccagcaccggcaccggcaaagtcgaagaataagaaggctaccaccgttgctgatagccccgatgttaccccagctgataactccaaagcggccaccttgcaaaatgttggtttgtttggagttgctgctctagttattgcactttctttg

SEQ ID NO: 7319 - DNA, 1420 bp, Gossypium raimondii
cattcgaggaatacggggaataattgaagtaacgagcctcccgatatgtatgtctatttggtcacatatccactccaaaatctactctgttttccctgcttttccaagcaatgtagttgctcatcaatttctttcctttcaaataaaaatcccaacagagtttgctaaagttgataagtatgtcttctagttaactaaagtagcatattttacctaacttcaccctccaatatcctaaataaaaagctcccatttcttatccaatcaaaacatccataacatttttgttcaaggaccacttcttcccttccattttactttgttttagttgccataacgtcaccttccaatacaacccacaatgaggcaacaatatgtcttcactactctcacgttgctcatcctgttttccctcagttgttcaacaacattagcccaagctccggcactggctccagcaccttctggtccgacaaacgtcaccaagatcctcgaaaaagccggtcaattcaccctcttcattcgtcttctaaagtccactcaagtggccaaccagctgctcggtcagctcaacaattccaacaatggtatgaccgtttttgcaccaacggacaatgctttctccagccttaaatcgggcacattgaattcactcaccgatgaacaaaaagtggagctggtgcaattccacatcgtcccaacatacctcacctcgtctcagttccaaaccattagcaatcctttgagaacccaagctggtgatagtggcgatggcaagttccctctcaatatcaccacttcggggaactccgtgaatataacaacagggttgacaaacaccagtgtttccggcactatttacactgatggtcagcttgctgtttatcaaatcgatcaagttcttcaaccattgcaaatatttgcacctaggcctccagctccagcaccggcaccggcaaagtcgaagaataagaaggctaccaccgttgctgatagccccgatgttaccccagctgataactccaaagcggccaccttgcaaaatgttggtttgtttggagttgctgctctagttattgcactttctttgtgaccatgaaaatggagaaaagaagaagacagtgattttgatggtgatcaagatggcgagtgttttttaatttttcaataattatcatttaaaaaatttatgttctgtatgaagattgaattttgagtttgtgttgttgatttcatttatttttgttttgaaattttctttgttatctcttatttctcaattgtaattgtgaatttcactttcttcatcctttctctttttaagattttgcatcattgcttgtttttgaaaacttttattgtcaaatattcatattatatttagattaaattcacagttggattaagtataagaaaaatt

SEQ ID NO: 7320 - DNA, 609 bp, Gossypium raimondii
tcagccgcggcagttcctcgaaaaagccggtcaattcaccctcttcattcgtcttctaaagtccactcaagtggccaaccagctgctcggtcagctcaacaattccaacaatggtatgaccgtttttgcaccaacggacaatgctttctccagccttaaatcgggcacattgaattcactcaccgatgacaaaagtgcagctggtgcaattccacatcgtcccaacatacctcacctcgtctcagttccaaaccattagcaaccctttgagaacccaagctggtgatagtggcgacggcaagttccctctcaatgtcaccacttcggggaactctgtgaatataacaacagggttgacaaacaccagtgtttccggcactatttacactgatggtcagcttgctgtttatcaaatcgataaagttcttcaaccattgcaaatatttgcacctaggcctccagctcccgcaccggcaccggcaaagtcgaagaataagaaggctaccactgttgctgatagccccgatgttaccccagctgataactccaaagcggccaccttgcaaaatgttggtttgtttggagttgctgctctagttattgcacttt

SEQ ID NO: 7321 - DNA, 1194 bp, Theobroma cacao
aacacatatccaaacattttgtgctaggaccacttcccatcccaaccctcttcacttccattgtgcattgttttcttgccaagcaaccatttcccacacatcccaaagaggctacaacgatggtgatgatgaagcaacatctcttcattctctcatttctccttctctctttcctccgttgcccacaaacactagcccaagctccggccctggctccggccctggctccggcaccacccggtcccactaatgtcaccaaaatccttgaaaaagccggccaatttaccctcttcattcgccttctaaaagccaccgcagtcgccaaccagctccttggacagctcaacaacacaaacaatggcatgaccatttttgcaccaacagataatgctttctcgagccttaaatccggcaccttaaactcactctccgatgaacaaaaagttgagctggtgcaattccatataatcccaacatacctgtcatcaacccaattccaaactattagtaaccctttgagaacacaagctggggatagcgctgatggtaagtttcctctcaatgtcaccacctcaggaaactcggtcaatataacaacagggcttacaaacaccagcgtttctggcaccatttacactgatggtcagcttgctgtttatcaagtcgataaggtgcttcaacctttgcaaatatttgatcctaggcctccagccccggcacctgcaccggccaagtccaagaagaaggctgccgttgctgatagccctgacgataccccagctgacaactccaaagctgtcagtactctcaccatgcaaaatgtagtgttttggggagttagtgctatagttctcgcactctctttgtgacgatgaacaaaaacaaagttttggtgggattattaaggtgataatttgggggatccattttatcttctgggctatgatatccggtgggttggattcgagggtggtgatcaagatggtgagtgcttttttttttttttttcaataattatcatttatcattctgttctatcctatttgtataatgccagtctgtgatgagagtcaattgctatcaagattgaattttgaggtttttcttcttcttcttctgtgttcttcatttcttctctttttctattaagattttcactgtaatatctctttcttttccaactcccatgtaatt

SEQ ID NO: 7322 - DNA, 1454 bp, Theobroma cacao
caaccttcccaagaaaacattgagttgctcaagctaacaactatgtttttgctatctaaacttggccattttacctaacttcattctctcccctccttaataaaatccctcctctttctcttcctattaacacatatccaaacattttgtgctaggaccacttcccatcccaaccctcttcacttccattgtgcattgttttcttgccaagcaaccatttcccacacatcccaaagaggctacaacgatggtgatgatgaagcaacatctcttcattctctcatttctccttctctctttcctccgttgcccacaaacactagcccaagctccggccctggctccggccctggctccggcaccacccggtcccactaatgtcaccaaaatccttgaaaaagccggccaatttaccctcttcattcgccttctaaaagccaccgcagtcgccaaccagctccttggacagctcaacaacacaaacaatggcatgaccatttttgcaccaacagataatgctttctcgagccttaaatccggcaccttaaactcactctccgatgaacaaaaagttgagctggtgcaattccatataatcccaacatacctgtcatcaacccaattccaaactattagtaaccctttgagaacacaagctggggatagcgctgatggtaagtttcctctcaatgtcaccacctcaggaaactcggtcaatataacaacagggcttacaaacaccagcgtttctggcaccatttacactgatggtcagcttgctgtttatcaagtcgataaggtgcttcaacctttgcaaatatttgatcctaggcctccagccccggcacctgcaccggccaagtccaagaagaaggctgccgttgctgatagccctgacgataccccagctgacaactccaaagctgtcagtactctcaccatgcaaaatgtagtgttttggggagttagtgctatagttctcgcactctctttgtgacgatgaacaaaaacaaagttttggtgggattattaaggtgataatttgggggatccattttatcttctgggctatgatatccggtgggttggattcgagggtggtgatcaagatggtgagtgcttttttttttttttttcaataattatcatttatcattctgttctatcctatttgtataatgccagtctgtgatgagagtcaattgctatcaagattgaattttgaggtttttcttcttcttcttctgtgttcttcatttcttctctttttctattaagattttcactgtaatatctctttcttttccaactcccatgtaattgtgaattttgttgcacttctttgtatcataccatatcattatgcttactcattgctttccatccaacttcacagccatgcacatatatgcatatggattataagcacaatttattaaaataatcagaggatc

SEQ ID NO: 7323 - DNA, 1054 bp, Pteridium aquilinum
cattccattgtgcattgttttcttgccaagcaaccatttcccacacatcccaaagaggctacaacgatggtgatgatgaagcaacatctcttcattctctcatttctccttctctctttcctccgttgcccacaaacactagcccaagctccggccctggctccggccctggctccggcaccacccggtcccactaatgtcaccaaaatccttgaaaaagccggccaatttaccctcttcattcgccttctaaaagccaccgcagtcgccaaccagctccttggacagctcaacaacacaaacaatggcatgaccatttttgcaccaacagataatgctttctcgagccttaaatccggcaccttaaactcactctccgatgaacaaaaagttgagctggtgcaattccatataatcccaacatacctgtcatcaacccaattccaaactattagtaaccctttgagaacacaagctggggatagcgctgatggtaagtttcctctcaatgtcaccacctcaggaaactcggtcaatataacaacagggcttacaaacaccagcgtttctggcaccatttacactgatggtcagcttgctgtttatcaagtcgataaggtgcttcaacctttgcaaatatttgatcctaggcctccagccccggcacctgcaccggccaagtccaagaagaaggctgccgttgctgatagccctgacgataccccagctgacaactccaaagctgtcagtactctcaccatgcaaaatgtagtgttttggggagttagtgctatagttctcgcactctctttgtgacgatgaacaaaaacaaagttttggtgggattattaaggtgataatttgggggatccattttatcttctgggctatgatatccggtgggttggattcgagggtggtgatcaagatggtgagtgtcttttttttttttttttcttttctaataattatcatttatcattctgttctatcctatttgtataatgccagtctgtgatgagagtcaattgctatcaagattgaatttttgagg

SEQ ID NO: 7324 - DNA, 859 bp, Gossypium hirsutum
caaactacctgcttctagctctccttttgaatcaatctccatttttagttttcgtaaagtgaaaggatgttaggcattttcaagaaagaattaatgaatccaccaaaggagctgcatagcccagcttcactcacttcatcaaacaagcccaagcttcccaatcaaatcatcaaccatttcctttcttcaaatcccaacaatgctttctcaatggggttcggatcctcagcttgctttgcttatgctccctcagagaatcgtttccccaatcatcaaaggttgttctgtggagtggatgaaatatactgcatattcttgggggatttgaataatttgagcagcctgctaaagcagtatgggctgtcaaagggcaccaatgaagccatgtttatcatcgaagcatatcggaccctccgcgaccgtggtccgtacccggctgaccaggtccttaaggatcttgaaggcagctatggatttgtggtgtatgatagcaaagctggaagtgtatttgctgcattgggtgcagatgaaagggttaaactctattggggtgtagcagctgatggatcagtagttgtttcagataacttgaagcttataaaagaaagctgtgctaaatcatttgcaccatttccacctgggtgtatgttccacagtgagcaaggattgacgagttttgagcatccgaggagcaaaatgaaggcaatgccaagaattgacagtgaaggggtgatgtgtggtgccaatttcatggccgatgctcagtcgagaacaagtaggatgccccgagttggtagcgaagccaattgggcactgcgaggctccaaagcttgaataattcaatactaaatgacccaca

SEQ ID NO: 7325 - DNA, 1203 bp, Gossypium raimondii
ctcaattgtatatatacccaattacggggctttttctcaatatctcatcttcatcttcatttcaaactacctgcttttagctctccttttgaatcaatctccatttttggttttcgtaaagtgaaaggatgttaggcattttcaagaaagaattaatgaatcctccaaaggagctgcatagcccagcttcactcacttcatcaaacaagcccaagcttcccaatcaaatcatcaaccatttcctttcttcaaatcccaacaatgctttctcaatggggttcggatcctcagcttgctttgcttatgctcccacagagaatcgtttccccagtcatcaaaggttgttctgtggagtggatgaaatatactgcatattcttgggggatttgaataatttgagcagcctgctaaagcagtatgggctgtcaaagggcaccaatgaagccatgtttatcatcgaagcatatcggaccctccgcgaccgtggtccgtacccggctgaccaggtccttaaggatcttgaaggcagctatggatttgtggtgtatgatagcaaagctggaagtgtatttgctgcattgggtgcagatgaaagggttaaactctattggggtgtagcagctgatggatcagtagttgtttcagataacttgaagcttataaaagaaagctgtgctaaatcatttgcaccatttccacctgggtgtatgttccacagtgagcaaggattgacgagttttgagcatccgaggagcaaaatgaaggcaatgccaagaattgacagtgaaggggtgatgtgtggtgccaatttcatggccgatgctcagtcgagaacaagtaggatgccccgagttggtagcgaagccaattgggcactgcgaggctccaaagcttgaataattcaatactaaatgacccacattttattatttgtgttttttttttttgggggggggtgtttatttcctcgtttatgaaattgtaaaatgccttgtaaaaggcatgtttgataaataaaataaaaaaaaattaaaaaagaaaacctaacatggcttgataactgaaatgcctggaagagttttatcatctaataaatgatgcagcttagcatttgatcatatgaagattgcaaaaatatgaccttttgtaattgaccatagggaagcaagagtggtaattaactattttgctgtctgcttcatc

SEQ ID NO: 7326 - DNA, 1153 bp, Gossypium hirsutum
atcttcatttcaaactacctgcttttagctctccttttgaatcaatctccatttttggtttttcgtaaagtgaaaggatgttaggcattttcaagaaagaattaatgaatcctccaaaggagctgcatagcccagcttcactcacttcatcaaacaagcccaagcttcccaatcaaatcatcaaccatttcctttcttcaaatcccaacaatgctttctcaatggggttcggatcctcagcttgctttgcttatgctcccacagagaatcgtttccccagtcatcaaaggttgttttgtggagtggatgaaatatactgcatattcttgggggatttgaataatttgagcagcctgctaaagcagtatgggctgtcaaagggcaccaatgaagccatgtttatcatcgaagcatatcggaccctccgagaccgtggtccgtacccggctgaccaggtccttaaggatcttgaaggcagctatggatttgtggtgtatgatagcaaagctggaagtgtatttgctgcattgggtgcagatgaaagggttaatctctattggggtgtagcagctgatggatcagtagttgtttcagataacttgaagcttataaaagaaagctgtgctaaatcatttgcaccatttccaccagggtgtatgttccacagtgagcaaggattgatgagttttgagcatccaaggagcaaaatgaaggcaatgccaagaattgacagtgaaggggtgatgtgtggtgccaatttcatggccgatgctcagtcgagaacaagtaggatgccccgagttggtagcgaagccaattgggcactgcgaggctccaaagcttgaataattcaatactaaatgacccacattttattatttgtgtttttttttttggggggggggtgtttatttcctcgtttatgaaattgtaaaatgccttgtaaaaggcatgtttgataaataaaatgaaaaaaaattagaaaagaaatcctaacatggcttgataactgaaataaaaaaaaaaaaaaaaaaaactcgagagtaagtctaaagcggccgcggcccatccattttcccaccgggtgggggaacaaggaaatgtaccccaattcgccccaaaatgagtctaataaaatttcatggggcggtcg

SEQ ID NO: 7327 - DNA, 1019 bp, Gossypium raimondii
atcttcatcttcatttcaaactacctgcttttagctctccttttgaatcaatctccatttttggttttcgtaaagtgaaaggatgttaggcattttcaagaaagaattaatgaatcctccaaaggagctgcatagcccagcttcactcacttcatcaaacaagcccaagcttcccaatcaaatcatcaaccatttcctttcttcaaatcccaacaatgctgtctcaatggggttcggatcctcagcttgctttgcttatgctcccacagagaatcgtttccccagtcatcaaaggttgttttgtggagtggatgaaatatactgcatattcttgggggatttgaataatttgagcagcctgctaaagcagtatgggctgtcaaagggcaccaatgaagccatgtttatcatcgaagcatatcggaccctccgagaccgtggtccgtacccggctgaccaggtccttaaggatcttgaaggcagctatggatttgtggtgtatgatagcaaagctggaagtgtatttgctgcattgggtgcagatgaaagggttaatctctattggggtgtagcagctgatggatcagtagttgtttcagataacttgaagcttataaaagaaagctgtgctaaatcatttgcaccatttccaccagggtgtatgttccacagtgagcaaggattgatgagttttgagcatccgaggagcaaaatgaaggcaatgccaagaattgacagtgaaggggtgatgtgtggtgccaatttcatggccgatgctcagtcgagaacaagtaggatgccccgagttggtagcgaagccaattgggcactgcgaggctccaaagcttgaataattcaatactaaatgacccacattttattattttgttttttttttttgggggggggttttatttcctcgtttatgaaatcgtaaaatgccttgtaaaaggcatgtttgataaataaaatgaaaaaaaattagaaaagaaatcctaacatggcttgataactgaaat

SEQ ID NO: 7328 - DNA, 1067 bp, Theobroma cacao
atcccatttggtctttctttagtttactctctcaagttctcaagcaacctgtgttatttttggtttgaatcaatctccgatctctttaaagaagagaatttctagtttgattgaggaacaagaaatgttggcaatattcaacaaagggttagtgaacccaccgaaggaactgcacagtccagcttcggtcagttcatctaggaagcctaagcttccggtggaaatcctcgaggattttctctctgcaaatcccaacaatgcattctctattggcttcggagctgcagcttccttagcttatgttccacaacagaattcttgcaccacttaccaaaggttgttttgtggagtggatgaaatatactgcatcttcttaggaagtctgaacaacctttgcagccttctcaggcagtatggtctgtcaaaaggcacaaacgaggcaatgtttatcatcgaggcatacaggaccctccgggaccgtggcccctacccagcccatcaggtcctcaaggatcttgaaggaagctatggatttgtggtctatgatggcaaggctggaagtgtatttgctgcattgggtgcagatgaagcggttaacctcttctggggtattgcagctgatggatctgtggttgtttcagacaacttgaaggtcataaaagaaagctgtgctaaatcatttgcaccatttccagcagggtgtatgttccacagcgagcaaggattgatgagttttgagcatccaaggagcgaaatgaaggcaatgccaagaattgatagcgaaggggtgatgtgcggtgccgacttcaaggccgatgttcagtcaagaataagcagcatgccgcgcgtgggcagcgaagccaactgggcgctgcgaggctccacagcttgaatcatattttcactcatgacccacaattgtattccttctgatttttgtgtttttcttggctttattccttgtttttgatttttcctaggtcagtcggaactgacttcgccactgtaaaaaagtgccttgtgaacatgaaaaggcatgtttgataaataaaatgcaaaaaaaaaaa

SEQ ID NO: 7329 - DNA, 1435 bp, Theobroma cacao
ttcaatatcccatttggtctttctttagtttactctctcaagttctcaagcaacctgtgttatttttggtttgaatcaatctccgatctctttaaagaagagaatttctagtttgattgaggaacaagaaatgttggcaatattcaacaaagggttagtgaacccaccgaaggaactgcacagtccagcttcggtcagttcatctaggaagcctaagcttccggtggaaatcctcgaggattttctctctgcaaatcccaacaatgcattctctattggcttcggagctgcagcttccttagcttatgttccacaacagaattcttgcaccacttaccaaaggttgttttgtggagtggatgaaatatactgcatcttcttaggaagtctgaacaacctttgcagccttctcaggcagtatggtctgtcaaaaggcacaaacgaggcaatgtttatcatcgaggcatacaggaccctccgggaccgtggcccctacccagcccatcaggtcctcaaggatcttgaaggaagctatggatttgtggtctatgatggcaaggctggaagtgtatttgctgcattgggtgcagatgaagcggttaacctcttctggggtattgcagctgatggatctgtggttgtttcagacaacttgaaggtcataaaagaaagctgtgctaaatcatttgcaccatttccagcagggtgtatgttccacagcgagcaaggattgatgagttttgagcatccaaggagcgaaatgaaggcaatgccaagaattgatagcgaaggggtgatgtgcggtgccgacttcaaggccgatgttcagtcaagaataagcagcatgccgcgcgtgggcagcgaagccaactgggcgctgcgaggctccacagcttgaatcatattttcactcatgacccacaattgtattccttctgatttttgtgtttttcttggctttattccttgtttttgatttttcctaggtcagtcggaactgacttcgccactgtaaaaaagtgccttgtgaacatgaaaaggcatgtttgataaataaaatgcaaaaaaaaaaaaaaaaagggaattcgctgattagcaagtaggtttcccctttcctcaacttagaagtgtgattcaagaacaagcatattgaagatatctcagtcatatctgtaggagggacggatgggaaacaggtttgtttttaaagcattaacgcttgtttgtttcaggtacatcaacacttcaatgcaatagagtagatacacattggtttataatgactcatgacacaatctagcaattcaaactaagggtattgccaattcaaatttaatatgctggaaaaacagtgttgcgagaatcacctgaaaaaccggctattttccagctcttttaacttaatttcacaatttaatcaagtacatctgtgttc

SEQ ID NO: 7330 - DNA, 989 bp, Pteridium aquilinum
atcccattttggtctttctttagtttactctctcaagttctcaagcaacctgtgttattttggtttgaatcaatctccgatctctttaaagaagagaatttctagtttgattgaggaacaagaaatgttggcaatattcaacaaagggttagtgaacccaccgaaggaactgcacagtccagcttcggtcagttcatctaggaagcctaagcttccggtggaaatcctcgaggattttctctctgcaaatcccaacaatgcattctctattggcttcggagctgcagcttccttagcttatgttccacaacagaattcttgcaccacttaccaaaggttgttttgtggagtggatgaaatatactgcatcttcttaggaagtctgaacaacctttgcagccttctcaggcagtatggtctgtcaaaaggcacaaacgaggcaatgtttatcatcgaggcatacaggaccctccgggaccgtggcccctacccagcccatcaggtcctcaaggatcttgaaggaagctatggatttgtggtctatgatggcaaggctggaagtgtatttgctgcattgggtgcagatgaagcggttaacctcttctggggtattgcagctgatggatctgtggttgtttcagacaacttgaaggtcataaaagaaagctgtgctaaatcatttgcaccatttccagcagggtgtatgttccacagcgagcaaggattgatgagttttgagcatccaaggagcgaaatgaaggcaatgccaagaattgatagcgaaggggtgatgtgcggtgccgacttcaaggccgatgttcagtcaagaataagcagcatgccgcgcgtgggcagcgaagccaactgggcgctgcgaggctccacagcttgaatcatattttcactcatgacccacaattgtattccttctgatttgtgtttcttggctttattccttgtttgatttcctaggtcagtctggccgctcg

SEQ ID NO: 7331 - DNA, 1863 bp, Gossypium hirsutum
caagtaaacagcacatccccaataataccgaggaagaggaagttgaaaacccttgggctgtcccttggtgggtgtttctttaggttttcttggtcgcgacgattttcagtggcttgtaaatggcagcgtataggctcctgattttctccctctttttggccctagttttcaccaagattggagccgatgcctcaactgaaccgctgcttgaatcggacgccgccgattcttctgctcttaagatggagttggatcaactgaagtctaagatccgtcttcttgaatcaaatgttgaggagaaaattcgagaattgaaaaccaaggatgagatgataaagcagaaagataaaattatagaagaaaaatctgacaccatggcatcgttgcactctgaattatcatctcttcagaaaaaaggaaccccagatgctgaggaacgggtgggaaaagctcatgcgaaagctcttgaattgcagaaacaggttgatagacttaaaactgaactagaagcaaaattgaaggaaaaagattatttagaatcccgtgcaactaaagctgagaacaagttgaatgaattgaatttgcagctagagaatcttcaaaagatcaataaggaacaggagaacaaactagcaaaaactgagcgagctctaaatattgcagaggaagaactggtaaaggcaaagtttgatgccacttcaaaggcaaatgagttgatggaggttcacagcgcatggcttccaccttggcttgctacacagttaattcgtggtcaggccttcattcagacacattggaatcagcatggaaaaccaaacatggatatggtgatccagaaggctctagagaaaaaggccttagctaaaaagtgggctgaaccccacatggaagcaattaaaaccaaatgggttccagctgctaaggatcagtgggtggcggtaactacatatgctgaaccacatgtgcaatcgctcactgcaaaaactgttgaaatttatgaggtatcgaaggctacaataactcctcatattatcaaagttcaagaaacagttgatccttacttccaggaagccaagaagttcagtaagccatatattgatcaggttgctactttagcaaagcctcatgttgataaaatttctgtggtgatgaagccctatacaaaggaggtagttaaagcttatgggaggtttttggaatcggcaacaacataccatcaacaggttcaagcctctgtgcaagaaaatttgaagaagcatgagctgacaagacctcttgcaaccaaagagcttgagtggtttgcggcatctgctctattggctctacctattattattttgttcagaatattttcagcaattttctgcaaaaagacaaagaagcgtgttcgacatactaacgcaacccaccatggtcgtcgtaagggcaaaagggggcacacagacaagtagactgcgtgtatttaggttttggtctcttaatgttgggaaatattagaggctaactggacgtgtgtttttacttttgaggggctctaggtgatcatgttgggtatggagctgtggtgtcgcaattggaagtatttaatcttctcttacctctcaaggtccctggttttaatattattattattttttggggagggtgtggaattagaaaaagttaagaaccctagtgacgctacaaggttgaaatcttgagattcctagttgtaggagttgtgtattttatttatgttagtgtaattttattttattttgtttttctttctactggattcacaaacgaaacaaatcagtctctgtttcagaaatcatcatatactttttgagacatccaaggggttttatactctttatcttg

SEQ ID NO: 7332 - DNA, 2375 bp, Gossypium raimondii
aatcattttcctcaatcaaaacagaccctaattttcggtgtggcaaatgaaaaaaaaaatcattttaaaaaaattgccacgtttgtctagactgacaacacatatagagcaaaagatttttcttttttcttttttaaattttatttttcagaatcaataattagatctcctccataaagattatcgatatcaaccttcaacaagaaacaactagaaaaattaagaaagaaaaacacacatccccattaataccgaggaagaggaagttgaaaacccttgggctgtcccttggtgggtgtttctttaggttttcttggtcgcgacgattttcagtggcttgtaaatggcagcgtataggctcctgattttctccctctttttggccctagttttcaccaagattggagccgatgcctcaactgaaccgctgcttgaatcggacgccgccgattcttctgctcttaagatggagttggatcaactgaagtctaagatccgtcttcttgaatcaaatgttgaggagaaaattcgagaattgaaaaccaaggatgagatgataaagcagaaagataaaattatagaagaaaaatctgacaccatggcatcgttgcactctgaattatcatctcttcagaaaaaaggaacctcagatgctgaggaacgggtgggaaaagctcatgcgaaagctcttgaattgcagaaacaggttgatagacttaaaactgaactagaagcaaaattgaaggaaaaagattatttggaatcccgtgcaactaaagctgagaacaagttgaatgaattgaatttgcagctagagaatcttcaaaagatcaataaggaacaggagaacaaactagcaaaaactgagcgagctctaaatattgcagaggaagaactgataaaggcaaagtttgatgccacttcaaaggcaaatgagttgatggaggttcacagcgcatggcttccaccttggcttgctacacagttaattcgtggtcaggccttcattcagacacattggaatcagcatggaaaaccaaacatggatatggtgatccagaaggctctagagaaaaaggccttagctaaaaagtgggctgaaccccacatggaagcaattaaaaccaaatgggttccagctgctaaggatcagtgggtggcggtaactacatatgctgaaccacatgtgcaatcgctcactgcaaaaactgttgaaatttatgaggtatcgaaggctacaataactcctcatattatcaaagttcaagaaacagttgatccttacttccaggaagccaagaagttcagtaagccatatattgatcaggttgctactttagcaaagcctcatgttgataaaatttctgtggtgatgaagccctatacaaaggaggtagttaaagcttatgggaggtttttggaatcggcaacaacataccatcaacaggttcaagcctctgtgcaagaaaatttgaagaagcatgagctgacaagacctcttgcaaccaaagagcttgagtggtttgcggcatctgctctattggctctacctattattattttgttcagaatattttcagcaattttctgcaaaaagacaaagaagcgtgttcgacatactaacgcaacccaccatggtcgtcgtaagggcaaaagggggcacacagacaagtagactgcgtgtatttaggttttggtctctgaatgttgggaaatattagaggctaactggacgtatgtttttactttttaggggctctaggtgatcatgttgggtagggagctgtggtgttgcaattggaagtatttaatcttctcttacctctcaaggtccctggttttaatattattattattttttggggagggtgtggaattagaaaaagttaagaaccctagtgacgctacaaggttgaaatcttgagattcctagttgtaggagttgtgtattttatttatgttagtgtaatttttttttttcttctggattcacaaacgaaacaactcagtctctgtttcagaaatcatcatactttttaagttgagacatccaaggggttttatactctatcttgtctttgtctccaaggattactgtttgtttattgcctactttagctagtctctggatgggatcccatgggagagcgttgcaatttcaactttccaccgactctatatgcatagacatagcccattctaatttctaagggattggcatgactagccaggccatctgcttcggcaagcttctgtattcaatagctgtttttgctatgatccattatccatgtttgaaagagtagtatcttgaactatataattaactaattataaaatttaaatataatatggtgagctagttgaaatttaat

SEQ ID NO: 7333 - DNA, 1128 bp, Gossypium raimondii
cctgacgctgaactgagcggaaggaaaggggaaaaaaaaaagacagcaagggaaacacgaatcacaagcgctgatgaacaatctggaagagtacaaagccgacaacccacaacatctacaacaagaagagatggcagcttccgcgggggcgatggatggcttggctgcatccgctctccgctccgttctccagagagtccaccagaccgccgagcggtgtggtcgtgagtcgcagcggatccgtgtggttgccgtcagtaaaaccaaacccgtctccgtcattcgccaagtgtacgacgctggccatcgctgtttcggtgaaaactatgtccaggaaatcgtcaaaaaagctcctcagcttccggatgacatagagtggcattttattgggaacttgcagagcaataaagtgaagcctttgattgctggtgtgccaaaccttgccatggtggaaactgtagatgatgagaagattgcaaatcatcttaatcgtgttgttggaagctttgaaagaaagcctttaaaagtattagtccaggtgaataccagtggcgaggaatcaaaatctggtgtagagccttcaggttgtgtggaacttgtaaaacatgttagtctgaattgtccgaaccttcaattttgtggactgatgacaatagggatgcctgattatacatcaacaccagagaatttcaagacattagcaaattgcagaagtgaggtctgcaaggctcttggaatacctgaagaacaatgtgaactatcaatgggaatgtctagtgattttgagctagctattgaaatgggcagtacgaatgtcagagttggatcaaccatctttggagcaagggaatatcccaagaaaaactgaaacaaagcttatgaagtagaggggcttaatctttagatcttcattgcgttgtttattaaaagagttgtaggcaaacacaatcctcggtctgttgttctcgtacgtgaagagaaagaaaaggtgaaaagatactgatctatcttatcatccatggaacttgtttattccatcaaaataatgctaataaatgtaatgatttgatcttatatttaattcttactgttccattggaaaattattaatataatatttggttcctg

SEQ ID NO: 7334 - DNA, 1349 bp, Gossypium raimondii
taacgacaattaacggctcagtgactaaaatattacaacacaataacataagtgactaaaacgtaacatttcaaacataagcgactgaaatgtaacctaaggtaaacaaaagtgaccatgagtgtagtttacccaaaacaaaataataaacgcaccgggttgtcccaaggctaaaacgcaacgtttggcttaatcctgacgctgaactgagcggaaggaaagggaaaaaaaaaaagacagcaagggaaacacgaatcacaagcgctgatgaacaatctggaagagtgcaaagcctacaacccacaacatctacaacaagaagagatggcagcttccgcgggggcgatggacggattggctgcatccgctctccgctccgttctccagagagtccaccagaccgccgagcggtgtggtcgtgaatcgcagcggatccatgtggtcgccgtcagtaaaaccaaacccgtctccgtcattcgccaagtgtacgacgctggtcatcgctgtttcggtgaaaactatgtccaggaaattgtcgaaaaagctcctcagcttccggatgacatagagtggcattttattgggaatttgcagagcaataaagtgaagcctttgattgctggtgtgccaaaccttgccatggtggaaactgtagatgatgagaagattgcaaatcatcttaatcatgttgttggaagctttgaaagaaagcctttaaaagtattagtccaggtgaataccagtggcgaggaatcaaaatctggtgtagagccttcaggttgtgtggaacttgtaaaacatgttagtctgaattgtccgaaccttcaattttgtggactgatgacaatagggatgcctgattatacatcaacaccagagaatttcaagacattagcaaattgcagaagtgaggtctgcaaggctcttggaatacctgaagaacaatgtgaactatcaatgggaatgtctagtgattttgagctagctattgaaatgggcagtacgaatgtcagagttggatcaaccatctttggagcaagggaatatcccaagaaaaactgaaacaaagcttatgaagtagaggggcttaatctttagatcttcagtgcgttgtttattaaaagagttgtaggcaaacacaatcctcggtctgttgttctcgtacgtgaagagaaagaaaaggtgaaaagatactgatctatcttatcatccatggaacttgtttattccatcaaaataatgctaataaatgtaatgatttgatcttatatttaattcttactgttccattggaaaattattaatataatatttggttcctgataatttttttaatttgatacctaagc

SEQ ID NO: 7335 - DNA, 1066 bp, Gossypium hirsutum
aacacgaatcacaagcgctgatgaacaatctggaagagtgcaaagcctacaacccacaacatctacaacaagaagagatggcagcttccgcgggggcgatggacggattggctgcatccgctctccgctccgttctccagagagtccaccagaccgccgagcggtgtggtcgtgaatcgcagcggatccatgtggtcgccgtcagtaaaaccaaacccgtctccgtcattcgccaagtgtacgacgctggtcatcgctgtttcggtgaaaactatgtccaggaaattgtcgaaaaagctcctcagcttccggatgacatagagtggcattttattgggaatttgcagagcaataaagtgaagcctttgattgctggtgtgccaaaccttgccatggtggaaactgtagatgatgagaagattgcaaatcatcttaatcatgttgttggaagctttgaaagaaagcctttaaaagtattagtccaggtgaataccagtggcgaggaatcaaaatctggtgtagagccttcaggttgtgtggaacttgtaaaacatgttagtctgaattgtccgaaccttcaattttgtggactgatgacaatagggatgcctgattatacatcaacaccagagaatttcaagacattagcaaattgcagaagtgaggtctgcaaggttcttggaatacctgaagaacaatgtgaactatcaatgggaatgtctagtgattttgagctagctattgaaatgggcagtacgaatgtcagagttggatcaaccatctttggagcaagggaatatcccaagaaaaaatgaaacaaagcttatgaagtagaggggcttaatccttagatcttcagtgcgttgtttattaaaagagttgtaggcaaacacaatcctcggtctgttattctcgtacgtgaggagaaagaaaaggtgaaaagatactgatctatcttataatccatggaacttgtttattccatcaaaattaatgctaataaaatgtaatgatttgatcttatatttaattcttactgttccattggaaaattattaatataata

SEQ ID NO: 7336 - DNA, 1027 bp, Euphorbia esula
  misc_feature (78)..(78): n is a, c, g, or t
  misc_feature (88)..(88): n is a, c, g, or t
  misc_feature (571)..(571): n is a, c, g, or t
ttttataccatctaatcccaattagcgacgagtgaacctcgactttgcgcatgaattgaaattgatgatgaacactcnagaagaagangccaacaccacagataatccaacacagcaatcggagatggcagctgcatccgccgctatggacggcgtagccgcgtcagctcttcggtcggtcctccagcgagtcaaccaggcagcggagcgagccggtcgaagttctcagcagatccgagtggtagcagttagcaagacgaaaccggtctctgttctccgtcaagtctatgacgccggtcatcggtgcttcggtgaaaattatgttcaagaactcatagagaaagctcctcagcttccggaggatatagaatggcattttattgggaatttgcagagcaataaagttaaacctttgctgaatggagttcctaaccttgcaatggtggagactgtagatgacgagaagattgccaaccatcttgatcgtgcaattgggaatttgggaaggaaacctttgaaggtcttaatccaagtcaataccagtggggaagaatcaaaatctggagtcganccctcgggctgtgtggaacttgcaaaacacgttcagagttgtgcaaaccttgaattttctggtctaatgacaataggaatgcttgactatacatcaactcctgaaaacttcaagacattagcaaactgcagaactgaagtttgcaaggcacttggtataccagaagaacaatgtgaactctcaatgggcatgtccggtgattttgagctagcgattgaaatgggaagcacgaatgtgagggtcggatctaccatatttggagctagagaatatccaaagaagaaatgaaacccgtctgttagcagcttcctactttcttctttcttcaagtagaaagaccctgggcgaatttcattagcattttcgagcaaagcatacttgaaatgttgctatttatttggcaggcagagaaactagacaattttgtacatagattgaacagttaaatattgttat

SEQ ID NO: 7337 - DNA, 1011 bp, Manihot esculenta
gctaagagaatgaacaatctggaagaccaagccaagatagataacgcaacagcacaacaggtggcgcaatctgacatggcagcagcatccgccgcgatggacggcgtggcagcagcggctctccgctccgtgctacagcgtgtccagcaggcagcggagcgggctgggcgcggctcccagcatatccgagtagtagccgtgagtaagaccaaaccggtgtctgtcatccgtcaagtctacgacgctggtcaccggtgtttcggcgaaaactacgtccaagaaatcgttgaaaaagctcctcagcttccggaggacatagagtggcatttcattgggaatttacagagcaataaagcgaaacctctacttgctggtgtaccaaaccttgcaatggtagaaagtgtagatgatgagaagattgccaatcatcttaatcgagcggttggaaatttgggcaggaaacgtttgaaggtcttaatccaagtgaataccagtggtgaagaatcaaaatctggagttgaaccttcagcgtgtgttgaacttgcaaaacatgtgaatcagaactgccccaaccttgagttttgtggcctaatgacaataggaatgcttgactattcatcaaccccagaaaacttcaagacattaacaaattgcagaagtgaggtttgcaaagcacttggtataccagaagaacaatgtgaactctcaatgggcatgtctaatgactttgagcaagctattgaaatgggaagtacgaatgtgaggattggatctactatatttgggcctagagaataccagaagaaatagaacaaggctgtcttttgcttgcttcattcacagggaagatcctgggtattatcaatctgtatttctgggaaacatctaccctgcattgttgatctgtaatgtccagaactgttttagaaggaaaattgaagagcaaaataataactccctttacttgaatgttcaatatatcattatcatacatgaaatgttcttgaattc

SEQ ID NO: 7338 - DNA, 778 bp, Euphorbia peplus
gatgaaccctctagaagaagaagccaacaccacagataatccaacacagcaatcggagatggcagctgcatccgccgctatggacggcgtagccgcgtcagctcttcggtcggtcctccagcgagtcaaccaggcagcggagcgagccggtcgaagttctcagcagatccgagtggtagcagttagcaagacgaaaccggtctctgttctccgtcaagtctatgacgccggtcatcggtgcttcggtgaaaattatgttcaagaactcatagagaaagctcctcagcttccggaggatatagaatggcattttattgggaatttgcagagcaataaagttaaacctttgctgaatggagttcctaaccttgcaatggtggagactgtagatgacgagaagattgccaaccatcttgatcgtgcaattgggaatttgggaaggaaacctttgaaggtcttaatccaagtcaataccagtggggaagaatcaaaatctggagtcgaaccctcgggctgtgtggaacttgcaaaacacgttcagagttgtgcaaaccttgaattttctggtctaatgacaataggaatgcttgactatacatcaactcctgaaaacttcaagacattagcaaactgcagaactgaagtttgcaaggcacttggtataccagaagaacaatgtgaactctcaatgggcatgtccggtgattttgagctagcgattgaaatgggaagcacgaatgtgagggtcggatctaccatatttggagctagagaatat

SEQ ID NO: 7339 - DNA, 1048 bp, Lippia dulcis
cagaggcagaggagagagatagagtggagttgggaaaggagtcgtcttcaactgcaccaatcggccaatcatcgaactcatcttcagcagcacaaatgacggcggcttccgccgcggagggcgttgctgcggcggctctgcgctcggtgcttcagcgggttcagcaggcggcggagcggtctggacgcacgtcggaccgaatccgggtggtggctgtgagcaagactaagccggtctccctcctccgccaagtgtacgacgctggacaccgcagcttcggcgagaattacgtccaggagatcgtggaaaaagctcctcagctgccggatgacatagaatggcatttcattgggaatctgcagagcaataaagtgaagccacttataagtggtgtaccaaatcttgccatggtggagaccatagatgatgggaagattgcgaatcatcttaaccgtgccattggaaatgctggaagaaaacctttgaaagtaatggtccaagtaaatacgagtggtgaagaatctaaatctggtgtagagccatctgcctgcgtggagcttgccaaacatgttagtatgaactgccctaaccttgaattctgtggcctaatgacaatagggatgccggattacacttccacccctgagaatttcaagacattagcaaagtgtagaagcgaggtttgtgaggcacttggcatagcagaagagcaatgtgaactatcaatgggcatgtctggagactttgaacttgctattgaaatgggcagtacaaatattagaattggatcaaccatatttggagcaagggagtacccgaagaaaaaatagaactaattagtttctacagtctgtttttagagaaatatatatcaaatgctgtagcgtgacatcaatatacaccttctcttgatctctgctgagatgagttagacttagcaatagcattcaggaacatgcaattctgaattttgaagttcaattcagttatttgtaactgttgtcagcttcaacacagcacgcgattccttaataaaaatactggattt

SEQ ID NO: 7340 - DNA, 1132 bp, Tropaeolum majus
gagacgataacgaaaccagtggaaaacaaaggggcacgaacacgaacacattaatgaacaatctggtagaagaaggagaaagagagaacataaatcaaaatctagaagccgaaggaggagacgtagctcaatctggaatggcggcctcatcagctgcgttggacggcgtagcagctgtggctctgcgatctgtactccaccgggttcatcaagtggctgagaaagcaggtcgcgtgcccgaacgaatccgggtcgtggccgtaagcaagacgaaacctgtttctattctccgccaagtttacgacgcgggtcatagatgtttcggtgaaaactacgtgcaagagattgtcgagaaagctcctcagctaccagacgatatcgagtggcattttattgggaatttgcagagcaataaagtgaaaactctacttgctggtgttcctaaccttgcaatggtagagactgtggatgatgagaagattgcaaaccatctggatcgtgctgttggaaaccatggaagacagcctttaaaggttttagtccaagttaatacaagtggagaagaatcaaaaaatggcgtggagccttcaggatgtgtggatctcgcaaaacatgtcggtctagcctgtccgaacctactgttttgtggcctgatgacaatagggatgctggattatacttcaacaccagaaaacttcaagacattagtgaactgcagaactgaggtttgcaaggctcttgggataccggaagagcaatgtgaactatcaatgggcatgtctggtgatttcgagcaagcgattgaaatgggcagtaccaatgtcagagttggatctaccatatttggtgctcgggagtatccgaagaaaaagtgagatcaggggttaatacattatttaagtagaaggaagtaattcatttttgcttcgtattggtcagtataaatcatatttacgtgaataaaaggttatgagtgaatgttctttcgcttgtccggcaattagaatgtgcacttcaaatgaaagatgataagttgatatgaattttgtaaaaatgtttacattaggtgtgatgcgcactcgattctataatacttgtgttattgcacattcttcgtgtttattatcgtgac

SEQ ID NO: 7341 - DNA, 1030 bp, Ipomoea nil
gagaaagaagagaaggaagattccccacagccgtcagcatcaggaaatggcctcttccgccgccatagacggcgtggcatctacggcgctgcgatcggttctgcagcgggtgcagcaggccggcgaacgctgcggccgccagtccgaccggattcgggtggtcgccgtgagcaagaccaagccagcctcccttatccgccaagtttacgactctggccaccgctgtttcggcgaaaattatgtccaagagctcgtcgacaaagctccacagcttccggaggatatagagtggcatttcatcggcaatttgcagagcaataaagtaaagccgcttctgactggtgtgccaaatcttgcaatggtggagactgttgatgatgagaagattgcaaatcagcttaatcgagtggttggaaacattggaaggaaaccattgaaggttttcgttcaagtgaatacaagtggagaagaaactaaatccggtgttgagccagctgcgtgtgtggaccttgtcaaacacattagttcaagctgcccgaatcttgaattcagtggcctgatgacaataggaatgcctgactatacttcgacccctgagaattttaagacattagcaaactgtagaagtgaggtatgcaaggcacttggaatagctgaagagcagtgtgagctgtcaatgggcatgtccggtgactttgaacttgcaattgaaatgggcagtacaaatgtcagagttggatctacaatatttggagctagggagtatccaaagaagcaatgaaactagctactaccagacactcgatgactcgaagaaccaaattcatcgccaataatgaaaattcactattcgacagagctttcttgacaggaggattcatagataatgaaaatttccttagcttctttgctgcacctaagaactgattgagacctccatttatgtaatggtttaccttcacctatagctctctggccaagcccgagtctataactatagctggaatgatgatattaactttttaatcat

SEQ ID NO: 7342 - DNA, 1199 bp, Citrus sinensis
aaaataatgacatggctgtgctcatttccacacggttttctgacatgtgtcagtgaaaatgagcgatactagaaaagcaacaacacaagtgaatgggtgatgaagaatcaggaacatgaagaagagcgcaagaggagagagaatcatatcaacgaacaagtagaagcagaaaccatggctgcgtctgccgccacagatggcgttgcagcgacggcgcttcggtccgtgatccaacgggtccaccaagccgccgagagatccagtcgcccgccggaccggattcgaatcgtcgctgtcagcaaaaccaaaccggtctcagtaatccgtcaggtttatgaggccggtcaccgatgtttcggtgaaaactacgttcaagaaatagtggaaaaggcggctcagcttccagatgatctagaatggcatttcattgggaacctgcagagcaataaagtgaaacctttattggctggtgtgcctaacctggcaatggtagaaagtgtggacaacgagaagattgcaggtcgtcttaatcgtatggttgaaaccatgggaaggaagcctttaaaagtcttggttcaagtgaataccagtggagaagaatcgaaatctggagttgagccttcagggtgtctggaacttgtgaaacatgttagtcaaaactgtccgaatcttgagttttgtggcctaatgacaattgggatgccagattacacatcgaccccggagaacttcaagacattagcaaaatgcagaagtgaggtatgcaaggctcttggaataccagaagagcaatgtgatctgtctatgggaatgtctggtgacttcgagcttgctattgaaatggggagcaccaatgtcaggattggatccacaatatttggtgcaagggaatatccgaagaagaactaaactttttttttcacctgttctgaaaacgttggctattgttatgtatttatcttaatgtactgaaactagagtatagtagattaatcatattttttatgcacttgttctttcgatgctgtagtatttcttttcactcttgaatgatgatttttgggggctatacttgttgatcccttcataatgatgggttattcatcagagcctaggattcttcttatattgcgctgatgggtccaaactacaaaaattgtatgtttatatctgaaatttttactcaaatttaacaggca

SEQ ID NO: 7343 - DNA, 2065 bp, Gossypium raimondii
tatggatgtaaaaaaaaaaaaaaatctttcgccattaaaacgaaacccaaaagaaaaaaaaaaaaaactgtaccttcttcccagttccccacccttgttaattattactaatatttctctctctcaatctcaaaaagccttttgatttcttcttaaaatctcttcttttctctctctttttctcagtctcccgttagacccggtctatccatctatatcttatttatccaacccatatttcatctcctctttttttttttttgggaaccaaatctatctttagggttttgattcaatcattcattgttctttcacaaaggaatgacgactactaaaaaaaacatgttacctcctggtttggttaacaatctccaggaagttcttcttagcagaaaaggcggaaactccaacaccaataacgatgaacaacaacaaaaacccgacgccgttactgattctactgagacatctacttctgcttctgatgaaaacgacaactccaagcctgtcgttttggttaccaacggtgaagggattgattcacttggccttgtttatctcgttcaagctttggtccgttctggcctctacaatgtccatgtttgcgcccctcaatcggacaaatctgtgtctagtcattccgtgactgtccgagaaacaattactgttactccggcagaaatcgatggtgccactgcttatgaagtttcagggactcctgtagattgtgtatccttagcattgtctggggcgttgttctcgtggtctaagcccctgctggtaattagtggaattaaccggggatcaagctgtggtcatcatatgttttactcgggtgttgtggctggagctagagaagcactagtttctggtgtaccatctttgtcaatatcactgaactggaagagggaagaaagccaagaaagtgattttaaggatgcggttgctgtttgtttacctttaataaccgcagccatcagagatatcgaaaagggtgttttccccaaaagttgctttctaagtatagaaattcctacttctccttcagcaaacaagggttttaaattgaccaagcaaagtatgtggagatccgcaccaaattggcttgctgtttcagctaatcggcatccttcttctgctgctcatttcatgtctaatcaacaaagccttgggctccaacttgcacagcttagccgagatgcatctgctgctggtgctgctcgccgcatatctgcgcaaaggcagaatgtggaagtagagtcggttggggctgttaaatccgatacaaataaagtgaaaaagtactttcgactggagtttataaataaagaacaggaagaagcagaagaggatttggatttcaaggcccttgacaacggatttgttgcagtaactcccttctcactttgtcctcaaattgaggtggacattcaaaccgctgcatcagattggatctccggtgcacttcaggtggagcaatagaaccctgggaaggccaacaaaaaaaatcttaaatcaatcaatttgtatacatccgcaggaggcattacatttagtcatcaattgagtgcttctattaatttccattgaaatgcttgttctgtattttccctgttcattttttcttctaggggttcccaaaatatcaataactcgggtgtttgtcttttgttctagctgtttgttgatacaaggaaatagcatggtctaaattaaatatgaccatggtctttctgcaaattcttcatgttgttgttgtgggggcttttcatgtaatatggtcttttgatttgtttcaaatttatgtgaatgtttctaggcctaaatgaatattgttgttcttcatattgctgttgttcataattagaggcataggcagtagtaaaaggctcaaaggccatataatatgggcccctaccacttcggcggagcattgatgacagcaatcaaagtatcagtcgccaagttggcctgcatctatatttgctatattagtgtcaacccactagcttctcacccaaatctgttttgtacccattttctttcaataaaaaaatatatggag

SEQ ID NO: 7344 - DNA, 2302 bp, Gossypium raimondii
aaggactaaaatgttaaatttgtaaaaggtatagggactggaagcagaattagacaaagttaaaactgcaacttaaaaggagagggattaacgctttacgactgacatgtatggatgtaaaaaaaaaaaaaaatctttcgccattaaaacgaaacccaaaagaaaaaaaaaaaaaactgtaccttcttcccagttccccacccttgttaattattactaatatttctctctctcaatctcaaaaagccttttgatttcttcttaaaatctcttcttttctctctctttttctcagtctcccgttagacccggtctatccatctatatcttatttatccaacccatatttcatctcctcttttttttttttggggaaccaaatctatctttagggttttgattcaatcattcattgttctttcacaaaggaatgacgactactaaaaaaaacatgttacctcctggtttggttaacaatctccaggaagttcttcttagcagaaaaggcggaaactccaacaccaataacgatgaacaacaacaaaaacccgacgccattactgattctactgagacatctacttctgcttctgatgaaaacgacaactccaagcctgtcgttttggttaccaacggtgaagggattgattcacttggccttgtttatctcgttcaagctttggtccgttctggcctctacaatgtccatgtttgcgcccctcaatcggacaaatctgtgtctagtcattccgtgactgtccgagaaacaattactgttactccggcagaaatcgatggtgccactgcttatgaagtttcagggactcctgtagattgtgtatccttagcattgtctggggcgttgttctcgtggtctaagcccctgctggtaattagtggaattaaccggggatcaagctgtggtcatcatatgttttactcgggtgttgtggctggagctagagaagcactagtttctggtgtaccatctttgtcaatatcactgaactggaagagggaagaaagccaagaaagtgattttaaggatgcggttgctgtttgtttacctttaataaccgcagccatcagagatatcgaaaagggtgttttccccaaaagttgctttctaagtatagaaattcctacttctccttcagcaaacaagggttttaaattgaccaagcaaagtatgtggagatccgcaccaaattggcttgctgtttcagctaatcggcatccttcttctgctgctcatttcatgtctaatcaacaaagccttgggctccaacttgcacagcttagccgagatgcatctgctgctggtgctgctcgccgcatatctgcgcaaaggcagaatgtggaagtagagtcggttggggctgttaaatccgatacaaataaagtgaaaaagtactttcgactggagtttataaataaagaacaggaagaagcagaagagtatttggatttcaaggcccttgacaacggatttgttgcagtaactcccttctcactttgtccacaaatcgaggtggacattcaaaccgccgcatcagattggatctccagtgcacttcaggtggagcaatagaaccctgggaagaccaacaaaaaaaatcttaaatcaatcaatttgtatacaaccgcaggaggcattacatttagtcatcaattgagtttgtgcttctattaatttccattgaaatgcttgttctgtattttccctgttcattttttcttctaggggttcccaaaatatcattaactcgggtgtctgtcttttgttctagctgtttgttgatacaaggaaatagcatggtctaaattaaatatgaccatgttctttctgcaaattcttcatgttgttgttgtgggggcttttcatgtaatatggtcttttgatttgttgcaaatttatgtgaatgtttctaggcctaaatgaatattgttgttcttcatattgctgttgttcataattagaggcataggcagtagtaaaaggctcaaaggccatataatatgggcccctaccacttcggccgagcattgatgacatcaatcaaagtatcagtcgccaagttggcctgcttctacatttgctatattagtgtcaacccactagcgtctcagccaaatctgttttgtacccattttctttcaataaaaaaatatatggagtgagtctattcttttattaaaaatttgagatattcctttgtataacaagtacttgatttattgtaaaaattttatagaagataatataaatcatggtgcatcagaagtaaaaaaaaaaaaaata

SEQ ID NO: 7345 - DNA, 1817 bp, Gossypium hirsutum
gggaaccaaatctatctttagggttttaattcaatcattcattgttatttcacaaaggaatgacgactgctaaaaaaaacatgttacctcctggtttggttaacaatctccaggaagttcttcttagcagaaaaggcggaaactccaacaccaataacgatgaacaacaacaaaaacccgacgccattactgattctactgagacatctacttctgcttctgatgaaaacgacaactccaagcctgtcgttttggttaccaacggtgaagggattgattcacttggccttgtttatcttgttcaagctttggtccgttctggcctctacaatgtccatgtttgcgcccctcaatcggacaaatctgtgtctggtcattccgtgactgtccgagaaacaattactgttactccggcagaaatcgatggtgccactgcttatgaagtttcagggactcctgtagattgtgtatccttagcattgtctggggcgttgttctcatggtctaagcccctgctggtaattagtggaattaaccggggatcaagctgtggtcatcacatgttttactcgggtgttgtggctggagctagagaagcactaatttctggtgtaccatctttgtcaatatcactgaactggaagagggaagaaagccaagaaagtgattttaaggatgcggttgctgtttgtttacctttaataaccgcagccatcagagatatcgaaaagggtgttttccccaaaagttgttttctaagtatagaaattcctacttctccttcagcaaacaagggttttaaattgaccaagcaaagtatgtggagatccgcaccaaattggcttgctgtttcagctaatcggcatccttcttctgctgctcatttcatgtctaatcaacaaagccttgggctccaacttgcacagcttagtcgagatgcatctgctgctggtgctgctcgccgcatatctgcgcaaaggcagaatgtggaagtagagtcggttggggctattaaatcagatacaaataaagtgaaaaagtactttcgactggagtttataaataaagaacaggaagaagcagaagagtatttggatttcaaggcccttgacaacggatttgttgcagtaactcccttctcactttgtccacaaatcgaggtggacattcaaaccgccgcatcagattggatctccagtgcacttcaggtggagcaatagaaccctgggaagaccaacaaaaaaaatcttaaatcaatcaatttgtatacaaccgcaggaggcattacatttagtcatcaattgagtttgtgcttctattaatttccattgaaatgcttgttctgtattttccctgttcattttttcttctaggggttcccaaaatatcattaactcgggtgtctgtcttttgttctagctgtttgttgatacaaggaaatagcatggtctaaattaaatatgaccatgttctttctgcaaattcttcatgttgttgttgtgggggcttttcatgtaatatggtcttttgatttgttgcaaatttatgtgaatgtttctaggcctaaatgaatattgttcttcttcatattgctgttgttcataattagaggcataggcagtagtaaaaggctcaaaggccatataatatgggcccctaccacttcggccgagcattgatgacatcaatcaaagtatcagtcgccaagttggcctgcttttacatttgctatattagtgtcaacccactagcgtctcagccaaatcagttttgtacccatttctttcaataaaaaaatatatggagtgagtctattc

SEQ ID NO: 7346 - DNA, 1616 bp, Theobroma cacao
ttatctctctcttttggctctcttgtttagggttttgattcaatcattcttaatgaaataaatatgacgactacttctgtgaagaagaacatgttacctcctggtttggttaacaatctgcaagaagttctccttagcagaaaaggaggaaacaacaacaatgaacaacaaaaggatgattctgctgctgattctactgagccatctacttctacttgtaatgaagacactgctgatagtaacgacagctccaagcctgtcgttttgcttaccaacggggaagggattgactcccttggccttgtttatctcgttcaagctttggtccgtttaggcctctacaatgtccatgtttgcgctcctcaatcggacaaatctgtttcgggtcattcagtaactctccgagaaacaattgctgttactccagcagaaattgatggcgccacagcttatgaagtatcagggactactgtggattgcgtctccttagccttgtctggggcactattctcatggtcaaagcctctactggtaattagtggaattaatcggggatcaagctgtggtcatcacatgttttactcaggtgttgtggctggcgctagagaagcattaatttgtggtgtaccctctttgtcaatatcactgaactggaagagggaagaaagccaagaaagtgattttaaggatgcagttgctgtttgtttacctttaatcaatgcagccatcagagatattgaaaagggtgttttccctaaaagttgctttctaagtatagaaatccctacttctccttcagcaaacaagggttttaaattgaccaagcaaagtttttggagatctgctccaagttggcaagctgtttcagctaatcggcatccttctgctgcacatttcatgtctaatcaacaaagccttggtatccaacttgcacagcttagccgagatgcatcagctgctggtgctgctcgccgcttgaccacacaaaggaagaacgtggagatagaatctgttggggctgctaaatctgataccaagaaagtgaaaaagtactttcgattggagtttgttgatagagaacaggaagatacagatgaggatttggatttcagggcactcgataacggatttgttgcagtaactcccctatcactttctccacaaattgagtcagacattcaaacggctgcatcagattggatctctagtgcgcttcatggggagcaatagaaccttgggtaccaacataaaatcttaatcagtcatttgtataaagccacaggagcgatatacatttagtcatcaattgagatctgctttgttatgatatttcttttttccctcctctttgttatgtatttccctttccattttttataaagggttctaaacaccatcaggtttggggttgtcttggtttcctctaggtcttgatacaaggaaatagccttggtctgaatgatatgaccatgtgctttccccaaattattgttgttgtttcttttttcctgaccacttttttcattttttgttctttggatttgtatgtaatttcttctttgatttcttagatggtgttcatgattattaatcaattttttcaatttacttttgtg

SEQ ID NO: 7347 - DNA, 2161 bp, Theobroma cacao
atgttatatatattatatatattttgtatggtgcagaattgctgtttgctctacaaatttaagctggaaacataacatgatttggtaccatgtttttaagaccaatctcgaactagttgtaaagtaaaagcagtgtcaggcaaagagaaagaaaaaggaaaaccagtgggaaaaaaaaaaaaccacatcctccatttagacaacagtgttccattccatcttccccctccccttcttaattattattcctctcgtatcaaaaagtcctctctctctctctctctgtcttcaaaagctttttcaccgtctctactactctctctctctctctctctttctcggtcttccggtagacccggtctatccaactctctctctctcttatttatctatccattccgattcctttttgcagcaaattttccttttctcatttattgttatctctctcttttggctctcttgtttagggttttgattcaatcattcttaatgaaataaatatgacgactacttctgtgaagaagaacatgttacctcctggtttggttaacaatctgcaagaagttctccttagcagaaaaggaggaaacaacaacaatgaacaacaaaaggatgattctgctgctgattctactgagccatctacttctacttgtaatgaagacactgctgatagtaacgacagctccaagcctgtcgttttgcttaccaacggggaagggattgactcccttggccttgtttatctcgttcaagctttggtccgtttaggcctctacaatgtccatgtttgcgctcctcaatcggacaaatctgtttcgggtcattcagtaactctccgagaaacaattgctgttactccagcagaaattgatggcgccacagcttatgaagtatcagggactactgtggattgcgtctccttagccttgtctggggcactattctcatggtcaaagcctctactggtaattagtggaattaatcggggatcaagctgtggtcatcacatgttttactcaggtgttgtggctggcgctagagaagcattaatttgtggtgtaccctctttgtcaatatcactgaactggaagagggaagaaagccaagaaagtgattttaaggatgcagttgctgtttgtttacctttaatcaatgcagccatcagagatattgaaaagggtgttttccctaaaagttgctttctaagtatagaaatccctacttctccttcagcaaacaagggttttaaattgaccaagcaaagtttttggagatctgctccaagttggcaagctgtttcagctaatcggcatccttctgctgcacatttcatgtctaatcaacaaagccttggtatccaacttgcacagcttagccgagatgcatcagctgctggtgctgctcgccgcttgaccacacaaaggaagaacgtggagatagaatctgttggggctgctaaatctgataccaagaaagtgaaaaagtactttcgattggagtttgttgatagagaacaggaagatacagatgaggatttggatttcagggcactcgataacggatttgttgcagtaactcccctatcactttctccacaaattgagtcagacattcaaacggctgcatcagattggatctctagtgcgcttcatggggagcaatagaaccttgggtaccaacataaaatcttaatcagtcatttgtataaagccacaggagcgatatacatttagtcatcaattgagatctgctttgttatgatatttcttttttccctcctctttgttatgtatttccctttccattttttataaagggttctaaacaccatcaggtttggggttgtcttggtttcctctaggtcttgatacaaggaaatagccttggtctgaatgatatgaccatgtgctttccccaaattattgttgttgtttcttttttcctgaccacttttttcattttttgttctttggatttgtatgtaatttcttctttgatttcttagatggtgttcatgattattaatcaattttttcaatttacttttgtggttgactaatcactgagcaatactatcataagccatcacatttactatgtttattgaattatttgggatgatttcaagtgtattgaattaaccttttaacaattg

SEQ ID NO: 7348 - DNA, 2964 bp, Gossypium raimondii
aattttccagtgaccagaacgaaaatcaaaagcagccatcatctttagatcagagacacaaaaaagggctttgacggttgttgaagaagaaattaaaaggtaaaaaaaagaaaagagctgctgttttttgactaagattgtgattgtcaaaattgatgctgaggatcaaacagattgtgtttttggttaacgagtgattttgcttgatcgagtgattgtttgctgttagaagacgaaggtgttactagtattatcaacgaattctatcgaaaatcgagtgctttattgacaagcagggttcggtttagatgcaaacgtctcagaaacaccaaactcgggtcaatatccacaggttgtatcaccaacctgttaaggatgttgatcaattttgtttgcctcatattcagatattagagaacaatgcatgttcggatatcggcagtcaaggacccagtgtgtcctatcaagcctacaatgaccagatttttactctggaatcatccacggcggctgctagtatcgttgcttatgattccccttctgctataagtgtctcgtcgagcaggagtcctttctctccacaaggttctcaatcgtggatgtctgatcctcatcattcccccgacaatacacatggatcaccgttcagtggatcttctgttgttgatgatagcaatggattgaagcacaagttacgagagctggaagtctcgttgttggggcctgaatcggatattatagacagctgcaattgttgctttactagtggagctcaccaagctgcttcaatggcaggcttgaaccacgagcaactggtggacatgattcctagattagacttgaaggaggtgcttattgcttgtggtcaagcgctttacgacaatgacaagtcgagagtggcaggtttaatgcatgtgttggagaaaatggtttctgtatctggggaaccactccaacgattgggtgcttatgttcttgaagggcttagagcaaggttggaatcatcggggagtaatatctacaaagccttaaaatgtcaagaaccgacaagctcggaactaatgtcttacatgcatattctctttcgaatctgcccgtactggaagtttgcatacacatcagctaatgctgtcatcaaggaagtcatggaatacgagcagagaattcatatcattgatttccaaatagcacagggtacccaatggatgtaccttattgcagctctttcaaaacgccctggtgggcctccatttatccgtgttactggtattgatgattctcagtcaaatcatgctcgaggtggcggacttagtattgtggggcagaagctatcggaatttgctaagtcgtacaaagtgccattcgagtttcatgatactagcgtgtctacttccgagattcaagtacagaatctcaacattcgtcctggggaagccctagccgtgaatttcccttatgtattgcatcacatgccggacgagagcgtaaccatctcgaaccacagagaccgattgttgagattggtgaagagtttgtcccccaaagtcgtcacccttgttgagcaagagtctaacaccaacacatccccctttttttctcggtacatcgagacactcaattattacacagctatgttcgaatccatagacgtagcttgtccaagagacgacaagcaaaggatcagtgcagaacagcattgcgtggctcgggatattgtgaatatgattgcttgtgaagggcaagaaagggtggaaagacacgaacttctcggaaaatggaggtcgagatttatgatggctggtttttctccatatccgttgagttctttggtcacatcagcggtacgagatatgttaaaagaatataacaacaactatagagttgtagagagagaagggtctctctatcttgggtggataaacagagccatggcaacctcttctgcatggaggtgaaaaaggaatggaggaatctgtaaattctacccaaataccctttttttttcttcttaattttatagcatcaacctttaggtgtgtgctgtaaatttatagaaaaatatgagcttagctttttgttggttttttaggcaaagggactgaattgcaaaaatctcagtgtacatttcttatgaaacagctttgagcagattttagtcactttgtggatattggctcacatcaatcagtgaatcaattcatatactattacctgtttttaataggaaatgacagtgacgaattttttttcggtattttctcaaaagactccctttctgtctctttttcaagtggttctctctgcgctgactcctccacagctctataatttcaagttggtcatggcacccatcagcagtatgggaaccggactcgggccacctcagttggatttggtgatgtttcacagcttccattgctttagactctagctctaaaggttgttgagctccgttggagtatggctctatccttacatggtcgtgcacggttttgcgggttcctcctcgatggcctaaaaccatgaacacggcatctcatagtcacttgttgaggcctgtagttgcggtcttgatctcctccttttccttccgtttttgtatggtcatggttttggactctatggttggttataggtaaacctaaagccttatgttggggttggaactatcgcaccacgatcgtagttgttcctagctttgagctgtatttgtcttgtcttgtattcggaacaacttttcctttttggggactatccctaagcgccattaggcgtttgtatggtttcctttcaatggaaacaacaaaaataaatgtcatctcatctagtaagtggtggagaagggccccaaatattgtgtttgtgtgttatgcgtggggagagatccattgtataaaacgaaaatagttttacactctttcgtatctctttatatgcacgggagagcaattttcggttaaaatc

SEQ ID NO: 7349 - DNA, 2903 bp, Gossypium hirsutum
agattgtgattgtcaaaattgatgctgaggatcaaacagattgtgtttttggttaacgagtgattttgcttgatcgagtgattgtttgctgttagaagacgaaggtgttactagtattatcaacgaattctatcgaaaatcgagcgctttattgataagtggggttcggtttagatgcaaacgtctcagaaacaccaaactcgggtcaatatccacaggttgtatcaccaacctgttaaggatgttgatcaattttgtttgcctcatattcagatattagagaacaatgcatgttcggatatcggcagtcaaggacccagtgtgtcctatcaagcctacaatgaccagatttttactctggaatcatccacggcggctgctagtatcgttgcttatgattccccttctgctataagtgtctcgtcgagcaggagtcctttctctccacaaggttctcaatcgtggatgtctgatcctcatcattcccccgacaatacacatggatcaccgttcagtggatcttctgttgttgatgatagcaatggattgaagcacaagttacgagagctggaagtctcgttgttggggcctgaatcggatattatagacagctgcaattgttgctttactagtggagctcaccaagctgcttcaatggcaggcttgaaccacgagcaactggtggacatgattcctagattagacttgaaggaggtgcttattgcttgtggtcaagcgctttacgacaatgacaagtcgagagtggcaggtttaatgcatgtgttggagaaaatggtttctgtatctggggaaccactccaacgattgggtgcttatgttcttgaagggcttagagcaaggttggaatcatcggggagtaatatctacaaagccttaaaatgtcaagaaccgacaagctcggaactaatgtcttacatgcatattctctttcgaatctgcccgtactggaagtttgcatacacatcagctaatgctgtcatcaaggaagtcatggaatacgagcagagaattcatatcattgatttccaaatagcacagggtacccaatggatgtaccttattgcagctctttcaaaacgccctggtgggcctccatttatccgtgttactggtattgatgattctcagtcaaatcatgctcgaggtggcggacttagtattgtggggcagaagctatcggaatttgctaagtcgtacaaagtgccattcgagtttcatgatactagcgtgtctacttccgagattcaagtacagaatctcaacattcgtcctggggaagccctagccgtgaatttcccttatgtattgcatcacatgccggacgagagcgtaaccatctcgaaccacagagaccgattgttgagattggtgaagagtttgtcccccaaagtcgtcacccttgttgagcaagagtctaacaccaacacatccccctttttttctcggtacatcgagacactcaattattacacagctatgttcgaatccatagacgtagcttgtccaagagacgacaagcaaaggatcagtgctgaacagcattgcgtggctcgggatattgtgaatatgattgcttgtgaagggcaagaaagggtggaaagacacgaacttctcggaaaatggaggtcgagatttatgatggctggtttttctccatatccgttgagttctttggtcacatcagcggtacgagatatgttaaaagaatataacaacaactatagagttgtagagagagaagggtctctctatcttgggtggataaacagagccatggcaacctcttctgcatggaggtgaaaaaggaatggaggaatctgtaaattctacccaaatacccttttttttcttcttaattttatagcatcaacctttaggtgtgtgctgtaaatttatagaaaaatatgagcttagctttgtgttggttttttaggcaaagggactgaattgcaaaaatctcagtgtacatttcttatgaaacagctttgagcagattttagtcactttgtggatattggctcacatcaatcagtgaatcaattcatatactattacctgtttttaataggaaatgacagtgacgaatttttttcggtattttctcaaaagactccctttctgtctctttttcaagtggttctctctgcgctgactcctccacagctctataatttcaagttggtcatggcacccatcagcagtatgggaaccggactcgggccacctcagttggatttggtgatgtttcacagcttccattgctttagactctagctctaaaggttgttgagctccgttggagtatggctctatccttacatggtcgtgcacggttttgcgggttcctcctcgatggcctaaaaccatgaacacggcatctcatagtcacttgttgaggcctgtagttgcggtcttgatctcctccttttccttccgtttttgtatggtcatggttttggactctatggttggttataggtaaacctaaagccttatgttggggttggaactatcgcaccacgatcgtagatgttcctagctatgagctgtatttgtcttgtcttgtattcggaacaacttttcctttttggggactatccctaagcgccattaggcgtttgtatggtttcctttcaatggaaacaacaaaaataaatgtcatctcatctagtaagtggtggagaagggccccaaatattgtgtttgtgtgttatgcgtggggagagatccattgtataaaacgaaaatagttttacactctttcgtatctctttatatgcacgggagagcaattttcggttaaaatcgagaaaatcgacttaatcgattttaatttggcggttttttcggttataaattcaatttagatagttatttcggtg

SEQ ID NO: 7350 - DNA, 3246 bp, Gossypium raimondii
gcacacggcggtccacacgttgtgagcgagtaaagatttttttgttttacgccctcttttagaattttcggagtggcattcgtgtaaatacaaaagattaccaagggcgtttattggtaaattcatcacactcacgactatatatataaaaataatacaggttccaccattaattttccagtgaccggaacgaaaatcaaaagcagccatcatctttagatcagagacacaaaaaagggctttgacggttgttgaagaagaaattaaaaggtaaaaaaaagaaaagagctgctgttttttgactaagattgtgattgtcaaaattgatgctgaggatcaaactgggttaattcattcatggagatttgcttaatctattctgtttttggttaacgagtgattttgcttgatcgagtgattgtttgctgttagaagacgaaggtgttactagtattatcaacgaattctatcgaaaatcgagtgctttattgacaagcagggttcggtttagatgcaaacgtctcagaaacaccaaactcgggtcaatatccacaggttgtatcaccaacctgttaaggatgttgatcaattttgtttgcctcatattcagatattagagaacaatgcatgttcggatatcggcagtcaaggacccagtgtgtcctatcaagcctacaatgaccagatttttactctggaatcatccacggcggctgctagtatcgttgcttatgattccccttctgctataagtgtctcgtcgagcaggagtcctttctctccacaaggttctcaatcgtggatgtctgatcctcatcattcccccgacaatacacatggatcaccgttcagtggatcttctgttgttgatgatagcaatggattgaagcacaagttacgagagctggaagtctcgttgttggggcctgaatcggatattatagacagctgcaattgttgctttactagtggagctcaccaagctgcttcaatggcaggcttgaaccacgagcaactggtggacatgattcctagattagacttgaaggaggtgcttattgcttgtggtcaagcgctttacgacaatgacaagtcgagagtggcaggtttaatgcatgtgttggagaaaatggtttctgtatctggggaaccactccaacgattgggtgcttatgttcttgaagggcttagagcaaggttggaatcatcggggagtaatatctacaaagccttaaaatgtcaagaaccgacaagctcggaactaatgtcttacatgcatattctctttcgaatctgcccgtactggaagtttgcatacacatcagctaatgctgtcatcaaggaagtcatggaatacgagcagagaattcatatcattgatttccaaatagcacagggtacccaatggatgtaccttattgcagctctttcaaaacgccctggtgggcctccatttatccgtgttactggtattgatgattctcagtcaaatcatgctcgaggtggcggacttagtattgtggggcagaagctatcggaatttgctaagtcgtacaaagtgccattcgagtttcatgatactagcgtgtctacttccgagattcaagtacagaatctcaacattcgtcctggggaagccctagccgtgaatttcccttatgtattgcatcacatgccggacgagagcgtaaccatctcgaaccacagagaccgattgttgagattggtgaagagtttgtcccccaaagtcgtcacccttgttgagcaagagtctaacaccaacacatccccctttttttctcggtacatcgagacactcaattattacacagctatgttcgaatccatagacgtagcttgtccaagagacgacaagcaaaggatcagtgcggaacagcattgcgtggctcgggatattgtgaatatgattgcttgtgaagggcaagaaagggtggaaagacacgaacttctcggaaaatggaggtcgagatttatgatggctggtttttctccatatccgttgagttctttggtcacatcagcggtacgagatatgttaaaagaatataacaacaactatagagttgtagagagagaagggtctctctatcttgggtggataaacagagccatggcaacctcttctgcatggaggtgaaaaaggaatggaggaatctgtaaattctacccaaataccctttttttttcttcttaattttatagcatcaacctttaggtgtgtgctgtaaatttatagaaaaatatgagcttagctttttgttggttttttaggcaaagggactgaattgcaaaaatctcagtgtacatttcttatgaaacagctttgagcagattttagtcactttgtggatattggctcacatcaatcagtgaatcaattcatatactattacctgtttttaataggaaatgacagtgacgaattttttttcggtattttctcaaaagactccctttctgtctctttttcaagtggttctctctgcgctgactcctcctcagctctataattttaagttggtcatggcacccatcagcagtatgggaaccggactcgggccacctcagttggatttggtgatgtttcacagcttccattgctttagactctagctctaaaggttgttgagctccgttggagtatggctctatccttacatggtcgtgcacggttttgcgggttcctcctcgatggcctaaaaccatgaacacggcatctcatagtcacttgttgaggcctgtagttgcggtcttgatctcctccttttccttccgtttttgtatggtcatggttttggactctatggttggttataggtaaacctaaagccttatgttggggttggaactatcgcaccacgatcgtagttgttcctagctttgagctgtatttgtcttgtcttgtattcggaacaacttttcctttttggggactatccctaagcgccattaggcgtttgtatggtttcctttcaatggaaacaacaaaaataaatgtcatctcatctagtaagtggtggagaagggccccaaatattgtgtttgtgtgttatgcgtggggagagatccattgtataaaacgaaaatagttttacactctttcgtatctctttatatgcacgggagagcaattttcggttaaaatcgagaaaatcgacttaatcgattttaatttggcggttttttcggttataaattcaatttagatagttatttcggtggatt

SEQ ID NO: 7351 - DNA, 2919 bp, Theobroma cacao
acgatgataataaataaagaaagccattatttttggagacagacgcacaaccggaggacgctcgttgaagaagaatcttcagagagcggaacccagacataggctggtgattgttgactaagattgtattcttctttgatatttcttccttgcacgactaaagcagttgatggtcagcatcgatgccaaggatcaaactatttttatcttcatacgaaggctagttggctgcttaaccattgtaatctcttgattgatgttgtgtagcttttccattggagagtaattttgctctatcaagcaactgctgctactagaagaaagagttaccattaccaaaagaattctgttgtcacagcaaacatctgtcagtaacaaaaagttttctggaggaggttgataagcggattgggctgagatgcaaacatctcagaaacaccaaacttcagcctgtatccgtaggctgtatcaccaacctgttcaggaaatggaggcactttgtttgcctcatattcagatattagacaacaatgtatgctcagatgttgggagccaaggaaccagtgtttcctttcaaacctacaaggatcaattttttaccctggaatcatccactgcaactgctggttttgttgtctatgattccccttctgctgtaagcatctcatcaagcaggagccctttctccccacaaggttctcaatcatacctatctgatcctcatcattcccctgacaatacttatggatcaccattcagtggatcttctgttgttgatgatggcaatgaatggaagcacaagctgagggagctggaaatttccttgttgggacctgaatcagatgtcatagacagctgcaattgctgcttcagtagtggagcccaccaagctgcttcaatggcaagctttaactgcaatcaactggtggaaatgatccctagattagacttgaaacaggttctcgttgcctgtggtcaagcacttcatgagggtgatatgccaacagtggcaggtttaatgcatgtcttggagaaaatggtttcagtgtctggggaaccaatccaacgattgggtgcttatgtgctggaagggcttagagcaaggttggaatcctcagggagtagtatctacaaagccctgaaatgcaaagaaccaacaagctcagaactaatgtcttacatgcatattctcttcaaggtctgtccgttctggaagtttgcatacacatcagctaatgttgtcatcagggaagtcatggaatatgaaccaaaaattcacatcattgatttccaaatagcacaaggaacccagtggatgttcctcatcgcagctcttgcaaaacgccctggtgggcccccggctatccgtataactggtattgatgattctcagtcaaatcatgctcgaggtgggggacttaatattgtggggcagaggctatcagaatttgctaagacgtacaatgtgccatttgagtttcatgatgctgccatgtctggttgtgaggttcaattagagcatcttaaggttcaacctggggaagctctagctgtgaattttccatatgtgttgcatcacatgccagatgagagtgtaagcacctggaatcacagagatcgactgttgaggttggtgaagagtttgttgcccaagattgtcactcttgtggagcaagagtccaataccaacacatccccattcttttcaaggtaccttgagacactggattattacacagctatgtttgaatccatagatgtagcttgttcgagagatgacaagcagaggatcaatgcagagcagcactgcgtggctcgcgatattgtgaatatgattgcttgcgaggggcctgagagggtggaaaggcatgaactttttggaaagtggaggtcaagattcaccatggctggtttttctccatatccattgagttcctcagttactatggctgtaagggatgtgttgaaggactacaacaacaattatagacttgaggagagagaaggggctctctatcttggctggataaacagagctatggccacctcttccgcgtggaggtgaaagcctgataccgacagtgatgccatgaaaaactgttaaattttgcgcaaaatgcttttgttaagatttctcttttagagcatgggcctttagggtgttgtaaattaatagaaatatgagcttagacttcttttgatagcttttagtcgagggacttgaattgcaaatattttcatgtatatcaccattgtccatctcgaaatgaaacaaggataggttccagttccaatgccagctcatttgttcttctactatcattttcacctctggacgctggttcacatcaatcactgaatcaatgtcccacatccaatcttaaaccaatgctttgcaacctcaagggagttgacctttaccttaccttaaaacatcacttacatcagctgtgagtcatcaaaatccaatcccaccttgtaagtttcctcgaatccctccaaaatggaagaaagagaaagtcattcggcaacttgtcaatcaaaattcaatccactcaaggaagctttgcggctatactttctatttaaatcagagataaccaagctaagaggagagaaattttaaaagaagatttgagcattaggagatacagtaagtggggaatctctttatttgttggaaaaaaaaattttattgaaaagctcccagcgaggatcgaactcgcgacctttcgcttacgaagcgaacgcactaccactatgctatggaagccggcgacctgcagttcccaatttctcttatccttttgctctaatcgggtcacttttcaaagttgacccattttgagaatttgaggaggaaggcccatcttgatagagatgaccacaattgaactagaatcaagtgacttaaatcac

SEQ ID NO: 7352 - DNA, 2768 bp, Theobroma cacao
acgatgataataaataaagaaagccattatttttggagacagacgcacaaccggaggacgctcgttgaagaagaatcttcagagagcggaacccagacataggctggtgattgttgactaagattgtattcttctttgatatttctgccttgcacgactaaagcagttgatggtcagcatcgatgccaaggatcaaactatttttatcttcatacgaaggctagttggctgcttaaccattgtaatctcttgattgatgttgtgtagcttttccattggagagtaattttgctctatcaagcaactgctgctactagaagaaagagttaccattaccaaaagaattctgttgtcacagcaaacatctgtcagtaacaaaaagttttctggaggaggttgataagcggattgggctgagatgcaaacatctcagaaacaccaaacttcagcctgtatccgtaggctgtatcaccaacctgttcaggaaatggaggcactttgtttgcctcatattcagatattagacaacaatgtatgctcagatgttgggagccaaggaaccagtgtttcctttcaaacctacaaggatcaattttttaccctggaatcatccactgcaactgctggttttgttgtctatgattccccttctgctgtaagcatctcatcaagcaggagccctttctccccacaaggttctcaatcatacctatctgatcctcatcattcccctgacaatacttatggatcaccattcagtggatcttctgttgttgatgatggcaatgaatggaagcacaagctgagggagctggaaatttccttgttgggacctgaatcagatgtcatagacagctgcaattgctgcttcagtagtggagcccaccaagctgcttcaatggcaagctttaactgcaatcaactggtggaaatgatccctagattagacttgaaacaggttctcgttgcctgtggtcaagcacttcatgagggtgatatgccaacagtggcaggtttaatgcatgtcttggagaaaatggtttcagtgtctggggaaccaatccaacgattgggtgcttatgtgctggaagggcttagagcaaggttggaatcctcagggagtagtatctacaaagccctgaaatgcaaagaaccaacaagctcagaactaatgtcttacatgcatattctcttcaaggtctgtccgttctggaagtttgcatacacatcagctaatgttgtcatcagggaagtcatggaatatgaaccaaaaattcacatcattgatttccaaatagcacaaggaacccagtggatgttcctcatcgcagctcttgcaaaacgccctggtgggcccccggctatccgtataactggtattgatgattctcagtcaaatcatgctcgaggtgggggacttaatattgtggggcagaggctatcagaatttgctaagacgtacaatgtgccatttgagtttcatgatgctgccatgtctggttgtgaggttcaattagagcatcttaaggttcaacctggggaagctctagctgtgaattttccatatgtgttgcatcacatgccagatgagagtgtaagcacctggaatcacagagatcgactgttgaggttggtgaagagtttgttgcccaagattgtcactcttgtggagcaagagtccaataccaacacatccccattcttttcaaggtaccttgagacactggattattacacagctatgtttgaatccatagatgtagcttgttcgagagatgacaagcagaggatcaatgcagagcagcactgcgtggctcgcgatattgtgaatatgattgcttgcgaggggcctgagagggtggaaaggcatgaactttttggaaagtggaggtcaagattcaccatggctggtttttctccatatccattgagttcctcagttactatggctgtaagggatgtgttgaaggactacaacaacaattatagacttgaggagagagaaggggctctctatcttggctggataaacagagctatggccacctcttccgcgtggaggtgaaagcctgataccgacagtgatgccatgaaaaactgttaaattttgcgcaaaatgcttttgttaagatttctcttttagagcatgggcctttagggtgttgtaaattaatagaaatatgagcttagacttcttttgatagcttttagtcgagggacttgaattgcaaatattttcatgtatatcaccattgtccatctcgaaatgaaacaaggataggttccagttccaatgccagctcatttgttcttctactatcattttcacctctggacgctggttcacatcaatcactgaatcaatgtcccacatccaatcttaaaccaatgctttgcaacctcaagggagttgacctttaccttaccttaaaacatcacttacatcagctgtgagtcatcaaaatccaatcccaccttgtaagtttcctcgaatccctccaaaatggaagaaagagaaagtcattcggcaacttgtcaatcaaaattcaatccactcaaggaagctttgcggctatactttctatttaaatcagagataaccaagctaagaggagagaaattttaaaagaagatttgagcattaggagatacagtaagtggggaatctctttatttgttggaaaaaaaaattttattgaaaagctcccagcgaggatcgaactcgcgacctttcgcttacgaagcgaacgcactaccactatgctatg

SEQ ID NO: 7353 - DNA, 1193 bp, Gossypium raimondii
gtaagtgatggaaggagttatttaacgagtcaaagacgtggcaaatgggattctgaaggtaaaaaggaaaaaaacttaggcaactcggtgaagaaattattgagatttgagatcaatcatcacatagatttcaaagattttcaatggcagccgaagaaggcaaaacggcagacgcacagtttttccacctcctttccaatctactccatcaggtagaagcattgactaaccaggaagaagttgaactgcgttcgaaaatcgaagcccttggattggaggttacaaaagttccttccaagtctacacacagccttgatgagctggaaatcgcgagagagttggacaagttatcggctaagttagacggtgtggatgagatgatatcctctgccatggcagcagacccgcaggtgcgatcccttttgagtggcactgccgatgtatggatgccggttattactgccaatgctgatgagcgacgcaatttggctgcatcaatcagtaccgataaccctcttggcaacaacgaagacgacaacaaacccgacaattgatgtttcaccggtcagtcacctcccccatactttgttctaatactaatttgttttcgggtttttggggatatgtcgtatgactagaatataccattgcattaatcgttttgttttgtctattggggaacagaaagtaagtttcttattctgttgtatccgtagttacattgggtctcattattttaaactcgaattgggttagacgcaagacggagaaagctcttataaagtgtttatttttacttattctctatccacaaaactcaaaaccgataccttgttttagaggcttcgaacttcgaaaacaatagtgttgctcatgttggaactaatggctgctcttcttcttcctcttgatgctgttgatgacgatgatgatgatgaccagcttcattggtttttttacctcatgggggagatgataatctgttagatatagagtaagggacttggtttattagtttaaattttattcctttctttttgttcctaattagtttaattaaggatcatcacacgttgctgctgatatataacctgggatatgttttctttttcgttatttaagatctagaaatatgaaaagggaaaatttttcccaagtccttatctcctaacctttttaacttttcctattaa

SEQ ID NO: 7354 - DNA, 1066 bp, Gossypium hirsutum
aaaaacttaggcaactcggtgaagaaattattgagatttgagatcaatcatcacatagatttcaaagattttcaatggcagccgaagaaggcaaaacggcagacgcacagtttttccacctcctttccaatctactccatcaggtagaagcattgactaaccaggaagaagttgaactgcgttcgaaaatcgaagcccttggattggaggttacaaaagttccttccaagtctacacacagccttgatgagctggaaatcgcgagagagttggacaagttatcggctaagttagacggtgtggatgagatgatatcctctgccatggcagcagacccgcaggtgcgatcccttttgagtggcactgccgatgtatggatgccggttattactgccaatgctgatgagcgacgcaatttggctgcatcaatcagtaccgataaccctcttggcaacaacgaagacgacaacaaacccgacaattgatgtttcaccggtcagtcacctcccccatactttgttctaatactaatttgttttcgggtttttggggatatgtcgtatgactagaatataccattgcattaattgttttgttttgtctattggggaacagaaagtaagtttcttattctgttgtatccgtagttaatttgggtctcattattttaaactcgaattgggttagacgcaagacggagaaagctcttataaagtgtttatttttacttattctctatccacaaaactcaaaatcgataccttgttttagaggcttcgaacttcgaaaacaatagtgttgctcatgttggaactaatggctgctcttcttcttcctcttgatgctgttgatgacgatgatgatgatgaccagcttcattggtttttttacctcatgggggagatgataatctgttagatatagagtaagggactttgtttattagtttaaattttattcctttctttttgttcctaattagtttaattaaggatcatcacacgttgttgctgatatataacctgggatatgttttctttttcgttatttaagatctagaaatatg

SEQ ID NO: 7355 - DNA, 1377 bp, Gossypium raimondii
agtaggagcgtatggggacactggcaggtgtaagtgatggaaggagtcatttaacgagtcaaagacgtggcaaatgggattctgaaggtaaaaaggaaaaaaccttaggcaactcggtgaagaaattattgagatttgagatcaatcatcacatagatttcaaagattttcaatggcagccgaagaaggcaaaacggcagacgcacagtttttccacctcctttccaatctactccatcaggtagaagcattgactaaccaggaagaagttgaactgcgttcgaaaatcgaagcccttggattggaggttacaaaagttccttccaagtctacacacagccttgatgagctggaaatcgcgagagagttggacaagttatcggctaagttagacggtgtggatgagatgatatcctctgccatggcagcagacccgcaggtgcgatcccttttgagtggcactgccgatgtatggatgccggttattactgccaatgctgatgagcgacgcaatttggctgcatcaatcagtaccgataaccctcttggcaacaacgaagacgacaacaaacccgacaattgatgtttcaccggtcagtcacctcccccatactttgttctaatactaatttgttttcgggtttttggggatatgtcgtatgactagaatataccattgcattaatcgttttgttttgtctattggggaacagaaagtaagtttcttattctgttgtatccgtagttacattgggtctcattattttaaactcgaattgggttagacgcaagacggagaaagctcttataaagtgtttatttttacttattctctatccacaaaactcaaaaccgataccttgttttagaggcttcgaacttcgaaaacaatagtgttgctcatgttggaactaatggctgctcttcttcttcctcttgatgctgttgatgacgatgatgatgatgaccagcttcattggtttttttacctcatgggggagatgataatctgttagatatagagtaagggactttgtttattagtttaaattttattcctttctttttgttcctaattagtttaattaaggatcatcacacgttgctgctgatatataacctgggatatgttttctttttcgttatttaagatctagaaatatgaaaagggaaaatttttcccaagtccttatctcctaacctttttaacttttcctattaatcatgtcacgtgtctctcatccaatgggcctgtgccaaaatctgacacattttaacgcggtcaggtggggtaccaaaatatagaaagtacaggtaccaaaacaaacaaattgaaagtagaagtactacattgacaattttgttaaaatacagggg

SEQ ID NO: 7356 - DNA, 1963 bp, Cicer arietinum
cgatgattgaagcacacgtaaaccatggttaaagaatggaccatccttaaccgcacactgaagttaagaaaatatccaaatcaagcgaccgaccagaacacgtgtacggtaagatttcgttacaaccgcctcaaggattgttagaaaattagggttcgtttgtgagataggaatccttatcgttacttttcacctgaaactcgccgctttttctatcgaaatccctttgatttttggtgtgcaatcatggaaatggaacgcatcgtcgaattctctcgcacttacatggatcgccccccaaggaagagggcgcggttgggctgggacatcgttgaggtcccaaaggctcaggtaggattattttgtgcacaagaggttgagaatatttcaagctatgctccttcagaacatatctctagttctctatttaagggagttgctcgaaatggttctcccccatggcgagatgacgacaaagatggccattacatgtttgagcttggagataatttaacttctcgctataagatccacggcaaaatgggcgaaggaacttttggacaggtattggagtgttgggacagagaaaggaaggaaatggttgccataaaagttgttcgtgctataaagaagtatcgagaggcagccatgattgaaattgagatgctgcagcaacttgggaaacatgataaagggggcaatcgttgtgtgcaaatacggaactggtttgactatcgtaatcatatatgtattgtgtttgagaaacttggaccaagcttatacgattttcttcggaaaaacaattatcgttcatttcccattgatcttgttcgcgagattggaagacaactattggaatgtatagcattcatgcatgacttacacatgatccacactgatctgaaaccggaaaacatacttctggtttcatccgagtatcttaaaatccctgactacaagagctcatccagattaccatgctcctttttcaagagagtgcctaagtcaagtgccataaaggttatcgattttggcagcactacttatgaacgggaaaaccagaactacattgtatcaacacgtcattaccgggcacctgaagttatccttggacttgggtggagctatccatgtgatatatggagtgtgggatgtatattagtcgagttgtgcactggggaagctttgtttcagactcacgaaaatttagagcatcttgccatgatggagagggttcttggtccattaccgcagcagatgttgaagaaagttgaccgacatgctgagaagtatgtccgaagggggagattggactggccagaaggtgcaacttcaagggagagtattaaagctgtaatgaagcttcctcgactgcagaaccttataatgcagcatgtcgatcattcagctggagatcttatacatcttttgcagggtctacttagatatgacccctttgaaagacttacagctagggacgccttaagacattcattctttatgagagatcaccttaggagatgattatccatttttagagatctagtgtccaagttgaatctgtcaaaagtgaaaatatgggtgcgtggaggaggaacgcttgtaattaatatgtgggtttagttgataagggaggatggttatacagcatcactttcccctccaagcatgtttgacccaatacttatttatttttaaaatttattgaacatgtattcttacaaacccgtaatctgcgggtaatgtacaaaacaaatgtagtgtttttaaggcattatccataattaaggggtggacagaaacacctaatctgacccgaaatcaaaaaaccagaaccgaccgaccatacttcaatatgtagaaaaaaatagtattaaaatactgaacgatttaagcctccatcttaattaattgtctaaagttggaattggaaggaagttttaaaaatagtagtatctatgtg

SEQ ID NO: 7357 - DNA, 2080 bp, Glycine max
ttagaattagggttctctatctgcaaagcaaaccttatcttttcacctgaaacttgcttttgttcccgattttctcaaattgctttcggttttcgttctgattctgcaaaatcatggagatggagcgcatcgttgaattccctcacacctacatggatcgacccccaagaaagagagcgcgtttgggctgggacatcgctgaggcccccaaggctcaggtaggattgttttgtggacaagaggttgagaatatttcaagctatgctccttcagaacatccccctagttctctgtttaagggagttgcccgaaatggttctcccccatggcgagatgatgacaaagatggccattacatgtttgagcttggagataatttaacttctcgctataagatccatagtaaaatgggcgaaggaacttttgggcaggtcttggagtgctgggacagagaaaggaaggaaatggttgccataaaaattgtccgtgggataaagaagtatcgagaggcagccatgatagaaattgaggtattgcaacagcttgggaaacacgataaaggtagcaatcgttgtgtgcaaatacggaactggtttgactatcgtaatcatatctgtattgtgtttgagaaacttggaccaagcttatacgattttcttcggaaaaacagttatcgttcatttcccattgatcttgtccgtgagattggctggcaactgttggaatgtgtagcatttatgcatgatttacgcatgatccatactgacctgaagcctgaaaacatacttctagtttcaccagagtatcttaagattcctgactacaagagtacaaccagatcaccaagctcctttttcaagagagtgcccaagtcaagtgctataaaagttattgattttggcagcactacatatgaacgagaagatcagacttacattgtgtcaactcgtcattatagggcacctgaagttatccttggacttgggtggagctatccatgtgatatatggagtgtgggctgtatattggttgaattatgcactggtgaagctttgtttcagactcatgaaaatttagagcatctggctatgatggagagggtgcttggtcctataccacagcagatgttaaagagagttgaccgacatgcagagaagtatgttcgaaggggtaggttggactggccagagggtgcaatctcacgagagagtattaaagctgttatgaagcttccccgactacagaaccttataatgcagcatgttgatcattcagctggagatcttatacatcttttgcaggggctacttagatatgacccctttgaaagacttacagctagggatgctttgaggcattccttctttatgagagatcatcttaggagatgatttttatgtgtttgtaaacgattggtctgcttttaggtgaaagatcactcgagggcaaatatggctgtaaggagcctatgtgccaatgtaaataaatatttaaatttaggcttgtgtgacaagtgaggatggttattcagcagcatttacacctcaacctcaaagcctgtgtttcaaacgttttattaaaaaataataattgtagatgttactaatccgttatccggtaaaaaaaaaaccgatatcccaactcgtgcggaatgaatgtagttcatgtgaaaattggtggaattatccaccaatgtgcaagatgggccccacccataagataggaaaacacttgaaaaacacttgcttgttaaacgttgctgtcaaattctcatgctttggacgttgctgtcaaatgtgttaagttaatgaatttcttcgctttaaacatcttgctagttaaaaattcgttggaacttttgtacgaaactgcaactctttcaatatgttgttgagaatgaagtgagctacagcaattagatgtcgagtgggctacttaaaagtgtacaactaaggagagactacatggctgcttctctttcggcgaccttgtctattttatttggtgataccagacaatcgttgagttgactcaagcttcttgtaaaatattagttggaatcacaaatatttgataattt

SEQ ID NO: 7358 - DNA, 2316 bp, Glycine max
tacaacaatcataccaagcaaggagcgacgctaagaggacacgtgtacggccacatttcctctcatcagattaaagggtggttagaattagggttctctatctgcaagcaaaccttatcttttcacctgaaacttgcttttgttcccgattttctcaaattgctttcggttttcgttctgattctgcaaaatcatggagatggagcgcatcgttgaattccctcacacctacatggatcgacccccaagaaagagagcgcgtttgggctgggacatcgctgaggcccccaaggctcaggtaggattgttttgtggacaagaggttgagaatatttcaagctatgctccttcagaacatccccctagttctctgtttaagggagttgcccgaaatggttctcccccatggcgagatgatgacaaagatggccattacatgtttgagcttggagataatttaacttctcgctataagatccatagtaaaatgggcgaaggaacttttgggcaggtcttggagtgctgggacagagaaaggaaggaaatggttgccataaaaattgtccgtgggataaagaagtatcgagaggcagccatgatagaaattgaggtattgcaacagcttgggaaacacgataaaggtagcaatcgttgtgtgcaaatacggaactggtttgactatcgtaatcatatctgtattgtgtttgagaaacttggaccaagcttatacgattttcttcggaaaaacagttatcgttcatttcccattgatcttgtccgtgagattggctggcaactgttggaatgtgtagcatttatgcatgatttacgcatgatccatactgacctgaagcctgaaaacatacttctagtttcaccagagtatcttaagattcctgactacaagagtacaaccagatcaccaagctcctttttcaagagagtgcccaagtcaagtgctataaaagttattgattttggcagcactacatatgaacgagaagatcagacttacattgtgtcaactcgtcattatagggcacctgaagttatccttggacttgggtggagctatccatgtgatatatggagtgtgggctgtatattggttgaattatgcactggtgaagctttgtttcagactcatgaaaatttagagcatctggctatgatggagagggtgcttggtcctataccacagcagatgttaaagagagttgaccgacatgcagagaagtatgttcgaaggggtaggttggactggccagagggtgcaatctcacgagagagtattaaagctgttatgaagcttccccgactacagaaccttataatgcagcatgttgatcattcagctggagatcttatacatcttttgcaggggctacttagatatgacccctttgaaagacttacagctagggatgctttgaggcattccttctttatgagagatcatcttaggagatgatttttatgtgtttgtaaacgattggtctgcttttaggtgaaagatcactcgagggcaaatatggctgtaaggagcctatgtgccaatgtaaataaatatttaaatttaggcttgtgtgacaagtgaggatggttattcagcagcatttacacctcaacctcaaagcctgtgtttcaaacgttttattaaaaaataataattgtagatgttactaatccgttatccggtaaaaaaaaaaccgatatcccaactcgtgcggaatgaatgtagttcatgtgaaaattggtggaattatccaccaatgtgcaagatgggccccacccataagataggaaaacacttgaaaaacacttgcttgttaaacgttgctgtcaaattctcatgctttggacgttgctgtcaaatgtgttaagttaatgaatttcttcgctttaaacatcttgctagttaaaaattcgttggaacttttgtacgaaactgcaactctttcaatatgttgttgagaatgaagtgagctacagcaattagatgtcgagtgggctacttaaaagtgtacaactaaggagagactacatggctgcttctctttcggcgaccttgtctattttatttggtgataccagacaatcgttgagttgactcaagcttcttgtaaaatattagttggaatcacaaatatttgataatttattgaaaatgaccattactatactaattactaatgtatgggcaatctacagggatctcttgtaagaaaagccattgttagttatatgctgccaatgttataaaattcaagttaggtgagttggtgtgattagtgaatcagcccgctaatcggtgtg

SEQ ID NO: 7359 - DNA, 1779 bp, Cajanus cajan
ttagggttctctctgtgcaaagcaaaccttatcttttcacctgaaactcgctcccttgtactcgtacccttttttctcaatttccatttggttttcgttccgattctgcaatatcatggagatggaacgcatcgttgaattccctcacacctacatggatcggcccccgagaaagagggcgcgtttgggttgggacattgctgaggctcctaaggctcaggtaggattgttttgtggacaagaggttgagaatatttcaagctttgctccttcagaacatcccactagttctctgtttaagggagttgctcgaaatggttctcccccatggcgagacgatgacaaggatggacattacatgtttgagcttggagataatttaacttctcgctataagatccatagcaaaatgggggaaggaacttttgggcaggtcttggagtgctgggacagagaaaggaaggaaatggttgccataaaaattgtccgtgggataaagaagtatcgagaggcagccatgatagaaattgaggtactgcaacaactggggaaacacgataaaggtagcaatcgttgtgtgcaaatacggaactggtttgactatcgtaatcatatctgtattgtgtttgagaaacttggaccaagcttatacgattttcttcggaaaaacagttatcgatcatttcccattgatcttgtccgtgagattggctggcaactattggaatgtgtagcatttatgcatgacctgcgcatgatccatactgacctcaagcctgaaaacatacttctagtttcaccagagtatctgaaaattcctgattacaagagtacttccaaatcaccaagttcctttttcaagagagtgcccaagtctagtgctataaaggttattgattttggcagcactacatatgaacgagaagatcagacttacattgtatcaactcgtcattatagggcacctgaagttatccttggacttgggtggagctatccatgtgatatatggagtgtgggttgtatattagttgagttgtgcacaggtgaagctttgtttcagactcacgaaaatttagagcatctggctatgatggagagggtgcttggtcctataccgcagcagatgctaaagagagtcgaccgacatgcagagaagtatgtccggaggggtagattggattggccagagggtgcaacctcccgagagagtattaaagcagtaatgaagcttccccgactacagaatcttataatgcagcatgttgatcattcagctggagatcttatacatcttttgcaaggactacttagatatgacccttttgagagacttacagctagggatgctctgcgacattccttctttacgagagatcatcttaggagatgattttcagatgtctagtaaacgatgggtctgtttttaagtcatagatcactgagggcaaatatggctgcaatgaagcctttgtcctatgtaaataaaaatatttataccttaggcttttgtgactagtgaggatgggttattcagcaccaagcagcagttacaccgaaaagcctgtatgtcttcatcttcaattattaaaaaaataataatcgaagatgttcttgctatccctatatcttgacagaaattaaaaaacatgtatttaacccgataactggaatttcggtcaaaacgcagttagaattgtaagttgctggaactatacacaaatatgcctatagttgatttggaagttgttggaattacacaaacatgcttatagtgga

SEQ ID NO: 7360 - DNA, 1773 bp, Glycine max
aaacaaggagcgacgctaagaggacacgtgtacggccatatttcctctcatcagattgaagggtggttagaattagggttctctatctgcaaagcaaaccttatcttttcacctgaaacttgcttttgttcccaattttctcaaattgctttcggttttcgttctgattctgcaaaatcatggagatggagcgcatcgttgaattccctcacacatacatggatcgacccccgagaaagagagcgcgtttgggctgggacatcgctgaggtccccaaggctcaggtaggattgttttgtggacaagaggttgagaatatttcaagctttgctccttcagaacatccccctagttctctgtttaagggagttgctcgaaatggttctcccccatggcgagacgatgacaaagatggccattacatgtttgagcttggagataatttaacttctcgctataagattcatggcaaaatgggcgaaggaacttttgggcaggtcttggagtgctgggacagagaaaggaaggaaatggtcgccataaaaattgttcgtgggataaagaaatatcgagaggcagccatggtagaaattgaggtactgcaacagcttgggaaacacgataaaggtagcaatcgttgtgtgcaaatacggaactggtttgactatcgtaatcatatctgtattgtgtttgagaaacttggaccaagcttatacgattttcttcggaaaaacagttatcgttcatttcccattgatcttgtccgtgagattggctggcaactattggaatgtgtagcatttatgcatgacttacacatgatccatactgacctgaagccggaaaacatacttctagtttcaccagagtatcttaaaattccagattacaagagtacaaccagatcaccaagttcctttttcaagagagtgcccaagtcaagtgctataaaagttattgattttggcagcactacatatgaacgagaagatcagacatacattgtgtcaacacgtcattatagggcacctgaagttatcctcggacttgggtggagctatccatgtgatatatggagtgtgggttgtatactggttgaattatgcactggtgaagctttgtttcagactcatgaaaatttagagcatctggccatgatggagagggtgcttggtcctataccacagcagatgttaaagagagttgaccgacatgcagagaagtatgtccgaaggggtagattggactggccagagggtgcagcctcacgagagagtattaaagctgtaatgaagcttccccgactacagaacattataatgcagcatgttgatcattcagctggagatcttatacatcttttgcaggggctacttagatatgacccctttgaaagacttacagctagggatgctttgaggcattccttctttactagagatcaacttaggagatgattttcatgtatttgtaaacgattggtctgtttttaagtttaaagatcattcgagggcaaatatggctgtaaggaagcctatgtgccatgtaaataaatatttgaatatcttgggctaaactaaagcaagtgaggatggttattcagcagcagttacacctcaaagcctgtatctcaaacgttttcttaaaaaaaataaaataattgtagatgttcttttactaatctgatgtccggtggaaacaaaccccgatattacaactcatgcagaattaatgtaggaattttaagtcgaaattggtggaattatctacaaa

SEQ ID NO: 7361 - DNA, 1720 bp, Glycine max
atcagattgaagggtggttagaattagggttctctatctgcaaagcaaaccttatcttttcacctgaaacttgcttttgttcccaattttctcaaattgctttcggttttcgttctgattctgcaaaatcatggagatggagcgcatcgttgaattccctcacacatacatggatcgacccccgagaaagagagcgcgtttgggctgggacatcgctgaggtccccaaggctcaggtaggattgttttgtggacaagaggttgagaatatttcaagctttgctccttcagaacatccccctagttctctgtttaagggagttgctcgaaatggttctcccccatggcgagacgatgacaaagatggccattacatgtttgagcttggagataatttaacttctcgctataagattcatggcaaaatgggcgaaggaacttttgggcaggtcttggagtgctgggacagagaaaggaaggaaatggtcgccataaaaattgttcgtgggataaagaaatatcgagaggcagccatggtagaaattgaggtactgcaacagcttgggaaacacgataaaggtagcaatcgttgtgtgcaaatacggaactggtttgactatcgtaatcatatctgtattgtgtttgagaaacttggaccaagcttatacgattttcttcggaaaaacagttatcgttcatttcccattgatcttgtccgtgagattggctggcaactattggaatgtgtagcatttatgcatgacttacacatgatccatactgacctgaagccggaaaacatacttctagtttcaccagagtatcttaaaattccagattacaagagtacaaccagatcaccaagttcctttttcaagagagtgcccaagtcaagtgctataaaagttattgattttggcagcactacatatgaacgagaagatcagacatacattgtgtcaacacgtcattatagggcacctgaagttatcctcggacttgggtggagctatccatgtgatatatggagtgtgggttgtatactggttgaattatgcactggtgaagctttgtttcagactcatgaaaatttagagcatctggccatgatggagagggtgcttggtcctataccacagcagatgttaaagagagttgaccgacatgcagagaagtatgtccgaaggggtagattggactggccagagggtgcagcctcacgagagagtattaaagctgtaatgaagcttccccgactacagaacattataatgcagcatgttgatcattcagctggagatcttatacatcttttgcaggggctacttagatatgacccctttgaaagacttacagctagggatgctttgaggcattccttctttactagagatcaacttaggagatgattttcatgtatttgtaaacgattggtctgtttttaagtttaaagatcattcgagggcaaatatggctgtaaggaagcctatgtgccatgtaaataaatatttgaatatcttgggctaaactaaagcaagtgaggatggttattcagcagcagttacacctcaaagcctgtatctcaaacgttttcttaaaaaaaataaaataattgtagatgttcttttactaatctgatgtccggtggaaacaaaccccgatattacaactcatgcagaattaatgtaggaattttaagtcgaaattggtggaattatcta

SEQ ID NO: 7362 - DNA, 3520 bp, Glycine max
taacatcgagattagggttcctgaagctgaggcactatcttcccaaaagaatacaaatctctttgaagttttcgtagttctctgaatcatggagatggaacgcgtcttcgaatttcctcacacttacatggatcgtcgcccgagaaagagagcgagattgggctgggacatccctgaagttcccaaggctcaggtaggattgttttgtggacaagatgttgggactatttcaagctttgctccttcaaggggtccctcagaacataccactagttctctatttgttaagccagttgctcgaaatggttctcccccttggcgagatgatgacaaagatgggcattacatgtttacgcttggagaaaatttaacttctcgctataagatccataccaaaatgggtgaaggaacttttgggcaggtcttagaatgctgggatagagaaaggaaggaaatggttgccgtaaaaattgtccgtggtataaagaagtatcgagaagcagccatgatagaaattgaggtgttgcaacagcttggtaaacatgataaaggaggcaatcgttgtgtgcaaatacggaactggtttgactatcgtaatcatatctgtattgtgtttgagaaacttggaccaagcttatacgattttcttcggaaaaacaattatcgctcatttcccattgatcttgtccgtgagattggcaaacaactattggaatgtatagcattcatgcatgatttgcgcatgattcatactgacctgaagcctgaaaacatactactagtttcacccgagtatgtcaaagttcctgactacaagagttcatctagatcatcatgttcctatttcaagagagttcccaaatcaagtgctataaaggttattgattttggcagcaccacttatgagcgagaagatcagaactacattgtatcaactcgtcattatagggctcctgaagttatccttggacttggctggagctatccatgtgatatatggagtgtgggatgtatattggttgaattatgcacaggtgaagctttgtttcagactcatgaaaatttagagcatcttgcaatgatggaaagggtacttggttcattaccacagaccatgatgaagagagtcgaccgacatgctgagaagtatgttagaaggggtagattagactggcctgagggtgcaacctcgagggagagtatcaaagctgtaatgaagcttcctaggcttcagaaccttgtaatgcagcatgtagatcattcagctggcgatctcatacatctcttgcaggggttacttagatatgacccctctgaaagacttacagccaaggaagctcttagacattccttctttatgagagaacactttagaagatgattcactttcttaactgctgcatcattgaccttcctaaggatttgaagatgtgggcaaatgaactcacctgtgtgatggctagtttttctgcagctgtcctctccccaatgctatgctgaaaaatccttatgtaggaatttttgaatggatctggattcgatgtacagaagaaaaaaaaaatgctaatgttatggtgaaaattgtagattttacgggcatgattcatatggcatcctgagctttgtgtgcacgagtataagtctccattcgagtgtaccgcacacacatgatatattagacacgattgacaagtcacgggaagcttctattcatagcagagatatggcagcgacgcaagagcgggaagcttccatgatgaggcaatgtatttagcagacctcagctgttgctataatgggggaggcatcgcagcaatatgatgcgataatagcacaaaaccaatcataactaataagaaaagaatatcaaatctttggcattgcatttggtgaatatgggagaaagttgagactaatttagttcgcaggtggacagtgttgacaaaataagttatagtctgacctcgggctgcaaaatagagaggtcttttaaaccttttttgcctcttagcaactggtcaacttcatgagtatcaacaagataaggtccttaataattttgtgctgcaaaatggagattgggattttcaaagctttgataattgtcttctcattctagtttgcaaccaaatccatggagattgggattttcaaagctttgataattgtcttctcattctagtttgcaaccaaatccaagctatggtgctttcctctctgttacttgatgaagatcgtttggcttggagatgatcaaatgatgggatcccaactatatatgatcgagaaattgctcgttcaactcttaccaactataaagaaggagcaatttctcgatcatatatacctggagtggtcccaatgatgaaattgttgctttggaaaattgctaaaatctcccaatgatgaatcgtgccctatatgctaatgtactgtggaagaacttcaattcgtgctataatatatggcatgctggccaaagaagtgtgaacctcactccttgagaataattcagatgctgacattttcgtgaatcttatggacctttggttacaatcaaatttattgaaggatagtcagtggagtttaattttgggattaacatctccagcatgaagtttgttgaacatttgcacgtagtccaataacgggtaacacgacagacccaacaacactcactaatatagattttaatatcattttagatgtaactttgagtttaattcaattttacaaaatcgacttgtaagatataagttgttcctatttctatacattatatgacagcaaaaaaatgcaactacatttggtaattccacaccttcacccggaaaggctaaattacgtgtgaaagaacaagctgctcttatcatgttgcgggtacttgctaatcctcatgatgtggtggtgcactccaattgattcaatttggatagatatatatctcggtctctcctatacatggccattttaagctaaatttgatggggcagttcttggataacatgatttggctgcttgtggtagagttttaagagaacaaaatggcactttcgttttgcctataaattgggatcttgttctgtccttaatgccagtttgtgggtaatcctaataggagttagagtggctaggtcctgtgggttttgtttgtaacattcaatccgattcttatggagttacaccatttgaaagctgcatgtgataatctccacccttcatacgccttggtgcaaaaaatccttcaagaatgcagatggtacctatccaatttgtccatacttcaagggaagctaataagacctccaatggcttagcggaatagggattatctatgcatgctatagatttaggacttttgatgtagccccatgcgtaattcatttttctttgttagcttacttagccgctgtaacattccttcctggattttagttgggcttttgcccctcctacacaaaaaaaaaaaaaaaagaagtatacgaaaataatttaagaaaagataaatgcaaatcatttc

SEQ ID NO: 7363 - DNA, 3447 bp, Glycine max
attagggttcctgaagctgaggcactatcttcccaaaagaatacaaatctctttgaagttttcgtagttctctgaatcatggagatggaacgcgtcttcgaatttcctcacacttacatggatcgtcgcccgagaaagagagcgagattgggctgggacatccctgaagttcccaaggctcaggtaggattgttttgtggacaagatgttgggactatttcaagctttgctccttcaaggggtccctcagaacataccactagttctctatttgttaagccagttgctcgaaatggttctcccccttggcgagatgatgacaaagatgggcattacatgtttacgcttggagaaaatttaacttctcgctataagatccataccaaaatgggtgaaggaacttttgggcaggtcttagaatgctgggatagagaaaggaaggaaatggttgccgtaaaaattgtccgtggtataaagaagtatcgagaagcagccatgatagaaattgaggtgttgcaacagcttggtaaacatgataaaggaggcaatcgttgtgtgcaaatacggaactggtttgactatcgtaatcatatctgtattgtgtttgagaaacttggaccaagcttatacgattttcttcggaaaaacaattatcgctcatttcccattgatcttgtccgtgagattggcaaacaactattggaatgtatagcattcatgcatgatttgcgcatgattcatactgacctgaagcctgaaaacatactactagtttcacccgagtatgtcaaagttcctgactacaagagttcatctagatcatcatgttcctatttcaagagagttcccaaatcaagtgctataaaggttattgattttggcagcaccacttatgagcgagaagatcagaactacattgtatcaactcgtcattatagggctcctgaagttatccttggacttggctggagctatccatgtgatatatggagtgtgggatgtatattggttgaattatgcacaggtgaagctttgtttcagactcatgaaaatttagagcatcttgcaatgatggaaagggtacttggttcattaccacagaccatgatgaagagagtcgaccgacatgctgagaagtatgttagaaggggtagattagactggcctgagggtgcaacctcgagggagagtatcaaagctgtaatgaagcttcctaggcttcagaaccttgtaatgcagcatgtagatcattcagctggcgatctcatacatctcttgcaggggttacttagatatgacccctctgaaagacttacagccaaggaagctcttagacattccttctttatgagagaacactttagaagatgattcactttcttaactgctgcatcattgaccttcctaaggatttgaagatgtgggcaaatgaactcacctgtgtgatggctagtttttctgcagctgtcctctccccaatgctatgctgaaaaatccttatgtaggaatttttgaatggatctggattcgatgtacagaagaaaaaaaaaatgctaatgttatggtgaaaattgtagattttacgggcatgattcatatggcatcctgagctttgtgtgcacgagtataagtctccattcgagtgtaccgcacacacatgatatattagacacgattgacaagtcacgggaagcttctattcatagcagagatatggcagcgacgcaagagcgggaagcttccatgatgaggcaatgtatttagcagacctcagctgttgctataatgggggaggcatcgcagcaatatgatgcgataatagcacaaaaccaatcataactaataagaaaagaatatcaaatctttggcattgcatttggtgaatatgggagaaagttgagactaatttagttcgcaggtggacagtgttgacaaaataagttatagtctgacctcgggctgcaaaatagagaggtcttttaaaccttttttgcctcttagcaactggtcaacttcatgagtatcaacaagataaggtccttaataattttgtgctgcaaaatggagattgggattttcaaagctttgataattgtcttctcattctagtttgcaaccaaatccatggagattgggattttcaaagctttgataattgtcttctcattctagtttgcaaccaaatccaagctatggtgctttcctctctgttacttgatgaagatcgtttggcttggagatgatcaaatgatgggatcccaactatatatgatcgagaaattgctcgttcaactcttaccaactataaagaaggagcaatttctcgatcatatatacctggagtggtcccaatgatgaaattgttgctttggaaaattgctaaaatctcccaatgatgaatcgtgccctatatgctaatgtactgtggaagaacttcaattcgtgctataatatatggcatgctggccaaagaagtgtgaacctcactccttgagaataattcagatgctgacattttcgtgaatcttatggacctttggttacaatcaaatttattgaaggatagtcagtggagtttaattttgggattaacatctccagcatgaagtttgttgaacatttgcacgtagtccaataacgggtaacacgacagacccaacaacactcactaatatagattttaatatcattttagatgtaactttgagtttaattcaattttacaaaatcgacttgtaagatataagttgttcctatttctatacattatatgacagcaaaaaaatgcaactacatttggtaattccacaccttcacccggaaaggctaaattacgtgtgaaagaacaagctgctcttatcatgttgcgggtacttgctaatcctcatgatgtggtggtgcactccaattgattcaatttggatagatatatatctcggtctctcctatacatggccattttaagctaaatttgatggggcagttcttggataacatgatttggctgcttgtggtagagttttaagagaacaaaatggcactttcgttttgcctataaattgggatcttgttctgtccttaatgccgtgtagtgggtaatcctaataggagttagagtggctaggtcctgtgggtttgtttgtaacgttcaatccgattcttatggagttacaccatttgaaagctgcatgtgataatctccacccttcatacgccttggtgcaaaaaatccttcaagaatgcagatggtacctatccaatttgtccatacttcaagggaagctaataagacctccaatggcttagcggaatagggattatctgtgcatgctatagatttaggacttttgttgtagccccatgtgtaatccatttttctttgttagcttacttagccggtgtaacattccttcctggattttagttgggctcttgcccctcctacac

SEQ ID NO: 7364 - DNA, 1867 bp, Glycine max
gggagatttcatcccagccgcctccacggtcgttattattaggctaacatcgcgtttagggttcctgaagccgaggctctatcttcccaaaatcatataattctctttcatctgaattttccctttcaaatctcttcctttgaagttttcgtagttctctgcatcatggagatggaacgcgtcttcgagtttcctcacactcacatggatcggcgcccgagaaagagagcgagattgggctgggacatccctgaggtccccaaggctcaggtaggattgttttgtggacaagatgttgggactatttcaagctttgctccttcaaggggtccctcagaaaataccactagttctctatttgttaagccagttgctcgaaatggttctcccccttggcgagatgatgacaaagatgggcattacatgtttgcgcttggagaaaatttaacttctcgctataagatacatagcaaaatgggtgaaggaacttttgggcaggtcttagaatgctgggatagagaaaggaaggaaatggttgccgtaaaaattgtccgtggtattaagaagtatcgagaagcagccatgatagaaattgaggtgttgcaacagcttggtaaacacgataaaggaggcaatcgttgtgtgcaaatacggaactggtttgactatcgtaatcatatctgtattgtgtttgagaaacttggaccaagcttatacgattttcttcggaaaaacaattatcgctcatttcccattgatcttgtccgtgagattggcagacaactattggaatgtatagcattcatgcatgacttgcgcatgattcatactgacctgaagcctgaaaacatactactagtttcaccagagtatgtcaaagttcctgactacaagagttcatctagatcaccaagttcctatttcaagagagttcccaaatcaagtgctataaaggttattgattttggcagcaccacttatgagcgagaagatcagaattacattgtatcaactcgtcattatagggctcctgaagttatccttggacttggctggagctatccatgtgatatctggagtgtgggatgtatcttggttgagttatgcacgggcggagctttgtttcagactcacgaaaatttggagcatcttgccatgatggaaagggtacttggtccattaccacagcccatgttgaagagagtcgaccgacatgctgagaagtatgttagaaggggtagattggactggcctgagggtgcaacctcaagggagagtatcaaagctgtaatgaagcttcctaggcttcagaaccttgtaatgcagcatgtagatcattcagctggcgatctcatacatctcttgcaggggttacttagatatgacccctctgaaagacttacagccaaggaagctcttagacattccttctttatgagagatcaatttagaagataattcactttctaagctgctgcatcatcgttgaccttcctaagggattaactttagaagatgtgggcaaatgaactcacctgggtgatggctggtttttcctgcagctgtcttcactcctgctgaaaaatcctcatttaggaatttttgaattgatccgaattcaaagtacagaagaaaaaaatgctaatgttgtggtgaaaattgtagctttgtgctcacaaatttaattctccatttgagggtatgaaatttaataattttattatagaagttttttttttgtaaaattttaatacagtatgtttaaattttgaatacagttttttatttgataagttgataaaaaataatatttttgttggatataattttttagcattaataatattaaatgaattgatataattaa

SEQ ID NO: 7365 - DNA, 1800 bp, Glycine max
cctgaagccgaggctctatcttcccaaaatcatataattctctttcatctgaattttccctttcaaatctcttcctttgaagttttcgtagttctctgcatcatggagatggaacgcgtcttcgagtttcctcacactcacatggatcggcgcccgagaaagagagcgagattgggctgggacatccctgaggtccccaaggctcaggtaggattgttttgtggacaagatgttgggactatttcaagctttgctccttcaaggggtccctcagaaaataccactagttctctatttgttaagccagttgctcgaaatggttctcccccttggcgagatgatgacaaagatgggcattacatgtttgcgcttggagaaaatttaacttctcgctataagatacatagcaaaatgggtgaaggaacttttgggcaggtcttagaatgctgggatagagaaaggaaggaaatggttgccgtaaaaattgtccgtggtattaagaagtatcgagaagcagccatgatagaaattgaggtgttgcaacagcttggtaaacacgataaaggaggcaatcgttgtgtgcaaatacggaactggtttgactatcgtaatcatatctgtattgtgtttgagaaacttggaccaagcttatacgattttcttcggaaaaacaattatcgctcatttcccattgatcttgtccgtgagattggcagacaactattggaatgtatagcattcatgcatgacttgcgcatgattcatactgacctgaagcctgaaaacatactactagtttcaccagagtatgtcaaagttcctgactacaagagttcatctagatcaccaagttcctatttcaagagagttcccaaatcaagtgctataaaggttattgattttggcagcaccacttatgagcgagaagatcagaattacattgtatcaactcgtcattatagggctcctgaagttatccttggacttggctggagctatccatgtgatatctggagtgtgggatgtatcttggttgagttatgcacgggcggagctttgtttcagactcacgaaaatttggagcatcttgccatgatggaaagggtacttggtccattaccacagcccatgttgaagagagtcgaccgacatgctgagaagtatgttagaaggggtagattggactggcctgagggtgcaacctcaagggagagtatcaaagctgtaatgaagcttcctaggcttcagaaccttgtaatgcagcatgtagatcattcagctggcgatctcatacatctcttgcaggggttacttagatatgacccctctgaaagacttacagccaaggaagctcttagacattccttctttatgagagatcaatttagaagataattcactttctaagctgctgcatcatcgttgaccttcctaagggattaactttagaagatgtgggcaaatgaactcacctgggtgatggctggtttttcctgcagctgtcttcactcctgctgaaaaatcctcatttaggaatttttgaattgatccgaattcaaagtacagaagaaaaaaatgctaatgttgtggtgaaaattgtagctttgtgctcacaaatttaattctccatttgagggtatgaaatttaataattttattatagaagttttttttttgtaaaattttaatacagtatgtttaaattttgaatacagttttttatttgataagttgataaaaaataatatttttgttggatataattttttagcattaataatattaaatgaattgatataa

SEQ ID NO: 7366 - DNA, 1661 bp, Vigna unguiculata
ggaagctgaggctctatcttcacacaagcatattttctctttcatcttaatctgtctcttctttgaagttttcgtagatcttcgaatcatggagatggaacgcgttttcgaatttccccactctcacatggatcggcgaccgagaaagagagcgaggttgggctgggacattcctgaggtccctaaggctcaggtaggattgttttgtggacaagatgttggggctatttcaagctatgctccttcgaggggtccctcagaacataccacttgttccctatttgttaaggctgttgctcaaaatggttctcccccttggcgagatgatgacaaagatggacattacatgtttgcgcttggagataatttaacttctcgctataagatccatagcaaaatgggtgaaggaacttttgggcaggtcttagaatgctgggaccgagaaaggaaggaaatggttgcgattaaaattgtccgtgggataaagaagtatcgagaagcagccatgatagaaattgaggtgttgcaacagcttggtaaacatgacaaaggaggcaatcgttgtgtgcaaatacggaactggtttgactatcgtaatcatatctgtattgtgtttgagaaacttggaccaagcttatacgattttcttcggaaaaacaattatcgctcatttcccattgatcttgtccgcgagattggcagacaactattggaatgtatagcattcatgcatgatttgcggatgattcatactgacctgaaacctgaaaacatattactagtttcgccggaatatgtcaaagtgcccgactacaagagttcgtctagatcaccaagtacctatttcaagagagttcccaaatctagcgccataaaggttattgattttggaagcaccacttacgagcgagatgatcagacttacattgtatcaactcgtcattatagagcgcctgaagttatccttggacttggctggagctatccatgtgatatatggagtgtaggatgtatattggtggagttatgcacgggcgaagcattatttcagactcatgaaaatttagaacatcttgctatgatggaaagggtacttggtcctttaccacagcacatgttgaagagagtcgatcgaaatgctgagaagtatgttaggaggggtagattagactggcctgagggtgcaacctcgagggagagtatcaaagctgtaatgaagcttcctaggttacagaaccttataatgcagcatgtagatcattcagcaggcgatctcatacatctgttacagggattacttagatttgatccctctgaaagacttacagccaaggaagcccttagatatcccttctttatgagagatcactttaggagataatacttaagatattgtttcaatgaccttcctaaggatgtgtacatttgtgtgatgtttggttattctgcagctttcctccttatttaggggattttggaatcaatctgaattcaatgtacagaagaaaaaatatgttctaaggttatggtgaaaagttggagatgtatttttaccttgagctttgtgttcttggatttaatttgtcctttctagggttctttgttactttaaattttatcggtccccgcgttgtattatagtccgtatgttgtttttggtc

SEQ ID NO: 7367 - DNA, 1878 bp, Cajanus cajan
tatcaacgcagagtacgggggggatgccgaggcactatcttcacaaacgcatatttttctttcatctgaatctttccttgaaatctctccctttgaagttttcgtagttctctcaatcatggagatggaacgcgtcttcgaatttcctcacactcacatggatcggcgcccgagaaagagagcgagattgggctgggacatcgccgaggtccccaaggctcaggtaggattgttttgtggacaagatgttgggagtatttcaagctatgctccttcaaggggtccctcagaacataccaatagttctctatttgttaaggcagttgctcgaaatggttctcccccttggcgagatgatgacaaagatgggcattacatgtttgcgcttggagaaaatttaacttctcgctataagatccatagcaaaatgggtgaaggaacttttgggcaggtcttagaatgctgggacagagaacggaaggaaatggttgccataaaaattgtccgtggtataaagaagtatcgagaagcagccatgatagaaattgaggtgttgcaacagcttggtaaacatgataaaggaggcaatcgttgtgtgcaaatacggaactggtttgactatcgtaatcatatctgtattgtgtttgagaaacttggaccaagcttatacgattttcttcggaaaaacaattatcgctcatttcccattgatcttgtccgcgagattggcagacaactattggaatgtatagcattcatgcatgatttgcgcatgattcatactgacctgaagcctgaaaacatactactagtttcgccagagtatgtgaaagttccagactacaagagttcatctagatcaccaagttcctatttcaagagggttcccaaatcaagtgctataaaggttattgattttggaagcaccacttatgagcgagaagatcagaattacattgtatcaactcgtcattatagggctcctgaagttatccttggacttggctggagctttccgtgtgatatatggagcgtgggatgtatactggttgagttatgctcgggagaagctttgtttcagactcatgaaaatttagagcatcttgcaatgatggaaagggtacttggtccattaccgcagcacatgttgaagagagttgaccgacatgctgagaagtatgttagaaggggtagattagactggcctgagggtgcaacaacaagggacagtattaaagctgtgatgaagcttcctaggctacagaaccttataatgcaacatgttgatcattcagctggcgatctcatacatctcttgcaggggttacttagatatgacccatctgaaagacttacagccaaggaagctcttagacattccttctttatgagagatcactttaggagataatcaactttctaaaagctgctgcatcattgacatcctaaggatgtgtgctaatgagcgcacatctgtgtgatggctgcatcgcttctcaatccaatgttatgctgtaaaaaatcctatttagaaaattttgaatgaatctgaattcaatgtacagtagaaaaaaaatgctaacgttatggcaaaaatttgagatttatgggcatgactggtattgcatcccgatctaagtctccatacggagtggaatttatttctacccgcgtcattttcatggctttcaaatggtactgtgtgacatgtttaagagggtcggtgagacatttgaaaattgaaacgcgagctttggactcttgaagtcggttataatcgccattttgatttttaatcaggctgggtgtcgactgatttgggcctctctttgaaagtagtcgatgaaaataagtatagttgggggcttgggagccagg

SEQ ID NO: 7368 - DNA, 1718 bp, Lupinus angustifolius
agggttcctcaaccattatcatcgcgaaaagcatattttttccctttaccttttaatctttctccttcaattgttctttcaagctttcgcagatctagataatcatggagatggaacgcgtatttgaatttcctcacactcacatggatcgacgcccaagaaagagagcgagattaggctgggacatccctgaggtcccgaaggctcaggtaggattgttttttggacaagaggttgagaatatttcaagctatgctccttcattgggttcctcagaatataccactagttctctatttgttaagggagttgctcgaaatggttctcccccttggcgagaagatgacaaagatgggcattacatgtttgcgattggagataatttaacatctcgctacaagattcatagcaaaatgggagaaggaacttttgggcaggtcttggaatgttgggacagagaaaagaaggaaatggttgccataaaaattgtccgtgggataaagaagtatcgtgaggcagccatgatagaaattgaggtattgcaacagcttgggaaacatgataaaggtggcaatcgttgtgtgcaattacggaactggtttgactatcgtaatcatatatgtattgtgtttgagaaacttggaccaagcttatatgattttcttcggaaaaacaattatcgctcatttcccattgatgtagtccgtgagattggcagacaactattggaatgtgtagcattcatgcatgatttgtctatgatccatactgacctgaaacctgaaaacatacttctggtatcaccagagtatgtcaaagttcctgactacaagagttcatccagatcaccaagttcctatttcaaaagagtgccccaatctagtgctataaaggttattgattttggcagtaccacttatgagagaaaggatcagaattacattgtatcgacccgccattatagggcacctgaagttattcttggacttggatggagttatccatgtgatgtatggagtgtgggatgtatactggttgagttatgcacgggtgaagctttgtttcagactcatgagaatttagagcaccttgccatgatggagagggtgcttggtgcattaccacagcacatgttaaagagaattgaccgacatgcggagaagtatgttagaaagggtagattagactggccagagggtgcaacctcaagggacagcattaaagccgtgatgaagcttcctaggctacagaaccttataatgctgcacgtggatcattcagctggtgatcttatacatctcttgcaggggttacttaggtttgacccctctgagagacttactgctaaggaagctctccgacattctttctttagagaccaccttaggagataatctacccattactattatagctgctgctgcttctgtatctcgatcgtgccgaacatgatggtgttttatagcgatatctctgttggggttgtaattgttacaaatgataaagtgaagccactcttgtaaatgtttgtgtcttcctctctggatcaatagggggagtgatggctggctttctagcagttctctcacgccaacgatttactagttatttgtcgtttacaatttctccgaattcttgtgtagaagaaaaacttctagtatcggaattcttatgtagaagaaaaacttctactgtttatcgtatgtttgaaattgcaa

SEQ ID NO: 7369 - DNA, 1833 bp, Phaseolus vulgaris
cttcacacaagcatattttctctttcatcttagtttttctcttctttgaagttttcgtactgcttcgaatcatggagatggaacgcgtcttcgaatttcctcactctcacatggatcggcgaccgagaaagagagcgaggttgggctgggacattcctgaggtccctaaggctcaggtaggattgttttgtggacaagatgttggggctatttcaagctatgctccttcaaggggtccctcagaacataccacttgttccctatttgttaaggctgttgctcaaaatggttctcccccttggcgagatgatgacaaagatggacattacatgtttgcgcttggagaaaatttaacttctcgctataagatccatagcaaaatgggcgaaggaacttttgggcaggtcttagaatgctgggaccgagaaaggaaggaaatggttgcaattaaaattgttcgtgggataaagaagtatcgagaagcagccatgatagaaattgaggtgttgcagcagcttggtaaacatgacaaagggggcaatcgttgtgtgcaaatacggaactggtttgactatcgtaatcatatctgtattgtgtttgagaaacttggaccaagcttatacgattttcttcggaaaaacaattatcgctcatttcccattgatcttgtccgcgagattggcagacaactattggaatgtatagcattcatgcatgatttgcgtatgattcatactgatctgaagcctgaaaacatattactagtttcaccagagtatgtcaaagtgcctgactacaagagttcatctagatcaccaagtacctatttcaagagggttcccaaatctagtgccataaaggttattgattttggcagcaccacttacgagcgagaagatcagacttacattgtatcaactcgtcattatagagctcctgaagttatcctcggacttggctggagctatccatgtgatatatggagtgtaggatgtatattggttgaattatgcacgggcgaagctttatttcagactcatgaaaatttagaacatcttgctatgatggaaagggtacttggccctttaccacagcacatgttgaagagagtcgaccgaaatgccgacaagtatgttaggaggggtagattagactggcccgagggtgcaacctcgagggagagtatcaaagctgtaatgaagcttcctaggcttcagaaccttgtaatgcaacatgtagatcattcagcaggcgatctcatacatctgttgcagggattacttagatttgatccctctgaaagacttacagccaaggaagcccttagatatcccttctttatgagagatcactttaggagataatacttctcctaagatattgtttcattgaccttcctaaggaatgtacatttgtgtgatgtttggttattctgcagctgtgatctccttattaagggatttttgaatcaatttgaattcaatgtacagaagaaaaaaaatgttctaatattatggtgaaaagttggagatgtattggtaccttgacctgtgttcgtgaatttaacttgtccttacattattagatgttactgtcaaacttcatcggtcaccgatttgtattatagtcaggatggtgtttttggacatgaagttacttggatctcctgaaacttaggaaaggcaggaagtttaggtaatgacaggtgattggaggcgaggttttttttatatcgtgaactgagcacttgattattatggctatgtataacagaaacaaaatttagacttaggatattattatcattaattttaaagaattaatttaaattcc

SEQ ID NO: 7370 - DNA, 1846 bp, Phaseolus vulgaris
gccgaggctctatcttcacacaagcatattttctctttcatcttagtttttctcttctttgaagttttcgtactgcttcgaatcatggagatggaacgcgtcttcgaatttcctcactctcacatggatcggcgaccgagaaagagagcgaggttgggctgggacattcctgaggtccctaaggctcaggtaggattgttttgtggacaagatgttggggctatttcaagctatgctccttcaaggggtccctcagaacataccacttgttccctatttgttaaggctgttgctcaaaatggttctcccccttggcgagatgatgacaaagatggacattacatgtttgcgcttggagaaaatttaacttctcgctataagatccatagcaaaatgggcgaaggaacttttgggcaggtcttagaatgctgggaccgagaaaggaaggaaatggttgcaattaaaattgttcgtgggataaagaagtatcgagaagcagccatgatagaaattgaggtgttgcagcagcttggtaaacatgacaaagggggcaatcgttgtgtgcaaatacggaactggtttgactatcgtaatcatatctgtattgtgtttgagaaacttggaccaagcttatacgattttcttcggaaaaacaattatcgctcatttcccattgatcttgtccgcgagattggcagacaactattggaatgtatagcattcatgcatgatttgcgtatgattcatactgatctgaagcctgaaaacatattactagtttcaccagagtatgtcaaagtgcctgactacaagagttcatctagatcaccaagtacctatttcaagagggttcccaaatctagtgccataaaggttattgattttggcagcaccacttacgagcgagaagatcagacttacattgtatcaactcgtcattatagagctcctgaagttatcctcggacttggctggagctatccatgtgatatatggagtgtaggatgtatattggttgaattatgcacgggcgaagctttatttcagactcatgaaaatttagaacatcttgctatgatggaaagggtacttggccctttaccacagcacatgttgaagagagtcgaccgaaatgccgacaagtatgttaggaggggtagattagactggcccgagggtgcaacctcgagggagagtatcaaagctgtaatgaagcttcctaggcttcagaaccttgtaatgcaacatgtagatcattcagcaggcgatctcatacatctgttgcagggattacttagatttgatccctctgaaagacttacagccaaggaagcccttagatatcccttctttatgagagatcactttaggagataatacttctcctaagatattgtttcattgaccttcctaaggaatgtacatttgtgtgatgtttggttattctgcagctgtgatctccttattaagggatttttgaatcaatttgaattcaatgtacagaagaaaaaaaatgttctaatattatggtgaaaagttggagatgtattggtaccttgacctgtgttcgtgaatttaacttgtccttacattattagatgttactgtcaaacttcatcggtcaccgatttgtattatagtcaggatggtgtttttggacatgaagttacttggatctcctgaaacttaggaaaggcaggaagtttaggtaatgacaggtgattggaggcgaggttttttttatatcgtgaactgagcacttgattattatggctatgtataacagaaacaaaatttagacttaggatattattatcattaattttaaagaattaatttaaattcc

SEQ ID NO: 7371 - DNA, 1855 bp, Phaseolus vulgaris
attagggttgctgaagatgaggctctctgtcttcacaaaaacatttatttctccttcatcttaattttcagcttctttgaacttttcatagttctctgaattatggagatggaacgcgtcttcgaatttcctcacactcacatggatcgacgcccgagaaagagagcacgattgggctgggacatccctgaggctcctaaggctcaggtagaattgttttgtggacaagatgttgagactatttccagctatgctccttcaagtggtccctcagaacataccactagttctctaattgttaaggcagttgctcaaaatggttctccctcttggcgagacgatgacaaagatggacattacatgtttgcgcttggagaaaatttaacttctcgctataggatccatagcaaaatgggtgaaggaacttttgggaaggtcttagaatgttgggacagagaaaggaaggaaatggttgcaataaaaataatccgagggataaagaagtatcgagaagctgccatgatagaaattgaggtgttgcaacagcttggtaaacatgacaaaggaggcaatcgttgtgtgcaaatacggaactggtttgactatcgtaatcatatctgtattgtgtttgagaaacttggaccaagcttatacgattttcttcggaaaaacaattatcgctcatttcccattgatcttgtccgtgagattggcagacaactattggaatgtatagcattcatgcatgacttgcggatgattcatactgacctgaagccggaaaacatactactagtgtcgccagagtatgttaaagttcccgactacaagagctcatctagatctccgggttcctatttcaagaaggttcccaaatcaagtgctataaaggttattgattttggcagcaccacttatgagcgagaagatcagaattacattgtatcaactcgtcattatagagctcctgaagttatccttggacttggctggagctacccatgtgatatttggagtgcgggatgtatattggttgagttatgcacgggcgaagctttatttcagactcatgaaaatttagaacatcttgcaatgatggaaagggtacttggtccattaccactgcacatgttgaagagagtcgaccgacatgctgagaagtatgttagaaggggtagattacactggcctgatggtgcgacttcaagggagagtatcaaagctgtaatgaagctaccaaggctacagaaccttataatgcatcatgtagatcattcagccggcgatctcatacatctcttgcaggggttacttagatttgacccttctgaaagacttacagccaaggaagctcttagacactccttctttatgagagatcactttaggagataattcactttctaacagcatcattcaccttctcaaggatgtgcacaaaggaactcacatctgtgtgatggctggtttttctacagccttcctcactccaaggctatgctgaaaaatccttatttagggaatttggaaataatctgaattcaatgtacagaagaaaaatatgcatattatgggggatgaagttatattattcctgacctctgcgcgacttaaaagttttcatacgaggggaaataacttgtttctttcttcccgcgtcaccctggttgtgaaggtttgcggactttgaaacaccgaaagcaggctgtgattttcgattctaaataagctttaagggcaagatcaggataagacttgagttgattatcgtaaactgagttcgtgatggtgtttgtagatatcattattgctaattgggaataatcaaaattaaaaattcaatgcagtaataaaa

SEQ ID NO: 7372 - DNA, 1877 bp, Phaseolus vulgaris
atcaagattagggttgctgaagatgaggctctctgtcttcacaaaaacatttatttctccttcatcttaattttcagcttctttgaacttttcatagttctctgaattatggagatggaacgcgtcttcgaatttcctcacactcacatggatcgacgcccgagaaagagagcacgattgggctgggacatccctgaggctcctaaggctcaggtagaattgttttgtggacaagatgttgagactatttccagctatgctccttcaagtggtccctcagaacataccactagttctctaattgttaaggcagttgctcaaaatggttctccctcttggcgagacgatgacaaagatggacattacatgtttgcgcttggagaaaatttaacttctcgctataggatccatagcaaaatgggtgaaggaacttttgggaaggtcttagaatgttgggacagagaaaggaaggaaatggttgcaataaaaataatccgagggataaagaagtatcgagaagctgccatgatagaaattgaggtgttgcaacagcttggtaaacatgacaaaggaggcaatcgttgtgtgcaaatacggaactggtttgactatcgtaatcatatctgtattgtgtttgagaaacttggaccaagcttatacgattttcttcggaaaaacaattatcgctcatttcccattgatcttgtccgtgagattggcagacaactattggaatgtatagcattcatgcatgacttgcggatgattcatactgacctgaagccggaaaacatactactagtgtcgccagagtatgttaaagttcccgactacaagagctcatctagatctccgggttcctatttcaagaaggttcccaaatcaagtgctataaaggttattgattttggcagcaccacttatgagcgagaagatcagaattacattgtatcaactcgtcattatagagctcctgaagttatccttggacttggctggagctacccatgtgatatttggagtgcgggatgtatattggttgagttatgcacgggcgaagctttatttcagactcatgaaaatttagaacatcttgcaatgatggaaagggtacttggtccattaccactgcacatgttgaagagagtcgaccgacatgctgagaagtatgttagaaggggtagattacactggcctgatggtgcgacttcaagggagagtatcaaagctgtaatgaagctaccaaggctacagaaccttataatgcatcatgtagatcattcagccggcgatctcatacatctcttgcaggggttacttagatttgacccttctgaaagacttacagccaaggaagctcttagacactccttctttatgagagatcactttaggagataattcactttctaacagcatcattcaccttctcaaggatgtgcacaaaggaactcacatctgtgtgatggctggtttttctacagccttcctcactccaaggctatgctgaaaaatccttatttagggaatttggaaataatctgaattcaatgtacagaagaaaaatatgcatattatgggggatgaagttatattattcctgacctctgcgcgacttaaaagttttcatacgaggggaaataacttgtttctttcttcccgcgtcaccctggttgtgaaggtttgcggactttgaaacaccgaaagcaggctgtgattttcgattctaaataagctttaagggcaagatcaggataagacttgagttgattatcgtaaactgagttcgtgatggtgtttgtagatatcattattgctaattgggaataatcaaaattaaaaattcaatgcagtaataaaattactagctgaatgat

SEQ ID NO: 7373 - DNA, 1532 bp, Arachis hypogaea
aagagagctagattaggctgggatatccctgaggccccaaaggctcaggtaggattattttgtggacaagaggttggaactatttcaagctatgctccttcatggggtccctcagaacataccagtagttctctttctgttaagggtgttgctcgaaatggttctccccctcagcgagatgatgacaaagatggccattacatttttgagcttggagaaaatttaacttctcgctacaagattcatagcaaaatgggtgaaggaacttttggacaggtcttagaatgctgggacagagaaaggaaggaaatggttgccattaaaattgttcgtggggtaaagaagtatcgggaagcagccatgattgaaattgaggtgctgcagcagcttggtaaacacgataaaggtggcaatcgttgtgtgcaaatacggaactggtttgactatcgtaatcatatctgtattgtctttgagaaacttggaccaagcttatacgattttcttcggaaaaacaattatcgctcatttcccattgatcttgtccgtgagattggcagacaactgttggaatgtgtagcattcatgcatgatttgcgaatgatccatactgacctgaagcctgaaaacatacttctagtttctcccgagtatgtcaaagttcctgattacaagagttcatcaagatcaccaagttcttatttcaagagagtgcccaagtcaagtgctataaaggttattgattttggcagcacgacttatgagcgagaagatcagaattacattgtatcaactcgacactatagggcacctgaagttatccttggactgggctggagttacccgtgtgatatttggagtgtggggtgtatattggttgagttatgcactggtgaagctttgtttcagacccatgagaatttagagcaccttgccatgatggagagggtgcttggaccactacctcagcacatgctgaagagagtagaccgacatgctgaaaagtacattagaaggggtagattagactggccagaaggtgcaacctcgagggatagtattaaagccgtaatgaagcttcctaggctacagaaccttatcatgcagcatgttgatcactccgctggtgatcttatacacctcttgcagggattgcttagatatgatccctcagaaaggcttacagccagggaagctctaagacattctttcttcatgagagattacctacggagatgatgatccaccccatcacactcgcatgcctattctcccttgaaatcaagggcaaatatgaccacaactgttgccaggcaaaagaggggggggggggatttggagccagtccctgtaaatacttttatcttaccccttcacaaaagcgtggatggggtatagccagcgctttgattgttatttcttgttcagaaattttgatagaatatactatcattagcccaagtctgaaatcaatgtaatatagaagaaaagctgtgttaaatctcatttttcagaagttttaagttgtcgccaaa

SEQ ID NO: 7374 - DNA, 1835 bp, Cicer arietinum
ttttcgcagttattcgaatcgtcatggaaatggaaagagtcttcgaattccctcacactcacatggatcggcgtccaagaaagagagcgaggttgggctgggatgttcccgaggtccctaaggctcaggtagggttgttttttggacaagaggttgcgaatatttcaagctatgctccttctggggttcccgcagaaaataccactagttctctctttgttaagggagttgctcgaaatggttctcccccatggcgagatgatgacaaagatggccattacatgtttgctgttggagaaaatttaacttcccgctataagatccacagcaaaatgggtgaaggaacttttgggcaggtattagaatgctgggacagagaaaggaaggaaatggtagccataaaaatagtccgtggaataaagaagtatcgagaagcagccatgatagaaattgagatgttgcagcagcttggtaaacatgatattggaggcaaccgttgtgtgcaaatacggaactggtttgactatcgtaatcatatctgtattgtgtttgagaaacttggaccaagcttatacgattttcttcggaaaaacaattatcgctcatttcccattgatcttgtccgtgagattggcagacaactattggaatgtatagcatttatgcatgatttgcgcatgatccatactgaccttaagcctgaaaacatactcctcgtttcatcagattatgtcaaagttcctgactacaagattacatctaggtcaccaaactcatatttcaagaaagtgccaaagtcatgtgctatcaaagttatcgattttggtagcactacatatgagcgagtagatcagagttacattgtatcaactcgtcattatagagcaccagaagttatccttggtcttggctggagtcatccgtgtgatatatggagtgtgggatgtatattggttgagttatgcacgggcgaagctttgtttcagactcatgaaaatttagagcaccttgccatgatggagagggtgcttggtccactaccattgcacatgttgaagagagttgaccgacatgctgagaagtatgttagaagaagtaaattagactggccagagggtgcagcctcaagggagagcattaaagctgtattgaagctccctagactacagaacctcataatgcagcatgttgaccattcagccggtgatctcatacatctgttgcaggggttacttagatacgatccctctgaaagactttcagctaaggaagccctgagacattcctttttcatgaggagatcacactagatgatcagccaattattaaaagagatcacataaccaattacaataagccgccgccacacccactgctgcttggtcttatcatcatacttgacattcttaagatgggttcacaagagcccatatatgtgttgtgtgagaagatcgctgcagcacttccaaattggaaggggtgtccatggtgctgtaaattttttcatcttagtcttgtgatgcgaatgaccaaggatcgccccaactctttgattatcgatccttatttagaaaaacgaatgtgttcgttcgtactgacttacaggaattcaatgtacatagataattacaattttaacatgtgtgttatgtttaaaatttgagatttatatgattgtgtgagtattattagctgagttgaaaagagtctgtacctctcaaaattttgctctctctacaatgtcattagtatagcgattcgcagttaattaaaaatttaatttaataactaaaagcctgaacagaatttgtgcagtttagatcccatatcttaaa

SEQ ID NO: 7375 - DNA, 1467 bp, Medicago truncatula
caaatcttctctaaatcgatttttccccaaattttctctgaatttttcgcacctctttgaatcatggagatggaacgcgtcttcgaatttcctcacactcacatggatcgtcgaccaaggaagagagcaaggttgggttgggatgttcctgaaaccccaaaggctcaggtagaattgttttttggacaagagcttgggaatatttcaagctatgctccttcaggggttccctcggaacacaccactagttccctatctgttaagggtgttgctcgaaatggttctcccccttggcgagatgatgacaaagatggccattacacttttgctgttggagaaaatttaacttcccgctataagatccacagcaaaatgggagaaggaacttttgggcaggtattggaatgctgggacagagaaaggaaggaaatggttgccattaaaattgtccgtggaataaaaaaatatcgtgaagcagccatgatagaaattgagatgttgcaacagcttggtaaacatgatataggtggcaatcgttgtgtgcaaatacggaactggtttgactatcgtaatcatatatgtattgtctttgagaaacttggaccaagcttatacgattttcttcggaaaaacaattatcgctcatttcccattgatcttgtccgtgagattggcagacaactattggaatgtatagcatttatgcatgatttgcgcatgatccatactgacctaaagcctgaaaacatactccttgtttcaccagactatgtcaaagttcctgactacaagatttcatctaggtcaccaaactcatatttcaagaaagtgcccaagtctagtgctatcaaggttattgattttggaagcaccacatatgagcgagtagatcagagctacattgtctcaactcgtcattatagagcacctgaagttatccttggtcttggctggagtcattcatgcgatatatggagtgtgggttgtatattggtcgagttatgcacgggcgaagctttgtttcagactcatgaaaatttagagcaccttgccatgatggagagggtacttggtccactaccaatgcatatgttgaagagagtcgaccgacatgctgagaagtatgtcagaagaggtaaattggactggccggtgggtgcaacctcgagggagagtattaaagctgtaatgaagctccctagactacagaatctaataatgcagcatgttgatcattcagctggtgatctcatacatctgttgcaagggttacttagatatgacccctctgaaagaatcactgccaaggaagccctcagacattccttttttatgaggagatcacattagatgacccaccattaactaaagttagatcacgttagatccatcaattactcttggccactccctcccccctgcaaggtcgtcatcaaggtggatgcacatgagcccataacagtattg

SEQ ID NO: 7376 - DNA, 1788 bp, Citrus clementina
acaaaacaaagaaaattcttatcttcgttattttattcgttcgtttcaatcgcatcaagatctcgatctctctcttatttcctcgccgtgagctgcgatcatggagatggagcgcgtgacggagtttcctttttcgaatctggatcggcgtcctcgtaagcgagcgcgtttgggctgggacgtgcctcaggtaccgaaggctcaggtaggattattttgtggacaagaggttgggaatgtaacaagctttgcacctccaagagctccctcagaccatgtcactagttcttctctatttgtaaagggagtggctcgaaatggttctcccccatggcgtgaggatgacaaagatggccattatatgtttgcgcttggagaaaatttaacttctcgctataagattcacagcaaaatgggtgaaggaaccttcggtcaggttttggaatgctgggatcgtgagaggaaagaaatggtagccattaaaattgttcgtgggatcaagaaatatcgtgaggctgctatgatagaaattgaagtacttcaacaacttgcaaaacatgataaaggtggcaaccgttgtgtgcaaatacggaactggtttgactatcgtaaccatatctgtattgtgtttgagaagcttggatctagcttatacgattttctacggaaaaacaattatcgctcatttcccattgatcttgtccgtgagattgccagacaactgttggaatgtatagcatttatgcatgatctgtgtatgatacatactgacttaaagcctgagaacgttctacttgtttcttccgagtatattaaggttcctgactacaagagttctttgcacacaccaaaagattcttcctactttaaaagaatgccaaagtcaagtgctattaaggtgattgattttggcagcacaacttatgagcgcccagatcagaactacattgtatccacccgacattatcgtgcgccggaggttatccttggacttgggtggacttacccatgtgatatatggagtgttggttgtatcttagtggagttatgcacgggtgaggcattattccaaactcatgagaacttggaacaccttgcgatgatggaacgggtgcttggtcccttgcctcaacatatgctgaagagagtagaccgacatgcagagaagtatgttagaaggggtaggttggactggccagaaggtgcagcctctagggaaagtattaaatctgtgatgaagctacctcgtcttcagaacctaataatgcagcacgttgaccattcagctggtgatcttacacatttattgcaaggactgcttaggtatgatcctacggacaggctaactgcgcgtgaagctcttaggcatcccttttttacaagagatcatcttaggagataggtacccatatacttgttacacaattctccggttgcaatatgcggtggttagaagccaagtatcacagttgtgggatctgggttgttctattttgttgtgctgttgcatgttcttacttatctaacccaaatctgaggcactgtgaatatttgacattaagaaatggaatttgtgggggaaaaagggtggaggattttcctcttcacccaacaaaagacctaggtatgtgttgtacatggtggagttagtttcttggcatgattttgcctacaaatgtgactaaccaaagtgtaaaatattggatcttttgtatctgcagaaattattttcatatgcagaaatgatttcttcttgtttgagggttttgatttttcctattttcagca

SEQ ID NO: 7377 - DNA, 1788 bp, Citrus sinensis
acaaagcaaagaaaattcttatcttcgttattttattcgttcgtttcaatcgcatcaagatctcgatctctctcttatttcctcgccgtgacctgcgatcatggagatggagcgcgtgacggagtttcctttttcgaatctggatcggcgtcctcgtaagcgagcgcgtttgggctgggacgtgcctcaggtaccgaaggctcaggtaggattattttgtggacaagaggttgggaatgtaacaagctttgcacctccaagagctccctcagaccatgtcactagttcttctctatttgtaaagggagtggctcgaaatggttctcccccatggcgtgaggatgacaaagatggccattatatgtttgcgcttggagaaaatttaacttctcgctataagattcacagcaaaatgggtgaaggaaccttcggtcaggttttggaatgctgggatcgtgagaggaaagaaatggtagccattaaaattgttcgtgggatcaagaaatatcgtgaggctgctatgatagaaattgaagtacttcaacaacttgcaaaacatgataaaggtggcaaccgttgtgtgcaaatacggaactggtttgactatcgtaaccatatctgtattgtgtttgagaagcttggatctagcttatacgattttctacggaaaaacaattatcgctcatttcccattgatcttgtccgtgagattgccagacaactgttggaatgtatagcatttatgcatgatctgtgtatgatacatactgacttaaagcctgagaacgttctacttgtttcttccgagtatattaaggttcctgactacaagagttctttgcacacaccaaaagattcttcctactttaaaagaatgccaaagtcaagtgctattaaggtgattgattttggcagcacaacttatgagcgcccagatcagaactacattgtatccacccgacattatcgtgcgccggaggttatccttggacttgggtggacttacccatgtgatatatggagtgttggttgtatcttagtggagttatgcacgggtgaggcattattccaaactcatgagaacttggaacaccttgcgatgatggaacgggtgcttggtcccttgcctcaacatatgctgaagagagtagaccgacatgcagagaagtatgttagaaggggtaggttggactggccagaaggtgcagcctctagggaaagtattaaatctgtgatgaagctacctcgtcttcagaacctaataatgcagcacgttgaccattcagctggtgatcttacacatttattgcaaggactgcttaggtatgatcctacggacaggctaactgcgcgtgaagctcttaggcatcccttttttacaagagatcatcttaggagataggtacccatatacttgttacacaattctccggttgcaatatgcggtggttagaagccaagtatcacagttgtgggatctgggttgttctattttgttgtgctgttgcatgttcttacttatctaacccaaatctgaggcactgtgaatatttgacattaagaaatggaatttgtgggggaaaaagggtggaggattttcctcttcacccaacaaaagacctaggtatgtgttgtacatggtggagttagtttcttggcatgattttgcctacaaatgtgactaaccaaagtgtaaaatattggatcttttgtatctgcagaaattattttcatatgcagaaatgatttcttcttgtttgagggttttgatttttcctattttcagca

SEQ ID NO: 7378 - DNA, 1616 bp, Manihot esculenta
aacgaattttatctttctccgttgtctggttgtttatttctcttcagggttccaagatttgtttttcccaattttcttttttgattttctccgatctagcttccgattatggagatggagcgcgtgaccgagtttcccctggcgcaccttgatcgccgacccaggaagagggctcgtctgggctgggacgtttctcaggtccccaaggctcaggtaggaatattttgtggacaagaggttggcagtataacaagctatgcatcttctggagcaaccccagaccatattatctctagttcactatttgtaaagggagtggctcgaaatggttctcccccatggcgggaagatgacaaggatggccattacatgtttgcaattggagaaaatttaacttctcgctataagatacacagcaagatgggtgaaggcacctttggtcaagtattggaatgctgggacagagaaagaaaggaaatggttgcaatcaaaattgtccgtgggattaagaagtatcgtgaagcagctatgatagagattgaagtgctgcaacagcttggtaaacatgataagggtggcaatcgttgtgtgcaaatacggaactggtttgactatcgtaaccatatctgtattgtttttgagaagcttggaccaagtttatacgattttctacgcaaaaacaattatcgctcatttcccattgatcttgtccgtgagattggaagacaactgttggaatgtgtagcatttatgcatgacttgcacctgattcatactgatctgaagcccgagaatattctgcttgtttctgctgattatattaaagttcttgattacaagggttcgtcccgagcaccaaaggaaagctcctacttgaaaagagtcccaaaatcgagtgctattaaggtgattgattttggtagcactacttatgagcgccaagatcagaactacattgtatctaccagacattaccgtgctccagaagttattcttggacttgggtggagttatccatgtgatatatggagcgtcggttgcatcttagtggaattatgcactggagaggcattattccaaactcatgagaatttggagcacctggctatgatggaaagggtctttgggccactgcctcagcatatgttgaagagaatcgatcgacatgcagagaaatatattagaaggggtagattggactggcctgaaggtgcgacttcaagggaaagtattaaagctgttctgaagttgcctcgtcttcagaatctagtaatgcagcatgttgatcattcggctggagatctgatacatctattgcaaggattgcttagatatgaaccctctgataggctaacagctcgtgaagccctaaggcatccctttttcacaggggaccatctaaggagatgaccaacagatggttgacaatcgatagatgtaaataataaatatattcttattcccagggatgttacggctatgcctgggcctcgccttgccatctcggtaaaatttgcacccagtgctctgttaaacctgcactaacccaatgccatgtgtataattaaaaattatcaacgtggaatgaagaagttacttgtgctttttccctggag

SEQ ID NO: 7379 - DNA, 1802 bp, Vitis vinifera
atactagaagatctagcctcttctttttcttgtgtttggtactcgagaaatttgattgtctcagggattttgtcttgcgttctgtggagatatggagatggtggagcgcgtgaccgagtttcctcacacgcacatggatcgccggccgaggaagaggccgcgtttgggatgggatgttcttcctcaggctccgaaggctcagctagggatgttttgtggacaagaggttgggaatgtggcaagctttgcaccttcaaaggcacactccgaccaaactactagttctatgtttgtaaagggagtagctcgaaatggttctcccccatggcgagaagatgacaaagatggccattacatatttgcgcttggagaaaatttaacttctcgctataagatcaacagcaagatgggcgaaggaacctttggtcaggttttggaatgctgggacagagagaggaaggaaatggttgccgtcaaaattgtccgtggtattaagaagtatcgtgaggctgccatgattgaaattgaagtcttacaacagcttgctaaacatgacaagggtggcaatcgttgtgtgcaaatacggaactggtttgactatcgtaaccatatctgtattgtgtttgagaagcttggaccaagcttatacgattttctacggaaaaacaattatcgctcatttcccattgatcttgtccgtgagattggcagacaactgttggaatgtgtagcatttatgcatgatttacgcctcatacatacggatttgaagcctgagaatatacttctagtgtctccagaatatgttaaagttccagactacaaggtttcatcccgttcacccaaggatggttcttactttaagagagtaccaaaatcaagtgctattaaagtgattgattttggaagcacaacatatgagcgacaagatcagaactacattgtatcaacacggcattatcgtgcgccagaggttattcttgggcttggatggagttatccatgtgatatatggagtgttggatgtatcttggtggagttatgcacgggagaagcattgtttcagactcatgagaatctggagcaccttgccatgatggaaagggtgttgggtccactgccgcagcacatgctgaagagagtagaccgacatgcagagaagtatgtacgaaggggtagattggactggccagaaggtgcgacttcaagggaaagtatcaaagctgttctcaagctacctcgccttcagaacctaataatgcagcatgtggaccattcggctggagatctaatacatctgttgcaaggtcttcttagatatgacccttcagaccgattgacagccattggagccctaaggcatcccttctttacaagggatcacctcaggaggtcttgactttgagagcacattgatcaggatgcattgctggacagacttttgacggagagcacattaaccacaaagttccttttggtgatgtagagcccaagtttacaagaggctctctgctcgtgtaaatatgtccattgttatacaagatgaaagattagtccccatcatctcaatttccttaaaaatgttggggctattctacccaagacaattctcaaatgttgtacaaccatgaatttcactaaccaatccctaattaatgttagatgacaagtaattccttgattttcacttttgtcccggaggcagaattctataattgttatttttgttttaatcatcaattatgtggttgataggcaatttacccaaaagctggtatttatggaggttggatagggttaga

SEQ ID NO: 7380 - DNA, 1665 bp, Vitis vinifera
ttcttgtgtttggtactcgagaaatttgattgtctcagggattttgtcttgctttctgtggagatatggagatggtggagcgcgtgaccgagtttcctcacacgcacatggatcgccggccgaggaagaggccgcgtttgggatgggatgttcttcctcaggctccaaaggctcagctagggatgttttgtggacaagaggttgggaatgtggcaagctttgcaccttcaaaggcacactccgaccaaactactagttctatgtttgtaaagggagtagctcgaaatggttctcccccatggcgagaagatgacaaagatggccattacatatttgcgcttggagaaaatttaacttctcgctataagatcaacagcaagatgggcgaaggaacctttggtcaggttttggaatgctgggacagagagaggaaggaaatggttgctgtcaaaattgtccgtggtattaagaagtatcgtgaggctgccatgattgaaattgaagtcttacaacagcttgctaaacatgacaagggtggcaatcgttgtgtgcaaatacggaactggtttgactatcgtaaccatatctgtattgtgtttgagaagcttggaccaagcttatacgattttctacggaaaaacaattatcgctcatttcccattgatcttgtccgtgagattggcagacaactgttggaatgtgtagcatttatgcatgatttacgcctcatacatacggatttgaagcctgagaatatacttctagtgtctccagaatatgttaaagttccagactacaaggtttcatcccgttcacccaaggatggttcttactttaagagagtaccaaaatcaagtgctattaaagtgattgattttggaagcacaacatatgagcgacaagatcagaactacattgtatcaacacggcattatcgtgcgccagaggttattcttgggcttggatggagttatccatgtgatatatggagtgttggatgtatcttggtggagttatgcacgggagaagcattgtttcagacccatgagaatctggagcaccttgccatgatggaaagggtgttgggtccactgccgcagcacatgctgaagagagtagaccgacatgcagagaagtatgtacgaaggggtagattggactggccagaaggtgcgacttcaagggaaagtatcaaagctgttctcaagctacctcgccttcagaacctaataatgcagcatgtggaccattcggctggagatctaatacatctgttgcaaggtcttcttagatatgacccttcagaccgattgacagccattggagccctaaggcatcccttctttacaagggatcacctcaggaggtcttgactttgagagcacattgatcaggatgcattgctggacagacttttgacggagagcacattaaccacaaagttccttttggtgatgtagagcccaagtttacaagaggctctctgctcgtgtaaatatgtccattgttatacaagatgaaagattagtccccatcatctctcaaaaatgtaattccaatttccttaaaaatgttggggctattctacccaagacaattctcaaatggtgtacaaccatgaatttcactaaccaatccctaattaatgttagatgacaagtaatt

SEQ ID NO: 7381 - DNA, 2030 bp, Ricinus communis
ggtctccttcaccaaaacaacaaatcctcatctcaaattcatatttttcttgtttgtttctcgtcaaaatccttagcggtttcctccgtaattttcttcgatcgtggtttcgactatggagatggagcgcgtgactgagtttcctctcccgcacctggatcgccgaccgagaaagagggcgcgtttgggctgggacgtgcctctagtccctaaggctcaggtaggaatgttttgtgcacaagaggttggaaatgtagcaagctatgcatcttctggagcaaattcagaccatactactacctctagttctgtatttcttaaaggagtggctcctcgaaatggttctcccccatggcgggaagatgacaaggatggccattacatgtttgcgcttggagaaaatttaacttctcgctataagatacacagcaaaatgggtgaaggtacctttggtcaggttttggaatgctgggacagagaaaggaaggagatggttgctatcaaaattgtacgtgggattaagaagtatcgtgaggcagctatgatagagattgatgttttacaacagctcggtaaacatgataaaggtggcaaccgttgtgtgcaaatacggaactggtttgactatcgtaaccatatctgtattgtttttgagaagcttggaccaagcttatacgattttcttcgcaaaaacaattatcgctcatttcccattgatcttgtccgtgagattggaagacaactgttggaatgtatagcatttatgcatgacttgcacctgattcatactgatttgaagcctgagaatattcttctagtctctcctgattatgtcaaggttccagattacaagggttccacccgatcaccaaaggacagttcctacttcaaaagagtccccaagtctagtgctgtgaaggtgattgattttggtagcacaacttatgagcgccaagatcagaactatattgtatcaacacggcattaccgtgcaccagaagttattctcggactaggatggagttatccttgtgatatatggagcgtcggatgcatcttggtggaattatgcactggtgaggcattgtttcaaacacatgagaatttggagcacctagcaatgatggaacgggtgcttgggcccttgcctcagcatatgttgaagaggatagatcgacatgctgaaaaatatgttagaaggggtagactggactggcctgaaggtgcgacttcgagggaaagtattaaagctgttttgaagctacctcgtcttcagaatctagtaatgcagcatgtagatcattcagctggagatctcatacatcttttgcaaggactgctgagatatgatccgtcagataggttaacagctcgagaagcattgaggcatcccttttttgcaagggaccatctgaggaggtgactacctgataggccaccattaagggcaagcaggttgctgtaaatgattaacagttgttgtcgataggcagtctgagatgatgaagaagatgaaggataaatctttctttgtgctgctatcgaccataggacctggcggatgtatatagggtctcttcttactaacaccaactctattatgtagtttccatacaactgaaatgctgagctggaagcgctataaattgtttattgcaattttatctttgacaatgaattattttttatccagtagtacatccatccatccgataaatttctttgacctgggtaattcgtaaaatggtgggattttctgtaatgaaatatttatgatataatatattactagcgttctaaatcatgatactttaaatcttctcgcgtttgaattaattctgcggctgactctgaccttagattagcgcctgatgatggatatttctgtctggaacgaaacaattgaagattgtagattttatcaaatcaacgaagtttggaaatctgtaaatttgcgatctttatcaagttggtctatagtattttatctaacttttaattttgtgaatttgtagatattcttatttttg

SEQ ID NO: 7382 - DNA, 1510 bp, Trigonella foenum-graecum
gttcaatccaattcacaattcttctccaaatcgattttttttccccaaaaatttctctgaacttttcgcacctctttcaatcatggagatggaacgcgtcttcgaattccctcacactcacatggatcgtcgcccaaggaagcgagcgaggttgggctgggatgttcctgaaacccctaaggctcaggtaggattgttttgtggacaagagcttgggaatatttcaagctatgctccttcaggggttcccccagaacacacccctagttctctatctgttaagggtgttgctcgaaatggttctcccccttggcgagatgatgacaaagatggccattacacttttgctgttggagaaaatttaacctcccgctataagatccacagcaaaatgggtgaaggaactttcgggcaggtattggaatgctgggacagagaaaggaaggaaatggttgccattaaaattgtccgtggaataaagaagtatcgggaagcagccatgatagaaattgagatgttgcaacagcttggtaaacatgatataggcggcaatcgttgtgtgcaaatacggaactggtttgactatcgtaatcatatatgtattgtgtttgagaaacttggaccaagcttatacgattttcttcgcaaaaacaattatcgctcgtttcctattgatcttgtccgcgagattggaagacaactgttggaatgtatagcatttatgcatgatttgcgcatgatccatactgacctaaagcctgaaaacatactccttgtttcaccagactatgtcaaagttcctgactacaagatttcatctaggtcaccaaactcatatttcaagaaagtgcccaagtctagtgctatcaaggttattgattttggaagcaccacatatgagcgagtagatcagagttacgttgtatcaacccgtcattatagagcacctgaagttatccttggtcttggttggagtcacccttgtgatatatggagtgtaggatgtatattgactgagttatgcacgggtgaagctttgtttcagactcatgaaaatttagagcaccttgccatgatggagagggtacttggtccactaccaatgcatatgttgaagagagttaaccgacatgctgagaagtatgtcagaagaggtaaattagactggcctttgggtgcaacctcgagggagagtattaaagctgtaacaaagctccctagactacagaatcttataatgcagcatgttgatcattcagctggtgatctcatacatctgttacaagggttacttagatatgatccctctgaaagaattacagccaaggaagccctcagacattccttttttatgaggagatcacattagactatccaccattactaaaatgatatcacattagatcaaccaatttctcatagccaccacctcctgctgctgcacaagagccaatatttgtgttgtgataagataagccacagcccttcctaattaagaagaggccacagc

SEQ ID NO: 7383 - DNA, 1725 bp, Quercus alba
aaccaagaaagaaagaaagaaaatctgatagtcatggagatggagcgcgtgacagagtttccccacacgcacatggatcggcgacccaccaagagggcgcgtttgggttgggatgttcttcctcagccttcaaaggctcaggtaggaatgttttgtggacaagaggttgggagtctgacaagctttgcaccttcaagagcaccctcagaccttaccactaattcttctctttatgaaaagggagtggctcgaaatggttctccccccaaggcgagatgatgacaaagatgggcattacatgtttgagcttggagaaaatttaacttctcgctataaaatccacagcaaaatgggtgaaggtacctttggtcaggttttggagtgctgggatagagaaaggaaagaaatggttgccatcaaaatagtccgtggaatcaagaagtatcgtgaagcagctatgatagaaattgaaatgctgcaacaacttggtaaacatgataaaggtggcaaccgttgtgttcaaatacggaactggtttgactatcgtaaccatatctgtattgtgtttgagaagcttggaccaagtttatacgattttctacggaaaaacaattatcgctcatttcccattgatcttgtccgtgagattggcagacaactgttggaatgtgttatgcatgagttgcgtttgattcatactgacttgaagccagagaatatccttttagtatcatcagattatgttaaagttcctgattacaaggactataagaattcttctcgatcaccaaaggatggttcatactttaaaagagtgccaaagtcaagtgccatcaaggtgattgattttggtagtacaacttatgaacgtcaagagcagacctatattgtatccacacgacattaccgtgcacctgaggtgattctaggactcggatggagttatccctgtgatgtatggagtgttggctgcatcttggtggaattatgcacgggtgaggcattgtttcaaactcatgagaatttggagcacctggcaatgatggagagggtgcttggcccattgccccagcacatgttgaagagagtagaccgacatgcggagaagtatgtcaggagaggtagattggattggccggatggtgctacctcaagagagagtattaaagctgtaactaagctccctcgtcttcagaacctgataatggagcatgttgatcattcagctggggatctcattcatctattgcagggattgcttagatatgatccgctagataggttgaaagctcgggaagcccttagacatcccttcttttctagggatcatctgaggagatgatgatccagctgcctagtatagtgaaatgttctatatctgaatgccattacaggggcttctgcttcacaaatggcgtctaaatatctctactccactgaaggatgcagaagaattgttagttgtatatacacactggagaaaagctcacttgtcaaagggcacatcggctcttttcctgcctgttgaccattttattttttctttttcaatttgatctttccatcttttcatgtatgtagtcgcgatccagctaacaagattccaaatgtaataccaggcaaattactcgaatgttaaccactctttgaaatgatggtttattttttttcctctaattgcatggtctcaaaattcgaagtttacgcatttatttaaactgggtt

SEQ ID NO: 7384 - DNA, 1697 bp, Cichorium intybus
gggacgatctcgcgattacgagtattatctcctcacgatcgtctctctgaaaacactcggttttctaatcatcaattaacgagtttcttttggattcgcatccgattatggagatggagcgtgttacggagtttccgatgggccaattggaccttaggccgaggaagcgacaaagacttggctgggatgtggttcctcaaccaccgaaggctcagctaggattgttttgtggacaagagattggaaatgtggccagctttgcaccttcatcagacaatattagttcaccccttgttaagcgtgtggctcgaaatgcttctcccccatggcgccaagatgataaagatggacattatgtgtttgcccttggagataatttaacctctcgatataagattcatggaaagatgggagaaggtacatttggtcaagtattggaatgttgggacaaggaaagaaaggaaatggtggcaataaagatagtccgtggtataaagaaataccgtgaggctgcaatgatagagattgatgtactacaacaacttggtaaacatgacaaaggaggcaatcgttgtgtgcaaataaggaactggtttgactatcgtaaccatatctgtattgtttttgagaagcttggaccaagcttatatgattttctacgcaaaaacaattatcgctcatttcccattgacctagttcgggagattggcagacaactcttggaatgtattgcatttatgcatgatttgcggttgatacacactgatttgaagcctgaaaacattcttttagtgtctccagagtatgtgaaagtgcctgattacaagggttcttcaaggtcaccaaaggatggttatttttctaaaagagtaccgaaatcgagtgcaatcaaggttattgattttggtagtacaacatatgacagacaagaccagagttacatagtgtccacacgtcattatcgtgctccagaagttatattaggacttggttggagttacccatgtgatatatggagtgttggttgtattttggtggagctttgctcgggtgaagcattgtttcaaactcatgaaaacttggaacatcttgcaatgatggagagggttcttggtgctttgcccacaagcatgttgaagaaagcagatcgacatgcagaaaaatatgtgagaaagggtagattggattggcctgaaggggctacttcaagagaaagtattaaagctgttatgaagctacctcggcttcagaatttgattatgcagcatgtggaccattcagcaggggatttaattcatttgttacaagggcttttaagatatgatccttcagagaggctaacagcacgtgcagctttaagacatccgtttttcactagggatcatcttagtagacggtactaggcatattctgtgaagctgtaaaagttaaatgtggggaaatgctgtacatattttttacccttgaaagggtgtcttacgtgtttctaacgtaacgtggggggattgtaggctaattgcaaacaaccaaatctcattgaccttgaagtcaaatttatgtacaatatgtagaggagggacgtaactcctgataattggtttgaaagtttgttttattataaaactattcatgtctctcttgtaattgatgaaggtcaaattgaaattgaaatttcttttttcttatggtctacatcc

SEQ ID NO: 7385 - DNA, 1538 bp, Panax ginseng
cttattttgatctcttttctcttgaattaaaccttgtttctctgtattgatcatggagatggaacgtgtggttgagtttccccacgcgcatatggatcggcgaccgagaaaaaggcagcgtttaggctgggatgttgttcctcagccccccaaggctcagctaggattgttttgtggacaagaggttgggaatgtgaccagctttgcatcgaaggcacccacagaccatactagttcttctctgttggttaagggagtggctcgaaatggttctcccccatggcgagaagatgacaaagatggacattatatgtttgcggttggagataatttaacatctcgctataagattttcagcaagatgggggaaggcacctttggccaggttttagaatgctgggataaagagaggaaagaaatggttgctattaaagttgttcgtggcattaagaaatatcgtgaagcagcattgattgaagttgatgtcctgcaacagcttggtaaaaatgacaaagctggcaatcgttgtgtgcaaataaggaactggtttgactatcgtaaccatatctgtattgtctttgagaagcttggcccaagcttatacgattttcttcggaaaaacaattatcgctcctttcccattgatcttgtccgtgagattggcagacaactgttggactgtgtagcattcatgcatgacttgcacctcatacacactgatttgaagcctgagaacattcttctcgtctctcccgaatacattaaagttcctgactacaagggttcgtcccgattacctatggatggttcatattttaagagagtacctaaatcaagtgcaattaaagtaattgattttggaagcacaacatatgatcgtcaagatcagacttatattgtttcaacacggcattaccgtgctcctgaagttattttaggacttggatggagctacccttgtgatgtatggagtgtaggctgcatcctggtggagctttgctcaggagaagcattgttccaaacacatgagaatttagagcaccttgccatgatggagagggtacttggtccaattccacagcacatgttgaaaagagtagaccggcatgcagagaaatatgccaggaagggaaagctggactggccagagggtgcagcctctagagaaagcatcaaggccgttttgaagctgccacgtctccagaacctaataatgcaacatgtagatcattcggctggtgatctcatacatctactacaggggctgctgagatatgatccatctgaaagatcgacggcacgtgaggccctcaggcacccatttttcaccagggatgatctgaggagatgatagccagcgagataagctttgtatttacgtaagtggtataatagaggtggatcaaaactggcgccaaatcatgtcccaagaaggaaaaggtggattactttgtattattgtaaatgtgttaatataatagagtttttcaatatttgttgtccaattttgtacttcttgattctcaagtgtatacaaa

SEQ ID NO: 7386 - DNA, 1593 bp, Fragaria vesca
tctcacaaaaacatcatcttcttcaatcttcagacttggctccctttttcgccccaaaaattttcttctagaaatctccgattaaccgatctgcgatcatggagatggagcgcgtggtggagtttcctcacactcacatggatcgtcgtccccgaaagcgagcgcgtctgggctgggacgttcctcaggccccaaaggctcaggtaggaatgtattgtggacaagaggttgggaatatgacaagctttactcctttgatggcaccctcactctacactagttctctattcgataaggaagtagctcgaaatggttcacccccatggagagaagatgacaaggatgggcattacatgttttcagttggcgaaaatttaacagctcgctataaaatccaaagcaaaatgggagaaggtacatttggtcaggttttggagtgctgggacagagaaaaaaaggaaatggttgccataaaaatagtccgcgggatcaagaaatatcgtgaagcagctatgattgaaattgagatgctgcaacaacttggtaaacacgataaaggtggcagccgttgtgtgcaattacggaactggtttgactatcgtaaccatatctgtattgtgtttgagaagcttggaccaagcttatacgattttctcaagaaaaacaattaccgctcatttcccattgatctcgtccgtgagattggcagacaactgttggaatgtgtagcattcatgcatgatctctctcttattcataccgacttgaagccagagaacatacttcttgtttctcctgattacattagagtccctgactataataagagctcatctcgatcacccaaagatagctcttactataaaagagtaccaaagtcaagtgctattaaggttattgattttggtagcacaacttatgagcgtcaagatcagaactatattgtgtcaacccgtcattaccgtgcacctgaggttattcttggaatgggctggagctacccttgcgatgtatggagcattggttgtatcttagtggagttgtgcacgggtgaggctttgttccagacacatgaaaacttggagcaccttgccatgatggagcgggtacttggtccccttccccagcatatgttgaagagagcagaccgacatgctgagaagtatgtcaggagaggtcgattggattggcctgaaggtgctgcgtcgagggagagtataaaggctgttcaaaaacttgctcgtcttcagaatcttataatgcagcacgtagaccattcagctggtgaccttatccacctcttgcaggggctactgaagtatgacccctcagatagacttacagctcgtgaagctcttaggcattcatttttcacacgggacaatctgaggagatgattattgcttacataccgagcgaatgttagccgaggtgtaggattgtttccattgtgtagatatctgaatgtagatttggttgacacccgctatcatggttggatatcaagtcaatgttgaatgccctgaagtctgctgacgcaattgtgtattgtacagtactgattttgtgaaatgagataaatgaatgtttttt

SEQ ID NO: 7387 - DNA, 1518 bp, Arnica chamissonis
tatcgcttccgattatggagatggaacgtgttacggagttcccatgagtcaattggacctcaggccgagaaaacgacagagattgggctgggacgtcgctcctccgccgccgaaggctcagctaggactattttgtggacaagagattggaaatgtaaccagctttgcatctttgggggccccatccgaccatattagttcatccatccttaaacgcgtggctcgaaatctttctcccccatggcgccaagatgacaaggatggacattatgtctttgcagttggagataatcttaccgcccgatataagattcatggaaagatgggtgaaggtacttttggccaagttttggaatgttgggacaaagaaagaaaagaaatggttgcaataaaaattgttcgtggtataaagaaataccgtgaggcagctatgattgagattgatgtgttgcaacaacttggtaaacatgacaaaggtggcaaccgttgtgtgcaaataaggaactggtttgactatcgtaaccatatatgtattgtttttgagaagcttggaccaagcttatatgattttctacgcaaaaacaattatagctcatttcccattgacctagttcgggagattggcagacaactattggaatgtatagcatttatgcatgatttgcggctaatacacactgatttaaagcctgagaatatacttctagtgtcaccagagtatgtgaaagtgcctgattacaagggttcgtcaaggtcaccaaaggatggttcttattctaaaagggttccaaaatctagtgctattaaggtgattgactttggtagtacaacgtatgaccgtcaggatcagacctacatagtgtccacccgtcactatcgtgccccagaagtcatattagggcttggatggagctacccatgtgatatatggagtgtaggttgcattctggtggaactttgcactggcgaggcgttgttccaaactcatgaaaacttggaacatcttgcaatgatggagagagtacttggcctgttgcccacacacatgttgaaaaaatcggatagacacgcagagaagtatgtgaggaagggtagattggactggcccgaggggtctacctcgagagaaagtatcaaggctgtgatgaagctacctcggcttcagaatttgattatgcagcatgtagaccattctgcaggggacttgattcatttgctgcaaggccttttaaggtatgatccatcggagaggctaacagcccgtgccgcactaagacaccctttcttcactagggaccatcttagacggtattagtatgtaaaaactaaacttgggtccagaaggatcgggagagataacatgtgtgccaacggatcgggctctttgtctgtacaatattttaacctttaataagggttagtttggtgtatctccaaacaacggactttatagcgaccagatctgattgactgatttatgtttgtacaaaccgtaggcgctaggtgactttgaatagg

SEQ ID NO: 7388 - DNA, 1730 bp, Platanus occidentalis
aaaacagatcgatctgtttctgatctcgatctctctgcaagcgtttctacgtggtcatggagatggaatgcttgacggagtttcctcacactcacatggatcggcgtcccagaaagaggccgaggttagcttgggatgttcctcaggcaccaaaggctcagccaggaatattttgtgggcaagaggttggaaatcttacaagctttgcaccttcgagggcaccctcagaccatactagttctctgtttgtaaagggagtggctcgaaatggttctcccccatggcgagatgatgacaaagatggacattacatttttgcgcttggagaaaatttaacttctcgctataggattcacagcaaaatgggtgaagggacctttggtcaggttttagaatgctgggatagggaaaggaaggaaatggttgccatcaaaattgtccgtggtattaagaagtaccgtgaagcagcaatgatagaaattgaagttcttcaacagcttgggaaacatgataaaggaggcagccgttgtgtgcaaatacggaactggtttgactatcgtaaccatatctgtattgtatttgagaagcttggaccgagcttatacgattttctacggaaaaacaattatcgctcatttcccattgatctagcccgcgagcttggcagacaactgttggaatgtgtagcatttatgcatgatttgcatctgatccatacagacttgaagcctgagaacatactgctagtttctcctgaatatataaaagtaccagactacaaggtttcatctcgatcacctaaagatggctcgtactttaaaaggttgccaaagtcaagtgctatcaaggtaattgattttggtagcacaacatatgaacatcaggatcacagctacattgtatcaacaaggcactaccgtgcacctgaggttattcttggacttgggtggagttatccatgtgatatctggagtgtgggttgtatattggtggagctctgctcgggagaagcactgtttcagacccacgagaatttggagcacctcgccatgatggagagggtgttgggcccaattccgcagcacatgttgaagagagtggaccgccatgctgagaagtacgtcagaaggggaagactagattggcccgagggtgcgacttcaagggagagtattaaagctgttttgaagctgcctcggcttcagaacctggtaatgcagcatgtagatcactcggcaggggacctcatagatcttttgcaaggtctaataaagtatgatcctgtcgaccggctgactgctcgtgaagcccttaggcacccgttctttacgagggaccagcacaggagatcttgaaaaagcttataaagtttagtgaggatcctgaacacgtgaaatatttttatattgacgttcccgcgattgggaggtttggtaacagattcttgcttgtgggtcagaaggaatggggtcggacggggattgtcatggtatcatgcaaaaaatatctttgcttgagtattcctcgtgcctgtgctcatcaagggtgttggtactaaaccacgggatgctaagaagcctgctttttgctcccatcctgatgtatacgatattggtcttctggattgacagtagactaaatcatttttttttcctcttgtttgtataaagtaatcaataatgcgatccacttttgaattcatttttctcatcttctatgtctaatctatt

SEQ ID NO: 7389 - DNA, 1959 bp, Populus trichocarpa
gtggaatcaacaaacacatgtcagactcaaatccacggataaaatcaacccacgttgtcggtcagttctcctcctaccttcatcccacgttatttattattcagattaaaacaagggttagctagaattctctctgcaccaaaaatcgtgaaaatttctctggatttctcttcgatcatggagttggaacacgtgaccgtcattcccataacgcacctggatcgaccaaggaagagagcgcgttttggctgggacgtgcctcaggcccaggtaggaatattttgtggacaagaggttggaaatgtagcaagctatgcatcttcaggagcaatctcagaccatactagttctctgtttgtaaaaggagtggctcgaaatggttctcccccatggagggaagatgacaaggatggtcattacatgtttgcgcttggagataatttaacttcccgctacaagatacacagcaaaatgggagaaggcaccttcggtcaggttttggaatgctgggacagagaaagaaaggaaatggtcgccatcaaaattgtacgtggcatcaagaaatatagggaagcagctatgatagaaattgaagtgctgcaaaatcttggtaaacatgataaagggagcaaccgttgtgtgcaaatacggaactggtttgactatcgtaaccatatttgtattgtatttgagaagcttggaccaagcttatacgattttcttcgcaaaaacaattatcgctcatttcccattgatcttgtccgtgagattggcagacaactgttggaatgtgtagcatttatgcatgacctgcgtatgatacatactgatttgaagcctgagaacatactcctagtttcttctgactatgtaaaagttcctgattacaagaactcatctcgttcaccaaaggacatttcctactataaaagagtcccaaaatcaagtgccattaaggtaattgattttggtagcacaacttatgagcgacaagatcagaattacattgtatcaacacggcattatcgtgcaccagaagttattcttggacttggatggagttatccttgtgatatatggagtgttggttgcatcttagtggagttatgcactggtgaggctttatttcaaacacatgaaaatttggaacatcttgcaatgatggaacgtgtgcttggtcctatgccacagcatatactgaagagagtggatcgacatgcagggaagtatgttagaaggggtaggctggactggccagagggagctgcttcaagagaaagcatgaaagctgttttgaagctaccccgacttcagaatctagtaatgcaacatgtggaccagtctgctggagatcttatacatctcctgcaaggactgcttagatatgatcccttggacaggttaacagctcgagaagctctgagacatcccttcttagcaaaagttcagcataggaggtgaggaatagaatggtcatgccaagagatgagggcctgtgattgtgtactgtattgttgctttattggggctgtggcagttaatccagctgacaatggtgaagttcttacgttaagaatctgcgttgcctattttaccccaaccattggagaggttggcatctgtaaatatctgtggcataaatttcaggcacctctgcttaaatgtcaggaaccgctgctgggcgtctcgcgtactgtgcttgctgggtttgaatgtattgttagaagttgctaacccaattccaagagtgtacagtagggaaatcttgttgagaattataaatagaatgttgatttggaagcagtccgtccaattctttttacctttttttttcttgattaaacaagttccattcgttttattttccttttaaatggttgcctttaatacagttttattctgtcaattctgaatgatcattttcacaagttagaaaaggcattgttcattatcaggaaa

SEQ ID NO: 7390 - DNA, 1923 bp, Lactuca sativa
cacgtgtacggatggatgcacgttcaccgcccaacgcttgattgtttggtcaatattagggttgcgttagggttgggttttccatcacagatctcacccgattacagtattatctcttcaagatcgtctctctgaatacatagtcggttttctgatcatcaatcaacgagtttcttttcgaatcgcatacgattatggagatggagcgtgttacggagtttcccatgggtcaattggatctcaggccgaggaagcgacaaagattgggctgggatgtggttcctccaccaccgaaggctcagctaggattattttgtggacaagagattggaaatgttgcaagctttgcacctcagcgagcaccatcagaccacattagttctccccttgttaagcgtgtggctcgaaatgcttctcccccatggtgccaagatgataaagatggtcattatgtgtttgcacttggagataatctaacttctcgatataagattcatgggaaaatgggagaaggtacatttgggcaagtattggaatgttgggataaggaaagaaaggaaatggtggcaataaaaattgttcgtggtataaagaaatatcgtgaggcagcaatgatagagattgatgtgttgcaacaacttggtaaacatgacaaaggaggcaatcgttgtgtgcaaataaggaactggtttgactatcgtaaccatatctgtattgtttttgagaagcttggaccaagcttatatgattttctacgcaaaaacaattatcgctcatttcccattgacctagttcgggagattggcagacaactcttggaatgtattgcatttatgcatgatttgaggctgattcacactgatttgaagcctgaaaacatacttcttgtgtctccagagtatgtgaaagttcctgattacaagggttcatcgaggtcaccaaaagatagttctttttctaaaagggttccgaaatcgagtgctattaaggtgattgactttggtagtacaacatatgacagacaggaccaaagctacatagtgtccacacgtcactatcgtgcaccggaagttatattagggcttggatggagttatccatgtgatatatggagtgttggttgtattttggtggaactttgctcgggggaagcattgtttcaaacacatgaaaacttggaacatcttgcaatgatggagagggttcttggcccattgcctacacacatgttaaagaaagcagaccgacatgcagagaaatatgttcggaagggaaggttagattggccagaaggggctacatcaagagaaagtattaaagctgtgatgaagctacctcggctccagaatttgataatgcagcatgtagaccattcagcaggggatttgattcatctgttgcaagggctattaagatatgatcctttggagagggtaacagcacgtgcagcattaagacatcctttcttcaccagggacaatctcagtagacgatactaacaatatgaaaacaaaatatgtggtggtcaatatacacacggaaggaaggaaagatgtttttgctgtagatatttttattacccgtgaagctcaagggtatgttctgtgttcctactgctctgctgtcacacatctcattgaccaccttgaaagtcaagtttatgtacaaacaaacaaacaaacaaaatgtagaaaagaaaagagaggcctaactaactcttcctagcctaggtggtatgtatggtgttatgatatgatatggtgttttcatgataatcattcaatctgattgaaaccaagcttgttttcatgttttgtactctagctattgtctattgatggtgggtaatggaaattgttttctttaggttcttatgctccacaatttgatggccttgtcttttgtcataaaaaatataattat

SEQ ID NO: 7391 - DNA, 1776 bp, Centaurea maculosa
tctgttcttatagatcatcatcgatcatcgatggttttaaggtgaaattcgcatctggatatggagatggagcgtgttacggagttcccgatgactcaattggacatcaggcctaggaaacgacagcgattgggctgggacgtggttcctcaaccgcctaaggctcagctaggattgttttgtggacaagagattggaaatctgaccagctttgcaccttcgcgggcaccgtcagaccatattaattcatcccttgttaagcgagtggctcgaattggttctcccccatggcgccaagatgataaagatggacattatgtttttgcagttggagataatttaacttctcgatataagattcatggaaagatgggagaaggtacgtttggccaagtattggaatgttgggacaaggaaagaaaggaaatggttgccataaaaattgtccgtggtataaagaaataccgtgaggcagccatgatagagattgacgtgttgcaacagcttggtaaacacgataaaggtggcaatcgttgtgtgcaattaaggaactggtttgactatcgtaaccatatctgtattgtttttgagaagcttggaccaagcttatatgattttctacgcaaaaacaattatcgctcgtttccaattgacctagttcgggagattggcagacaactcttggaatgtatagcatttatgcatgatctgcggctgatacacactgatttaaagcctgagaacattcttttggtgtctggggagtatctgaaagtgcctgattacaagtgttcatcgaggtcaccaaaggatgggtctttctctaaaagaatcccaaaatctagtgctattaaagtgatcgactttggtagtacaacatatgaccgtcatgaccagaactacatagtgtccacacgtcattaccgtgcaccagaagttatattaggacttggatggagctacccatgtgatatatggagtgtggggtgtattcttgtggagctttgctcgggtgaagctttattccaaacgcatgaaaacttggaacatttagcaatgatggagagggtccttggtccgttgcctatgcacatgttgaagaaagcagaccgacatgcagagaagtatgttagaaagggtaggttggattggccagagggtgctgggtcaagagagagcattaaagcggttatgaagctacctcggcttcagaacttgataatgcagcacgtagaccattcagctggtgatctgattcatgtgttgcaagggcttttgaggtatgatccttcggaaagattaacagcacatgcggctctacgacatcctttcttcaccagggatcattttagacggtattgatggcagcggtggcatgtagatagagatgtttggtcagctaacaacaagccacatttcactagaaggaattctatgtataaaattctaacattcgacaggtgggatgtggtttatgtatttggtaatttctgatgttgtgctaaaagcagagctgggtttcattacaatctgtttttgaatcttgttgatgaaattgttgcaattgtttgaatttatatacatatactattatctcttctaaaaaaaacaaaaaaaaaaaacaataatttcgttattcatacaataacacggtatatctatttcaataacatggtatatctatttacacaaatctcgtaagaatctcatagacaacatatacaataatacaaatcaatacccgttttgatcctaaatccgtaactaagtttcaaa

SEQ ID NO: 7392 - DNA, 1754 bp, Centaurea maculosa
ataacaagattacctttttcgaattcatccatctgaaaccctaatctgttcttatagatcaatcaatcatcaatcatcgattgattttaggtgaaattcgcatctggatatggagatggagcgtgttacggagtttccgatgactcaattggacatcaggcctaggaaacgacagcgtttgggctgggatgtggttcctcaaccgcctaaggctcagctaggattgttttgtggacaagagattggaaatctgaccagctttgcacctacgcgggcaccgtcagaccatattagttcatcccttgttaagcgagtggctcgaattggttctcccccatggcgccaagatgataaagatgggcattatgtgtttgcagttggagataatttaacttctcgatataagattcatggaaagatgggagaaggtacgtttggccaagtattggaatgttgggacaaggaaagaaaggaaatggttgccataaaaattgtccgtggtataaagaaataccgtgaggcagctatgatagagattgacgtgttgcaacagcttggtaaacacgataaaggtggcaatcgttgtgtgcaattaaggaactggtttgactatcgtaaccatatctgtattgtttttgagaagcttggaccaagcttatatgattttctacgcaaaaacaattatcgctcgtttccaattgacctagttcgggagattggcagacaactcttggaatgtatagcatttatgcatgatctgcggctgatacacactgatttaaagcctgagaacattcttctagtgtctggggagtatctgaaagtgcctgattacaagggttcatcgaggtcaccaaaggatgggtctttctctaaaagaatcccaaaatccagtgccatcaaggtgattgactttggtagtacaacatatgaccgtcatgaccagaactacatagtgtccacacgtcattatcgtgcaccagaagttatattaggacttggatggagctacccatgtgatatatggagtgtgggttgtattcttgtggagctttgttcgggtgaagctttatttcaaacacatgaaaacttggaacatctagcgatgatggagagggtccttggcccgttgcctatgcacatgctgaagaaagcagaccgacatgcggagaagtatgttagaaagggtaggttggattggccggagggtgctgggtcaagggagagcattaaagcagttatgaagctacctcggcttcagaacttgataatgcagcacgtagaccattcagcaggtgatctgattcatgtgttgcaagggcttttgaggtatgatccttcggaaagattaacggcacatgcggctctacggcatcctttcttcaccagggatcattttagacggtattaatggcagtggcatgtagatagagagatgtttggtcggtcagctaacagcaaccacatttcactagaaggaattccatgtataaaattctaacattcaacagttgggatgtggtttatgtgttctgtaatttctgatgttgtgctaaaagcagctgggtttcattacgatctgtttttgaggtcttgatgaaattgtttgaattttatatacatatgttatctcttcttgaagcaaatctttgtatttggcttcaatttatgaatatcaaagttaatcatatgcatgatttgttgatcatcaaaaaagagattaataataaaatccaagaggcattaagcctaac

SEQ ID NO: 7393 - DNA, 1613 bp, Cirsium arvense
tcgacataaacaaagtattaccctttttcgaaattcatccatctgaaaccctaatctgttcttatagatcaatcaatcgatcaatcaatcgatcaatcatcgattgtttttgttgaaattcgcatctggatatggagatggagcgtgttacggagtttccgatgactcaattggacatcaggccgaggaaacgacagcgtttgggctgggatgtggttcctcaaccgcctaaggctcagctaggattgttttgtggacaagagattggaaatctgaccagctttgcacctacgcgggcaccgtcagaccatattagttcatcccttgttaagcgagtggctcgaattggttctcccccatggcgccaagatgataaagatgggcattatgtgtttgcagttggagataatttaacttctcgatataagattcatggaaagatgggagaaggtacgtttggccaagtattggaatgttgggacaaggaaagaaaggaaatggttgccataaaaattgtccgtggtataaagaaataccgtgaggcagctatgatagagattgacgtgttgcaacagcttggtaaacacgataaaggtggcaatcgttgtgtgcaattaaggaactggtttgactatcgtaaccatatctgtattgtttttgagaagcttggaccaagcttatatgattttctacgcaaaaacaattatcgctcgtttccaattgacctagttcgggagattggcagacaactcttggaatgtatagcatttatgcatgatttgcggctgatacacactgatttaaagcctgagaacattcttctagtgtctggggagtatctgaaagtgcctgattacaagggttcatcgaggtcaccaaaggatgggtctttctctaaaagaatcccgaaatccagtgctattaaagtgatcgactttggtagtacaacatatgaccgtcacgaccagaactacatagtgtccacacgtcattatcgtgcaccagaagttatattaggacttggatggagctacccatgtgatatatggagtgtggggtgtattcttgtggagctttgctcgggtgaagctttattccaaacacatgaaaacttggaacatctagcgatgatggagagggtccttggcccgttgcctatgcacatgttgaagaaagcagaccgacatgcggagaagtatgttagaaagggtaggttggattggccggagggtgctgggtcaagagagagcattaaagcggttatgaagctacctcggcttcagaacttgataatgcagcatgtagaccattcagcaggtgatctgattcatgtgttgcaagggcttttgaggtacgatccttcggaaagattaacagcacatgcagctctacggcatcctttcttcaccagggatcattttagacggtattaatggcagtggcatgtagatagagagagatgtttggtcggtcagctaacagcaaccacatttcactagaaggaattccatgtataaaattctaacattcgacaggtgggatgtggtttatgtgttaatttctgatgttgtgctaaaagcagctgggtttcattacgatctgtttttgaggtc

SEQ ID NO: 7394 - DNA, 1956 bp, Cirsium arvense
aatcaagtggtaagggattgatttatgcatattgaaaggacataacaagattacctttttcgaattcatccatctgaaaccctaatctgttcttatagatcatcaatcatcgattgtttttaggtgaaattcgcatctggatatggagatggagcgtgttacggagtttccgatgactcaattggacatcaggccgaggaaacgacagcgtttgggctgggatgtggttcctcaaccgcctaaggctcagctaggattgttttgtggacaagagattggaaatctgaccagctttgcaccttcgcgggcaccgtcagaccatattaattcatcccttgttaagcgagtggctcgaattggttctcccccatggcgccaagatgataaagatgggcattatgtgtttgcagttggagataatttaacttctcgatataagattcatggaaagatgggagaaggtacgtttggccaagtattggaatgttgggacaaggaaagaaaggaaatggttgccataaaaattgtccgtggtataaagaaataccgtgaggcagctatgatagagattgacgtgttgcaacagcttggtaaacacgataaaggtggcaatcgttgtgtgcaattaaggaactggtttgactatcgtaaccatatctgtattgtttttgagaagcttggaccaagcttatatgattttctacgcaaaaacaattatcgctcgtttccaattgacctagttcgggagattggcagacaactcttggaatgtatagcatttatgcatgatctgcggctgatacacactgatttaaagcctgagaacattcttctagtgtctggggagtatctgaaagtgcctgattacaagggttcatcgaggtcaccaaaggatgggtctttctctaaaagaatcccaaaatccagtgccatcaaggtgattgactttggtagtacaacatatgaccgtcatgaccagaactacatagtgtccacacgtcattatcgtgcaccagaagttatattaggacttggatggagctacccatgtgatatatggagtgtgggttgtattcttgtggagctttgctcgggggaagctttatttcaaacacatgaaaacttggaacatctagcgatgatggagagggtccttggcccgttgcctatgcacatgttgaagaaagcagaccgacatgcggagaagtatgttagaaagggtaggttggattggccggagggtgctgggtcaagagagagcattaaagcggttatgaagctacctcggcttcagaacttgataatgcagcatgtagaccattcagcaggtgatctgattcatgtgttgcaagggcttttgaggtacgatccttcggaaagattaacagcacatgcagctctacggcatcctttcttcaccagggatcattttagacggtattaatggcagtggcatgtagatagagagagatgtttggtcggtcagctaacagcaaccacatttcactagaaggaattccatgtataaaattctaacattcgacaggtgggatgtggtttatgtgttaatttctgatgttgtgctaaaagcagctgggtttcattacgatctgtttttgaggtcttgatgaaattgtttgaattttatatacatatgttgttatctcttcttttttggttttaaaataaacttgtttaattccgaataccgtacaatcactcatgcataacatacaagtaatgccaacacacacaaagccatctagtattcacacaaaagactctggaaaaagaagcacggttttaacaaaagggaaaacgctcggtgccttttagattgtttatggacggcgtcgttttgttactttttcatattccctacgaaatacacctcatggagtacatggccacagggggaatcaaccgcgggcgcaccataaactctagggtggtcac

SEQ ID NO: 7395 - DNA, 1518 bp, Cirsium arvense
gaattcgtttatctgaaaaactattcaactctttttttagatcaatcatcgagtgttttgttgaaatcgcatctggatatggagatggagcgtgttacggagtttcccatgagtcaattagatatcaggcctaggaaacgacagcgattgggttgggatgtggttcctcaaccaccgaaggctcagctaggattgttttgtggacaagagattggaaatctgaccagctttgcaccttcgcgagcaccgtcagaccatattagttcatcccttgttaagcgtgtggctcgaattggttctcccccatggcgccaagatgataaagatggacattatgtatttgcagttggagataatttaacttctcgatataagattcatggaaaaatgggagaaggtacgtttggccaagtattggaatgttgggacaaggaaagaaaggaaatggttgctataaaaatcatccgtggtataaagaaataccgtgaggcagctatgatagagattgacgtgttgcaacaacttggtaaacacgataaaggtggcaaccgttgtgtgcaattaaggaactggtttgactatcgtaaccatatctgtattgtttttgagaagcttggaccaagcttatatgattttctacgcaaaaacaattatcgctcgtttccaattgacctagttcgggagattggcagacaactcttggaatgtatagcatttatgcatgatctgcggctaatacacactgatttaaagccagagaacattcttctagtgtctcgggagtatctgaaagtgcctgattacaagtgttcatcgaggtcaccaaaggatgggtctttctccaaaagaatcccaaaatccagtgctatcaaggtaatcgactttggtagtacaacatatgaccgtcaggaccagaactacatagtttccacacgtcattatcgtgcaccagaagttatcctaggacttgggtggagctacccatgtgacatatggagtgtgggttgtattctggtggaactttgctcaggtgaagctttattccaaacgcatgagaacttggaacatctagcaatgatggaaagggttcttgggccattgcctatgcatatgttgaagaaagcagatcgacatgccgagaagtatgttagaaagggaaggttggactggcctgagggtgctggttcaagagaaagtattaaggcggttatgaagctacctcggctgcagaacttaatcatgcagcatgtagaccattcagccggtgatctgattcatgtgttgcaagggcttttgaggtatgatccttctgaaaggctaacagcacatgcggcattaagacatcctttctttacaagggatcatcttagacggtattaatggcagttgtggtgtctgtatgtagatagagatatatttggtcagctaacagctacctaaatcttactgggcaatttatgtacaatagctaactttgggtatttggtaatctctaatacagcagttggtgaatcttat

SEQ ID NO: 7396 - DNA, 1628 bp, Tragopogon dubius
acagatctacgcaatacaatatcatctctctgaaaacatcgccagttttctatacatcaattaacgagtgtttttgtcgaatcggatacgatcatggagatggaacgtgttaccgagtttcccatgggtcaattggacctcaggccgaggaagcgacagagactgggctgggatgtggttgctccaccgccgaaggctcaggtaggattgttttgtggacaagagattggaaatgtgacgggctttgcacctcagctggaccatattagttcacctcttgttaagcgagtggctcgtaatgattctcccccatggcgccaagatgataaagatggccattatgtttttgcacttggagataatttaacttctcgatacaagattcatgggaaaatgggagaaggtacatttgggcaagtattggaatgttgggacaaggaaagaaaggaaatggtggcgataaaaatcgtacgtggtataaagaaataccgcgaggcggcaatgatagagatagacgtgttacaacaactcggtaaacatgacaaaggaggcaatcgttgtgtgcaattaaggaactggtttgactatcgtaaccatatctgtattgtttttgagaagcttggaccaagcttatatgattttctacgcaaaaacaattatcgctcatttcccattgacctagttcgggagattgccagacaactcttggaatgtattgcatttatgcatgatttacggttgatacacactgatttaaagccagaaaacatacttctagtctcttctgagtatcttaaagtttctgattacaagggttcttcgaggtcaccaaaggatggttcttattcaaaaagagtaccgaagtcgagtgctattaaggttattgactttggtagtacgacatatgaccgccaggatcagagttatatagtgtcaacacgccattaccgtgcacctgaagttattttagggcttggatggagttacccatgtgacatatggagtgttggttgtattctggtggagctttgctcgggtgaagctttgttccaaacacatgagaacttggaacatctcgcaatgatggagagggtacttggcccattgcctacccacatgttaaagaaagcagaccgacatgcggagaaatatgtgagaaagggaaggttggattggccagaaggtgcgacttcaagagaaagtattaaagcggttatgaagttacctcggcttcagaatttgataatgcaacatgtagaccattcggctggggatttgattcatttgttgcaagggcttttgaggcatgatccgttggagaggctaacagcatcggaggctttgaggcatcctttttttacaagggatcatcttaggcggtattaggggcggtttggtcaaatgtgtacataatttacccttaatgggtttttggatattatagggatagtgtcataactcattgaccttgatgtataaatagtagagggatggatgtaattctggagatgtcgttttatggacctgataatctgtttgaagtttttttggttatcgactttgtttatatgggtaatatacatgaaatgtcactctattatctgtttgagacaaaaaaaaaaaaaaaa

SEQ ID NO: 7397 - DNA, 1693 bp, Malus domestica
atcttttatctcccgatctgcgatcatggagaccgagcgcgtgacggagtttcctttcgctcacttggatcgccgccctcgaaagagggcgcgtttgggctgggatgttcctcaggccccaaaggctcaggtaggaatattttgtggacaagagcttgggaatgtgacaagctttgcatcattcgtggcacctgcagagcccactactatttctctatttgataaggaagtggctcgaaatggttcccccccatggagagaggatgacaaagatggacattacatgttttcgcttggagaaaatttaacatctcgctacaaaattcagagcaaaatgggtgaaggtacctttggccaggtgttggaatgctgggacagagaaagaaaggaaatggttgcaataaaaattgttcgcggcattaagaaatatcgtgaagcagcaatgatcgaaattgaagtgctgcaacagcttggtaaacatgataaagggggcaaccgttgtgtgcaattacggaactggtttgactatcgtaaccatatctgtattgtatttgagaagcttggaccaagcttatacgattttctcaagaaaaacaattaccgctcatttcccattgaccttgtccgtgagattggcagacaactcttggaatgtgtagcatttatgcatgatcttcgtcttattcataccgacttgaagccagagaatatactccttgtttctcaggattatattaaagttcctgattacaataagagctcatctcgatcacccaaagatagctcctattttaagagaataccaaagtcgagtgctattaaggttattgattttggtagcacaacttatgagcgtcaagatcaaacctatattgtatcaacacggcattatcgtgcaccagaggtgattctcgggctgggatggacctacccttgcgatgtatggagcattggttgtatcctggtggagttgtgcacgggcgaagccctgtttcagactcatgagaatttggagcacctcgccatgatggaacgggtacttggaccccttccccagcacatgttgaagagagcagaccgacatgctgagaagtatgttaggaggggtagattagattggccggagggtgcagcatctagagagagtatcagagctgttcagaagcttcctcggcttcagaatctcataatgcagcatgtagaccattccgccggggaccttattcacctcctgcagggtctgcttaggtacgacccctcggataggctttcagctcgtgaagccctccgacattcttttttcaccaaggacagtctaaggagatgagttttttctcgtttttgcgttctgccgagtgaagtgtacattgtatatgcgtgagatttacgctaggtgtcatccgtaacttccagtagatgtccaattgcaaacattaccattacggagggaggggtggacgcacccgctattccagttgcgctgcacgcggccgatctatgtagtgtaaaagtctgctaaccaaactctgcattgtacagaaatgacattttgtaagaaataaattcttcattatcctgcgtcttcatgttttcgcccaagtacggttcttgattgcttgcttgcaaagcaagatatgtccatacactttcctttgtacccaagtaatgaccgtaccacttgctccccagtgaa

SEQ ID NO: 7398 - DNA, 1867 bp, Brassica rapa
cttctctttcgcctctggtttaaaactagggttaggccacgattctgttttacccaaaagcttatctccatcgccgtttggctctctgaaaaaaatcatcctattagttttctcgttgctcgatccgttcgaatccgtgattatggagatggagcgcgttcacgagtttcctcacacacacatggatcgccgtccccgaaagagagcgcgtctcggctgggacgtgttgcctacagcgcctaaggctcaggtaggaatgttttgtggacaagagattgggaatttgtcaagctttggagctccttcggagattagtagctcttctctttctgttaagactgttgctcgtaatgattctcccccgtggcgtgaagatgacaaggatggacattacatgtttgaactgggagatgacttaaccccacgctataaaatatatagcaagatgggagaaggtacctttggtcaagttttagaatgttgggatagggagaggaaagagatggtggcagtgaaaattgttcgtggagtgaagaagtaccgggaggcggctatgattgaaattgagatgcttcagcagcttggtaaacatgacaaaggtggcaatcgttgtgtacaaattcggaactggtttgactatcgtaaccatatatgtatcgtatttgagaagcttggatcaagtttatacgattttcttcggaaaaacaattatcgctcctttcccattgatcttgtccgtgagattggctggcaactcttggaatgtgtagcatttatgcatgacttgcgcatgattcataccgacctgaaaccagaaaatattctcttagtctcctcagactatgtgaaaattcccgagtacaagggttcccgattacagagggatgtttcgtataaacgagtgcctaaatcaagtgcaataaaggttattgattttggtagcacaacttatgagcgacaggaacagagctacattgtgtcaactagacattacagggcaccagaagtcattttaggtcttggctggagttatccttgtgatgtttggagcattggatgtatcatagtggagctgtgcacgggagaagcattgttccaaacacatgaaaacctggagcatctagcgatgatggagcgtgttcttgggccgcttcctcagcaaatgctgaagaaagtggaccgacacgcagagaaatatgtgagaagaggtcgtttagattggcccgatggggcaacctcaagagacagccttaaagcagtattgaagcttcccaggcttcagaatctgataatgcaacatgtggaccattcggcgggagatttgataaacatggtgcaaggtctgcttaggtttgatccggcagaaagactgaccgctcgtgaagcattgaggcatccttttttcgcaaggagaagatgacgacgtgaccttgaatttgacgacgaggagtgttgtatatagtgagatgtatgtttgtagtagtaataactagtaaaacctttacgaaatggtggtgttacgtgacaaccctctacgaattctgatattattaattaaaacaaatgctttgaatcagtcttttttgaagtgaagagcgattatttgtctatcatctttgtttcataaagtttttgttcgtttatcgtccgagttcaaggtacattaatctaactgtgtaacatggacaataaagagccagaaaatgaatgtattattttcattgaaattattataagctgccgcgtatatggagtaaacgtattcatattgatcaatgagccggccaaatgacaagaaaattaaatgaataaaataaactttactcaccctaatttttgtttagtttattaaaactctggcaggccc

SEQ ID NO: 7399 - DNA, 1503 bp, Brassica napus
atcgccgtttggctctctgaaaaaaatcatcctattagttttctctttactcgatccgttcgaatctgtgattatggagatggagcgcgttcacgagtttcctcacacacacatggatcgccgtccccgaaagagagcgcgtctcggctgggacgtgttgcctacagcgcctaaggctcaggtaggaatgttttgtggacaagagattgggaatttgtcaagctttggagctccttcggagattagtagctcttctctttctgttaagactgttgctcgtaatgattctcccccgtggcgtgaagatgacaaggatggacattacatgtttgaactgggagatgacttaaccccacgctataaaatatatagcaagatgggagaaggtacctttggtcaagtgttagaatgttgggatagggagaggaaagagatggtggcagtgaaaattgttcgtggagtgaagaagtaccgggaggcggctatgattgaaattgagatgcttcagcagcttggtaaacatgacaaaggtggcaatcgttgtgtacaaattcggaactggtttgactatcgtaaccatatatgtatcgtgtttgagaagcttggatcaagtttatacgattttcttcggaaaaacaattatcgctcctttcccattgatcttgtccgtgagattggctggcaactcttggaatgtgtagcatttatgcatgacttgcgcatgattcatacggacctgaagccagaaaatattctgttagtctcctcagactatgtgaaaattcccgagtacaagggttccagattacagagggatgtttcctataaacgagtgcctaaatcaagtgcaataaaggttattgattttggtagcacaacttatgagcgacaggaacagagctacattgtatcaactagacattacagggcaccagaagtcattttaggtcttggctggagttatccttgtgatgtttggagcattggatgtatcatagtggagctgtgcacgggagaagcattgttccaaacacatgaaaacctggagcatctagcgatgatggagcgtgttcttgggccgcttcctcagcaaatgctgaagaaagtggaccgacacgcagagaaatatgtgagaagaggtcgtttagattggcccgatggggcaacctcaagagacagccttaaagcagtattgaagcttcccaggcttcagaatctgataatgcaacatgtggaccattcggcgggagatttgataaacatggtgcaagggctgcttaggtttgatccggcagaaagactgaccgctcgtgaagcattgaggcatccttttttcgcaaggagaagatgacgacgtgaccttgaattcgacgacgaggagtgttgtatatagtgagatgtatgtttgtagtagtaatatctagtaaaacctttacgaatggtgttacgtgacaaccctctacgaattctgatattattaattaaaacaaatgctttgaatca

SEQ ID NO: 7400 - DNA, 1738 bp, Mesembryanthemum crystallinum
gtgagttctcattctctcatctgccaactttctctctcatcgatcgattctttgctgcgttgattttctctctctagaagaatccctaacatggagatggagcgagtcaccgagtttcctctgactcaccacctggatcgccgacgcaggaagcgtgcgcgtttgggatgggatgttgctcctcagatctctaaggcccagataggtatattttgtggacaagaggttggaaatgttacaagctttgcaccttcagctgcaccttcagaacatactactactactagttccctgttctccaagggagtcgcacgtaatggttctccgcgccaaggagggatgatgacaaagatgggcattacatgtttgagctttggagaaaatttaacttctcgctataagatccacggcaaaatgggtgaaggtacctttggtcaggtattagaatgctgggatcgtgagcggaaggaaatggtggcgataaaaattgtacgtgggattaaaaaatatcgggaagcagccatgattgaaattgatgtgctgcaacagctcggtaaacatgacaaagggggtagtcgttgtgtgcaaatacggaactggtttgactatcgtaaccatatctgtattgtctttgagaaacttggatcaagcttatacgatttcctacggaaaaacaattacggcccatttcccattgatcttgtccgtgagaatggaagacaactgttggattgtgtagcatttatgcatgatcttcatcttatacacactgatttgaagcctgagaatgtgctgttagtctcatcggactatgttaagatccgtgattacaagggcttttctcgatcacctaaagacagctcctattacaaaaaggtgccaaaatcaagtgccataaaagtcattgattttggtagcaccacatatgaacgtccagatcaaaactatatagtttcaacacgccattatcgtgcaccagaggttatccttggtctcggttggagttatccatgtgatgtgtggagtgttggttgcattctggtggagctttgctcaggagaagccttgttccaaacacatgagaacttagaggaccttgcaatgatggagagggtgcttggtccattgccccagcatatgctgaagagagtagatcgacatgctgagaagtatgttagacgaggtagattggactggcctgaaggcgcagcctctcgagagagtattagagcagttaccaaactgctgcgtctacagaacctcgtaatgcagcatgtggatcattcagggggtgattttatccaccttttgcaaggtcttcttagatatgacccatcagaccgactcacagctcgtgaagccgtccgacaccctttttttactcgtgataatttgaggaggtgacaaacaaagtcgtttgcttgaattaggtctcttaacaaattgattacttggctctgagttatcctcggtagatcagcatccaccacactccgggatggtcactcctcgaaagtattgcaaatgagttaatttcaatgactggtgtcgtaacttgccttcaaatttcaacatgtacagttgcaagttcaggtttatggaacaggaaggtgcactgggattgaagatgtatatatatttttgcttacaggtcttgtgtaattgtgtgtgtatccatttttttaactctaaaaatttttgagtgagataataatataaagagggttcttaaaaaaaa

SEQ ID NO: 7401 - DNA, 1586 bp, Malus domestica
atttcccgatctgcgatcatggagacggagcgcgtgacggagtttcctttcgcttacttggatcgccgccctcgaaagagggcgcgtttgggctgggacgttcctcaggccccaaaggctcaggtaggaatgttttgtggacaagagcttgggaatgtgacaagctatgcatctttgatggcaccctcagagaccagtactatttctctatttgataaggaagtgactcgaaatggttcccccccatggagagaagatgacaaagatgggcattacatgttttcgcttggagagaatttaacaactcgctacaaaatccagagcaaaatgggtgaaggtacctttggtcaggtgttggaatgctgggacagagaaaaaagggaaatggttgccataaaaattgttcgtggcatcaagaaatatcgcgaagcagcaatgatagaaatcgaagtgctgcaacagcttggtaaacatgataaaggtggcaatcgttgtgtgcaattacggaactggtttgactatcgtaaccatatctgtattgtgtttgagaagcttggaccaagcttatacgattttctcaagaaaaacaattaccgctcatttccgattgaccttgtccgtgagattggaagacaactgttggaatgtgtagcattcatgcatgatcttcgtcttattcataccgacttgaagccagagaatatactccttgtttctcaggattatattaaagttcctgattacaataagagctcatctcgatcacccaaagatagctcctattttaagagagtaccaaagtcgagtgctattaaagttattgattttggtagcacaacttacgagcgtcaagatcaaacctatattgtatcaacacggcattaccgagcaccagaggttattcttgggctgggatggacctacccttgcgatgtatggagcattggttgtatcctggtggagttatgcacgggtgaagccttgttccagactcacgagaatttggagcacctcgccatgatggagcgggtacttggttccctaccccagcacatgttgaaaagagcagaccgacatgctgagaagtatgttagaaggggtagattggattggccagagggtgcagcttctagagagagtatcagagctgttcagaagcttcctcggctccagaatcttataatgcagcacgtagaccattccgccggggactttattcacctcttgcagggtctgcttaggtacgacccctcggataggctttccgctcgcgaagccctccgacattcttttttcacgaaggacagcctcaggagatgattttattctcggttgcgcttcctgccgagtgaagtgtacattgcgtctgcaccaaaatcgcgataggtatcggcaataactttctgtagatatccaaatacaaacattactatttaccgattgatggacgtccgtatgctattcgagttgcgctgtacctgcggttgatttatgtagtgtagaagtctgctaacccaattgtgcattgtacagaagtgacatttggaataatgaagaaataacttgttactacattatcctgttcg

SEQ ID NO: 7402 - DNA, 1907 bp, Brassica napus
gtaccctacggtcttaacgcgtaaagcgtacactaagctaaaccccgcgtacacaccgtcaacccggaacaagtcggaagtccagggtcaaggcgcgccggaaccgtcttacccggacccggtcgggggccgaagacgacgacgcggtacgtacggtaggacggacgggcggcggcggacggtcgtacgacgacgacgacggacggcggacggaccggcggtacggcggtcggtcgtacgtcgtagtagttacgttaggtagtagtaacgtaacttaacttaacgttaactaagttacgttaacgtttaacgttttaacgtttactttacgttacgtacgtagagcgagcggggtaacgaacccccttcctttttagtacccaaaaagactcatctccatcgccgtttggctctctgaaaaaatcatcctattagttttttctttgctcgatctgttcgaatctgtgattatggagatggagcgtgttcacgagtttcctcacacacacatggatcgccgtccccgaaagagagcgcgtctcggctgggacgtgttgcctacagcgcctaaggctcaggtaggaatgttttgtggacaagagattgggaatttgtcaagctttggagctccttcggagattagtagctcttctctttctgttaagactgttgctcgtaatgattctcccccgtggcgtgaagatgacaaggatggacattacatgtttgaactgggagatgacttaaccccacgctataaaatatatagcaagatgggagaaggtacctttggtcaagtgctagaatgttgggatagggagaggaaggaaatggtggcagtgaaaattgttcgtggagtgaagaaataccgtgaggcggctatgattgaaattgagatgcttcaacagcttggtaaacatgacaaaggtggcaatcgttgtgtacaaattcggaactggtttgactatcgtaaccatatatgtatcgtatttgagaagcttggatcaagtttatacgattttcttcggaaaaacaattatcgctcctttcccattgatcttgtccgtgagattggctggcaactcttggaatgtgtagcatttatgcatgacttgcgcatgattcatacggacctgaaaccagaaaacatcctcttagtctcctcagactatgtgaaaattcccgagtacaagggttcccgattacagagggatgtttcctataaacgagtacctaaatcaagtgcaataaaggttattgattttggtagcacaacttatgagcgacaggaacaaagctacattgtgtcaactagacattacagggcaccagaagtcattttaggacttggctggagttatccttgtgatgtttggagcattgggtgtatcatagtggagctgtgcacgggagaagcattgttccaaacacatgaaaatcttgagcatctagcgatgatggagcgtgttcttggtccgttgcctcaacaaatgctgaagaaagtggaccgacacgcagagaaatatgtgagaagaggtcgtttagattggcccgatggggcaacctcaagagacagcctgaaagcagtattgaagcttcccaggcttcagaatctgataatgcaacatgtggaccattcggcgggagagttgataaacatggtgcaagggctgcttaggtttgatccggcggaaagactaaccgctcgtgaagcactgaggcatccttttttcgcaaggagaagatgacgacgtgaccttgaatttgacgacgaggagtgttgtatatagtgagatgtatgtttgtagtagtaaaaactaaaacctttacgaaatggtgttacgtgacaaccctctacgaattctgatatcattaattaaaacaaatgctttgaatcactctttttt

SEQ ID NO: 7403 - DNA, 1591 bp, Arabidopsis lyrata
ctctggttaaaaactagggttaggctacgattctgtttacccaaaaagctattgtcatcgccgtttggctttctgaaaaatcacaccgattaagattttctctggaattctgagattatggagatggagcgtgtgcatgaatttcctcatactaacatggatcgccgtcccagaaagagagcgcgtctcggctgggatgtgttgcctcaggcaaccaaggctcaggtaggaatgttttgtgggcaagagattggaaatttatcaagctttccatcgtccggagctccttcagacaatagtagctctctttgtgttaagggtgtggctcgtaatggttctcccccatggcgagaagatgataaggatggacattacatgtttgaactgggagatgacttaactccacgctataaaatctatagcaaaatgggcgaaggtacttttggtcaagtgctagaatgttgggatagggagaggaaggaaatggtggcagtaaaaattgttcgtggtgtgaagaaataccgcgaggccgctatgattgaaattgaaatgctgcaacagcttggtaaacatgacaaaggtggcaatcgttgtgtacaaattcggaactggtttgactatcgtaaccatatctgtattgtctttgagaagcttggatcaagtttatacgattttcttcggaaaaacaattatcggtcctttcccattgatcttgttcgtgagattggctggcaactcttggaatgtgtagcatttatgcatgacttgcgcatgattcatacggaccttaaaccagaaaatattctgttagtctcctcggactatgtgaagattcctgagtacaagggctcccgattacaaagggatgtttgctataaaagagtgcctaaatcaagtgcaataaaggtgattgattttggtagcacaacttatgagcgccaggaccaaacctacattgtatcaaccagacattatagggctccagaagtcattttaggtcttggctggagttatccgtgtgatgtttggagcattggatgtatcatagtggagctgtgcacgggtgaagcattgttccaaacacatgaaaacctggagcatcttgcgatgatggagcgtgttcttgggccgtttcctcaacaaatgctgaagaaagtggaccggcatgcagagaaatatgtgagaagaggtcgtttggattggccggatggggcaacctcaagagatagcctgaaagcagttttgaagctccctaggcttcagaatctaataatgcaacatgtggaccactcggcgggggagttaataaatatgttgcaaggacttctgcggtttgatccggcagagagactaaccgctcgtgaagccctgaggcatccttttttcgcaaggagaagatagcgggagttcaatttgacgagtgtaaatagagatgaaatatgtatgatttgtagtaagcatttacctcacaaccccacgaattctgatataaattaacaaatatgcttagatcactctattttaaagtgataggcgattgttgtctatctttgtaaactggatcgttcaaattcaaaagagttttagtttt

SEQ ID NO: 7404 - DNA, 7594 bp, Arabidopsis lyrata
caaattgcattgctctctggttaaaaactagggttaggctacgattctgtttacccaaaaagctattgtcatcgccgtttggctttctgaaaaatcacaccgattaagattttctctggaattctgagattatggagatggagcgtgtgcatgaatttcctcatactaacatggatcgccgtcccagaaagagagcgcgtctcggctgggatgtgttgcctcaggcaaccaaggctcaggtaggaatgttttgtgggcaagagattggaaatttatcaagctttccatcgtccggagctccttcagacaatagtagctctctttgtgttaagggtgtggctcgtaatggttctcccccatggcgagaagatgataaggatggacattacatgtttgaactgggagatgacttaactccacgctataaaatctatagcaaaatgggcgaaggtacttttggtcaagtgctagaatgttgggatagggagaggaaggaaatggtggcagtaaaaattgttcgtggtgtgaagaaataccgcgaggccgctatgattgaaattgaaatgctgcaacagcttggtaaacatgacaaaggtggcaatcgttgtgtacaaattcggaactggtttgactatcgtaaccatatctgtattgtctttgagaagcttggatcaagtttatacgattttcttcggaaaaacaattatcggtcctttcccattgatcttgttcgtgagattggctggcaactcttggaatgtgtagcatttatgcatgacttgcgcatgattcatacggaccttaaaccagaaaatattctgttagtctcctcggactatgtgaagattcctgagtacaagggctcccgattacaaagggatgtttgctataaaagagtgcctaaatcaagtgcaataaaggtgattgattttggtagcacaacttatgagcgccaggaccaaacctacattgtatcaaccagacattatagggctccagaagtcattttaggtcttggctggagttatccgtgtgatgtttggagcattggatgtatcatagtggagctgtgcacgggtgaagcattgttccaaacacatgaaaacctggagcatcttgcgatgatggagcgtgttcttgggccgtttcctcaacaaatgctgaagaaagtggaccggcatgcagagaaatatgtgagaagaggtcgtttggattggccggatggggcaacctcaagagatagcctgaaagcagttttgaagctccctaggcttcagaatctaataatgcaacatgtggaccactcggcgggggagttaataaatatgttgcaaggacttctgcggtttgatccggcagagagactaaccgctcgtgaagccctgaggcatccttttttcgcaaggagaagatagcgggagttcaatttgacgagtgtaaatagagatgaaatatgtatgatttgtagtaagcatttacctcacaaccccacgaattctgatataaattaacaaatatgcttagatcactctattttaaagtgataggcgattgttgtctatctttgtaaactggatcgttcaaattcaaaagagttttagttttcgaccaccctatctatctacaagtagatgtacttttttattgagaaagtgttactcattaatgaatgattttataacaccaagctacgagtgagtgcatgtttttcataaatattagtcagtagatgccaacaaagattgaaaaagcgcatttacatttgaatatattgaagaaatggtataacaagagagatacgttgcaaagaaactctgaaaggccaaaactaattttaaattctcgcaatcgattgcgttacgcaaagaaactcctccattgatgaggcccaggataacccaaaccaaattaactgggtgtttttttttttttttaaatttttttataaggcattcgtcggaaagaaacagcatgtagttagtgtaccagcggaaagaaaactacacgatttgcaagaaatttcccagtttctctgtttatctctgcaattagccaatttccgccttgtccgattctgcttcacctctgctcgttccttgtcctatcctcgcaaagctgtattgtaagcaataggttgatgggttctgcagccagacagcctctcttctcatttggtgttattgctgatgttcagtatgcggatattccagatggccgctcttttttaggtgttcctaggtattacagaaacagcttccttgtcctgcaaagagctgttgaaacttggaaccaacatggtaacctcaaatttgttattaacatgggagacattgttgatggcttttgtcccaaagatcaatccttggctgccactaagaaactggttcgtgaattcgagaaattcaacggtcctgtgtatcatatgattggcaatcactgcctctacaatctcccccgtgaagagttgcttccgttgctcaagatcccaggtcgtgatggcaatgcttattatgatttctcaccaaccccagagtatagaattgtggtgttagattgttatgacatcagtgctcttggatggcctcaggaccatccgaatactatcgctgcattgaaaatacttgaagaaaagaacccaaactcagaaaaaaacagccccgcgggtcttgaggatgttgagaggagatttgtcaagtataatggtggtgttggggagaaacagctgcaatggctagacagtgttcttcaggatgcaacgaattcaaatcagagagttatcgtatgtgggcatgtgcctatgagccctggtgtggcatccaaagcagccttgttatggaattttgatgaagtgatgaacattatacacaagtatgactctgttaaagtttgtttgtccggacacgatcataaaggaggatactttgttgattttcatggggttcaccatagatctttggaagctgctttggagtgccccccaggtacgtattcgtttggatatattgatgtatatgagaacaagttatctcttgttggtactgatcggatgccaagcactgattttgaaagctagagttttcctgaatgatcaattatctgaaattcagaatttgtaatcacaatccctatttatatgatgattgttttgttttgattgtactatcatacggctgcacctgaatgtactaatatgtatttggggcttttcgaataagatgaatataagtttcaattgattggatacaagttattttaaagaacttccataagttcttaataaggaatctatatcagattatctgttttggatttagttgttctattaaaggaaatctctacataaaggtatccctttgtagtgtctagctgaattttgtgtgtacctctgtgttcagctgatgaacttatgtttgtcaagtcatggttccttaatagattcagtgcagatgacataagaaacatagataagatttggtgttaattgtagtttggatgcattattaacggttagagcttgattagcagaccaattagtgttgttatgttgattagatcaagtgttcagatgaaactagatggttttctgttgactgaatttctgaaactgctcgagtgttttgaaagaactccaattcatggaggcaagtgatgttaagggcgctaaatggaaggaaaggattgatttttagtttatggttaacagcttggactatgagatggtcatcttgattcagatgaatgtgtactgaaatggtctcaacaaggcgcatgagttcggttgcaaaggaaatacattgttttatgttgcaattgcaaaatgtcactaaagagtgaagagtgaagagtgaagagtgaagaaacatgagatgtaagtgattatgattccgagtttagtaattccctaggaagaagggaaagtgtagctgtcgtgctgaatcgttttggtgagtctacacttcacagaagttcttgatggggttgaatcgaataataagcagttgcaatccggtttgtaacattcacaagtgtttgattcaaaaatgctgcctaaaccaacatcacaaagagaatttattgggagactgctttagctagcaaacttagtgagtaagtgagtacttgttctagagatattatatctagcacaaattttgatggaccaacaatcaatctcagccaaccttatatacttcaatttcgctactcaattttttttgtctaagtgatatgaaccttaattacatgggacggtgaagtcttctaatttataaaattctaaatagatagcaagggcatatttgcgttgcgttaatgcttggatgttgattagagaaaaaagtttatagataagttaaccataatgaatgttatgtgatatgacctagattcggatgtttgattttgggattgggatctaagtaggtctaattggtacgatgaagataaaattgagtattgttttcagtgcctaacaatattagattgttgataaaaaaaatatattattaaaatttaagatagggatctaattaggtctaattggtatgatgagaaattaaaaaaaataaaaattattggcactattttccgcgcctaaacattattaggtttccggatttggatataagtaggtctaattggtagggtcaggagttttgttttttctttcattattgggcattgttgaacattatttgataagtcaattttgtttgtgtcgactaccgagtaatgggcctaaaaatttccttaaattatgcgcactaaatgatcgtcggttcaaattgtggcgtttagtggcatataagtatataaagatagttgactatatgcatactataaatgtgagacacacgtgtgacattctcataacttttctcttcgtcccacttctcatattctcagtcacggagtcgagtcgtgaaagaaacaaagatacgctcttcaccgaactccaaaactcaatcgaggtcaccgctaaacttgtaaaagatagtggaggtttgtgaatcgccttacctttttttatataactcaaagattttgtaccttcaatctataattttttgaaacctgtgagttaagggcttactttttgaagtctaggctctaactgtaggtaagtatagagatatatgacctaattagattatctaattatgctctagacttttttttggatatacatgattcatgattcatctcaatactattttattaaaaaaatttctaattgataacaagtaattgtgttgtgttaatgcttggatgtccatgagtaaaaaaagtttatagataaattaatcgtattgagtgtgatgtgatatgacctagattcgaatgtctaattttcggattgggatctaagtaggtctaattgtacgatgaggaggttttttgggtattgttttccgtgcctgaacattattagattgttgataaaaagtttttttattagaatttcagatagggatctaattaggtctaattggtattatgaagaattttgtttttttgttttttttttttttttttttaaaaaaattcttggcattgttttccgcccctaaacattattaggtttctggaatgggatataataactggtatggtgaggaattttgttttttttttcattcttgggcatttttttcgtgactgaacattatttgataagtcaattttgtttgtgtcgactaccgagtaatgggcctaaaaatttccttaaattatgcgcactaaatgatcgccggttcaaattgtggcgtttagtggcatataagtatataaagatagttgactgtatgcatactataaatgtgagacacacgtgtgacattctcataacttttctcttcgtcccacttctcatattctcagtcaccgagtcgagtcgtgaaagaagcaaagatacgctcttcaccgaactccaaaactcaatcgaggtcaccgctaaacttgtaaaatatagtggaggtttgtgaatcgccttacttttttttttataactcaaagattttgtaccttcaatctataattttttgaaacctgtgagttaagggcttaccttttgaagtctaggctctaactgtaggtaagtatagagatatactatgacttattttattgaaaaatagttattttcgtttatacatctctagactttttttcggatatacatgattcatgattcatctcaatactattttattaaaaaaatttctaattgataacaagtgcataattgtgttaatgcttggatgtccatgagtaaaaaaagtttatagataaattaatcgtattgagtgtgatgtgatatgacctagattcgaatgtctaattttcggattgggatctaagtaggtctaattgtacgatgaggaggttttttgggtattgttttccgtgcctgaacattattagattgttgataaaaagtttttttattagaatttcagataggaatctaattaggtctaattggtatgatgaaatttttttttttttttttaattcttggcattgttttccgcccctaaacattattaggtttctggaatgggatataataactggtatagtgagaaattttgttttttttttcattcttgggcattgtttttcgtgactgaacattatttgatagtcaactatgtttgtgtcgactaccgagtaatgacgcctgcaattttccttaaattattcatactaaataatcgccggttcaaatagtggcgtctagtggcatttatgtatttaaagataattgattgtatgcatactataaatgtgagacacacgtgtgacacacatttatttatcctcccttaccagaatcacattctctttcagatcatgaacatccatactctcctcttcgtctcagtcctcatattctcactcaccgagtcgagtcgtggaagaaacaaagatagactcttcaccgagctccaaaactcaatcgaggtcaccgctaaacctgtaaaagatagtggaggtttgtgaatcgtcttactttttttataaaataaagattatgtaccttcaaattcattctgtaaacttttgaaatttgtgagttaagaatcttaccttttgaagtctaggctctaactgtaggttaattatagagatatataacctattttattgaaaaaaagttattttcgtttatacatctctagacctttttttgggatatgcatgattcatggttcatttccatattattttattgaaaaaattattaatatttatactttaaatttgtacatgggtctctatagttttagaaggtggaaaagatatggtgacaattacatggaagctaaagtcgtcaaccaaggtcgacatggatgctgccttcaagacaatccaaatcaagctttgttatgcaccgatcagccaagttgatagaccatggcggaagtctgataacaaactctctaaggacaatagttgccctcacgagattgtgtccaagccatacgacatgaccccccaatcactcgattggaccgtcgaacgtgatatccccactggaacctatttcgtacgtgcctatggaattgatggagatggccacgaagtagca

SEQ ID NO: 7405 - DNA, 1700 bp, Nicotiana benthamiana
aatattagttggataacctagggtttgtggtttcgcatcaacaactttctgcgcaattgttttctctctctaaagactttttctctctctagattttgcaagctttcagcgatggaaatggaacgcgttaccgagtttccgttaactcatcacctggaccggcggccaagaaagagggcgcgtctgggatgggatgttcttcctgttgaaccgcctaaggctcagctaggattgttttttggacaagaggttgggaatgtgacaagctacgcaccttcaaggaaactcacagaccttacttgcacaccctttattaagggagtgactcaaaatggttctcccccttggagagaagatgacaaagatggccattttgtttttgagctgggagaaaatttaacatcacgctataaaattcacagtaagatgggtgaaggtactttcggtcaggtcttagaatgctgggatcgtgagaggaaagaaatggtggctattaaaattgttaggggcatgaagaagtatcgtgatgctgcaatgattgaggttgaaatgcttcaacagcttggtaaacatgacaaagggggcaatcgttgcgtacaaatacggaactggtttgactatcgtaatcatatctgtattgtctttgagaagcttggaccaagcttatacgatttccttcggaaaaacaattaccgctcgtttcccattgatcttgtccgtgagattggaagacaactgttggaatgtatagcatttatgcatgatttgcgcctgatccatactgacttgaagcctgagaacattcttctcaactcctcagaatatgtgaaggttcctgactacaaggtttcttcaaggtcaccaaaagatggttcttactataaaagaattccaaaatcaagtgctataaaggtaatagattttggtagcacgacttatgatcgtcagaatcagacgtatatagtatcaactcgtcattaccgtgcacccgaggttattctagggcttggatggtcataccaatgtgatatatggagtgttgggtgtatcctggtggagctatgttcgggagaagcattgtttcaaacacatgagaatttagaacaccttgctatgatggagaaggtattgggtcccctgcctcagcacatactgaaaagagtggatcggcaagctgaaaagtatgttagaagaggacgtttagactggcccgaaggagcaacatctcgtgacagtatcaaagctgtgttaaagttggcccgccttcagaacattgtcatgaagcatgtggatcattctgctggagatcttattaatcttttgcaaggacttcttaggtatgatccttcagaaaggttgactgctcgtgaagccttgcggcatccattcttcacccgcgatcatcttaggaggtagaagattttccctttgcatgatgaagctccaaacttgaatgctattgctgtgtgacttgaagtagagcaagctctgttggttcggctcagtctacacaatctcgcaatgtaaagagctccaaaaatttactgggttcttgcggggttttgtacactagtcatggtgatggtggaagtcatgcctgtgtatataatagttaacccttgattaactaacaaaatgtaattagatttgagcattgcttctaatttgagctgttgtgagatcaccgtttgctaaaagtt

SEQ ID NO: 7406 - DNA, 1633 bp, Eutrema parvulum
ctctggtttaaaactagggttaggctgcgattctgttacccagaagctttttcgccatcgccgtttggcactctgaaaagcatctgaattaaatttctttgtctttgtttagctcaattcgcctgaatctgtgattatggagatggagcgcgtgcgtgagtttcctcatactcatatggatcgccgtcccagaaagagggcgcgtctcggttgggacgtgttgccttcggcgcctaaggctcaggtaggaatgttttgtgggcaagagattggaaatatgtcaagctttgcatcgtccggagctcctgcagacattagtagcacttctctttgtgttaagggtgtagctcgaaatgattctcccccatggcgagaagatgacaaggatggacattacatgtttgaactgggagatgacttaactccacgctataaaatatatagcaaaatgggagaaggtacctttggtcaagtgttagaatgttgggatagggagaggaaagaaatggtggcagtaaaaattgttcgtggagtgaagaaataccgtgaggcggctatgattgaaattgaaatgctgcaacagcttggtaaacatgacaaaggtggcaatcgttgtgtacaaattcggaactggtttgactatcgtaaccatatatgtatcgtatttgagaagcttggatcaagtttatacgattttcttcggaaaaacaattatcgctcctttcccattgatcttgtccgtgagattggctggcaactcttggaatgtgtagcatttatgcatgacttgcgcatgattcatacggaccttaaaccagaaaatattctgttagtctcctcagactatgtgaaaattcctgagtataagggctcccgattacaacgggacgtttgctataaaagagtgcccaaatcaagtgcaataaaggttattgattttggtagcacaacttatgagcgacaggaccaaaactacattgtatcaacaagacattacagggcaccagaagtcattttaggtcttggctggagttatccttgtgatatttggagcattggatgtatcatagtggagctatgcacgggagaagcattgttccaaacacatgaaaacctggagcatctagctatgatggagcgtgtacttggtccgttccctcaacaaatgctgaagaaagtggaccggcatgcagagaagtatgtgcgaagaggtcgtttggattggccggatggggcaacttcaagagacagcctgaaagcagtgttgaagcttcctcggcttcagaatctgatcatgcaacatgtggaccactcggcgggggagttgataaacatggtgcaagggctgcttcggtttgatccggcggaaagactaaccgctcgtgaagcactcagacatccttttttcacaaggagccacttgagaagatgacatgtcctacaatttgacgagtgtatatagtgagatatttatgtagtatctagcaacaaacatttaccataaacgtgacaacaccacgaattcttctgatattaattaaacaaatgcttaaatcactctttttaaagtgaaaggcgatcatttgtctattttgttctgaatggctgtctttatttatcgtccgaattcaaa

SEQ ID NO: 7407 - DNA, 1601 bp, Panax ginseng
atttgtcgttcgattatcgctctaattttgatatcttttctcttgaattcaacctttgtttctctgtattgatcatggagatggaacgtgtggttgagtttccccacgcgcatatggatcggcgaccgagaaaaaagcagcgtttaggctgggatgttgttcctcaggcccccaaggctcagctaggattgttttgtggacaagaggttgggaatgtgaccagctttgcatcaaaggcacccacagaccatactagttcttctctgttggttaagggagtggctcgaaatggttctcccccacggcgagaagatgacaaagatggacattatatgtttgcggttggagataatttaacatctcgctataagattttcagcaagatgggggaaggcacctttggtcaggttttagaatgctgggataaagagaggaaagaaatggttgctattaaagttgttcgtggcattaagaaatatcgtgaagcagcattgattgaagttgatgtcctgcaacagcttggtaaaaatgacaaagctggcaatcgttgtgtgcaaataaggaactggtttgactatcgtaaccatatctgtattgtctttgagaagcttggcccaagcttatacgattttcttcggaaaaacaattatcgctcctttcccattgatcttgtccgtgagattggcagacaactgttggactgtgtagcattcatgcatgacttgcgcctcatacacactgatttgaagcctgagaacattcttcttgtgtctcccgaatacattaaagttcctgactacaagggttcttcccgattacctatggatggttcatattttaagagagtacctaaatcaagtgccattaaagtaattgattttggaagcacaacatatgatcgtcaagatcaaacttatattgtttcaacacggcattaccgtgctcctgaagttattttaggacttggatggagttacccttgtgatgtatggagtgtaggttgcatcctggtggagctttgctcaggagaagcattgttccaaacacatgagaatttagagcaccttgccatgatggagagggtacttggtccaattccacagcacatgttgaaaagaatagaccggcatgcagagaaatatgccaggaagggcaagttggactggccagagggtgcagcctctagagaaagcatcaaggccgttttgaagctgccacgtctccagaacctaataatgcaacatgtagatcattcagctggtgatctcatacatctactacaggggctgctgagatatgatccatctgaaagatcgacggcacacgaggccctcaggcacccatttttcaccagggataatctcaggagatgatagtcagtcagcgagataagctttgtttgtaaccaaggcataacagaagtggtataaagtttcttgtatgggcataataatagaggtggatcaaaactgtcgccaaatcatgtcccaagaaggcaagaaggaaaagctggattactttgtattattgtaaatgtgttcatataatagagtttttcaaaatttgttgtccaattttgtacttcttgtaccaactgactt

SEQ ID NO: 7408 - DNA, 1799 bp, Theobroma cacao
acgggaataacacgaatttaacaaatcgtacattagcatattcggtcaaacaaagggcaagactcgtgacacgtgtacggctagatataatcacaaccgactccactcctttgattgttaggttataaactagggtaaggttcttcccgttttcttcacgaaaagaaaaccttatcatcttcttctgcctttttttatcgtaaaaaaaggaaaaatattgttttcgattttctaacactttctcgaggtaaaaggaatttgcttgtctagatctaggtgttgcgatcatggagatggagcgtgtgacggagttccctcatacgcatatggatcggcgacctagaaagaggccgcgattgggctgggacgtaactcagttgccgccgcaggcccaggtaggaatgttttgtgcacaagaggttgggaatctgacaagctttgcctcttccactgcaagagcaccctcagattatactagtactattactactagttcttctctagttgtaaagggaggagtggctcgaaatggttctcccccatggcgagaagatgacaaggatgggcattacatgtttgagcttggagataatttaacctcccgctataagatacaaagtaaaatgggtgaaggtacctttggtcaagttctagaatgctgggatagggagacgaaggatgtcgtggccatcaaaattgtccgtggaattaagaaatatcgtgaagcagccatgatagaaattgagatgctgcaacagcttggaaaacatgataaagggggcaatcgttgtgtgcaaatacggaactggtttgactatcgtaaccatatctgtattgtctttgagaagcttggaccaagcttatacgattttctacggaaaaacaattatcgctcatttcccattgatcttgtccgtgagattggcagacaactattggaatgtgtagcatttatgcatgatttgcatctgatacacacggacttgaagccagaaaacattcttctagtctctccagagtatgttaaagttcctgattacaagagtacatcacgatccccaaaggataattcttactttaaaagattaccaaagtcaagtgctattaaggtaatagattttggtagcacaacttacgagcgtcaagatcagacttacattgtttccacgcggcattatcgtgctccggaggttattcttggacttggatggagttatccgtgtgacatatggagtgttggttgcatcttagttgaattatgcacgggtgaggcgctgttccaaactcatgagaatttggagcaccttgccatgatggagcgggtgttaggtccactacctcagcacatgttgaagagagtagaccgacacgcagagaagtatgttagaaggtgtagattggattggccagatggtgctacctcaagtgggagtatcaaagctgtgcttaagctacctcgtctgcagaacctgataatgcagcatgtggaccattcagccggggatctaattcatctattgcaaggattgcttaggtatgatcctattgataggcttacagctcgtgaagcactgaggcatccctttttcagtagggaccaatttaggagatgagcatggaattgggttggtagacaatgtctcagcttgtaaagtttttctaacaagaactgcttcttacgttagcaccatcttgtgcgacaagctgtattgtggtgcaagctaacagattatcaccaagtcaaatggtttcatgtatcgtttgttagattcaataaaattttagaatttgttgtgtcc

SEQ ID NO: 7409 - DNA, 1627 bp, Theobroma cacao
ccttatcatcttcttctgcctttttttatcgtaaaaaaaggaaaaatattgttttcgattttctaacactttctcgaggtaaaaggaatttgcttgtctagatctaggtgttgcgatcatggagatggagcgtgtgacggagttccctcatacgcatatggatcggcgacctagaaagaggccgcgattgggctgggacgtaactcagttgccgccgcaggcccaggtaggaatgttttgtgcacaagaggttgggaatctgacaagctttgcctcttccactgcaagagcaccctcagattatactagtactattactactagttcttctctagttgtaaagggaggagtggctcgaaatggttctcccccatggcgagaagatgacaaggatgggcattacatgtttgagcttggagataatttaacctcccgctataagatacaaagtaaaatgggtgaaggtacctttggtcaagttctagaatgctgggatagggagacgaaggatgtcgtggccatcaaaattgtccgtggaattaagaaatatcgtgaagcagccatgatagaaattgagatgctgcaacagcttggaaaacatgataaagggggcaatcgttgtgtgcaaatacggaactggtttgactatcgtaaccatatctgtattgtctttgagaagcttggaccaagcttatacgattttctacggaaaaacaattatcgctcatttcccattgatcttgtccgtgagattggcagacaactattggaatgtgtagcatttatgcatgatttgcatctgatacacacggacttgaagccagaaaacattcttctagtctctccagagtatgttaaagttcctgattacaagagtacatcacgatccccaaaggataattcttactttaaaagattaccaaagtcaagtgctattaaggtaatagattttggtagcacaacttacgagcgtcaagatcagacttacattgtttccacgcggcattatcgtgctccggaggttattcttggacttggatggagttatccgtgtgacatatggagtgttggttgcatcttagttgaattatgcacgggtgaggcgctgttccaaactcatgagaatttggagcaccttgccatgatggagcgggtgttaggtccactacctcagcacatgttgaagagagtagaccgacacgcagagaagtatgttagaaggtgtagattggattggccagatggtgctacctcaagtgggagtatcaaagctgtgcttaagctacctcgtctgcagaacctgataatgcagcatgtggaccattcagccggggatctaattcatctattgcaaggattgcttaggtatgatcctattgataggcttacagctcgtgaagcactgaggcatccctttttcagtagggaccaatttaggagatgagcatggaattgggttggtagacaatgtctcagcttgtaaagtttttctaacaagaactgcttcttacgttagcaccatcttgtgcgacaagctgtattgtggtgcaagctaacagattatcaccaagtcaaatggtttcatgtatcgtttgttagattcaataaaattttagaatttgttgtg

SEQ ID NO: 7410 - DNA, 1617 bp, Arabidopsis thaliana
caatttgctattcctctgcttaaaaactagggttaggctacgattctgtttacaccaaaaaagcttttcgtcatcgccgtttggctttctgaaacaaatcacaccgtttaagattttctctgattctgagattatggagatggagcgtgtgcatgaattccctcatactcacatggatcgtcgtcccagaaagagagcgcgtctcggttgggatgtgttgcctcaggcaaccaaggctcaggtaggaatgttttgtgggcaagagattggaaatatatcaagctttgcatcttccggagctccttcagacaatagtagctctctttgtgttaagggtgtggctcgaaatggttctcccccatggcgagaagatgataaggatggacattacatatttgaactgggagatgacttaactccacgctataaaatttatagcaaaatgggggaaggtacttttggtcaagtgctagaatgttgggatagggagaggaaggaaatggtggcagtaaaaattgtccgtggtgtgaagaaataccgtgaggctgctatgattgaaattgaaatgctgcaacagcttggtaaacatgacaaaggtggcaatcgttgtgtacaaattcggaactggtttgactatcgtaaccatatctgtattgtatttgagaagcttggatcgagtttatacgattttcttcggaaaaacaattatcgctcctttcccattgatcttgtccgtgagattggctggcaactcttggaatgtgtagcatttatgcatgacttgcgcatgattcatacggaccttaaaccagaaaatattctgttagtctcctcagactatgtgaagattcccgagtacaaggggtcccgattacaaagggatgtatgctataaaagagtgcctaaatcaagtgcaataaaggtgattgattttggtagcacaacttatgagcgccaggaccaaacctacattgtatcaaccagacattatagggcaccagaagtcattttaggtcttggctggagttatccgtgtgatgtttggagcgttggatgtatcatagtggagttgtgcacgggtgaagcattgttccaaacacatgaaaacctggagcatctagcgatgatggagcgtgttcttgggccgtttcctcaacaaatgctgaagaaagtggaccggcactcagagaaatatgtgagaagaggtcgtttggattggccagatggggcaacctcaagagatagcctgaaggcagtattgaagcttcctcggcttcagaatttaataatgcaacatgtggaccactcagccggggagttaataaatatggtgcaaggacttctgcgatttgatccgtcagagagaataaccgctcgtgaagctctgaggcatccgtttttcgcaaggagaagatagcgggacttgaatttgacgagtgtaaatagggatgaaatatgtatgatttgtagcaagtctttaccccacaaccccacgaattctgatataaattaacaaatatgctaagatcactctttttttaaccgtgataggcgattgtttgtctatctttgtaaactggatcgtttcaattcaaaagagttttagttttggattct

SEQ ID NO: 7411 - DNA, 1688 bp, Nicotiana benthamiana
ggtttcgcatcaacaactttctgtgcaattgttttctctctctaaaggcttctctctctctctagattttgtaagctttcagcgatggagatggaacgcgttaccgagtttccgttgactcatcacctggaccggcggccaagaaagagggcgcgtctgggctgggatgttcttcctgctgaaccgcctaaggctcagctaggattgttttatggacaagaggttgggaatgtgacaagctacgcaccttcaaggcaactcacagaccttacttgcacaccctttattaagggagtgactcaaaatggttctcccccttggagagaagatgacaaagatggccattttgtttttgagctgggagaaaatttaacatcacgctacaaaatccacagtaaaatgggtgaaggtactttcggtcaggtcttagaatgctgggatcgtgagaggaaagaaatggtggctattaaaattgttcggggcatgaagaagtatcgtgatgctgcaatgattgaggttgaaatgcttcaacagcttggtaaacatgacaaagggggcaatcgttgtgtacaaatacggaactggtttgactatcgtaatcatgtctgtattgtctttgagaagcttggaccaagcttatacgatttccttcggaaaaacaattaccgctcatttcccattgatcttgtccgtgagattggaagacaactgttggaatgtatagcatttatgcatgatttgcgcctgatccatactgacttgaagcctgagaacattcttctcaactccgcagaatatgtaaaggttccggattacaaggtttcttcaagatcaccaaaagatggttcttactataaaagaattccaaaatcaagtgctataaaggtaattgattttggtagcacgacttatgactgtcagaatcagacttatatagtatcaactcgtcattaccgtgcacccgaagttattctagggcttggatggtcatacccatgtgatatatggagtgttgggtgtatcttagtggagctatgttcgggagaagcgttgtttcaaacacatgagaatttggaacaccttgcgatgatggagaaggtattggggcccctgcctcagcacatgctgaaaagagtggatcggcaagctgaaaagtatgttagaagaggacgtttagactggcccgaaggagcaacatctcgtgacagtatcaaagctgtgctgaagttggcccgccttcagaacattatcatgcagcacgtggatcattctgccggagatcttattaatctactgcaaggacttcttaggtatgatccttcggaaagattgactgctcatgaagccttgcggcatccattcttcacccgtgatcatcttaggaggtagaagattttcctttgcatgatggtagctccaaacttgaatgctatttctgtgtgaggcttgaagtggagcaagctttgttggctcagcgtagtctacacaattttgcaatgtaaagagctccaaatttactgggttcttgcgggttttgtatactagtcatggtgatggtcgaagtcatgcctgtgtatataatagttaacccttgattaactaacaaaatgtaattatatttgagcattgcttctaatttgagctgttgtgagatctccgctttctgaaagttaatagaattttgtttt

SEQ ID NO: 7412 - DNA, 1667 bp, Helianthus annuus
aaatctccattcagaaaacataaacagcttctatagatcaatcgtcaagctcgttcggtgaaatcgcttccggttatggagatggaacgtgttaccgagtttccgatgagtcagttggatctcaggccgagaaaacgacagcgtttgggctgggatgtggctcctctcacgccgaaggctcaggtagggttgttttgtggacaagagattggggatgtgcccagctttgcactctctggggccccatcagactatattagttcgtccattcttaagcgtgtggctcgaaatgtttctcctccgtggcgccaagatgataaagatgggcattatgtgtttgcagttggagataatctaaccacccgatataagattcatggaaaaatgggcgaaggtacctttggacaagttttagaatgttgggacaaagaaagaaaagagatggttgcaataaaaatagttcgtggtataaagaaatatcgtgaggctgctatgatagagattgatgtgttgcaacaacttggtaaacatgacaaagggggcaaccgttgtgtgcaaataaggaactggtttgactatcgtaaccatatctgtattgtttttgagaagcttggaccaagcttatatgattttctacgcaaaaacaattatagctcattcccaattgacctagttcgggagattggcagacaacttttggattgtatagcatttatgcatgaattgaggctgatacacactgatttaaaacctgagaatgtgcttttagtctcttcagagtatctgaaggtgcctgattacaagggttcttcaaggtcaccaaaagatggttccttttccaaaagggtcccaaaatcaagtgccattaaggtgatcgactttggtagtacaacgtatgatcgtcaggatcagagctacatagtatctactcgtcattatcgtgcaccagaagttattttaggacttggatggagctacccatgtgatatctggagtgtcggttgtattcttgttgaactatgcacgggtgaagctttgtttcaaactcatgaaaacttggaacatcttgcaatgatggagagagtctttggcccgttgcctaatcacatgttgaggaaaacagaccgacatgctgagaagtatgtgagaaagggtagattggactggcctgagggtgcagcatcaagagaaagtatcaaagctgtgacgaagctacctcgacttcagaacttgattatgcagcatgtggaccattctgcaggggatctgattcatttgctacaagggcttctaaggtataatccatcagagaggctaacggcacgagctgcactaagacatcctttcttcacgagggatcatctaagacggtattagtcttaaaagttaaacttgggtcaattggaaagatcgaggagacagcacgcaagccgacggtcaggcactatttgactgtacagaattaaaaacctctaacaaagggtttggttggtgttcatgcaaacaacagtcttctatagcaaacacatccgattgactgtaattttactgattatgctttgtacaaaccgtgaagttgcctacctgactttgaatgggtgacgtcatggtacttgtaatttgtagtttttttgtttacagctgataattattttgaatgcagtttt

SEQ ID NO: 7413 - DNA, 1777 bp, Aquilegia formosa
gatattccttatcaaactcaccgccttttcacatcattcaattagggtttcttcaacaacaatcttttcttcaatttctcgatcttgatttctctgtttttttttttctctcgatttatcgaattcgctctttcgatcttgttttctttctgtgtgtcgatttgatctgtttgtaggttttgattcgattgatttgttgattttgtgatggagatggagtgtccaccaacagagtttccacatactactcatatgatggatcgacgacctcgaaagaggccgaggttaggttgggatgttcctcaactccctaaggctcaaatagggatgttttgtgggcaagatgttggaaatgtcaccagctatgcaccctcagaccatactagttctctttttgtaaagggagtggctcgaaatggttctcccccttggagagatgatgacaaggatggacattacatgtttgcgcttggagataatttaacttctcgctataagatccacagcaaaatgggagaaggtacatttggccaggttttagaatgctgggacagggagaggaaagaatttgttgccatcaaaattgtacgtgggatcaaaaagtatcgcgaagcagcgatgatagaaattgatgttcttcaacagcttgcaaagcatgataagtctggcgctcgttgtgtgcaaatacggaactggtttgactatcgtaaccatatctgtattgtatttgagaagcttggacctagcttatacgatttcctacggaaaaacaattatcgctcatttcccattgatcttgttcgtgagcttggcagacaactgttggaatgtgtagcatttatgcatgatttgcgtctcatacacactgatttgaagcccgagaacatacttcttgtatcccctgattatgtaaaaataccagattacaaggtgtcccctcgttcgcctaaggatggggcttactttaaaagattgcctaaatcaagtgctatcaaagtaatagattttggaagcacaacatatgagcaccaagaccacagttatattgtatcaacacgacactaccgcgcacctgaagttattcttggtcttggatggagttattcatgtgatgtatggagtattgggtgtattttggtagagctttgctcgggtgaagcactttttcagactcatgaaaatttggagcaccttgccatgatggagagagtattaggcccattgccacaacacatgttgaaaagagtagatcggcatgcggagaaatatgtcagaagaggaagattggactggccagaaggcgctacttcaagagagagcatcaaagctgtgacgaagttgccacgtcttcagaatcttgtaatgcagcatgttgatcactcaggtggggactttataaaccttttgcaaggtcttttgagatatgatccatcagacaggcttacggctaaagaggcccttagacaccctttttttacgagggatgttcaccggaggtcatcatgaagagatacataaagctagaagttgcttagatgtttcttgtgatatttgagatgtggagtgttgcctacctgatctcaagagtgtaaagaatgacatggaaatggggtatggcaagctgagttattcttactgttggtcatgcttgatataacttgggtctcctggtgaattactgggatccatttgtagcttgtaacattgtaaagtactgtcagtcttgtacattgtaaaatatttacattttttgttcaataaatttaagttgtgcttt

SEQ ID NO: 7414 - DNA, 1664 bp, Prunus persica
acacaacacaacctttcttcccctatttttcatctcgccgatcctctacttcctttccgttctcgtcaaaatttttttactttctttctagcgatcttcgatttcttgatctgcggccatggagactgagcgcgtgacggagtttcctttcactcacttggatcgtcgccctcgaaagagagcgcgattgggctgggatgttcctcaggccccaaaggctcaggtaggaatgttttgtggacaagagcttgggaatgtgacaagctttgcatctttgatggcaccatcagaccacactactatctctctttttgataaggaagtggctcgaaatggttcccccccatggagagaggatgacaaagatgggcattacgtgttttcgctcggagaaaatttaacatctcgctacaaaatccagagcaaaatgggtgaaggtacctttggtcaggttttggaatgttgggacagagaaaaaaaggaaatggttgccataaaaattgttcggggggtcaagaaatatcgtgaagcagcaatgatcgaaattgaagtgctgcaacagcttggtaaacatgacaaaggtggcaaccgttgtgtgcaattacggaactggtttgactatcgtaaccatatttgtattgtgtttgagaagcttggaccaagcttatacgattttctcaagaaaaacaattaccgctcatttcccattgaccttgtccgtgagattggccgacaactgttggaatgtgtagcattcatgcatgaccttcgcctgattcataccgacttgaagccagagaatatactccttgtttctcacgattacagtaaagttcctgattataataagaactcatctcgatcacccaaagatagctcatattttaaaagaattccaaagtcaagtgctattaaggttattgattttggaagcacaacttatgaacgtcaagaacaaaactatattgtatcaacgcgacattaccgagctccagaggttattcttggaatgggatggacctacccgtgtgatgtatggagcattggttgtatcttagtggagttatgcacgggtgaggctttgttccagactcatgaaaatttggagcatcttgccatgatggagcgggtacttgggcctttgccccagcacatattgaagagagcagaccgacatgctgagaagtatgtcaggaggggtagattggattggccagagggtgcagcctcgcgagagagtatcagagctgttcagaaacttcctcgtcttcagaatcttgtaatgcagcatgtagaccattccgcaggggacctcattcacctcttgcagggtctccttaggtacgacccatcggataggctttcagctcgggaagccctcagacattcatttttcacgaaggacaatcttagaagatgagtttattattgtgtttgtgcctgccgctgagtgaagtgtgcaatgtggctggcctgaaatcctgacaggtgttgttaataacatccccctcatgtagatatatccgaatgtactgatgattatttgttaaccgcgagcggcccacccattctgctctcccagttgcccaacgccacctgcctttgattattgtacagaactgacagtttgaaataatgaacaaatgtcttctcacattactttc

SEQ ID NO: 7415 - DNA, 1844 bp, Gossypium raimondii
tactttgttcacaagaagaaataaaaagccttgtcatcgtttttagccttattttattcgtcaaataagcgatttctgtttttcgattttctcactctttctccggaaaaaaaaaaattttttagatctagaatctgcgatcatggagatggagcgcgtgacggggttccctcatacgcatatggatcgccgaccaagaaagcgtccgcgattgggctgggacgtaactcagctgccaccgcaggctcaggtaggaatgttttgtgcacaagaagttgggagagtgacaggctttgcttcttccactgcaaaagcacctgcagattatgctagtactattactactagttcttctgtagttttaaagggaggagtggctcaaaatggttctcccccatggcgagacgatgacaaagatggacattacatgtttgagcttggagataatttaacctctcgctataagatacagagtaaaatgggcgaaggtacctttggtcaggttttagaatgctgggatagagagaggaaggagatggttgccataaaaattgtccgtggaattaagaagtatcgtgaggcagccatgatagagattgagatgttgcaacagcttagaaaacatgataaaggtggcaaccgttgtgtgcaaatacggaactggtttgactatcgtaaccatatttgtattgtgtttgagaagcttggaccaagcttatacgattttctacgcaaaaacaattatcgctcatttcccattgatcttgtccgtgagattggcagacaactattggaatgtgtagcattcatgcatgatttgaacctgatacacacagacttgaagccagaaaacattcttctagtctctccagagtacgtcaaaattcctgattacaagggtacattgcgatctccaaaggacagttactttagaagattgccaaaatcaagtgctattaaggtaatagattttggtagcactacatatgagcgcccagatcagaattacattgtatcaacaaggcattatcgtgctccggaggttattcttggacttggatggagttatgcttgtgatatatggagtgttggttgcattttagttgaattatgcacaggtgaagcgctgtttcaaacccatgaaaatttagagcaccttgccatgatggagcgagtgttaggtccactacctcagcacatgttgaagagagtagaccgtcatgcagagaagtatgttagaagaggtagattggattggccagatggtgcaacctcaagggagagtatcaaggctgttcttaagctacctcgtctccagaacttgataatgcaacacgtggaccattcagctggggacctgattcatctattgcaaggattgcttagatatgaccctattgataggctgacagctcgggaagccttaaggcaccctttcttcagtagggaccaatttaggcgattgagcttggctggcattggttggcctggaatgaatgaatatctaagaaagtagacaaggattcatatctgtaaatattactaacctggaatacttgttaacactagcaccttctgcgtgtgttaaaggactgaattgtggtgcaaacaacagattaaaacaccatttagttagattgtgactaaacccttttggatattgtagtaaatatgggggcatttattcacatacttctcgtctcctggcaatccattaattccatcttttttgagtgcatatcttgccagccttaatttgtgcaagattctttttttatttatgtattttatatttttgggccctaaagtatgcctttacctaatacaaattatgaaagtttcat

SEQ ID NO: 7416 - DNA, 1563 bp, Ambrosia trifida
cttccaatagatcaataacaatcagattctttgtattaatcggatatggagctgaacgtgttacggagtttccaatgagtcaattggatgttaggccacgaaaacgacagctttgggttgggatgttgctcctttgacacccaaggctcaggtaggattgttttgtggacaagagattggaaatgtgaccagctttgcaccttcaggggtcacatcagaccatagtagttcatccgtccttaaacgtgttgctcgaaatgtttctcccccatggcgtcaagatgataaggatggacattttgtgttcgcagttggagataatctgactacccgatataagattcatggaaaaatgggcgaaggtacctttggccaagtattggaatgttgggacaaagaaagaaaagagatggttgcaataaaagttgttcgtggcataaagaaatatcgtgaggcagctatgatagagatcgacatgttgcaacaacttggtaaacatgacaaaggtggcaaccgttgtgttcaaataaggaactggtttgactatcgtaaccatatctgtattgtttttgagaagcttggaccaagcttatatgattttctacgcaaaaacaattatagctcattcccaattgacctagttcgggagattggcagacaacttttggattgtatagcatttatgcatgaattgcgattaatacacactgatctaaagcctgagaatgtgcttttagtctctccagagtatgtgaaagtgcctgactacaagggctcatcaagatcaccaaaagatggttctttttctaaaagggtcccaatatcaagtgctattaaggtgatcgactttggtagtacaacatatgaccgtcaggatcagaactacatagtatctactcgtcactatcgtgcaccagaagttattttaggacttggatggagctacccatgtgatatctggagtgtcggttgtattctggttgaactatgcacaggtgaagctttgttccaaactcatgaaaacttggaacatcttgcaatgatggagagagtttttggtccgttgcctaatcacatgttgaggaaatcagaccgacacgctgagaagtatgtgagaaagggtaggttggactggcccgagggtgctgcctcaagagaaagtatcaaagctgtgacgaagctacctcggcttcagaacttgattatgcagcatgtagatcattctgcaggggacttgattcatttattgcaagggcttctaaggtatgatccatcagagaggctaacagcacgagctgcgctaagacatcctttcttcactagggatcattttagacggtattagtttttgtagaagttcaaacgtgggttaattggaaagatcgagagagaatgctggtcgcgctcttttgactgtacagatttgaagcctaagacaaggcatggttggtgtccctgagtctttatagcaaccacatttgattgactgtaacttcactctgattatatgctttgtacaagccacggttatatactttgactgtaacgcgtggtcgtaatttg

SEQ ID NO: 7417 - DNA, 1763 bp, Helianthus annuus
cggcaagatgcaccttcatcaaaccgacgcttgattgtttggtcaatattagggtttcgtcattcacaaatctacattatcataaaattagggtttcaaaatctccattcagaaaacattaacagcttttatagatcaatcgtcaagctcgttcggtgaaatcgcttccggttatggagatggaacgtgttaccgagtttccgatgagtcagttggatcttaggccgagaaaacgacagcgtttgggctgggatgtggctcctctcacgccgaaggctcaggtagggttgttttgtggacaagagattggggatgtgcccagctttgcactctctggggccccatcagactatattagttcgtccattcttaagcgtgtggctcgaaatgtttctcctccgtggcgccaagatgataaagatgggcattatgtgtttgcagttggagataatctaaccacccgatataagattcatggaaaaatgggcgaaggtacctttggacaagttttagaatgttgggacaaagaaagaaaagagatggttgcaataaaaatagttcgtggtataaagaaatatcgtgacgctgctatgatagagattgatgtgttgcaacaacttggtaaacatgacaaagggggcaaccgttgtgtgcaaataaggaactggtttgactatcgtaaccatatctgtattgtttttgagaagcttggaccaagcttatatgattttctacgcaaaaacaattatagctcattcccaattgacctagttcgggagattggcagacaacttttggattgtatagcatttatgcatgaattgaggctgatacacactgatttaaaacctgagaatgtgcttttagtctcttcagagtatctgaaggtgcctgattacaagggttcttcaaggtcaccaaaagatggttccttttccaaaaggtcccaaaatcaagtgccattaaagtgatcgactttggtagtacaacgtatgatcgtcaggatcagagctacatagtatctactcgtcattatcgtgcaccagagttattttaggacttggatggagctacccttgtgatatctggagcgtcggttgtattcttgttgaactatgcacgagtgaagctttgtttcaaactcatgaaaacttggaacatcttgcaatgatggagagagtctttggcccgttgcctaatcacatgttgaggagaacagaccgacatgctgagaagtatgtgagaaagggtagattggactggcccgagggtgcagcatcaagagaaagtattaaagctgtgacgaagctacctcgacttcagaacttgattatgcagcatgtggaccattctgcaggggatctgattcatttgctgcaagggcttttaaggtatgatccatcagagaggctaacggcacgagctgcactaagacatccttttttcacgagggatcatctaagacggtattagtcttaaaagttaaacttcggtcaattggaaagatcgaggagacaacacgcaagccaacgatcaggcactctttgactgtacagaattataaaccccctaacatagggtttggttggtattcatgcaaacaacagtcttctatagcaaacacatctgattgactgtaattttactgattatgctttgtacaaaccgtgaagttgcctacctgactttgaatgggtgacgtcatggtacttgtaatttgtagttttttgtttacagctgataattatttgaaatgcagtttt

SEQ ID NO: 7418 - DNA, 1624 bp, Euonymus alatus
tctgtttgtttcttgtcaaaattgctaatttgttctctcctttttccgtttgtaatcttgatcactctttgcgatatctcggcgtttcgttgagataatggagatggaacgcgtaacggggtttcctctcgatcggcgacccaggaagagggcgcgcttgggatgggatgtgcctcaggtcccaaaggctcaggtaggaatattttgtgcgcaagaggttgggaatgtgatcagctttgcatcttcaagagcaccctcggacattattcctagttctctttttgtaaagggagtggatcgaaatggttctcccccatggagggaagatgacaaggatgggcattacgtgtttgcagttggagataatttaacttctcgctataagatacacagcaaaatgggcgaaggcacatttgggcaagttttggaatgctgggaccgagaaaggggggaaatggttgccattaaagttgttcgtggaatcaagaagtaccgtgatgctgctatgattgaaattgaagttcttcaacagcttggaagacatgataaaggcaatcgttgtgtacaaataaggaactggtttgactatcgtaaccatatctgtattgtgtttgagaagcttggaccaagcttatacgattttcttcgcaaaaacaattatcgctcatttcccattgatctagtccgtgagattggcagacaactgttggaaagtgtagcatttatgcatgagttgcgtttgattcatactgacttgaagcctgagaacatacttctggtttcacccgactatgtgaaagttcctgattataagagttcatcccgatccccaagggacggatcctattttaaacgggttccaaagtatagttctattaaagttatagacttcggtagtactacatatgaacgtcaagatcagagctatgttgtctcaacgcgacattaccgtgcaccagaggttattcttgggcttggatggagttatccctgtgatgtatggagtgttggttgtatattggtggagttatgcacgggagaggcattgttccaaactcacgagaatttggagcatcttgcaatgatggaacgggtgctgggtccattgcctcatcatatacttaagaagattgatcgacattcagagaagtatgttagaaggggaaggcttgactggccagaaggtgctacgtcaagagatagtataagagcagtttcgaagcttcctagacttcagaacttgataatgcagcatgtagaccattcagctggagatcttatacatcttttacaatgtcttcttagatacgatcctactgagagattggctgcccacaatgctctaaagcatccgttttttatgagggaacatcaaaggagatgaattagggtgtaggtgattgatttgttggattatggcagctgttgatatgcaagtcatattctgtagtacagagatgggccttagattttctttgcccaaaggtagaggctgcatctgtgtacataggttctcatagtggagcaaagtgtgtagcgagtgctaatccaagtggggctgttaccgaacccggaggtgtaaaattgacaaaatggttaaccagtaattaaaatgcttattttt

SEQ ID NO: 7419 - DNA, 1422 bp, Flaveria ramosissima
tcttcacaagattacgctttcgaaatcctccatctgaaatcatcatcagctttctgtagatcaaatcatcagtttcttcggtgaaatcgcttccgattatggagatggaacgtgttacggagtttccgatgagtcagttggatctcaggccgagaaaacgacagaggttgggctgggatgtggctccggcgccgacgaaggctcaggtaggattgttttgtgcacaagagattggaaatgtgacaagctttgcacctttggggccccaacagaccatattagttcatccatcctaaaacgagtggctcgagatgtttctcccccatggcgccaagatgataaggatggacattatgtgtttgcagttggagataatctaactaccagatataagattcatggaaaaatgggtgaaggtacgtttggccaagttttggaatgttgggacaaagaaagaaaagaaatggttgccattaaaattgttcgtggtataaagaagtatcgtgaggcagctatgatagagattgatgtgttgcaacaacttggtaaacatgacaaaggtggcaaccgttgtgtgcaaataaggaactggtttgactatcgtaaccatatctgtattgtttttgagaagcttggaccaagcttatatgattttctacgcaaaaacaattatagctcattcccaattgacctagttcgggagattggcagacaactattggaatgtatagcattcatgcatgatttgcggctaatacacactgatttaaagcctgaaaatgtacttctagtatctcctgagtatgtgaaagtgcctgattacaaggcttcatcaagatcaccaagggattgtttctttaccaaaagggtcccaaaatctagtgcaataaaggtgattgactttggtagtacaacatatgatcgtcaggatcagaactacatagtgtctacccgacactatcgtgcaccagaagtaatactaggacttggatggagctatccgtgtgacatatggagtgtcggctgcattctggtggaactctgcaccggcgaggctttgtttcaaacacatgaaaacttggaacatcttgcaatgatggagaaagtacttgggacgttgcccgtgcacatgttgaagaaatcagaccgacacgcagagaagtatgtgagaaaaggtagattggactggcctgagggtgcaacctcaagagaaagcatcagagccgtgatgaagctacctcgccttcagaacctgattatgcagcatgtagaccattctgcaggggacttgattcatttgctgcaagggctgttaaggtatgaccccttggacaggctaacagcacgtgccgcactaagacatccgtttttcacccgggatcattttagacggtactagttccataaaagctaaaggtcatt

SEQ ID NO: 7420 - DNA, 1659 bp, Raphanus sativus
  misc_feature (1006)..(1006): n is a, c, g, or t
ggacccaaaaaagcttatctccatcatcgccgtttggctctctgaaaaaaccatcccgtatttgatcctctctgtttttgtctctgctcggatccgttcgaatctgtgattatggagatggagcgtgttcatgagtttcctcatactcacatggatcgccgtcctcgaaagagagcgcgtctcggctgggacgtgttgcctccagcgcctaaggctcaggtaggaatgttttgtggacaagagattgggaatatgtcaagctttggagctccttcttcggagattagtagctctacttctctttctgttaagactgttgctcgtaatgattctcctccctggcgtgaagatgacaaggacggacattacatgtttgaactgggagatgacttaactccacgctataaaatatatagcaagatgggcgaaggaacatttggtcaagtgttggaatgttgggatagggagaggaaggaaatggtggctgtgaaaattgttcgtggagtgaagaaataccgtgaggcggctatgattgaaattgagatgcttcaacagcttggtaaacatgacaaaggtggcaatcgttgtgtacaaattcggaactggtttgactatcgtaaccatatatgtatcgtatttgagaagcttggatcaagtttatacgattttcttcggaaaacaattatcgctcctttcccattgatcttgtccgtgagattggctggcaactcttggaatgtgtagcatttatgcatgacttgcgcatgattcatacggactgaaaccagaaaacattctgttagtctcctcagactatgtgaaaattcccgagtacaagggttcccgattacagagggatgtttcctataaacgagtgcctaaatcaagtgcaataaaggttattgattttggtagcacaacttatgagcgacaggagcaaagctacattgtgtcaactagacattacagggcaccagaagtcattttaggacttggctggagttanccttgtgatgtttggagcattggatgtatcatagtggaactgtgcacgggagaggcattgttccaaacacatgaaaacctggagcatctagcgatgatggagcgtgttcttggtccgtttcctcaacaaatgctgaagaaagtggaccgacacgctgagaaatatgtgagaagaggccgtttggattggcctgatggggcaacctcaagagacagcctgaaagcagtattgaagcttcctcggcttcagaatctgataatgcaacatgtggaccattcggcgggagagttgataaacatggtgcaagggctacttaggtatgatccggcggaaagactaaccgctcgtgaagcactgagacatccttttttcacaaggagaagatgacgtgaccttgaaatttgacggatgtatatagtgagatgtgtgtttgtagtagtaacaactagtaaaacctttacgaaattgtgttacgtgataaccctctacgaattctgatatctattttgttaaaacaaatgctttgaatcactcttttttgaagtgaagagcgattatttgtctatcttgtttggtaaagtctttgtccgtgtacgtccggattcaaaagataatgtttacaagacgataatggatgattttcattgaaatta

SEQ ID NO: 7421 - DNA, 1924 bp, Gossypium raimondii
caaggcccccaagcctcttactttgttcacaagaagaaataaaaagccttgtcaccttttttagccttatttttttcgtcgaataagcgatttctgtttttcgattttctctctctttctccggaaaaaaaaaaagaaaattttttagatctagaatctgcgatcatggagatggagcgcgtgacggggttccctcatacgcatatggatcgccgaccaagaaagcgtccgcgattgggctgggacgtaactcagctgccaccgcaggctcaggtaggaatgttttgtgcacaagaagttgggagagtgacaggctttgcttcttccactgcaaaagcacctgcagattatgctagtactattactactagttcttctgtagttctaaagggaggagtggctcaaaatggttctcccccatggcgagacgatgacaaagatggacattacatgtttgagcttggagataatttaacctctcgctataagatacagagtaaaatgggcgaaggtacctttggtcaggttttagaatgctgggatagagagaggaaggagatggttgccataaaaattgtccgtggaattaagaagtatcgtgaggcagccatgatagagattgagatgttgcaacagcttagaaaacatgataaaggtggcaaccgttgtgtgcaaatacggaactggtttgactatcgtaaccatatttgtattgtgtttgagaagcttggaccaagcttatacgattttctacgcaaaaacaattatcgctcatttcccattgatcttgtccgtgagattggcagacaactattggaatgtgtagcattcatgcatgatttgaacctgatacacacagacttgaagccagaaaacattcttctagtctctccagagtacgtcaaagttcctgattacaagggtacattgcgatctccaaaggacagttactttagaagattgccaaaatcaagtgctattaaggtaatagattttggtagcactacatatgagcgcccagatcagaattacattgtatcaacaaggcattatcgtgctccggaggttattcttggacttggatggagttatgcttgtgatatatggagtgttggttgcattttagttgaattatgcacaggtgaagcgctgtttcaaacccatgaaaatttagagcaccttgccatgatggagcgagtgttaggtccactacctcagcacatgttgaagagagtagaccgtcatgcagagaagtatgttagaagaggtagattggattggccagatggtgcaacctcaagggagagtatcaaggctgttcttaagctacctcgtctccagaacttgataatgcaacacgtggaccattcagctggggacctgattcatctattgcaaggattgcttagatatgaccctattgataggctgacagctcgggaagccttaaggcaccctttcttcagtagggaccaatttaggcgattgagcttggctggcattggttggcctggaatgaatgaatatctaagaaagtagacaaggattcatatctgtaaatattactaacctggaatacttgttaacactagcaccttctgcgtgtgttaaaggactgaattgtggtgcaaacaacagattaaaacaccatttagttagattgtgactaaacccttttggatattgtagtaaatatgggggcatttattcacatacttctcgtctcctggcaatccattaattccatcttttttgagtgcatatcctgccagccttaatttgtgcaagattctttttttatttatgtattttatatttttgggccctaaagtatgcctttacctaatacaaattatgaaagtttcataagatgttcaatcacacagatcgataaattatgacttgaaattaataattgtcaggg

SEQ ID NO: 7422 - DNA, 1727 bp, Gossypium hirsutum
ttttttagatctagaatctgcgatcatggagatggagcgcgtgacggggttccctcatacgcatatggatcgccgaccaagaaagcgtccgcgattgggctgggacgtaactcagctgccaccgcaggctcaggtaggaatgttttgtgcacaagaagttgggagagtgacaggctttgcttcttccactgcaaaagcacctgcagattatgctagtactattactactagttcttctgtagttctaaagggaggagtggctcaaaatggttctcccccatggcgagacgatgacaaagatggacattacatgtttgagcttggagataatttaacctctcgctataagatacagagtaaaatgggcgaaggtacctttggtcaggttttagaatgctgggatagagagaggaaggagatggttgccataaaaattgtccgtggaattaagaagtatcgtgaggcagccatgatagagattgagatgttgcaacagcttagaaaacatgataaaggtggcaaccgttgtgtgcaaatacggaactggtttgactatcgtaaccatatttgtattgtgtttgagaagcttggaccaagcttatacgattttctacgcaaaaacaattatcgctcatttcccattgatcttgtccgtgagattggcagacaactattggaatgtgtagcattcatgcatgatttgaacctgatacacacagacttgaagccagaaaacattcttctagtctctccagagtacgtcaaagttcctgattacaagggtacattgcgatctccaaaggacagttactttagaagattgccaaaatcaagtgctattaaggtaatagattttggtagcactacatatgagcgcccagatcagaattacattgtatcaacaaggcattatcgtgctccggaggttattcttggacttggatggagttatgcttgtgatatatggagtgttggttgcattttagttgaattatgcacaggtgaagcgctgtttcaaacccatgaaaatttagagcaccttgccatgatggagcgagtgttaggtccactacctcagcacatgttgaagagagtagaccgtcatgcagagaagtatgttagaagaggtagattggattggccagatggtgcaacctcaagggagagtatcaaggctgttcttaagctacctcgtctccagaacttgataatgcaacacgtggaccattcagctggggacctgattcatctattgcaaggattgcttagatatgatcctattgataggctgacagctcgggaagccttaaggcaccctttcttcagtagggaccaatttaggcgattgagcttggctagcattggttggcctggaatgaatgaatatctaagaaagtagacaaggattcatatctgtaaatattactaacctggaatacttgttaacactagcaccttctgcgtgtgttaaaggactgaattgtggtgcaaacaacagattaaaacaccatttagttagattgtgactaaacccttttggatattgtagtaaatatgggggcatttattcacatacttctcgtctcctggcaatccattaattccatcttttttgagtgcatatcctgccagccttaatttgtgcaagattctttttttatttatgtattttatatttttgggccctaaagtatgcctttacctaatacaaattatgaaagtttcat

SEQ ID NO: 7423 - DNA, 1850 bp, Prunus mume
acacaacacaacctttcttcccctatttttcatctctccgatcccttttttccttcccgttctcgtcaaaaaaattttactttctttctagcaatcttcgatttctcgatctgcggccatggagactgagcgcgtgacggagtttcctttcactcacttggatcgtcgccctcgaaagagagcgcgattgggctgggatgttcctcaggccgcaaaggctcaggtaggaatgttttgtggacaagagcttgggaatgtgacaagctttgcatctttgatggcaccatcagaccacactactatttctctttttgataaggaagtggctcgaaatggttcccccccttggagagaggatgacaaagatgggcattacatgttttcgctcggagaaaatttaacatctcgctacaaaatccagagcaaaatgggtgaaggtaccttcggtcaggttttggaatgttgggacagagaaaaaaaggaaatggttgctgtaaaaattgttcggggggtcaaaaaataccgtgaagcagcaatgatcgaaattgaagtgctgcaacagcttggtaaacatgacaaaggtggcaaccgttgtgtgcaattacggaactggtttgactatcgtaaccatatttgtattgtgtttgagaagcttggaccaagcttatacgattttctcaagaaaaacaattaccgctcatttcccattgaccttgtccgtgagattggccgacaactgttggaatgtgtagcattcatgcatgaccttcgcctgattcatactgacttgaagccagagaatatactccttgtttctcacgattatattaaagttcctgattataataagaactcatctcgatcacccaaagatagctcatattttaaaagaattccaaagtcaagtgctattaaggttattgattttggaagcacaacttatgaacgtcaagatcaaaattatattgtatcaacacgacattaccgggctcccgaggttattcttggaatgggatggacctacccttgtgatgtatggagcattggttgtatcttagtggagttgtgcacgggtgaggccttgttccagactcatgaaaatttggagcaccttgccatgatggagcgggtacttgggcccttgccccagcacatgttgaagagagcagaccgacatgctgagaagtatgtcaggaggggtagattggattggccagagggtgcagcctcgcgagagagtatcagagctgttcagaaacttcctcgtcttcagaatcttgtaatgcagcatgtagaccattccgcaggggacctcattcacctcttgcagggtctccttaggtacgacccatcagataggctttcagctcgggaagccctcagacattcatttttcacgaaggacaatcttagaagatgagtttattattgtgtttgtgcctgctgctgagtgaagtgtatgatgtggttggcctgaaatcctgagaggtgttaataacatccccttcgtgtagatatatccgaatgtactgatgattatttgttaaccgtgagcggcccacccgttgtgctctcccagccacctgcctatgattaatgtacagaactgagagtttgaaataatgaacaaatgtcttctcacattactttccggccaccttgttctttgttaaattttacctgaatgaatcaaacagctgtgtgtgtaataattctgcaagctctgctatatttacacatggttcttccatgtaaaactcataccaaattattttgaaagtatcaggcaggccattataccaatcaattgggtctctagttaggtgtggctactattggtactgtctttt

SEQ ID NO: 7424 - DNA, 1592 bp, Eutrema halophilum
caatttgcaatttgctctgatttaaaactagggttagggtgcgattctgttacccagaagctttcgccatcgctcgtttggctttctgaaaaatcaccccgattagagaaaaaaattattttggtacaattctattgattctgagattatggagatggagcgcgtgcatgagtttcctcatactaacatggatcgccgtcccagaaagagggcgcgccttggttgggacgtgttgcctctggcgcctaaggctcaggtaggaatgttttgtgggcaagagattggaaatttttcaagctttgcatcgtccggagctccttcagacattagtagcacttctctttgtgttaagactgtggctcgaaacgattctcctccatggcgagaagatgacaaggatggacattacatgtttgaactgggagatgacataactccacgctataaaatatatagcaaaatgggcgaaggcacctttggtcaagtgttagaatgttgggatagggagaggaaggaaatggttgcagttaaaattgttcgtggagtgaagaaatatcgtgaggcagctatgattgagattgaaatgctgcaacagcttggtaaacatgacaaaggtggcaatcgttgtgtacaaattcggaactggtttgactttcgtaaccatatatgtatcgtatttgagaagcttggatcaagtttatacgattttcttcggaaaaacaattatcgctcctttcccattgatcttgttcgtgagattggctggcaactcttggaatgtgtagcatttatgcatgacttgcgcatgattcatacggaccttaaaccagaaaatattctgttagtctcctcagattatgtgaaaattcccgagtataagggctcccgattacaaagggatgttagctataaaagagtgcctaaatcaagtgcaataaaggtgattgattttgggagcacgacttatgagcgtcaggatcaaaactacatagtatcaacaagacattatagggcaccagaagtcattttaggtcttggctggagttacccttgtgatgtttggagcattggatgtatcatagtggagctatgcacgggagaggcattgttccaaacacatgaaaacctggagcatctagcgatgatggagcgtgtacttgggccgtttcctcaacaaatgctgaagaaagtggaccgacacgcagagaaatatgtgagaagaggtcgtttggattggccggatggggcaacatcaagagacagtctgaaagcagtattgaagcttcctcggcttcagaatctaataatgcaacatgtggaccactcggcaggggagttgataaacatggtgcaagggcttcttcggttcgatccggcggagagactaaccgctcgtgaagcgctcagacatccttttttcacaaggagaagatgacgtgtcccttcaatttgacgttgtaattagtgtgatatgcatgtttgtagtaactagtgaactaccaaaagatttgttacgtgactctctgatattaatataacaaaatgctttcaatcactcttttttgacgtgaaatgcgagtatttgactattt

SEQ ID NO: 7425 - DNA, 1596 bp, Eutrema halophilum
caatttgcaatttgctctgatttaaaactagggttagggtgcgattctgttacccagaagctttcgccatcgctcgtttggctttctgaaaaatcaccccgattagagaaaaaaattattttggtacaattctattgattctgagattatggagatggagcgcgtgcatgagtttcctcatactaacatggatcgccgtcccagaaagagggcgcgccttggttgggacgtgttgcctctggcgcctaaggctcaggtaggaatgttttgtgggcaagagattggaaatttttcaagctttgcatcgtccggagctccttcagacattagtagcacttctctttgtgttaagactgtggctcgaaacgattctcctccatggcgagaagatgacaaggatggacattacatgtttgaactgggagatgacataactccacgctataaaatatatagcaaaatgggcgaaggcacctttggtcaagtgttagaatgttgggatagggagaggaaggaaatggttgcagttaaaattgttcgtggagtgaagaaatatcgtgaggcagctatgattgagattgaaatgctgcaacagcttggtaaacatgacaaaggtggcaatcgttgtgtacaaattcggaactggtttgactttcgtaaccatatatgtatcgtatttgagaagcttggatcaagtttatacgattttcttcggaaaaacaattatcgctcctttcccattgatcttgttcgtgagattggctggcaactcttggaatgtgtagcatttatgcatgacttgcgcatgattcatacggaccttaaaccagaaaatattctgttagtctcctcagattatgtgaaaattcccgagtataagggctcccgattacaaagggatgttagctataaaagagtgcctaaatcaagtgcaataaaggtgattgattttgggagcacgacttatgagcgtcaggatcaaaactacatagtatcaacaagacattatagggcaccagaagtcattttaggtcttggctggagttacccttgtgatgtttggagcattggatgtatcatagtggagctatgcacgggagaggcattgttccaaacacatgaaaacctggagcatctagcgatgatggagcgtgtacttgggccgtttcctcaacaaatgctgaagaaagtggaccgacacgcagagaaatatgtgagaagaggtcgtttggattggccggatggggcaacatcaagagacagtctgaaagcagtattgaagcttcctcggcttcagaatctaataatgcaacatgtggaccattcggccggggagttgataaacatggtgcaagggcttcttcggttcgatccggcggagagactaaccgctcgtgaagcgctcagacatccttttttcacaaggagaagatgacgtgtcccttcaatttgacgttgtaattagtgtgatatgcatgtttgtagtaactagtgaactaccaaaagatttgttacgtgactctctgatattaatataacaaaatgctttcaatcactcttttttgacgtgaaatgcgagtatttgactatttgttt

SEQ ID NO: 7426 - DNA, 1704 bp, Solanum phureja
atttcgcatcaatctcttccgtcttatcattactttcttcgctattattctctctctctaaagctttctctctctagatttctaagctttctgccatggagacggagcgcgtgaccggttttccgttgacgaatcttgaccgacggccaagaaagagggcgcgtctgggctgggatgttctccctgaaccacctaaggctcagctaggattgttttgtggacaagatgttgggaatgtgacaagctatgcatcttcaaggcaactcactgaccttactagtgctccctttactattaaggaagtggctcaaaatggttcaccccctcggagagaagatgacaaggatggacattttgtgtttgagctgggagaaaatttaacatcacgctataagatccacagtaagatgggtgaaggtactttcggtcaggtcctagaatgctgggatcgtgaaaggaaagaaatggtggctataaaaattgttcggggtatgaagaagtatcgtgatgcagcaatgattgaggttgaaatgcttcaacagcttggtaaacatgacaatggcaatcgttgcgtacaaatatggaactggtttgactatcgtaatcatatctgtattgtctttgagaagcttggaccaagcttatatgatttccttcggaaaaacaattaccgttcatttcccattgatcttgtccgtgagattggaagacaactgttggattgtgtagcatttatgcatgatttgcgccttatccatactgacctgaagcctgagaacatacttctcacctccccagaatatgtaaaggttcctgactacaaggtgtcttctaggtcaccaaaagatggttcttactataaaagaatcccaaaatcaagtgctataaaggtaattgattttggtagcactacatacgaccgtcagaatcagacatatgttgtgtcaactcgtcattaccgtgcacctgaagttattctaggtcttggatggtcctatccttgtgatatatggagtgttggctgtatccttgtggaactttgttcgggagaagcattgtttcaaacacacgagaatttagaacaccttgctatgatggagaaagtactgggccctctgcctcagcacatgctgaaaagagtggaccgtcaagcggagaagtatgttagaagaggaaggttggactggcctgagggggcaacttcccgggatagtattaaagctgtgttgaagttggcccgtcttcagaacataatcatgcagcatgtggatcactctgctggtgatcttattaatcttttgcaaggacttcttagatatgatccttcagaaagattaactgctcgggaagccttgcggcatccattcttcactcgtgatcatcttaggagatagattaagttttttgtcttttctttttactcgtgtgcactcaatgccattgcccctccaaccttgaatgccatttgatgtggtggtgaccggaagccaactctgttggctcattgtggtgttgggtgaatttgatgcttgcccctgtgtaaataaatccagaatactggttttttcggggtattcttgtattattatatactactaggttaaggctgttgtggaagtcccaccattgtgtgtataaagatgatatctaaccctcaattactaacaaacaaaaattgaatttaaggatggagtttgctttcgt

SEQ ID NO: 7427 - DNA, 1812 bp, Gossypium hirsutum
aagaaataaaaagccttgtcatcgtttttagccttattttatccgtcaaataagcgatttctttttttcgattttctcactctttctgcggaaattttttttttttagatctagaatctgcgatcatggagatggagcgcgtgacggggttccctcatacgcatatggatcgccgaccaagaaagcgtccgcgattgggctgggacgtaactcagctgccaccgctggctcaggtaggaatgttttgtgcacaagaagttgggagagtgacaggctttgcttcttccactgcaaaagcacctgcagattatgctagtactattactactagttcttctgtagttttaaagggaggagtggctcaaaatggttctcccccatggcgagacgatgacaaagatggacattacatgtttgagcttggagataatttaacctctcgctataagatacagagtaaaatgggcgaaggtacctttggtctggttttagaatgctgggatagagagaggaaggagatggttgccataaaaattgtccgtggagttaagaagtatcgtgaggcagccatgatagagattgagatgttgcaacagcttagaaaacatgataaaggtggcaaccgttgtgtgcaaatacggaactggtttgactatcgtaaccatatttgtattgtgtttgagaagcttggaccaagcttatacgattttctacgcaaaaacaattatcgctcatttcccattgatcttgtccgtgagattggcagacaactattggaatgtgtagcattcatgcatgatttgaacctgatacacacagacttgaagccagaaaacattcttctagtctctccagagtacgtcaaaattcctgattacaagggtacattgcgatctccaaaggacagttactttagaagattgccaaaatcaagtgctattaaggtaatagattttggtagcactacatatgagcgtccagatcagaattatattgtatcaacaaggcattatcgtgctcctgaggttattcttggacttggatggagttatgcttgtgatatatggagtgttggttgcattttagttgaattatgcacaggtgaagcgctgtttcaaacccatgaaaatttagagcaccttgccatgatggagcgagtgttaggtccactacctcagcacatgttgaagagagtagaccgtcatgcagagaagtatgttagaagaggtagattggattggccagatggtgcaacctcaagggacagtatcaaggctgttcttaagctacctcgtctccagaacttgataatgcaacacgtggaccattcagctggggacctgattcatctattgcaaggattgcttagatatgaccctattgacaggctgacagctcgggaagccttaaggcaccctttcttcagtagggaccaatttaggcgattgagcttggctggcattggttggcctggaatgaatgaatatctaagaaagtagacaaggattcatatctgtaaatattactaacctgtaatacttgttaacactagcaccttctgtgtgcgttaaaggactgaattgtggtgcaaacaacagattaaaacaccatttagttagattgtgactaaacccttttggatattgtagtaaatatggggacatttattcacatacttctcgtctcctggcaatccattaattccatcttttttgagtgcatatcttgccagccttaatttgtgcaagattctttttctatgtattttatatttttgtgctctaaagtatgcctttacctaatacaaattat

SEQ ID NO: 7428 - DNA, 1720 bp, Solanum lycopersicum
atttcgcatcaatctcttccgtcttttcctaactttctttgcaattgttttctctctctaaatttgtaagctttctgccatggaaactgagcgcgtgactggctttccgttgacgaatcttgatcggcggccaagaaagagggcgcgtctgggctgggatgttcttcctgaaccgcctaaggctcagctaggattgttttgtggacaagatgtggggaatgtgacaagctatgcatcttcaaggcaactcactgaccttactagtgctccctttactattaagggagtggctcaaaatggttctcctcctcggagagaagatgacaaggatggacattttgtgtttgagctgggagaaaatttaacaccacgctataagatccacagtaagatgggtgaaggtactttcggtcaggtcctagaatgctgggatcgcgaaaggaaagaaatggtggctatcaaagttgttcggggtatgaagaagtatcgtgatgccgcaatgatcgaggttgaaatgcttcaacagcttggtaaacatgataatggcaatcgttgcgtacaaatatggaactggtttgactatcgtaatcatatctgtattgtctttgagaagcttggaccaagcttatatgatttccttcggaaaaacaattaccgttcatttcccattgatcttgtccgtgagattggaagacaactgttggattgtgtagcatttatgcatgatttgcgccttatccatactgacctgaagcctgagaacatacttctcatctccccagaatatgtaaaggttcctgactacaaggtgtcttctaggtcaccaaaagatggttcttactataaaagaatcccaaaatcaagtgctataaaggtaattgattttggtagcactacatatgaccgtcagaatcagacatatgttgtgtcaactcgtcattaccgtgcacctgaagttatcctaggtcttggatggacgtacccttgtgatatatggagtgttggctgtatccttgtggaactttgttcgggagaagcattgtttcagacgcacgagaacttagagcaccttgctatgatggagaaagtactgggccccctgcctcagcacatgctgaaaagagtggaccgtcaagcagagaagtatgttagaagaggacggttggactggcctgagggggcaacttcccgggatagtattagagctgtgttaaagttggcccgtcttcagaacataatcatgcagcatgtggatcattctgcaggtgatcttattaatcttttgcaaggacttcttagatatgatccttcagaaagattaactgctcgggaagccttgcggcatccgtttttcacccgtgatcatcttaggagatagaacaacgctttgttttaactttttgtactcgtgtgcacacaatgctgttgcatgatgatggtagccctccaaccttgaatgccatttgatgcagtggtgaccggaagccaactctgttggctcattgtggtgatagttgaatctgactttgtccctgtgtaaataaatccaaaatactggttttttgcggggcattcttgtataatatattactagggtaaggttgtggtggaagtacccaccagtgtgtataagatgatttctcactcactcaattactaacacaaattgattgcaaggatgagttatgagattgtttcaaaattatttatcgtcattttc

SEQ ID NO: 7429 - DNA, 1494 bp, Ambrosia trifida
catcatcatcatcttccaattgatcaataataatcagattcttttgtattaatcggttatggagacggaacgtgttacggagtttccgatgagtcaattggatctcaggccacgaaaacgacagcgtttgggttgggacgttgctcctctaacaccaaaggctcaggtaggattgttttgtggacaagagatcggaaatgtgaccggctttgcaccttcaggggtcatatcagactatagtagttcatccgtccttaaacgtgttgcgcgaaatgtttctcccccatggcgtcaagatgataaggatggacattatgtgttcgcagttggagataatctgactacccgatataagattcatggaaaaatgggcgaagggacctttggccaagtattggaatgttgggacaagaaaaaaaagagatggttgcaataaaaattgtccgtggcataaagaaatatcgcgaggcagctatgatagagatcgacgtgctgcaacaacttggtaaacatgacaaaggtggcaaccgttgtgttcaattaaggaactggtttgactatcgtaaccatatctgtattgtttttgagaagcttggaccaagcttatatgattttctacgcaaaaacaattatagttcattcccaattgacctagttcgggagattggcagacaactattggattgtatagcatttatgcacgaattgcgattaatacacactgatctaaagcctgagaatgtgcttttagtctctccagaatttgtgaaagttcctgactacaagggctcatcaaggtcaccaaaagatggttctttttccaaaagggtcccaatatcaagtgctattaaggtgatcgactttggtagtacaacatatgaccgtcaggatcagaactacatagtatctactcgtcactatcgtgcaccagaagttattttaggacttggatggagctacccatgtgatatatggagtgtcggttgtattctggttgaactatgcacaggtgaagcgttgttccagactcatgaaaacttggaacatcttgcaatgatggagagagtttttggcccgttgcctaatcacatgttgaggagatcagaccgacacgctgagaagtatgtgagaaagggtaggttggactggcccgagggtgctgcttcaagagaaagtatcaaagctgtgacgaagctacctcggcttcagaacttgattatgcagcatgtagatcattctgcaggggatttgattcatttgttgcaagggcttctaagatatgatccatcagagaggctaacagcacgagctgcgctaagacatcctttcttcactagggatcattttagacgctattagtttgtagaagttaaaacgtgggtcaattggaaagatcgagagagaatgctgggcgggctctttgactgtacagatttgaagccctagacaaggcatggttagcaaccacatccgattgactacagctttactctg

SEQ ID NO: 7430 - DNA, 1645 bp, Euphorbia peplus
ggaagagggcacgcttaggctgggacgttcccctgcttcctaaggctcaggtaggaaatttttgtggacaagaggttggaaatttacaaagctatgctggagcaatctcagaccatactacctctaattccctatttgtaaatggagtggctcgaaatggttctcccccatggagggaagatgacaaggatggccattacatgtttgcgattggagataatttaacttcacgctataagatacacagtaaaatgggcgaaggcacatttggtcaggttttagaatgctgggacagggaaaggaaggagatggtagcaatcaaaattgtccgtggggttaataagtatcgtgaagcagctatgatagagattgacgtgctgcaacaacttggtaaaaatgacaaaggtggcaaccgttgtgtgcaattacggaactggtttgactatcgtaaccatatctgtattgtttttgagaagcttggaccaagcttatacgattttcttcgcaaaaacaattatcgctcatttcccattgatcttgtccgtgagattggcagacaactgttggaatgtgtagcatttatgcatgacttgcgcttaattcataccgatttgaagccagaaaacatccttctggtttctgctgactatgttaaagttcccgattacaagggctctttccgctcaccgaaagagagctcctactgtaaaagagtccccaagtctagtgccataaaggtgatagattttggtagcactacttatgagcgtcaagaccagaactatattgtgtcaacgcggcattatcgtgctccagaagtcattcttggacttggatggagttatccttgtgacgtatggagcattggttgcatcttagtggaattatgcactggtgaggcattgtttcagacacatgagaatttggagcatctggcgatgatggaacgggtgcttgggacactgcctcagcacatgttgaagagagtcgaccgacatgctgagaaatatgttagaaggggtaggctggactggcctgaaggggcgacttcaagggaaagtatcagggctgttacgaagttgcagcggctgcagaatctaataatgcagcatgttgatcactcagcgggagatctcatacatctcttacaaggacttcttaaatatgattcctcggataggttaactgctagagaagctctaaggcaccccttcttctgcagggacaatcttaggatgtgattggttagatattgatataagcatcccgcatctgatttgctattggagcgactcagtgatgttcagaaagtattaattcaaattgacaacacttgtgtagatgtcgagggttcttctggccaattcagtcttatgggttcttaactcaattctgaatctgtgtagatattctttttggttgaagcagcacttgttctatgccagtggattgagttatattggatgccaagaagccctagatctggattgtaaattgtctacaattgacaactaatggaaagcaaggattatttagttttgattgggggattttctatccaattagagatctaaatagcatctaattgtgttcatttgtacactgactactgatggttcatgacttgtatggaaagacaacatat

SEQ ID NO: 7431 - DNA, 1946 bp, Catharanthus roseus
atttcatcaaagttttttctctctctactgtatttgtttttttctctctgtagactttcgtgatggagatggaacgcgtgacggagtttccactcacgcatcttgatcgtaggccgaggaagaggccgcgattgggctgggatgtggtgcctgagacaccgtttcagactcaggtggctcctaaggctcagctaggtttgttttgtggacaagagcttggaaatgtgacaagctatgcgtcttcaagggcaaccccagaacattctactagttcattgtttaataagggagtggctcgaattggttctcccccatggcgaggagatgacaaagatggacattatttgtttgagcttggagagaatttaacttctcgctataaaattcacagcaagatgggagaaggcaccttcggccaggtcctagaatgttgggatagggagaggaaggaaatggttgccattaaaattgttcgaggtgttaagaagtatcgggaggctgccatgattgaggtcgatgtacttcaacagcttggtaaacatgataaagggggcaaccgttgtgtgcaaatacggaactggtttgactatcgtaaccatatctgtattgtctttgagaagcttggaccaagcttatacgattttctacggaaaaacaattaccgctcatttcccattgatcttgtacgagagattggcagacaactattggagtgtgtagcatttatgcatgatctgcaccttatccacactgatttaaaaccggagaacattcttctagtatctcccgagtacattaaagttcctgattacaggggtttcacaaggtcaccaaaggatggatcttattacaagagaataccgaagtcgagtgccataaaggtaatcgactttggtagtactacatatgatcggcaagatcagacatacattgtttcaacacgtcattaccgtgcaccagaagttattctaggacttgggtggagttatccttgtgatgtatggagtgttggctgcattctggttgagctatgctcgggggaggccttgttccaaacacatgagaatttggaacaccttgctatgatggaaagggtacttggtcctctgcctcaacacatgttgaaaaaagctgaccggaatgctgataagtatgttaggaggggccgattagactggccaggagctgcatcccgggatagtatcaaagctgttcttaagttgcctcgccttcagaatctcgtaatgcagcatgttgaccattctggaggggatctcattcacctcctgcaaggtcttctcaagtatgagccgttggataggctgacagctcgggaagctcttaggcatccatttttcactagggattgtttgaggcggtccttctgaaagttttctggcagctcaggatcgaaatatgatggccttcaacctgcaatttaaaggcgagggtcttgagcttggccgttgagtgtaaagactgaccatagctgatttgctaacccagtgttagaattgattgctgaccttgcttttgtacatatcaagttcttgagaagcagatgtagagctcctaccactgtctttacatccacactactctttgctgagagttctagatctctgtgaacatgagcatatacaatttcagacgcttgtgtgcaattgctaacttaagtttatatcaagtttggagatacattataccaagaaatatatacttgcgtattgtttcaattttccctttcatctttcaagtatttagctttgcttctgtatggtagtagtttatgcaattggcatccgatctaaatgtgccaatagtaagcttaatttgaattaatcagagtcgtgtatttttttaaatgctggttaaccttttcagaggttaaaacaagttgcatatgaagacggttcaaaataggcttcaataactgctaattttct

SEQ ID NO: 7432 - DNA, 1514 bp, Flaveria ramosissima
acaatcgatcatcggaaaattcaaccggagatctgtgaaaacgagcagcagatcatggagatggagcgcgtgacggagtttccgataagtaacgtcgacatcggaccgagaaaacggcagcgaattggctgggatgttgttcatccggctgctaaggctcagctaggattgttttatggacaagatgttggaaatgtgaccagctttgcaccctcacgggcaccccaagaccataataattcatctattgttaagcatgtggctcacaatggttctccgccatggcgtgaagatgataaagatgggcattatatgtttgcacttggagataatttaacttctcgatataagattcatgggaaaatgggagaaggtacatttggtcaagtgttggaatgctgggataaagaaaggaaggaaatggtggccattaaaattgttcgtggtataaagaaataccgtgaggcagccatgattgagattgatgtgctccaacaacttggtaaacatgataaaggtggcaatcgttgtgtacaaataaggaactggtttgactatcgtaaccatatctgtattgtttttgagaagcttggaccaagtttatatgattttctacgcaaaaacaattatcgatcatttcctatagacctagttcgtgagattggaagacaactcttggaatgtgtagcattcatgcatgatatgtgcttaatacacaccgacttgaagcctgagaacattcttctagtgtccccagaatatatcaaagttcctgattacaagggttcatctaggtcgcccaaggatagttcatactccaagagaataccaaaatgcagtgctatcaaagtaattgattttgggagcacaacatatgaccgtccggaccagaactacatagtgtcaactcgtcattatcgtgcaccagaagttatattaggattaggatggagttacccttgtgatatatggagtgttggttgtatccttgtggagctttgttctggtgaagctttgtttcaaactcatgagaatcttgaacatcttgctatgatggagcgggtccttggatttttacctcagcacatgttgaggaaagcagatcggcatgcagataaatacattagaaaaggtaggctggactggcctgagggtgctacctcgagagaaagtattaaagctgttcaaaaactacctcgacttcagaacttaatcatgcaacatgtagatcattcagccggcgaccttattcatctcttacaggggcttttgagatatgatcctttagataggttaacagcacgagaagctttaagacattcgtttttcactagagatcactttaagcgttattagatatgatgtgggttgtatgttttttatcgtgtcatgttcccatcccgattgaatacaaagtttaagtcttacgctagttgagtcctgtatgtgtttagcagaatatcttcttgatagcaatgtgcaagtgtgtgtgtttattgtaaatggctaatctg

SEQ ID NO: 7433 - DNA, 1470 bp, Flaveria ramosissima
tggaacgtgttacggagtttccgatgagtcagttggatctcaggccgagaaaacgacagaggttgggctgggatgtggctccggcgccgacgaaggctcaggtaggattgttttgtgcacaagagattggaaatgtgaccagctttgcacctttgggggccccaacagaccatattagttcatccatcctaaaacgagtggctcgagaggtttctcccccatggcgccaagatgataaggatggacattatgtgtttgcagttggagataatctaactaccagatataagattcatggaaaaatgggtgaaggtacgtttggccaagttttggaatgttgggacaaagaaagaaaagaaatggttgccattaaaattgttcgtggtataaagaagtatcgtgaggcagctatgatagagattgatgtgttgcaacaacttggtaaacatgacaaaggtggcaaccgttgtgtgcaaataaggaactggtttgactatcgtaaccatatctgtattgtttttgagaagcttggaccaagcttatatgattttctacgcaaaaacaattatagctcattcccaattgacctagttcgggagattggcagacaactattggaatgtatagcattcatgcatgatttgcggctaatacacactgatttaaagcctgaaaatgtacttctagtgtctcctgagtatgtgaaagtgcctgattacaaggcttcatcaagatcaccaagggattgttccttttccaaaagggtcccaaaatctagtgcaattaaggtgattgactttggtagtacaacatatgatcgtcaggatcagaactacatagtctctacccgacactatcgtgcaccagaagtaatactaggacttggatggagctatccgtgtgacatatggagtgtcggctgcattctggtggaactctgcaccggtgaggctttgtttcaaacacatgaaaacttggaacatcttgcaatgatggagaaaatacttgggacgttgcccgtgcacatgttgaagaaatcagaccgacacgcagagaagtatgtgagaaaaggtagattggactggcctgagggtgcaacctcaagagaaagcatccgagccgtgatgaagctaccccgccttcagaacctgattatgcagcatgtagaccattctgcaggggacttgattcatttgctgcaagggctgttaaggtatgaccccttggacaggctaacagcacgtgccgcactaagacatccgtttttcacccgggatcattttagacggtactagttccataaaaactaaaggtcattggaaataatcgaggtagaaaatgcatacggcttcatggcgtgctcttcgactgtacaaaagtataacacaaaagtataacccttaacaagggtttgtttggtgttcctgcaaacatggtttatatcaaccagatctgattgactgatatatt

SEQ ID NO: 7434 - DNA, 1395 bp, Nicotiana benthamiana
tacgcaacttctttctacatctctcgtcaagttttctctctctaaaactaagacttttctctctctaaattttctagcttttctgtaatggaaacggaacgtgtgaccgagttcccgatgacccatctggatcttcgtccaagaaagagggcgcgtttgggctgggacatacttcctgagcagcctaaggctcagctagaattgttttgtggacaagcggttgggaatctgacaagctatacgacttcgaggcaacctacagaccttactggtacactggttgttaaggggcggaatggttctcccccatggaggaatgatgacaaagacgggcattatacatttgagcttggagaaaatttatcgtcacgctacaaaatccacagtaaaatgggagaaggtacttttggccaggttctagaatgctgggaccgtgaaaagaaggaaatggtggccattaagattgttcggggcattaaaaagtatcgtgaagcagctatgattgagattgaaatgcttcaacagcttggtaaacatgacaaagctggcaattgttgtgtgcaaatacggaactggtttgactatcgtaatcatatctgtattgtctttgagaagctaggaccaagcttatatgatttcctacggaaaaacaattaccgctcatttcccattgatcttgtccgtgagattggcagacaactcttggaatgtgtagcatttatgcacgatttgcgtctcatccacactgatttgaagcctgaaaacattctgcttgtctccccggattatattaaagttcccgactataagttttcttcaaggtcacctaaagatagttcttactacaaaagagttccaaagtcaagtgctataaaggtaatcgattttgggagcacaatatatgatcgtcaggatcagaagtatattgtatcaactcgtcattaccgtgcaccagaagttattctaggtcttggatggaggtacgcatgtgatgtatggagtgttggctgtatccttgtggagttatgttcgggagaagcattgtttcaaacacatgaaaatctagagcaccttgctatgatggagagggtacttggctcccttcctcaacacatgctaaaaagagtagaccggcaagcagacaagtatgtgagaaggggacgtttggactggcctgaaggagcatcatcccgtgacagtatcaaagccgtgttaaagcttactcgccttcagaatataattatggagcatgtggatcattcagctggagatcttattaatctcttgcatggactcctccgttatgatccatctgaaaggttaactgctcgtgaggcactgagacatcctttctttacgtggggtcatctgagtaggtaaattggattgcacttc

SEQ ID NO: 7435 - DNA, 1764 bp, Solanum lycopersicum
atttcgcatcaatctcttccgtcttttcctaactttctttgcaattgttttctctctctaaatttgtaagctttctgccatggaaactgagcgcgtgaccggctttccgttgacgaatcttgatcggcggccaagaaagagggcgcgtctgggctgggatgttcttcctgaaccgcctaaggctcagctaggattgttttgtggacaagatgtggggaatgtgacaagctatgcatcttcaaggcaactcactgaccttactagtgctccctttactattaagggagtggctcaaaatggttctccccctcggagagaagatgacaaggatggacattttgtgtttgagctgggagaaaatttaacaccacgctataagatccacagtaagatgggtgaaggtactttcggtcaggtcctagaatgctgggatcgcgaaaggaaagaaatggtggctatcaaaattgttcggggtatgaagaagtatcgtgatgccgcaatgatagaggttgaaatgcttcaacagcttggtaaacatgataatggcaatcgttgcgtacaaatatggaactggtttgactatcgtaatcatatctgtattgtctttgagaagcttggaccaagcttatatgatttccttcggaaaaacaattaccgttcatttcccattgatcttgtccgtgagattggaagacaactgttggattgtgtagcatttatgcatgatttgcgccttatccatactgacctgaagcctgagaacatacttctcatctccccagaatatgtaaaggttcctgactacaaggtgtcttctaggtcaccaaaagatggttcttactataaaagaatcccaaaatcaagtgctataaaggtaattgattttggtagcactacatatgaccgtcagaatcagacatatgttgtgtcaactcgtcattaccgtgcacctgaagttatcctaggtcttggatggacgtacccttgtgatatatggagtgttggctgtatccttgtggaactttgttcgggagaagcattgtttcagacgcacgagaatttagagcaccttgctatgatggagaaagtactgggccccctgcctcagcacatgctgaaaagagtggaccgtcaagcagagaagtatgttagaagaggacggttggactggcctgagggggcaacttcccgggatagtattagagctgtgttaaagttggcccgtcttcagaacataatcatgcagcatgtggatcattctgcaggtgatcttattaatcttttgcaaggacttcttagatatgatccttcagaaagattaactgctcgggaagccttgcggcatccgtttttcacccgtgatcatcttaggagatagaacaacgctttgttttaactttttgtactcgtgtgcacacaatgctattgcatgatgatggtggccctccaaccttgaatgccatttgatgcggtggtgaccggaagccaactctgttggctcattgtggtgatagttgaatctgactttgtccctgtgtaaataaatccaaaatactggttttttgcggggcattcttgtattatatattactagggtaaggttgtggtggaagtacccaccagtgtgtataagatgatttctcactcctcaattactaacacaaattgattgcaaggatgagttatgagattgtttcaaaattatttatcgtcattttcacctacttgagaaacaaaaatttagttttttgttcgaaattttta

SEQ ID NO: 7436 - DNA, 1832 bp, Gossypium raimondii
ctgtgcggcccatatcacaattttagaaggatcgcacattcacatggcatattccgtcaatccaacggtaaatctcttgacacgtgtacggaaagatagcatcacaaccgcctcggtccctttagttgttaggttaaaaactcgggtacggtgagcgaaaccttatcctgaagaaagggggaaaaaatattaattttcaattttttatcattttcacgggaaaaagaaagaattttcttttctagatctagtctttacgatcatggagatggagagcgtgacggagtttcctcatacgcatatggatcggcgacctagaaagcggccgcgattgggatgggacgtaactcagttgccgccgcaggctcaggtaggaatgttttattcacaagagatttggaatgtgacaagcgttgcttctactgcaaaagcaccctcagattgtgctagtactattactactagttcttctgtagttctaaatggtggagttgctcgaaacggttctcccccgtggcgagaagatgacaaagatgggcattacatgtttgagcttggagataatttaacctctcgctataagatacagagtaaaatgggtgaaggtacttttggtcaggttttagaatgctgggatagagagaggaaggagatggttgctatcaaaattgttcgtggaattaagaaatatcatgaagcagccatgatagaaattgagatgctgcaacagcttgggaaacatgataaaggtggcaatcgttgtgtgcaaatacggaactggtttgactatcgtaaccatatctgtattgtgtttgagaagcttggaccaagcttatacgattttctacggaataacaattatcgctcatttcccattgatcttgtccgcgacattggcagacaactattggaatgtgtagcattcatgcatgatttgcgtctgatacatacggacttgaaaccagaaaatattcttcttgtctctccagagtgtgtcaaagttcctgattacaagggtacatcaagatttcctaaaggtagttcttactttaaaaggttgccaaaatctagtgccattaaggtaatagattttggtagcactacttatgagcgtcaagatcagacttacattgtgtcaacacgacattatcgtgctccagaggttattcttggactgggatggagttacccttgtgacatatggagtgttggctgcatcttagttgaattatgcacgggtgaggcattgtttcaaacacatgagaatctggagcaccttgccatgatggagcgggtgttgggtccactacatcagcacatgttgaagagagtagatcgacatgcggagaagtatgttagaagtggtagactggattggccagatggtgctgcatcaagggagagtatgagagctgttcttaagctacctcgtcttcagaacttgataatgcagcatgtggatcattcagctggggatctaatccatctattgcaggggttgcttaggtatgaccctattgataggctcactgctcgtgaagctctaaggcatccgttttttagcggggacaagtttaggcgatgagcatgcgatatgcttcattttgtaaattgcatcaaacattcagttacatgaaaattgtatcattagttggattgaatatacctttttataaattatcctgcccatgtcgttgttgtttcaatgcatctctgagggcaattgacacttgaaaaaagtgttgcaacatgatattttaaaattaaaacaaataatttaagattaaatatcttatgctgttgagcttccaaatgcaaaattaaataaagca

SEQ ID NO: 7437 - DNA, 1771 bp, Euonymus alatus
gatcgccgcttcatagaatcttcctaattttctcaaagctattggtttcttgtcaaaatttgcaaattttctctctttttacagttgtaatcttgttcgccatctgcgatatctctgtgtttcgttgcggtaatggagatggaacgcgtgacggggtttcctctcgatcggcgacccaggaagagggcgcgcttgggatgggacgttcctctggtcccaaaggctcaggtaggaatattttgtgcgcaagaggttggaaatgtgatcagctttgcatcttcgagagcaccctcagacattattcctaattctctatttgtaaagggagtggatcgaaatggttctcccccatggcgggaagatgacaaagatgggcattacgtgtttgcagttggagataatttaacttctcgctataagatacacagcaaaatgggtgaaggcacatttgggcaggttttggaatgctgggaccaagaaagggaagaaatggttgccattaaaattgttcgtggaatcaagaagtaccgtgatgctgctatgattgaaattgaagttcttcaacaacttgcaagacaggataaaggcaatcgttgtgtacaaatacggaactggtttgactatcgtaaccatatctgtattgtgtgtgagaagcttggaccaagcttatacgattttcttcgcaaaaacaattatcgctcatttcccattgatctagtccgtgagattggcagacaactgttggaatgtgtagcatttatgcatgagttgcgtttgattcatactgacttgaagcctgagaacatacttctggtttcacccgactatgtgaaagttcctgattataagagttcatcccgatccccaagggacggatcctattttaaacgggttccaaagtatagttctattaaagttatagactttggtagtactacatatgaacgtcaagatcagagctatgttgtctcaacgcgacattaccgtgcaccggaggttattcttgggcttggatggagttatccctgtgatgtatggagtgttggttgtatattggtggagttctgcacgggagaggcattgtttcagactcacgagaatttggagcatcttgcaatgatggaacgggtgctgggtccattgcctcatcatatacttaagaagattgatcgacattcagagaagtatgttagaaggggaaggcttaactggccagaaggtgctacgtcaagagatagtataagagcagtttcgaagcttcctagacttcagaacttgataatgcagcatgtagaccattcagctggagatcttatacatcttttacaaggtcttcttagatacgatcctactgagagattggctgcccacaatgctctaaagcatccgttttttatgagggaacatcaaaggagatgaattagggtgtaggtgattgatttgttggattatggcagctgttgatatgcaagtcatatcctgtagtacagagatgggccttagtttttctttgcccaaaggtagaggctgcatccgtgtacataggttctcatagtggagcaaagtgtgtagcgagtgctaatccaagtggggctgttaccgaacccggaggtgtaaaattgacaaaatggttaaccagtaattagaaatgcttatttttgccgattcttgtcataactcctaaccgtttattctatttgtggcattattctggtcgcattgtgggctttggtatcgttaaggttatgcttactcccagcgaaattggact

SEQ ID NO: 7438 - DNA, 1638 bp, Gossypium raimondii
gcgaaaccttatcctgaagaaagggggaaaaaatattaattttcaattttttatcattttctcgggaaaaagaaagaattttcttttctagatctagtctttacgatcatggagatggagagcgtgacggagtttcctcatacgcatatggatcggcgacctagaaagcggccgcgattgggatgggatgtaactcagttgccgccgcaggctcaggtaggaatgttttattcacaagagatttggaatgtgacaagcgttgcttctactgcaaaagcaccctcagattgtgctagtactattactactagttcttctgtagttctaaatggtggagttgctcgaaacggttctcccccgtggcgagaagatgacaaagatgggcattacatgtttgagcttggagataatttaacctctcgctataagatacagagtaaaatgggtgaaggtacttttggtcaggttttagaatgctgggatagagagaggaaggagatggttgctatcaaaattgttcgtggaattaagaaatatcatgaagcagccatgatagaaattgagatgctgcaacagcttgggaaacatgataaaggtggcaatcgttgtgtgcaaatacggaactggtttgactatcgtaaccatatctgtattgtgtttgagaagcttggaccaagcttatacgattttctacggaataacaattatcgctcatttcccattgatcttgtccgcgacattggcagacaactattggaatgtgtagcattcatgcatgatttgcgtctgatacatacggacttgaaaccagaaaatattcttcttgtctctccagagtgtgtcaaagttcctgattacaagggtacatcaagatttccaaaaggtagttcttactttaaaaggttgccaaaatcaagtgccattaaggtaatagattttggtagcactacttatgagcgtcaagatcagacttacattgtgtcaacacgacattatcgtgctccagaggttattcttggactgggatggagttacccttgtgacatatggagtgttggctgcatcttagttgaattatgcacgggtgaggcattgtttcaaacacatgagaatctggagcaccttgccatgatggagcgggtgttgggtccactacatcagcacatgttgaagagagtagatcgacatgcggagaagtatgttagaagtggtagactggattggccagatggtgctgcatcaagggatagtatgagagctgttcttaagctacctcgtcttcagaacttgataatgcagcatgtggaccattcggctggggatctaatccatctattgcaggggttgcttaggtatgaccctattgataggctcactgctcgtgaagctctaaggcatccgttttttagcggggacaagtttaggcgatgagcgtgcgatatgcttcactttgtaaattgtatcaaacattcagttacatgaaaattgtatcattagttggattgaatatacctttttataaattatcctgcccatgtcgttgttttttcaatgcatctctgagggcaattgacacttgaaaaaagtgttgcaacatgatattttaaaattaaaacaaataatttaagattaaatatc

SEQ ID NO: 7439 - DNA, 1574 bp, Triphysaria pusilla
ttttgccagatcctgagatggagatggaacgcgtgaccgagctgacgatggatcggcggccgaggaaaagggcgcgattgggctgggatgttcttcctcaagctcccaaggctcagctagggttgtttactggacaagagattggaaatgtgacaagctatgcaccttcgagcgcaatatcggaacatcatagttcattatttgttaagaagagcttggctcgaaatggttcccctccatggcgagaagatgacaaagatggccattatgtgtttgagatcggagattatttaacttctcgctataagatttgcagcaagatgggtgaaggcacctttggtcaggttttggagtgttgggatagggagaaaaccgaaatggtagctatcaaaattgttcgtgggattaagaaatatcgggacgcagcaatgattgaggtggaagtgctccaacaacttgctaggcatgacaaaggtggcactcgttgtgttcaaatacggaactggtttgactatcgtaaccatatctgtattgtctgtgagaagcttggaccaagcttatacgatttcctacgcaaaaacaattatcgctcatttcccattgatcttgtccgtgagattggcagacaactattggaatgtgtagcatttatgcatgatttgcacctcatacatacggacttgaagcctgaaaatatacttcttgtatcaccagaatacttgaaagttcctgattacaagggttcttcaaggtctcccaaagacggttcatattacaagagagttccaaaatcaagtgctatcaaagtaattgactttggcagcactacatatgacaagaaggaccagtcatacatagtatcaactcgtcactacagagctcctgaagtcattctaggacttggatggagttacccttgtgatgtatggagtattggctgtattttggttgagctttgctcgggtgaagcattgttccaaacccacgaaaatttggagcatctcgcaatgatggaaagagtcattggacccttgccccagcacatgttgagaaaagcagatcgacatgcagataagtatgttagtaggggcagattagactggccggaaggggctacatctagagatagtataaaagctgttacaaagttgccgagacttcaaaatttgatcatgaaccacgtggatcattctgccggagatcttatacatttattacaaggtcttctgagatatgatcctaatgaaagaatgtcggctcaagaagccctcaaacactcgtttttcacgagggatcggttaagtagatactgaaatttgttcgaataatgaatgaggagctctatttcgcactgtgccggtgaaaaatgattcgacggtgaagattggttgtgcttttgggatgtgacatataatataccaaattgcgctcggagggtcggcggtgtacatagattcggcacagtggtggtgtagctcgtctttcgatcatgtcttgtgctgtatttgttcacctattatgaaataattataacaagatttagaatgaatacttagaaacaaaaaaaaaaaaaa

SEQ ID NO: 7440 - DNA, 1336 bp, Cirsium arvense
cttgatcgaagaagaataaaatcatagtttcgtgacaaaaatttgcatccgatcatggagatggagcgtgttacagagtttccgatgagtaatgttgatctccgaccgagaaaacggcagcgacttggctgggacgctgttcatccggcgactaaggctcagctaggattgttttgtggacaagaggttgaaaatgtgaccagctttgcaccttctcgggcaccccaagaccataataattcatctcttgttaagcgtgtggctcgcaatggttctcccccatggcgtgaagatgataaagatgggcattatatgtttgcacttggagataatttaacctctcgctataagattcatgggaaaatgggagaaggcacgtttgggcaagtgttggaatgctgggacaaagaaaacaatgaaatggttgccataaaaattgttcgtggtataaagaaatatcgtgaggcagctatgattgaaattgatgtgctccaacaacttcgtaaacatgataaaggtggcaatcgttgtgtacaaataaggaactggtttgactatcgtaaccatatctgtattgtttttgagaagcttggaccaagtttatatgattttctacgcaaaaacaattatcgctcatttcccatagacctagttcgtgagattggcagacaactcttggaatgtatagcatttatgcatgatctacgcttaattcacaccgacttgaagccggagaacattcttctagcatctccggagtatatcagagtgcctgattacaagggttcatcaaggtcaccgaaggatagttcttactccaaaagagtccccaagtgtagtgctatcaaagtgatcgattttggcagcacaacatacgatcgtcaggaccagagctatatagtgtcaacacgtcattatcgtgcaccagaagttatattagggcttggatggagttatccttgtgatatatggagcgttggttgtatcctggtggagctttgctctggtgaagctttatttcaaacacacgaaaatctcgaacatcttgctatgatggaaagggtgctcggctttttacctcaacacatgttacggaaagcagatcggcatgcagaaaagtacattagaaagggtcggttggactggcctcagggtgctacctcgagagaaagccttaaagctgttgcaaaactgcctcgacttcagaatttaatcatgcagcatgtagatcattcagccggggagctgattcaagtgttgcaggggcttatgagatacgatccttcggagaggttaacggcacgtgaagctttaagacatccgttttttacccgag

SEQ ID NO: 7441 - DNA, 1588 bp, Triphysaria pusilla
gagagtattattattctctcttcacaccctagctttctctccagaaaaaaatatatttcttgcatttcggccggatcctgagatggagacggaacgcgtgaccgagctgacgatggatcggcgcccgaggaaaagggcgcggttgggctgggatgttcttcctcaagctcataaggctcagctaggattgttttctggacaagagattggaaatgtgacaagctatgcacctccaagcgcactattggatcatcctaattcattatttgttaagaatggcttggctaggaatggttctcctccatggcgagtagatgacaaagatggccactatgtgtttgagatcggagataatttaacttctcgctataagatttgtagcaagatgggtgaaggcacctttggtcaggttttggagtgttgggatagggagaaaaccgaaatggtagctatcaaaattgttcgtggtattaagaaatatcgtgacgcagcaatgattgaggtagaagtgctccaacaacttggtaggcatgacaaaggtggcaatcgttgtgttcaaatacggaactggtttgactatcgtaaccatatctgtattgtctgtgagaagcttggaccaagcttatacgatttcctacgcaaaaacaattatcgctcatttcccattgatcttgtccgtgagattggcagacaactattggaatgtgtagcatttattcatgaattgcatctcatacatacggacttgaagcctgaaaatattcttcttgtatctccggaatacttgaaagttcctgactacaagggctcttcaagatctcccagggacagtttatattacaagagagttccgaagtctagtgctatcaaggtaattgattttggtagcactacatacgacaaggaccagtcatacatcgtatcaactcgtcattacagagctcctgaagttattctaggacttggatggagttacccttgtgatatatggagtgttggctgtattttggttgagctttgctcgggtgaagcgttgttccaaacccatgaaaatttggagcatcttgcaatgatggaaagagtgctcggaccaatgccccagcaaatgttgaaaaaagcagatcgacacgcagagaagtacgttagaaggggcagattagattggccggagggggctacgtctagagatagtatgaaagctgttactaaattgccgagacttcagaatttgatcatgcaacacgtggatcactctgccggagatcttattcatttattacaaggtctcttgagatatgatcctgcagaaagattgtcggctcaagaagccctcgagcacccgtttttcacaagggatcgtttatgtagatactgaaattcctttggataatgaatgggctctatttccggctgctggtgagcaatgattcaacgattcaagagccgtgtacatagattttcagtagtcctgtgttgtatttgttttcttattaagtactcgatgaaataatggtaacaagattagatgaataatacatatcttgcccggtttattttaatgttgtgccaaagaatatattttgttaca

SEQ ID NO: 7442 - DNA, 3785 bp, Malus domestica
tgttcatatttattatattttatttttgcagatctagttatattttcagtgatatttctggttctggaatcaaggagggggcggtcaagatgtcttctctgagtagagagcttgtgttcttgatcttgcaatttctcgatgaggaaaaattcaaagagactgttcacaagctagagcaggaatctgggtttttctttaatgtgaaatactttgaggatgaggtgcataatggcaattgggatgaagttgagaagtacctctccgggttcactaaagtggacgataaccgctattccatgaaaatctttttcgagataaggaagcagaagtatctcgaggcattggacaagcatgatcggtccaaagccgtggatattctagtaaaggatttaaaggtttttgccacattcaatgaagaacttttcaaggaaatcactcagctcttgacattggagaactttagggagaatgaacaactatccaagtatggagatacaaagtctgccagggcaatcatgttggttgaacttaagaaactgattgaagcaaatcccttattccgtgataaattgcagttcccaagccttaagaattcgaggctacggacactcattaaccaaagcttaaattggcagcatcagctttgtaagaacccaagaccaaatccagatataaaaacactttttgtggatcactcatgtggacaacctaatggtacgcgggcaccatcacctgcaaacaacccactgcttggatccttaccaaaagctggagggtttcctccactaggtgcacatgggccttttcaacctacaccagccccggttcccataccccttgcaggttggatgtctaatccttccactgttactcatccagcagtttctgaaggaggaggtattggtcttggtggtccatcaataacagctgccttgaaacatccaaggactcctccaactaatccttctgtggagtatccgtctggggattctgatcatgtttctaaaagaacaaggccgatggggctgtctaccgaggttaatctccctgttaacatgttgccagtaacatttccagggcacggtcatggtcaacctttgaatgcacctgatgacttgcccaagaatgtcacactgactttgaatcagggttcatctcccatgagcatggattttcatccttcacagcagaccttgcttcttgttggtaccaatgtgggggacatagggctgtgggaagttggatctaaggagcgactagttttacggaacttcaaagtatgggatcttagttcgtgctcaatgcccctgcaggctgctctagttaaggaccctggtgtgtctgttaaccgtgtgatttggagccctgatggtgctttgtttggtgttgcttactcaaggcacattgttcaaatatattcatatcatgggggtgatgacgtacgacagcacctagagattgatgcacatgttggtggagtaaatgatatagcattctcccatcccaataagcagctttgtgtgattacctgtggggatgacaagaccatcaaggtgtgggatgctacaactggtgcaaaacaatatacttttgaaggtcatgaggctccagtttattctgtctgcccacattataaggaaaacattcagtttatcttttcaacagcactggatggaaagataaaggcttggttgtatgacaatttgggatctcgagttgattatgatgctcctggtcgctggtgcacaaccatggcttatagtgctgatggtacaaggctattttcatgtgggacaagtaaagatggtgagtcatatattgttgaatggaatgaaagtgaaggggctgtgaaaaggacctatcaaggctttcgcaagcgttcttttggcgttgtgcaattcgatactactaaaaaccggtttttggctgctggtgatgatttttctattaaattttgggacatggacaatattcaacttctgacaactgttgatgctgatggaggcctcccagcaagccctcgtatccgctttaacaaggatggcactctcttggctgtttctgccaatgagaatgggattaaagttttggcaaatgcagatggaatgcggttgttgcgaacatttgagaatcatctctcttatgatgcgtcaaggccctctgaagttgtgacaaagcctgcaataaccccaattcaagttgcagcagcagctgctagtggtgctggactggctgaaagaagtgcatctgcagctgctgtttctggaatgaatggggatgctcggaacttaggggatgtgaaacctagaatagcggaagaatccaatgacaaatcaaagatttggaaactcactgaaatcagcgaaccatcacaatgccgttccttgaggctacctgaaaacatgagagtaaccaagatttcgaggttaatctatactaattcgggaagtgcaattttggctttagcatcaaatgccatccatttgttatggaaatggcagaggagtgagcgtaactctagcaaggcaactgctagtgtttcacctcaactgtggcaaccctcaagtggcattttaatgaccaatgatattactgacacaagtcctgaagaagctgttccttgctttgctttgtccaagaatgattcttatgtaatgtcagcatctggtggaaagatttccctgttcaatatgatgacatttaagacaatgacaactttcatgcctccaccacctgctgcaacatttcttgctttccatcctcaagataacaatattatagctattgggatggatgattctacaattcagatatataatgtccgcgtagatgaggttaagagcaagcttaaaggccactctaaaagaataactggcctagcattttctcatgtactgaatgcgctagtttcgtcaggagcagatgctcagctctgcgtatggaactctgatggatgggaaaagctgaagtccagattcttgcagcttccagctgggagaacaacagcttcactgtcagacacacgtgtacagtttcatcacaaccagcaacagttcttggttgtgcacgagactcaacttgccatatatgaaacaacaaaactagaatgtgtaaagcagtgggttccacgtgattctgctgcaccaatctctcatgcaacattctcatgcgatagccagcttgtatatgccagctttttagatgcaaccgtgtgtgtgttcagcgctgcaaatctcagactgcggtgtcgtattaatccttctgcttatcttcctgctaatgttagttctaacgtacagccccttgttattgcggcgcatccacaagaagcaaatcagtttgcattaggactatcggatggtgctgttcacgtctttgagccccttgaatctgaaggcaaatggggtgtggctccacctgttgaaaatggttcagcaagcagtgcgccggctactcaagttggaacttcaggttcagatcaagctcagagatgatcaagaggctggcagagcacaagttcttttacatgctttgcttgctggcctattccaaatacagtttgtgttcttcatgcagtgtaatttaatcaaggaaggatgtgcagatatgtagatttaacaagttggttcagaatctcaagtaaggtaaatgcagtaggagtattgtcagtgaaacgtatttaaattgtgtcagaaatgaagagttttattttctccggtatgcttttctttcaattgatgatcatgaatatcattctagttttttatttttattttttatgtcaa

SEQ ID NO: 7443 - DNA, 3939 bp, Prunus mume
tattttatttttgcagatctagttataatcttggtgatatttctggttctggaatcaaagacgaggggtcaagatgtcttctctcagcagggagcttgtgttcctgatcttacagtttctagatgaggaaaaattcaaagagactgtacacaagctggagcaggaatctgggtttttcttcaatatgaaatattttgaggatgaggtgcataatggtaattgggatgaagttgagaagtacctgtccggattcactaaagtggacgataaccggtattccatgaaaatcttttttgagatacggaaacagaagtatcttgaggcattggacaagcatgatcggtccaaagctgtggatatactagtaaaggatttaaaggtttttgccacattcaatgaagaacttttcaaggaaatcacccagctcttgacattggagaactttagggagaatgaacaactatccaaatacggagatacaaagtctgccagggcaataatgctggttgaacttaagaaactgattgaagcaaatcccttattccgtgataaattgcaattccccaacctcaaaaattcgagactacggactctcattaaccaaagcttaaattggcagcatcagctttgtaagaacccaagaccaaatccagatataaaaactctttttgtggatcactcgtgtggacaaccgaacggtgcgcgggctccatcacctgcaaacaatccactgcttggatccttgccaaaagccggaggatttcctccgctaggtgcacatgggccttttcaacctacaccagccccagttccaataccccttgcaggttggatgtctaatccttccactgttactcatccagctgcttctgaaggaggagctattggtcttggtgctccatcaattacagctgccttgaaacatccaaggactcccccaactaatccttctgtagagtacccgtctggggattctgatcatgtatctaaaagaacaaggcccatggggctgtcttctgaagtaaatctccctgttaacatgttgccagtaacatttccgggtcatggtcatggtcaagctttgaatgcacctgatgacttgccaaagaatgtcacacggactttgaatcagggttcatctcccatgagcatggattttcatcctttgcagcagactctgcttcttgttggtactaatgtgggggacatagggctgtgggaagttggatctagggagcgactagttttgaggaacttcaaagtttgggatcttggttcatgttcaatgcctctgcaggctgctctagttaaggatcctggcgtatctgttaaccgtgtgatatggagtcctgatggttctttatttggtgttgcttactcaaggcacattgttcaaatatattcttatcatgggggtgacgatatacgacagcaccaagagattgatgctcatgttggtggagtaaatgatctagcattctcccaccccaataaacagctttgtgtaattacctgcggggatgacaagaccatcaaggtgtgggatgctacaactggtgcaaaacagtatacttttgaaggtcatgaggctcctgtttattctgtctgcccacactacaaggaaaacattcagtttatcttttcaacagcattggatggaaagataaaggcttggttgtatgacaatttgggatctcgggttgattatgatgctcctggtcgctggtgcacaaccatggcttacagtgctgatggtacaaggctcttttcatgtgggacaagtaaagagggtgagtcatatattgttgaatggaatgaaagtgaaggggccgtgaagaggacctatcaaggcttccgcaagcgttcttttggtgttgtgcaattcgatactactaaaaaccgatttttggctgctggtgatgatttctctattaaattttgggacatggacaatactcagcttctgacaactgttgatgctgatggaggcctcccagcaagccctcgtatccgctttaacaaggatggcagtctcttggctgtttctgccaatgagaatgggattaaagtattggcaaatgcagatggaattcgattgttacgaacatttgagaatcatctttcttacgatgcatcaaggacctctgaagttgtgacaaagcctgcaataaaccctatttcagttgctgcagcagcggcagctgctgctgctaccagtgccggtctggctgacagaagtgcatctgcagtttctatttctggaatgaatggggatgctcggaacttgggggatgtgaaacctagaatagctgaagaatccaatgacaaatcaaagatttggaaactcacagaaatcaacgaaccgtctcaatgtcgttccttgaggctacctgaaaacatgagagtgaccaagatatcgaggttaatctatactaattcaggaagtgcaattttggcattagcatcaaatgccatacatttgctctggaaatggcagaggagcgagcgtaactctactagcaaggcaactgctagtgtttcacctcaactctggcaaccctcaagtggcattctaatgaccaatgatgttgctgacacaagtcctgaagaagctgttccttgctttgctttgtccaagaatgattcttatgtaatgtcagcatctggtggaaagatttccctattcaatatgatgacatttaagacaatgacaactttcatgccgccgccgcctgctgcaacgtttcttgctttccaccctcaagataacaatattatcgctattggaatggatgattccactattcagatatataatgtccgtgtagatgaggttaagagcaagcttaaaggtcactctaaaagaataactggcctagcattctctcatgtactaaatgtgctagtttcatcaggagcagatgctcagctttgtgtatggaatcctgatggatgggaaaagcagaagtccagattcttgcagcttccagctgggagaacaacagcttcacagtcagacacgcgtgtacagtttcatcaggaccagatgcacttcttggttgtgcatgagactcaacttggcatatatgaaacaacaaaactagaatgtgtaaagcagtgggtcccacgtgattctgctgcaccaatttcccatgcaacattctcatgcgacagccagcttgtatatgccagctttttagatgcaaccgtgtgtgtgtttagtgctgcaaatctcagactacgatgtcgtattaatccttctgtttatcttcctgctaatgtcagcaataacgtacagcccctcgtgattgcggcacatccacaagaaccaaatcagttcgcattaggactatcggatggtgctgttcatgtctttgagcccctcgaatctgaaggcaaatggggcgtgcctccacccgttgaaaatgggtcagcaagcagtgtgccagctactcaagttggaactgcaggttcagatcaagcacagagatgatcaaaaggctggcagagcacaagttcttttacatgcttggcttgctggcccattccaaatatagtttgtgttcttgatgcaatgtaatttactcaaggaatgaatgatgtgcagatatgtagatttaacatgttggttcagaatatcagtaaggtaaatgctgtaggagtattggcagtgatcatgtatttattttctgcgtcagaaaggaagagtttaatgtctctcccttatgcttttcgtcttccaattgatcatgaatatataattcttgttaattttctatgtcaatttccgttgctgtctcagttttcttttcttttgacttcggctgttgttagttggatgttaacctgcaagtcattgtaggataataatggacctttgtccttttttaagattctggtttctcttgaggaaaatggtagggagatgacattattgaa

SEQ ID NO: 7444 - DNA, 3928 bp, Prunus persica
atacaaaaatttctggagagagaaagagagtttactataagtttctagagagagaaagctttctctgagctctgtctctgtctctgtctctctctctctcttcttcgtcttctggatgtgtggttgtttgttctgatttggttctcaagatctagttataagcttagtgatatttctggttctggaatcaaagacgaggggtcaagatgtcttctctcagcagggagcttgtgttcctgatcttacagttcctagatgaggaaaaattcaaagagactgtacacaagctggagcaggaatctgggtttttcttcaatatgaaatattttgaggatgaggtgcataatggtaattgggatgaagttgagaagtacctgtccggattcactaaagtggacgataaccggtattccatgaaaatcttttttgagatacggaaacagaagtatcttgaggcattggacaagcatgatcggtccaaagctgtggatatactagtaaaggatttaaaggtttttgccacattcaatgaagaacttttcaaggaaatcacccagctcttgacattggaaaattttagggagaatgaacaactatccaagtacggagatacaaagtctgccagggcaattatgctggttgaacttaagaaactgattgaagcaaatcccttattccgtgataaattgcaattccccaacctcaaaaattcgagactgcggactctcattaaccaaagcttaaattggcagcatcagctttgtaagaacccaagaccaaatccagatataaaaactctttttgtggatcactcgtgtggacaaccgaacggtgcgcgggctccatcacctgcaaacaatccactgcttggatccttaccaaaagccggaggatttcctccactaggtgcacatgggccttttcaacctacaccagccccagttccaatacctcttgcaggttggatgtctaatccttccactgttactcatccagctgcttctgaaggaggagctattggtcttggtgctccatcaattacaggtgtttcattacattgtgcagctgccttgaaacatccaaggactcccccaactaatccttctgtagagtacccgtctggggattctgatcatgtatctaaaagaacaagacccatggggctgtcttctgaagtaaatctccctgttaacatgttgccggtaacatttccgggtcatggtcatggtcaagctttgaatgcacctgatgacttgccaaagaatgtcacacggactttgaatcagggttcatctcccatgagcatggattttcatcctttacagcagactctgcttcttgttggtactaatgtgggggacatagggctgtgggaagttggatctagggagcgactagttttgaggaacttcaaagtttgggatcttagttcatgttcaatgcctctgcaggctgctctagttaaggatcctggcgtatctgttaaccgtgtgatatggagtcctgatggttctttatttggtgttgcttactcaaggcacattgttcaaatatattcttatcatgggggtgacgatatacgacagcacaaagagattgatgctcatgttggtggagtaaatgatctagcattctcccaccccaataaacagctttgtgtaattacctgcggggatgacaagaccatcaaggtgtgggatgctacgactggtgcaaaacagtatacttttgaaggtcatgaggctcctgtttattctgtctgcccacactacaaggaaaacattcagtttatcttttcaacagcattggatggaaagataaaggcttggttgtatgacaatttgggatctcgggttgattatgatgctcctggtcgctggtgcacaaccatggcttacagtgctgatggtacaaggctcttttcatgtgggacaagtaaagatggtgagtcatatattgttgaatggaatgaaagtgaaggggccgtgaagaggacctatcaaggcttccgcaagcgttcttttggtgttgtgcaattcgatactactaaaaaccgatttttggccgctggtgatgatttctctattaaattttgggacatggacaatattcagcttctgacaactgttgatgctgatggaggcctcccagcaagccctcgtatccgctttaacaaggatggcagtctcttggctgtttctgccaatgagaatgggattaaagtattggcaaatgcagatggaattcgattgttacgaacatttgagaatcatctttcttacgatgcatcaaggacctctgaagttgtgacgaagcctgcaataaaccctatttcagttgctgcagcagcagcagcagctgctgctaccagtgctggtctggctgacagaagtgcatctgcagtttctatttctggaatgaatggggatgctcggaacttgggggatgtgaaacctagaatagctgaagaatccaatgacaaatcgaagatttggaaactcacagaaatcaacgaaccttctcaatgtcgttccttgaggctacctgaaaacatgagagtgaccaagatatcgaggttaatctatactaattcaggaagtgccattttggcattagcatcaaatgccatacatttgctttggaaatggcagaggagtgagcgtaactctgctagcaaggcaactgctagtgtttcacctcaactctggcaaccctctagtggcattctaatgaccaatgatattgctgacacaagtcctgaagaagctgttccttgctttgctttgtccaagaatgattcttatgtaatgtcagcatctggtggaaagatttccctattcaatatgatgacatttaagacaatgacaactttcatgccgccaccgcctgctgcaacgtttcttgctttccaccctcaagataacaatattatagctattggaatggatgattccactattcagatatataatgtgcgtgtagatgaggttaagagcaagcttaaaggtcactctaaaagaataactggcctagcattctctcatgtactaaatgtgctagtttcatcaggagcagatgctcagctttgtgtatggaattctgatggatgggaaaagcagaagtccagattcttgcagcttccagctgggagaacaacagcttcacagtcagacacgcgtgtacagtttcatcaggaccagatgcacttcttggttgtgcatgagactcaacttgccatatatgaaacaacaaaactagaatgtgtaaagcagtgggtcccacgtgattctgctgcaccaatttcccatgcaacattctcatgcgacagccagcttgtatatgccagctttttagatgcaaccgtgtgtgtgtttagtgctgcaaatctcagactacgatgtcgtattaatccttctgtttatcttcctgctaatgtcagcaataacgtacagcccctcgtgattgcggcacatccacaagaaccaaatcagttcgcattaggactatcggatggtgctgttcacgtctttgagcccctcgaatctgaaggcaaatggggcgtgcctccacccgttgaaaatgggtcagcaagcagtgtgccagctactcaagttggaactgcagggtcagatcaagcacagagatgatcaaaaggctggcagagcacaagttcttttacatgcttggcttgctggcccattccaaatatagtttgtgttcttgatgcaatgtaatttactcaaggaatgaatgatgtgcagatatgtagatttaacatgttggttcagaatatcagtaaggtaaatgctgtaggagtattggcaatgatcatgtatttattttctgcgtcagaaaggaagagtttaatgtttctcccttatgctttcgtcttccaattgatcatgaatatataattcttattaatttt

SEQ ID NO: 7445 - DNA, 3753 bp, Glycine max
tttgcagatctagttcactgttgctcattttagtgtgtatctaatcgaagacgagggaggggttcggatgtcgtctctcagtagggaattggtgttcttgatcttgcagtttctcgatgaggaaaagttcaaggagactgtgcacaagcttgagcaggagtcagggtttttctttaacatgaaatattttgaggatgaagtgcacaatggcaattgggatgaggtggagaaatacctctctggtttcacaaaggtggatgataacaggtattctatgaagatattttttgagataaggaagcagaagtatctggaggctttagataagcatgaccggtccaaggctgtagaaatattagtgaaggatttgaaagtgtttgctacatttaacgaagaattgttcaaggaaatcacgcagcttctgacattggaaaattttagggaaaatgaacaattgtcaaagtatggtgatacaaagtctgcacgagcaatcatgttggttgagctcaaaaagctcattgaagcaaatcccttatttcgtgacaaactgcaatttcccaaccttaaaaactcaaggttacggactctcatcaatcaaagcctgaattggcagcatcaactttgcaagaatccacggccaaatcccgacataaaaactctttttgtggatcactcatgtgggcaaccaaatggtgctcgagctccttcacctgctaataacccgctactaggtgccttaccaaaggctggaggatttcctccacttggtgcacatgggccttttcagcctactccagcaccagtgccaacacccctggctggttggatgtcaaatcctaccactgtagcacatgctgcagtttctggaggtggagctataggtcttggtgctccatctatgcctgctgctttgaagcatcctaggacccccccaactaatccttctgttgactatccatctggagactcagatcatgttgctaagagaacaaggccaatgggaatatcagatgaggtgaatcttcctgtcaatgtgttgtcagcaacattccctggtcatggtcaacatagtcaagcttttaatgcacctgatgacatacctaagactgtcgtacgaactcttaatcagggttcatctcctatgagcatggactttcatccaattcaacaatctttgcttcttgttggtacaaatgtgggggacattgctttgtgggaggtgggttctagggagcggttggtctcaaggaatttcaaagtttgggatcttagtgcatgttcaatgccatttcaggcggctcttgtcaaagatccgggtgtttctgtgaatcgtgtgatttggagtcctgatggtgctttgtttggagtcgcttactcaaggcacattgttcagatatactcttaccatggtggggatgaaatacgacagcacctggagattgatgctcatgttggtggagtaaatgatctagcattttcccatccaaataagcaactatgtgtgataacttgtggtgatgataaaaccattaaggtatgggatgctgcttcgggtgcaaagcagtatacttttgaaggtcacgaggctcctgtttattctgtctgatggggaatcatccactgctgagttggaatgaaagtgaaggagctgttaaaaggacttaccaaggatttcgtaagcgatctttgggtgtcgtgcaatttgatactaccaaaaatcgatttttggctgctggtgatgatttctccatcaaattctgggatatggataatgttcagcttttgacaactgttgatgctgatgggggtctccctgcaagcccgcgtattcgcttcaacaaggatggaactcttttagctgtctctgcaaatgagaatggaattaaaattttagccaatggggatggtattcgcttgtcgcgcacactagagaattctttatatgatgcatcaagagcatctgaagccttgacaaagcctataattaatccaatttctgctgctgccgctgctgcaaccagtgctgcactggcagagagggcttcatctgtagtagctattgctggaatgaatggggatacccgaaacttgggtgatgttaaacctagaataagtgaagaatctaatgacaagtcaaagatatggaagctcactgaaatcaacgaacaatctcaatgtagatccttgaagctaccggagaatgtaagagtaaccaagatatcaaggttgatatatacaaattcaggtaatgctattctggcattagcatcaaatgccattcacctactctggaaatggcagcgaaatgagcgtaactcatctggcaaggccactgctaccttgcagcctcagttgtggcaaccatcgagtggcatcctgatgacaaatgacattgctgatagcaatcctgaggatgctgtaccctgctttgcgttgtccaaaaatgactcatatgtaatgtctgcatcaggagggaagatatctctgtttaatatgatgacttttaagactatgacaactttcatgcctccaccacctgcggcaacctttcttgctttccatcctcaggataacaatattattgctataggcatggatgattcctctattcaaatatataatgtccgtgttgatgaggttaaaagtaaactcaaaggccataataaaagaattactggtcttgctttctctcatgtattgaatgtattagtttcatctggagcagatgctcagatttgtgtctggaatactgatggatgggaaaagcagaagtctagattcttgcagcttccttctgggagaacaccaccggcacagtcagatacccgtgtacagtttcatcaagatcaaatacagttcttggttgtacatgaaactcagctcgccatttatgaagcaacaaaactagaaggtctaaagcagtggttcccgcgagactcatctgcaccaatatcctatgcaactttctcatgtgatagccagctggtatatgccagctttttagacgcaacaatctgtgtatttagtgcttcaaacctcagattacgttgtcggatcaatccttcttcatatcttcctgcaagtgtcagttccaacacacaaccacttgtaatcgctgcacaccctcaagaaccaaatcagtttgctgtcggactgtctgatggtggagttcatgtttttgaaccccttgaatctgaaggcaagtggggtgtgcctcccccgattgagaatgggtcagcaagcaatgtggcagctgcttcagttggaccttctccagatcaagctcaaagatgatccatgtcagccgaagacaagtttcttttacatacttggcttgctggccattttaagaactaaatttgtacttaagttaatgcagggcactctccaattcagttgatccagctaagttaaatccatcaatcgtacatgccaaaagtttggagcaacttctttggttgaagaccaaaatcacattgtaatttgccaatagatgtgaaaaattcttttaaagtttaatgctaagatgatgtacaagtccttttgagtactttcaagttgtttttggctatctaattagattggttgatcctaacttgttgccttttgtgagttccatttcagccttactgtactattcttatctgcatcttcatgtttcccatattttctatataatttttgaaaaacaaatcgtcaatttggttcctaaagtatagttccctccttaatagtccttaccttggcatgata

SEQ ID NO: 7446 - DNA, 4086 bp, Theobroma cacao
atttttctagagagagaaagggacaatctctggctcgcttgtgtgtgtgtgtgtgtttttttttccatttttctagagagagaaagcttcgtatttttgttcctctaagagagaggaagcttcttctttctttctctctctgaaaatcgatctcttcgaagaacaagttgggaattgaagacggggcggctacgatgtcgtctctcagtagagagctcgtgttcttgatcttacagtttctagatgaggaaaagtttaaagagactgtgcacaagcttgaacaggaatctgggtttttctttaatatgaaatatttcgaggatgaggtgcataatggaaattgggatgaggttgagaaatacctgtctggtttcaccaaggttgacgataaccgatattctatgaaaatcttttttgagataagaaagcagaagtatcttgaggcattggataagcatgatcgatccaaggctgtggagatattggtaaaggatttgaaagtttttgctacatttaatgaggagcttttcaaggaaatcactcagcttttgacgttggagaattttagagagaatgaacaattgtcaaagtatggagataccaagtctgctagagcaatcatgttagttgaactcaagaagcttattgaagcaaatcctttattccgtgataaattgcagttccctaaccttaaaaattcgaggttacggacactcattaatcagagcttgaattggcagcatcaactttgtaaaaaccccaggccaaatccagatataaaaaccctctttgtggatcactcatgtggacagccaaatggtgcacgggcaccgtcacctgcaaataatccacttcttggatccttaccaaaagctggaggttttcctcccctaggtgctcatgggccttttcaacctacaccagcacaagttccagcaccccttgcaggttggatgtcaaatccttcaaccgtaactcatccagcagtttctggtggaggagctattggtcttggtgcttcttcaatcccagctgcattgaagcatccaaggactcctccgactaatccatctgtagactacccacctggggactctgatcatgtttccaaaaggacaaggcccatggggatttctgatgaggtaaatcttcctgtcaatgtgctgccggttacatttcctggccatggtcacagtcagactttcaatgcacccgatgatcttccaaagactgttgcaagaactctaaatcagggttcatctcctatgagcatggattttcatcctaagcaacagactctacttctagttggtaccaatgttggggagatagcattgtgggaagttggttctcgggagcagctggttttaaagaacttcagagtttgggaacttagtgcttgttcaatgcctctgcaggctgctctagccaaagatcctgctgtctctgtaaaccgtgtaatttggaaccaaccccaccctgagggttctctatttggagttgcttactcaaggcacattgtgcaaatttattcttaccatggtggtgatgacgttcggcaacatttggagattgacgctcatgttggtggagtaaatgatcttgcattctctcttccaaataagcaactttgtgtaataacctgtggtgatgacaagacaattaaggtgtgggatgctagcactggtgcaaagcaatttatctttgaaggtcatgaggctcctgtttattctgtctgccctcaccataaagaaaacattcagtttatcttttcaacagctgtagatggaaagataaaggcatggttgtatgataatatgggatctcgggttgactatgaagctcctggtcgttggtgcacaaccatggcctacagtgctgatggtacaaggctgttctcctgtggcaccagtaaagaaggggactcattcatcgtagaatggaatgaaagtgaaggggctgtgaagaggacatatcaaggattccggaagcgttctttgggtgttgtgcaatttgacacaactaagaataggtatttggcggctggtgatgatttctctatcaaattctgggatatggataatatttcactgttgaccagtattgatgccgatggaggtcttccagctagcccacgcatccgctttaataaggatggctctcttttggctgtttctaccaatgataatgggattaagattttggcgaactcagatggtatgcgattattgcgcactatggaaaacctttcttatgatgcatcaagagcatctgaagccccaaagcctactataaattcaatctccgctgctgcagcagcagcggcagcagtagctgctactagtgctggaattgcagacagaagtgcctctgtggttgcaattgctgcaatgaatggggatgcccggagtttgggggatgtgaaacccagaataacggaagaatccagtgataaatcaaagatttggaagctcactgaaatcagtgaaccatctcagtgtcgatctttgaggcttcctgaaaacttgagggtaaccaagatatcaaggttaatcttcacaaattcaggtaatgctattttggcattagcatcaaatgctattcacttgctttggaagtggcagcgaagtgaacgtaatacaattggcaaggcaactgctagtgtaccacctcagttgtggcaaccatcaagcggcattttgatgacaaatgatgttgctgacacaaatcccgaagaggccgtgccctgttttgctttatcaaagaatgattcttatgtaatgtcagcatctgggggaaagatttccttgtttaatatgatgacatttaagacaatggcaactttcatgccaccaccgccagcagcaacttttcttgcattccacccacaagataataatattattgctataggcatggatgattcaacaattcagatatataatgtccgtgtggacgaggtgaagagtaaacttaaaggccactccaaaagaataactggcctggccttctctcatgtactgaatgtgcttgtctcatcaggagcagattctcagctttgcgtatggaacactgatggatgggaaaagcagaaggccagattcttgcaggtttcagctgggaggaccccaatggcacagtcagacacgcgagtacaattccatcaggaccagatacattttcttgttgtacatgagactcagcttgcaatatatgaaacaacaaagctagaatgtgtgaagcagtgggtcccacgtgaatcttctgcaccaataactcatgcaacattctcatgtgatagccaactggtatatgccagctttctagatgcaactgtctgtgtatttagtgctgcgaacctcagactacgttgtcgtataaatccttctgcttatcttcctgctagtatcagttccaatgttcacccacttgtaattgctgcacatccatcagagccaaatgaatttgcattgggactctcagatggcggggttcatgtctttgagccccttgaatctgaaaacaaatggggcgtgcctccaccagttgaaaatgggtcggccagcagtgtggcagcaacaccttcagttggagctccgggaccagaacaagcccagagatgatgaaatggctgcctgagcacaagttcttttatatgcttggcttgcatgcccgtccctaatttagcttgacaatcaagatatgtgatctgagaacaatatgcaaagatgtagatttaacatattttgtcagatacaatctaaggtaaatgtcatactagtatttgatagtttcaagtgttttcttatgcccttttggagggtagaaattcttggaaggaaggattttctttgctgttgtagttgtttgtcttctatattcacccccctccccttcccttttccataaatggcaatgttctttttatgtataacatttacaattttcacaaaccagtgttctctctttgttgtcttcaactttggctggtgacctttttattgtccaaggattcgacaacatagtcctttgccagtttgtctttgggatgcttcatgtcagactcagttgtagtatatgaacaag

SEQ ID NO: 7447 - DNA, 3926 bp, Malus domestica
atacaaaaattttctggagagaggagagtttactataagtttctagagagagaaagctttctccgagctctgtctctctctctctctctctctctctctctctctttttcttcttcttctggatgtgtggctgtttgttctgatttggttttctcaagatctggttatattgttggtgatatttctggttctggaatcaaagagggggcggtcaagatgtcttctctgagtagggagctggtgttcctgatcttgcagtttctcgatgaggaaaaattcaaagagaccgttcacaagctggagcaggaatctgggtttttcttcaatatgaaatattttgaggatgaggtgcataatggcaattgggatgaagttgagaaatacctctccggcttcactaaagtggacgataaccgctactccatgaaaatctttttcgagatacggaagcagaagtatctcgaggcactggacaagcatgatcgctccaaagccgtggatattctagtaaaggatttaaaggtttttgccacattcaatgaagaacttttcaaggaaatcactcagctcttgacattggagaactttagggagaatgaacaactatccaagtatggagatacaaagtctgccagggcaatcatgttggttgaacttaagaaactgattgaagcaaatcccttattccgtgataaattgcagtttccaaaccttaagaattcgaggctacggactctcattaaccaaagcttaaattggcagcatcaactttgtaagaacccaagaccaaatcctgatataaaaacactttttgtggatcactcatgtggacaaccaaacggtgcacgggcaccatcgccagcaaacaacccactgctagggtccttgccaaaagctggagggtttcctcaaataggtgcacatgggccttttcaacctacacaagccccggttccaattccccttgcaggttggatgtccaatccttccactgttacacatccagcagtttctgaaggaggaggtattggtcttggtggtccatcaataacagctgccttgaaacatccaaggactcctccaactaatccttctgtggagtacccgtccggggattctgatcatgtttctaaaagaacaaggccgatggggctttctaccgaagttaatctccctgttaacatgttgccagtaacatttcaagggcacggtcatagtcaagctttgaatgcacctgatgacttgcctaagaatgtcacacggactttgaatcagggttcatcacccatgagcatggattttcatccttcacagcagactttgcttcttgttggtaccaatgtgggggacattgggctgtgggaagttggatctagggagcgactagttttaaggaacttcaaagtatgggatcttagttcatgctcaatgcccctgcaggctgctctagttaaggaacctggtgtgtctgttaaccgtgtgatttggagccctgatggtgctttatttggtgttgcttactcaaggcatattgttcaaatatattcttaccatgggggtgatgacgtacgacaacacctagagattgatgcacatgttggtggagtaaatgatctagctttctcccatcccaataagcagctttgtgtgattacctgtggggatgacaagaccatcaaggtgtgggatgctacaaccggtgcaaaacaatatacttttgaaggtcacgaggctccagtttattctgtctgcccacattataaggaaaacattcagtttatcttttcaacggcactggatggaaagataaaggcttggctgtatgacaatttgggatctcgagttgattatgatgctcccggtcgctggtgtacgaccatggcttatagtgctgatggtacaaggctattttcatgtgggacaagtaaagatggtgagtcatatattgttgaatggaatgaaagtgaaggcgctgtgaagaggacctatcaaggctttcgcaagcgttcttttggtgttgtgcaattcgatactactaaaaaccggtttttggctgctggtgatgatttttcaattaaattttgggacatggacaacactcaacttatgacaactgttgatgctgatggaggcctcccagcaagccctcgtatccgctttaacaaggatggcactctcttggctgtttctgccaacgagaatgggattaaagttttggcaaatgcagatggaatgcggttgttgcgaacatttgagaaccatctttcttatgaggcgtcaaggacctctgaagttgtgacaaagcctgcaataaccccaattcaagcagctgctagcagtgccggactggctgaacgaagtgcagctgcagctgctctttctggaatgaatggggatgctcggaacttgggggatgtgaaacctagaatagctgaagaatccaatgataaatcaaagatttggaaactcactgaaatcagtgaaccatcccaatgccgttccttgaggctacctgaaaacatgagagtaaccaagatttcgaggttaatctatactaactcaggaagtgcaattttggcattagcatcaaacgccatccatttgttatggaaatggcagaggagtgagcgtaactctactagcaaggcaactgctagtgtttcacctcaactgtggcaacccacaagtggcattttaatgaccaatgatattactgacacaagtcctgaagaagctgttccttgcttcgctttgtccaagaatgattcttatgtaatgtcagcatctggtggaaagatttccctgttcaatatgatgacatttaagacaatgacaactttcatgccaccaccgcctgccgcaacatttcttgctttccatcctcaagataacaatattatagctattggaatggatgattctacaattcagatatataatgtccgcgtagatgaggttaagagcaagcttaaaggccactctaaaaggataactggcctggcattttctcatgtactgaatgtgctagtttcatcaggagcagatgcacagctttgcgtatggagctctgatggatgggaaaagctgaagtccagattcttgcagcttccagctggaagaacgacagcttcactatcagacacgcgtgtacagtttcatcacgaccagcaacagttcttggttgttcacgagactcaacttgccatatatgaaacaacaaaactagaatgtgtcaagcagtgggtcccacgtgattctgctgcaccaatttctcatgcaacattctcatgcgatagccagcttgtatatgccagctttttagatgcaaccgtttgtgtgtttagtgctgcaaatctcagactacggtgtcgtattaatccttctgcttatcttcctgctaatgtcagttctaacgtgcagcccctcgtgattgcggcgcatccgcaagaagcaaatcagttcgcattaggactatcggatggtgctgttcatgtctttgagccccttgaatcggaaggcaaatggggtgtggccccaccagttgaaaatgggtcagcaagcagtgcgccggctaatcaagttggagctgcaggatcagatcaagtgcagagatgattgagtggctggcagagcacaagttgttttacatgcttggcttgctggcctattccaaatacagttgtgttcttcatgcagtgtaatttaatcgaggaacgatgtgcagatatgtagatttaacaagttggttcagaatctcaagtaagttaaatgcaggagtattagcagtgaaatgtatttaaattatgtgtcggaaatgaagagtattacgtttctcaggtatgctttatttccaaagatgatcagatcatgaatatagttctagtgttttttttttatgtcaaattgcgttgctgtcgcgttcttca

SEQ ID NO: 7448 - DNA, 4014 bp, Citrullus lanatus
gagagagataagcttaggagagagaaaagaagaagaagaaggaagaaagaaagaaagaaagaagagagtgaaagtcttcattcttagagagagagagagaaaggagagagaaagcttctctaagctctctctctgtttctgagtttctgtttttttgttctctgaaccaacccttctatgtttgttcttgttttgttttcaagatctagcggttttttctgctaatactgataaaaacggaggcggtagtgatgtcgtccctcagtagggagctggtgttcttgatcttacagtttctcgatgaggaaaaatttaaggagacagttcacaagctcgagcaggaatctgggtttttcttcaatatgaaatattttgaggatgaggtgcataatgggaactgggatgaagttgagaaatacctctctggttttacaaaagtagatgataatcgctattcaatgaaaatattttttgagattaggaagcagaagtatcttgaggcattggacaagcatgaccgctccaaggcagtagatattttagtaaaggacttaaaagttttttccacgtttaatgaagaactttttaaggagattactcagctattgacgctggagaattttagggaaaatgaacaactgtccaagtatggtgatacgaagtctgcaagagcaattatgttggttgagttgaagaagctaattgaagcaaatcctttgttccgtgataaattgcagtttcctcaccttaaaaactcaagattgcgtactcttattaatcaaagcttaaattggcagcatcaactttgtaaaaaccctagaccaaatccagatattaaaaccctctttgtggatcattcttgtgggcaaccaaatggtgcgcgggctccgtctcctgcaaacaatccgcttcttggatccttacccaaacctggaggttttcctcctcttggtgcgcatgggccttttcagcccacggcagctccagttcctgcacctcttgctggttggatgtctaatccctcagctgttactcatcctgcagtttctggtgggggtgccattggtcttggtgctccatctatcccggctgctttgaaacatccacggactcctccaactaacccttctgtagaatacccttctgcggactctgatcatgtttctaaaaggccaaaacctatggggatgtctgatgaggtaaatctaccagttaatgttctgccagtttcatttgctggtcatggtcattcacaaacctttaatgcaccggatgatttgccaaagaccgttatgcgaacactgaatcaagggtcatctccaatgagcatggatttccatccggtccaacaaactctgcttcttgttggcacaaatgtgggtgaaatagggttgtgggaagttggatctagggagcgacttgtttcaaagagtttcaaagtctgggatctcaatgcatgttcaatgcctttacaggcagctctacttaaagagcctgatgtatcggtaaaccgtgttatttggagccctgatggttctttatttggtgttgcctattcgaggcacattgttcaaatatactcctatcacggtggtgatgacatgcgacagcacctggagattgatgctcacgtcggtggagttaatgatctagcattctccaatcccaataaacaactttgtgtcataacgtgtggggatgacaagaccattaaggtctgggatgctggcaatggtgcaagacaatatacatttgaaggccacgaggctcctgtttactctgtttgccctcactacaaggaaaatattcagttcatcttttcaacagcactggatggaaagataaaagcatggctatatgataatatgggctcacgagttgattatgatgctcctggacgttggtgcacaaccatggcttacagtgcagatggtacgaggctcttctcatgtgggacaagtaaagacggagagtcttatattgttgagtggaatgagagtgaaggagctgttaagagaacttatcaagggttccgcaagcgatctctgggtgttgtacaattcgatacgactaaaaatcggtttttggctgctggtgatgatttctccattaaattttgggatatggacaatgttcagcttctaacaactgttgatgctgatggagggctcccagcaagtcctcgcatccgctttaacaaggatggcacccttttagctgtttctggcaatgagaatggaattaaaatcttggccaacgtggatggaatccgactactaagaacatttgaaaatctttcatatgatgcagctagaacgtcagaggctgggacaaagcccacaataaatccaatttcagctgctgcggccgtggcagcagcagcggcagctagtagtgctgccgatagaggtgcctctgtcgtcaccatgtctggagtggctggggattcccgaagtttgggggatgtgaaacccagaattcctgaagattccaatgacaagtcaaagatttggaagctcactgaaattaacgaaccatctcaatgtagatccttgaggctgcctgagaatgtaagagtgaacaagatatctaggttgatctacacaaattctggaagtgcaatcttggcattggcatcaaatgcaattcatctgctatggaaatggacgcgaagtgaacgtaattcaactggcaaggcaactgcaaatgttttgccacaattatggcaaccatcaagtggtattctaatgaccaacgatgttgctgacactagttctgaagaggctgtgccctgctttgctttatccaaaaatgattcttacgtcatgtcagcttctggtggaaagatttccctcttcaatatgatgacatttaagacaatgacaactttcatgccgccaccacctgctgccacattccttgcctttcacccacaagataacaatataattgccattggcatggatgactccacaattcaaatttataatgtccgcgtggatgaggtaaagagcaagcttaaaggccactctaaaagaataactggtttggccttctctcacttactgaacgtgctagtttcatccggagctgatgcacagctttgtgtgtggagctctgatgggtgggagaagcagaaaacaagattcttgcaacttccaagtggtagaccaccatcctcacaatccgacactcgtgtacagtttcatcaggaccaggttcactttctggtcgtgcacgagactcagattgcaatatacgaaactacgaaacttgagtgtgtaaagcagtggacgccacgggaatctggtgcaccaatctctcatgcaacattctcttgcgacagtcaaatgatatatgccagctttttggatgcaactgtctgtgtgtttaccgttgctagtctcagattacgttgtcgaattagtccttcagcttatcttcctgctagtgtgagcaacgcttctgtacaaccactagtgattgcagcacatccccaagaagcaaaccaatttgctttagggctatcagatggcggggttcatgtcttcgaacctctcgaatcagagggaaaatggggtgtggctccacctgtcgaaaatggatcagcatcaagtgtgccgacaactccatcagtcggagcttcaggttcagatcaagccccgagatgatcgagcagctagcacgagtacttttacatgcttgattgctggctctccaactttaggtatacttcagattttaactggttgaccttttttttcttcttttttctccttggaacatttgttagccatgtttgtattttgtaatttttttatggttgattttccatttcccccagtttgttgttcatgatatgtagttttactcaaggaaacagcaaaaagatgtagatttatcttctttcctcagattctgtgtaagttaacattctgcaggagtattactaatagtcaaatgaccttactgataatttttttctgtcaatttttcttctctccctttcctgaa

SEQ ID NO: 7449 - DNA, 3547 bp, Echinacea purpurea
gggaaatctctctgttttgtttcttgatctctgttctagcatcaatcgatcttgctacgggtttcacggatctgctctattagaatctttgattattattattatctttattatcctgatttggggtcaaaaggaactgcaatgtcttctctgagtagagaactagtgttcttgatcttgcagtttcttgatgaagaaaaattcaaagagactgttcacaagcttgaacaggaatcagggtttttctttaacatgaagtattttgaggatgaggtgcataatgggaactgggatgaggttgagaaatatctttctggtttcactaaagtggatgataatcggtactcaatgaagatatttttcgaaattaggaagcaaaagtatcttgaagcattggataagcatgacaggtccaaggctgttgagattcttgtaaaagatcttaaagtgtttgcttcatttaatgaagacctttttaaggagataactcagttattaactttggagaattttagggagaatgaacagttatcaaaatacggagacactaaatccgctcgagctataatgttggttgaacttaagaagctaattgaagcaaatcccttgtttcgcgacaaattgcaatttccgaatcttaagaattcaagattaaggacactcataaaccaaagtttgaattggcaacaccaactttgtaaaaacccgagaccaaatccagatatcaaaacattgtttgttgatcattcatgtggtcaaccaaacggtgcacgtgctccatcacctgcgaacaatccccttcttggatcattaccaaaagctggaggctttcctcctttgggtgcacatgggccttttcaaccaacaccggctccagtgccaactccacttgctggttggatgtctaatccgccaactgtatctcatccaacgatttccggtagtgcaattggtctcggtagtccctctatttcagctgctttgaagcacccaagaactccaacaaatccgtctttggattacccatctgcagattctgatcatatgagcaaaagagcaaggccaatggggataactgatgaggtaaatctgccggttaatgtgttgcctgtgtcattcgcggggcattctggtcatagtcaagcttttaatgcacctgatgatttaccaaaaaccgttgcacgaaccttaaaccagggttcatctcctatgagcatggattttcatcctattcaacaaacattactattagttggaacaaatgtgggagatgtaggattatgggaagtcggctcacgggaaaaattagttctaaaaaatttcaaagtatggaatcttagtgcatgttcaatgcctcttcaggctgctctagtaaaagatccaggtgtctcagtgaaccgtgtaatctggagtccggatggttcactgtttggagttgcatattcaaggcacattgtacaaatatattcatatcatggaggtgatgatgtgagacaaaatgtagagattgatgctcatgttggcggagtaaatgatcttgcattctctaatccaaacaagcagctctgtgtgataacttgtggggacgacaaaacaatcaaggtttgggatgcaacaactggtgttaaaaagtacacttttgaaggccatgaagctcctgtttattctgtatgccctcactataaagagaatattcagtttatattctcaacggctcttgatggaaagataaaagcatggttatacgataacatgggatcacgtgttgattatgaggcacccggtcgttattgcacaacaatggcatacagtgctgatggaacaaggcttttctcatgtgggacaagcaaagatggggaatcacatatagtcgaatggaacgagagtgaaggtgctgtaaagagaacgtatcttggtttccgtaaacgatctttaggtgttgttcaattcgatacaacaaaaaaccgatttttagcagctggtgatgattttgcaattaaatattgggatatggataatactcaacttttgatgagtgttgatgctgatggaggtcttccggcgagcccacggatccgtttcaacaaagatggtgctcttttggctgtttctactaatgataacggtatcaaaattctagcaaattctgatggacttcgattacttcgaacttttgaaaatctttcatttgatggttctgcttcaagaactcctgaagcagcaaagcctacgataaacgctttatctactccagctgctagtgctgcattagcagaaagagttgcctccgttggatccatctcagcagtgaacggggatgcaagaagcttgccggatgtgaaacctaggatcatggaagaagctaatgacaaatcaaagatttggaaactatctgagattaatgaagcttctcaatgtcggtcattgaagcttcctgagaacatgagagtaacaaagatatcaagattgatatatacaaattcaggaaatgctcttttagcattagcatcaaatgctattcatttgctatggaaatggcagcgtaatgagcgtaattcaagtggcaaggcaacagctggtgtttcgccgcaattatggcaaccttcaagtgggattttgatgactaatgatgtggcagagactaaccctgaagaatctgttgcatgctttgctttgtctaaaaacgattcttatgtaatgtctgcatcaggaggaaagatttctttgttcaacatgatgacattcaagacaatgaccacattcatgcctccgccaccagcagcaacgtttcttgctttccatcctcaagataacaatattatagcaattggcatggacgactcgacaatccagatttataacgttcgtgttgatgaggttaaaagcaagctcaaaggccactccaaacgaataactggtctcgccttttctcatgtgctaaatgtgctagtctcatctggtgctgatgctcagatttgtgtatggagttctgatggatgggaaaaacagaaggcgaaatacttgcaactcccctcaggtagaacaacagctgcacaatcagacacacgggttcagtttcatcaagatcagatccattttcttgttgtacacgagtctcaactcgctatatacgaaacaacaaaacttgagtgtgtaaaacagtgggtcccacgtgaatcatccgcaccaatatcacacgccacattttcatgcgatagtcaactcatatacgcatgtttcttggacgcaactgtgtgcgtattcactgcatctcacctacgcttacggtgtcgcatcaatccatccgtttacctttccccttcggttctcagcaatctgaatgtgcacccgatggtgatcgctgctcacccacaagaaccaaatcaatttgcattggggctgtcagatggaatggtgcatgtttttgagccgcttgaatctgaaggcaaatggggggtcccaccaccagctgaaaacgcgtcaacaagcaatgtagctgccacgtcacctgcacgaggttcggggtcagaacaagggcagagatgac

SEQ ID NO: 7450 - DNA, 3944 bp, Citrus clementina
gtcggtatataaattagaaaaggcttaggaggatatataaatagagagagagagaaaaaaaaagtcttttatttttagagagataaagctccatttcttaagagagaaagctccaattccctgagggagctcgttttaactctctgtctctctctttctctcttgcaaatcgattcaccagatctacggtaatagttggtgaaaattgtacgcttggaattaaaaaaactgggtgcttaaacgatgtcgtctctcagtagagagctggtgttcctgatcttacagtttctggatgaggaaaagttcaaagaaactgttcacaagcttgaacaggaatctgggtttttctttaacatgaaatattttgaggatgaggtgcataatgggaattgggatgatgttgagaaatacctctctggttttactaaagtggatgataatcgctactcgatgaaaatatttttcgagataaggaaacagaaatatctcgaggcattggataagcatgaccgggcaaaggctgtggaaatattagtgaaagatttgaaggttttttctacatttaacgaggaactattcaaggagattacccagctgttgacattggagaattttagggagaatgagcaattgtctaagtatggagacacaaagtctgcaagatcaatcatgttggttgagctcaagaagcttattgaagccaaccccttatttcgtgataaattgcagttccccaaccttaaaaattcaaggttacgcactcttatcaaccaaagcctgaattggcagcaccaactttgtaaaaacccaaggccaaatccagatataaagactctctttgtggatcacacttgtggacaaccaaatggtgcacgggccccatcacctgcaaacaatccattgcttggatccttaccaaaagctggggttttccctcctctgggtgcacatgggccttttcaacctacaccagccccagttccaacaccccttgcaggttggatgtctaatcctcccactgtaactcatccagcagtttctggaggagctattggtcttggtagtccatccatcccagctggtacatccctgtctcactctgctttgaagcaccccagaactcctccaactaatccctctgttgactacccatcaggggattctgaccatctttctaaaaggactaggccaataggaatatccgatgagataaacctgcctgttaatgtgttgccagtgtcatttacgggtcacagtcacagtcaggcctttagtgcacctgaagacttgccaaagactgtgacaaggactttgaatcagggatcatctcctatgagcatggacttccatcctgttcaacagacacttcttttagttggaactaatgtgggggacataggattatgggaagttggttctagggagcgacttgttttgagaaactttaaagtttgggatctcggcgcatgttcaatgcctctccaggcagctctagtcaaagatcctggtgtgtctgttaaccgtgtcatatggagcccggatggtagtttatttggagttgcatactcaaggcacattgtccaaatctattcatatcatgggggagatgaagttcgacagcacttggagattgatgctcacgttggtggagtaaatgatattgctttctcgcatccaaataagcaactttgcgtgataacctgtggtgacgacaaaacgataaaggtgtgggatgctactaatggtgcgaagcagtatatatttgaaggccacgaggctcctgtttattctgtctgccctcatcacaaggaaaatatccagttcatcttttcaacggcacttgatggaaagattaaagcttggttgtatgacaatttgggatctcgagttgattacgaagctcctggccgctggtgcacaacaatggcctacagtgctgatggtacaaggctcttttcatgcgggacaagtaaagatggggaatcatttattgttgaatggaatgaaagtgaaggagctgtgaagaggacctatcaaggattccgcaaacggtctctgggtgttgttcagtttgatacaactaaaaacaggtttttggctgctggtgatgatttctctattaaattctgggatatggacagtgtgcaacttttgactagtattgatgctgatggaggtcttccagcaagccctcgaatccgctttaacaaggatggctgtctcttggctgtttctaccaatgataatggaatcaagattttggcaacttcagatggcattcgtttgctgcgtacatttgagaatcttgcttatgatgcatcacgaacatctgaaaactcgaagcctacgataagcccaatttcagctgcagcagctgccgctgcaactagtgctggacttgcagacagagcggcttctatggtttcaattccaggaatgaatggagatgtacggagcttggcggatgtgaaacctagaataactgaagaatccaatgacaaatcaaaggtttggaagctaactgaactcagtgaaccaaatcagtgtcgatctttgaggcttcctgaaaacttgagagcaacaaagatatcaaggttgatcttcacaaattcaggtaatgctatcttggcattagcttcgaatgcaattcatttgctctggaagtggcagcgaactgagcgtaattcatctggcaaggcaactgccagtgtggcacctcagctatggcaaccaccgagtggcattatgatgactaatgatgttacagactctaaccctgaggaggctgtaccctgctttgcgttgtcaaagaatgattcttatgtaatgtcggcctctggtggaaagatttccctcttcaatatgatgacatttaagactatggcaacttttatgccaccgccacctgcagcgacatttcttgcttttcatcctcaagacaacaatatcattgctattggcatggatgattcctcaattcagatatataacgttcgagtagatgaggttaaaagcaaacttaaaggccactccaaaagaataaccggtctggcgttctctcatgcattgaatgtgctagtttcatctggagcagattctcagctttgtgtatggggctctgatggatgggaaaagcaaaagaatagattcttgcaaattccaactgggaggacaccaactgcgcagtcagacacacgtgtacagtttcatcaagaccaaatacacttccttgttgtacatgagacacagcttgctatatttgaaactacaaaactagaatgtgtgaagcagtgggtcccgcgtgagtcttctgctccaatcactcatgcaacattctcatgcgatagccagctggtatatgcttgcttcttagatgcaactgtctgtgtttttagtgctgcaaatctcaaattgcgttgtcgtatcaacccgtctgcgtatcttcctgctggtgtcagcagttccaatgtccacccgcttgtgattgctgcgcatccacaagaaccaaatgagtttgcgttgggactatctgatggtggggttcatgtttttgagccccttgaatctgaaggtaaatggggcgtcccaccacctgttgacaatgggtcaacaagcagcatgccagctactcctccagttggaggttcaggttcagatcaagcacagagatgatgaaatggctggcagagcataagttcttttagatgcttgccttgccagccaccattccaaattagtttgaggttcgggatgtgtaatttaaatgaaggacatgcaaagatgtagattttaacatgttttctttaatcaagataattataagaagatgtaaggtaaacgctgtgggagaattgatagtgaaatgatttccctttttaactcttagaaagatcctttttaaaggaattgctatttatctttccgctcttgatgttgaatatcat

SEQ ID NO: 7451 - DNA, 3730 bp, Cucumis sativus
tgatgtcgtccctcagtagggagctggtgttcttgatcttacagtttctcgatgaggaaaaatttaaggagacagttcacaagcttgagcaggaatctgggtttttcttcaatatgaaatattttgaggatgaagtgcataatgggaactgggatgaagttgagaaatacctctctggttttacgaaagtagatgataatcgatattcaatgaaaatattttttgagattaggaagcagaagtatctcgaggcattggacaagcatgaccgctccaaggcggtagatattttagtaaaggacttaaaagttttttccacgtttaatgaagaacttttcaaggagattactcagcttttgacgcttgagaattttagggaaaatgaacaactgtccaagtatggtgatacgaagtctgcacgagcaattatgttggttgagttgaagaagctaattgaagcaaatcctttattccgtgataaactgcagtttcctcaccttaaaaactcaagattgcgtactcttattaatcaaagcttaaattggcagcatcagctttgtaaaaaccctagaccaaatccagatattaaaaccctctttgtggatcattcttgtggacaaccaaatggtgctcgggctccttctcctgcaaacaatccacttcttggttccttacccaaacctggaggttttcctcctcttggtgctcatgggccttttcagcccacggcagcacctgttccagcacctcttgctggttggatgtctaatccctcagctgttactcatcctgcagtttctggtggaggtgccattggtcttggtgctccatctatcccggctgctttgaaacatccgcggactcctccaactaacccttctgtagaatacccttctgctgactctgatcacgtttctaaaaggccaaaacctatggggatgtctgatgaggttaatctaccagttaatgttctgccagtatcatttactggtcatggtcatgcccaaaattttaatgccccagatgatttgccgaagactgttatgagaacactgaatcaaggatcaaatccaatgagcatggatttccatccgatccaacaaactctgcttcttgttggcacagatgtgggcgaaatagggttgtgggaagttggatctagggagagacttgtttcaaagaattttaaagtctgggatctcaatgcatgttcaatgcccttgcaggcagctctagttaaagagcccgatgtatcggtaaaccgtgttatttggagccctgatggttctttatttggtgttgcctattcgaggcacattgttcaaatatactcctatcatgggggtgatgacatgcgacagcatctggagattgatgctcatgttggtggagttaatgatctagcattctccaatcccaataaacaactttgtgtcataacatgtggtgatgacaagaccattaaagtctgggatgctggcaatggtgcaagacaatatatatttgaaggccacgaagctcctgttttctctgtttgccctcactacaaggaaaatattcagttcatcttctcaacagcacttgatggaaagataaaggcatggctatatgataatatgggctcacgagttgattatgatgctcctggacgttggtgcacaaccatggcttacagtgcagatggtacgaggctcttctcatgtggtacaagtaaagatggagattcttatattgttgagtggaatgagagcgaaggagctgttaagagaacttatcaagggttccgcaaacgatctctaggtgttgtacaatttgatacgactaaaaatcggtttttggctgctggtgatgatttctctattaaattttgggatatggacaatgttcaacttctaacaaccgttgatgctgatggggggctcccagcaagtcctcgcattcgctttaacaaggatggtacacttttagctgtttctggcaatgagaatggaattaaaatcttggccaatgtggatggaatccggctgttaagaacatttgaaaatctttcatatgacgctgctagaacatcagaggctgggacgaagcccacaataaatccaatttcagctgctgcagcggtggcagcagcagcagcggctggtagtgccgccgatagaggtgcctctgtcgtcaccatgtctggagtggctggggattcccgaagtttgggcgatgtgaaacctagaattcctgaagattccaatgataagtcaaagatttggaagctcaccgaaattaacgaaccatctcaatgtagatccttgaggctgcctgagaatgttagagtaaacaagatatctaggttgatttacacaaattctggaagtgcaatcttggcattggcatcaaatgcaattcatctgctatggaaatggacacgaagtgaacgtaattcaactggaaaggcaactgcaaatgttttgccgcaattgtggcaaccatcaagtggcattctaatgaccaatgatgttgctgacactagttctgaggaggctgtgccctgctttgctttatccaaaaatgattcttacgtcatgtcagcttctggtggaaagatttccctcttcaatatgatgacatttaagacgatgacaacttttatgccaccaccacctgctgccacattccttgcctttcacccacaagataacaatataattgccattggtatggatgactccacaattcaaatttataatgtccgcgtggatgaggtaaagagcaagcttaaaggccactctaaaagaataactggcttggccttctctcacttactgaacgtgctagtttcatccggagctgatgcacagctttgtgtgtggagctctgatgtctgggagaagcagaaaacaagattcttgcaacttccaagtgggagaccaccatcctcacaatccgatactcgtgtacaatttcatcaggaccaggttcactttctggttgtgcacgagacacagattgcaatatatgagactacaaagcttgagtgtgtaaagcagtggacgccacgggaatctggtgcaccaatctctcatgcaacattctcttgcgatagtcaaatgatatatgccagctttttggatgcaactgtctgcgtgtttaccgttgctagtctcagattacgttgtcgaattagtccttcagcttatcttcctgctagtgtgagcaatgcttccgtacaaccactagtaattgcagcacatccccaagaagcaaaccaatttgctctagggctatcagatggtggggttcatgtctttgaacctctcgaatcagaaggaaaatggggtgtgcctccacctgtcgaaaatggatcagcatcaagtgtgccgacgactccatcagtcggagcttcaggttcagaacaagctccgagatgatcgagcagctagcacgagtacttttacatgcttgattgctggctctccaactttaggtatacttcagattttaactggttgaccttttttttttttctccttggaacatttgttagccatgcttgtattttgtaatttttttatggttgattttccattccccccagtttgttgttcatgatatgtagttttactcaaggaaacagcaaaaagatgtagatttatcttctttcctcagattctgtgtaagttaacattctgcaggagtattactaatagccaaatgaccttactgataattctttctc

SEQ ID NO: 7452 - DNA, 4048 bp, Panax ginseng
cctatcccctcgttgtgtccttcgcctcccttacgactttttattttcttccgacgcgatagagtagagagagaaagtggagagagaaatttgagtgagaaatacctctattatgcgagaaacagacatatatagatagatacagacagagagagtgcaactagctagaagagagagagagcagttgtttctacctcgagctcgtcgtttctccaaccctgagtcttctattatatcttcaatcgatctcttcgttttgtaatccatctctatcggtgcaagtctccattgagcttctctctatctgctaatatgctggcttgattgattgattatctttctctggatttgaagacagcttagatacaatgtcttctctcagtagagagcttgtgttcttgatcttacagttcctagatgaggaaaaattcaaggagactgttcacaagcttgaacaagaatctggattttactttaacatgaaatactttgaggaagaagtacataatgggaactgggatgaggttgagaaatacctctctggtttcacaaaagtggacgacaatcggtactcgatgaagatcttttttgagataaggaagcagaaatatctagaggcattggataagaatgatcgatccaaggctgtggaaatccttgtaaaggatcttaaagtttttgcatcatttaatgaagagcttttcaaggagattactcagcttttaacattggagaacttcagggagaatgagcagctgtccaaatatggagatacaaaatccgcaagagcaattatgttggttgagctcaagaagcttattgaagcaaatcccttgtttcgtgacaaattgcaatttcctaaccttaaaaattcgaggttacgtactctcatcaaccaaagcttgaattggcaacatcaactttgtaaaaatccaaggccaaatccagacattaaaactctttttgtggatcattcatgtgcacaaccaaatggtgcacgtgctccatcacctgcaagtaatccactgcttggatccttaccaaaagctggagtttttcctccccttggtgcacatgggccattccaacctacagcagcaccagttccaactcctcttgccggttggatgtctaatcctcctgcagttggccatcctgcggtttctggtggagctattggtcttggtggtccatccatgtcagctgctttgaagcatcctaggactccgtcaacaaacccttctttagattacccatctggagattcagatcatgtaaccaaaagaacaaggcccatggggatatctgatgaggtaaatcttcccgttaatgtattgcccttgtcattccctgggcacggtcatagtcaggctttcaatgcacccgatgacctgcccaaaaacgttgcacgaactttgaatcagggctcatctcctatgagcatggattttcatccaattcaacagactttacttctagttggtaccaatgtgggggatataggattatgggaaattggttccagggaagactggttcttagaaacttcaaagtttgggatcttggtgcatgttcagtgcctctgcaggctgctctagttaaagatcctggtgtctctgttaaccgtgtgatttggagcccagatggttctttgtttggagttgcatattcaagacacattgttcaaatatattctcatcacaggggtgatgatataaggcagcatttggagattgatgctcatatcggtggagtaaatgatcttgcattctctcatcccaataagcagctatgtgtgataacctgtggggacgacaagactattaaggtttgggatgccacaactggtgcaaaacaatacacttttgaaggtcatgaagctcctgtctattctgtatgccctcactacaaagaaaacattcagtttatattttcaacagctctagatggaaagataaaggcatggttatatgacaatttgggatctcgagttgattatgatgcccctgggcggtggtgcacaacaatggcctacagcgctgatggaacaaggctcttctcatgtgggaccagcaaagatggagaatcgcacattgttgaatggaatgaaagcgagggggctgtaaaaaggacatatctaggcttccggaaacgttctttgggtgttgtgcaatttgatacaactaaaaaccgatttttagcagctggggacgaattttctgttaaattctgggatatggataatgttcaacttttgacaagtattgatggggatggaggccttccagcaagtccacatatccgcttcaacaaggatggttcacttttggccgtctctaccaatgaaaatgggatcaaaattttagcgaattctgatggattttgcttattacgtgcattcgaaaatctatcttatgatgcttcaagaggtcctgaaactgtgaagccttcaattaacacaatttctgctgctgcggcggcagcagctgctgccagtagttcaggacctgtagatagggttgcctctgctgttgctatttctggaatgaatggagaaaccaaaaatttgggggacatcaagccgagaataactgaagaatctaatgacaagtcaaagatttggaaactcatagaagttaatgagccttctcagtgtcgctcattgaagctccctgaaaacatgagagtaactaagatatcaaggttgatatacacaaattcaggtaatgctatattggcattagcatcaaatgcaattcatcttctatggaaatggcagagaagtgaaagaaattcaagtggcaaggctacagccagtgtttcacctcaattatggcaaccatcaagcggcattctgatgaccaatgacgtgactgacaccaacccggaggatgctgtaccatgctttgctttgtccaaaaatgattcttatgtgatgtcagcatcaggaggaaagatatctttattcaacatgatgactttcaagacaatgacaacattcatgcccccgccacctgcagctacatttcttgctttccatcctcaggacaacaatatcattgctattggcatggatgactccacaattcaaatatataatgttcgtgtggatgaggtacaaaagcaagcttaaaggccactctaagagaatcaccggccttgctttctctcatgtactgaatgtgctagtttcttccggagcagatgctcagctttgtgtgtggaattctgatggatgggaaaagcaaaagagcagatacctgcaagttccagctgggaggactacaacagcacagtccgacactcgggtacaatttcatcaggaccagatgcactttctggttgtacatgagactcaacttgccatatatgagacaataaaactagaatgtgtaaaacagtgggtcccacgagaatcttctgcccctatttctcatgcaacattttcatgcgatagtcagctggtatatgccagtttcttggatgctagtttgtgcgtattcagtgctgcacacctccgcttgcgatgtcgtattaatcctttggcttatctatcacctagtgtcagcaattcaaatatccatccactagtgattgctgcacatccacaagaaccaaatcagtttgcattgggtctgtcagatggaggagtccatgtctttgaaccccttgaatctgaaggcaaatggggtgtgcctccaccagtcgaaaacgggtcagcaagcagtgtcacgactacaccttcagttggagcttcaggttcagatcaagcccagagatgagacaaagggttgccagcacacaagttctttaaatgctttgcttgctgggaaattccaaatttttgagtgcaggaaatgtaatttacttggtgaatgatttgcagacttgtagatctaacatgtgaatcaagatattatgcaaggtaaatgctttacagtagtaatagtaaatgttcgttctttattgctggaaggaatttcttctagaaaatggatctttgttaaaatacttctagtatcctgctctgctttgagaatgaaaatag

SEQ ID NO: 7453 - DNA, 3800 bp, Glycine max
ctctctatatatattttcgagtttctagagagagagcgagtagattagtccatttccgcgaggagagagaaagtgcaagaatcggaagagagagagagcgtttgtttagtttgtgatgtggtagctttgaaggttaattttggaaatacggaggagggttttcttccataaataaatgcttctggttagatgatttcattgacgatctagttcactgttgctcattttagtgtgtatctaatcgaagacgagggaggggttcggatgtcgtctctcagtagggaattggtgttcttgatcttgcagtttctcgatgaggaaaagttcaaggagactgtgcacaagcttgagcaggagtcagggtttttctttaacatgaaatattttgaggatgaagtgcacaatggcaattgggatgaggtggagaaatacctctctggtttcacaaaggtggatgataacaggtattctatgaagatattttttgagataaggaagcagaagtatctggaggctttagataagcatgaccggtccaaggctgtagaaatattagtgaaggatttgaaagtgtttgctacatttaacgaagaattgttcaaggaaatcacgcagcttctgacattggaaaattttagggaaaatgaacaattgtcaaagtatggtgatacaaagtctgcacgagcaatcatgttggttgagctcaaaaagctcattgaagcaaatcccttatttcgtgacaaactgcaatttcccaaccttaaaaactcaaggttacggactctcatcaatcaaagcctgaattggcagcatcaactttgcaagaatccacggccaaatcccgacataaaaactctttttgtggatcactcatgtgggcaaccaaatggtgctcgagctccttcacctgctaataacccgctactaggtgccttaccaaaggctggaggatttcctccacttggtgcacatgggccttttcagcctactccagcaccagtgccaacacccctggctggttggatgtcaaatcctaccactgtagcacatgctgcagtttctggaggtggagctataggtcttggtgctccatctatgcctgctgctttgaagcatcctaggacccccccaactaatccttctgttgactatccatctggagactcagatcatgttgctaagagaacaaggccaatgggaatatcagatgaggtgaatcttcctgtcaatgtgttgtcagcaacattccctggtcatggtcaacatagtcaagcttttaatgcacctgatgacatacctaagactgtcgtacgaactcttaatcagggttcatctcctatgagcatggactttcatccaattcaacaatctttgcttcttgttggtacaaatgtgggggacattgctttgtgggaggtgggttctagggagcggttggtctcaaggaatttcaaagtttgggatcttagtgcatgttcaatgccatttcaggcggctcttgtcaaagatccgggtgtttctgtgaatcgtgtgatttggagtcctgatggtgctttgtttggagtcgcttactcaaggcacattgttcagatatactcttaccatggtggggatgaaatacgacagcacctggagattgatgctcatgttggtggagtaaatgatctagcattttcccatccaaataagcaactatgtgtgataacttgtggtgatgataaaaccattaaggtatgggatgctgcttcgggtgcaaagcagtatacttttgaaggagctgttaaaaggacttaccaaggatttcgtaagcgatctttgggtgtcgtgcaatttgatactaccaaaaatcgatttttggctgctggtgatgatttctccatcaaattctgggatatggataatgttcagcttttgacaactgttgatgctgatgggggtctccctgcaagcccgcgtattcgcttcaacaaggatggaactcttttagctgtctctgcaaatgagaatggaattaaaattttagccaatggggatggtattcgcttgtcgcgcacactagagaattctttatatgatgcatcaagagcatctgaagccttgacaaagcctataattaatccaatttctgctgctgccgctgctgcaaccagtgctgcactggcagagagggcttcatctgtagtagctattgctggaatgaatggggatacccgaaacttgggtgatgttaaacctagaataagtgaagaatctaatgacaagtcaaagatatggaagctcactgaaatcaacgaacaatctcaatgtagatccttgaagctaccggagaatgtaagagtaaccaagatatcaaggttgatatatacaaattcaggtaatgctattctggcattagcatcaaatgccattcacctactctggaaatggcagcgaaatgagcgtaactcatctggcaaggccactgctaccttgcagcctcagttgtggcaaccatcgagtggcatcctgatgacaaatgacattgctgatagcaatcctgaggatgctgtaccctgctttgcgttgtccaaaaatgactcatatgtaatgtctgcatcaggagggaagatatctctgtttaatatgatgacttttaagactatgacaactttcatgcctccaccacctgcggcaacctttcttgctttccatcctcaggataacaatattattgctataggcatggatgattcctctattcaaatatataatgtccgtgttgatgaggttaaaagtaaactcaaaggccataataaaagaattactggtcttgctttctctcatgtattgaatgtattagtttcatctggagcagatgctcagatttgtgtctggaatactgatggatgggaaaagcagaagtctagattcttgcagcttccttctgggagaacaccaccggcacagtcagatacccgtgtacagtttcatcaagatcaaatacagttcttggttgtacatgaaactcagctcgccatttatgaagcaacaaaactagaaggtctaaagcagtggttcccgcgagactcatctgcaccaatatcctatgcaactttctcatgtgatagccagctggtatatgccagctttttagacgcaacaatctgtgtatttagtgcttcaaacctcagattacgttgtcggatcaatccttcttcatatcttcctgcaagtgtcagttccaacacacaaccacttgtaatcgctgcacaccctcaagaaccaaatcagtttgctgtcggactgtctgatggtggagttcatgtttttgaaccccttgaatctgaaggcaagtggggtgtgcctcccccgattgagaatgggtcagcaagcaatgtggcagctgcttcagttggaccttctccagatcaagctcaaagatgatccatgtcagccgaagacaagtttcttttacatacttggcttgctggccattttaagaactaaatttgtacttaagttaatgcagggcactctccaattcagttgatccagctaagttaaatccatcaatcgtacatgccaaaagtttggagcaacttctttggttgaagaccaaaatcacattgtaatttgccaatagatgtgaaaaattcttttaaagtttaatgctaagatgatgtacaagtccttttgagtactttcaagttgtttttggctatctaattagattggttgatcctaacttgttgccttttgtgagttccatttcagccttactgtactattcttatctgcatcttcatgtttcccatattttc

SEQ ID NO: 7454 - DNA, 4043 bp, Nicotiana benthamiana
ctcgtcgtttgttgggttttcttcttctttttctcttccatggatctatttgttctttaagatctgcaaacacaccggtttttcatacttcctctgggcttgaagacaaagtagttgcaatgtcatctctcagcagagaacttgtgttcttgattttacagtttctagatgaggaaaaattcaaagaatcagtccacaagcttgaacaagaatctggctttttctttaacatgaagtactttgaagatgaagtgcataatggtaactgggatgaagttgaaaagtatctctctggttttaccaaagtggacgataaccgttattccatgaaaattttctttgaaataaggaagcaaaagtatcttgaggcattggacaagcgtgaccggtccaagggcgttgaaattcttgtaaaagatcttaaagtttttgcatcgttcaatgaggacctttttaaggagattactcagctgttaacactagataatttcagggagaatgaacagctgtccaagtatggggatactaaatctgcacgggctatcatgttggttgagctcaagaagcttattgaagcaaatccattgtttcgtgacaaattgcagtttccaaacctcaaaaattcaagattacgaactttgattaaccaaagcttaaattggcagcaccaactttgtaaaaatcctaggccaaatccagatattaaaactctatttgtggatcattcttgtggacaaccaaatggtgctcgtgctccatcacctgcaaacaatccgttgcttggatcagtgccaaaacctggcagctttcctcctcttggtgcacatgggcctttccaacctgggccaccacctgtagcagctccacttgctggttggatgtccaacgcaccaactgtagcacatccagcagtttctggtggacctatgtgtcttggttcttcatctattccagcttcccttaaacatcctaggactccaccaacaaatccttccattgattatccatctggggaatctgatcatgttgccaaaagaactaggtcacttggaatatctgatgaggttaatcttcctgtcaatgtgctgcctatatcatttccagggcaaggtcataatcaagcgctcagcgtacctgatgacctgcccaagactgttgcacgaacattaaaccagggatcatctcccatgagcatggattttcatccttctcagcagacgttgcttctagtcggcacaaacgttggagatattgcattgtgggaagttggttctagggagagactggtgttgagaaacttcaaagtctgggacttgggtgcatgttcaatgccgttgcagactgctttggtaaaagatcctggtgtctcagttaaccgtgttatatggagccccgatggttcattatttggggttgcatactctaggcacattgttcaaatatattcttatcatgggaatgatgatattcgtcagcatttggagattgatgctcatgttggaggcgtaaatgatcttgcattctctcaccctaataagcagctttgtgttataacatgtggagacgacaaaactataaaggtttgggatgccacatctggtgcaaaacaatacacatttgagggtcatgaggctcctgtgtactctgtgtgccctcaccataaagagaacattcagtttattttctcaacagcattagatggaaagataaaagcatggctatatgataatttgggatctcgagtagattatgatgctcctggtcgttggtgcacaacaatggcatatagtgccgatggaactagactattttcatgtggaaccagcaaagatggggagtcacacattgttgagtggaacgaaagtgaaggggctgtcaagagaacatatctaggttttcggaaaagatcattgggtgttgtacaatttgatacaactaaaaatagatttttggcagctggtgatgatttctcgatcaaattctgggatatggaccatgttcaactcctgaccagcattgatgctgatggaggtcttccagcaagccctcgaattcgatttaacaaggacggttctctattggctgtttctgctaatgaaaatggtataaagattttggccaatagtgatggtattcgtttagttcgtacttttgagaacctagcttatgatgcttcccgggcatctgaaagtgcaaagcccacagtaaatcaaatatcagcaagcagttctggatttgcagacagggtggcctctggtgttggcatctctggaatgaatggagatgcaagaaatacagtggatgtaaaacccaggattgttgaagagcctaatgataaatctaagatatggaagctcactgaaattactgaaccatcacagtgccggtccttgaagcttcctgagaacctcagagtgactaagatatcaaggttaatatatacaaactctggtaatgctatcttagcattagcatcaaatgctattcacctgctttggaagtggcaaagaaatgaacgcaattccagtggaaaggctacagccagtgtatcacctcaattgtggcaaccttcaagtggcatactaatgacaaatgacgtgaccgaaccaaaccatgaggaagctgtttcctgctttgctttgtccaagaatgactcttatgtgatgtcagcatctggaggaaagatctccttgttcaatatgatgacattcaagacaatgacgactttcatgcccccacctccagcagcaacttttctagcattccatcctcaagataataacattatcgctattggcatggatgattctaccatccagatatataatgttcgagtggatgaggttaaaagcaagcttaaaggccactctaaaaggataactggcctcgccttctctcattcgcttaatgtgctggtttcttcaggagctgattctcagctgtgtgtatggagcaccgatgggtgggaaaagcagagagctagatccttgcagctgctggggagatcaacatctcagtcagataccagagtgcagtttcatcaggaccaaactcatttcctggttgtgcatgaggcgcagattgctatatatgaaacaacaaaattggaatgcgtaaagcagtgggttccacgtgaaagtgctgcccctatttctcatgcgacattctcatgtgatagccagctgatatatgccagtttcttggatgcaactgtttgcgtattcacttttacgcccctccatatgcgatgccgtattattccttcagcttatctatcaccaagtattagcaattcgaatgtccacccagttgtagttgcagcacatccacaagatccaaaccagttcgcattaggcttgtcagatggtagtgttcatgttttcgaaccacttgaatctgaaggcaaatggggggtccctccgccacttgaaaatggatcagcaaatggtatgccaaccgctccatctgttggagcttcaggctccgaacaagcaccaagataactaagaggccactgagtacaaggtgttgtgtgttgtttcgctggatatttcccaaatttcagttcagactaacgggtagatgttcgttctatgtttgttctagtagtctaaccagagtcctccaagttaaaacacaaactgtaatgtatcgcccaacgtttgtgttctttgcaattgaaagggaaagaaatcttgcctggggctaggagtcttagcactagttgcagcttaaggtcttggtttttgtaccaacatttgtgactttcatttgtggtactgtattacagatgttctcttggtataggacataacttagcccagtagtctccaatgtataaatgtacaactcatgcggtaagatgtaatgtaaaatgaatgcattactcttgtaatatctttagtttagtgaggaaacctatcctaccagctttgtaatttgagttatgcttcaattggttcttggtatatctacttcagctcaactttttggaacataagtgtaatctttctattacatgctgagatttcagacacacggtg

SEQ ID NO: 7455 - DNA, 4066 bp, Solanum lycopersicum
gagtgagaaggatatatacctattttatgcctcgagttcgtcgttaatttgtcccattttgcattatctctgtgggttttcgtttttctcctcccatcttcttccatggatctatctgctctgtaaacaaagcatctgcacaaacactgtttttacatactagttctgggcttggagacgaggtagtagcaatgtcatctctcagtagagagcttgtattcttgatcttacagtttctagatgaggagaagttcaaagaaacagttcacaagcttgagcaagaatctggctttttctttaatatgaagtactttgaagatgaagtgcataatggtaattgggatgaagttgaaaagtatctctctggttttaccaaagtggatgacaaccgatattccatgaagattttctttgaaataaggaagcaaaagtatcttgaggcattggacaagcgcgaccggtccaagggtgttgaaattcttgtaaaggatcttaaagtttttgcatctttcaatgaggagcttttcaaggagataactcagctattgacacttgagaatttcagggagaatgaacagctgtccaagtatggagatactaaatctgcacgagctattatgttggttgagctcaaaaagcttatagaagcaaatcccctgtttcgtgacaagttgcagtttcccaacctcaaaaactcaaggttacgaactttgattaaccaaagcttaaattggcagcaccaactttgtaaaaatcccaggccaaatccagatatcaaaacactgtttgttgatcattcttgtggacaaccaaatggtgctcgagctccgtcacctgcaaacaatccattgcttggatcagtgcccaaaccaggcagcttccctcctcttggtgcacacgggcctttccaacctgggccagcacctgtggcagctcctcttgctgggtggatgtccaaccctcccactgtagctcatccagcagtttctggtggacctatgggtcttggtccttcatctattccagcttctcttaaacatcccaggactccaccaacgaatccgtctattgattatccatctggggaatctgatcatgctgccaaaagaactaggtcactgggaatatctgatgaggttaatcttcctgtgaatgtgctacctatatcatttccagggcaaggtcataatcagtctcttactgtacctgatgacttgcctaagactgttgcaagaacactaaaccagggatcatctcccatgagcatggattttcatccttctcagcagacattgcttctagttggcacgaatgttggagatattgcattatgggaagttggttcaagggagagactggtattgagaaacttcaaagtctgggacttgagtgcatgttcaatgccattacagactgctctggtaaaagatcctggtgtctcagttaaccgtgttatatggagccccgacggttcgttatttggggttgcgtactctaggcacattgttcaaatatattcctatcacgggaatgatgacatacgtcagcatgtggagattgatgctcatgttggaggcgtaaatgatcttgcattctctcaccctaataagcagctctctgtcataacatgcggagatgacaaaactataaaggtttgggatgccacatctggtgcaagacaatatacatttgagggtcatgaggcacctgtatattctgtgtgccctcaccataaagaaaccattcagtttattttctctacagcattagatggaaagataaaagcgtggttatatgataatttgggatctcgagtagattatgaggctcctggtcgttggtgcacaacaatggcatacagtgctgacggaactagactgttttcatgtggaaccagcaaagatggggagtcgcacattgttgagtggaatgaaagtgaaggggctgttaagagaacatatcaagggtttcgcaaaagatcgctgggtgttgtacaatttgatacaactaaaaatcgatttttggcagctggtgatgatttctcaatcaaattttgggatatggaccatgtcccgctcctgacaagtattgatgctgatggaggtcttccagcaagccctcggattcgattcaacaaagatggttctctattggctgtttctgctaatgaaaatgggataaagattttggcaaataatgacggtattcgcttaatacgcacttttgagaacctagcttatgatgcttccagggcatctgaaacaacaaagcctacagtaaatccaatatctgtagcatcagcaaataattctggatttgcagatagggtggcctctgttgttggcatcagtggaatgaatggagatgcaaggaatccggtagatgtaaaacctcgaataaatgaagagcctaatgacaaatcgaagatatggaagctcactgaaattagtgaatcatcacagtgccggtccttgaagctgcctgagaacctcagagtgactaagatatcaagattaatatatacaaattctggtaatgccgtcttagcattagcatcaaatgctattcacttgctttggaagtggcaaaggaatgaacgcaatacaagtggcaaggcaacagccagtgtttcacctcaattgtggcaaccttcaagtggcatattaatgacaaatgatgtgcatgaaccaaaccatgaggaagctgtctcctgctttgccttgtccaagaatgactcgtatgtgatgtcagcatctggtggaaagatatccttgttcaacatgatgacattcaagacaatgacaactttcatgcctccacctccagcagcaacttttcttgcatttcatcctcaagataacaatattattgctattggcatggatgattctaccatccagatatataatgtccgagtggatgaggttaaaagcaagcttaaaggccactctaaaaggataactggcctcgccttttctcatgtgctcaatgtgctagtttcatcaggagctgattctcagctgtgtgtgtggagcactgatggatgggaaaagcagagggctaggaccttgcagctaccgggtagatcgacatctcaatcagataccagagtgcagtttcatcaggatcaaactcatttcctggctgtgcatgaggcacagattgctatatttgaaacaacaaagctggaatgtttaaagcagtgggttccacgtgagagtgctgccccaatttctcatgccacattctcgtgtgatagccagctgatatatgccagtttcttggatgcaactgtgtgcgtattcactgcagggcacctccatatgcgatgccgcattattccttcagcttatctatcacccagtattagcaattcaaacatccacccagtcgtagttgcagcacatccacaagatccaaaccagtttgcattaggtctgtcagatggtagtgttcatgtttttgaaccacttgaatctgaaggcaaatggggagtccctccaccacttgaaaatggatcaacaaatggtatgcccaccgctccatctattggagcttcaggctccgatcaagcaccaagatgacaaagaagcctctaagcaaacaatgttgtgtcctgttttgttgaatcttacccaaatttcagatcaaactgacgagtaaatgttcgttctaggagactaaccagaatcctccaagtcaaaatatgaagtgtatgtaacaccccaaagatttgtttttctttgcaatcggaagggaaggtttgtcttcagtggagctaggagtctcagtactagtcacagcttaagatttgacttgttttttacaccaatgttgtggctttcgtttgtggtaatctattagctagagaggacataatttagctcagtactctccaacatgtaaatttccaacttatgaggtaagatgtaatgtaaaatgaacacttcactctttatattccttagtgtagtgaggaattccttctatcagctttttatttcgtatgattcttgaattggattttggcaagtctcacctctttaaggttcaacttattatgaac

SEQ ID NO: 7456 - DNA, 10256 bp, Solanum lycopersicum
cggctttgtggtccccatgaaactgacttattgaatagttgttatgcttatcattgataagtcatggtgcttatctgagagaaatcacaatttcctcgaaaatataatgactcgcaagagtattttattcattttctcggcgatacgagataaaagggaaatagcaacacacaatatatagacttctatatttagagagagagtgagtgagaaggatatatacctattttatgcctcgagttcgtcgttaatttgtcccattttgcattatctctgtgggttttcgtttttctcctcccatcttcttccatggatctatctgctctgtaaaccaagcatctgcacaaacactgtttttacatactagttctgggcttggagacgaggtagtagcaatgtcatctctcagtagagagcttgtattcttgatcttacagtttctagatgaggagaagttcaaagaaacagttcacaagcttgagcaagaatctggctttttctttaatatgaagtactttgaagatgaagtgcataatggtaattgggatgaagttgaaaagtatctctctggttttaccaaagtggatgacaaccgatattccatgaaaattttctttgaaataaggaagcaaaagtatcttgaggcattggacaagcgcgaccggtccaagggtgttgaaattcttgtaaaggatcttaaagtttttgcatctttcaatgaggagcttttcaaggagataactcagctattgacactagagaatttcagggagaatgaacagctgtccaagtatggagatactaaatctgcacgagcgattatgttggttgagctcaaaaagcttatagaagcaaatcccctgtttcgtgacaagttgcagtttcccaacctcaaaaactcaaggttacgaactttgattaaccaaagcttaaattggcagcaccaactttgtaaaaatcccaggccaaatccagatatcaaaacactgttcgttgatcattcttgtggacaaccaaatggcgctcgagctccgtcacctgcaaacaatccattgcttggatcagtgcccaaaccaggcagcttccctcctcttggtgcacacgggcctttccaacctgggccagcacctgtggcagctcctcttgctgggtggatgtccaaccctcccactgtagctcatccagcagtttctggtggacctatgggtcttggtccttcatctattccagcttctcttaaacatcccaggactccaccaacgaatccctctattgattatccatctggggaatctgatcatgctgccaaaagaactaggtcactgggaatatctgatgaggttaatcttcctgtgaatgtgctacctatatcatttccagggcaaggtcataatcaatctcttactgtacctgatgacttgcctaagactgttgcaagaacactaaaccagggatcatctcccatgagcatggattttcatccttctcagcagacattgcttctagttggcacgaatgttggagatattgcattatgggaagttggttcaagggagaggctggtgttgagaaacttcaaagtctgggacttgagtgcatgttcaatgccattacagactgctctggtaaaagatcctggtgtctcagttaaccgtgttatatggagccccgacggttcgttatttggggttgcgtactctaggcacattgttcaaatatattcctatcacgggaatgatgacatacgtcagcatgtggagattgatgctcatgttggaggcgtaaatgatcttgcattctctcaccctaataagcagctctctgtcataacatgcggagatgacaaaactataaaggtttgggatgccacatctggtgcaagacaatatacatttgagggtcatgaggcacctgtatattctgtgtgccctcaccataaagaaaccattcagtttattttctctacagcattagatggaaagataaaagcgtggttatatgataatttgggatctcgagtagattatgaggctcctggtcgttggtgcacaacaatggcatacagtgctgacggaactagactgttttcatgtggaaccagcaaagatggggagtcgcacattgttgagtggaatgaaagtgaaggggctgttaagagaacatatcaagggtttcgcaaaagatcgctgggtgttgtacaatttgatacaactaaaaatcgatttttggcagctggtgatgatttctcaatcaaattttgggatatggaccatgttccactcctgacaagtattgatgctgatggaggtcttccagcaagccctcggattcgattcaacaaagatggttctctattggctgtttctgctaatgaaaatgggataaagattttggcaaataatgacggtattcgcttaatacgcacttttgagaacctagcttatgatgcttccagggcatctgaaacaacaaagcctacagtaaatccaatatctgtagcatcagcaaataattctggatttgcagatagggtggcctctgttgttggcatcagtggaatgaatggagatgcaaggaatccggtagatgtaaaacctcgaataaatgaagagcctaatgacaaatcgaagatatggaagctcactgaaattagtgaatcatcacagtgccggtccttgaagctgcctgagaacctcagagtgactaagatatcaagattaatatatacaaactctggtaatgccgtcttagcattagcatcaaatgctattcacttgctttggaagtggcaaaggaatgaacgcaatacaagtggcaaggcaacagccagtgtttcacctcaattgtggcaaccttcaagtggcatattaatgacaaatgatgtgcatgaaccaaaccatgaggaagctgtctcctgctttgccttgtccaagaatgactcgtatgtgatgtcagcatctggtggaaagatttccttgttcaacatgatgacattcaagacaatgacaactttcatgcctccacctccagcagcaacttttcttgcatttcatcctcaagataacaatattattgctattggcatggatgattctaccatccagatatataatgtccgagtggatgaggttaaaagcaagcttaaaggccactctaaaaggataactggcctcgccttttctcatgtgctcaatgtgctagtttcatcaggagctgattctcagctgtgtgtgtggagcactgatggatgggaaaagcagagggctaggaccttgcagctaccgggtagatcgacatctcaatcagataccagagtgcagtttcatcaggatcaaactcatttcctggctgtgcatgaggcacagattgctatatttgaaacaacaaagctggaatgtttaaagcagtgggttccacgtgagagtgctgccccaatttctcatgccacattctcgtgtgatagtcagctgatatatgccagtttcttggatgcaactgtgtgcgtattcactgcagggcacctccatatgcgatgccgcattattccttcagcttatctatcacccagtattagcaattcaaacatccacccagtcgtagttgcagcacatccacaagatccaaaccagtttgcattaggtctgtcagatggtagtgttcatgtttttgaaccacttgaatctgaaggcaaatggggagtccctccaccacttgaaaatggatcaacaaatggtatgcccaccgctccatctattggagcttcaggctccgatcaagcaccaagatgacaaagaagcctctaagcgaacaatgttgtgtcctgtttttttgaatcttacccaaatttcagatcaaactgacgagtaaatgttcgttctaggagactaaccagaatcctccaagtcaaaatatgaagtgtatgtaacaccccaaagatttgtttttctttgcaatcggaagggaaggtttgtcttcagtggagctaggagtctcagtactagtcacagcttaagatttgacttgttttttacaccaatgttgtggctttcatttgtggtaatctattagctagaggacataatttagctcagtactctccaacatgtaaatttccaactcgtgaggtaagatgtaatgtaaaatgaacacttcactctttatattccttagtgtagtgaggaattccttctatcagctttttatttcgtatgattcttgaattggattttggtaagtctcacctctttaaggttcaacttattatgaacaacgaactgtacatgttgtttctttaatacccagcgactctcattacagttgtttctttaatatccaatggacattaccatactagtttgatgtttttggcatttgaatcttataatatgagtgcatatacatcccgatgataaatgagtgtgcacgacataaagtattcatccaaaaagcaacagaaatggtacaaaagttaaagagttttcatgaaataatcaattcatttccgtatctgaatcttatgcttagtttggagggttgttattatattgtgttttaatgaatgaatcatttaaatagattgtattgttttctgttgttacacaatgtcatgtattaataaattcagaattatagtgtacgagataaaaatacagactgaataataataaaataaaataattaaaaaataacaacttgaattgatcactaaccataaatttaaacaataacatggtcagtaacaattagaacaaacttgccgacagtagcatgatggcgcaacacagaattcagaagcagctgcttttttcttacaaattagttcttgacattcttcatctacatattcaagttcccaataccagacaagtttcatctatggcatggccgaccaatatacacgcaagaatgacatctacacaaacttcaacacacaaattatttacttacaattcaaaaaataacatgtttagggttttgaaaaacatctggctgttgtgcgatttgatacaactaagaatcggtcatgatttctccattaacttatgggatatggaccatctttagttcctggcaagtattgatgctccagcaagccctctgattcgattcatcaaggatggttctcttcagctaatgaaaatgggataaagattttggaagataatgacggtatccgcttccggggcatctgaaactgcaaagggttccaaattgaacttcaaatcagttgaattaactccaaacaatggcttcgcataatgaagatgcaggaaatgtaataccccagcttaatgaagagcctaatgatgaacctaagatgtggaggctcactaaaattagagactcattgcaatgccagtccttgaagcttcctgaaaatcttggagtgactaagatatcaagtttaatatatacgagctctggtaattgtatcttagcattagcatcaaatgctattcacctgctttggaagtggcaaggaaatgagcgcaattctaggggcaaggcaacagccagtgtttcaccacaactgtgtcaaccttcaagtggcatcttaatgacaaatgatgtgcacgaaccaaaccatgaggaagctgtctcttgctttgctttgtccaagaacgatgggtatgtgatatcaacatctggtggaaggatgtccttgttcaacctgatggcattaaagagattgacaactttcatgcctccacctccagcagcaacttatattgtcttccttcctcaagataacaacattatcgctattggcatggatgattctaccatccagatatatcatgtccgactgggtgagctgtgtgtatggagcactgttgggtgggaaatgcagagggctaaatccttgcagctacgggggcaatcaatatctcaatcagataccagagtgcagtttcatcaggatcaaactcatttccttgttgtgcatgaggcacagattgcagtatatgaaacagcaaagttggaatgtttaaagcagtgggttccgcgtgaaagtgatgccccaatttctcatgccacatactcatgtgatagccagcttatatatgctagtttcttggatgcaactgtgtgcatcttcactgctgggagcctccatatgcagtgctgcatttttccttctgcttatctgtcacccggtatcagcaatttaaatatccacccagttgtagttgcagcacatccagaagatccaaaccaatttgcattaggtatgtcagatggtggtgttcatgtttttgaacctcttgaatctgaaggcaaatggggtgtccctccaccagttgaaaatggctttgcaaaaggtgggccagcttctccagctattggagcttcaggctccgattaagcaccaacatacaaagaaacctctaagcaaacagtcttctgtcttgtttttttttttttggatcttacccaaatttcagttcagactggtcaaacatgagcggattatgtaacgcccaaaaaatttgtgttctttgacttggtttttacgacaatgttatgcttttgtgtgtgactgtgtggtaatccatttgctacagaaaataatttagctcagtactcttcaacaatttctcctttcagctatctagttcttgagttgtattttggcaagtgtcacctctccaagggcgagttactttgacctgtgatatttactcaacctcaacttgttatgaacagcaatatgtgttgtttctttgatattctggtgactgtgagtaattgtttaaatcattttacccttacgatggtgttatttgcacaaaagaagaacttgattgtctgatttggctcatagagaattggccagagttttgtgagaaaaagaaaactctcatgcgcaatgtgatgatacaaactatgaaacctggagcacagtaatagagtactagacaatggacattatagagtaacataaagctagttttgaattttggcttatgaatctacagaaattctcatcaatcattaaacaaaaataccttcacatttaatatattgtttatactataactattatgtatattattttttttaatatcattctttattttcatgtaaaatcaataaaaattaatattattacaaatagaattcatgcttgatatacaattcttttctctagaatatatcacggtaaaatataattagtggcaaaattggattattgttacattcttaatataaatattcattggataaatttattattttggaagtattcttttatagaaaaatattagaactacatataatttattatttattatttttttactatacatacgcaatgggtatacggttttatatttgaattataatagaaaattcatttatcattgttatatattcttttatataaattaattagataaaagttcatggcataaattattttaaataaaacaccttttgtttagttttttttttttatatatgtaaaataaattacttttatttataatacaaaatatagtaatttgtaggaaagtctaattggggtgaaataagaataaagaacaaaaatacatccatattcatccaacagcaacaaaatgatacaaaagtgaaaggcatttcatatataaaccttactgaagccgaaacctaaccaaacccagaattggccaagtagcatgacggcgcaacaccaatgaagcttctccgttatagagaagaaggcttcatctatggcagaatcacatctacccaaatctttttctttactaaccattcaaaatctagggtttttgtaaacactgatgggtgttgtgcaatttgatacaacaaaaaatcgatttgtggcagcggtggatgatttcttaatcaaattctccgatgtggaccatccagtatcaaggttaatatgtacaaactctggtgatgccatcttagtattagcatcgaatgctattaacctgctttgctttgtccaagaatgcttgctatgtgatatcaacatctggtggaaagatctctttgttcaacatgatgacattcaagcctacagtaaatccaatatctgtagcatcagcaaacaaattctggatttgcatataggtggcctcttttgttgccatcagtggaatgttgtgtaaatttaactcccaaaggtgtatgtgtagccttactccaaaggaaagtctaattggggtgaaataagaataaagaacaaaaatacatccatattcatccaacagcaacaaaaatgacacaaaagagaaaggcatttcatctataaaccttactgaagccgaaacctaaccaaacccagaatcggccaagtagcatgacggcgcaacaccaacgaagcttctccgttatagagaagaaggcttcagctatggcagaatcacatctacccaaatctttttcttcagttaccattcaaaatctagggattctgtaaacactgatgggtgttgtgcaatttgatacaactaaaaatcgatttgtggcagcggtggatgatttctcaatcaaattctccgatgtggaccatccagtatcaaggttaatatgtacaaactctggtgatgccatcttagtattagcatcgaatgctattaacctgctttgctttgtccaagaatgcttgctatgtgatatcaacatctggtggaaagatctctttgttcaacatgatgacattcaagagagtttcatgcctccacctccagcagcaacttatattgccttccatcctcaagataacaacatcatcactattggttaaaagcaagcttaaagggcactctaaaaggataactggccttgccttctctcatttgctcaatgtgctagtttcctcgggagctgattctcagctgtgtatggagcactgttgggcgggaatgcagagggccagatccttgcagctacggggtcgatcgatatctcaatcagataccagagtgcagtttcatcaggatcaaactcatttctttgttgtgcatgacgcacagcttgcaatttatgaaaaaacaaagttgaaatgcttaaagcagcagccagctgatacatgccagtttcttggatgcaactgtgtgcatattcactctccatatgcgatgccgttcaaatatccacccagttgttgcagaacatctagaagatccaaggcaatatgcactagctatgtcagatagcagtgttaatgtttccataccacttgaatctggaggcaaataaggtgtccttccaccacttgtaggttgtgcagacggcgttccagcaatctgaaggcagatggggcgtgtaaatggttctgcagacggcattccagcaatctcaaggcagatgggccgttcctccaacacttgaaaatgattttgcagaagatgtgccagctgctccatcctggagcttggagcttcgatcaagcaccaagataacagagaattattaagcaaacaaacagtctatagtacttttgacaagcctgaactcctctgtgaagtcactaatgacatttgtttttcgaattctttggcttatgtgaatcaacaatatttttcagtttgtttatcaagataattgatagaaaatccaaaacgagtgttttaatatcaatatacaaatgccttaaaatgtgaaagaaaaattattcaggtgtgagaaagtgtgcatcttggggtggataacatccgcattaaaattatgcatagttatatcatagtacgcacaaagatacatcataggatatatatccaaaggaagtcccttaggtaactgttcacaagcaacagaaaaaatttaaaaagccacatccacagaatatatatacaaaggaagtcccttaggtgccaagcatttcacgagattgttcttcctcttgccaaggaaataatggttcccacatctgagccttagctgaacgtaagcttactaaagccgtatcctgacctcccaccaaagtaccatgacggcgcaacaccaattcagaatttagaagtggttgctgtttcttacaaatatgtacaaaacctactaacctacccccaggaccaaggaagcttatctacattttccctcatactgaagtgccccatacgacagagaggaggcttcatctatggcatgatgaaaagatcgaccaaagatgcacagatgagtgacatctaggcaaatctgcaacagacattatttacaattcaaaaaataacacgatttatttttaatctatgtacagcagtcccccagcactgactaggtgatcaaaacaagta

SEQ ID NO: 7457 - DNA, 4087 bp, Aquilegia formosa
gagagagagaaggagattaagagagagagagagagagagaaagaaagagaagtttgagagattttttctatctttttttctatgtgctgtagttgatcgatctctggttttcttcttcatcttgttgttcttgttgaaggtgagttttgtgtttgtgtttgtgttgaagcttaaatctaaaggaatctatctctatctgttgtttaatttctacaatttgaagttagttgtaagggtttgaagacttacaagggttttcgaagcgatgtcgtctctcagtagagagcttgtgttcttgatattacagtttctggatgaagagaagttcaaagagacagttcacaagcttgaacaagaatctggattcttctttaatatgaagtattttgaagatgaagttcacaatggaaattgggatgaagttgagaggtacctttcaggttttactaaagttgatgacaaccgctattcgatgaagatcttctttgaaatcaggaagcagaagtatctcgaggcattggataagcatgatcgtgccaaagctgttgaaattcttgtgaaggatttgaaagtctttgcttcgtttaatgaggaattgttcaaggagattactcaacttttgaccttggagaattttagggaaaatgagcaactgtccaagtatggagatacaaagtctgcaagaactataatgttggttgagctgaagaaacttattgaagccaatcctcttttccgagataaattacagtttccaaatctaaaaaactcgaggctgaggacactgattaatcaaagcttgaattggcagcatcagctttgcaaaaacccaaggccaaatccagatataaaaactctttttgtcgatcatacttgtggacaaccaaatggtgcacttgctccttcacctgcaaatagttctctcctttctatgccgaaagcaggtggctttcctccattgggtgcacatgggccatttcaacctgcaccagcgccagttccaactccactcgctggttggatgtccaatccagctactgtaccacaccctgctgtgtctggaggagctattggactcggtgctccaacaaatccagctgcaatgttgaagcatccacggactccaccatctaaccatgttgattacccatcaggggattctgaccacgttgctaaaagaacaaggccccttggtattagtgatgaggtgaaccttcctgttagcatctcaccagtaacttatatgggtcagagtcataattcggctttcagcacagatgacctgcccaagactgtggcacggacgtttagtcaggggtcatctccaatgagcatggattttcatcctcgtcaacaaactttacttctagttggtacaaatgtcggggacatagcactgtgggaagttggttctagggagagattatttctgaggaatttcaaggtttgggatcttggggcatgttcgatgccactccaggcgtctttggtcaaggatccaagtgttgctgttaatcgtataatatggaaccctgatggttctttgttcggagttgcatactcaagacacattgtgcagatttatgcttatcacggtggtgatgacgtgaggcagcacttagagattgatgctcatgttggtggtgtaaacgaccttgcattctcgcacccaaacaagcagctttgtgttgtaacttgtggtgatgacaagactataaaggtctgggatgcagcaactggggccaagcagtatacatttgaaggtcatgaggctcccgtttattctgtatgccctcattacaaggaaaacattcagtttatcttttcaaccgctctggatggaaagattaaagcatggctatatgacaatttgggatccagggttgattatgatgctcctggccactggtgcacaacaatggcctatagtgctgatggctcaaggctgttttcttgtgggactagtaaagatggggagtcttacattgttgaatggaatgaaagtgaaggtgctgtaaagcggacctacctaggattccgaaaacgttctgcaggagtcgtgcaatttgatacgactaagaatcggtttttagccgctggtgatgagtttgtgattaaaatttgggatatggataatgttaaccttttgactactatggatgctgagggagggttaccagcgagtccacgtatccgcttcaacaaggagggaaccttattggctgtttctgcaaatgataatgcgattaaagtcttggccactactgatggtcttcggttgctacgcacatttgaaaatcgttcttttgacgcatcaagagctgcatctgaggctgtttcgaagccttcaataaatccaatttctgctgctgctgctgctgcggctgccgctgcaactagtgctgggcatgcagatataggtgcttctgtggtgtctatttctggaatgaatggtgacgcaagaaatatgggggatgtaaaacctagaataactgaagaagcaaatgacaagtcaaaaatttggaaactcactgagatcagtgatggagcgcagtgtagaactatgcgacttccagacagtataagatccagtaagatatcaagattgatttataccaacactggtactgccattttgggattggcttcaaatgccgtccattttctctggaagtggcaacgtaatgaacggaattcaagtggcaaggcgacagcgaatgttccccctacattatggcaaccatcaagtggcattttaatgaccaatgatattgctgatgttaaccccgaagagtgtgtaccctgctttgctttgtccaagaatgattcttatgtcatgtcagcatcaggtgggaagatatcactgttcaacatgatgacgtttaagaccatgacaacatttatgcctccacctcctgcggcgacttttcttgcttttcacccccaagataacaacattatcgcaataggcatggatgattctactatacagatttataatgtccgtgttgatgaggtgaaaagcaagcttaaaggccattccaaaagaatcactggtcttgccttttcccatgcactcaatgtactagtttcttctggagctgatgctcagatttgtgtatggaactctgatggatgggaaaaacagaagagcagattcttacaaattccagctggaaggaatccagcagcactatccgatactcgcgtacagttccatcaagaccagatacatttcctggttgtgcatgaaacacagcttgccatatatgaaacaactaaactagaatgtttgaagcagtgggttccaagggaatcatctgcacccatttctcatgcgacattatcatgcgacagccagttagtatatgccagctttctggatgcaacagtatgcatttttggtgcagcaaaccttcggctacgctgtcggattaacccaactgcttatctacccgccaatgttagtgctagtatacatccacttgtaattgctgcgcatccacaagaaccaaaccagttcgcattgggactgacagatggtggggttcatgtctttgagccccttgaatctgaaggaaaatggggtgtgcctccgcctgttgaaaatgggtcaggaagtggtatgccctcagcaccagcagtcgggacttcaggttcagatcaaccgcagagatgatgtatgaagaattggataaagcatgagttgtttcaaattttcaacttcttgtcctttgtccactctgttactgtgaattctcatatactcctcagccttcatttgtctgtgctgaagagttgagtagctttttctttgccttagcttgtgttggtttaccttttcatcaatttatttgcagttttaggtttaaaggtatatgtaagttagggatggattgtagaagcgaagactcacatgtaggacatagaaagtaatattatataggaagtacccagaggtgaagtaaggtgtactttgcttgaggtccttttttaatagcttgttggatattgacatgtttttgtgaatcaaatagcactgtagcctctttgacagtttgtaatattttcttcgtattttctaccc

SEQ ID NO: 7458 - DNA, 3675 bp, Citrus sinensis
gtcggtatataaattagaaaaggcttaggaggatatataaatagagagagagagaaaaaaaaagtcttttatttttagagagataaagctccatttcttaagagagaaagctccaattccctgagggagctcgttttaactctctgtctctctctttctctcttgcaaatcgattcaccagatctacggtaatagttggtgaaaattgtacgcttggaattaaaaaaactgggtgcttaaacgatgtcgtctctcagtagagagctggtgttcctgatcttacagtttctggatgaggaaaagttcaaagaaactgttcacaagcttgaacaggaatctgggtttttctttaacatgaaatattttgaggatgaggtgcataatgggaattgggatgatgttgagaaatacctctctggttttactaaagtggatgataatcgctactcgatgaaaatatttttcgagataaggaaacagaaatatctcgaggcattggataagcatgaccgggcaaaggctgtggaaatattagtgaaagatttgaaggttttttctacatttaacgaggaactattcaaggagattacccagctgttgacattggagaattttagggagaatgagcaattgtctaagtatggagacacaaagtctgcaagatcaatcatgttggttgagctcaagaagcttattgaagccaaccccttatttcgtgataaattgcagttccccaaccttaaaaattcaaggttacgcactcttatcaaccaaagcctgaattggcagcaccaactttgtaaaaacccaaggccaaatccagatataaagactctctttgtggatcacacttgtggacaaccaaatggtgcacgggccccatcacctgcaaacaatccattgcttggatccttaccaaaagctggggttttccctcctctgggtgcacatgggccttttcaacctacaccagccccagttccaacaccccttgcaggttggatgtctaatcctcccactgtaactcatccagcagtttctggaggagctattggtcttgggagtccatccatcccagctggtacatccctgtctcactctgctttgaagcaccccagaactcctccaactaatccctctgttgactacccatcaggggattctgaccatctttccaaaaggactaggccaataggaatatccgatgagataaacctgcctgttaatgtattgccagtgtcatttacgggtcacagtcacagtcacagtcacagtcaggcctttagtacacctgaagacttgccaaagactgtgacaaggactttgaatcagggatcatctcctatgagcatggacttccatcctgttcaacagacacttcttttagttggaactaatgtgggggacataggattatgggaagttggttcgagggagcgacttgttttgagaaactttaaagtttgggatctcggcgcatgttcaatgcctctccaggcagctctagtcaaagatcctggtgtgtctgttaaccgtgtcatatggagcccggatggtagtttatttggagttgcatactcaaggcacattgtccaaatctattcatatcatgggggagatgaagttcgacagcacttggagattgatgctcacgttggtggagtaaatgatattgctttctcgcatccgaataagcaactttgcgtgataacctgtggtgatgacaaaacgataaaggtgtgggatgctactaatggtgcgaagcagtatatatttgaaggccacgaggctcctgtttattctgtctgccctcatcacaaggaaaatatccagttcatcttttcaacggcacttgatggaaagattaaagcttggttgtatgacaatttgggatctcgagttgattacgaagctcctggccgctggtgcacaacaatggcctacagtgctgatggtacaaggacctatcaaggattccgcaaacgatctctgggtgttgttcagtttgatacaactaaaaacaggtttttggctgctggtgatgatttctctattaaattctgggatatggacagtgtgcaacttttgactagtattgatgctgatggaggtcttccagcaagccctcgaatccgctttaacaaggatggctgtctcttggctgtttctaccaatgataatggaatcaagattttggcaacttcagatggcattcgtttgctgcgtacatttgagaatcttgcttatgatgcatcacgaacatctgaaaactcgaagcctacgataagcccaatttcagctgcagcagctgccgctgcaactagtgctggacttgcagacagagcggcttctatggtttcaattccaggaatgaatggagatgtacggagcttggcggatgtgaaacctagaataactgaagaatccaatgacaaatcaaaggtttggaagctaactgaactcagtgaaccaaatcagtgtcgatctttgaggcttcctgaaaacttgagagcaacaaagatatcaaggttgatcttcacaaattcaggtaatgctatcttggcattagcttcgaatgcaattcatttgctctggaagtggcagcgaactgagcgtaattcatctggcaaggcaactgccagtgtggcacctcagctatggcaaccaccgagtggcattatgatgactaatgatgttacagactctaaccctgaggaggctgtaccctgctttgcgttgtcaaagaatgattcttatgtaatgtcggcctctggtggaaagatttccctcttcaatatgatgacatttaagactatggcaacttttatgccaccgccacctgcagcgacatttcttgcttttcatcctcaagacaacaatatcattgctattggaatggatgattcctcaattcagatatataatgttcgagtagatgaggttaaaagcaaacttaaaggccactccaaaagaataaccggcctggccttctctcatgcattgaatgtgctagtttcatctggagcagattctcagctttgtgtatggagctccgatggatgggaaaagcaaaagaatagattcttgcaaattccaactgggaggacaccaactgcgcagtcagacacacgtgtacagtttcatcaagaccaaatacacttcctggttgtacatgagacacagcttgctatatttgaaactacaaaactagaatgtgtgaagcagtgggtcccgcgtgagtcttctgctccaatcactcatgcaacattctcatgcgatagccagctggtatatgcttgcttcttagatgcaactgtctgtgtttttagtgctgcaaatctcaaattgcgttgtcgtatcaacccgtctgcgtatcttcctgctggtgtcagcagttccaatgtccacccgcttgtgattgctgcgcatccacaagaaccaaatgagtttgcgttgggactatctgatggcggggttcatgtttttgagccccttgaatctgaaggtaaatggggcgtcccaccacctgttgacaatgggtcaacaagcagcatgccagctactcctccagttggaggttcaggttcagatcaagcacagagatgatgaaatggctggcagagcataagttcttttagatgcttgccttgccagccaccattccaaattaggtat

SEQ ID NO: 7459 - DNA, 3486 bp, Flaveria ramosissima
ttctctgcttttcttcttgatatatctcttctaccatcaatcgatcttgttaagggaggagtgaattgcaatgtcttctttaagtagggaattagtgttcttgatcttgcagtttcttgatgaagaaaaattcaaggaggctgttcacaagcttgaacaagaatcagggttcttctttaacatgaaatattttgaggaagaagtgcacaatgggaactgggatgaggttgagaaatacctttctggtttcactaaagtggatgataatcggtattcgatgaagatatttttcgaaattagaaagcaaaagtatcttgaagcattggataagaatgacaggtccaaggctgtagagattcttgtaaaagatcttaaagtgttttcttcatttaatgaagatctgtttaaggagataactcagttattaactttggataattttagggagaatgaacaattatccaaatatggtgatactaaatcggctcgaactataatgttggttgaacttaagaagttaatcgaagcaaatcccctgtttcgtgacaaattgcagtttccaagccttaagaattcaagattaaggactctcataaaccaaagcttgaactggcaacaccaactttgtaaaatcctaggccaaatccagatatcaaaacgttatttgtcgaccattcgtgtggtcaaccaaatggtgcacgcgctccatcacctgctggtaatccgcttcttggatcattacctaaagctggtggctttcctcctttgggtgcacatgggccgtttcaacctgcaccggctccagtaccaactccgcttgctggttggatgtctaatccgccatctgtatctcatccaacggtttctggtagtgcaattggtctcggtagtccatctatttcagctgctttgaagcatccaagaactccaacaaatccttcactggattacccgtctgcagattctgatcacatgaacaaaagaacaaggctcatggggataacagatgaggcaaatgtgccagttaatgcgttgcctgtgtcattcccggggcattctggtcataatcaagcttttaatgtacccgatgaattgccaaaaaccgtggcacgcacattaaaccagggttctactcctatgagcatggattttcatccaattcaacaaacattacttttagttggaacgaatgtgggcgacataggattgtgggaagttgggtcacgcgaaagattggttcttaaaaacttcaaagtttggaatcttagtgcatgttcagtggcttttcaggctgctttagtaaaagatcctggcgtctcagtgaaccgtgtaatctggagtccagatggttctttgttcggagttgcatattcaaggcacattaggtacaaatatattcatatcacggaggtgatgatgtgagacaaaatgtagagatcgatgctcatgttggtggagtaaatgatcttgcattctctcatccaaacaaacagctatgtgtgataacttgtggggatgacaaaaccatcaaggtttgggatgcatcaactggtgtaaagaagtatacttttgaaggccatgaagcacctgtttattctgtatgccctcactataaagagaatattcagtttatattttcaacggcccttgatgggaagataaaagcatggttatacgataacctggggtcaagagttgattatgaggctcctggtaagtggtgcacaacaatggcatacagtgctgatggaacaaggctcttttcatgtgggacgagcaaagacggggaatcacacattgtagagtggaatgaaagtgaaggggctgtaaaaagaacgtatattggtttccgtaaacgatctctaggtgttgtgcagtttgatacaacaaaaaaccgtttcttggcagctggcgatgattttgcagttaaatattgggatatggataatgttcagattttgactagtgttgatgctgatggaggtcttgcggcaagcccgcgaatccgatttaataaagatggtgctcttttggctgtttctactaatgacaatggtatcaaaattttggcaaattccgacggacttcggttacttcgaacttttgagaatctttctttggacggttctgctgcaagaactcctgaggctgcaaagtctaccataaacgcgttatctgctgctgctgctagcaatgctgcattagcagaaagggttgcagttgcacccgttggatccatcactgcagtgaacggggatgccaaaagcttgccagatgggaaacctaggatcggggaagaatctagtgacaaatcaaagatttggaaactaacggagatcaatgaagcatctcaatgccggtcattaaagctccctgagaacatgagagttacaaagatatcaagattgatatatactaattcaggaaatgccattctagcattagcgtcgaatgctattcatttgctatggaaatggcagcgtaacgagcggaattcaagtggcaaggcgacagctggcgttccgccacaattatggcaaccttcaagtgggattttgatgactaatgatgtggcggagaccaaccccgaagaatctgttgcctgctttgctttgtctaaaaatgattcttatgttatgtctgcatctggaggaaagatatctttgttcaatatgatgacattcaagacgatgacaacgtttatgccaccgccacctgcagcaacatttcttgctttccaccctcaagacaataatattatagcaattggcatggatgactcgacaatccagatttataacgttcgtattgatgaggttaaaagcaagcttaaaggccactctaaaagaatcacgggcctcgccttttctcatgctctaaatgtcctagtctcatctggcgctgatgctcagatttgtgtatggagttctgatggatgggaaaaacagagatcgcggtacgttcaactcccaccagggagaacaccatcaccacaatccgacactcgtgtgcagtttcatcaggatcagatccattttcttgttgttcatgagacccaactcgctatttatgaaacaacaaaactagactgcgtaaatcagtgggttcaacgagaaaattcagccccgatatcgcacgcaacattttcatgcgatagtcagctgatatttgcaagtttctttgatgcaaccatttgtgtctttactgctccccaccttcgccttcgatgtaaaatcaatccctatgcatatcttacaagtactaacctgcatgtgcacccgatggtgattgctgctcatccacaagaaccgaaccaatttgcattggggctttctgatggaaccgttcatgttttggagccacttgaatctgatggcaggtgggggttgccaccaccggctgaaaacgggtccacaagcacagtaccagctacaccgcccgctgctggttcagggtctgaacaacccacccagaggtgaccatgtt

SEQ ID NO: 7460 - DNA, 4419 bp, Oryza sativa
gcgatttgtccgttctctatctgggcgtgtattactgtttcctttcccgataagaaaattttcccccgcctattataaataggaaaattcagggctcccccatttctaaattgttgacttaccatactacccctcgctcagtctcatcctcctccaggctcgccctcgttcctctctctctctcctcgcaaagcgatcgaggcaaatccggagccgccgccgggccctcgatcttcgccggcggccgcccccacctccgtcgacgagcgaagcggcgccgcctctcccttctaccgggccgacgtggagctgagcggagcggcggggaggggggggggggtggggaggggggtgaggggagatccacgcgagctgatctcttccgtggtgtgtgcgccgtgcgggacggggtcgggtcgttttctgtgacctgtacaatagggtagggtttgaggcttttgagcagaggcgcatccgccgcgtgggtgggtgggtgcggcggtggaggggaggatgtcgtcgctgagccgggagctggtattcctcatcctgcagttcctcgatgaggagaagttcaaggagactgttcacaagcttgagcaggagtctgggttctacttcaacatgaagtacttcgaagacgaggtgatcaatgggaattgggatgaggttgagcgctacctcggtggctttaccaaggttgatgacaaccgctactcgatgaagatattctttgagatccgcaaacagaagtatcttgaggcccttgataagcatgatcgttcgaaggcggttgaaatcttggtcaaggacctgaaggtcttcgcgtcctttaacgaggagttgtttaaggagatcacacagcttttgacgttggaaaactttagggaaaatgagcaactctccaaatacggtgatacaaaatctgccagagcaataatgcttgttgaactaaagaagctgattgaagctaatcccttgttccgtgacaagcttcagtttccaaatctgaagagctccagattgcggacacttataaaccagagcttaaactggcagcaccagctttgcaaaaatcctagacctaaccctgatatcaagactctgtttgttgatcattcttgtggacaaccaaatggtgctcgtgctccatcgccagcaaacaatccattacttggatctataccaaaacctggaggtttccccccattgggtgctcacgcgccatttcaacctgcacctacacctgtcccacctctggctggctggatgtcaaaccctccagcagtaacacatcctgctgtgtctggtggagctattggatttggtactcctacaaatcctgctgctatattaaaacatcctagaacaccaacaactgccaatccttctatggattatccatcaggagattctgatcacgtctccaagagaacgagaccagttgggatgtctgaggaggtgaatcttccagtgaatatgttacctgtgacatatccacagagtcatagttacccgcaagatgattttcataaaaatgttgcacggacattgagccaaggatcaactccaatgagcatggacttccatccagttcagcaaactctccttcttgttggtaccaatgttggtgacattggattatgggatgtcggtaccaaggaacgacttgttttaagaaacttcaaggtttgggatcttacaaaatgctcaatggccctccaggcatcacttgtcaaagaccctactgtctcagttaaccgcataatatggagtcctgatggaaccttgtttggtgttgcttattcaaggcatattgtacagatctattcataccatggcggtgatgatatcaggcagcacttggagattgatgcgcatgtcggtggtgtaaatgacattgcatttgcccatccaaataagcagctatgtataataacctgcggagatgacaagacaattaaggtctgggaggccactagtggagcaaagcaatttacatttgaaggtcatgaagctcctgtttactctgtttgtccacattataaggaaaatattcagttcatcttctcaactgctttggatggaaagataaaggcttggctatatgataatttgggatccagagttgactatgatgcgccaggacattggtgcacaacaatggcatatagtgcagatggttcaaggttattttcttgtgggactagcaaggatggcgaatcacatctagtggaatggaatgaaagtgaaggagctgtcaagagaacttaccagggatttcgcaagcgatcgatgggtgttgtccaatttgataccacacggaacaggtttttggctgctggagatgaattcttgattaagatatgggacatggacaacacaagtcttctgactaccattgatgccgatggtggtcttcctgcaagtccacgggtccgattcaacaaggaaggtactctgctggctgtttctacccatgaaaatggtatcaagatcttagcaaatgctgatggagtacggttgctgcgcacattggaaaatcgttcatttgatgcttctcggagtgcgtctgagactgtaacaaagcccctaatgaatccattgactgctgctgctgctgcggcggcgtcagctgctgctgccgggactagttcaggaaatgctgctccaccggcaataactgcactgaatggggatagccgaagcttggttgatgtaaagcctagaatagctgatgagccattggataaatcaaaagtctggaaacttatggagataaccgagtcaagtcagtgcagatcattgaaattaacagataatatgaggacaagcaagatttcaagacttatttacacaaattctggtgtcgctatcttggctttagcttcaaatgctgttcatctgctctggaaatggcctcgcaatgaccgaaactcaagtggaaaggctactgcaagtgtttctcctcaattatggcaacctccaagcggcatcctcatgactaatgacataactgacaaccctgaagaagctgtccattgctttgctttgtcaaagaatgattcatatgtcatgtctgcatctggagggaaaatatctctgttcaacatgatgacttttaagacgatgacaacttttatgcctccgccgccggcggcaacgtttcttgctttccatcctcaagataacaacattatagcaattggaatggatgactcaaccatccaaatctacaatgttcgaattgatgaggtcaaaagcaaacttcgagggcactctaagaaaattactggacttgctttttcaaatgtattaaatgtgttagtctcttctggagctgatgcgcagatatgtgtgtggagcacagatgggtgggataaattaaagagcagaatgttacagataccatcaagtcgtccatcatctataatcttagacacacgtgttcagttccatcaggatcaattgcactttcttgttgtgcatgagacccagattgccatatatgaaactacaaaattagaacccgtgaagcagtggcctgtccgggagaactcttctccaataacgcatgccatgttctcctgcgatagtcaattgatttatgcaagctttctggatgccactgtttgcatatttaatgcatcgagtttgagactccaatgtcgaattcttccagcatcctatcttcctcagaatatcagctcaaatgtttatcctgtcgttgtggcggcacatccttcggaagcaaatcagtttgctctaggcctgactgatggtggtgtttatgtattggaacccttggaatctgagagaaaatggggaaatcctccaccagcagagaatggatcaaccagcgctttgtccacacctcctaatggagcatcaagttctgatcaaccagaaagataatgatgaggagtttgaagtgttacattttttgtacttgcacggtacaaattcactaaccaagacgatgcacttcactcttacagcttcccttccgtagagctggttccaaggggtagtcgatgaacggacggaataaaaagacaagcttaacagcagttcatttgttgcttatatgtctcactgttatctgtattaagtgagggaagagttagtcctagtatttaattttgctgtctgtcgtgctgtgaaaaaagatgtttgcaagtagcttaagctgtagcaacaatttgtctgaacttattatcaccttttattcacaactagaaagtaaattgctgctcctatcgtttgtgttcatctctgttctcttgatgcatgtcttgcgctgtttcatccagtcgtgccacccgcgtagcacggtgtcacaatgcagctcgacctttacatatccactttgctagattcaattgctatttgagcctttgccttaaaattgctgggggg

SEQ ID NO: 7461 - DNA, 4165 bp, Oryza sativa
aaattgttgacttaccatactacccctcgctcagtctcatcctcctccaggctcgccctcgttcctctctctctctcctcgcaaagcgatcgaggcaaatccggagccgccgccgggccctcgatcttcgccggcggccgcccccacctccgtcgacgagcgaagcggcgccgcctctcccttctaccgggccgacgtggagctgagcggagcggcggggaggggggggggggtggggaggggggtgaggggagatccacgcgagctgatctcttccgtggtgtgtgcgccgtgcgggacggggtcgggtcgttttctgtgacctgtagaatagggtagggtttgaggcttttgagcagaggcgcatccgccgcgtgggtgggtgggtgcggcggtggaggggaggatgtcgtcgctgagccgggagctggtattcctcatcctgcagttcctcgatgaggagaagttcaaggagactgttcacaagcttgagcaggagtctgggttctacttcaacatgaagtacttcgaagacgaggtgatcaatgggaattgggatgaggttgagcgctacctcggtggctttaccaaggttgatgacaaccgctactcgatgaagatattctttgagatccgcaaacagaagtatcttgaggcccttgataagcatgatcgttcgaaggcggttgaaatcttggtcaaggacctgaaggtcttcgcgtcctttaacgaggaattgtttaaggagatcacacagcttttgacgttggaaaactttagggaaaatgagcaactctccaaatacggtgatacaaaatctgccagagcaataatgcttgttgaactaaagaagctgattgaagctaatcccttgttccgtgacaagcttcagtttccaaatctgaagagctccagattgcggacacttataaaccagagcttaaactggcagcaccagctttgcaaaaatcctagacctaaccctgatatcaagactctgtttgttgatcattcttgtggacaaccaaatggtgctcgtgctccatcgccagcaaacaatccattacttggatctataccaaaacctggaggtttccccccattgggtgctcatgcgccatttcaacctgcacctacacctgtcccacctctggctggctggatgtcaaaccctccagcagtaacacatcctgctgtgtctggtggagctattggatttggtactcctacaaatcctgctgctatattaaaacatcctagaacaccaacaactgccaatccttctatggattatccatcaggagattctgatcacgtctccaagagaacgagaccagttgggatgtctgaggaggtgaatcttccagtgaatatgttacctgtgacatatccacagagtcatagttacccgcaagatgattttcataaaaatgttgcacggacattgagccaaggatcaactccaatgagcatggacttccatccagttcagcaaactctccttcttgttggtaccaatgttggtgacattggattatgggatgtcggtaccaaggaacgacttgttttaagaaacttcaaggtttgggatcttacaaaatgctcaatggccctccaggcatcacttgtcaaagaccctactgtctcagttaaccgcataatatggagtcctgatggaaccttgtttggtgttgcttattcaaggcatattgtacagatctattcataccatggcggtgatgatatcaggcagcacttggagattgatgcgcatgtcggtggtgtaaatgacattgcatttgcccatccaaataagcagctatgtataataacctgcggagatgacaagacaattaaggtctgggaggccactagtggagcaaagcaatttacatttgaaggtcatgaagctcctgtttactctgtttgtccacattataaggaaaatattcagttcatcttctcaactgctttggatggaaagataaaggcttggctatatgataatttgggatccagagttgactatgatgcgccaggacattggtgcacaacaatggcatatagtgcagatggttcaaggttattttcttgtgggactagcaaggatggcgaatcacatctagtggaatggaatgaaagtgaaggagctgtcaagagaacttaccagggatttcgcaagcgatcgatgggtgttgtccaatttgataccacacggaacaggtttttggctgctggagatgaattcttgattaagatatgggacatggacaacacaagtcttctgactaccattgatgccgatggtggtcttcctgcaagtccacgggtccgattcaacaaggaaggtactctgctggctgtttctacccatgaaaatggtatcaagatcttagcaaatgctgatggagtacggttgctgcgcacattggaaaatcgttcatttgatgcttctcggagtgcgtctgagactgtaacaaagcccctaatgaatccattgactgctgctgctgctgcggcggcgtcagctgctgctgccgggactagttcaggaaatgctgctccaccggcaataactgcactgaatggggatagccgaagcttggttgatgtaaagcctagaatagctgatgagccattggataaatcaaaagtctggaaacttatggagataaccgagtcaagtcagtgcagatcattgaaattaacagataatatgaggacaagcaagatttcaagacttatttacacaaattctggtgtcgctatcttggctttagcttcaaatgctgttcatctgctctggaaatggcctcgcaatgaccgaaactcaagtggaaaggctactgcaagtgtttctcctcaattatggcaacctccaagcggcatcctcatgactaatgacataactgacaaccctgaagaagctgtccattgctttgctttgtcaaagaatgattcatatgtcatgtctgcatctggagggaaaatatctctgttcaacatgatgacttttaagacgatgacaacttttatgcctccgccgccggcggcaacgtttcttgctttccatcctcaagataacaacattatagcaattggaatggatgactcaaccatccaaatctacaatgttcgaattgatgaggtcaaaagcaaacttcgagggcactctaagaaaattactggacttgctttttcaaatgtattaaatgtgttagtctcttctggagctgatgcgcagatatgtgtgtggagcacagatgggtgggataaattaaagagcagaatgttacagataccatcaagtcgtccatcatctataatcttagacacacgtgtacagttccatcaggatcaattgcactttcttgttgtgcatgagacccagattgccatatatgaaactacaaaattagaacccgtgaagcagtggcctgtccgtgagaactcttctccaataacgcatgccatgttctcctgcgatagtcaattgatttatgcaagctttctggatgccactgtttgcatatttaatgcatcgagtttgagactccaatgtcgaattcttccagcatcctatcttcctcagaatatcagctcaaatgtttatcctgtcgttgtggcggcacatccttcggaagcaaatcagtttgctctaggcctgactgatggtggtgtttatgtattggaacccttggaatctgagagaaaatggggaaatcctccaccagcagagaatggatcaaccagcgctttgtccacacctcctaatggagcatcaagttctgatcaaccagaaagataatgatgaggagtttgaagtgttacattttttgtacttgcacggtacaaattcactaaccaagacgatgcacttcactcttacagcttcccttccgtagagctggttccaaggggtagtcgatgaacggacggaataaaaagacaagcttaacagcagttcatttgttgcttatatgtctcactgttatctgtattaagtgagggaagagttagtcctagtatttaattttgctgtctgtcgtgctgtgaaaaaagatgtttgcaagtagcttaagctgtagcaacaatttgtctgaacttattatcaccttttattcacaactagaaagtaaattgctgctcctatcgtttgtgttca

SEQ ID NO: 7462 - DNA, 490 bp, Trigonella foenum-graecum
taccaacagagagaaagatagtcatggctagcagcagcatggcatcagcagctactggatttgtgttgtcacttaatgttgctgccaacaacacagcttcttccaggagtaccatgttgatgtttcctttaaagtccaacaatattggttcttcttctagacttgttgtcagggcagccgatgaagctgcacccgctactgctcctccagccggtgaagcagcagcagctcctaaacccaagccaccaccaattggccccaagagaggtgctaaggtgaagattcttaggaaggaatcctactggtacaaaggcactggttctgttgttgctgttgatcaagaccccaagactcgttaccctgtcgtggttcgattcaacaaagtgaactatgccaatgtatcaacaaataactatgctttggatgagattgaagaagtttaatgagaccaatttaattgtaattcaaactcttgttatgctattgtaag

SEQ ID NO: 7463 - DNA, 822 bp, Trifolium pratense
ctcagatttcaatctaatcttgtcctttttttcaacttttaagattactaaaacacacacacacacaacaatagttatggctaccagcagcatggcatcagcagcttgtggatttatgttgtcacttaatgttgctgccaccacaacctcatcatcagcaacatcttccaggagtgccatgttgatgttccctataaaatccaacaatattggttcttcttcttctagacttgttgtcagagcatccgaggagcctgccgccggtgcacccgccactgctgctgctcctccggccggtgatgccgctcctaaacccaaaccaccaccaattggccccaagagaggtgctaaggtgaagattcttaggaaggagtcctactggtacaaaggaactggttctgttgttgctgttgatcaagaccccaagactcgctaccctgttgtggttcgattcaacaaagtcaactatgcaaacgtatcgacaaataactatgctttggatgagattgaagaagtttaatgagaccaatttaagtgtaattccaactcttgtcatgctattgaagttactagcctaaggttttttttcatgtcatcataaaaaatttgtatcatattatctctgttatctatgtacctcttgatctctagaaactacattcaatgtgcagctgctcataattttgatgttctcttgcttctgattttactaaaattaggcatgttaatgaaatactactaattaggcatgctagtatgagtaatttccaaaatagtggaatcatataatacacattggatgacccgagatcgagcatatat

SEQ ID NO: 7464 - DNA, 1169 bp, Cicer arietinum
gttgagttgatgatttttgatatagtaaaataaaatgaacgagttgtgacaacattatccaaaggaatgagatatggttgcacaagtggcaccacccaagtggaggaaacgattgacactatggtttctgaggatgagataattctcctccaaaaataaacaaccaaaaaccaacacacttcactcactcaaagcctctcatagttcaatctagtcttgtccttattgaaacttttaagattaccaaaagagagaaacagagagattgagaagaagtcatggctagcagcagcatggcatcagcagctactggttttgtgctgtcacttaatgttgttgcatccaacacaaactcatcagcactttctaggagtaccatgttgatgttccctataaagtccaacactattgctacttctagacttgttgtcagggcctccgatgacgctgcacccgctaccgccactcctccggccgatgctgaagtagctgccaaacccaagccacctccaattggtcccaagagaggtgctaaggtgaagattcttaggaaagaatcctactggtacaaaggcactggttctgttgttgctgttgatcaagaccccaagactcgctaccctgtcgtggttcgattcaacaaagtgaactacgcgaatgtatcgacaaataactatgctttggatgagattgaagaagtgtaatgagaccaatttatttgtaattcaaactcttgtcatgctattgcatttactagcctaaggttttttcatgtcataaaaaaaatctgtatcatattctctctgctatctatctatctatcctttgatctctagaagctacattcaatgtgcagttgctcataatcttaaagttccatagcatctattaaaattaggcatgttagggaaatactcctaattaggcatatttttgcaatactaaaattaaaggttggtcaaagagttggtggtccaacgaatcataaatagactctaatatcgtattaaaatttagtttgaacccaactgctcccttggtaagtgaagagtgtctcccacagaaaatggtgttgcataatgtcttgccccctttgcatagtttctttatgtaccatgatatactaaaataatatcactacatataaatatgaagcggtaacaagtgtg

SEQ ID NO: 7465 - DNA, 1563 bp, Cicer arietinum
gaagaaatgacacgtggaatgtaaattctatcgcctatttttttaattattattatccaaaatccaatccaaattgatttgttcatcaaaaagagaaaatagtatcaagagaagtgagtgtgggttttgaagttggagtggaatggccatcttctctacaacgttaggttccttcgcttccatatccttcctctcacattcacaacccgactctttttcttcttctaccgtcaatccattcactttccccaaattcccccacaagttcgcaccttcccaatgccatcatcatcatcgtcataaaatcttcgtctctggtagtagtaatagtagtagtgatacccacattgatgaattcgccagtggtcttcttcaacgcccttctgctcctgactcatacgaagcccttcgccaagctcggagatcgtcagattggaaggctgcaaacgcatatagagatagcggactcatttacaatggtagggttgagggttctaatgctggaggcttgctgcttcggttttactctatcatgggctttctcccatacccacagttgagcccattgcatgcttgtaaagcaccggagaaaactatccaagaaattgcaagagacttgctcggttccattttaccagtcaaggtaataatagtagatgaagataaaaggaagttggtcttatctgaaaaagaagcttcctggtttaaacattcaaaacatgtcaacataggggacatttttgaagcaatagttggttctgttgaggactatggtgcttttgttcatctgcgtttccctaatggtctttatcatcttactggactgatacatatctcagaagtgtcatgggatctagttcaagatgtaagagacttcttaacagaaggcgataaagtgagggtcaaagttataagtattgatagtgtgaaatcgaggattacactgtcaattaaacagctagaagaagatccacttctagaaactctggataaagtaatacctcaggatggctcagctgctctggatattttcagcggtagtaatagcagtggcatcgagccccttccagggctggagacaattcttgaagagctactgcaggaatatggcatatatgaagcaagaatcagccgtcaggggtttgaaaaacgagtggtctcacaagacttgcagctttggctttctaacgcacctcccatggaccaaaggtttactctccttgctcgggctggaagacaggtgcaagagatacatttgaaaacatcccttgatcaggaaggtataaaaaaggcaatacaacgagtattggagcgtgttccctgaaatcacaatcattttcctccccataataatcacaatcattttgtacagtttcacatttattttaaagtttcagaaagacataattgagatgttgcattattatttttatcgtgtaataatgtatttgtacaaccaatgtgtacccgtaaaatcccaagtcgtgatttaaccaactcgcaaaaggtttttcaattgtaaaaacacttcatttaatgacaacaccttaagattctaccatc

SEQ ID NO: 7466 - DNA, 1378 bp, Trigonella foenum-graecum
caattgcatcatcgctcaaacgccgcctccactccaccaccaccaccaccaccaccatcgtcaatcctttcaatttccctaaatgccctcacaagttaccaccttgtcaatggcatcctcactatcgtcatcacaacacttctaaaatcttcgtctccggtagtaataataatcacattgatgaactcgacagtggtcttcttcaacgcccttacgctcctcactctcaagacgctcttcgccaagccaggagatcgtcagattggaaggctgcaaacgcatacagagatagtggactcatttacaatggtagggttgaggcttttaatgctggaggtttgctgcttcggttttactctctcatgggctttctcccatacccgcattttagcccagtgcatgcatgtcaagaaccggataaaactatccaagaaattgcaagagagttgattggttccatcttatcagtaaaggtaatcgcagtagatgaggaggaaaggaaattggtcttatctgaaaggaagcttcatggtttaaatattcaaaacatgtcaacataggggacctttttgaagcaagagtcggttctgttcaggactttggtgcttttgttcatctgcgtttccctgacggtctttatcaccttaccggactaatacatatctcagaagtgtcatgggatctagttcaagatgtaacagacttcttaaaagaaggcgaagaagtgagggtcaaagttatcagtattgatactgtgaaatcgaggattacactgtcaatgaaacagctagaagaagatccactactagaaactctggacaaagtaatacctcaggatggttcagctgtttccggttctttcaaaagtagtactagcagtcacatcgatcccctaccagggctggatacaattcttgaagagctactgcaggaagatggcatatacagtgcaagaattagccgtcaggggtttgaaaaacgagtggtctcacaggacttacagctttggctttctaatgcacctcccatggaccaaagatttactctacttgctcgagctggaagacaggtgcaggagatacatctgaaaacatcccttaatcaggaaggcatcaaaatggcaatacaacgagcattggagcgtgttccctgattctgattataatcacaagattttgtatagctttcacatttatttaaaagtttcagaaagacataatattacagttgttgcattattattttatgatgtaataatgtatttttacatccgatacgtaaaatgatgccatgccgtgatgattcatttaaccaactcgcaaaaggttcaattgtaacatcactccatttattgacaatttactttaattcatttcat

SEQ ID NO: 7467 - DNA, 1331 bp, Trigonella foenum-graecum
ccaccctctccctcaaaccaaaacccccaactataatccaatgttcttctaccaacaacaacaacaacaacataatcgacatcgacatggtaaaacccaacaaggaacctacgaacaaaaacaaaacaaagtctgtgtcctttgggacctcgacaacaaaccaccacgtggaccaccgtacaacgccgccttatctctcaaaaccctcgccgaacgtttcggcgacgtcaccgacatctccgcttacgccaaccgtcacgctttcattcatctccctcaatgggttctcaaccaacgccgtgaacgcaaaaacctcgacatcctcgaacgtaaaggtatcattaacccctccgaaccttatatctgttctgtctgcggtagaaaatgtaaaaccaacgtggatctcaagaaacactttaaacagcttcatcaacgagagagacagaagaaggtgaaccgtttgaattcgttgaaggggaagaagagacaaaagtataaggagagatttgtgagtggtgatgagaagtataataatgcggttagagagattttgaagccgaaagttgggtatgggctggcttccgagttgcggcgggcgggtgtttttgtgaagactgtggaggataagccacaggctgctgattgggctttgaagaagcagatgatgcattctatgagtagagggattgattggttgtttttggtttccgatgattcggattttagtgagatgttgaggaaggctagagaggccaatttagggactgttgttgttggggatgttgataaggcgttggggaggcatgctgatttgtgggtgccttggaatgctgttgagaatggtgaggttttggatatggatttggtgccgaagaatagggatagaagaagaacatcagcaacaacgactacaacgacaatggatgattttggtgatgtgttgttttatcatgagggtgaggaaatggtaatggaagaagattttatgttggagtatagcgatgatgaggattttgatgaggattcagatgaagaagatgaagatgggttttttatttattgattcttttgtaaatgaagctaaggttgaaatgaaattgaggtttaagaatcaattgctacccaaatttatgttggagtaccgacacttcagattgaagacatatctggtgtctgacatgtctggtgtctgacactgatacattaattacatttactgtgtcgtgtttgtgtcggtgtttcatagaaattgtggggttgggttacatattgtagtgttgtttgttatatatatgaaacatatttgacttttaagggttggaatgcttacc

SEQ ID NO: 7468 - DNA, 2562 bp, Cicer arietinum
cttatctactaaaatcaatttccgaaggaagaaatcatgaattcacagttactcctttacgcaaatgcaacaccaacaccaacacacactcttcactctcactctcattattccttcttccgcaaaacaaaaaccccaattcgtatcagatgctgcaccaccaccaccaccaccaccaccaccaccatagacatcgaaatggtcaaaaccaaacaaggaacctacgaaccaaaacaaaacaaagtcgtcgtactatgggacctcgacaacaaaccaccacgtggtccaccttacgaagccgcactctctctcaaaaccctagctgaacgtttcggccaactcaccgacttctccgcttacgccaaccgccacgccttcatccaccttcctcaatgggtcctcaaccaacgccgcgaacgcaaaaacctcgacatcctcgaacgcaaaggaatcatcaatccctccgaactctacgtctgcaccgtctgcggccgaaaatgcaaaaccaatttagatctcaaaaaacacttcaaacagcttcaccaacgcgagcgtcagaagaagcttaaccgtttgaattcgttgaaaggaaagaagcgtcagaagtataaagaacgctttgttagtggggaccacaagtataacgatgcggttaggaggattgttactcccaaagttggttacggtttagcttcggagttgcggcgtgccggtgtttttgttaagactgttgaggataaacctcaggctgctgattgggctttgaagaaacagattatgcattctatgactagaggcattgattggttgtttttggtttcggatgattctgattttagcgatatgttgaggagggcgagggaggctaatttagggactgttgttgttggagatgttgatagagttttggggagagatgctgatttgtgggttccttggactgctgttgagaatggtgaggttatggatatggatttggttcccaagagtagagggaggagaaggaattccacggggaccactaccaccaccacaatgaatgattttggtgatgtgttgttttttcatgggggtgaggaaatggaagaagattttatgttggagtatagcgaggatgaggattttgatgatgacgagtacacatcggatgaagaagaagaagatgatggattttatatttattgattgattctttttgtaaatgaagttgttatggcgtcgattgattgggataaggcttgattcttgttgttgttttgtaaatgaagttaagcatgattgacacaaaattgaggtttaagaatcaattagtacccaaattgatgttaaattgaggaatagtgttatattgtaatgttgttagttatttagtattatatatatctacggcttccactttaagggttggagtgattgctttctttgaagaatagtacatttaactatcctgctaaagctagtactgcttaagattcaggcttgccatggtacatttctgctatgaattatttcatttttgcatatattttgtgaattagattgctgtttagcatcgccatttaagtttcaaatttcaagtgtactttacagggatgtgtagggtacagtgaagtatttagttagtcaatgaaattgtatttttagttctagttggattttggttcttgtagtttaaatatttgattcaggaatacttttgaaaatgtagattaagaacatataattagtttggaagaagtattttctaaaatagtactcttaatatattagagtgcaaaaggaattggatattcacatgaatatgaatataacaactattttctcttggtttttctaaagactgactcgatacttaaatatgtaatctgagttttaacaaagatgtagctccggatgggcatggttttagtttattgaaatctgagtcagtcttttgttagttatacataatctgagtgactcttcccacgaaggtggaagattcattgagtgcattattgcatggattagtcctttatcaagccaaatcacttgtaatctggttctcgccttctcggtggtgacattcacataaccttggcgctatcatcacgaagaaccttacaaaggaaggatgcctctccgcacaccatcaactcttacaacggcgtacacagagcttggtatcacttttagcctccaaaaaattggatgattggtaatgtccgcagcactaattgtcaatatacttttagcacacatactttttattggtttacaagtatctgttccttctgtttcagttttgaatcactgcttacatgttttgtgacaaattttctgcacggttgccattggcatgcagacctaaatgtgccaatattaatggttgcggtcattctgcagaacttcccttccagaagccaaaaatggagtgaaattcactaccttccggtagtgtcagaaaacccaattttttacgttgtccttgtatatgtattatacttctatttttcttctttctctttttgactatatgcctctctcaaaataaaatacaaaagttgatttttttacaccatt

SEQ ID NO: 7469 - DNA, 1388 bp, Cicer arietinum
acacgttgaaaataatgtgagtgaagtaagagtattgttggtacaggaataaagtcgggttttgatgcgacccgagacgatccatcaagtggatccgaatatcccttcaccttggctttggcttaaaccaagaagcggaacatgttgagaagatttgatgatgctgaacaatgtttggtgtgaatcgcatttcgcatcattttcgagactgtgaacactttggtggttttgttggcttcagattcaatttcaattctcttcacactttccatctttcattcccatgctctctcaaaccttctttcgctccctcaactaccactcttcgttccaacaactgtttctcttctaccccttctaactctccccgtcaaattcctctcctttttcattgtttcagtcaacaagaagatgaacgtgaaattctctctgacggaatatctgcagttgcaggtggagttgtagcgttgggaaagtttgatgctctgcacataggtcatcgagaacttgcaattcaagcatcaagagctggaccaccatttcttttatcatttgttggcatggcaaaggtactgggttgggaaaatagagctcccatagttgcaaagtgcgaccgaaagcgcattctttcatcttgggttccttattgtggtaacatggtcccagaagagtttcagattgagttttcatgcgtgcgacatctcagtccacaacaatttgtggaaaagttatcaaaagagcttaaagtgcgtggagttgttgcaggtgagaactatcgatttggatataaagcagctggtgatgcattagagctagtaaagctgtgtgaagaatatggaatggaagcttacataataaaatctgttatggacaagaaccaattctctacaaatataaattccagtgctagctcgaaagagaggggacaggtctcgtctacgcgtgtccgtgaagcccttgctgtaggagatatgacgtatgtctcagagcttttgggtagacagcaccgtctcgtattaatggccacggaccgagaaaggttcagctttggtcagtacaaggtgtctgctcctaaatcgtgtttattgaatctagcaccaaaggaaggtttatatgagaagtgttcacttttacttggtcaagaaaatgttatgctatgtagggtaattattgacagcaagtttgtccatatagaacccgatttcggaggttcgagtgatatttttggtactcacaatttgcagtacttgcatattgaatttggtgattccaacccttgattcagtttagataatgtttctaattaaattcttagtctacttaataatagacgattcttatctgtccttgaagttttaaagctgatgatataattgagtataaattaa

SEQ ID NO: 7470 - DNA, 1444 bp, Panicum virgatum
gggcccacctcatcgccgcctcctcttcccgcgccccccgcccgcctctctggagcgacggttgcctgctcccactccaaccatggccgccaccgccgccgccctggtgcgggctctctcctcaccaccgtccccgtctcctccgctctcctcgcgaccgagaccgagagcccttcgcggggacactctcctctcgctccgcgaaaagccgcgcgcccgcgtcgtctgtgccgccgccgcctccggctcctccaacttcgggaatcaaacatcactgatgcctcctttcagctttacacttgatgaaggtttttccaggtccaaaaagccgtatagatggcaacgggtattgcttaaagtaagtggggaggctcttgctggagatcacacagaaaacattgacccaaagattacaatggcaattgcaagagaggtcgcttctgtcaccaagctaggtgtagaggttgctattgttgttggtgggggcaatatcttccgtggggcctcttgggctggatgtagtgggcttgatcgctcatctgcggattacatcggaatgctggctactgtgatgaatgctatatttcttcaagcaacaatggagagcattggaataccaacccgtgtccaaactgccttccgtatgtcagaggttgcagagccatacatacgccgaagagctgtcaggcatttagagaaaggaagggttgttatattcgctgctgggacagggaacccattctttacaactgatacagccgctgctctccgttgtgcagaaatcaatgcagaggtagtgcttaaagcaacaaatgttgatggtgtgtatgatgcagacccccgacataacccaaatgcccgccttcttgagacagtgagctatcatgaagtgactacaagagatctctcggtaatggacatgactgccattacactatgccaagaaaacaacattcccgttgtcgtgttcaacttgcaaaagcctgggaacattgcaaaggctattgttggtgagaaggttggtacctttattggatgcacaggaaatcaggaacaaaatggaaacgcactgcatgaagaaagaagattggttaacgaggcgtgagctcaacagctgctcgatctgtgctctccctctttccttatttagtttatgcgtaggaagttttaggaggttgggtttggagctggtgctagaattagctagactagattagctacaaagttcttatagctgcaaccttgaaagaagacaattagaccaaaattttccagccaagtgctgctatcctatgtacaatagactcaaggagattacctaataaaataaaatctttttgcatgtggctgtacgtaaaggacgattcacagctcctggtattggtgagtggctggctgtggtatgtggaggtgagatttctaatcaatttcctcagtaaccccc

SEQ ID NO: 7471 - DNA, 1411 bp, Setaria italica
cccacttcctggggcgacggttgcttactccaaccatggccgcctccgccgccgtggtgcaggctctctcctcgccaccgtccctgtctcctctgctcccctcgcgcccgagagcccttcgcatcaacattcccctctcactctccgcaaagccgcgcgcccgcgccaccgccgccgccgccgccggttccgactcctccaacttcgggaatcaaacatcactgttgccgccgttcagctttacgcttgatgaaggttcttctaggtcgaaaaggccatacagatggcaacgtgtactgcttaaagtaagtggggaagctcttgctggagatcgcaccgaaaacatcgacccaaagattacaatggcaattgcaagagaggttgcttctgtcaccaagctaggtgtagaggttgctattgttgttggtgggggcaatatcttccgtggggcctcttgggctggatgtagtgggcttgatcgctcatcagcggattacatcggcatgttggccactgtgatgaatgctatatttcttcaagcaacaatggagagcattggaatacctacccgtgtccaaactgccttccgtatgtcagaggttgcagaaccatatatacgcagaagagctgtcaggcatttagagaaaggaagggttgttatatttgctgccgggacagggaacccattctttacaactgatacagctgctgctctccgttgtgcagaaattaatgcagaggtagtgcttaaagcaacaaatgttgatggtgtgtacgatgcagaccccaggcataacccaaatgctcaccttcttgagacagtgagctatcatgaagtgactacaagagatctctcggtaatggacatgactgccatcacactatgccaagaaaacaacattcctgttgtcgtgtttaacttgcaaaagccaggaaacattgcaaaggctattgttggtgagaaggttggtacctttattggttgcacaagaaatcaggaacaaaacggcaatgcaatgggtgaagaaagaagattggttaacgaggtgtgagctgaacagctgcatgagctggggctccccttcttttcttatttagtttacgtgtaggaggttttagggagctggtgctggatattaggctagattagctacaaaaattatgatagttgtaaccttggaagaagacactcgaataaaaatttcacggtcaagtgctgctatcctatgtacaatagacttaatgagatcacataataaaactaaatctgatgaggattgcatgtggctgcacgtgaagaaccatttcacagctcctagtaccggtgagtggctcagtgtggcattctttctcaaactagtagaaacattcaagtttatataattgctggtaccaatcataatggccaatt

SEQ ID NO: 7472 - DNA, 1565 bp, Setaria italica
tagagcgcggctgctgagtatcgagtcgcgggcccacctcatcatcttctcctcccgcgtgcccccacttcctggggcgacggttgcttactccaaccatggccgcctccgccgccgtggtgcaggctctctcctcgccaccgtccctgtctcctctgctcccctcgcgcccgagagcccttcgcatcaacattcccctctcactctccgcaaagccgcgcgcccgcgccaccgccgccgccgccgccggttccgactcctccaacttcgggaatcaaacatcactgttgccgccgttcagctttacgcttgatgaaggttcttctaggtcgaaaaggccatacagatggcaacgtgtactgcttaaagtaagtggggaagctcttgctggagatcgcaccgaaaacatcgacccaaagattacaatggcaattgcaagagaggttgcttctgtcaccaagctaggtgtagaggttgctattgttgttggtgggggcaatatcttccgtggggcctcttgggctggatgtagtgggcttgatcgctcatcagcggattacatcggcatgttggccactgtgatgaatgctatatttcttcaagcaacaatggagagcattggaatacctacccgtgtccaaactgccttccgtatgtcagaggttgcagaaccatatatacgcagaagagctgtcaggcatttagagaaaggaagggttgttatatttgctgccgggacagggaacccattctttacaactgatacagctgctgctctccgttgtgcagaaattaatgcagaggtagtgcttaaagcaacaaatgttgatggtgtgtacgatgcagaccccaggcataacccaaatgctcaccttcttgagacagtgagctatcatgaagtgactacaagagatctctcggtaatggacatgactgccatcacactatgccaagaaaacaacattcctgttgtcgtgtttaacttgcaaaagccaggaaacattgcaaaggctattgttggtgagaaggttggtacctttattggttgcacaagaaatcaggaacaaaacggcaatgcaatgggtgaagaaagaagattggttaacgaggtgtgagctgaacagctgcatgagctggggctccccttcttttcttatttagtttacgtgtaggaggttttagggagctggtgctggatattaggctagattagctacaaaaattatgatagttgtaaccttggaagaagacactcgaataaaaatttcacggtcaagtgctgctatcctatgtacaatagacttaatgagatcacataataaaactaaatctgatgaggattgcatgtggctgcacgtgaagaaccatttcacagctcctagtaccggtgagtggctcagtgtggcattctttctcaaactagtagaaacattcaagtttatataattgctggtaccaatcataatggccaattctgagactgtccggtaagtgtcatgctgctgctatttggcatctcctgatatctctgccttttgggagcaattatgcatgcattcttgtaa

SEQ ID NO: 7473 - DNA, 1231 bp, Pennisetum glaucum
gccgcctccgccgccgcggtgccggctctctcctcgccaccgtccctgtctcctctgctcccctcgcgcccgagggcccttcgcatcaacactcccctctcactctccgccaagccgcgtgcctgggccgccaccgccgccgccgccggttctgactcctccaacttcgggaatcaagcatcgctgatgccaccattcagctttacacttgatgaaggttcttctaggtcgaaaaggccgtacagatggcaacgtgtactgcttaaagtaagtggggaagctctcgctggagatcgcactgaaaacatcgacccaaagattacaatggcaattgcgagagaggttgcttctgtcaccaagctaggtgtagaggttgctattgttgttggtgggggcaatatcttccgtggggcctcttgggctggatgtagtgggcttgatcgctcatctgcagattacattggcatgttagccactgtgatgaatgctatatttcttcaagcaaccatggagagtattggaataccgacccgtgtccaaactgccttccgtatgtcagaggttgcagaaccatacatacgccgaagagctgtcaggcatttagagaaaggaagggttgttatatttgctgctgggacagggaacccattctttacaactgatacagctgctgctctccgttgtgcagaaatcaatgcagaggtagtgcttaaagcaacaaatgttgatggtgtgtatgatgcggaccccaggtataacccaaatacccgcctgcttgagacagtaagctatcatgaagtgattacaagagatctctcagtaatggacatgactgccattacgctatgccaagaaaacaacattcctgttgtggtgtttaacttgcaaaagccaggaaacattgcaaaggctattgttggtgagaacgttggtacctttattggttgcacaagagatcaggaaaagaacggaaacgccttgggtgaagaaagaagattggttaacgaggtgtgagcttacacgtgcatgacctgtggctctccccctcttttcgtatttagttcatgatgagtaggaggttttagagggtcggtgttggaattagactagattagctacaaagattctattagttgtaaccttggaagaattgataaaaaaattttgcagccaagtgctgctatcctatgtacaataaacttaaggagatcacctaatgaaaacaaaatgt

SEQ ID NO: 7474 - DNA, 1298 bp, Zea mays
gatcatcctctcagtccttgcttgtcctcccatcccggagatcgacggctgcttgccgcactcgctccagcggccagccggccacaggcaactatggccgcctctgccgccgccgcggggcctgctacctttctcccgcgcctcccctcgccacggtctccgtctcctatgctccctcctctcggacggagagcccatcccgtcgccgctccgctctgtctctccgccaagcgccgcgcctgcgccgccatgggctccagctcctcctccaactcaggaaatcaaacgtcactgatgctgccgttcagctttacattcgatgaagattcttctagttccagaaggctatatagatggaaaagggtattgctcaaagtaagtggggaagctcttgccgggaatcacacagaaaacatcgacccaaagattacaatggctattgcaagagaagttgcttctgtcaccaaactaggtgtagaggttgctattgttgttggcggtggcaatatcttccgtggggcctcttgggctggatgtagtgggcttgaccgctcatctgcggattacatcggcatgctggccactgtgatgaatgctatatttcttcaagcgacgatggagagcatcggaataccgacccgtgtccagactgccttccgtatgtcagaagttgcagaaccatacatacgccgaagagctgtcagacatttagagaaaggaagagttgtcatatttgctgctggaacagggaacccattcttcacgactgatacagctgctgctctccgttgtgccgaaatcaatgcagaggtagtgctgaaagcaacaaatgttgatggtgtgtatgatgcggaccccaggcagaatccaaatgcccgccttctggagactgtgagctatcatgaagttacgacaagagatctctcagtaatggatatgactgctattacactatgccaagaaaacaacattcccattgtcgtgtttaacttgcaagagcctggaaacattgcaaaggctattgtcggtgagaaggttggtaccttcatcggatgcacaagagatcaggagctaaatggaaacacactggttcaagaaagaagattggttaatgaggcgtgatctccagagatgcaagagttgggggggctccctcttctcttattcagtttttatatatacatatgaggtttagggttgggggctggtgctggaattagattagattagctatcaaaatcctgataatagttgtaaccgtgaaataagacacttggacgaaattaaaattttcctgc

SEQ ID NO: 7475 - DNA, 1493 bp, Zea mays
atatttttacattataaataacactatttatagagtagagtttaaaataagagatacaaagataagaggtgaaagctgctcgaaatagtgctgcccagctgcaactcacatttcgggcccatttaacccgagtccttatcctttaaaatggagaaaaaatatctcccctccttcctgatcatcctctcagtccttgcttgtcctcccatcccggagatcgacggctgcttgccgcactcgctccagcggccagccggccacaggcaactatggccgcctctgccgccgccgcggggcctgctacctttctcccgcgcctcccctcgccacggtctccgtctcctatgctccctcctctcggacggagagcccatcccgtcgccgctccgctctgtctctccgccaagcgccgcgcctgcgccgccatgggctccagctcctcctccaactcaggaaatcaaacgtcactgatgctgccgttcagctttacattcgatgaagattcttctagttccagaaggctatatagatggaaaagggtattgctcaaagtaagtggggaagctcttgccgggaatcacacagaaaacatcgacccaaagattacaatggctattgcaagagaagttgcttctgtcaccaaactaggtgtagaggttgctattgttgttggcggtggcaatatcttccgtggggcctcttgggctggatgtagtgggcttgaccgctcatctgcggattacatcggcatgctggccactgtgatgaatgctatatttcttcaagcgacgatggagagcatcggaataccgacccgtgtccagactgccttccgtatgtcagaagttgcagaaccatacatacgccgaagagctgtcagacatttagagaaaggaagagttgtcatatttgctgctggaacagggaacccattcttcacgactgatacagctgctgctctccgttgtgccgaaatcaatgcagaggtagtgctgaaagcaacaaatgttgatggtgtgtatgatgcggaccccaggcagaatccaaatgcccgccttctggagactgtgagctatcatgaagttacgacaagagatctctcagtaatggatatgactgctattacactatgccaagaaaacaacattcccattgtcgtgtttaacttgcaagagcctggaaacattgcaaaggctattgtcggtgagaaggttggtaccttcatcggatgcacaagagatcaggagctaaatggaaacacactggttcaagaaagaagattggttaatgaggcgtgatctccagagatgcaagagttgggggggctccctcttctcttattcagtttttatatatacatatgaggtttagggttgggggctggtgctggaattagattagattagctatcaaaatcctgataatagttgtaaccgtgaaataagacacttggacgaaattaaaattttcctgcaaagtgctattgttctgtg

SEQ ID NO: 7476 - DNA, 1188 bp, Glycine max
agttaacctcaattcatcattcattctatgttgtctctcttcttctgtctgtcgtcttcttccctctcactctttcaactttcaagtaacaccacactcttcttttcttactcttactcttatgcttttcaccttcttcacttcactaccctctacccttttctgagacacaaacactcttcctgttccacgcttccaatggcttcatgtagtatagggaccccaaatattaaagcattgaacttgcactttggtggaaaaaaagttggcctttcacaacaatttggtacaagaagctggatcagtaagcagtcactgcagtacactagtttggttatgtcacgacagaaagttaggttttcaccgacagagatccaatttgttacaaggtcagaaggttctgaagaggttaaatcttcaggtttgacaagtgagcttattcctaatcttattgaggtggagttcctgctcacaaaattatgcgacacaagttcaattggggagttagatttaaaacttgctgggtttcacctgcatgtagtgagggatttgactgaaaaaactaaaactctacctcctccaattcctgcttctgaaagtataattaatgtcacagaaacacctaaaacaaatggatcagtttctacaacttcgttggctgtctcgaagccagtagacccaataccttcttctgggtccatccagagattcctaaacaaagctgctgatgaaggcttggtaataattcagtctccaaaggtgggtttctttaggagatcacggacgataaaggggaggcgtgctccaccatcatgtaaagagaaacaaaatgttgaggaggggcaagtgatttgttatattgaacagcttggtggtgagctgccaattgagtctgatgtgtcgggagaggtcatcaagatcctacaaaaggacggcgatcctgttggatatggtgacgcacttgttgcaatattgccatcatttcctggaataaagaagcttcaatagcctcgaatttttggaaaacagtcattcttgccagccatgctgtaattgagtcatacatatatttcattacttttgagttcatgtggtccatagcttatttgttttgcatatcaaagacaaagggtaaaatcaaactactttgttttctcatactttcctatttgtgttggtggtgttgtc

SEQ ID NO: 7477 - DNA, 1422 bp, Glycine max
ggtgaaaattgagaatgaaaaaggaatgaagaaatccaaattacaagtgtagccctgccctgcccagatgtaacagttaacctcaattcatcattcattctatgttgtctctcttcttctgtctgtcgtcttcttccctctcaccctttcaactttcaagtaacaccacactcttcttttcttactcttactcttatgcttttcaccttcttcacttcactaccctctacccttttctgagacacaaacactctcttcctgttccacgcttccaatggcttcatgtagtatagggaccccaaatattaaagcattgaacttgcactttggtggaaaaaaagttggcctttcacaacaatttggtacaagaagctggatcagtaagcagtcactgcagtacactagtttggttatgtcacgacagaaagttaggttttcaccgacagagatccaatttgttacaaggtcagaaggttctgaagaggttaaatcttcaggtttgacaagtgagcttattcctaatcttattgaggtggagttcctgctcacaaaattatgcgacacaagttcaattggggagttagatttaaaacttgctgggtttcacctgcatgtagtgagggatttgactgaaaaaactaaaactctacctcctccaattcctgcttctgaaagtataattaatgtcacagaaacacctaaaacaaatggatcagtttctacaacttcgttggctgtctcgaagccagtagacccaataccttcttctgggtccatccagagattcctaaacaaagctgctgatgaaggcttggtaataattcagtctccaaaggtgggtttctttaggagatcacggacgataaaggggaggcgtgctccaccatcatgtaaagagaaacaaaatgttgaggaggggcaagtgatttgttatattgaacagcttggtggtgagctgccaattgagtctgatgtgtcgggagaggtcatcaagatcctacaaaaggacggcgatcctgttggatatggtgacgcacttgttgcaatattgccatcatttcctggaataaagaagcttcaatagcctcgaatttttggaaaacagtcattcttgccagccatgctgtaattgagtcatacatatatttcattacttttgagttcatgtggtccatagcttatttgttttgcatatcaaagacaaagggtaaaatcaaactactttgttttctcatactttcctatttgtgttggcggtgttgtcacgctcactctcttgacatttctgtttgcaaatagccgcctactcaagacacatctagacactagactagaaacaagtggcttcttaaaaaataaataaacactgatcgatgtcgtcacacacgggaaggaaaaatcatttgttttcctatgatagca

SEQ ID NO: 7478 - DNA, 1209 bp, Cajanus cajan
aatcttggttcattcattcgttccatgttgtctgtcttcttttttctttgctcttccaagtttcaagtcttatgctattcacttcccaaccctttaccctttacacgctcccaatggcttcatgtagcttagggacctcaaacattaaactattgaacttgcactttggtggaataaaatttggcctttctcagcaatatggtacaagaagctggatcagtaggcagtcattgcagtacactagtttggtcatgtcacgacagacagttaggtttttagcatcaccgaatgacccatcgccagatatcgaatttgttacaaagtcagaagaagattctgaagagaataaatcatcaggcttgacaagtgagctgattcctaattttaatgaggtggagttcctgctcacaaaattatgtgacacaagttcaattggggagttagatttaaagcttgctgggtttcacctgcatgtagtgagggatttgggtgaaaatattaaaactctaccctcagcgagtcctgcttctgtaagtataaataatgttccagaaacacctaaaacaaatggatcagtttctacaacttcgttggccatctcaaatccagtaccttctctagggtctatccagagattcctagacaaagctgctgatgaaggcttggtaataattcagtctccaaaggttggtttcttcaggagatcacgaaccataaaggggaagcgtgctccaccttcatgtaaagagaaacaaaatgttgaggaggggcaggtgatttgttatattgaacaacttggtggagagctgccaattgagtctgatgtgacgggggaggtcatcaagatactacgaaaggatggtgatcctgttggatatggtgacgcacttgttgcaatattgccatctttccccggaataaagaagcttcaataggtttcatttttttgaggaagagacatcccttgccagccatgctgtaattgactctacatatattctttactcttgagttcctgtggtccatagcttgtttgttttttttttacttttagtattagttttgcatcgcatagacaatggtaaaataaaacaactctattttctcattcattttcttgttcctgttgtcacgctcttgcattttggtttgcaaatggccgtatattcaagacactagaacgagaatgaagtgatttacttgcaaaaa

SEQ ID NO: 7479 - DNA, 3100 bp, Glycine max
tccaagttccaacccggtccgaaaaaagccgtcggtttgggtgtgcatccccgttgtgcagaaccgaaccttacttttcaaattttagggcttaagagcgtttccttgcgcggagcttcattcagctcaagagagatggcgaacgaagagttgggtagttggactgatctgctacattcttccaccaagcttctcgaacaagctgctccttctgctcagttccctccacttcagaggaacttagatcaactggaagcattatccaagaagcttaaatccaagacagtaaggactgaagcaccttctcaatctattgctgcaacaaggctccttgctcgtgaggggataaatgcagagcagcttgcaagggatctgaagtcatttgaactgaagacaacttttgaggatgtttttcctgttgaggcaacaagcgttgaagagtatctgcagcaggttcatgaaatggcgatggtctctgctgtccaagaagctcagaaggataatctcaggagtttcaatgattatatgatgaaagtattagaggaggattggcaaaaagaaaagcgtgatttccttcagagtttaagtcgaatttcaacattacctaggacaaacattgctgctaacagcaatgtgggtaccctaccgggtcaaattgtgtctgtatcttctacttcacaagtctcttctggtatgcctagcatggagattgtttctctgactggcagacctattgtggagaaaaaggcatctgtctatgccgaggtagtgaaaaaactgaataaagcaagggaggctggttcaccatttaaacctgctgcagctttcaaaggtgcatatgaaaatttgggcattgatgctagtggtggaaagtcagtaacaatgcgaaagatatggcaccttgttcagatgctgatgggtgaggactcagccgtgcaatgtgtttcaaaaaggatgtcattgattattggtgcaagacgccaccttgaatggggacatgagaaatacatcatggataccatacaaagtcatcctgcacaagctgctcttggtggtggtgttgggaatttgcaaagaatccgcgccttccttcggattcggttgagggattatggtgtactggattttgatgctggcgatgctcggcggcagcctcctgttgataccacatggcagcagatatatttttgcctgaggtctggttattatgacgaagcaagaaatgttgcccaatcttcacgtacttcacatcaatttgctcctttgctcacagagtggattaataaaggagggatggtaccagaagagattgcaactgctgcatcggaggaatgtgaaagaatgttgagaactggtgaccgggtaggtcgtactgcatatgacaagaaaaagttacttctgtatgccatcatatcaggttctcgaaggcatatcgatcgcctgcttagagatcagccaagtctctttagtacaatagaggatttcttgtggttcaaattgtcagctgtgcgggattgccctagtggaccttcatccattgttctaagtgatggtctgattccgtacagtttggatgatttgcaaagttacctgaataaatttgagccctcgtactatacaaaaaatggaaaagatcctttggtatatccctatatcttgcttttaagcattcaattgcttccagctgtattatacttgtctaaggaagcaggagatgaaggatataacattgatgctgcccacctatcaattgtgctagctgatcatggggtcctttctgaaggtgctggttctgggcaaaagttaggagtgatggatgcttatgcggaagtgtcgaccattatcaggcagtatggatctatgtatttgcgtcttggtgatctccaaatggccctagaatatttcgcacaagctgctgcagcagtgggcgggggggagttatcttggactggtagaggtaatgttgatcaacaaaggcagagaaatttgatggtgaagcagcttctaactgaactattgttaagggatggaggcatatatcttctacttggtgcaagaggtacgggagaagaaggtgaattgggacgttttgtgactgatccaaaagcaaggcaacaatttttaattgaagctgcatgccagtgtcaggaggctgggatgtatgacaagtctatagaaattcagaagagagtgggttccttctcaacggcactggataccatcaataagtgcctctctgaagctatttgtgcccttttccgtggaagattagatggcgagagtcgtactgctggcctcatccattctggcaatgagattttggagacatactcttattacccagatgtcaggcttcaagagagagaacatgtttttgaccagcaaactgtgttacgacaacttgagtcaatattgtcgattcacaaattagcaaggcttggacattatcttgatgcattaagggaggttgctaaacttccattccttcctttagacccccgaggccctgatattgctgttgatgtgcttgaaaatttatctcctcatgtccaagcttgtattccagatcttttgaagactgctctcacttgtctggataatgtgacagactctgatggatctcttcgtgccttgagggctaagattgcaagtttcattgcaaacaatttaaggaggaattggcctcgtgatttgtatgaaagagttgcgcagaggctgtgaaagtaaatcatgtgattgcaatggtagttacgtttgaaaggcaacagaatatgtttggctaaaggttttcagtagtagcatatgtaaagtagtcttaatgacgtgcctgctgcaccacctatgcccggagatatactgagaggaaataatagaaaaaggaaatacactggttctaaatattctctccacttttccactttttgttctagccattggtaatatactgctcactttgtattaataagaacattactttaagttttaaccgctccgcatatggtataacaaatcagcaaacagcatgttcttttacatctttttcattatttgttttggtgggagtatcattaatatccactcgtcttaaatgctctagaag

SEQ ID NO: 7480 - DNA, 3087 bp, Glycine max
ccggtccgaaaaaagccgtcggtttgggtgtgcatccccgttgtgcagaaccgaaccttacttttcaaattttagggcttaagagcgtttccttgcgcggagcttcattcagctcaagagagatggcgaacgaagagttgggtagttggactgatctgctacattcttccaccaagcttctcgaacaagctgctccttctgctcagttccctccacttcagaggaacttagatcaactggaagcattatccaagaagcttaaatccaagacagtaaggactgaagcaccttctcaatctattgctgcaacaaggctccttgctcgtgaggggataaatgcagagcagcttgcaagggatctgaagtcatttgaactgaagacaacttttgaggatgtttttcctgttgaggcaacaagcgttgaagagtatctgcagcaggttcatgaaatggcgatggtctctgctgtccaagaagctcagaaggataatctcaggagtttcaatgattatatgatgaaagtattagaggaggattggcaaaaagaaaagcgtgatttccttcagagtttaagtcgaatttcaacattacctaggacaaacattgctgctaacagcaatgtgggtaccctaccgggtcaaattgtgtctgtatcttctacttcacaagtctcttctggtatgcctagcatggagattgtttctctgactggcagacctattgtggagaaaaaggcatctgtctatgccgaggtagtgaaaaaactgaataaagcaagggaggctggttcaccatttaaacctgctgcagctttcaaaggtgcatatgaaaatttgggcattgatgctagtggtggaaagtcagtaacaatgcgaaagatatggcaccttgttcagatgctgatgggtgaggactcagccgtgcaatgtgtttcaaaaaggatgtcattgattattggtgcaagacgccaccttgaatggggacatgagaaatacatcatggataccatacaaagtcatcctgcacaagctgctcttggtggtggtgttgggaatttgcaaagaatccgcgccttccttcggattcggttgagggattatggtgtactggattttgatgctggcgatgctcggcggcagcctcctgttgataccacatggcagcagatatatttttgcctgaggtctggttattatgacgaagcaagaaatgttgcccaatcttcacgtacttcacatcaatttgctcctttgctcacagagtggattaataaaggagggatggtaccagaagagattgcaactgctgcatcggaggaatgtgaaagaatgttgagaactggtgaccgggtaggtcgtactgcatatgacaagaaaaagttacttctgtatgccatcatatcaggttctcgaaggcatatcgatcgcctgcttagagatcagccaagtctctttagtacaatagaggatttcttgtggttcaaattgtcagctgtgcgggattgccctagtggaccttcatccattgttctaagtgatggtctgattccgtacagtttggatgatttgcaaagttacctgaataaatttgagccctcgtactatacaaaaaatggaaaagatcctttggtatatccctatatcttgcttttaagcattcaattgcttccagctgtattatacttgtctaaggaagcaggagatgaaggatataacattgatgctgcccacctatcaattgtgctagctgatcatggggtcctttctgaaggtgctggttctgggcaaaagttaggagtgatggatgcttatgcggaagtgtcgaccattatcaggcagtatggatctatgtatttgcgtcttggtgatctccaaatggccctagaatatttcgcacaagctgctgcagcagtgggcgggggggagttatcttggactggtagaggtaatgttgatcaacaaaggcagagaaatttgatggtgaagcagcttctaactgaactattgttaagggatggaggcatatatcttctacttggtgcaagaggtacgggagaagaaggtgaattgggacgttttgtgactgatccaaaagcaaggcaacaatttttaattgaagctgcatgccagtgtcaggaggctgggatgtatgacaagtctatagaaattcagaagagagtgggttccttctcaacggcactggataccatcaataagtgcctctctgaagctatttgtgcccttttccgtggaagattagatggcgagagtcgtactgctggcctcatccattctggcaatgagattttggagacatactcttattacccagatgtcaggcttcaagagagagaacatgtttttgaccagcaaactgtgttacgacaacttgagtcaatattgtcgattcacaaattagcaaggcttggacattatcttgatgcattaagggaggttgctaaacttccattccttcctttagacccccgaggccctgatattgctgttgatgtgcttgaaaatttatctcctcatgtccaagcttgtattccagatcttttgaagactgctctcacttgtctggataatgtgacagactctgatggatctcttcgtgccttgagggctaagattgcaagtttcattgcaaacaatttaaggaggaattggcctcgtgatttgtatgaaagagttgcgcagaggctgtgaaagtaaatcatgtgattgcaatggtagttacgtttgaaaggcaacagaatatgtttggctaaaggttttcagtagtagcatatgtaaagtagtcttaatgacgtgcctgctgcaccacctatgcccggagatatactgagaggaaataatagaaaaaggaaatacactggttctaaatattctctccacttttccactttttgttctagccattggtaatatactgctcactttgtattaataagaacattactttaagttttaaccgctccgcatatggtataacaaatcagcaaacagcatgttcttttacatctttttcattatttgttttggtgggagtatcattaatatccactcgtcttaaatgctctagaag

SEQ ID NO: 7481 - DNA, 2956 bp, Cajanus cajan
gttggttagggtgcatctccgttgtgcagaacccaacctgagttttcaaattttagggcttaagaacgtttgtgtctgtaaaactaaaacccttgttcttgttcttgcgagccatggcgaacgaaagttggaccgatctcctacattcgtcaaccaagcttctcgaacaagctgctccttctgctcagttccctccccttcagaggaacttggatcaactggaagcgttatccaagaagcttaaatccaagaccgtaaggactgaagcaccttcgcaatctattgctgcaacaaggctccttgctcgagaggggataaatgcagagcagcttgctagggatctgaagtcatttgaactgaagacagcttttgaggatgtttttcctgttgaggctacaagtgttgaagagtatctgcagcaggttcatgaaatggcaatggtctctgctgttcaggaagctcaaaaggataatctcaggagtttcagtgattacatgatgaaagttttagaggaggattggcaaaaagaaaagcgtgatttccttcagagtttaagtcgaatttcaacattacctaggacaaacattgctgctaacagcagtgtgggtaccctcccaggtcagattgcgtctgtgtcttctactccacaagtctcatctggtatgcctagcatggagattgttcctctgacaggaagacctattgtggagaaaaaggcatctgtctatgctgaggtggtgaagactctgaatagagcaagggagtctgggttaccatttaaacctgctgcagctttcaagggtgcatatgaaaatttgggcattgatgctagtggtggaaaatcagtaacgatgcgaaagatatggcaccttgttcagatgctgatgggtgaggactcaaccccgcaacgtgtttcaaaaaggatgtcattggttattggtgcaagacgccaccttgaatggggacatgagaagcacataatggataccatacaaagtcatcctgctcaagctgctcttggtggtggagttgggaatttgcaaagaatccatgccttccttcggattcggttgagggattatggagtactggattttgatgctggtgatgctcggcggcagcctcctgttgataccacatggcagcagatatatttttgcctgaggtctggttattatgatgaagcaagaaatgtagccctatcttcacgtgcttcgcatcaattttctcctttgctcacagagtggattaatactggagggatggtgccagaagaggttgcagctgctgcatcagaggaatgcgaaagaatgttgagaactggtgaccgggtaggtcgaactgcatatgacaagaaaaagttacttctgtatgccatcatatcaggttctcgaaggcatattgatcgcctgcttagagatcagccaaatctctttagtacaatagaggatttcttgtggttcaaattgtcagctgtgcgggattgttctagtggaccttcatccattgttctaagtgatggtctgattccttacagtttggatgatttacaaatttacctgaataaatttgagccctcatattatacaaagaatggaaaagatcctctggtttatccctatatcttgcttttaagcattcaattgcttccagccatattgtacttgtctaaggaagcgggtgatgaaggatataacattgatgctgcccacctatcaatcgtgctagctgaccatggggtcctttctgaaggtgctggttctgggcaaaagttgggagtgatggatgcttatgcagaagtgtccaccattatcaggcagtatggatctatgtatttgcgtcttggtgatctccaaatggcactagaatattacgcacaagctgctgcagcagtgggtggggggcagttgtcatggactggtaggggtaatgttgatcagcaaaggcagagaaatttgatgctgaagcagcttctaactgaattattgttaagggatggaggcatatatcttttacttggtgcaagaggtgctggagaagaaggtgaattgggacgttttgtgactgatcccaatgcaagacaacaatttttaattgaagctgcatgtcagtgtcaagaggctgggatgtatgacaagtctatagaaattcagaagagagtgggttccttctcaatggcactggataccatcaataggtgcctctctgaagctatttgttcccttttccgtggaagattagatggtgagagtcagactgctggcctcatccattctggcaatgaaattttggagacatacacttattacccagatgtcagtcttcaagagagagatcacgtttttgagcagcaaactgtgttacgacaactagagtcaatattgtcaattcacaaattagcaagagtggggcattatgttgatgcattaagggaagttgctaagcttccatttcttcctctagatccccgaggacctgatattgctggtgacgtgtttgaaaatttatcccctcatgtccaagcttgtattccagatcttttgaaggctgctctcacttgtctggacaatgtgacagactctgatggatcacttcgtgccttaagggccaagattgcgagttttatcgcaaataatttaaagaggaattggcctcgtgatttgtatgagagagttgcgcagaggttgtgaaagtaaattatgcgatggcaattgtagttaacctttgaattcttgaaagaaggcaacagaatgtgtttggttaaaggttttgagtggcataacacatgtaaagtctgctggtggatcagaaaaaggaaatacactggttgtcaatattctcataacctcttctatttttgttttagctgttgctaatatactgttcactttgtattaataagaacattactttcaagtttcaagccctcctattttgctataaaaaaataccacgc

SEQ ID NO: 7482 - DNA, 2975 bp, Phaseolus vulgaris
ggtgcagaaccgaaccttacttttcaaattttagggcttaagagcgttttactgtgaaactctccttcttcctctctccgtgcgcgaagcttcaacgagagagccatggcgaacgaagacttcagtagttggactgatctgctacattcttcgacgaagcttctagaacaagctgcaccttctgctcagttccctccacttcagaggaacttagatcaactcgaatcattatccaagaagcttaaatccaaaaccgtaaggactgaggcaccgtctcaatctatcgctgcaacaaggcttcttgctcgtgaggggataaatgcagagcagcttgcaagggatctgaagtcatttgaactgaagacaacttttgaggatgtttttcctgttgaggcaacaagtgttgaagagtatctgcagcaggttcatgaaatggcaatggtctctgccgttcaggaagctcaaaaggataatctcaggagtttcaatgattacatgatgaaagttttagaggaggattggcaaaaagaaaagcgtgatttccttcagagtttaagtcgaatttcaacattacctaggacaaacattgctgctaacagcagtgtgggtaccctcccaggtcagattgcgtctgtgtcttctactccacaagtctcatctggtagttctagtatggagattgttcccctgtctggcagacctattgtggagaaaaaggcatctgtctatgctgaggtagtgaagaatctgaataaagcaagggaatctgggttaccatttaaacctgcagcagctttcaagggtgcatatgaaaatttgggcattgatgctagtggtggaaaatcagtaacgatgcgaaagatatggcaccttgttcagatgctgatgggtgaggactcagccccgcaacgtgtttcaaaacggatgtcattgattattggcgcaagacgccaccttgaatggggacatgaaaaatacataatggacaccatacaaagccatcctgcacaagctgcacttggtggtggtgttgggaatttgcacagaatccgtgcctttcttcggattcggttgagggattatggagtactggattttgatgctggtgatgctcggcggcagcctcctgttgatacaacatggcagcagatatatttttgcctgaggtctggttattacgatgacgcaagaaatattgccctatcttcacgtgcttcacatcaatttgctcctttgctcacagagtggattaatactggagggatggtcccagaagagattgcagctgctgcatcagaggaatgtgaaagaatgctgagaactggtgatagggttggtcgaactgcatatgacaagaaaaagttacttttgtatgccatcatatcaggttcccgaagacatattgatcgcctgctcagagatcagccaactctctttagtacaatagaagatttcttgtggttcaaattgtcagctgtgcgggattgtcctagtggaccttcatccattgttctaagcgatagtctgattccatacagcctggacgatttgcaaagttacctgaataaatttgagccctcatactatacaaaaaatggaaaagatcctctggtatatccctatattttgcttttaagcattcaattgcttccagctgtattatacttgtctaaggaagcaggagatgaagggtataacattgatgctgtacacctatcaattgtgctagctgatcatggggtcctttctgaaggtgctggttctgggcaaaagttgggagtgatggatgcttatgcagaagtatccaccattatcaggcaatatggatctatgtatctacgtattggtgatctccaaatggccctagaattttatgcacaagctgctgcagcagtgggcggtgggcagttgtcgtggactggtagaggtaatgttgatcaacaaaggcagagaaatctgatgctgaagcagcttctcacggaactattattaagggatggaggcatatatcttttacttggtgcaagaggttccggagaagaaggtgaattgggacgttttgtgactgatccaaaagcaagggaacaatttctaattgaagctgcattgcagtgtcaggaggctgggatgtatgacaaatctatagaaattcagaagagagtaggttccttctcaatggcgctggataccatcaacaagtgcctttctgaagctattattgcccttttccgtggaagattagatggtgaaagtcggactgccggctttatccattctggcaatgagattttggagacatatgcgtattatccagatgtcagtcatcaagagagagaacacgtttttcagcagcaaaccgtgttacgacaacttgagtcaatattgtcaattcataaattagcaagactggggcattatgtcgatgcattaagggaggttgctaaacttccatttcttcctctagaccctcgaggctctgatagtgctgttgatgcgtttgaaaatttatcttcgcatgtccaagcttgtgttccagatcttttgaaagttgcccttagttgtctggacaatttgactgactctgatggatcacttcgtgccttaagggctaagattgcgagttttattgcaaataatttaaagaggaattggcctcgtgatttgtatgagagagttgcccagaggttgtgaaagttgcttatgcgatggtaattgtatttacctttgagttcttgaaaggcaacataatatgtttggttaaaggttttcagtagtataacacatgtaaaatagtctcaattaccttcctgctgtacctcctggggttatagtgggaggaactacaaaaggaaacacactgtttatgaatgttctcacagtctttactctttttgatttaactaatggtaatacactgttcaatttgtattaataagaacaccaataccaaatatcacgatgttcttgtttgcgtc

SEQ ID NO: 7483 - DNA, 2998 bp, Phaseolus vulgaris
cgaaaaacccgttgggttgggtgcgtcgtggtgcagaaccgaaccttacttttcaaattttagggcttaagagcgttttactgtgaaactctccttcttcctctctccgtgcgcgaagcttcaacgagagagccatggcgaacgaagacttcagtagttggactgatctgctacattcttcgacgaagcttctagaacaagctgcaccttctgctcagttccctccacttcagaggaacttagatcaactcgaatcattatccaagaagcttaaatccaaaaccgtaaggactgaggcaccgtctcaatctatcgctgcaacaaggcttcttgctcgtgaggggataaatgcagagcagcttgcaagggatctgaagtcatttgaactgaagacaacttttgaggatgtttttcctgttgaggcaacaagtgttgaagagtatctgcagcaggttcatgaaatggcaatggtctctgccgttcaggaagctcaaaaggataatctcaggagtttcaatgattacatgatgaaagttttagaggaggattggcaaaaagaaaagcgtgatttccttcagagtttaagtcgaatttcaacattacctaggacaaacattgctgctaacagcagtgtgggtaccctcccaggtcagattgcgtctgtgtcttctactccacaagtctcatctggtagttctagtatggagattgttcccctgtctggcagacctattgtggagaaaaaggcatctgtctatgctgaggtagtgaagaatctgaataaagcaagggaatctgggttaccatttaaacctgcagcagctttcaagggtgcatatgaaaatttgggcattgatgctagtggtggaaaatcagtaacgatgcgaaagatatggcaccttgttcagatgctgatgggtgaggactcagccccgcaacgtgtttcaaaacggatgtcattgattattggcgcaagacgccaccttgaatggggacatgaaaaatacataatggacaccatacaaagccatcctgcacaagctgcacttggtggtggtgttgggaatttgcacagaatccgtgcctttcttcggattcggttgagggattatggagtactggattttgatgctggtgatgctcggcggcagcctcctgttgatacaacatggcagcagatatatttttgcctgaggtctggttattacgatgacgcaagaaatattgccctatcttcacgtgcttcacatcaatttgctcctttgctcacagagtggattaatactggagggatggtcccagaagagattgcagctgctgcatcagaggaatgtgaaagaatgctgagaactggtgatagggttggtcgaactgcatatgacaagaaaaagttacttttgtatgccatcatatcaggttcccgaagacatattgatcgcctgctcagagatcagccaactctctttagtacaatagaagatttcttgtggttcaaattgtcagctgtgcgggattgtcctagtggaccttcatccattgttctaagcgatagtctgattccatacagcctggacgatttgcaaagttacctgaataaatttgagccctcatactatacaaaaaatggaaaagatcctctggtatatccctatattttgcttttaagcattcaattgcttccagctgtattatacttgtctaaggaagcaggagatgaagggtataacattgatgctgtacacctatcaattgtgctagctgatcatggggtcctttctgaaggtgctggttctgggcaaaagttgggagtgatggatgcttatgcagaagtatccaccattatcaggcaatatggatctatgtatctacgtattggtgatctccaaatggccctagaattttatgcacaagctgctgcagcagtgggcggtgggcagttgtcgtggactggtagaggtaatgttgatcaacaaaggcagagaaatctgatgctgaagcagcttctcacggaactattattaagggatggaggcatatatcttttacttggtgcaagaggttccggagaagaaggtgaattgggacgttttgtgactgatccaaaagcaagggaacaatttctaattgaagctgcattgcagtgtcaggaggctgggatgtatgacaaatctatagaaattcagaagagagtaggttccttctcaatggcgctggataccatcaacaagtgcctttctgaagctattattgcccttttccgtggaagattagatggtgaaagtcggactgccggctttatccattctggcaatgagattttggagacatatgcgtattatccagatgtcagtcatcaagagagagaacacgtttttcagcagcaaaccgtgttacgacaacttgagtcaatattgtcaattcataaattagcaagactggggcattatgtcgatgcattaagggaggttgctaaacttccatttcttcctctagaccctcgaggctctgatagtgctgttgatgcgtttgaaaatttatcttcgcatgtccaagcttgtgttccagatcttttgaaagttgcccttagttgtctggacaatttgactgactctgatggatcacttcgtgccttaagggctaagattgcgagttttattgcaaataatttaaagaggaattggcctcgtgatttgtatgagagagttgcccagaggttgtgaaagttgcttatgcgatggtaattgtatttacctttgagttcttgaaaggcaacataatatgtttggttaaaggttttcagtagtataacacatgtaaaatagtctcaattaccttcctgctgtacctcctggggttatagtgggaggaactacaaaaggaaacacactgtttatgaatgttctcacagtctttactctttttgatttaactaatggtaatacactgttcaatttgtattaataagaacaccaataccaaatatcacgatgttcttgtt

SEQ ID NO: 7484 - DNA, 3120 bp, Medicago truncatula
aacccggtccgaaacaaaccctacgataacattaccggttcacctccatcctccaggacctgaaccttgcttttcaaatttagggcttaagaacgaaaacgaaaacaacctccaaaaccctttcttcttctcttcgcatcgctgttaaactcactcgctgaagattcatccatggcgaacgaagatttatccagttggaccgatctacttcactcttcctccaaacttcttgaacaagccgctccttccgctcagttccctcctcttcagaggaatttggatcaacttgaagcgttatcgaagaagcttaaatccaagactgttagagctgaggcgccgtcacagtccattgcggcaactaggcttcttgctcgtgagggtataaatgcagagcagcttgcaagggatttgaagtcatttgagttgaagacaacttttgaggatgtttttcctgttgaggcaacaagcgtcgaagagtatctgcagcaggttcatgaaatggcaatggtctctgccgtccaggaagctcagaaggataacctaaggagtttcaatgattatatgatgaaagttttggaggaggattggcaaaaagaaaagcgtgatttccttcagagtttaagcaggatttcaacattaccaaggacaaatatgattgctaatagcaatgtgggtacccgtcctggtcagattgtgtctatggcttctactccacaagtctcttctggtagcatggagattgttcccatgactagtagacccattgcagataaaaaggcatctgtctatgctgaagtagttaaaaatctgaatagagcaaggcagtctggattgccatttaaacttgccgcaactttcaagggtgcatacgaaagtttgggcgttgatgctggtggtggaaaatcagtaacaatgcgaaagatatggcaccttgttcagatgctgatggatgaggactcaaccttgcgacgtgtttccaaaaggatgtcattgattattggggcaaggcgccaccttgagtggggacatgagaaatacatcatggatactatacataatcatcccgcacaagcttctcttggtggtggtgttggaaatttgcaaagaatccgcgccttccttcggattcggttgagggattatggggttctggattttgacgctggtgatgctcggagacagccacctgttgataccacatggcaacagatatatttttgtctgaggtctggttattacgatgaagcaagaaatgttgctctatcttcgcgtgcttcacatcaatttgctcctttgctcacagagtggattaatactggaggaatggtgccagaagaggtggcaactgcagcatcagaagaatgtgaaagaatgttgagaaccggtgatcgggtaggccggactgcatatgacaagaaaaaattactgctgtatgccatcatatcaggttctcgaagacatattgatcgcctgcttagagatcaaccaactctttttagcacaatagaggatttcttgtggttcaaattgtcggctgtgcgggactgccccagtggatcttcgtccattgttctaagtgatggtttgattccatacagtttggatgatttgcaaagttacctaaataaatttgaaccatcatactatacaaaaaatggaaaagatcctctggtatatccctatatcttgcttttaagcattcaattgcttccggctgtattatacttgtctaaggaagcaggagatgaaggatataacattgatgctgcccacctatcaattgtgctagccgatcatggggtcctttctgaaggcatcggtactgggcaaaagttgggagtgatggatgcttatgcagaagtgtccacaattatcaggcaatatggatctatgtatttgcgtcttggtgatcttcagatggcactagaatattatgcacaagctgctgctgcagtcggcggtggacagttgtcgtggactggtagaggtaatgttgatcagcaaaggcagagaaacttgatgctgaagcagcttctaactgaattattgttaagggatggagggatatatcttttacttggtgcaagaggtgccggagaagaaggagaattgggacgtttcgttgcggatccaaatgcaaggcaacaatttttaattgaagcggcatgccagtgtcaggagtctgggatgtatgacaaatctatagaaatccagaagagagttggttccttctcaatggcgctggataccatcaacaagtgcctctctgaagctatttgttctcttttccgtggaaggttagatggtgagagccggactgctggtcttatccattctggcaacgagattttggagacatatacttactacccagatgtcagtcatcaagagagagagcaagtttttgagcagcaaactatattgagacaacttgagtcaatattatcaattcacaaattgtcaagactggggaatcatgttgatgcattgagggaggttgctaaacttccatttttgcctctagatccccgaggacctgatactgctgttgacgtgtttgaaaatttatctcctcatgtccaagcttgtataccagacctcttgaaggttgctctgacttgtctggacaatgtgacagactctgatggatcacttcgtgctttgagagctaagatttccagttttattgcaaataatgtaaaaaggaattggcctcgtgatttgtatgaaagagttgcgcagaggctgtgaaagtaaatgtacggcgtcaattgtttaaggcaacataatgtgtttgaatgaaggttcccagtagtgtaaaacttgtaaagtagtgtcaatgtcaatgatatttgtgctcgacctatgacctggagatataatctgaagaaccagaaaagtgaaattatgaattttctcttcatcttttcatctgatttagccaaatggtattcacacgtttggtttagaagaacattaatttaaaccgctcacttccatttaatgcctgctagaatatgagacatagttggcaaatagaaacgctattcttattcactttttttcttattactttggttggagcaacatttttccatgtctttagtcgtaggactagaa

SEQ ID NO: 7485 - DNA, 2946 bp, Medicago truncatula
aggacctgaaccttgcttttcaaatttagggcttaagaacgaaaacgaaaacaacctccaaaaccctttcttcttctcttcgcatcgctgttaaactcactcgctgaagattcatccatggcgaacgaagatttatccagttggaccgatctacttcactcttcctccaaacttcttgaacaagccgctccttccgctcagttccctcctcttcagaggaatttggatcaacttgaagcgttatcgaagaagcttaaatccaagactgttagagctgaggcgccgtcacagtccattgcggcaactaggcttcttgctcgtgagggtataaatgcagagcagcttgcaagggatttgaagtcatttgagttgaagacaacttttgaggatgtttttcctgttgaggcaacaagcgtcgaagagtatctgcagcaggttcatgaaatggcaatggtctctgccgtccaggaagctcagaaggataacctaaggagtttcaatgattatatgatgaaagttttggaggaggattggcaaaaagaaaagcgtgatttccttcagagtttaagcaggatttcaacattaccaaggacaaatatgattgctaatagcaatgtgggtacccgtcctggtcagattgtgtctatggcttctactccacaagtctcttctggtagcatggagattgttcccatgactagtagacccattgcagataaaaaggcatctgtctatgctgaagtagttaaaaatctgaatagagcaaggcagtctggattgccatttaaacttgccgcaactttcaagggtgcatacgaaagtttgggcgttgatgctggtggtggaaaatcagtaacaatgcgaaagatatggcaccttgttcagatgctgatggatgaggactcaaccttgcgacgtgtttccaaaaggatgtcattgattattggggcaaggcgccaccttgagtggggacatgagaaatacatcatggatactatacataatcatcccgcacaagcttctcttggtggtggtgttggaaatttgcaaagaatccgcgccttccttcggattcggttgagggattatggggttctggattttgacgctggtgatgctcggagacagccacctgttgataccacatggcaacagatatatttttgtctgaggtctggttattacgatgaagcaagaaatgttgctctatcttcgcgtgcttcacatcaatttgctcctttgctcacagagtggattaatactggaggaatggtgccagaagaggtggcaactgcagcatcagaagaatgtgaaagaatgttgagaaccggtgatcgggtaggccggactgcatatgacaagaaaaaattactgctgtatgccatcatatcaggttctcgaagacatattgatcgcctgcttagagatcaaccaactctttttagcacaatagaggatttcttgtggttcaaattgtcggctgtgcgggactgccccagtggatcttcgtccattgttctaagtgatggtttgattccatacagtttggatgatttgcaaagttacctaaataaatttgaaccatcatactatacaaaaaatggaaaagatcctctggtatatccctatatcttgcttttaagcattcaattgcttccggctgtattatacttgtctaaggaagcaggagatgaaggatataacattgatgctgcccacctatcaattgtgctagccgatcatggggtcctttctgaaggcatcggtactgggcaaaagttgggagtgatggatgcttatgcagaagtgtccacaattatcaggcaatatggatctatgtatttgcgtcttggtgatcttcagatggcactagaatattatgcacaagctgctgctgcagtcggcggtggacagttgtcgtggactggtagaggtaatgttgatcagcaaaggcagagaaacttgatgctgaagcagcttctaactgaattattgttaagggatggagggatatatcttttacttggtgcaagaggtgccggagaagaaggagaattgggacgtttcgttgcggatccaaatgcaaggcaacaatttttaattgaagcggcatgccagtgtcaggagtctgggatgtatgacaaatctatagaaatccagaagagagttggttccttctcaatggcgctggataccatcaacaagtgcctctctgaagctatttgttctcttttccgtggaaggttagatggtgagagccggactgctggtcttatccattctggcaacgagattttggagacatatacttactacccagatgtcagtcatcaagagagagagcaagtttttgagcagcaaactatattgagacaacttgagtcaatattatcaattcacaaattgtcaagactggggaatcatgttgatgcattgagggaggttgctaaacttccatttttgcctctagatccccgaggacctgatactgctgttgacgtgtttgaaaatttatctcctcatgtccaagcttgtataccagacctcttgaaggttgctctgacttgtctggacaatgtgacagactctgatggatcacttcgtgctttgagagctaagatttccagttttattgcaaataatgtaaaaaggaattggcctcgtgatttgtatgaaagagttgcgcagaggctgtgaaagtaaatgtacggcgtcaattgtttaaggcaacataatgtgtttgaatgaaggttcccagtagtgtaaaacttgtaaagtagtgtcaatgtcaatgatatttgtgctcgacctatgacctggagatataatctgaagaaccagaaaagtgaaattatgaattttctcttcatcttttcatctgatttagccaaatggtattcacacgtttggtttagaagaacattaatttaaaccgctcacttccat

SEQ ID NO: 7486 - DNA, 3023 bp, Trigonella foenum-graecum
ctgcccatttgaaccggttcaaaacaaaccctacgatagcataccggttcacccccatcctccagaacctgaacctttgcttttcaaattttaggcttaagaacgaaatcaaaacaacctccaaaaccctttcttcttcttcttcttcttctctctcttttgcgtctttgttaagctcgctcgctgaagattcatccatggcgaacgaagacttatccagttggaccgatctactccattcctcctccaagcttctcgaacaagccgctccttccgctcagttccctccacttcagaggaacttggatcaactcgaagcgttatcgaagaagcttaaatctaagactgtaagagctgaggcaccttcacaatccattgctgcaactaggcttcttgctcgcgagggtataaatgcagagcagctagcaagggatttgaagtcatttgagttgaagacaacttttgaggatgtttttcctgttgaggcaacaagcgttgaagagtatctgcagcaggttcatgaaatggcaatggtctctgccatccaggaagctcagaaggataatctcagaagtttcaatgattatatgatgaaagttttggaggaggattggcaaaaagaaaagcgtgatttccttcagagtttaagccggatttcaacattaccgaggacaaacatgattgcgaatagcaatgttggtacccgccctggtcagattgtatctatggcttctactccacacgtctcttctggtagcatggaaattgttcccatgactagtagacccattgcggataaaaaagcatctgtctatgctgaagtagtgaaaaatctgaatagagcaaggcagtctggattgccatttaaacttgccgcagctttcaagggtgcatacgaaagtttgggcattgatgctggtggtggaaaatcagtaacaatgcgaaagatatggcaccttgttcagatgctgatggatgaggactcaaccttgcgacgcgtttccaaaaggatgtcattgattattggggcaaggcgccaccttgagtggggacatgagaaacacatcatggatactatacataatcatcccgcacaagcttctctcggtggtggtgttggaaatttgcaaagaatccgtgccttccttcggattcggttgagggattatggggttctggattttgacgctggtgatgctcggagacagccacctgttgataccacatggcaacagatatatttttgtctgaggtctggttattacgatgaagcaagaaatgttgctctatcttcgcgtgcttcacatcaatttgctcctttgctcacagagtggattaatactggaggaatggtgccagaagaggttgcaactgctgcatcagaagaatgtgaaagaatgttaagaaccggggaccgggtaggccggactgcatatgacaagaaaaaattgctactgtatgccatcatatcaggttctcgaagacatattgatcgcctgcttagagatcaaccaactctttttagcacgatagaggatttcttgtggttcaaattgtcggctgtgcgggactgccccagtggatcttcgtccattgttctaagtgatggtctgattccatacagtttggatgatttgcaaagttatctgaataaatttgaaccatcatactatacaaaaaatggaaaagatcctctggtatatccctatatcttgcttttaagcattcaattgcttccggctgtattatacttgtccaaggaaacaggagatgaaggatataacattgatgctgcccacctatcaattgtgctagccgatcagggggtcctttctgaaggtattggtactgggcaaaagttgggagtgatggatgcttatgcagaagtgtccactattatcaggcaatatggatctatgtatttgcgtcttggtgatctccagatggcactagaatattatgcacaagctgctgctgcagtcggcggtggacagttgtcgtggactggtagaagtaatgttgatcagcaaaggcagagaaacttgatgctgaagcagcttctaactgaattattgttaagggatggaggcatatatcttttacttggtgcaagaggtgctggagaagaaggggaattgggacgttttgtggcggatccaaatgcaaggcaacaatttttaattgaagcagcatgccagtgtcaggaggctgggatgtatgacaaatctatagaaattcagaagagagttggttccttctcaatggcgctggataccattaacaagtgcctctctgaagctatttgttctcttttccgtggaaggttagatggtgagagccggacggctggcctcatccattctggcaatgagattttggaggcatatacttactacccagatgtcagtcttcaagagagagatcatgtttttgagcagcaaactgtattaagacaacttgagtcaatattatcaattcacaaattgtcaagactggggaatcatgttgatgcactaagggaggttgctaaacttccatttctgcctctagatccccgaggacctgatattgctgttgatgtgtttgaaaatttatctcctcatgtccaagcttgtattccagacctcttgaaggttgctctgacttgtctggacaatgtgacagactctgatggatcacttcgtgccttgagggctaagattgccagttttattgcaaataatgtaaaaaggaattggcctcgtgatttgtacgaaagagttgcgcagaggttgtgaaagtaaatgtgcgacgtgaattgtttaaggcaacggaatatgtttgaatgaaggttcacagtagtgtaaaacttgtaaagtagtgtcaatgtcaatgatatttgtgctggacctatgtcctggagatataatccgaagaactagaaaagtgaaattatgaattttctcttcatcttttcatctgatttagccaaatggtaatatggtggtattcacagctttggttaacaagaacattactttaac

SEQ ID NO: 7487 - DNA, 3108 bp, Cicer arietinum
gcgtaaggtagcgtaccggttcatccagaaccagaagtgaaccaaacctcgcttttcaaattttagggcttaagaaagaaaaagaaaacaacctccaaaacccttctttttcttccgtcgttgagctcgctgaagaagagtcatggcgaacgaagacttggccagctggaccgatctgctacattcttcctctaagcttctcgaacaagctgctccttctgctcagttccctccacttcagaggaacttggatcaactcgaagcgttatctaagaagcttaaatccaaaactgttagggctgaggcaccttcccaatctattgctgcaactaggcttcttgctcgtgagggtataaatgcagagcagcttgcaagggatctgaagtcatttgagttgaagacaacttttgaagatgtttttcctgtcgaggccacaagcgtcgaggagtacctgcagcaggttcatgaaatggcaatgatctctgctgtccaggaagctcagaaggataatcacaggagtttcaatgattacatgatgaaagttttagaggaggattggcaaaaagaaaagcgtgatttccttcagagtttaagccggatttcaacattacctaggacaaacatgattgctaacagcaatgtgggtacccggccaggtcagattgtgtctatggcttctagtccgcaagtctcttctggcagcatggagattgttcccacgactagcagacccattgtggagaaaaaggcatccgtctatgctgaagtagtgaaaaatctgaatagagcaaggcagtctggattgccatttaaacctgccacaggtttcaagggtgcatatgaaagtttgggcattgattctagtggtggaaaatcagtaacgatgcgaaagatatggcaccttgttcagatgctgatgaacgaggactcaaccttgcgtcgtgtttcaaaaaggatgtcattgattattggggccaggcgccatcttgagtggggacatgagaaatacatcatggatactatacataatcatcctgcacaagcttctcttggcggtggtgtcggaaatttgcaaagaatccgcgccttccttcggattcggttgagggattacggggtactggattttgacgctggtgatgctcgtcggcagcctcctgttgatacaacatggcaacagatatacttttgtttgcgatctggttattatgatgaagcaagaaacgtttccctatcttcacgtgcttcgcatcaatttgctccattgctcacagagtggattaatactgggggaatggtaccggaagaggttgcaactgctgcatcagaagaatgtgaaagaatgttgagaactggtgatcgggtaggccgaactgcgtatgacaagaaaaagttacttctgtatgccatcatatcaggttctagaagacatattgatcgtctgcttagagatcaaccaactctttttagtacaatagaggatttcttgtggttcaaattgtcagctgtgcgggactgccccactggatcttcgtccattgttctaagtgatggtctgattccatacagtttggatgatttgcaaagttacctgaataaatttgaaccatcatactatacaaaaaatggaaaagatcctctggtatatccatatgtcttgcttttaagcattcaattgcttccggctgtattatacttgtctaaggaaacaggagatgaaggatataacattgatgctgcacacctatcaattctactagctgatcatggggtcctttctgaaggtgctggtactgggcaaaagttgggagtgatggatgcttatgccgaagtgtccaccattatcaggcaatatggatctatgtatttgcgtcttggtgatctccagatggcattagaatattatgcacaagctgctgctgcaattggtggtgggcagttgtcgtggactggcagaggtaatgttgatcagcaaaggcagagaaacttgatgctgaagcagcttctaactgaattattgttaagggatggaggcatatatcttttacttggtgcaagaggtgctggagaagaaggggaactgggacggtttgtggctgatccaaatgcaaggcaacagtttttgattgaagcagcatgccagtgtcaggaggctgggatgtatgacaaatctatagaaattcagaagagagtggggtccttctcaatggctctggataccatcaataagtgcctctctgaagctatctgttcccttttccgtggaaggttagacggcgagagccggactgcgggcctcatccattctggcaatgagattttggagacatatacttactaccctgatgtcagtcttcaggagagagagcatgtttttgagcagcaaactgtattaagacaacttgagtcaatattatcaattcacaaattgtcaagactaggcaatcatgttgatgcattaagggaggttgctaaacttccatttctccctctagatccccgaggacctgatattgttgttgatgtgtttgaaaatttatctcctcatgtccaagcttgtataccagacctcttgaaggttgctctgacttgtctggataatgtgacagattctgatggatcacttcgtgctttgagggctaagatcgccaattttattgcaaataacgtaaagagaaattggcctcgggatttgtatgaaagagttgcgcagaggttgtgaaaaatgtacgatgggaattgtttgttgcctttgaaactttaaaggcaacagtatgttttttgaatgaaggtccccagtaatgtaaaacttgtaaagtagtggcaatgtcaatgatatttatggtggacctatgtcctggagatataatcggagaaactacaaatgtgaaataaaactggttatgatttttctcttcatcttttcatatgatttagctaaatggttatgtaatagggtgtttacaggtttggttaacaagaatattactttaaactgctcccgtccattcaatacatgctagaagatgcaaaaactaataagcaatgatattggaatacaaaatttgacatataatagaacacaaacaaataccctatcaaatatag

SEQ ID NO: 7488 - DNA, 3070 bp, Lotus japonicus
cttttcaattttttagggctcaagaaaacagtgtctgagtctgagagactgagactaaaaccctttctttctttctcttcgctccgagctcgatagccatggcgaacgaagacttggccagttggtcagatcttctccattcttccacgaagcttctcgaacaagccgcaccttctgctcagttccctcctctccagaggaacttagatcaactggaagcattgtctaagaagcttaaatccaaaactgtgagggctgaggcgccttctcaatctatcgctgcaaccagactgcttgctcgtgagggtataaatgctgagcagcttgcaagggatctgaagtcatttgaattgaagacaacttttgaggatgtttttcctgttgaggcaacaagcgttgaggagtatttgcagcaggttcatgaaatggcaatggtctctgctgtccaggaagctcagaaggataatctcaggagtttcaatgattatatgatgaaagttttggaggaagattggcataaagaaaagcgtgacttccttcagagtcttaaccgaatttcaacattacctcggacaaacatggtaactaacagcaatgggggtacccgccaaggccagattgtgtccgtggcttccaatgtacctagcatggaggttgttccttttactaccagacctattgcggagaaaaaggcatctgtctatgctgaagttgtgaaaaacctgaatagagcaaggcagtctgggctaccatttaaacctgctgcagctttcaagggtgcatatgaaagtttaaacattgatgctagtggtggaaaatcagtaacaatgcgaaagatatggcaccttgttcagatgctgatggatacggactcaccattgcaacatgtttcaaaaaagatgtcattgattattggggcaagacgccaccttgaatggggacatgagaaatacatcatggatactatacaaagtcatcccgcccaagctgctcttggcggtggtgtaggaaatttgcaaagaatccgtgccttccttcggattcggttgagagattatggggcactggatttcgatgctggtgatgctcggcggcagcctcctgttgatactacatggcagcagatatatttttgcctgaggtctggttattatgatgaagcaagaaatgttgccctatcttctcgtgcttcacatcaatttgctcctctgctcacggagtggatcaatactggaggaatggtagcagaagagattgcagttgctgcatctgaagaatgtgaaagaatgttgagaactggtgatcgggtaggccgagctggatatgacaagaaaaagttactgctgtttgccattatatcaggttctcgaaggcatatcgatcgcctgcttagagatcaaccaactctctttagtacaatagaggatttcttgtggttcaaattgtcagctgtgcgggattgccctgggggatcttcgtctattgttctaagtgatggtctgataccatacagtttggatgatttgcaaatttacctgaataaatttgaaccatcatactacacaaaaaatggaaaagatccccttgtatatccctatatcttgcttttaagcattcaattgcttccagctgtattacacttgtctaaggaaacgggagatgaaggatataacattgatgctgcccacctatcaattgtgctagctgatcacggtgtcctttctgaaggtgctggtgctgggcaaaagttgggagtgatggatgcttatgcggaagtgtccaccattatcaggcaatatggatctatgtatttgcgtcttggtgatctccaaatggcactagaatattatgcacaagctgctgctgcagttggaggtggccagttgtcatggactggtagaggtaatgttgatcaacaaaggcagagaaatttgatgctgaaacagcttctaacagagttactgttaagggatggaggcatatatcttttacttggtgcaagaggtgctggagaagaaggggaattgggacgttttgttactgatttcaaagcaagaaaacaatttttatatgaagctgcatgccaatgtcaggaggctgggatgtatgacaaatctatagaaattcagaagagagtgggttccttctcaatggcgctggatactatcaataagtgcctctctgaagccatttgtgcccttttccgtggaagattagacggtgagagccagactgctggcctcatccattctggcaatgagattttggaagcatatccttactatccagatgtcagtcctcaagagagaatagatgtttttgagcagcaagctgtgttaagagaactcgagtcaatattatcaattcacaaattgtctagactggggcatcatgttgatgcattaagggaggttgcaaaacttccatttctccctctagatccccggggccctgatgttgccattgatgtgtttgagaatttatctcctcatgtccaagcttgtattccggatcttttgaaggttgctctcacttgtctggactatgtaacggactctgatggatcacttcgcgccttaagggcaaagattgcgagttttattgcaaataaccttaagaggaattggcctcgtgatttgtatgagagagttgcgcagaggttgtaaaagtgaaagtacgacggctagtgttgctgcctttgaattaatgaaggcaacagaatgtttagatgaaggttttcagtgtaaaacttgtagagtactcattgatccttttggagaaggaattccctggttatgaattttgttattaccttttcttctgtttttgctaatcgcttgtaaactgaacatgtagccttgtaatagtttaccttataaaaaatatttaaaaatcataataatgatccaagaatgatcagaaacactctatagggtatctattgcaccgagtcatttttgtgtgtagtgcctataaaattttatgccgcccatcaactgtaatcatttgcaatgtttaaatttgtgaaccaggtagaccttgcatcattataaaatcatttgttacattt

SEQ ID NO: 7489 - DNA, 2963 bp, Arachis hypogaea
ggggggaagggaacaattgggttccaaatgttagggctttgagtgataactaaaaccctttccctttttctctttccctttccctttccctggctgtttggaattggagagcgccatggccaacgaagacttgagtagctggagcgatctccttcattcttcctccaagcttctcgaacaagctgctccttccgctcagttccctcctcttcagaggaacttagaccaattagaagcattatctaagaagctgaaatccaagacattaaggaccgaggctccttcacaatcgatagctgcaacaaggctccttgctcgtgaggggataaatgcagagcaacttgcaagggacctgaagtcatttgaattgaagacaacttttgaggatgtttttcctgtggaggccacaagtgtcgaggagtatctgcagcaggttcatgaaatggcaatggtatctgctgtccaggaagctcagaaagacaatcttaggagtttcaatgactatatgatgaaagttttggaggaggattggcaaaaggaaaagcgtgatttccttcagagtttaagtcgaatttcaacattgcctaggacaaacatgcttgctgccagcaatgttggtacccactcaggtcaggttgtgtcaatggcttctggtccacaagtttcttctggtgtgtctagcatggatattgttcctccgagcagcaggcctattatggagaaaaaggcatctctatatgctgaagttgttaagaatcttaataaagcaagggaatctggtttaccatttaaacctgctgcagctttcagggctgcatatgaaagtttgggcattgaagccagtggtggaaagtcagttacgatgcggaagatatggcaccttgttcagatgctgttgggtgaggactcaaccgtgcagaatgtttcgaaaaggatggcattgattattggggcgagacgccatcttgaatggggacatgagaaatatgtcatggataccatacaaagtcatcctgcacaagctgctcttggtggcggcgttgggaatttgcaaagaatccgtgccttccttcggattcggttaagggattatggaatactggattttgatgctggggatgctcggcgccagcctcctgttgatactacatggcagcagatatatttttgcttaagaactgggtattatgatgaagcaagaaatgttgctctctcttcccgtgcttcacatcaatttgctcctttgctcacagaatggattaatacgggaggaatggtgccagaagagattgcagttgctgcaatggaggaatgtgaaagaatgttgagaactggtgatcgtgtaggtcgagctgcatatgacaagaaaaaattactgctgtatgccatcatatcaggttcccgaaggcatattgatcgtatgcttagagaccaaactctattcagtacaatagaggatttcttgtggttcaaattgtcagctgtgcgggactgccctagtggaccttcatctattgttctaagagatggcctggttccatacagtttggatgatttacaaacttacctgaataaatttgagccatcatactatactaaaaatggaaaagatcctatggtttatccctatattttgcttttaagcattcaattgcttccagctgtgctatacatgtctaaggaaactggagatgaaggatataatgttgatgctgctcacctatcaattgtgctagctgatcatggtatcctctctgaaggtgctaggcaaaaattaggagtgatggatgcttatgcagaagtgtctaccattatcaggcagtatggatctatgtatttgcgtcttgatgatctccaaatggcattagaatattatgcacaagctgctgctgcagtgggcggtgggcagctttcatggactggtagaggtaatgttgatcagcaaaggcaaagaagtttgatgttgaagcagcttctaactgaaatattgttaagggatggaggaatattccttttactgggtccaaggggtgctggagaagaaggtcaattgggtcgttttgtgacagatccaaaagcaaggcaacagttcttaattgaagctgcttgccagtgtcaggaggctgggatgtataacaagtctatagaaattcagaagagagtggggtctttctcaatggcattggacaccattaataagtgcctgtctgaagctatttgtgcccttttccgtggaaggttagatggcgagagccagacagccgggcttatccattctggcaatgagattttggagacataccattatcatccggatgtcagtcttcaggagagagaccatgtttttgagcagcaaactgtgttgagacaacttgagtctatactgtcaattcacaaattggccagagtggggcatcatgttgaggcgttaagggagattgctaaacttccatttcttcctctagatcctcgaggccctgatattgctgtcgatgtgttcgaaaacttatctcctcatgtccaagtttgtatcccggatcttttgaaggttgctctcacttgtctggacaatgtgacggactccgatggatcactccgtgccttaagggcgaagattgcgagtttcattgcaaataatatgaagaggaattggccccgcgatttatatgaaagagttgcccaaaggttgtgaagtaaaatatacaacggaatctgtttgggcgaaggtttctgtttaagtgtaactgtaacccctgtaaagagttcctacagcctataggagtatgtatttctaggaactagaaaatgtaagtgatatacgctggttatgaatttccgcacccattttttaagctggggtactgaggacatgtttacgcatgtatggttaacaaagaatattactttaatgctttgtcacgcactatttcttgtgctatgatatactgtatgacaaataacgt

SEQ ID NO: 7490 - DNA, 3049 bp, Lupinus angustifolius
aaggtccaaaagctacttactaaaacccttctttagcttttggtggagggagaagagaagagaaacatggcgaacgaagatctgagcaattggagtgatcttctacactcttctacgaagcttctagaacaagctgctccttctgctcagttccctccacttcagaggaacttagatcaacttgaagcattgtctaagaagctcaaatccaagaccttaagggccgaggcgccttctcaatctattgctgctacaaggctccttgctcgtgaggggataaatgcagagcagcttgcaagggatctgaagtcatttgaattgaagaccacatttgaggatgtttttcctgttgaggcaacaagtgttgaagagtatctgcagcaggttcatgaaatggcaatggtctctgctgtccaggaagctcagaaagataatctcagaagttttaacgattacatgatgaaagtttttgaggaggattggcaaaaagaaaagcgtgatttccttcaaagtttaaaccgaatttcatcattacctaggacaaacacgactgccaccagcagcacaggtacccgctcgggccagattgtgcctacagcttctagtccacaagtctcttatggtatggaggttgttcctcttactagtaggcctattatggagaagaaggcatccgtctatgctgaagtagtgaaaaacctgaataaagcaagggagtgtgggttaccattcaaacctgcggcatctttcaagggcgcatatgaaagtttgggtattgatgctggtggtggaaaatcagttactatgcggaagatatggcaccttgttcagatgatgatggatggagactcaactcagcaacatgtttcagaaaggatgtcattgactattggtgcaagacgccaccttgaattgggacacgagaaatacatcatggacaccatacacagtcatcctgcacaagctgctcttggaggcagtgttgggaacttgcaaaggatccgtgccttccttcggattcggttgagggattatggattactggattttgatgctggtgatgctcggcggcagcctcctgttgataccacatggcagcagatatatttttgcttgaggtctgggtattatgatgaagcaaggaatgtttccctatcttcacgtgcttcacatcaattttctcctttgcttacagagtggattaatactgggggagtggtaccagaagagattgcatctgctgcatcagaggaatgtgaaagaatgttgagaactggtgatcgagttggtcgagctgcttatgacaagaaaaagttacttctgtatgctatcatatcaggttctcgaagacatgttgatcgcttgcttagagatcaaccaactctctttagtacaatagaggatttcttgtggttccaattgtcagctgtacgcgactgctctagtggaccttcatctattgttctaagtgatggtctggttccatacactttggatgatttgcaaatttacctcaataaatttgaggcatcatactatacaaaaaatggaaaagatcctctggtatatccctacatcttgcttttaagcattcaattgcttccagctgtattatacatgtctaaggaaactggagatgaaggatataacattgatgctgtccacctatccgttgtgctagctgatcatgggttcctttctgaaggtgctggtgctgggcataagttaggagtgatggatgcttatgcagaagtgtctaccattgttaggcagtatggatccatgtatttgcgtcttggtgatctccaaatggcattagaatattatgcgcaagctgctgctgcagtgggtggtgggcagttggcatggactggtagaggtaatgttgatcagcaaaggcagagaaatttgatgctgaagcaacttttaactgaactattgttaagggatggaggcatatatcttttacttggtgcaagaggtgctggggaagaaggtgaattgggtcgttttgtgactgatccaaaagcgaggcaacaatttttaattgaagctgcctgccagtgtcaggaggctgggatgtatgataaatctattgaaattcagaagagagtggggtccttttccatggccctggataccatcaataagtgcctctctgaagctatttgtgcccttttccgtggaaggttagatggtgaaagtcgaaccgctggcctcatccattctggcaatgagattttggagacgtacacttattaccctgatgtcagtcttcaagagagagagaatgtctttgagcagcaaaatgtgttaagacaacttgagtcagtattgtcaattcacaaattggcaagactggggaactatgtggatgcaataagggaggttgccaaacttcaatttcttcctctagatcctcgaggccctgacattgctaacgacgtgtttgaaaatttatctcctcatgtacaagcgtgtattccagatctgttgaaggttgctctcacttgtctggacaatgtgacggattctgatggatcacttcgtgctttaagggccaagatttcgaatttcattgcaaataatttgaagaggaactggccccgtgatttatacgaaagagttgcgcaaaggttgtgaaattataaatatacgatgagaatcgttttagcctttaagttcttgaggacaacagaatgtgtctggatgaaggttttcagtagtgtaacaattgtaaagtagtctcaatggcatattttctggaactatgctgaggagatatattatgagtaactataacaaagaaatacacttatgaattttctcatccttttttgtgctcttggtaatatgcttttacatatttgtttaacaagaacatttcaaaatttcgaattaattagcaaagagcatgatgttaattttcatttttttggttattttggttggagtaacatgttccatgtctaatgatactgtagtaggaccagaaatggcatgagatgtaacagttagttgctggtggaacttgcatagttttcttctt

SEQ ID NO: 7491 - DNA, 2990 bp, Lupinus angustifolius
cttgttcggcttttgttggagggagaagagaaaagagatatggcgaacgaagatataagcaattggagtgatcttctacattcttccacgaagcttctagaacaagctgctccttctgctcagttccctcctcttcagaggaacttagatcaacttgaagcattatctaagaagctgaaatccaagaccttaaggaatgaggcgccttctcaatctattgctgcaacaaggctccttgctcgtgaggggataaatgcagagcagcttgcaaaggatctgaagtcatttgaattgaagacaacgtttgaggatgtttttcctgttgaggcaacaagtgttgaagagtatctgcagcaggttcatgaaatggcaatggtctctgctgtccaggaagctcagaaagataatatcagaagttttaacaattacatgatgaaagttttggaggaggattggcaaaaggaaaagcgtgatttccttcagagtttaaaccgaatttcaacgttacctcggacgaacatgaatgctaatagcaacgtgggtacccgcccgggtcagattgtgtctatagcttctagtccacaagtctcttctggtatggaggttgttcctcttactagtaggcctattatggagaagaaggcatccatctatgctgaagttgtaaaaaacctgaataaatcaagggagcgcgggttaccattcaaacctgctgcatctttcaagagcgcatatgaaagtttggacattgatggtggtggtggaaaatcagttacaatgcggaagatatggcatcttgttcagatgatgatggatggagacccaactcagcaacgtgtttcaataaggatgtcactgactattggtgcaagacgccaccttgaattgggacacgagaaatacatcatggacaccattcacagtcatcctgcacaagctgctcttggcggtggtgttggaaatttgcgaagaatacgtgccttccttcggattcggttgagagattatggattactggattttgatgctggtgatgctcggcggcagcctcctgttgatactacatggcagcagatatatttttgcttgaggtctgggttttatgatgaagcaaggaatgttgccctatcttcacgtgctgcacatcaattttctcctttgcttacagagtggattaacactggaggaatggtaccagaagagattgcatctgctgcatcagaggaatgtgaaagaatgttgagaactggtgatcgggttggtcgagctgcatatgacaagaaaaagttagtgctgtatgccatcatatcaggttctcgaagacatattgatcgcttgcttagagatcaaccaactctctttagtactatagaggatttcttgtggtttcaattgtcagctgtacgtgactgccctagtggaccttcatctattgttctaagtgatggtctggttccatacagtttggatgatttgcaaatttacctcaataaatttgaaccatcatactatacaaaaaatggaaaagatcctctggtatatccctacatcttgcttttaagcattcaattgctaccagctgtattatacatgtctaaggaaacaggagatgaaggatataacattgatgctgtccacctatccattgtgctagctgatcatgggttcctttctgaaggtgctggacataagttaggagtgatggatgtttatgcggaagtgtctaccattattaggcagtatgggtccatgtatttgcgtctttgtgatctccaaatggcattagaatattacgctcaagctgctgctgcagtgggtggtggacagttgtcatggactagtagaggtaatgttgatcagcaaaggcagagaagttcgatgctgaagcaacttctaactgaacttttgttaagggatggaggtatatatcttttacttggtgcaagaggttctggagaagagggtgaattgggtcgttttgtgactgatccaaaagcgaggcaacaatttttaattgaagctgctttccaatgtcaggaggctgggatgtatgataaatctattgaaattcacaagagagtgggatccttttccgtggccctggataccatcaacaagtgcatttctgaagctatttctgccctttttcgtggaagatcagatggtgaaagtcggactgctggcctcatccattctgggaatgatattctggagacgtacacttattaccctgatgtcagtcttcaagagagacagcttgtctttgagcagcaaaatgtgttaagacaacttgagtcagtattgtcaattcacaaattggcaagactagggaactatgtggatgcaataagggaggttgctaaacttcaatttcttccgttagatccccgaggccctgacattgctatcaatgtgtttgaaaatttatctcctcatgtagaagcttgtattccagatctgttgaaggttgcactcacttgtctggacaatgtaacagattctgatggatcacttcgtgcttttagggcgaagatttcaagtttcattgcaaataatttgaagaggaattggcctcgtgatttatacgaaagagttgcacagaggttgtgaaagtataaatatgagatcggaattgttctagtctttaaattcttgaggttttcagtagtgtaacaattgtaaagtagctctaccttaacaaattttgcctgtcattcgatacactttctgaaccgaactattgcagagcaattcaactcaagggttaagttgtcttgtatcttaaaatttatatagcaaaatagtctgaaacagattcattttttttattttctcaatatcaacagggctcagtggatgggaagattattcatttagcttttaccttgaagtaattttctcatgtagatgggaagattattattggtgaatatgttattatgttttgatcaataatttcgctcattgtgcttcaagagctgagtttatgt

SEQ ID NO: 7492 - DNA, 3074 bp, Theobroma cacao
aaaaggctaaaacccattttttccctctcatcacaatcccaaaggactaaggggagtgatggcgagtgagcaagacatgagcagctggaccgatcttctccactcttcctccaagcttctcgagcaagccgctccttctgctcagtttcctcctcttcagagaaacttagatcaattagaagcactctcgaagaagctcaaggcaaaaaccttaagaactgaggctccttctcgatctattgctgccacaaggctacttgcacgtgagggaattaatgctgagcagcttacacgtgatctgaagtcgtttgaattgaagacaacattcgaggatgttttccctgctgaagcaacaagtgttgaggagtatctgcagcaggttcatgaaattgcaatggtttcagccatccaagaagctcagaaggataacctcagaagttttaatgattatatgatgaaagtgttggaggaagactggcagaacgaaaaacgagactttttacagagcctgagccggatttcaacgttacccaagactaacatgcttgataaaagcattactggtgctcgttcaggtcaaatagtttccatggcttctagtcctcaggtttcatcaggtccctctggcatggagcttttacctttagctaacaagccagttgttgagaaaaaagtgtcagtatatgctgaagttgtaagaaatctgaacaatgcaagacaacaaggcttaccgtttaaacctgcaacggcttttaaggctgcatatgagagtttgggcactgaagcatctagtggcaaatcagttaacatgcagaaaatgtggcatcttattcagacactaatgggtgaggattcaacaatgcaacgaagtgtttcaagaaagatgtcattagtaattggtgcgaggcgtcacctggaatggggacatgagaaatacattatggatacagtacaaagccatcctgcacaagctgctcttggtggagctgttgggaatttgcatagagttcatgcctttcttcggattcgtttgagggattatggaattctggattttgacgcaggtgatgctcgaaggcaacctcctgttgataccacttggcagcagatttatttttgcttgaggactgggtattatgatgaagcaagacaagttgcccaatcatcccgtgcttctcaccagtttgcaccactgcttacagagtggattaacagtggaggcatggttccagctgacattgcagttgctgctgcagaagagtgtgaaaaaatgtttagaatgggtgatcgggttggtcgagctgcgtatgacaagaaaaagttattgctctatgctatcatatccggttctcgcaggcaagttgaccgtctcctcagagatttaccatcacttttcagtaccatagaggatttcctgtggttcatattgtcagcagtacgggacttacctggtggaacctcatctgttattctgaatgagggtttagtaccatacagtctggatgatttgcaagcttacctaaacaaatttgagccatcatattacacaaagaatggaaaggaccctctggtatacccgtatgtcttgcttttaagtatccagttactaccggctgtttcatacttgtctaaagaaacaggagatgaaggatataacattgatgctgcacacatagcaatcgtgttagcagacaatggggtcctttatgaaggtgctggtgctggtgctggaaaaaaactggggatgatggatgcttatgcagaagcatccagcattattaggcagtatggctctatgtatataaggcttggtaaccttcaaatggcactagaatattatgcacaagctgctgctgcagtaggtggtggacaggtatcatggactgggagaggtaatgtggatcagcaaaggcaaaggcacttgatgctgaagcagctttttactgagctattcttacgagatggtgggatttatcttttacttggttcaagaggtgcaggagaggaaggtgaattgggaagattcttgactgatcataaagcaagacaacagtttctgcttgaagctgcccgccattgtcaagatgctgggctgtacgagaaatctatagaaattcagaagagagttggggcattttcaatggcattggatacaataaataagtgcctatctgaagcaatttgtgccctatcgtgtggtagattggatggcgagagtcgaactgctggcctcattcattctggcaatgagatcttggagactttcaaatattatcctgaagtcagtctccaagagagggaacatgttttggagcaacaaactgtattgagacagcttgaggcaatactgtctatccacaaattgacaagactagggcagtatcttgatgctgtaagggaagttgccaaacttccattccttccattggatccacgagcacctgatgttacctctaacgcgtttgaaaatttatctcctcatgtccaagcttgtgtgccggacctgctaaaggtagctctaacttgtttggaaaatgtgactgatacagatggatcacttcgcgctatgagagcgaagattgcaaccttccttgcaaataatatgcatcagaattggccccgtgatttatacgaaacggttgccagacgcttgtgaaacaaatctgaccaaggaaaaagagtggatataggcagaaatctcccttcataggtgagatatataagcagagttaaatttgagcagtgtggtttattgtaatgaatttttccattttggaatgagctcagctcatattagggtctgtttttaaaactgttggcgacccatttatccgtgtttatatgtccatctctgttctaaatcctggatgagaaagctgaaagggtaacgttattcgtccgtggacccttaaacttataccttcaattgtgagacaaagctcgccattgttaatctatcatcttcatgcttttaaccttcaaaacgtgaatagtaaacaataagcagtcaatttaaacccaccccttaaaaaaattaaaaaaaaggaaacagtagtgaaggctataaccagatc

SEQ ID NO: 7493 - DNA, 3108 bp, Vitis vinifera
cgttctctctctcctttcaaaattagggcttaataaaacccttccccctctctctcacacaccgaagtcagcaaccatggccaccgactccgacatgagttcctggaccgatctcctccactcctccacgaagcttctcgaacaagccgctccttcggctcagttccctcctctccagaggaacttagaccaattagaagcgttatctaagaagctaaagtcaaaaaccctaagagctgaagctccatcacaatccgttgcagccacaaggttattggcacgtgagggactaaatgcagaacagcttgctcgggatctcaagtcttttgagttgaagacaacatttgaggatgttttccctgctgaggcaacaagtgtcgaggaatacctgcagcaggttcatgagatggcaatagtttccgctatccaggaagcacagaaagataaccttaaaagttttaatgattacatgatgaaagttatggaggaggattggcaaaaggaaaaaagggatttccttcaaagcttgagccgcatatcaacattgcccaagactaatattagtgattcaagcactggggctactcgtccaggtcaaattgcatccatgatttccagtcctcaggtttcatctggtctgtctagtatggagcttgtacctctagctaacaagcctgtcctcgagaaaaaaacttctgtttatgctgaggttgtgaagaatctcaacagtgcaagagagcgtggcttaccatttaagcctgctacagctttcaagggtgcttatgatagtttgggccttgagacatctggtggcaaatctgttaacatgcagaagatttggcacctgattcagacattaatgggtgaggatacagctgctcaatggaatgtttcaaaaaaaatgtcattagtaattggtgctaggcgccacctcgaatggggacatgagaaatatatgatagatacgatacaaagtcatcctgcacaggctgctcttggtggggttgttggaaatctgcaaagaatccatgcctttcttcggattcgtttgagagactatggggttctagattttgatgcaggtgatgctcgtagacaacctcctgttgataccacttggcagcagatttatttttgcttgaggactgggtattacgaggaagcaatagaggttgccagatcatctcgtgtttcaaatcagtttgcttctcagctcacagaatggattactacaagaggtatggtatcagcagagattgcagcagttgcttcagaggaatgcgataaaatgttaagaatgggcgatcgtgtgggtcgtgcagcatatgacaaaaaaaggttgctgctttatgctatcatatctggttctcgcaggcatattgatcgcttgctcagagatcttccaactcttttcaataccatagaggatttcttgtggttcaaattgtcagctgtgcgggactgtccaggtggatcctcatctgttgtcctgaatgagggcttggtaccatacagtttggatgatttgcagaattacctaaataaatttgagccatcatattatacaaaaaatggaaaggaccctctggtatatccatatgttttacttctaagtatccagttgctaccagcagtcctatacttgtctaaggaaatgggagttgaagggtataatgttgatgctacccatatatcaattgttctagcagaccatggggtcctttcagaaggtgctggggtaggacagaaattgggggtgatggatgcttttgcagaggcatctagcataatccggcagtacggatcagtgtatttacgtgctggtgatctttcaacagcattagaatattatgcacaagctgctgctgcagtgggaggtggacagttgtcatggactggaaggggcaatatagatcagcaatggcagagaaatctgatgctgaagcaactcctcactgaactgttattaagggatggtgggatttatcttttacttggtccgagaggtgctggagaagaaggtgaactggctcgttttctgactgatgtaaaagcaagacagcaatttctgcttgaagcttctcgccagtgtcaggatgctgggctgtatgatcaatctatagaaattcagaagagaattggggcattttcaatggcgttggatacaattaataagtgcctctctgaagcagtttgtgctttggctcgtggtagattggatggtgagagccgaactgctgggctaattcagtctggcaatgagatcctggagacatacaaatattttcctgaagtcagtcttcaagagagggaacatgttatggagcaacagactgtactaagagagcttgaggcaatattgtctatccataagttggcgagagtgggccattatctagatgccctgagggaggttgctaaacttccatttcttccacttgatccacgagcgccagataccacacctgatgtgtttcagaatttatctccccatgtccaagcttgtgtgcctgaccttctgaagattgctctcagttgtctggactatgtgacggatactgatggatcacttcgggccttgaggactaagattgccaattttctcgcaaacaatttgaataggaactggcctcgtgatttgtacgaaaaggttgctcgaacgttgtgaacgaacaaaggataggtagtttgagatgccacttccttagtcaagcaacaaaatgtggcagtttgagatacctgcattctggagatgtaaaatgacatggtccttcggtgttgacggcatcacagatacattttgtacaaaaacagtaagaccaggctttcatgaatcatgactgctgttttgtttgtttgataataggagaaagaaattaatgttttgcgggacttatttttcatactatgagttgcagtgggctgccattgttaatatgagcatcttgctatcaagatttttacttatttcccttttttaaagttgattaccatattagaaaagagagaacttgttttcggttctttcttacaacacctgctgcaatagtgagcaaactcgtttcacttgttcatgattaaattctatccttctaccagaaagtggat

SEQ ID NO: 7494 - DNA, 3708 bp, Theobroma cacao
aagaacgagaacggagcccaagccctaatggtccgtaggccaagccgagtggggtagctggctgcccctgctgctgctccctcgataataagggaaagctgtatgaccgtttttaaaaattagggctttagcataaaaggctaaaacccattttttccctctcatcacaatcccaaaggactaaggggagtgatggcgagtgagcaagacatgagcagctggaccgatcttctccactcttcctccaagcttctcgagcaagccgctccttctgctcagtttcctcctcttcagagaaacttagatcaattagaagcactctcgaagaagctcaaggcaaaaaccttaagaactgaggctccttctcgatctattgctgccacaaggctacttgcacgtgagggaattaatgctgagcagcttacacgtgatctgaagtcgtttgaattgaagacaacattcgaggatgttttccctgctgaagcaacaagtgttgaggagtatctgcagcaggttcatgaaattgcaatggtttcagccatccaagaagctcagaaggataacctcagaagttttaatgattatatgatgaaagtgttggaggaagactggcagaacgaaaaacgagactttttacagagcctgagccggatttcaacgttacccaagactaacatgcttgataaaagcattactggtgctcgttcaggtcaaatagtttccatggcttctagtcctcaggtttcatcaggtccctctggcatggagcttttacctttagctaacaagccagttgttgagaaaaaagtgtcagtatatgctgaagttgtaagaaatctgaacaatgcaagacaacaaggcttaccgtttaaacctgcaacggcttttaaggctgcatatgagagtttgggcactgaagcatctagtggcaaatcagttaacatgcagaaaatgtggcatcttattcagacactaatgggtgaggattcaacaatgcaacgaagtgtttcaagaaagatgtcattagtaattggtgcgaggcgtcacctggaatggggacatgagaaatacattatggatacagtacaaagccatcctgcacaagctgctcttggtggagctgttgggaatttgcatagagttcatgcctttcttcggattcgtttgagggattatggaattctggattttgacgcaggtgatgctcgaaggcaacctcctgttgataccacttggcagcagatttatttttgcttgaggactgggtattatgatgaagcaagacaagttgcccaatcatcccgtgcttctcaccagtttgcaccactgcttacagagtggattaacagtggaggcatggttccagctgacattgcagttgctgctgcagaagagtgtgaaaaaatgtttagaatgggtgatcgggttggtcgagctgcgtatgacaagaaaaagttattgctctatgctatcatatccggttctcgcaggcaagttgaccgtctcctcagagatttaccatcacttttcagtaccatagaggatttcctgtggttcatattgtcagcagtacgggacttacctggtggaacctcatctgttattctgaatgagggtttagtaccatacagtctggatgatttgcaagcttacctaaacaaatttgagccatcatattacacaaagaatggaaaggaccctctggtatacccgtatgtcttgcttttaagtatccagttactaccggctgtttcatacttgtctaaagaaacaggagatgaaggatataacattgatgctgcacacatagcaatcgtgttagcagacaatggggtcctttatgaaggtgctggtgctggtgctggaaaaaaactggggatgatggatgcttatgcagaagcatccagcattattaggcagtatggctctatgtatataaggcttggtaaccttcaaatggcactagaatattatgcacaagctgctgctgcagtaggtggtggacaggtatcatggactgggagaggtaatgtggatcagcaaaggcaaaggcacttgatgctgaagcagctttttactgagctattcttacgagatggtgggatttatcttttacttggttcaagaggtgcaggagaggaaggtgaattgggaagattcttgactgatcataaagcaagacaacagtttctgcttgaagctgcccgccattgtcaagatgctgggctgtacgagaaatctatagaaattcagaagagagttggggcattttcaatggcattggatacaataaataagtgcctatctgaagcaatttgtgccctatcgtgtggtagattggatggcgagagtcgaactgctggcctcattcattctggcaatgagatcttggagactttcaaatattatcctgaagtcagtctccaagagagggaacatgttttggagcaacaaactgtattgagacagcttgaggcaatactgtctatccacaaattgacaagactagggcagtatcttgatgctgtaagggaagttgccaaacttccattccttccattggatccacgagcacctgatgttacctctaacgcgtttgaaaatttatctcctcatgtccaagcttgtgtgccggacctgctaaaggtagctctaacttgtttggaaaatgtgactgatacagatggatcactttgcgctatgagagcgaagattgcaaccttccttgcaaataatatgcatcagaattggccccgtgatttatacgaaacggttgccagacgcttgtgaaacaaatctgaccaaggaaaaagagtggatataggcagaaatctcccttcataggtgagatatataagcagagttaaatttgagcagtgtggtttattgtaatgaatttttccattttggaatgagctcagctcatattagggtctgtttttaaaactgttggcgacccatttatccgtgtttatatgtccatctctgttctaaatcctggatgagaaagctgaaagggtaacgttattcgtccatggacccttaaacttataccttcaattgtgagacaaagctcgccattgttaatctatcatcttcatgcttttaaccttcaaaacgtgaatagtaaacaataagcagtcaatttaaacccaccccttaaaaaaattaaaaaaaaggaaacagtagtgaaggctataaccagatcgaatcttaattgggcctcctaaatacagcttgcaggaacacaggttataagcccagccaatgaatcactaattcgatattatcaataaactatgccatttatcattgttgaatttaaaattaacttatttaaaaatttgaatgtagtaactcttttaaagaacatttaatcatatcaaaggattaattttgttaggcatgtcaactatttttggataggaaatagcaaaaatgtgacattcctagcttctatcctaggcagccataaggttggtagaagcaacttcgtcgaagggtgtttttgatagattggtttagataattacggctttggaatgggggccgaaaatgtaaaaataacaaatctgacaaatgggaggaacactgtggcagtgtttggtacgagagatgggcagtcatattcttttgttacaacgtactcaattgcattacattgtaaaattttgcaatatttttttacaatataaaacttgttacgct

SEQ ID NO: 7495 - DNA, 2990 bp, Cucumis sativus
ccatggcgaacgaccaagacatgagtggctggactgatctgcttcactcttctacaaagctcctcgaacaagctgctccatctgcccagttccctcctctccagaggaacttagatcagttagaagtgttatctaaaaagctcaaggcaaagaccctgagaactgaggcgcccacacaatctattgctgctacaaggttacttgcacgtgagggaataaatgcagagcaacttgctcgagatttgaagtcttttgaactaaagactacatttgaggacgtgtttcctgctgaagcaacaagtattgaagaatacttgcaacaggtccatgaaatggcaatgatctcagccatacaggaggcacagaaggacaatgttagaagttttaatgattacatgatgagagttttagaggaggattggaaaaaggaaaaacgtgatttccttcagagtttaagccgaatatctacattacctagaactaacatgattgatgataaaagtggggcttcaaagacgggtcaaatatcctcctttgtatccagtgcacatgtttcgtctggtgtacccagcctggagtctgtatctctagccaacaagcctattattgagaaaaaggcatcaacatatggtgaagtagtgaagaaaatgaacgatgcaagggaacgtggactaccctttaaacctgctgtagctttcaaaggtgcttatgaaagtttagatctccatgcatctgctgggaagtcagttaacatgcaaaaaatttggcatcttattcaaacattaatgggcgaggaatcaacttcaaaacgaaatatttcaaaaaagatgtcactaatacttggggcaaggcgccatctagagtggggacacgagaaatatataatggatacaatacaaagtcatcctgcacaggctgcccttggtggtgttgtaggaaatctgcaaagaattcgggccttccttcggattcgcttgagagactatggagtcctagattttgatgcgaatgatgcacgtagacagcctcctgttgatactacttggcaacagatttacttttgcttgagaactggatattatgacgaggccagaaacattgcgctgtcatctcgtgcttcaaatcagtttgctccactgcttacagagtggattaatactgggggcatggtaccagtggacatagcaagtgttgcatcagaagagtgtgagaagttgttaagaatgggagataggatgggccgagctgcatatgataagaaaaagttattgttatatgctattatttcaggttctcgccggcaaattgaccgtttgttgagagatcttccgatgctgttcaatacaatagaggattttctgtggtttcagttgtcagctgtacgtaacggccatggggaatcctcatctattgttttgaatgaaggctcagtaccttatactttggatgatttgcagttttaccttaataaatttgaaccgtcatattatacaaaaaatggaaaagatcccctggtatatccatatgttcttcttttaagtattcaattgctgcctgcggtcttgtatttgtcaaaagaaacaggagaagaaggattaaatattgatgctgcccacatatcaattgtgcttgcggacaatggagtactttcagaaggaacaggggctgggcaaaaattaggtgtgatggatccttatgcagaggtagccagcataatcaggcagtatggttctctttatttaagaatgggtaatttatctatggcactggagtactatgcccaggctgctgcagcactgggcggtggacagttgtcatggtctagcaggggtagtatggatcaacagaggcagaggactttgatgctgaagcaactgcttactgagctgttgttacgtgatggaggtatctatctcttgcttggtgcaaggggtgctggagaagaaggtgaattacgaagatttatgactgacatgaaatctaggcaacaatttctacttgaagctgctcgacagtgtcaggaagctgggctttatgacaagtcaatagagatccacaagagagttggggcattttccatggcattggatacaattaataggtgtctctctgaagcaatctgtgctctttcacgtggtagactggatggggagagccggactgctggccttattcattcaggcaatgacattttggaagcatacaaatattgtcgtgaaatcagccttcaggaaagagaatatgtcatggaacaacagaccgtgttaagacaactggaggcagttctttcaatccacaagttggccagattgggtcatcatcttgatgctctaagggagattgctcgaattccatttcttccattggatccacgagggccagatatggcttctgatgtgtttcaaaacttatctcctcacattcaggcttgtgtcccggatcttttgaaggttgcacttacgtgtctggacaatgtgacagactctgacggatcccttcgagccttgagagccaagattgcaaacttcattgcgaacaatttaaataggaattggcctcgggatttgtatgaaaaagttgctcaaaccttgtgaaagcatgagactgcagcattagaggggctggccaagaaaatggaaactgcaactaatgtggcaatggaaaatgtagcatacttttaggcttgtagcattgtgtaagaagtacaaaagaaaaaggaaaatgaatttgaatgttgggagagcggcctgttgatttgcgccgtttttgtttccccaaccagaaaactaattgtaagtttacaagcccattttagatgtttctttttcttttagttttctttccttttgatggaaaagctagagcataagagttgaaaaatggtgccaagtttaggatttatatttgatcagatgtgctgtggatctgtatctattcttaaatattaagaaaatgactgttttattgattgtatgtacagagaattcggt

SEQ ID NO: 7496 - DNA, 2629 bp, Malus domestica
ctttacctctctcggagaagccatggcgacggagcaaaacatgagtagctggaccgatctgctccactcctccaccaagcttctcgaacaagcggcgccttccgctcagttccctccgctacagagaaatttagatcagttagaaacattatctaagaaactcaaagcaaaaaccctacgaaatgaggctcctcaacaatccgttgctgccacaaggcttcttgcacgtgagggactaaatgcagagcagcttgcacgcgaccttaagtcctttgaattgaagacaacatttgaagatgtttttccgtctgaagcaacaactgttgaagagtatctgcagcaggtccatcaaatggcaatggtctcggctctccaagaagctcagaaggataaccttagaagttttaatgattacatgttaaaggttttggaggaggattggcaaaaggaaaaacgtgatttccttcaaagcttaagccagatttcgacattacccaggaccaacatgacttatactagcagcagtggtagtcgttctggtcaaatagcatctataacttctagccgtcaagtgtcatcttctccatctagcatggagcttgtgcctttagctagcaagcccatccgtgacaagaaagcctctgtctatgctgaagttgtaaaaattctgaacaatgcaaggcagcatggattaccatttaaacctgctacagctttcaagggtgcttatgagagtttaggccttgatgtatctggtggaaaatcagttaacatgcagaagatatggcaccttcttcagacattgatgggtgaagatataaccctaccgcgtagtgtttcaaaaaggatgtcattagttattggggcaaggcggcacctagaatgggggcatgaaaaatacatcatggatacaattcaaagtcatccggggcaggccgcccttggaggagttgttggaaatttacaaagaatccgtgcctttcttcggattcgtttaagagattatggagttctagattttgatgcaggcgatacccgcaggcagcctcctgttgataccacttggcagcagatctacttttgcttgagaactgggtattacgatgaggcaagatctgttgctctgtcatctcgtgcttcacaccaatttgctcctctgcttacggagtggattaatactggaggtatggtgcctgcgtcgattgcagcttctgcttcagaagaatgtgaaaaaatgttaagaatgggtgatcgtgtgggccgagctgcatatgacaagaaaaagttgttactatatgctcttgtttctggttctcgtaggcaaatcgaccgcctactaagagatctaccaacccttttcaacactatagaggatttcttgtggttcaaattgtctgctgtaagagactgccctggtggagctgcacccattgttatgaatgagagcttggtaccatacacattggatgatttgcagatgtacttaaataaattcgatccatcatattatacaaaaaatgggaaggacccccttgtgtacccatacgttttgcttttaagcatccagttgataccgggcatggtatacttgttcaaagaaactggagatgagggatataacattgatgctgcccacatatcaattgtgctagcagaccatgggttcctttctgaaggtgctggtgctggacagaaaatgggcttgatggatgcttacgcagaggcatcaagcataatcaggcagtatggatctgtatatttacgtcttggtaatctatcagtggcattagaatattatgcacaagctgctgctgcggttggtggtggggagttgtcatggtctggaagaggcaacgtggaccagcaaaggcagagaaatttgatgctgaagcagctccttacagagctgttattgcgggatggtgggatctatctactacttggatcaagaggtgctggagaagaaggtgaattggggcgatttttgactgatgtaaaaacaaggcaacaatttcttcttgaagctgcacaccaatgtcaggaggctgggttgtatgaaaagtctatagaaattcagaaacgaataggagcattctcgatggcattggatactattaacaagtgcctctctgaagcaatttgtgccctttcacgtggtagattggatggtgagagtcgaactgctggcctcattcactctggaaacgagatcttggaaatgcataaatactttcctgatatcagtcctcaagagagggaaagtgtttcagagcagtacattgttttaagacaactcgaggccgtactgtcaatccataagttggcaagaggaggccattacgctgatgccttaagggaggttgccaggcttcaatttcttcccttagttcccgggacaccagatgttaccactgatgtcttccagaatttatctccacatgtccaagcctgtgttccagacctcttgaaggtcgccctcacttgtctggacaacatggtggattctgatgggtctctccgtgccttgagggctaagattgctagcttcattgcaaacaattccaataggaactggcctcgtgatttgtatgagaaagttgcacggagcttgtgaagccgatgaaccacg

SEQ ID NO: 7497 - DNA, 3007 bp, Prunus mume
gagaagcgtagttctgaagcggtctgctgtttagcaataacaatacaatggccgtttaaattgtgttagggctttgcaaaagctcttaaaccctttccctctcttggacagccatggccaccgaccaaaacatgagtagctggaccgatctgctccactcctccaccaagcttctcgaacaagccgctccttccgcgcagttccctcctctacagagaaatttggatcagttagaaacattatcgaagaaactcaaggcgaaaactttacgaactgagactcctcaacaatccattgctgccacgaggcttcttgcacgtgagggactaaatgcggagcagcttgcgcgtgaccttaagtcctttgaattgaagacaacctttgaagatgtttttccgtctgaagctacaactgtcgaagagtatctgcagcaggtccatcaaatgacaatggtctcagctcttcaagaagctcagaaggataaccttagaagttttaatgattacatgttaaaagttttggaggaggattggcagaaagaaaaacgtgatttccttcaaagcctgagtcagatttcaacattacccaggactaacatgacttatactaccagcgctggtagtcgttctggtcaaatagcgtccataacttctagccctcaagtttcatctactccatctggtatggaggttgaacctttagctagcaagcccatccttgagaagaaaacatctgtctatgcagaagttgttaaaaatctgaataatgcaagacagcgtggattaccgtttaaacctgcttcagctttcaagggtgcttatgagagtttaggccttgatgcatctggtggaaaatcagttaacatgcagaagatatggcaccttcttcagacattaatgggcgaagatataaccatacaacggggtgcttcaaaacggatgtcattagttattggggcaaggcgccacctggaatgggggcatgaaaagtacatcatggatacaatccaaagccatcctgcgcaggcagccctcggaggagttgttggaaatttacaaagaattcgtgcctttcttcggattcgtttaagagattatggagttctagattttgatgcaggtgatgctcgtaggcagcctcctgttgataccacttggcagcagatctacttttgcttgagaactgggtattatgatgaagcaagagctgttgctctgtcatctcgcgtgtcaaaccagtttgctcctctgcttactgagtggattaatactggaggtatggtgcctgcggagattgcagctgctgcatcagaagaatgtgaaaaaatgttaagaacgggtgatcgcgtgggccgagctgcatatgacaagaaaaagttgttactatatgctctcatatctggttctcgtaggcaaatcgaccgcctactaagagatctaccaactctttttaacaccatagaggatttcttgtggttcaaattgtcagctgtaagagactgccctggtggagctgcacccattgtcatgaatgagagcttggtaccatacactttggatgatttgcagatttacttgaacaaatttgacccctcatactatacaaaaaatggaaaggaccctctggtgtacccatatgttttgcttttaagcatccagttgataccaggtgtggtatacttgtctaaggaaactggagatgaaggatataacattgatgctgcccacatatcaattgtgctagcagaccatggggtcctttctgaaggagctggggctggacagaaaatgggcgtgatggatgcttacgcagaggcatctagcataatcaggcagtatgggtctgtgtatttacgtcttggtaatcttcagatggcattagaatattatgcacaagctgctgctgcagttggtggtgggcagttgtcatggtctggaagaggtaatgtggatcagcaaaggcagagaaatttgatgctgaagcagctccttacagaactgttgttacgggatgggggcatctatcttttacttggttcaagaggtgccggagaagaaggtgaattggggcgatttttgactgatgtaaaagagagacaacaatttctgcttgaagctgctcaccaatgtcaggaagctggattgtatgaaaagtctatagaaattcagaaacgaataggggcattctcgatggcattggatacgattaacaagtgcctttctgaagctatttgtgccctctcacgtggtagattggatggtgagagtcgaactgctggtctcattcactctggaaatgagatcttggagatgcacaaatattatcctgaaatcagtcctcaagagagggaaagtgtttcagagcagcatattgtgttaagacaacttgaggccgtactgtcaatccataaattggcaagaggaggccattatgctgatgctttgagggaggttgccagacttccatttcttccattagatcctcggacaccagatgctaccactgatgtgttccagaatttatctcctcatgtccaagcctgtgttccggacctcctgaaggttgcactcacttgtctggacaacatggtggattctgatggatcgcttcgcgccttgagggctaagattgctagcttcattgcaaataattccagcagccccccccccccccccccctttgtatgagaaagttgcccggagcttttaaagcggacaaactacggtaggtcaagatgcctgtatggtttggttgatattaccatgcatgtaaccaactgtaaaatacaatttaaagtagcagtagtactttgatgcacagttaattggatattagcaatttcctggttttgaattcaactgggcaagctgaagtgagttgtggtcggatttctccggcgacatatgagcatcaaaatcacccgcattacatatttaccgcaatgtttgtgtgtgatttaaaatcttttataatgagaaaggtgagttattctgaactccgatgtttg

SEQ ID NO: 7498 - DNA, 3040 bp, Gossypium raimondii
atatttgaaaattaaattgtaaaatattcagatcataagagggaaaagaagagggttttcttcttttttccttttgaaaattagggttttagaaaatataaattaaagagtaaaattcttgaactttccctcgcatcagtgattcacatgagagctatggcgagtgagcaaggcatgagtagttggaccgatcttctccactcatccaccaagcttcttgagcaagctgctccttctgctcagtttcctcctcttcagagaaacttagatcagttagaagcactatcaaagaagctcaaggcaaaaaccttaagaactgaggctccttctcaatccattgctgccacaaggctacttgcacgggagggaattaacgctgaacagcttacacgcgatctgaagtcttttgaattgaagacaacatttgaggatgttttccctgctgaagcaacaagcgttgaggagtatctgcagcaggttcatgaaatggcaatggtttcagccatccaagaagctcagaaggataacctcagaagttttaatgattatatgatgaaagtgttggaggaagattggcaaaaggaaaaacgggacttcttacagagtttgagcagaatttcaacattacctaagacaaacatgattgataaaagcagtggtggtattcgttcaggtcaaatggttcccatggcttctagttctcaggtttcatctggtccttctgccattgggcttctacctttagctgacaagccagttgttgagaaaaaagtgtcggtatatgctgaagttgttagaaatctgaacaatgcaagacaacaaggcttgccatttaaacctgccacagcttttaaagttgcttatgagagtttgggtactgaagcatctggtggcaaatcagttaacatgcagaaaatgtggcatcttattctgaaattaatgggtgaggattcgatgatgcggcaaagtgtttctagaaagatgtcattagtaattggtgctagacgtcacttagaatggggacatgagaaatacattatggatataatacaaagccatcctgcacaagctgctcttggtggagctgttggaaatttgcatagagttcgcgcctttcttcggattcgtttgagggattatggacttctggattttgatgcaggtgatgctcgaaggcagcctcccattgataccacttggcagcagatttatttttgcttgaggactggttattatgatgaagcaagacaagttgccctgtcatcccgtgcttctcaccaatttgcaccactgcttgcagagtggattaatggtggaggcatggtgccagcacacactgcagctgctgctgcagaagagtgcgaaaaaatgttcagaatgggtgatcgggttggtcgagcttcatatgacaagaaaaaactgttgctctatgctatcatatcggggtctcgtaggcaaattgaccgtcttctcagagatataccatcacttttcagtaccatagaggatttcctgtggttcatattgtcagcagtacaggactttcctggtggaacctcatctaatgagggcttagtaccatacagtcttgacgatttgcaagcttacctaaacaaatttgagccgtcatattacacaaaaaatggaaaggatcctctagtatatccgtacatcttgcttttaagtatccagttgctaccagctatttcatacctgtctaaagaagcaggagaggaagaataccatattgatgctgctcacatagcaattgtgctagctgacaatggggtcctttctgaagtttctggagccggacaaaagctgggagttatggatgcgtacgcagaagcttctagcattattaggcagtatggctctatgtatctacggcttggtaaccttcaaatggctctagaatattacgcacaagctgctgctgcagtaggtggtggacatgtatcgtggactgggagaggtagtgtggatcagcaaaggcagatgaacttgatgctgaagcagcttctcactgagatattgtttcgagatggtggggtttatcttttacttggttcgagaggtgctggagaggaaggtgaactgagacgatttttgactgatcataaagcaagacaacagtttctgctagaagctgcccgccaatgccaagattctgggctgtacgacaagtctatagagattcagaagagaattggagcattttcgatggcattggatacgataaataagtgcctctctgaagcaatttgtgccttatcacgtggtagattggatggtgagagtcaaactgctggcctcattcactccgggaacgagatcttggagactttcaaatattatcctgaagtcagtttccaagagagggaacatgtttcagagcaacaaaccatattaagacagctcgagactatattatcaatccataaattgacaagactaggccagtatcttgatgctctacgagaagttgccaagatcccattccttccattcgatccacgagcacctgatacatctgctgatgtgttccaaaatttatctcctcatgtccaagcttgtttgcctgatttgctaaaggttgctataacttgtttggataatgtatccgatacagatggatcacttcgagccatgagatcaaagattgcaaccttccttgcaaataatatgcgtcagaattggcctcgtgatttatacgagaaggtcgccaaaagcttgtgaagcaaatatccaacgatggtgtgaaatgcccggaaaatttgatggaatccgaggcatggtggtagaaggggaaaaaaaagaggttaatgatgagaactcatctccctttgtagccataaccttatataatttgaccagtttttattagcagagttttcaaaatgtaatagctaatcggttatactcaatggtggtaaattttttatttgatttcttgagaatatttttttaaatatattttaacaaatttatcggtagatttaataatataattggaatttgcatgcacgtaaaaatttta

SEQ ID NO: 7499 - DNA, 3005 bp, Gossypium raimondii
tattcagatcataagagggaaaagaagagggttttcttcttttttccttttgaaaattagggttttagaaaatataaattaaagagtaaaattcttgaactttccctcgcatcagtgattcacatgagagctatggcgagtgagcaaggcatgagtagttggaccgatcttctccactcatccaccaagcttcttgagcaagctgctccttctgctcagtttcctcctcttcagagaaacttagatcagttagaagcactatcaaagaagctcaaggcaaaaaccttaagaactgaggctccttctcaatccattgctgccacaaggctacttgcacgggagggaattaacgctgaacagcttacacgcgatctgaagtcttttgaattgaagacaacatttgaggatgttttccctgctgaagcaacaagcgttgaggagtatctgcagcaggttcatgaaatggcaatggtttcagccatccaagaagctcagaaggataacctcagaagttttaatgattatatgatgaaagtgttggaggaagattggcaaaaggaaaaacgggacttcttacagagtttgagcagaatttcaacattacctaagacaaacatgattgataaaagcagtggtggtattcgttcaggtcaaatggttcccatggcttctagttctcatgtttcttctggtccttctgccagtgggcttctacctttagctgacaagccagttgttgagaaaaaagtgtcggtatatgcggaagttgttagaaatctgaacaatgcaagacaacaaggcttgccatttaaacctgccacagcttttaaagttgcttatgagagtttgggtactgaagcatctggtggcaaatcagttaacatgcagaaaatgtggcatcttattctgaaattaatgggtgaggattcgatgatgcggcaaagtgtttctagaaagatgtcattagtaattggtgctagacgtcacctagaatggggacatgagaaatacattatggatataatacaaagccatcctgcacaagctgctcttggtggagctgttggaaatttgcatagagttcgcgcctttcttcggattcgtttgagggattatggacttctggattttgatgcaggtgatgctcgaaggcagcctcccattgataccacttggcagcagatttatttttgcttgaggactggttattatgatgaagcaagacaagttgccctgtcatcccgtgcttctcaccaatttgcaccactgcttgcagagtggattaatggtggaggcatggtgccagcacacgctgcagctgctgctgcagaagagtgcgaaaaaatgttcagaatgggtgatcgggttggtcgagcttcatatgacaagaaaaaactgttgctctatgctatcatatcggggtctcgtaggcaaattgaccgtcttctcagagatataccatcacttttcagtaccatagaggatttcctgtggttcatattgtctgcagtacaggattttcctggtggaacctcgtctaatgagggtttagtaccatacagtcttgacgatttgcaagcttacctaaacaaatttgagccatcatattacacaaaaaatggaaaggatcctctagtatatccgtatatcttgcttttaagtatccagttgctaccagctatttcatacctgtctaaagaagcaggagaggaagaataccatattgatgctgctcacatagcaattgtgctagctgacaatggggtcctttctgaagtttctggagccggacaaaagctgggagttatggatgcttacgcagaagcttctagcattattaggcagtatggctctatgtatctacggcttggtaaccttcaaatggctctagaatattacgcacaagctgctgctgcagtaggtggtggacatgtatcatggactgggagaggtagtgtggatcagcaaaggcagatgaacttgatgctgaagcagcttctcactgagatattgtttcgagatggtggggtttatcttttacttggttcgagaggtgctggagaggaaggtgaactgagacgatttttgactgatcataaagcaagacaacagtttctgctagaagctgcccgccaatgccaagattctgggctgtacgacaagtctatagagattcagaagagaattggagcattttcgatggcattggatacgataaataagtgcctctctgaagcaatttgtgccttatcacgtggtagattggatggtgagagtcaaactgctggcctcattcactccgggaacgagatcttggagactttcaaatattatcctgaagtcagtttccaagagagggaacatgtttcggagcaacaaaccatattaagacagctcgagactatattatcgatccataaattgatgagactaggccagtatcttgatgctctacgagaagttgccaagatcccattccttccattcgatccacgagcacctgatacatctgctgatgtgttccaaaatttatctcctcatgtccaagcttgtttgcctgatttgctaaaggttgctataacttgtttggacaatgtatccgatacagatggatcacttcgagccatgagatcaaagattgcaaccttccttgcaaataatatgcgtcagaattggcctcgtgatttatacgagaaggtcgccaaaagcttgtgaagcaaatatccaacgatggtgtgaaatgcccggaaaatttgacggaatccgaggcatggtggtgggaaaagaagaggttactgatgagaactcatctccctttgtagccataaccttatataatttgaccagtttttattagcagagttttcaaaatgtaatagttaatcggttatactcaatggtggtaaattttttttttgatttcttgagaatatttttttaaaaatattttaacaaatttatcggtagatttaatattataattggaatttgcatgcacgtaaaaa

SEQ ID NO: 7500 - DNA, 4411 bp, Citrus clementina
attaagcgaaataacaaaaactaaaccgtttgagtggaggactggagtagggcttaatatgaaatcttcttaaacccttttccctctcattgattgattcagtaaaattggaaccgagcaaaatggcgggtgagcaagacatgagtggctggaccgatcttcttcactcctcaacgaagcttctcgaacaggcagctccctctgctcagttccctcctcttcagaggaacttagatcaactagaagcattgtcaaagaagctcaaggcaaaaaccataagaaccgagactccttctcagtctattgcagccacaaggctacttgcacgtgagggaataaatgcggaacagcttgctagagatttgaagtcatttgaattgaagacaacatttgaggatgtttttcccactgaggcaactagtgtggaagaatatctgcaacaggttcatgaagttgcaatggtgtcagccatccaagaagctcagacggataaccttagaagttttaatgattacatgatgaaagttctggaggaagactggcagaaagagaaacgtgactttcttcagagcttaagccgaatttcaacattacccaagactaacatgactgatacgagcactggaggtactcttcctggtcaaatggcatccatggcttctagtcctcagatttcctcaggtccttctgggatggagcttgtacctttagctaataagccacttcttgagaaaaaagcaactgtctacgctgaagttgtgaagaacctgaacaatgcaaggcagcaagcactgccatttaaacctgctactgcttttaagggcgcttatgaaagcttggccattgaatcatctagtggaaaatcagttaacatacagaaaatatggcaccttcttcagacaatgatgggtgagcatgcaactgtgcaacagactgcttcaagaaagatgtcacttgtaattggtgcaaggcgccacctggaatggggacacgagaagtatattatggatactatacaaagtcatcctgcacaggctgcccttggtggagttgttggaaatttacagagagttcgggcttttcttcgaatacgattaagggattatggagtcttggattttgacactggtgacactcgtaggcagcctccagttgataccacttggcagcagatttatttttgcttgagaactggatactatgatgaagcaagaaacgttgccctatcatcccgtgcttcaaaccagtttgctcctttgcttacagagtggataaacactggaggtatggtgccgccggagattgcagctgctgcttctgaagaatgtgataaaatgttgagaatgggtgatcgagtaggtcgagctgcatatgacaagaaaaagttgctactctatgctatcatatctggctctcgccggcaaattgaccggctgctaagagatctaccaactcttttcggtactatagaggattttttgtggttcaaactttcagccatacgggatgtacccagtgaagctccttctgttgtcctgagcgatggcttggccccatacagtttggatgatttgcaggtttacctaaacaagtttgatccatcatattatacaaaaaatggaaaggaccctctggtatacccttatgtgttgcttttaagcattcaggtgctaccagctgttctttatttatctaaagaatcaggtgatgaggggtataatattgatgctgcccacatatcaattgtgctagcagaccacggggtcctttctgaaggttctggtgctggaaaaaaactgggattgatggatccatatgcagaggcatccagcataattaggcaatatgggtctgcttatcttcgtcttggcaatctccagatggcattagaatattatgcacaagctgctgctgcagtaggtggtggacagttgtcgtggactgggagagctaatgttgatcaacaaaggcagaaaagcttgatgctgaagcaacttctaactgaactattgttacgagatggtggaatttatcttttacttggttcaagaggagctggggaggaaggtgaattgggacgatatataactgatctcaaagctagacaacagtttttacttgaagctgctgggcagtgtcaggaagctgggctttatgataaatctatagaacttcagaagagagttggagccttctcaatggcattggatacaattaacaagtgtctctcagaagcaatttttgccatgtcccgtggtaggttggatggtgaaagtcagactgctagcctaattcattctggcaacgaaattttggagatggaaaaatattatcctgaagtcagtcttcatgaacgagagcaagttctggagcaacagactgtattgagacagcttgaggcaatattgtctgtccataagatggcaaggtcaggccattatttagatgctttgagggaggtcgccaaactcccatttcttccatttgatccacgagttccagatgccatggttgatgtgtttcagagtttatctcctcacgtccaagcttgtgtgcctgacctactgagggttgctctaacttgtctggacaatgttacagataccgatggatcgcttcgtgccatgagggcgaaggtatgctgatttgagacaaatatcaataatattcgactcttaagtatcaataacactgtattccaaaatttcgattctttccagatatccgaatacgcccccgcgacgccgccgtcgttcgtcttacacgttgctgtcgccggccgtcttgttcaaccgacgccgtcgctaactccagcgcgaatgaaacccattgcttccaactattttccgatttgaagaagtgttggaggctagttttattttttaaaattagttagttagttagcgtataatttaaacatgcccatctctgttttgttgtataatttgtttccttgtgacttgctatttgataagtagttaagaattatataacctcaaacaaattagaaggctagtagaagtcttttttcttatgcttgtggtgtatagcatttgtttgatgaaatgtctgtaagaagaattgtggtattttgtgatactttttagggcaacccttatgcagtcattctaaagcatccgtatgaacaatttcttggctaaataatagtccatgtatgtttgttacagctaactcagtttatgtgaagttgactgaataaaaaactttagcatattcaatcaaaatatttaccaataaaagcaattgataagaaagagaagcggtagagtttgtttcttagaaatgcattatctgttaattttggttatgctttattcattggtcagattatgataggcccattctactatgttgtttgcctttggtaactatctctacgtaattttctcttttgcctatttttgaaaattgttgttgggaagtctcaggtgaaaccagaatggaagaaaatgattgtgattcttgggaaaaagccagtgataacgaggacagttatgtggacgaaattgatgaagaagattattatatgtcaggttttatatccaagttacagtttaggaaagacatttcaaaggctcattggaacaatgaattgggaatggctgaggttgtagaaaagaagggtaaaatgtggacaacgacgggaattgttcgaaatggaaagacctactgctcaattgaggagactctgtaggtttttggctgaaattggggctttatatcttttggacaataatgatttgtgtctcccattaaaagagatttatgaaaagattgcaaatgaaaagtctggatgcagttgggagctttttgaagtttacaggcacctcaaatctcttggctatattgtgggacggcatggtgttccttggatcgtgaagatccccaaaggtagagatattaacatcacaagtgacccagtttctcttcaggtaactccgaaaagacatggagtcatggaggtggaaccaaaagaagagagttctctagtcgctttgttcgacaatatacaaattaatgaagtgaggccagtgtttgatgtttatcttccaaatagaaagttcaaaaagtcttgccctggggatccaagctttttgctctacttaacatgcaaggtctgtccaccatccaaggcagaaattgaagtccttgagagacaatgtggcagtattccattgaagttttgtcatgtagagcaaggtcgtgttagtttcttttcctttgatagtgtggagcttcctattctcccctgactcgctgatgcattttcgagaacgaatgcacaaaacaagagcagtatgtcaagtaaattttagattagtaattcaatagtgtgcgacttataattctttaaaattaatacaaattagtgggaccaagtggctctgaa

SEQ ID NO: 7501 - DNA, 2334 bp, Glycine max
caaaaaaaaaaaacccgagtaaggagactgagaaaacagaactatacaaaatggaagatacactttctgcgttgaggtctttgatgctttctcagtctccaccgcttgatgccttagttgttccttctgaagattatcaccagagcgaatatgtgtccgcacgagacaagcgccgcgaattcgtttccggcttcactggaagtgccggcttggcacttataacaaagaatgaagcactgctgtggacggatggacgatattttttgcaggctgagcaagaacttagtgctcagtggaagcttatgcgtattggtgaagatcctgctgtagatatctggatggccgataatttgccaaaagaggcatccattggggttgacccttggtgcatttcaattgatactgctcaaagatgggagcgtgcttttgccgaaaaacagcaaaagctggttccaacctcaaaaaatttggtggatgaagtttggataaatcgcccacagccacagattaatgctgttatcgtacatccactgaaatttgcaggtcgctctgttgcagacaagttgaaagatttgagaaaaaagcttgtacatgagcaagcccgcgggataattttcacagcacttgatgaagttgcatggttgtataatattcgtggaagtgatgtggcctactgtcctgttgttcatgcatttgctattgtgacatccaattctgctttcatttatgtggacaaacgaaaggtttctgttgaggtacaagctcatttagtggagaatggaattgaaattcgagagtatacagctgtaagctctgatacgacattgcttgcaactgatgagcttgattctgtatctaccgccaaggttgctttagctgaaacagaggtccgaaaaattcccaatgaaactgctaagcatgcaaatggtgaacatcaagcagaagaaaatagtaatgacctcatatgggctgatccaggttcatgctgttatgcactgtatgcaaagttgaaccctgatacagttctcttgcatcaatcacctttggcccttgcgaaagctttaaagaactcggtggaattggacgggttaaagaaggcacatattcgggatggtgcagcggtcgtgcagtatcttgtctggctggataagaagatgcaggatattttgggagcttctggttactttttggagaacgattctgtgaaaaaggagaaacatttgcagtctttgaaattgactgaggtgactgtaagtgaccagcttgaaggttttcgagcatcaaaagagcatttcagaggattgagtttccccactatttcttcagttggcccaaatgcagctataattcattattctccaaaggcagaaacatgtgctgaacttgatccagacaaaatttatctttttgattctggagcccagtatctagatggaacaacagatattacacgaacagttcattttggtaaaccttcgactcacgaaaaagcgtgttatacagcagtcctaaagggtcacattgctcttggaaatgctagatttcccaatgggacaaatgggcattctcttgatattcttgctcgaattcctttgtggaaggatggtcttgattatcgacatggtactggtcatggaattgggtcctatttgaatgttcatgaaggacctcacttaatcagtttcagaccacaggctcgaaatgtaccattgcaatcttccatgactgttacagatgaacctggttactatgaggatggagagtttgggataagattggagaatgtgcttattgtcaaagaggctggtacaaatttcaattttggtgatagaggttacttatcttttgaacacattacctgggcaccatatcagaccaagttgattgacctgaaccttctatgtcctgaggagatagattggctgaactcgtatcactccacatgcagagatattctagcgccatatttgaatgaagttgaaaatgcatggctgaaaaaagccactgaacccgtaggtgcatgagctgtgtttggatttgaaaagttaataacttacgttggttcagcgtaattttagtgtcttccgtatccttttactgtaatatcaatattctgctgcatcatatttgagggcgtgtacaacgttaaattgtctatccgtacggcatcactgcgtgcatcagctctttttcttttccctaatattgtttataaataagatggatcttgtacctaaaaatgatgaaccactagtacaaatgaaacttgaaagtgttcgaaatttaattcttaggtactttgattgacggttcgtaattggatttaaccatttt

SEQ ID NO: 7502 - DNA, 2278 bp, Glycine max
cgagtaaggagactgagaaaacagaactatacaaaatggaagatacactttctgcgttgaggtctttgatgctttctcagtctccaccgcttgatgccttagttgttccttctgaagattatcaccagagcgaatatgtgtccgcacgagacaagcgccgcgaattcgtttccggcttcactggaagtgccggcttggcacttataacaaagaatgaagcactgctgtggacggatggacgatattttttgcaggctgagcaagaacttagtgctcagtggaagcttatgcgtattggtgaagatcctgctgtagatatctggatggccgataatttgccaaaagaggcatccattggggttgacccttggtgcatttcaattgatactgctcaaagatgggagcgtgcttttgccgaaaaacagcaaaagctggttccaacctcaaaaaatttggtggatgaagtttggataaatcgcccacagccacagattaatgctgttatcgtacatccactgaaatttgcaggtcgctctgttgcagacaagttgaaagatttgagaaaaaagcttgtacatgagcaagcccgcgggataattttcacagcacttgatgaagttgcatggttgtataatattcgtggaagtgatgtggcctactgtcctgttgttcatgcatttgctattgtgacatccaattctgctttcatttatgtggacaaacgaaaggtttctgttgaggtacaagctcatttagtggagaatggaattgaaattcgagagtatacagctgtaagctctgatacgacattgcttgcaactgatgagcttgattctgtatctaccgccaaggttgctttagctgaaacagaggtccgaaaaattcccaatgaaactgctaagcatgcaaatggtgaacatcaagcagaagaaaatagtaatgacctcatatgggctgatccaggttcatgctgttatgcactgtatgcaaagttgaaccctgatacagttctcttgcatcaatcacctttggcccttgcgaaagctttaaagaactcggtggaattggacgggttaaagaaggcacatattcgggatggtgcagcggtcgtgcagtatcttgtctggctggataagaagatgcaggatattttgggagcttctggttactttttggagaacgattctgtgaaaaaggagaaacatttgcagtctttgaaattgactgaggtgactgtaagtgaccagcttgaaggttttcgagcatcaaaagagcatttcagaggattgagtttccccactatttcttcagttggcccaaatgcagctataattcattattctccaaaggcagaaacatgtgctgaacttgatccagacaaaatttatctttttgattctggagcccagtatctagatggaacaacagatattacacgaacagttcattttggtaaaccttcgactcacgaaaaagcgtgttatacagcagtcctaaagggtcacattgctcttggaaatgctagatttcccaatgggacaaatgggcattctcttgatattcttgctcgaattcctttgtggaaggatggtcttgattatcgacatggtactggtcatggaattgggtcctatttgaatgttcatgaaggacctcacttaatcagtttcagaccacaggctcgaaatgtaccattgcaatcttccatgactgttacagatgaacctggttactatgaggatggagagtttgggataagattggagaatgtgcttattgtcaaagaggctggtacaaatttcaattttggtgatagaggttacttatcttttgaacacattacctgggcaccatatcagaccaagttgattgacctgaaccttctatgtcctgaggagatagattggctgaactcgtatcactccacatgcagagatattctagcgccatatttgaatgaagttgaaaatgcatggctgaaaaaagccactgaacccgtaggtgcatgagctgtgtttggatttgaaaagttaataacttacgttggttcagcgtaattttagtgtcttccgtatccttttactgtaatatcaatattctgctgcatcatatttgagggcgtgtacaacgttaaattgtctatccgtacggcatcactgcgtgcatcagctctttttcttttccctaatattgtttataaataagatggatcttgtacctaaaaatgatgaaccactagtacaaatgaaacttgaaagtgttcgaaatttaattctta

SEQ ID NO: 7503 - DNA, 2281 bp, Cajanus cajan
aaaagcaaagtggcgagactgagaaaatagaacgaaaggaaatggaagacacgctttcgaagttgaggtctttgatggcttctcactctcccccgcttgatgccttagtcgttccctccgaagattatcaccagagcgaatacgtatctgcacgagacatgcgccgccaattcgtttccggcttcaccggaagtgctggcttggcccttataacaaagaatgaagcactgctgtggaccgatgggcgatattttttgcaggctgaacaagaacttagtgatcagtggaagctaatgcgaattggtgaagatcctgctgtagatacctggatggctgataatttgccaaaagaggcttccattggggttgacccttggtgcatttcaattgatactgcccaaagatgggagcgtgcttttgccgaaaaacagcagaagctggttcaaaccacaaaaaatttggtagatgaagtttggataaatcgcccaccagaagagattaatgctgttattgcacatccactgaaatttgcaggtcgctctgttgcagataagttgaaagatttgagaaaaaaacttttacaggagcaagcccgtgggataattttcacagcgcttgatgaagttgcatggttgtataatattcgtggaagtgatgtggcctactgtcctgttgttcatgcatttgctattgtgacatccaattctgctttcatttatgtggacaagcgaaaggtttctgctgaggtacaaactcatttagtggagaatggaattgaaattcgagagtatagagctgtgagctccgatgtgacattgcttgcaactgatgagcttgatgctatatctactgacaagagagtaaatggtgaacatcaagcacaagaaaataagaatgacctcatatgggctgatccaggttcatgttgttatgcactgtatgcaaagttgaatcctgatacagttctcttgcagcaatcacctttggcccttgcaaaagctttaaagaactcggtggaaatggatgggttaaaaaaggcacatattcgagatggtgcagcagttgtgcaataccttgtttggctggataagaagatgcaggatatttatggagcttctggttactttttggagaaggattctgtgaaaaaggagaagcatttgcagtccggaaaattgactgaggtgactgtaagtgaccaacttgaaggttttagagcatcaaaagagcatttcagaggattgagtttccccactatttcctcggttggcccaaatgcagctatcatccattattctccaaaggcagaaacctgtgccgaacttgatccagacaaaatttatctttttgattctggagcccagtatctagatggaacaacagatattacacgaacagttcattttgggaaaccttctgctcatgaaaaagcgtgttatacagcggtccttaagggtcacattgctcttggaaatgctagatttcccaatggaactaatggtcacgcccttgatattcttgcccgaattcctttgtggaaggatggtcttgattatcgacatggtactggtcatggtattgggtcctatctgaatgttcatgaaggacctcacttaatcagtttcagaccacatgctcgaaatgtaccgttgcaatcctccatgactgttacagatgaacctggttactatgaagatggggagtttgggataagattggagaatgtgcttattatcaaggaggctgatacaaaattcaattttggtgataaaggttacttatcttttgagcacattacctgggcaccatatcaagcgaagttgattgacctgaaccgtctaaatcctgacgagataaattggctgaactcctatcactccacatgtagagatattctggcgccatacttggatgaagttgaaaatgcatggctgaagaaagccactgaacctgtagcggcatgagctgtgtttgcagttgaatagttaataacttgtgttgcttcagcgttattcatgcagtgtctccgtttccgtattctctataatcttgactttagatgccattggaatggctattccttcacatcagtatgcagcatgtatcaatataataattctgccgcatatttgtgaatgtacaatgttaaattgcctatccactcggcgtcagctcttttcttttgcacaatattgagatattataaattagatggatctagtacctaaaaatgatagaatgatgtaatttattatcagtacttaaatctttagactaggta

SEQ ID NO: 7504 - DNA, 2491 bp, Phaseolus vulgaris
gttgtattgcagtagctcaggactataagcagagagattacgcaaaatcaagagaaagaaaatggaagacacactttcagggttgaggtctttgatggctactcactctcctccactcgatgccttagttgtgccttctgaagattatcaccagagcgaatacgtatctgcacgagacaagcgccgcgaattcgtttcgggcttcactggaagcgctggcttagcactcgtaacgaagaacgaagcgctgctttggacggatggaagatattttttgcaggctgagcaagagcttagtgctcagtggaagctaatgcgtatcggtgaagatccttctgtagatatctggatagctgataacttgccaaaagaagcatttattggggttgacccttggtgcatttcaatcgatactgctcaaagatgggagcgagctttttctgaaaaacagcagaagctggtccaaaccacaaaaaatttggtagatgaagtttggaaaaatcgaccacaggcagagattaatgctgttattgtacatccactgaaattcgcaggtcgctctgttgcagataagttaaaagatttgagaaaaaggcttctgcaagagcaagcccgtggtataattttcacagcacttgatgaagttgcgtggttatataatattcgtggaagtgatgtggactactgtcctgttgttcatgcgtttgctattgtgacaatcaataccgctttcatttatgtagacaagcgaaaggtttctgttgaggttcaagctcatttagtggagaacgagattgaaattcgagagtatacagatgtaagctctgatgttacattgcttgcaacagatgagcttgatactgtatctacggtcaagagagtaaatggtggacatcaagcagaagaaaatagcaacctcatatgggctgattcaggttcatgctgttatgcactgtatgcaaagttgaaccctgatacagttttgttgcagcaatcacctttggctcttgcaaaagctttaaagaactcggtggaattggatggtttaaaaaaggcgcatattcgtgatggtgcagcggtcgtgcaatatcttgtctggctggataagaagatgcaggatgtttatggagcttctggatactttttggagaaggattctgtgaaaaaggagaagcagttgcagtccttgaaattgactgaggtgactgtaagtgaccagcttgaaagtttccgagcatccaaagagcatttcaaaggattgagtttcccaactatttcgtcagttggcccaaatgcagctatcattcattattctcctaaggcagaagcatgtgctgaacttgatccagacaaaatttatctctttgattctggagcccagtatctagatggaacaacagatattacacgaacagttcattttgggaaaccttcaactcatgaaaaagcgtgttacacagcagtactaaagggtcacattgctcttggaaatgctagatttcctaatgggacaaatgggcatgctcttgatattcttgctcgaattcctttgtggaaagatggtcttgactatcggcatggtactggtcatggaattgggtcctatctcaatgttcacgaaggacctcacctaatcagtttcagaccacatgctcgaaatgtaccattgcaatcttttatgactgtcacagatgagcctggttactacgaggatggagcgtttgggataagattggagaatgtgcttattgtcaaagacgctgatacaaaattcaattttggtgataaaggttacttatcgtttgagcacattacctgggcaccatatcaagcgaagttgattgacctgaaacttttaagtcctgacgagataaattggctgaactcttatcactccacatgtagagatattctagcgccatatttggatgaagttgaaagtgcttggctgaagaaagctactgaacctataggtgcatgataagttaataacttacgttgcttcagcgttatttttatggccattttcttccgtatccctattatactgtaatctagattttagatgcattgagatgcctattccttcgaatcaatatgcagcgtatatcaattctgcatatttagaatgttaactgtctatccattcggcattcctgcatcggctcttttctttttccttgtattgtaaataagtcggatcttgtacctaaaactcatgaaccactagtacagatgaaagtgaacggaatttcattttaccatttttatcaccaaccattggttttctgaccacataacatttcctcagtctctaccgtttaggaaaatccctggagaaaatgcatttttgaacacgtctaagaattagtgataaatgcattttgtcttcaaatattaatgaaaagttatacaacatcatgtgatagtttttctcaaagaacacgctagttcttgtagacaagaagagatgttgaacactttcatcttg

SEQ ID NO: 7505 - DNA, 2448 bp, Phaseolus vulgaris
aaggtattaccaatttaccattcatttcgtaggaatttgatgggtccctgattgaagaggtgcaaacggcatagcatagtcgctctctatataaacccaaccgatcagagttagttgtattgcagtagctcaggactataagcagagagattacgcaaaatcaagagaaagaaaatggaagacacactttcagggttgaggtctttgatggctactcactctcctccactcgatgccttagttgtgccttctgaagattatcaccagagcgaatacgtatctgcacgagacaagcgccgcgaattcgtttcgggcttcactggaagcgctggcttagcactcgtaacgaagaacgaagcgctgctttggacggatggaagatattttttgcaggctgagcaagagcttagtgctcagtggaagctaatgcgtatcggtgaagatccttctgtagatatctggatagctgataacttgccaaaagaagcatttattggggttgacccttggtgcatttcaatcgatactgctcaaagatgggagcgagctttttctgaaaaacagcagaagctggtccaaaccacaaaaaatttggtagatgaagtttggaaaaatcgaccacaggcagagattaatgctgttattgtacatccactgaaattcgcaggtcgctctgttgcagataagttaaaagatttgagaaaaaggcttctgcaagagcaagcccgtggtataattttcacagcacttgatgaagttgcgtggttatataatattcgtggaagtgatgtggactactgtcctgttgttcatgcgtttgctattgtgacaatcaataccgctttcatttatgtagacaagcgaaaggtttctgttgaggttcaagctcatttagtggagaacgagattgaaattcgagagtatacagatgtaagctctgatgttacattgcttgcaacagatgagcttgatactgtatctacggtcaagagagtaaatggtggacatcaagcagaagaaaatagcaacctcatatgggctgattcaggttcatgctgttatgcactgtatgcaaagttgaaccctgatacagttttgttgcagcaatcacctttggctcttgcaaaagctttaaagaactcggtggaattggatggtttaaaaaaggcgcatattcgtgatggtgcagcggtcgtgcaatatcttgtctggctggataagaagatgcaggatgtttatggagcttctggatactttttggagaaggattctgtgaaaaaggagaagcagttgcagtccttgaaattgactgaggtgactgtaagtgaccagcttgaaagtttccgagcatccaaagagcatttcaaaggattgagtttcccaactatttcgtcagttggcccaaatgcagctatcattcattattctcctaaggcagaagcatgtgctgaacttgatccagacaaaatttatctctttgattctggagcccagtatctagatggaacaacagatattacacgaacagttcattttgggaaaccttcaactcatgaaaaagcgtgttacacagcagtactaaagggtcacattgctcttggaaatgctagatttcctaatgggacaaatgggcatgctcttgatattcttgctcgaattcctttgtggaaagatggtcttgactatcggcatggtactggtcatggaattgggtcctatctcaatgttcacgaaggacctcacctaatcagtttcagaccacatgctcgaaatgtaccattgcaatcttttatgactgtcacagatgagcctggttactacgaggatggagcgtttgggataagattggagaatgtgcttattgtcaaagacgctgatacaaaattcaattttggtgataaaggttacttatcgtttgagcacattacctgggcaccatatcaagcgaagttgattgacctgaaacttttaagtcctgacgagataaattggctgaactcttatcactccacatgtagagatattctagcgccatatttggatgaagttgaaagtgcttggctgaagaaagctactgaacctataggtgcatgagctgcctttggagttgataagttaataacttacgttgcttcagcgttatttttatggccattttcttccgtatccctattatactgtaatctagattttagatgcattgagatgcctattccttcgaatcaatatgcagcgtatatcaattctgcatatttagaatgttaactgtctatccattcggcattcctgcatcggctcttttctttttccttgtattgtaaataagtcggatcttgtacctaaaactcatgaaccactagtacagatgaaagtgaacggaatttcattttaccatttttatcaccaaccattggttttctgaccacataacatttcctcagtctctac

SEQ ID NO: 7506 - DNA, 2354 bp, Arachis hypogaea
aagctaaactgtgattgagaaaaattagcgaagtagaagaaaatggaagacacactctctgctttgaggtcattgatgtcttctcactctccttctcttgatgccttagttgttccttccgaagattatcaccagagtgaatatgtatctgcaagagataagcgccgcgagttcgtttccggcttcagtggaagtgctggtttggcacttataacggcgaaagaagcactcttgtggacggatggacgatattttttgcaggcagagcaacagcttagtgatcaatggaagctaatgcgcattggcgaagatcctgctgtggatgtttggatggctgataacttgcctaaagatgcatctattggggttgatccatggtgcatttcggttgatactgcccaaagatgggaacgtgcttttgctgaaaaacatcagaagctggttcaaacgacaaaaaatttggtagatgaagtatgggcaaagcgacctccagaacagattaatgctgttattgtacatccattggaatttgcaggtcgctctgttgcagataagttgcaagacttgagaaaaaggcttgcgcaagagcgagcccgtggcatcattttcacagctcttgatgaagttgcctggttatacaatatccgtggaagtgatgtggcatactgtcctgttgttcatgcatttgctattgtgacaactaattctgctttcctttatgtcaacaaggaaaaagtatctgttgaggtaaaaactcatctagaggagaatggaattggaattcgagactatacagccgtgagctctgatgcagcattgctcgcaactgatgagcttgatgctctgtctactgccaaaggttctctagctgcagttacaaaggaagcagaaaagactcacaatgagctcaacaagggagtaaatggtgaacatctagctgaagaacatagtaatgactttgtatgggttgatccaggaacatgctgttatgcactgtattcaaaattgaactctcagacagttattctacagcagtcgcctttggcccttgcaaaagctttgaagaacccagtggagttggatggattaagaaaggcgcatgttcgggatggcgcggctgttgtgcaatatcttgtctggctagataagaagatgcaggaaatttatggagcgtctggttactttttagagggtaattctgtgaaaaaagaaaaaggattggagtccttgaaattgactgaggtgactgcaagtgacaaacttgaaggttttcgagcatcaaaagagcatttcagaggattgagtttccctactatttcctcagttggctcaaatgcagctatcattcactattctccacaggcagagacatgtgctgaacttgatccagacaaaatttatctagttgattctggagctcagtatctagatggaacaaccgatattacacgaactgttcattttgggaaaccttcagcacatgagaaagcatgttatacagcagtcctcaagggtcacattgctcttggaaatgctagatttcctaatggaacaaacggtcatgctcttgatattcttgctagagtcccactgtggaaggatggtcttgattaccggcatggtactggacatggaattgggtcctacctgaatgttcatgaaggacctcatttaatcagtttcagaccacaggctcgaaatgtaccacttcaatcttccatgactgttacagatgaacctggttattacgaagatggaaattttgggataagattggagaatgtgctcattgtcaatgaagctgatacaaaattcaattttggtgataaagggtacttgtcatttgaacacattacctgggcaccataccagacgaagttgattgacctgaaccttctaatgcctgacgagataagttggctgaacgcgtatcactcgaaatgtagagatattctggcaccatatttggatgtcgctgaaaatgcatggctacagaaagccactgaaccggtagctgtgtgagctttgttctgagctgggaatgtcaacgacttcaatatctgcactgtccttagtttccacacattacaactactatttgatgccctgttgaggtagctgttccttaaaactcgtacagcattgaaattccgaatgcgtatccccttggcatcaatttttcttttggtgacttcttggcatcagtttatgcctagttgttttcttacttgttattagaatattactatcaacgtattactgtaaagtgatgaacagtgatgaaccttgtactaaagtgaaagaagtgaactgtcgaaacgacagctgaaagtggaccaggttttattggaaaa

SEQ ID NO: 7507 - DNA, 2480 bp, Arachis hypogaea
acgcgggggaatctgaatccgtcgtggacctcgcttcgaggtgcgtctcagtgtcactataatatacaaatgcgtcgctgagaaccgaacttgttttggaggctaagctaaactgtgattgagaaaaattagccaagtagaagaaaatggaagacacactctctgctttgaggtcattgatgtcttctcactctccttctcttgatgccttagttgttccttccgaagattatcaccagagtgaatatgtatctgcaagagataagcgccgcgagttcgtttccggcttcactggaagtgctggtttggcacttataacggcgaaagaagcactcttgtggacggatggacgatattttttgcaggcagagcaacagcttagtgatcaatggaagctaatgcgcattggcgaagatcctgctgtggatgtttggatggctgataacttgcctaaagatgcatctattggggttgatccatggtgcatttcggttgatactgcccaaagatgggacgtgcttttgctgaaaaacgtcagaagctggcctcaacgacaaaaaatttggtagatgaagtatgggcaaagcgacctccagaacagattaatgctgttattgtacatccattggaatttgcaggtcgctctgttgcagataagttgcaagacttgagaaaaaggcttgcgcaagagcgagcccgtggcatcattttcacagctcttgatgaagttgcctggttatacaatatccgtggaagtgatgtggcatactgtcctgttgttcatgcatttgctattgtgacaactaattctgctttcctttatgtcaacaaggaaaaagtatctgttgaggtaaaaactcatctagaggagaatggaattggaattcgagactatacagccgtgagctctgatgcagcattgctcgcaactgatgagcttgatgctctgtctactgccaaaggttctctagctgcagttacaaaggaagcagaaaagactcacaatgagctcaacaagggagtaaatggtgaacatctagctgaagaacatagtaatgactttgtatgggttgatccaggaacatgctgttatgcactgtattcaaaattgaactctcagacagttattctacagcagtcgcctttggcccttgcaaaagctttgaagaacccagtggagttggatggattaagaaaggcgcatgttcgggatggcgcggctgttgtgcaatatcttgtctggctagataagaagatgcaggaaatttatggagcgtctggttactttttagagggtaattctgtgaaaaaagaaaaaggattggagtccttgaaattgactgaggtgactgcaagtgacaaacttgaaggttttcgagcatcaaaagagcatttcagaggattgagtttccctactatttcctcagttggctcaaatgcagctatcattcactattctccacaggcagagacatgtgctgaacttgatccagacaaaatttatctagttgattctggagctcagtatctagatggaacaacggatattacacgaactgttcattttgggaaaccttcagcacatgagaaagcatgttatacagcagtcctcaagggtcacattgctcttggaaatgctagatttcctaatggaacaaacggtcatgctcttgatattcttgctagagtcccactgtggaaggatggtcttgattaccggcatggtactggacatggaattgggtcctacctgaatgttcatgaaggacctcatttaatcagtttcagaccacaggctcgaaatgtaccacttcaatcttccatgactgttacagatgaacctggttattacgaagatggaaattttgggataagattggagaatgtgctcattgtcaatgaagctgatacaaaattcaattttggtgataaagggtacttgtcatttgaacacattacctgggcaccataccagacgaagttgattgacctgaaccttctaatgcctgacgagataagttggctgaacgcgtatcactcgaaatgtagagatattctggcaccatatttggatgtcgctgaaaatgcatggctacagaaagccactgaaccggtagctgtgtgagctttgttctgagctgggaatgtcaacgacttcaatatctgcactgtccttagtttccacacattacaactactatttgatgccctgttgaggtagctgttccttaaaactcgtacagcattgaaattccgaatgcgtatccccttggaatcaatttttcttttggtgactacttggcatcagtttatgcctagttgttttcttacttgttattagaatattactatcaacgtattactgtaaagttatgaacagtgatgaaccttgtactaaagtgaaagaagtgagctgtcgaaacgacagctgaaagtggaccaggttttattggaaaatacttttgtgttgcctgacggct

SEQ ID NO: 7508 - DNA, 2969 bp, Cicer arietinum
gtaaaaatctcgaactctatcacttggggcactcaagataagttataactactataacaaactatatgcgcaacaaatcttgtatgatcaaataataaatccgtaaccgttaaaaacaaagcaacagtgacgatcgttctatatcaagtagaatagaatctatctatataataaagctgtcagcattataatttatcatttcatttctcactcaaaaactcgaaagtcttaagcggcgtgactcagaaaccaaaacgaaacggaaaagaaatggcagacacactctctgctttgaggtctttgatggcttctcactctccgcctctccatgccttagttgttccctctgaagattatcatcagagtgaatatgtatctggacgagacaagcgtcgccaattcgtttctggcttcactggaagtgctggtttggcacttataacaaaggatgaagcattgctttggaccgatggacgttattttttgcaggctgaacaacaacttagtgatcagtggaaactgatgcgtatggccgaagatcctgctgtagatatatggatggctgataacttgccaaaagatgcagccattggggttgacccttggtgcatttcaattgatactgctcaacgatgggaacgtgcttttgccaaaaaccagcagaagctggtccaaactacaaaaaatttggtagatgaagtttggacaaatcgtccaccagcagagattaatgcggtcactgtacagccattaaagtttgcaggccgttctgtcacagataagttgaaagatttgagaaaaaagcttgtacaggagcatgctcgaggaataatttttacaacactcgacgaagttgcatggctgtataatattcgtggaaatgatgtggcatattgtccggttgttcatgcatttgctattgtgacatccaattctgccttcatttatttggacacacgaaagttgtctattgaggtaaaaactcatttagaggagaatggaattgaaatcaaagagtatacatcagtaagctttgacgtggcattacttgcgactgatgagcttgattccgtgtctactggtactcttgctgaagtttcgaaggaatctgcaaagattcccagtgaaacccataagagcgtaaatggtaaacatcaagcaggagaaaatagtagcaacttcatatgggctgatccaggttcatgctgctttgctttgtattcaaaactgaatcctgatacagttctcttgcagcaatcacctctggctcttccaaaagctttaaagaacccagtggaattggatgggttaagaaaggcacatattcgggatggtgcggctgttgtgcaatatcttgtttggctggataagaagatgcaagaaatttatggagcatctggatactttttagaggagaattctgttaaaaaggagaaacatttgaaacccttgaaattgactgaggtgactgtaagtgacaagcttgaagagttccgagcatcaaaagagcatttcagaggattgagtttccctactatttcttccgttggcccaaatgccgctattattcattattctccacaggcagacacatgtgccgagcttgatccagacaaaatttatctttttgattctggagcccagtatctggatggaacaacagatattacacgaacagttcattttgggagaccttcggatcatgaaaaatcatgttatacagcagtcctaaagggtcacattgctctgggaaatgctaaatttcctaatgggacaaatggtcacacgcttgatattcttgctcgaattcctttgtggaactatggccttgattatcgacatggaactggtcacggtattgggtcctacctgaatgtccatgaaggacctcaattaatcagtttcagaatacgaaatgtaccactgcaatcttccatgactgttacagatgaacctggttactatgaggatggagaatttgggatacgattggagaatgtgcttattgtcaaggaggctgatacaaaatttaattttggtgataaaggttacttgtcttttgagcatattacctgggcaccataccaaacgaagctgattgacctgaaccttctaaatccagaagagataaattggttgaactcctatcattccaagtgtagagatattttggcgccatatttggatgaagctgaaaatgcatggctgaagaaagccactcaacctgtcgctgtgtgagttgtattctgaattgaaaagttaagaaagtacgttgtttcagagtaaaataatgtgtgctgtcttgagtatccatagtgtttactgtattttagattttaaatgtccttcctattgggatgaccaatccttcaaattagtatacaccatgtacatttactctgctgctcattatataaggtttactcatgtgttgaattgcatattcactcagtaagagtccttttgtattacctagtagttttatcatcatcaacctaattttgcaaataagatgatgaatcttttgcctttcgcctgaaaaggacaagaaccaagttttattccaagatgctctcttgcttgacagctcgtaattgagttagccatttttagggggctgtcagggtgagtggttttcctcactgttgaaagaagacatttgtttgcagtccttgcgtataggatatcacttgaagcataagtttaccctttacagaagtatcttttatatagtacaaaacttaaccatgacagtagctaaaaatgttggggcatttacttagtctgattttaagattatctctatttctgttatattttggtagtgagatatatgttctttagcaattgtatgagtgaaggaatttggcgggaagaaaaatagatattactcatacaaatagatcgtctcattttatatatagttttatggtatcaacgtagtatcattgttgtttttctattatatc

SEQ ID NO: 7509 - DNA, 2410 bp, Lupinus angustifolius
aaaaatgacagaaacactctctgctttgaggtctttgatggcttcacactctccacctcttcatgccttaatcgttccttctgaagattatcatcagagtgaatatgtatctgaacgagacatgcgccgcagattcgtttccggcttcagtggaagtgctggtttggcgctcataacaaagaatgaagcgttgctgtggaccgatggacggtattttttgcaggcagaacaagaactcagtgatcagtggaagctaatgcgtcttggtgaagatcctcccgtcgatatctggatggctgataacttgccaaaagatgcatccattggggttgacacttggtgcatttcaatagataccgcccaaagatgggagcgtgctttttctggaaaacagcagaagctagttgaaactacaaaaaatttggttgatgaagtatggataaatcggccaccggcagagattaatgctgttaccatacaaccattgaaatttgcaggtcgctctgtgggagataagttgaaagatttgagaaaaaaacttgtgcaggagcaagcccgtggtattattttcactgcacttgatgaagttgcatggttgtataatattcgtggaagtgatgtggcatacagccctgttgttcacgcatatgccattgtgacatccaattctgctttcatttatgtagacaagcaaaaggtgtctgctgaggtaaaatctcacctagaagagaacgggattgaaattaaagattatacagcagtaagctctgatgttgcattgcttgcatataataagcctgctgctgggcctactgccaacggtgctctagcggaagtcacaaaggaggccggaaaaacatccagtgagaccaatagcagcataaatagtaatcatcaagctgaggaaaaaagcaacgaccttatatgggctgatcctggttcctgctgttatgcactatatttgaaattgaacgctgacactgttctcctgcagcagtcacctttggcccttgcaaaagctttaaagaacccagtggaattggaagggttaagaaattcacatattcgagacggtgcagctgttgtgcagtatcttgtctggctggataagcagctgcaagataattacggggcatctggttactttttggagggaaatgctgtgaaaaaggaaaaccatttgcagtccttaaaactgactgaggttactgcaagtgacaagcttgaaggattccgagcatcaaaagagcatttcagaggattgagtttccccactatttcctcagtcggtgcaaatgcagctataattcattataaaccacaggccgaaacatgcgccgagcttgatccagacaaaatttatctttttgattccggagcccagtatctagatggaacaactgatattacacgaacagttcatttcgggaaaccttcggctcacgagaaagcatgttatacagcagtccttaagggtcacattgctctcggaaatgctacatttcctaatgggacaactggttattcccttgatattcttgctcgtattcctctatggaagtatggtcttgattatcgacatggtactggtcatggagttgggtccttcctgaatgttcatgaaggtcctcatttaatcagtttcaggccacaggttcgaagtgtaccattgcaatcttccatgactgttacagatgaacctggttactacgaggatggaaatttcggcataagattggagaatgtgcttgttgtcaatgaggctgataccaaattcaattttggtgacaaaggttacttatcattggaacacattacctgggcaccataccaaacaaagttgattgacctgaaccttctattgcctgatgagataaattggctgaactcatatcacaaaacctgtagagatattctggcaccatatttggatgaggctgaaaatgcttggctgaagaaagccactgaacctataggtgtgtaagctgtgtttggggttggaaagttaataaattatgttgcttaagcttaatatctattatatcttcagcattcatattgtagattttacatgtttgttgggatggccattccttcaaataagtatcctacatatctgtttgactcacgctcagttattttcttttcaacctattatttgtaagtaaagatgaactttgtacctaataaagagacgaagaacctcaaaaatagattgaatgggtacaagttttattggaaaatgttttcttccttcatgggtcgtgatagtgaaaattagtagctttccttggcatacaatatattacttagtgcttagagatccaagacactgcttaagcataaattctctctggaacgatacaaaaatatatgcgaacacagtatcaaaatgaataatacacatact

SEQ ID NO: 7510 - DNA, 2294 bp, Medicago truncatula
atcatttgtaacacaaactcgaaaatcattagttcagcggtgagacttctgaagcaaaacaaaaaaaataaaaatggcagacacactctctgctttgcgttctttgatgtcttctcactctccacctcttcatgccttagttgttccttctgaagattatcaccagagtgaatatgtatctgcacgtgacaagcgtcgtgcatttgtttctggattcactggaagtgctggtttggcacttataacaaaggatgaagcacttctttggaccgatggacgttattttctgcaggctgaacaacaacttagtgatcagtggaagctaatgcgtctagctgaagatcctgctgtagatatctggatggctgataacttgccaaaagatgcagcaattggggttgacccctggtgcatttcaatcgatactgctcaaagatgggaacgtgcttttgccaaaaaacagcagaagctggtccaaacaacaaagaatttggttgatgaagtatggacaacacgcccaccagcagaaattaatgctgccgttgtacaaccattaaagtttgcaggtcgctctgtcacagataagttgaaagatttgagaaaaaagcttgcacaggagcatgctcgaggaatagttttaacagcactcgacgaagttgcttggctgtataatattcgtggaaaagatgtggcatactgtcctgttgttcacgcatttgctattgtgacatccaattctgccttcatttatgtggacaagcgaaaggtgtctattgaggttaaaactcatttagaggagaatggaattgaaattaaagagtatacagaagtaagcttagatgcggcatttcttgcgactaatgagcttgattctgtgtctactgccaaggctagtctagctgaagtgacgaagcaatctgaaaacagtgaaaccaataagagtgtaaatggtaaacatcaaacaggagaaaagtgtagcaacctcatatgggctgatccagcttcatgctgttatgcactgtattccaaactgaaccctgatgcagttgtcttgcagcaatctcctctggctctcccaaaagctttaaagaacccagtggaattggatgggttaagaaaggcccatgttcgggatggtgcggctgttgtgcaatatcttgtttggctggataataagatgcaggatatttatggagcatctggatactttttggaggagaacaccgtaaaaaaggagaaacctttgaagtccttgaaattgactgaggtgactgtaagtgacaagcttgaagaatttcgagcatcaaaagagcatttcagaggattgagtttccctactatttcttcagtaggcccaaatgcagctattattcattattctccacaagcagaaacatgtgccgagcttgatccagacaaaatttatctttttgattctggagcccagtatctggatgggacaactgatattacacgaacagttcatttcgggagaccttcggatcatgaaaaagcatgttatacagcagtcctaaagggtcacattgctttgggaaatgctagatttcctaatggaacaaatggtcaccaacttgatattctttctcgaattcctttgtggaactatggtcttgattatcgacacggaactggtcacggtattgggtcctacctgaatgtccatgaaggacctcatttaatcagtttcagaatacgaaatgtaccattgcaagcttccatgactgtaacagacgaacctggttactatgaggatggagcatttgggataagattggagaatgtgcttgttatcaacgaggctgatacaaaatttaattttggcgataaaggttacttatcgtttgagcatattacctgggcaccatatcaaacaaagttgattgacctgaaccttctaaatccagaagagaaaaattggttgaactcctatcattccaagtgtagagatattttggctccacatttggatgaagctggaaatgcatggttgaagaaagccacagaacctgtagctgtgtgagctgtgttttgagttgaaaatttaataaattgcattgtttcagaataatatatgtgctgtcttctgtattcatattcatattatttatatttaatgtaatatagattttaaataacctattgggatgactatgccttcaaattagcatacagcatgtacatttaatctgttgctcattattaaagtgtttggctgtttggatttgctaaaaagaacggaggggaatggaacagtgtctattccacaatttgac

SEQ ID NO: 7511 - DNA, 2227 bp, Medicago truncatula
ttgtaacacaaactcgaaaatcattagttcagcggtgagacttctgaagcaaaacaaaaaaaataaaaatggcagacacactctctgctttgcgttctttgatgtcttctcactctccacctcttcatgccttagttgttccttctgaagattatcaccagagtgaatatgtatctgcacgtgacaagcgtcgtgcatttgtttctggattcactggaagtgctggtttggcacttataacaaaggatgaagcacttctttggaccgatggacgttattttctgcaggctgaacaacaacttagtgatcagtggaagctaatgcgtctagctgaagatcctgctgtagatatctggatggctgataacttgccaaaagatgcagcaattggggttgacccctggtgcatttcaatcgatactgctcaaagatgggaacgtgcttttgccaaaaaacagcagaagctggtccaaacaacaaagaatttggttgatgaagtatggacaacacgcccaccagcagaaattaatgctgccgttgtacaaccattaaagtttgcaggtcgctctgtcacagataagttgaaagatttgagaaaaaagcttgcacaggagcatgctcgaggaatagttttaacagcactcgacgaagttgcttggctgtataatattcgtggaaaagatgtggcatactgtcctgttgttcacgcatttgctattgtgacatccaattctgccttcatttatgtggacaagcgaaaggtgtctattgaggttaaaactcatttagaggagaatggaattgaaattaaagagtatacagaagtaagcttagatgcggcatttcttgcgactaatgagcttgattctgtgtctactgccaaggctagtctagctgaagtgacgaagcaatctgaaaacagtgaaaccaataagagtgtaaatggtaaacatcaaacaggagaaaagtgtagcaacctcatatgggctgatccagcttcatgctgttatgcactgtattccaaactgaaccctgatgcagttgtcttgcagcaatctcctctggctctcccaaaagctttaaagaacccagtggaattggatgggttaagaaaggcccatgttcgggatggtgcggctgttgtgcaatatcttgtttggctggataataagatgcaggatatttatggagcatctggatactttttggaggagaacaccgtaaaaaaggagaaacctttgaagtccttgaaattgactgaggtgactgtaagtgacaagcttgaagaatttcgagcatcaaaagagcatttcagaggattgagtttccctactatttcttcagtaggcccaaatgcagctattattcattattctccacaagcagaaacatgtgccgagcttgatccagacaaaatttatctttttgattctggagcccagtatctggatgggacaactgatattacacgaacagttcatttcgggagaccttcggatcatgaaaaagcatgttatacagcagtcctaaagggtcacattgctttgggaaatgctagatttcctaatggaacaaatggtcaccaacttgatattctttctcgaattcctttgtggaactatggtcttgattatcgacacggaactggtcacggtattgggtcctacctgaatgtccatgaaggacctcatttaatcagtttcagaatacgaaatgtaccattgcaagcttccatgactgtaacagacgaacctggttactatgaggatggagcatttgggataagattggagaatgtgcttgttatcaacgaggctgatacaaaatttaattttggcgataaaggttacttatcgtttgagcatattacctgggcaccatatcaaacaaagttgattgacctgaaccttctaaatccagaagagaaaaattggttgaactcctatcattccaagtgtagagatattttggctccacatttggatgaagctggaaatgcatggttgaagaaagccacagaacctgtagctgtgtgagctgtgttttgagttgaaaatttaataaattgcattgtttcagaataatatatgtgctgtcttctgtattcatattcatattatttatatttaatgtaatatagattttaaataacctattgggatgactatgccttcaaattagcatacagcatgtacatttaatctgttgctcattattaaagtgtttg

SEQ ID NO: 7512 - DNA, 2315 bp, Trigonella foenum-graecum
aaactaaataaactcgaaagtcatcagttcatcggtgaaactgaaactgaaacttgagaaccaaaacaaaaatggcagacacactctctgctttgcgttctttgatgtcttctcactctccacctcttcatgctttagttgttccatctgaagattatcaccagagtgaatatgtatctgcacgtgacaagcgtcgtgaattcgtttctggattctctggaagtgctggtttggcacttataacaaaggatgaagcactgctttggaccgatggacgttattttttgcaggctgaacaacaacttagtgatcaatggaaactaatgcgtatggctgaagatcctgctgtagatatctggatggctgataacttgccaaaagatgcagcaattggagttgacccttggtgtatttcaattgatactgctcaaagatgggaacgtgcttttgccaaaaaacagcagaagctggtccaaacaacaaagaatttggttgatgaagtatggacaacacgtccaccagcagaaattaatgctgccgttgtacagccattaaagtttgcaggtcgctctgtcactgataagttgaaagatttgagaaaaaagcttgcacaggagcatgctcgaggaatagttttaacagcactcgacgaagttgcttggctgtataatattcgtggaaaagatgtggcatactgccctgttgttcacgcatttgctattgtgacattcaattctgccttcatttatgtggacaagcgaaaggtgtctattgaggttaaaactcatttagaggagaatggaattgaaattaaagagtatacagaagtaagcttagacgcggcattgcttgcgactaatgagcttgattccgtgtctactgccaaggctagtctagctgaagttacaaagcaatctgaaaattttgccagtgaaaccaataagagtgtaaatggtaaacatcaaacaagagaaaagagtagcaacctcatatgggctgatccagcttcatgctgctatgctctttattcaaaactgaaccctgatgcagtttgcttgctgcaatcacctctggctctttcaaaagctttaaagaacccagtggaattggatgggttaagaaaggcccatgttcgggatggtgcagctgttgtgcaatatcttgtttggctggataataagatgcaggatatttatggagcatctggatactttttggaggagaacaccgtaaaaaaggagaaacatttgcagtccttgaaattgactgaggtgactgtaagtgacaagcttgaagaatttcgagcatcaaaagagcatttcagaggattgagtttccctactatttcctcagtaggcccaaatgcagctattattcattattctccagaagcagaaacatgtgccgagcttgatccagacaaaatttatctttttgattctggagctcagtatctggatggaacaactgatattacacgaacagttcatttcgggagacctttggatcatgaaaaaagatgttacacagcagtcctaaagggtcacattgctttgggaaatgctagatttcctaatggaacaaatggtcaccaacttgatattctttctcgaattcctttgtggaagtatggtcttgattatcgacatggaactggtcacggtattgggtcctacctgaatgtccatgaaggacctcaattaatcagtttcagaatccgaaatgtaccattgcaagcttccatgactgttacagatgaacctggttactatgaggatggagcatttgggataagattggagaatgtgcttgttatcaaccaggctgatacaaaatttaattttggcgataaaggttacttatcgtttgagcatattacctgggcaccatatcaaacaaagttgattgacttgaaccttctaaatccagaagagaaaaattggttgaactcctatcattcgaagtgccgagatattttggcgccgcatttggatgaagctgaaaatgcatggttgaagaaagccacagaacctgtagctgtgtgacctgtgttttgagtggaaaagttaataagttgcattgtttcagaataatatatgtgctctcttctgtattcatattatttattatatttattgtaatctaatacagatttgaataacctattgtgattactatgccttcaaattagcatacagcatgtacatttaatctgttgctcattataaaagcactaggctctatttggatatgctaaaacaaacggggtggaatagaacaaaatggaatggaacaaaaagcattccactctttgg

SEQ ID NO: 7513 - DNA, 2146 bp, Lupinus angustifolius
aagattatcatcagagtgaatatgtatctgaacgagacatgcgtcgcagattcgtttctggcttctctggaagtgctggtttggcgctcataacaaagaatgaagcattgctgtggaccgatggacgatattttttgcaggcagaacaagaactcagtgatcagtggaagctaatgcgtattggtgaagatcctcccgtcgatatctggatggctgataacttgccaaaagatgcatccgttggagttgacacttggtgcatttcaattgataccgcccaaagatgggagcgtgctttttctggaaaacagcagaagctagttgaaactacaaaaaatttggttgatgaagtatggataaatcggccaccggcagagattaatgctgttaccatacaaccattgaaatttgcaggtcgctctgttggagataagttgaaagatttgagaaaaaagcttgtgcaggagcgagcccgtggtattattttgaccgcacttgatgaagttgcatggttgtataatattcgtggaagtgatgtggcatactgtcctgttgttcatgcatatgccattgtgacatccaattctgctttcatttatgtagacaagcgaaaggtgtctgttgaggtaaaatctcatctacaagagaacgggattgaaattaaagattatacatcagtaagctctgatgtggcgttgcttgcaaataataagcctgatgctctagctgaagtcacaaaggaggccagagaaacatccagtgagactaataacagcgtaaacagtaaccatcaagctgaggaaaaaagcaacgaccttatatgggctgatcctggttcctgctgttatgccctatatttgaaattgaatgccgacacagttctcctgcagcagtcacctttggcccttgcaaaagctttaaagaacccagcggagttggaagggttaagaaattcacatattcgagatggtgcagctgttgttcagtatcttgtctggctggataagcagttgcaagataattacggggcatctggttactttttggaggggaatgctgtgaaaaaggaaaaacatttgcagtccttcaaactgactgaggttacagcaagtgacaagcttgaaggattccgggcatcaaaagagcatttcagaggattgagtttccccactatttcctcagtcggtgcaaatgcagctataattcattataaaccagaggcagaaacatgcgctgagcttgatccagaccaaatttatctttttgattccggagcccagtatctagatggaacaactgatattacacgaacagttcattttgggaaaccttcggctcacgagaaagcatgttatacagcagtcctcaagggtcacattgctctcggaaatgctagatttcctaatgggacaactggttattcccttgatattcttgctcgtattcctctatggaaggatggtcttgattatcgacatggtactggtcatggagttggatccttcctgaatgttcatgaaggtcctcatttaatcagtttcaggccacaggtccgaactgtaccattgcaatcttccatgactgttacggatgaacctggttactacgaggatggaaatttcgggataagattggagaatgtgcttgttatcaacgaggctgatactaaattcaattttggtgataaaggttacttatcatttgaacacattacctgggcaccataccaaacaaagttgattgacctgaaccttctattgcctgatgagataaattggctgaactcataccactcaacctgtagagatattctggcgccatatttggatgaggctgaaaatgcttggctgaagaaagccactgaacctatagttgtgtgagctgtgtttgggtttggaaacttaataaataatgttgcttaagcttaatatctgctctatcttcagtattcatattctagattttacatgtcttgttgggatgcccattccttcaaattaagttttaagtgtcctacatgtctattgactcacgctcagttattttcttttcaaccttattgtttgtaaattaaagatgaactttgtacctaataaagagatgaagaacatacaaaaatagattagaatgggtactaagttttatt

SEQ ID NO: 7514 - DNA, 1923 bp, Glycine max
gcattaacaagaaccatgctcgtccaatccaacggctcacgtttctctcactctttctctctccttcaaatcctgaaacaaaagaaaaattgttcccaaaaaaactaaacgcattctggctaaaattctctgcattttcttcgtcacaacaacccttctctgattcgtcttcaatttttgtttccaaaaccttaggtcagatttctgtgtttgtcgtttctgataatctggagtggagctaggtcaagatgccgtgggtttccttgtttgtggatcacaaaagaaattgtgttcgcttggtggtgttttttcgtgtgattctgtaatttaattagctcaggtgtagtcccattaggttgcgaagcaactcttttcattaggttgttctccttttcatttccaaagctgttggggggactgaggatgtactttgcggtaacaataaagagataccaagctgtgaaggaagttggacaaattaaaatgagtgttggagttattggatacaaccaattgatgcttgtttgccaggccgagtattttcgtcagttgcttaaacctgttacgtagtctagcattgagggacaccggtttaggggggggattgccttatattgtacttcatcattataaagttgcagagagatgaagttttaatttggaaaagttgctattacttcttacatggaaattgaaatcaccttagcacctgctgtttagttttaacattcctttaggaacttccttccagccttagtacagaataattgccagttacataggctaaatcagcattgcttgctcgaacgtcagtcagattgaacagataatataatgcaaactcgggaatattttctcccagataagatgggacttcctttggctgatgagaccattgatcctcatatgcatgctccacttgcttctacctttgatgcatatttacctccaggtgtgaggcagataacacccattgaaagatttaaattgctaccctctgaggcttgccccaagaactttgtcatctttgatcaaacagatcaacaaagcaggatcatgttccatcctgcaatgacctacaaatttgacagtcctagcttacatgctcatgctactggttctcaagattttgagaagaacaaagtcaatcaaatggaaagagaattgtcatctgcttttgaagaagatcctaatgacattgatgcattgttgagcataggagcggatgaactagaagactttgacgaggaagaagtcagcacagcaaggactcgtgaaaaatatgaaagtttatccgatacttgctccagttattgctcaaaatcaaggaagaagaggtcatcatcatcatcttctgtacagaagtcttctggggctgggggttactgccacaatgaagggaagcaccaggagataaagaggatggtgaggatgttgagaaagattgtgcctgatggaggtaatcaaatggattctgttgctgttttaaatgaagctgttaaatacctcaagtctctcaaagttgaggttgaacaattcagggttgaaccatgaaaaatgtaagttagtcatatgctgctgcaacagttgactacatccccagctatgtttgttaccttctatgaatagcaccctttctcgccttgctcgccatcctaatgagaagaggccatgctatctgagtaataaattacgactgaccttttacttattctggttatgtaagaaaatactgtcataattgtacttttaggttgtgtttgattgtgtttctatgctggcttatttcttatagccccaaaactcaatttttattatgaatgttatgttatgaatgtactaaaaatttatatggctgataactccgctatttttgaggagatataaggtgagttggatagttaaggaaagataaaagtcacg

SEQ ID NO: 7515 - DNA, 1866 bp, Glycine max
ctctcactctttctctctccttcaaatcctgaaacaaaagaaaaattgttcccaaaaaaactaaacgcattctggctaaaattctctgcattttcttcgtcacaacaacccttctctgattcgtcttcaatttttgtttccaaaaccttaggtcagatttctgtgtttgtcgtttctgataatctggagtggagctaggtcaagatgccgtgggtttccttgtttgtggatcacaaaagaaattgtgttcgcttggtggtgttttttcgtgtgattctgtaatttaattagctcaggtgtagtcccattaggttgcgaagcaactcttttcattaggttgttctccttttcatttccaaagctgttggggggactgaggatgtactttgcggtaacaataaagagataccaagctgtgaaggaagttggacaaattaaaatgagtgttggagttattggatacaaccaattgatgcttgtttgccaggccgagtattttcgtcagttgcttaaacctgttacgtagtctagcattgagggacaccggtttaggggggggattgccttatattgtacttcatcattataaagttgcagagagatgaagttttaatttggaaaagttgctattacttcttacatggaaattgaaatcaccttagcacctgctgtttagttttaacattcctttaggaacttccttccagccttagtacagaataattgccagttacataggctaaatcagcattgcttgctcgaacgtcagtcagattgaacagataatataatgcaaactcgggaatattttctcccagataagatgggacttcctttggctgatgagaccattgatcctcatatgcatgctccacttgcttctacctttgatgcatatttacctccaggtgtgaggcagataacacccattgaaagatttaaattgctaccctctgaggcttgccccaagaactttgtcatctttgatcaaacagatcaacaaagcaggatcatgttccatcctgcaatgacctacaaatttgacagtcctagcttacatgctcatgctactggttctcaagattttgagaagaacaaagtcaatcaaatggaaagagaattgtcatctgcttttgaagaagatcctaatgacattgatgcattgttgagcataggagcggatgaactagaagactttgacgaggaagaagtcagcacagcaaggactcgtgaaaaatatgaaagtttatccgatacttgctccagttattgctcaaaatcaaggaagaagaggtcatcatcatcatcttctgtacagaagtcttctggggctgggggttactgccacaatgaagggaagcaccaggagataaagaggatggtgaggatgttgagaaagattgtgcctgatggaggtaatcaaatggattctgttgctgttttaaatgaagctgttaaatacctcaagtctctcaaagttgaggttgaacaattcagggttgaaccatgaaaaatgtaagttagtcatatgctgctgcaacagttgactacatccccagctatgtttgttaccttctatgaatagcaccctttctcgccttgctcgccatcctaatgagaagaggccatgctatctgagtaataaattacgactgaccttttacttattctggttatgtaagaaaatactgtcataattgtacttttaggttgtgtttgattgtgtttctatgctggcttatttcttatagccccaaaactcaatttttattatgaatgttatgttatgaatgtactaaaaatttatatggctgataactccgctatttttgaggagatataaggtgagttggatagttaaggaaa

SEQ ID NO: 7516 - DNA, 1974 bp, Cajanus cajan
acacccgcaataaacggaagtgcatttccaagaaccatgctcatcccatccaacggctcacatttctctctttctctctccttcaaatctccatagaaaaagaaaaatgctcccaaccaaacttcaaacacatccttgctaaaattctctgcgttttcatcacaacccttctctgattcctcttcaattttgtttctcttcttgcaaaactttaggtcagatttttgggtttgtctttttctgataaactggagtggagctaagtcaagatggcgtgggtttccttgtttgtagatcacaaaagaaattgtgttcgcttggtggtgttttttcgcgtgattctgtaatttaattagctcagctgcaggtgtagtcccattaggtttgtgaaggaacgttttccattagtttttcctttcatttccaaagctgttgggaggattgataatatgtactttgcgataacgataaagagataccgagctgtgaaggaagttggacaaattaaaatgtgtgttggagtcattgcgtacaaccaattgatgcttgtttgccaggctgagtatttccgtcagttgcttaaacctgttacgtagtctagcactgagggacattggtttaggggggggattgccttatagtacttcatcattataaagctgcagagagatgaagatttaatttggaaaagttgtcaccacttcttagatggaaattggaatcaccttagcaccttctgtttagttttaacattcctttaggaagttccttccagctttagtacagaataattgccagttgcataggctaaatcagcattgactcgaacgtcggtcagagtgaataggtaacataatgcagactcaagaatattttctcccggagaagatggtacttcctttggaagatgaggccattgatgctcatatgcatgttccatttgcttcttccttcgatgcatttttacctgatgcatttttacctccaggcgtgaggcagatgacaccctttgaaagatttaatttgcaaccatctgaggcttgccctaagaatttcattatctttgatcaaacagatcaacaaagcaggattatgttccatcctgcaatgacctacaattttagtggtcctggcttaaatgttcatgctacttgtcaagattttgagaagaataaagtcattcaaatggaaagagaattgtcaactccttttgaagaagatcctaatgacattgatgcattgttgagcataggagcagacgaactagaagactttgatgaggaagaggtaagcacagcaaggactcatgaaaattatgaaagtatatcagatacttgctcaagttattgctcaaaatcaaggaaaaaaaggtcgtcatcgtcttctgtgcaaaagtcttctggagaagggggttacggccacaatgaagggaaacaccgggagatgaagaggatggtgaggatgttgagaaggattgtgcctggtggaggtaatcaaatggatagtgttgctgttttagatgaagctgttaaatacctcaagtctctcaaagttgagatggaacaattcggagttggaccatgaaaatgtaagttggtcatatgctgcggcaaataattgactatttctccaactttgccatcatcctctatgaattagcatccttctagcctcgctcaccatcctagttccgttttagttccgttttataagaagaggcctttgctaagtaataaattatgactgacattttactctttctggtcatgtaagaaattactatcgtaattgtacttttcggttgtgcttgattgtgttgttggcttatctcttttaccctaaaactcggtttattattcatgttatgctatgaatgtaccataattttttatggttgataactcccttgcttcattctcgttctcagaatacttctcgtacccttgttcacattttaagttttatatgatgctg

SEQ ID NO: 7517 - DNA, 1921 bp, Phaseolus vulgaris
gcattctgactaaaattctctgtttcttcttcatcaccgcccttcactgattcctctttcattttgtttattttcttccaaaatcttaggtcttgctctgtcactgtgatctttgactccaatttgttccgttcaaacgctgctgtcaattttggtcaggtttttgggtttgtcttatctgataatctggagtggagctaagtcaagatgccgtgggtttccttgtttgtggatcacaaaagaaactgtgttcgcttggtggtgttttttcgtgtgattctgtaaattagttcgctcagtcccattaggttgcgaaggaactcttttatttggttcttctccatttcatttgcaaagctgttgggggatttgaggatgttctttgcgataacaataaagagataccgagctgtgaaggaagttggacaaattaaaatgagtgttggagtcattgcgtacaaccaattgatgcttgtttgccaggctgagtattttcgtcagttgctcaaacctgttacgtagtctagctttgagggacattggtttggggggggattgccttatattgtacttcatcattaaaagctgcagagagatgaagttttagtttggaaaagttgccattgccacttcatgttagatggaaattggaatcaccttagcacctgctgtttagtttttaacattcctttaggaacttccttcaagctttagtacagaataattgccagttgcataggctaaatcagcattgctcgttgaacgtcactcagattgaacagataatataatgcagactcaggaatattttctcccgaagaagatggtacttcctttggcagatgagtccattgatgctgatgctcacatgcatcctccacttgcttctgcctttgatgcgtttttacctccaggtgtggggcagataacaccctttgaaagatttaagttgcaaccctctgaggcttgccccaagaattttgttatctttgatcaaacagatcagcgaagtaggattatgttccatcctgcaatgacctacaaatttaatagtcctggcttagatgttgatgctactttttctcaagattttgagaagaataaagtgaatgaaatggaaagagaattgtcatctccttttgaagaagatcctaatgacattgatgcactgatgagcataggaggtgatgaactagaagactttgatgaggaagaagtaagcacggcgaggactcatgaacattatgaaagtttatctgatacttgctccagttattgctcaaaatcaaggaagaagagggtgccatcatcttgtgtacacaagtgttctgagggtagaggttgctgccacaatgatgggaataaccgggagataaagaggatggtgaggatattgagaaatatcgtgcctggtggaggtaatcaaatggattctgtcactgttttagatgaagcggttaaatacctcaagtctctcaaggttgaggtggaacagtttggagttggaccatgaagatgtaagatgttgcgccaacaattcagtatttccccaacatcgtttgttactagcctcactcaccatccaagttatgagaacaggtccttgctatctgagtaataaattatgactgacatttgactggttcaggttatgtaagaaaataccataaataatgttgtacttttaggttgagctttacctacaactcaattattattatgcatgctgttatgttatgaatgtcccattaatatacatggcccaagataaatgcttctggtaccttgtcacaatgaagttttatatgctgctgccaaactccactttcatttttgagttggatttcatttgatagtacgctcagtttgaggtatgtttctcgcaagtgttgtataacatggctgctaaagttcttgttga

SEQ ID NO: 7518 - DNA, 1961 bp, Phaseolus vulgaris
cgcgcgctctcatccaacggttcatatcacacccgcaataaacggaagtgcatttccaagaaccatgctcattccatccaacggctcacatttctttctctctttctctctccttcaattccttagacaaaagaaaaatgctacaaaggcaaaacgcattctgactaaaattctctgtttcttcttcatcaccgcccttcactgattcctctttcattttgtttattttcttccaaaatcttaggtcttgctctgtcactgtgatctttgactccaatttgttccgttcaaacgctgctgtcaattttggtcaggtttttgggtttgtcttatctgataatctggagtggagctaagtcaagatgccgtgggtttccttgtttgtggatcacaaaagaaactgtgttcgcttggtggtgttttttcgtgtgattctgtaaattagttcgctcagtcccattaggttgcgaaggaactcttttatttggttcttctccatttcatttgcaaagctgttgggggatttgaggatgttctttgcgataacaataaagagataccgagctgtgaaggaagttggacaaattaaaatgagtgttggagtcattgcgtacaaccaattgatgcttgtttgccaggctgagtattttcgtcagttgctcaaacctgttacgtagtctagctttgagggacattggtttggggggggattgccttatattgtacttcatcattaaaagctgcagagagatgaagttttagtttggaaaagttgccattgccacttcatgttagatggaaattggaatcaccttagcacctgctgtttagttttaacattcctttaggaacttccttcaagctttagtacagaataattgccagttgcataggctaaatcagcattgctcgttgaacgtcactcagattgaacagataatataatgcagactcaggaatattttctcccgaagaagatggtacttcctttggcagatgagtccattgatgctgatgctcacatgcatcctccacttgcttctgcctttgatgcgtttttacctccaggtgtggggcagataacaccctttgaaagatttaagttgcaaccctctgaggcttgccccaagaattttgttatctttgatcaaacagatcagcgaagtaggattatgttccatcctgcaatgacctacaaatttaatagtcctggcttagatgttgatgctactttttctcaagattttgagaagaataaagtgaatgaaatggaaagagaattgtcatctccttttgaagaagatcctaatgacattgatgcactgatgagcataggaggtgatgaactagaagactttgatgaggaagaagtaagcacggcgaggactcatgaacattatgaaagtttatctgatacttgctccagttattgctcaaaatcaaggaagaagagggtgccatcatcttgtgtacacaagtgttctgagggtagaggttgctgccacaatgatgggaataaccgggagataaagaggatggtgaggatattgagaaatatcgtgcctggtggaggtaatcaaatggattctgtcactgttttagatgaagcggttaaatacctcaagtctctcaaggttgaggtggaacagtttggagttggaccatgaagatgtaagatgttgcgccaacaattcagtatttccccaacatcgtttgttactagcctcactcaccatccaagttatgagaacaggtccttgctatctgagtaataaattatgactgacatttgactggttcaggttatgtaagaaaataccataaataatgttgtacttttaggttgagctttacctacaactcaattattattatgcatgctgttatgttatgaatgtcccattaatatacatggcccaagataaatgcttctggtaccttgtcacaatgaagttttatat

SEQ ID NO: 7519 - DNA, 1702 bp, Cajanus cajan
tcaaactcgtacggacggatattccgctgaatcaatacatcgttggtttctgagacagccaccttcggatctcagatcgccacgcttcctttgattttgtcttcctgcttcttcatttcctattctcagcttccaatttttcttcttttttctttggggggtttcgttcctctgtgcgccatccctaattcgataccatgaggaagaagctcgacacccgtttccccgctgctcggataaagaagataatgcaagcagatgaggatgttggaaagatagcattggcggttccagttttagtatctaaagctctggagttatttttgcaagatctttgtgaccgtacttatgaaataacacttcagagaggagcaaagaccatgaatgcattgcatttgaagcattgtgtacaaagttataacgtctttgactttctgagagacattgtcagcagggttccagactatgggcatgggcatgggcatggccattctgaggctggagctgatgatcgcacactttcaaagagaaggaaagctgctggtgaggagggcaatgacagtgatgaagaggctaagaggagtaagatgcgtgagttgggccacactggcactactggtaggggaagaggtcgaggtagaggaagaggccgaggacgtgggactcgaaccgtcgaaagagatatctgtcatcagcaggttgaatctgagccctgcacgtctattcagcacagtagcaatgatattcctaatacaagtgtgccattagataatggtccgcaatccaaggagttaccgaaggagaattttgcagtttctgaggaaagtactcaatctttccgtaacattgatttgaatgccaacttaaatgaaaacgaagacaaaaatgctagcacagctgtccaggcttcattgtctgagcccactgccatggagattaaacatgaagaaattccaggctggtctctatctgatgcggacaagatggccattgacactatgcagcttgcaaaccttggtaatcgactagaagaggatgaggaagattatgacgaggaagggtaaataacatacacattgggagattagctctgcaggaagctagtggtaacagaagaattagtacgtactagtgctatgatgactatcctctagtaaccactgtatgttcccatgctaagtatctgatgacccctctcttctttatctgttctggtatgtatctgttctcatgtagcagatgtagcttttctcttctttaatagtaatgttagcttcatgcacttaggctttaaatggatgttggtagttgacaaccacctttctagtacaggtcttggtaaagcttggttattagttgatttcattatgttgggttattcaagatatttgttgctgataaaatagttttctacttttctgttcctcaatcgtaatgcaaatatcccaatggatgttaacttcataaaaaaaaaacaatgcaagaaagatgttatctaattgatggagaatattttcctttgggcaattttgtgagtgaagttttggaaaggaagggtaaaatttccatttcctataaatattctctaatttggtaattttcaaaatgaaccaaatataatgataaattatcataaacttaatattttaatcgtttgtttttctatgaacattatataacttcaattcaaaaaaaaaaaaaa

SEQ ID NO: 7520 - DNA, 1483 bp, Phaseolus vulgaris
atcataatttttgttgcctcacaggcttgtgacgttgcagtttccttctatcgtcatcacaaattgtttcattgttttggtttccttcgtcaaactcgtacggacggatattccgctgaatcgacacctcgttggtttctgagacagcccttcggatctgagaccagaccagattgccacgcttcctttgattttgtcttccgcttcctagtttcttattctcagctacaaaattttctgcttcttctttttcttctggtttcgttcctctcctgattcaatacaatgagaaagaagctcgacacccgtttccccgctgcacgaataaagaagataatgcaagcagatgaggatgttggaaagatagcattggcagttcctgttttagtatctaaagctctggagttatttttgcaagatctctgtgaccgcacttatgaaataactcttcagagaggagcaaagaccatgaatgcactgcatttgaaacattgtgtacaaagttataacgtatttgactttctgagagacattgtcagcagggttcctgactatgggcatggacatggccattttgagggtggagccgatgatcgtgccctttcaaagagaaggaaagctgctggtgttgagggcaatgaaagtgatgaagagtccaagaggagtaagatgcgtgagttgggccacaccggcactcccggtaggggaagaggccgaggtagaggaagaggccgtggtcgagggattcgacctgttgaaacagacatcggtcatcagcaggttgagtctgagccttgctcctctattcaacaaattagcaatgatattcctaacacaagtctgccaatagataatggtgtgcaatccaaggagtgttcaaaggagaactttgcagctcatgaggaaagtactcaatctttccgtaacatcgatctgaatgctaacttaaacgaaaatgaagacaaaaatgctagtgcagctgttcaggcttcagtgcctgagcctgctgacatggacattaaacatgaagaaattccaggctggtccctatctgaagtcgacaagatggccattgacactatgcaacttgcaacccttggtagtagactagaagaggatgatgaagattatgatgaggaagggtaaataacatgcaccttgggggattagctttgtaggaagaagctcttggtaactgaagaacaactacttactaagttactactgctactatgatcactatcctctagtaatcactgtatgtgtcccatgctaatctgatgacccttctctctaaactgatatgtatctgttctcctgtagcagatgtagatttattttttcttccctaattgtaatgctagcatcatacacttttaggatttaaatggatgttgttagttgacaaccaccttactagttcaggatcaaactcttggtgtatctggtttactagttgatttctttatgttagattactcaa

SEQ ID NO: 7521 - DNA, 1773 bp, Phaseolus vulgaris
catcataatttttgttgcctcacaggcttgtgacgttgcagtttccttctatcgtcatcacaaattgtttcattgttttggtttccttcgtcaaactcgtacggacggatattccgctgaatcgacacctcgttggtttctgagacagcccttcggatctgagaccagaccagattgccacgcttcctttgattttgtcttccgcttcctagtttcttattctcagctacaaaattttctgcttcttctttttcttctggtttcgttcctctcctgattcaatacaatgagaaagaagctcgacacccgtttccccgctgcacgaataaagaagataatgcaagcagatgaggatgttggaaagatagcattggcagttcctgttttagtatctaaagctctggagttatttttgcaagatctctgtgaccgcacttatgaaataactcttcagagaggagcaaagaccatgaatgcactgcatttgaaacattgtgtacaaagttataacgtatttgactttctgagagacattgtcagcagggttcctgactatgggcatggacatggccattttgagggtggagccgatgatcgtgccctttcaaagagaaggaaagctgctggtgttgagggcaatgaaagtgatgaagagtccaagaggagtaagatgcgtgagttgggccacaccggcactcccggtaggggaagaggccgaggtagaggaagaggccgtggtcgagggattcgacctgttgaaacagacatcggtcatcagcaggttgagtctgagccttgctcctctattcaacaaattagcaatgatattcctaacacaagtctgccaatagataatggtgtgcaatccaaggagtgttcaaaggagaactttgcagctcatgaggaaagtactcaatctttccgtaacatcgatctgaatgctaacttaaacgaaaatgaagacaaaaatgctagtgcagctgttcaggcttcagtgcctgagcctgctgacatggacattaaacatgaagaaattccaggctggtccctatctgaagtcgacaagatggccattgacactatgcaacttgcaacccttggtagtagactagaagaggatgatgaagattatgatgaggaagggtaaataacatgcaccttgggggattagctttgtaggaagaagctcttggtaactgaagaacaactacttactaagttactactgctactatgatcactatcctctagtaatcactgtatgtgtcccatgctaatctgatgacccttctctctaaactgatatgtatctgttctcctgtagcagatgtagatttattttttcttccctaattgtaatgctagcatcatacacttttaggatttaaatggatgttgttagttgacaaccaccttactagttcaggatcaaactcttggtgtatctggtttactagttgatttctttatgttagattactcaagatacttgttaactgatagaatagttttttagttatatgttccacaatttgagagtaaatgcatatcaatgcatgtcaactacatcaaaaaaaatgaaagaaacataattatctcattgctggagaatattttactttgaatatgtttgtaactgaagttttggaagagaatgaaggtaaagttttgatttcttagatatactcgaatttggtaatttttgaaagaactatagtgataaattagcatgaacttaatattataatctcttgtttttctatgaacatcata

SEQ ID NO: 7522 - DNA, 1475 bp, Lotus japonicus
tgtcttcgtcaaagtcgtacggacggatattcagctgaatggacacacacacctcgtttgtttgatgatttctggaaccaacagcatcttcggatctcagatcagatttcgcttcctttgaatttctcctctcaattcttgtttttcattcttctcaaacttccttcccattttcctttcttacctcaatttcatgccatgaggaaaaagcttgatactcgtttccctgcggctcggataaagaagataatgcaagcagatgaggatgttggaaagattgcactggcagttcctgttttagtgtctaaagctctggaattatttttgcaagatctttgtgaccgcacttatgaaataactcttcagagaggagcaaagacaatgaatgcattgcatctgaaacattgtgttcaaagctataatgtctttgactttttgagagacattgtcagcacggttcctgattatgggcatggacatggccatggcaactctgagggtggagctgatgatcgtgcccttccaaagagaaggaaagctgctggggatgatggcaatgacagtgatgaagaagctaagaggagtaagatgcagcttgagttgggccacactagcagtactggcaagggaagaggccgaggtagaggtagaggccgaggccgtggtcgaggggctcgaactgtagaaaaagagactagtgtacaccaggttgaatctgagccttgcacctctatcccagaaagtagcaaagattttcctgatacaagtgtggcaatgtataatgatccagaatccaaggagttatcaaaggaaaacattgcagtccctgaggaaaatgctcaatctctccgcaacattgatctgaatgccaacttaaatgaaaatgaggacaaaggtgctagcacagctgctcaggcctcattgcctgaacctgcggaaacagagattaaacacgaagaaattcccggctggtccctttctgacgtggacaagatggccattgacaatatgcagcttgcaaaccttggtagtagagtagaagatgatgaagaagattatgatgaggaagggtaagttctagtgtacattttgggggattagctaaagatggtgaaaacagaagaatgagtacatattagtattttgatggctatcctctagtaaccagagaatctgaattacatatttcttctatatctgggatgtcaatgttcctgtgtagcagatgtagcttcctcttaacactaatgttagtagtacttagtagagctttgtgcacttttaggctcaaaatggatgtttttaggcgacatccaccttgctagtacaggtcaaacagttgttagagcttggctactagttgatttcattatgttgtgttatttgagcattgcctgacaaaatggttttctacttttctgtttgtctatcagaaagcagaagtatattaatagatgtaagctgctttgaagaat

SEQ ID NO: 7523 - DNA, 1870 bp, Medicago truncatula
gtctaactcgtacgaacgcatattccggcaaatcgacacttcgcaggtttctgtcccacactaccttcggatcttacatcacaccattcaccccttcctttgctttcaaatttcccttcaaaattgttaccttcttcctgttcaatttcccaatttgatgccatgaagaagaagcttgatactcgtttccctgctgctcggataaagaagataatgcaagcagatgaggatgttggaaagatagcactggcagttcctgttttagtttcaaaagctctggaattatttttgcaagatctttgtgaccgaacttatgaaataactctacagagaggagcaaagaccatgaatgcattgcatttgaaacattgtgtacaaagctacaacgtctttgactttttgagagacattgtcagcagggttcctgactatagccatggacatggccattctgaggctggggctgatgatcgcgccgttccaaagagaaggaaagctgctggtgatgattgtaatgacagcgatgaagaggctaagcggagtaaaatgcttgagttgggccacactggcagtactggtaggggaagaggaaggggtagaggaagaggccgcggtcgaggggctcgaactgcagaaagagaaaccttacatcagcaggttgaatctgaaccttgcacttctattcagcaaactagcaaagacgtccccaatacaagtatggcaatagataatggttcagaaccaaaggagttatcgaaggaaaatattgcagctcatgaagaaagtacccaatctctccgaaacattgatctgaatgccaacttacatgaaaacgaggaaaaaaataatacaagcacggatatacctactcaggccccattgcctgaacctgctgcaacaacagatatgcaacatgaagaaattccaggttggtctctttctgatgttgacaagatggcgattgacacactgcagcttgcagcgaatcttggtaataggctagatgaggatgaggaagattatgatgaggaggaagagtagctaacaccttaaggtggaaatcatgtctccgatgctaaatgaatgatcccctttttttctttgcctggtataccaatgaccttgtgtagatactaacaaatgtagttttttttcttcttcttatcagtaatgttagtttcatgcactttttagggttacaatggatgttgcaggttacatcaactttgctagtacatgatttacttcttggtaaagttggattaccagttggtttcattgttgttttatttaagatattgtctgtcaatggttttctacttctgagttgtacctcaatcagaaagcataagtatccttcttaactataaataaggtaaaagaaaaaaaagaaaaataataactaggtgatggaagaagtaagattaaatgaaaatagattataatcatattatttattaatatttttaagttctttcaaaatgtttatattttttaaatacatatttccaaaacacctccaggtccgtttcatgtattttatgaaatctaattaatattttgttttttcaaataatagcaaagaaattgcatctattaaaaaggtcttcatcataaggatgttattgtagaaaagaacaacaaccaatagtaaacaacaacacaaatgacaataaaagataataatttaaagacaacagttgttgatacagcagggactgaacctgtgcattctttagcaggaaagtcagctaacaaagtggctaaggttgtttcaagtgatataataccaaccatttcgcagcttctctgacttttgatgacagaataataacctatgaagcacggacacaaacacggacaccggaca

SEQ ID NO: 7524 - DNA, 3629 bp, Cajanus cajan
atggagtgtttgaaatcccctttcatattctccactccacttgtccctccgcctttcaagaagaagaaaccccgtcacgttctcatccgctgctccgtccagcgcgacccatggtccccgagctccggcgaccccgcgcggcccaagcccaggacgaggagcccgaagaagccgctgtcggacgacaacgcgcggcgcatcataaagagcaaggcggcgtacctgagcgttctgcggcggaaccagggcccgcaggcgcagaccccgcggtggataaagaggacccccgagcagatggtgcagtacctgcaggacgaccgcaacggccacttgtacggcaggcacgtcgtcgccgccatcaagagagtccgctctctctctcagagacacgacggagactacgacatgcggatggagatggcttccttcgtcggcaagctcaccttcaaggagatgtgcactgtgctcaaggagcaaaaggggtggaggcaggtcagagacttctttgcttggatgaaattgcagctgagctaccgtccaagtgtaattgtctacacaatagtgttgcgcctgtatggccaagttggaaagctgaaactggctgaggagatcttcttggagatgcttgatgcagattgtgagcctgatgaagttgcttgtggtaccatgctttgttcatatgccagatggggacgtcataaggctatgctgtccttttattccgctgtaaaagaaaggggaatatttctctctgttgctgtcttcaactttatgttgtcttctttgcaaaagaaatcactccatagagaggttgtagaggtgtggaaggatatgttagaaaaaggggtgatacctaatagttttacttatacagtcgccatcagctctcttatcaaagaagggctgcacgaagatgctttcaagacttttgatgagatgaggaataatggaattgttcccgaggaggtaacttatagccttcttataaatttaaatactaaaattggcaacagagatggagtccaaagactgtatgagaatatgaggattcaaggaataattcctagtaattacacttgtgcttcacttctatctttgtattacaaatatgaggactaccctagagccctgtcccttttttcagaaatggtacgcaataaaatttctgctgatgaagtcatatatggtttgcttataagaatttatggcaaacttggtttgtatgaggatgctcacaaaacatttgaagagacaaagcagcggggcctactcagtagtgagaaaacatatttggcaatggcacaagtccatcttacttcaggaaatgtagacaaagccttggaagttattgaactcatgaagtctagcaacctatggctctctcgatttgcttatattgtgctgctgcagtgttatgtgatgaaagaagatgtaatatctgctgaaggaacatttgtagctctctccaagacaggaccacctgatgctggttcttgtaatgatatgctcagtctgtacatgggacttaatttgatgaataaggctaaggagttcattgtccgaataagggaggatgggacacattttgacaaggagctttatagaacagttatgaaagtttattgtaaggagggaatgctgccagaagctgagcagttgacaaatcagatgtttaagaatgaatcttttaaaaatgacaagttcttgatgacattttattggattctttgtgaacataagggggatgcgcaatctgataatgaacttgcggccattgagcctgttgacaaatttgatgctacagctctagggctgatgctcagtttatacctgacaaatggaagcttcaacaaaactaaaatattactgaagttgttgggttatgctgctgggggttcaaaaattgttagtcagctcatcatcagcttgtctaaagatggagaaatcagtaaagcagaattgcttaaccatcaattaattaagcttggctgcagaatggaagaagccactgtagcatctctaattagccattatggcaaacaacaaatgctgaaacaagcggaagatatctttgcagaatatgtaaattctcccacatctagtaaactactgtataactctatgatcaatgcatatgccaaatgtggtaaacaagaaaaagcatattcactatacaaacaagtaacagaggaaggatgtgatttgggtgctgttggaattagcattgccgtaaattctttgaccaatggaggaaaacatcaggaggcagagaatattgttcgcaggagtcttgaagaaaatttggagcttgacactgtggcttataatacctttatcaaagccatgcttgaagcaggaaaattgcattttgcatccagcatttttgagcgcatgtgctcctctggttttgctccatcaattgaaacattcaacaccatgataagtgtctatggacaagaccaaaagttggataaagcagtggagattttcaacaaagctagctcatttggtgtctctttggatgaaaaaacatacatgaatttgattggctactatgggaaagctggtatgatgcttgaagtttcacagttgttcagtaaaatgcaggaagaaggtataaaacctggaaaggtgagttacaatatcatgatcaacgtctatgctaatgctggagttcttaatgaaacggagaaacttttccaggccatgcagagacaaggttgtttgcccgattctttcacgtatctttcccttgtccaagcatatacaaggagcctgaattattctaaagcggaggaaaccatacatgatatgcagagcaaaggcattccaccatcttgtgttcattttaatattttactccacgctttcacaaaagctgggttgattgatgaagccaagagggtttatgacaagctatctacttttggtttaattcctgatctcgtatgttaccgaacaatgctgaatggttacctgaaatgtggatgtgtgaaggaaggaataaactttttcgaaagtatatatgaatcaacaaaaagcgacgggtttatcctgagtgcagctgtgcatttttacaaatctgcgggaaacgaaagcaaagctgaagaaatattaagttcaatgaacaacttgaggatcccattcctcaagaaactagaagttggatcagataaactacttctgtcggaaatacttgggctttagaagcatgatgatgaaaaaagagacggttaagaaaaaaacatataaatctaatcaagctggtaatggtgatggtggaggctgctgcatgatgctgccaacgatgattggttcagaagtacttttgcccgtgatgaggacctaatacaattaaatgcagtgtgcctcagtcaattaaatcttgcgcttggacccagggtaaacatttgctattatcaaaggaatggactacagaggatattggaagtgtttgttagggtacttccagtgacagcatttgggtttcgtgtataactgacttgacttgccccttctctttttctcactatttgaccggggtacaagattttgttccttattgtagtgtatactgcttcaaataatgtatagaatcataggaaaatttaacttgatgtatcaatggc

SEQ ID NO: 7525 - DNA, 4325 bp, Phaseolus vulgaris
aatggagtgtctgaaatcccctctcctctacttgactccaccttccaaacctcatccccttgtggcaaagacaaagaagaagagaccccctcccgttctcattcgctgctccatcaagcgcgacccgtggtctccgacttttggcgaccccacgcgcccgaaaccgtggacgaagaacccgaagaaacctctgtcggacgacaacgcgcggcgcatcataaagaataaggcggcgtaccagagcattctgcggcggaaccagggcccgcaggcgcagaccccgagatggataaagaggacccccgaacagatggtccagtacttgcaagacgaccgcaacggtcacctctacggcaagcacgtcgtggccgcaataaaaaaagtacgctctctctcccagaaagttgatggcgactacgacatgaggatggagatgggttcctttgtcggaaaactcagcttcaaggagatgtgcgtcgtgctcaaggagcaaaaggggtggaggcaagtcagagacttcttttattggatgaaattgcagttgagctacagaccaagtgtaattgtctacacaatagtattgcgcttatatgggcaagttggaaagctgaaactggcagaagagatcttcttggagatgcttgatgtggattgtgagccagatgaagttgcttgtggtaccatgctttgttcgtatgccagatggggacaccacagggctatgctgtctttttattctgctgtaaaagaaaggggaacaattctctctgttgctgtctataattttatgatgtcttctttacaaaagaaatcactccatagagaggttgtacagatgtggaaggatatggtggaaaaaggggtgatacctaatagttttacttataccgtatccatcagctcacttgtcaaagaagggctgcatgaagatgctttcaagacttttgatgagatgaggaataatggagttgttcctgaggaggtaacttataatctgcttataaacataagtgctaaaagtggcaacagagatgaagtgcaaagactgtatgaggatatgctttttcgaggaatagttcctagtaattacacctgtgcttcacttttatctttatattacaaatatgaggactaccctagagccctgtcccttttttcactaatggtaagcaacaaaattgccgctgatgaagtcatatgtggtttgcttataagaatttatggaaaactgggcttatatgaggatgctcaaaaaacatttgaagagacaaatcagcgtggtcaactcaccagtgagaaaacatatttggcaatggctcaagtccatcttgcttcaggaaaactagacaaagccttacaagttattgaactcatgaggtctagcaacctatggttctctcgatttgcatatattgtgctgctgcagtgttatgtgatgaaagaagatgtagtatctgctgaaggaacatttgtagctctctccaaaacaggtccacctgatgctggttcttgtaatgatatgctcagtttgtatgtggggcttaatttgattaataaggccaaggagttcattatccaaataagggaggatgagacccattttgacaaggagctttatagaacagttatgagggtttattgtaaggagggaatgctgctagaagctgagcagttgacatatcagatggttaataatgaatcttttcgaagtgataaattcttcaagacattttattggattctctgtgaatataagggggatgcacaatctaatgatgaacttgtggccattgagcccattgaaaaatttgacgctacagctcttgggctgatgctcagtttatttctgacaaatgacaacttcagcaagacaaacttattactgaaactgttgttgggttatgcttctgggggatcaaaagttgttagtcaactcatcatcaacttgtctaaagaaggagaaatcagtaaggcagaattgcttaatcatcaactaattaagcttggctgcagaatggaagaagccgctgtagcttctctaattaatcattatggcaaacaacaaatgctgaaacaagctgcagatatctttgcagaatatgtaaatccctcctcatctagtaaactgctgtataactctatgatcaatgcatatgctaaatgcgggaaacaagagaaagcctatttgctatacaagcaagtgactgaggaaggacatgatttgggcgctgttggaatgagcattgctgtaaattctttgaccaatggaggaaaacatcaggaggctgagaattttattcacagcagtcttaaagacaacctggagcttgacactgtggcttacaatacctttatcaaggccatgcttgaagcaggcaaattgcaatttgcatccagtatttttgaccgcatgaattcctctggtgtttctccatcaattgaaacattcaacacaatgataagtgtctatggacaagatctgaagttggatagagcattggagatgttcaacaaagctagctcatttggtctcccgccggatgaaaaaacatacatgaatttgattggctattatgggaaagctggtatgattcttgaagcttccaagttgttcagtaaaatgcaggaagaaggtataaagcctggaaaggtaagttacaatatcatgatcaatgtatatgctactgccggagatcttcatgaaacagataaaattttccaggccatgcagaggcaaggttgtttgcctgattctttcacgtatctttcccttatccaagggtacacaaggaacaggaattatcataaagccgaggaaactttatatgctatgcagagaaaaggcattccaccgtcttgtgtccattttaatattttactccacgctttctcaaaagctgggttgattgaggaagccaggagggtttatgaggggctatcaacttttggtttagttcctgatctagtatgttaccgtacaatggtaaatggttacctgaaatgtggatatgtggatgaaggaacaaagttatttgaaagtatacgtgaatcaacaaaaggagacaggttcatcatgagtgcagctgtgcatttttacaaatctgctggaaaggaaagcaaagctaaagaaatattaatttcaatgaacaacaaggggatcccattcctgaggaatcttgaagttggatcagaagagagagtgaaaactccatgagatatttgtgtacttgagaagcattctgatgatggaaaaaggattagtgttataattacatataaatctaatcaacctggtaatggttattgtggatgctgcatgtatgtttttgctggcaacgatggttgggctcttggttcagaagtacttttagcaaaagggacaggatccacgtttgttgcagtgcaatctttgccttttgactgctcttcctgcccaaccttcctttgaaagtgtaagtcaagcattctgttaatggaaaaaaagaatagttatgactataaaacatataaatcgaatcaacctggtaatggttactgtggatgctgcatgtatgtttttactggcaacgatgataagtactttataccaagttatgagatggactttatagatattatagactccaggcacgaagagattctgagcattctatgttccttccaacataactgacgaaatggcactgctgaagtgatgagaccccaagtgtgtgtgcaaagacagaagagtagagatatggatagggatcagatacacttgtaactaaatcagtacatttgtaactaactaaactgtgactagtagaataaataggaggttggttggaggagcaaagggttgttgtattgtttactggtatagtaagcactctcaaattgccctaatctgtacaaggatgttagaataaaatctgtattttttctgcaagtcacgtcaatccctaaaatctgaggaagccattactctggtttacccaaaatttgagcagcagggaattgtatggatgaagctcaacagaaaccagttttgaagacaccggcgatgaggttgaagaacaaaactaaagattcttaggttgacttgtcctttttcagaagagaaagaactgtgctgcagtcttgcagaaactatagggtataaattagagtttgaaaatatgaagacaactcatggtagaaaaccttagggacttatttattacttagttaaacggacatatttatcttgttttggaggctattgtattgttagatgtttactcctattttatgtagattaacacttaaaatggaggacttgcaactactattttgtttctgataat

SEQ ID NO: 7526 - DNA, 4362 bp, Phaseolus vulgaris
tgaacgtgaggtgaagtgtctgtgggagctccatagtaatggagtgtctgaaatcccctctcctctacttgactccaccttccaaacctcatccccttgtggcaaagacaaagaagaagagaccccctcccgttctcattcgctgctccatcaagcgcgacccgtggtctccgacttttggcgaccccacgcgcccgaaaccgtggacgaagaacccgaagaaacctctgtcggacgacaacgcgcggcgcatcataaagaataaggcggcgtaccagagcattctgcggcggaaccagggcccgcaggcgcagaccccgagatggataaagaggacccccgaacagatggtccagtacttgcaagacgaccgcaacggtcacctctacggcaagcacgtcgtggccgcaataaaaaaagtacgctctctctcccagaaagttgatggcgactacgacatgaggatggagatgggttcctttgtcggaaaactcagcttcaaggagatgtgcgtcgtgctcaaggagcaaaaggggtggaggcaagtcagagacttcttttattggatgaaattgcagttgagctacagaccaagtgtaattgtctacacaatagtattgcgcttatatgggcaagttggaaagctgaaactggcagaagagatcttcttggagatgcttgatgtggattgtgagccagatgaagttgcttgtggtaccatgctttgttcgtatgccagatggggacaccacagggctatgctgtctttttattctgctgtaaaagaaaggggaacaattctctctgttgctgtctataattttatgatgtcttctttacaaaagaaatcactccatagagaggttgtacagatgtggaaggatatggtggaaaaaggggtgatacctaatagttttacttataccgtatccatcagctcacttgtcaaagaagggctgcatgaagatgctttcaagacttttgatgagatgaggaataatggagttgttcctgaggaggtaacttataatctgcttataaacataagtgctaaaagtggcaacagagatgaagtgcaaagactgtatgaggatatgctttttcgaggaatagttcctagtaattacacctgtgcttcacttttatctttatattacaaatatgaggactaccctagagccctgtcccttttttcactaatggtaagcaacaaaattgccgctgatgaagtcatatgtggtttgcttataagaatttatggaaaactgggcttatatgaggatgctcaaaaaacatttgaagagacaaatcagcgtggtcaactcaccagtgagaaaacatatttggcaatggctcaagtccatcttgcttcaggaaaactagacaaagccttacaagttattgaactcatgaggtctagcaacctatggttctctcgatttgcatatattgtgctgctgcagtgttatgtgatgaaagaagatgtagtatctgctgaaggaacatttgtagctctctccaaaacaggtccacctgatgctggttcttgtaatgatatgctcagtttgtatgtggggcttaatttgattaataaggccaaggagttcattatccaaataagggaggatgagacccattttgacaaggagctttatagaacagttatgagggtttattgtaaggagggaatgctgctagaagctgagcagttgacatatcagatggttaataatgaatcttttcgaagtgataaattcttcaagacattttattggattctctgtgaatataagggggatgcacaatctaatgatgaacttgtggccattgagcccattgaaaaatttgacgctacagctcttgggctgatgctcagtttatttctgacaaatgacaacttcagcaagacaaacttattactgaaactgttgttgggttatgcttctgggggatcaaaagttgttagtcaactcatcatcaacttgtctaaagaaggagaaatcagtaaggcagaattgcttaatcatcaactaattaagcttggctgcagaatggaagaagccgctgtagcttctctaattaatcattatggcaaacaacaaatgctgaaacaagctgcagatatctttgcagaatatgtaaatccctcctcatctagtaaactgctgtataactctatgatcaatgcatatgctaaatgcgggaaacaagagaaagcctatttgctatacaagcaagtgactgaggaaggacatgatttgggcgctgttggaatgagcattgctgtaaattctttgaccaatggaggaaaacatcaggaggctgagaattttattcacagcagtcttaaagacaacctggagcttgacactgtggcttacaatacctttatcaaggccatgcttgaagcaggcaaattgcaatttgcatccagtatttttgaccgcatgaattcctctggtgtttctccatcaattgaaacattcaacacaatgataagtgtctatggacaagatctgaagttggatagagcattggagatgttcaacaaagctagctcatttggtctcccgccggatgaaaaaacatacatgaatttgattggctattatgggaaagctggtatgattcttgaagcttccaagttgttcagtaaaatgcaggaagaaggtataaagcctggaaaggtaagttacaatatcatgatcaatgtatatgctactgccggagatcttcatgaaacagataaaattttccaggccatgcagaggcaaggttgtttgcctgattctttcacgtatctttcccttatccaagggtacacaaggaacaggaattatcataaagccgaggaaactttatatgctatgcagagaaaaggcattccaccgtcttgtgtccattttaatattttactccacgctttctcaaaagctgggttgattgaggaagccaggagggtttatgaggggctatcaacttttggtttagttcctgatctagtatgttaccgtacaatggtaaatggttacctgaaatgtggatatgtggatgaaggaacaaagttatttgaaagtatacgtgaatcaacaaaaggagacaggttcatcatgagtgcagctgtgcatttttacaaatctgctggaaaggaaagcaaagctaaagaaatattaatttcaatgaacaacaaggggatcccattcctgaggaatcttgaagttggatcagaagagagagtgaaaactccatgagatatttgtgtacttgagaagcattctgatgatggaaaaaggattagtgttataattacatataaatctaatcaacctggtaatggttattgtggatgctgcatgtatgtttttgctggcaacgatggttgggctcttggttcagaagtacttttagcaaaagggacaggatccacgtttgttgcagtgcaatctttgccttttgactgctcttcctgcccaaccttcctttgaaagtgtaagtcaagcattctgttaatggaaaaaaagaatagttatgactataaaacatataaatcgaatcaacctggtaatggttactgtggatgctgcatgtatgtttttactggcaacgatgataagtactttataccaagttatgagatggactttatagatattatagactccaggcacgaagagattctgagcattctatgttccttccaacataactgacgaaatggcactgctgaagtgatgagaccccaagtgtgtgtgcaaagacagaagagtagagatatggatagggatcagatacacttgtaactaaatcagtacatttgtaactaactaaactgtgactagtagaataaataggaggttggttggaggagcaaagggttgttgtattgtttactggtatagtaagcactctcaaattgccctaatctgtacaaggatgttagaataaaatctgtattttttctgcaagccacgtcaatccctaaaatctgaggaagccattactctggtttacccaaaatttgagcagcagggaattgtatggatgaagctcaacagaaaccagttttgaagacaccggcgatgaggttgaagaacaaaactaaagattcttaggttgacttgtcctttttcagaagagaaagaactgtgctgcagtcttgcagaaactatagggtataaattagagtttgaaaatatgaagacaactcatggtagaaaaccttagggacttatttattacttagttaaacggacatatttatcttgttttggaggctattgtattgttagatgtttactcctattttatgtagattaacacttaaaatggaggacttgcaactactattttgtttctgataat

SEQ ID NO: 7527 - DNA, 2250 bp, Glycine max
caacttcaatttcaacttcgaaatagtataactttttctcgcagcacacacagcatagtaccatggatgcgctgcgcgtcgcccccaccaccccgcctctcctccgccgccaccctctccgcaaaatggcgccccatcccctcaccgcgcgtccccgccgcgcgcccctcatcgtcgccacgctttccatgccgccggaggccactcactcctccgccgtcgccatcgtcgaagatccctcggaggcggctcctcctccgcgcccccgcgtctcgccggattccctccagtacccgcccggcttcgtcggcgcgattcccgccagctctcgctcagacggcggcgacggcgacggtatgaataatgccatgacttatttgacgaacattctctcttcgaaggtatatgacgtggcgattgagtcccctctgcaattggcgccaaagctctctgcgagactcggggttaaggtttggctcaagagagaggatttgcaacccgttttctcatttaagcttcgtggagcttataatatgatggcaaagcttccgacggaattgttggaaaagggggttatctgctcgtctgctgggaaccatgctcaaggagttgcattggctgccaagaggttgaattgcagtgcggtgattgctatgcctgtcaccactccagaaataaagtggaaatccgtggaggctctgggtgctacagttgtgctcgtgggggattcatatgatgaagcacaagcatatgctaagaagcggggggtagaggagggtaggacattcatacctccttttgatcatcctgatgtcatcatgggtcagggaacaattggcatggaaattgtccgccaaatgcaaggtccaatttatgcaatctttgtgcctgtgggaggtggtggtctcattgctggtattgctgcttatgtgaagagggttaacccagaggtgaagatttttggggttgagcccactgatgcaaatgcaatggcgttgtcactccaccatgaccagagagtgattttggaccaggttgggggatttgcagatggcgtagctgttaaagaggtcggtgaagaaactttccgcatatgcaaggagttgatagatggcattgttcttgtaagccgtgattcaatttgtgcgtcaataaaagatatgttcgaggagaaaaggaacatattagaaccagcaggagcacttgcactagctggagctgaggcatactgcaagcatcatgggatccaggggaaaaatattgtagcaataaccagtggagcaaacatgaattttgataaacttcgggttgtaactgaacttgctaatgttggtcgtaaacaagaggctgtgctggcaactgttatggcagaggagcctggcagtttcaaacaattttgtgaattggtggggcagatgaacataacagaattcaaatacagatataactcaaatgagaaggcagttgtcctttacagtgttggggttcacacaatctccgaactaagagcaatgcaggagaggatggaatcttctcagctcaaaacttacaatctcacagaaagtgacttggtgaaagaccacttgcgttacttgatgggaggccgatcaaacgttcagaatgaggttctttgtcgtctcacctttccagaaagacctggtgctttgatgaaatttttggactccttcagtccacgttggaatattagtttattccattaccgaggggagggtgaaactggagcaaacgtgctagttggattacaggtacccaaaagtgagatagatgagttccatgatcgtgctaacaaacttggatatgattataaagtggtgaataatgatgatgacttccagcttctaatgcactgatgggggttttaggcacttgtcattattgtgtattttagtggacaagattatcatatttaatatttccactgtcgcttcaaaaggttagatgtcattagttgattagaggaacaactagtgctttttacctagtgaggtgtcttatcacatttttataatcggtagtttatgttttttttttttttttgggaagcattggaatcttatatgttgttgcctggtcttttgtgtctgtaatataagtgtcttcaaaaggttgtttgctcgccaatcgcctgtattcccttcctttagcaaatcataagaaaataagacttttttttttaacagtgtttggttagaagcaaatgaggaatggagaaattttataaactttgat

SEQ ID NO: 7528 - DNA, 2226 bp, Glycine max
agtataactttttctcgcagcacacacagcatagtaccatggatgcgctgcgcgtcgcccccaccaccccgcctctcctccgccgccaccctctccgcaaaatggcgccccatcccctcaccgcgcgtccccgccgcgcgcccctcatcgtcgccacgctttccatgccgccggaggccactcactcctccgccgtcgccatcgtcgaagatccctcggaggcggctcctcctccgcgcccccgcgtctcgccggattccctccagtacccgcccggcttcgtcggcgcgattcccgccagctctcgctcagacggcggcgacggcgacggtatgaataatgccatgacttatttgacgaacattctctcttcgaaggtatatgacgtggcgattgagtcccctctgcaattggcgccaaagctctctgcgagactcggggttaaggtttggctcaagagagaggatttgcaacccgttttctcatttaagcttcgtggagcttataatatgatggcaaagcttccgacggaattgttggaaaagggggttatctgctcgtctgctgggaaccatgctcaaggagttgcattggctgccaagaggttgaattgcagtgcggtgattgctatgcctgtcaccactccagaaataaagtggaaatccgtggaggctctgggtgctacagttgtgctcgtgggggattcatatgatgaagcacaagcatatgctaagaagcggggggtagaggagggtaggacattcatacctccttttgatcatcctgatgtcatcatgggtcagggaacaattggcatggaaattgtccgccaaatgcaaggtccaatttatgcaatctttgtgcctgtgggaggtggtggtctcattgctggtattgctgcttatgtgaagagggttaacccagaggtgaagatttttggggttgagcccactgatgcaaatgcaatggcgttgtcactccaccatgaccagagagtgattttggaccaggttgggggatttgcagatggcgtagctgttaaagaggtcggtgaagaaactttccgcatatgcaaggagttgatagatggcattgttcttgtaagccgtgattcaatttgtgcgtcaataaaagatatgttcgaggagaaaaggaacatattagaaccagcaggagcacttgcactagctggagctgaggcatactgcaagcatcatgggatccaggggaaaaatattgtagcaataaccagtggagcaaacatgaattttgataaacttcgggttgtaactgaacttgctaatgttggtcgtaaacaagaggctgtgctggcaactgttatggcagaggagcctggcagtttcaaacaattttgtgaattggtggggcagatgaacataacagaattcaaatacagatataactcaaatgagaaggcagttgtcctttacagtgttggggttcacacaatctccgaactaagagcaatgcaggagaggatggaatcttctcagctcaaaacttacaatctcacagaaagtgacttggtgaaagaccacttgcgttacttgatgggaggccgatcaaacgttcagaatgaggttctttgtcgtctcacctttccagaaagacctggtgctttgatgaaatttttggactccttcagtccacgttggaatattagtttattccattaccgaggggagggtgaaactggagcaaacgtgctagttggattacaggtacccaaaagtgagatagatgagttccatgatcgtgctaacaaacttggatatgattataaagtggtgaataatgatgatgacttccagcttctaatgcactgatgggggttttaggcacttgtcattattgtgtattttagtggacaagattatcatatttaatatttccactgtcgcttcaaaaggttagatgtcattagttgattagaggaacaactagtgctttttacctagtgaggtgtcttatcacatttttataatcggtagtttatgttttttttttttttttgggaagcattggaatcttatatgttgttgcctggtcttttgtgtctgtaatataagtgtcttcaaaaggttgtttgctcgccaatcgcctgtattcccttcctttagcaaatcataagaaaataagacttttttttttaacagtgtttggttagaagcaaatgaggaatggagaaattttataaactttgat

SEQ ID NO: 7529 - DNA, 2312 bp, Cajanus cajan
caaattacaattctttctaaactcataaattttttgccccaaccacactatggatgccctgcgcgtcacacctacacccgcgccactgctccgccgccaccacagccgcgaaatggcgcgctgccccgttccgccgcgcccccgtattaagcccttcgtcgccgccaagctgtccaaaccgccggaggctgcgcactcttccaccgcctccgccgtggttgtggaggatctctcggcggtggctcctccgcggccccgggtgtcgccggaatccctccagtacccgcctggctacgtcggcgcgattccgagccggtcgggttccgaaacgagcgagggcgtgatgggtgcgatgacttatttgacgaatattctctcttccaaggtctatgacgtggccattgagtcccctcttcaattggcgccaaagctttctgatagactcggtgttaatgtttggctcaagagggaggatttgcagcctgttttctcgttcaagcttcgtggagcttataatatgatggcaaagcttccgagtgaaacgttggagaagggggttatttgctcgtctgctgggaatcatgctcaaggagttgcattatctgccaagaggttgaattgcagtgcggtgattgctatgcctgttaccactccagaaatcaagtggaaatctgtggaggcgctgggtgccacggttgtgcttgtgggagattcctatgatgaggcacaagcatatgctaagaagcgggggctagaggagggtaggacattcatacctccttttgatcaccccgatgtcattatgggtcaggggacggttgggatggaaattgtgcgccaaatgcctaatgaattgtttgcaatctttgtgcctgtgggaggtggtggtctcattgctggtattgcagcttatgtgaagagggtttctccagaggtgaagattattggggtggagcccactgatgcaaatgcaatggcattgtcactccatcatgaccagagagtgattctggaccaggttggaggatttgcagatggtgtagctgttaaagaggttggtgaagaaacttttcgcatatgcaaggagttgatagatggtgttgttctagtaagccgtgattcaatatgtgcatcgataaaggatatgtttgaggagaaaaggaacatattagaaccagcaggtgcacttgcactagctggagctgaggcatactgcaagtataatgggatccaggggaagaatattgtagtaataaccagtggagcaaacatgaattttgataaacttagggttgtaactgaacttgcaaatgttggtcgtaaacaagaggctgtgctagcaactgttatgccagaggagcctggcagttttaaacaattttgtcaattggtggggaaggtcaacatcacagaattcaaatatagatataactctaatgagaaggcggtggtcctatacagtgttggagttcacacagtctcagaactaagagcaatgcaagagaggatggaatcttgtcttctcaaaacttacaatctcacagaaagtgacttggtgaaagaccacttgcgttacctgatgggaggccggtcaaacgttcagaatgaggttctttgtcgtttcacctttccagaaagacctggtgctttgatgaaatttttggactccttcagtccacgttggaatattagtttattccattaccgaggggagggtgaaactggagcaaatgtactagttggaatacaggtgcccaaaaatgatatggatgagttccacggtcgtgccaacagacttggctatgattataaagtggtgaataatgatgatgacttccagcttctaatgcattgatgatggtgttaggcactagtcattattgtgtattttagtggacaagtttgtcatatttaattccacggtcgcttccaagagttggaaaggaagtggccccttcgggcatgtcattagttaattagaggaaactagtgctttttacctagtgtgacagcttgttacatttttataatatgtaacttatgttttgtttttggaacctttgaaataccctattgttgactagtcttttgtgtctgtaatgtaatataagcgccctcaaaaggttgttgtttgcttaacagcagcctgagcattgtggtgctgcgttttaacttttaaatgctgaaaaccttgaatgaaacagccttgtgttcgcagaagaacactagtcgtgaaggactagtttgagaagaaccaagggaataaccttcacatgagcctcacgagaatgacatgactaaaggagctgttt

SEQ ID NO: 7530 - DNA, 2327 bp, Phaseolus vulgaris
aatttgttccgcagacccagcctacctcctcactgccatggattcgttgcgcgtcgccactacaccgccacctcttctccgccgacaagctctctaccaaatgacgcgccacccccttgcggcgcgtcccagccccaagcccttcatcgccgccacgctttccacgccgccagaggctgcgcactcttcttcctatgctgtcgtcgttgaggatgccccgacggtggctcccccgcgcctccgggtctcgcctgatgccctccagtacccacccggatacgtcggcgcggttcctaaccggtcccgccccgacagtggtggcgacggcgtgatgaatgcgatgaattatttgacgaatattctcacctcgaaggtctatgacgtagctatcgagacccctctgcaattggcgccaaagctttctacgagactcggggttaaggtttggctcaagagagaggatttacaacctgttttctcatttaagattcgtggagcttataatatgatggcaaagcttcccagggagttgttggaaaagggggttatctgctcgtctgctgggaatcatgctcaaggagttgcattttctgccaagagattgaattgcagtgcggtgattgttatgcctgttaccaccccggaaatcaagtggaaatctgtggaggcgctgggtgctaaggttgtgcttgtgggggattcatacgatgaagcacaagcatatgctaagaagcaggcggtagaggagggtaggactttcatacctccttttgatcatcccgatgtcatcatgggtcagggaacagttgggatggaaattgtgcgccaaatgcagggtccattgcatgcaatctttgttcctgtgggagggggtggtctcattgctggtattgctgcttatgtgaagagagttaatccagaggtgaggattattggggtggaaccctctgatgcaaatgcaatggcgttgtcattccatcatgatcagagagtaattttggaccaggttggaggatttgcagatggtgtggctgttaaagaggttggtgaagaaactttcagaatatgcaaggagttggtagatggtgtagttcttgtaagccgagattcaatttgtgcgtcaataaaggatatgtttgaggagaaaaggaacatattggaaccagcaggtgcacttgcacttgctggagctgaggcatactgcaagtataatggaatccggggtgaaaacattgtagtaataaccagtggagcaaacatgaattttgataaacttcgtgttgtaactgagctagctaatgttggtcgtaaacaagaggctgtgctggccactattatgccggaggaacctggcagtttcaaacaattttgtcaattggtggggcaggtgaacatcacagaattcaaatacagatacaactctgatagaaaggctgttgtcctttacagtgttggggttcacacagtctccgaactaagagcaatgcaggagaggatggaatcttctcagcttaaaacttacaatctcacagaaagtgacttagtgaaagaccacttgcgttacctgatgggaggcagatcaaatatacagaatgaggttctttgtcgttttacctttccagaaagacccggtgccttgatgaaatttttagaccccttcagtccacgttggaatattagtttattccattaccgaggggagggtgagactggagcaaatattctagtaggtatacaggtacccaaaagtgagatggatgaattccatgaccgtgccaacagactgggatacgattatcaagtggtgaataatgatgatgacttccaactactaatgcactgatgatggttttaggcacttgtcattattgtgcatttgagtggacaagatgtccatatttaatatttcatcgatcacctctaaaagtttcgatgtggggaagccggaaagaaagtggcccttcagacatgtaattggttgatagaggaagtagctcttattatctagtgaggcatcttgtcacaatttttataatgtgtaattttatcttttgttttttattttggaaagcatggtggagtcctataatattgttgactggtcttttttccctgtaatataagcctctcaaaagggttgtttgctaaactcagcagcctgaccattgtggtgcagcgtttaatatgttcaaaaacttgaacttttcgtctagcattaatggaacaacaataatgaagagcaacctttggtgacaatgctgacactattatatggggttggcctacttttattaatatttaatcttgtgcagggcattacctactcc

SEQ ID NO: 7531 - DNA, 2311 bp, Phaseolus vulgaris
tttgttccgcagacccagcctacctcctcactgccatggattcgttgcgcgtcgccactacaccgccacctcttctccgccgacaagctctctaccaaatgacgcgccacccccttgcggcgcgtcccagccccaagcccttcatcgccgccacgctttccacgccgccagaggctgcgcactcttcttcctatgctgtcgtcgttgaggatgccccgacggtggctcccccgcgcctccgggtctcgcctgatgccctccagtacccacccggatacgtcggcgcggttcctaaccggtcccgccccgacagtggtggcgacggcgtgatgaatgcgatgaattatttgacgaatattctcacctcgaaggtctatgacgtagctatcgagacccctctgcaattggcgccaaagctttctacgagactcggggttaaggtttggctcaagagagaggatttacaacctgttttctcatttaagattcgtggagcttataatatgatggcaaagcttcccagggagttgttggaaaagggggttatctgctcgtctgctgggaatcatgctcaaggagttgcattttctgccaagagattgaattgcagtgcggtgattgttatgcctgttaccaccccggaaatcaagtggaaatctgtggaggcgctgggtgctaaggttgtgcttgtgggggattcatacgatgaagcacaagcatatgctaagaagcaggcggtagaggagggtaggactttcatacctccttttgatcatcccgatgtcatcatgggtcagggaacagttgggatggaaattgtgcgccaaatgcagggtccattgcatgcaatctttgttcctgtgggagggggtggtctcattgctggtattgctgcttatgtgaagagagttaatccagaggtgaggattattggggtggaaccctctgatgcaaatgcaatggcgttgtcattccatcatgatcagagagtaattttggaccaggttggaggatttgcagatggtgtggctgttaaagaggttggtgaagaaactttcagaatatgcaaggagttggtagatggtgtagttcttgtaagccgagattcaatttgtgcgtcaataaaggatatgtttgaggagaaaaggaacatattggaaccagcaggtgcacttgcacttgctggagctgaggcatactgcaagtataatggaatccggggtgaaaacattgtagtaataaccagtggagcaaacatgaattttgataaacttcgtgttgtaactgagctagctaatgttggtcgtaaacaagaggctgtgtggccattacggccgggggaacctggcagtttcaaacaattttgtcaattggtggggcaggtgaacatcacagaattcaaatacagatacaactctgatagaaaggctgttgtcctttacagtgttggggttcacacagtctccgaactaagagcaatgcaggagaggatggaatcttctcagcttaaaacttacaatctcacagaaagtgacttagtgaaagaccacttgcgttacctgatgggaggcagatcaaatatacagaatgaggttctttgtcgttttacctttccagaaagacccggtgccttgatgaaatttttagaccccttcagtccacgttggaatattagtttattccattaccgaggggagggtgagactggagcaaatattctagtaggtatacaggtacccaaaagtgagatggatgaattccatgaccgtgccaacagactgggatacgattatcaagtggtgaataatgatgatgacttccaactactaatgcactgatgatggttttaggcacttgtcattattgtgcatttgagtggacaagatgtccatatttaatatttcatcgatcacctctaaaagtttcgatgtggggaagccggaaagaaagtggcccttcagacatgtaattggttgatagaggaagtagctcttattatctagtgaggcatcttgtcacaatttttataatgtgtaattttatcttttgttttttattttggaaagcatggtggagtcctataatattgttgactggtcttttttccctgtaatataagcctctcaaaagggttgtttgctaaactcagcagcctgaccattgtggtgcagcgtttaatatgttcaaaaacttgaacttttcgtctagcattaatggaacaacaataatgaagagcaacctttggtgacaatgctgacactattatatggggttggcctacttttattaatatttaatcttgtgcagggca

SEQ ID NO: 7532 - DNA, 2128 bp, Lupinus angustifolius
atgaatcccacataactaaacaagagtcaatgtctgaatcacatgcgccacatcttcattaataattccattccattccattcacccttcttcatcaacaatggaggcgcttcgattctcaccgaccaaccctctattccgtttcaacaacgcgccacccaacgccgcccgtctcaaccctttcatcgccgcctccgtttccctcccggcggagatagctcccatttctcactctcctcttatacctcctcgcccaattgttaagtccaactccttacagtatccgccgggatatgtcggagcggttcccgatcactctccttcctccggcgacgacagtgcgatgagatatttgacgaatatactgtcctcgaaggtttatgatgttgctattgaatcacctcttcagttggcgccaaaattatctgaaagattaggggttaggatttggctcaagagagaagatttgcaacctgttttctcatttaagctccgtggagcttataatatgatggcgaagctttcaaaggaacaattggagaaaggagttatctgctcatcagctggaaatcatgctcaaggagttgcattatccgctaagagactgaattgcagtgctgtgattgctatgcctgttactacgccagacatcaagtggaaatctgtagagaatctgggtgctacagttgtactcattggggattcatatgatgaagcacaagcatatgctaagaaacgtgcaatagaggatggtcgtacatttgtacctccttttgatcatcccgatgttatcataggtcaaggaacagtgggaatggaaattgtgcgccaaatgcagggtccgctgcatgcaatctttgtgcctgtgggaggtggtggtctcattgctggtattgctgcttatgtgaagagggtttctccacaggtgaagatttttggagtggagcccactgatgcaaatgcaatggcattgtcatttcatcatggtgaaagagtgattttggaccaggttggaggatttgcagatggtgtagctgttaaagaggtcggtgaagaaacttttcgcatatgcaaagagctggtagatggagttgttcttgtaagccgtgattcaatttgtgcttcgataaaggacatgtttgaggagaaaagaagcatactagaaccagcaggcgcacttgcccttgctggagctgaggcatactgcaagtattatgggctcaaggggggaaatgttgtagcaataaccagtggggcgaacatgaattttgataaacttaggatcgtaactgagcttgctaatgttggtcgtaaacaagaggctctgcttgctactattttgccagaagagcctggcagtttcaaacatttttgtcaattggtggggcagatgaatattactgaattcaagtacagatataatagcaaggacaaagctgttgtcctttacagtgttggggtacatacagtctcagaactaaaggcaatgcaagagaagatggaatcttgtcagcttgaaactgtcaatctcacagaaagtgacttggttaaagatcacttgcgttacctgatgggaggcagatcaaatcttcagaatgaggttctatgccattttacctttccagaaagaccaggtgctctggtgaaatttttggactccttcagtccccgatggaacatcagcttattccattatcgtggccagggtgcaactggagcaaatgtattggttggaatacaggtaccacaaagtgagatggatgaattccgcgatcgtgccaccaaacttggatacgattatacggtggtgaacaatgacaatgtcttccagcttttaatgcaccgatgattttcgccactagcctgcactgtgagtttaggtgtactagattatcatatttattccaactgtggacttcattgaaggaggggttggatagaggcaagcctgcatgaaaatgcctcctccaggcatcaatttcagttgattagaggaacaagtgccttgtaactactagataaagcaaattgtggtttatgtttcccatgttgcagcactttatcacattgatttgctctataatttaagttttgtttattttcggaaaggattgaaatcctccgatgc

SEQ ID NO: 7533 - DNA, 1684 bp, Glycine max
aaagttagcgcgtgtgtaagaacgtttgattagtaactctggttagaaggagcataataaacctgcaattgttacagcaatataaaacggaaagacgaatagccaagagcgcgcactcactcactcacttattgcgtcaactgtactccatatcatatcaactggagctggggaacctcgtctctactcgctctcgtccccgccggagatccaccatggccggcaactccgccaccgccaccgccacctcctccgcattgtctcccgagaatttgaaattcaatttctcccccgataacccctcccgaatcatcctcacttcggatcaggtcaaccactgtacccaagccctcaaccttctgaaggagaagctccacgatcctcacgtgatcactcaggagttcgcacacttgcaggcgaacaggataactccgagtgagatgagaagaagatgcaccgtcgcgtatgacgccgtcaatttgagcaaaaaccgatacacggacgttttgccatttaacaagaacagggttgttctcaaatcaagtactgattataggcctgaagcacaggggtatatcaatgcaagccttatctcgacctcttccgctggaaatgtgtcccactttatagccacacaaggtccacttccacatacttgtgaggatttttgggaaatgattacccaatatcactgccctgtgattatcatgcttactaggttggtggataattacaagatggtaaagtgtgtagattattttcaagctgaggatgggcctagagaagttggtaatatttctattattggtaaatgggagaacactactgaaacttcactggtgttgcgccatttggaggtgaaccatagagaggtagatgatgcaccattatctgttttgcatattcagtatcctgaatggcctgaccatggagttccaaaagatacactagctgtgcgtgaaattttgaaaagattataccatttaccatcaaaccttggtccaatagtggtgcactgcagtgcaggtattggtagaactggagcatactgcacaattcacaacacaattcagagaatacttgctggagatatgtctgctgtacgcattgctaacacaatagctatgttcaggtcccagcgtattggaatggttcaaacccaggaccagtacattttctgctataatgctatcatagatgaactggaagaccttgtatctcagcagcaataggagtagaagggcagggaatttgattattttgttagaattctattggggaacagaatggcataatgactacaaattgtccctcctgttgctatttttcattttctaaataaacccctcccctcccctcaccctccacgcccccacctccctctttcattttatgatgaagatcataacttttaggatgtttttggcagaactaatttgcagtatatttggatttatcttataagctttctaaaataccttatgaaaatattttaatcatatttttcatttttattctagaaataaatacctatacgataaatacttatttaataagcgcttagttaaggtatttactccaaaaaaagaaagcacctcggagtactaggcgtagttgttaactctatctatatgtactaggtgcattcgatcgctgggaacctcgtttgaatcgtctatgagta

SEQ ID NO: 7534 - DNA, 1531 bp, Cajanus cajan
ataaaaaccgaaaggggaaaagcaaagagcgcactcactcacttattgcgtcaattccactccatttaacggtgaagtgaggaggagaatacgacgtcgctggagctggggaacctcgtctctactcgctctcgtccccggcggagatccaccatggccggcaatcccaccaccaccgcctcctccgcattatctcccgagaaattcaatttctcgcccgattacccctcaaaaatccccctcacttcggatcagctcaaacactgcacccaggccctcaaccttctcaaggacaaattccacactcctcacaaaatcactgaggagttcgcacacttgcaggggaacagaataacaccgagtgagatgaggagaagatgcaccgtcgctctcgacgccgtcaatttgagcaagaatcgttacacggacgttttaccatttgacaacaacagggttgttctcaagtcaagtacagattatagacatgcagcactggggtatatcaatgcaagccttgtctcgacccctggaaatgtgtcccagtttattgccacacaaggtccacttccgcatacttacgaggatttctgggaaatgattattcaatatcactgccctgcgattatcatgcttactaggttggtggaccattacaggacagtaaagtgtggagattattttcaagctgaggatggacccagagaagttggtaatatttctattgttggtaaatggatgagcactactgaaacttcgctggtgctgcgccatttagtggtgaaccatagagaggtagaagaggccgcattatctgttttgcatattcagtatcctgaatggcccgaccatggagttcccaaagatacttttgctgtgcgtgaaattttgaaaagattgtaccatttacctcccaaccttggcccaatagtggtgcactgcagtgcaggtattggtagaactggaacatactgcacgattcacaatacaattcagagaatacttgctggtgatatgtctgctgtagatattgctaacacaatagctgtgttcaggtcccagcgtattggaatggttcagaccaaggatcagtacgaattctgctataaagctatcattgatgaactggaagaccttgtatctcagcagtaataacagtagaaggggtgctggaaggatgtttagcttgaagctaactttcaattcttcgatctctatttttggttccctgcaatgcttatgtctcctggcagctgagtctgaaactctggcattccggagactttatcgaacttattctcaagctttcatgtataattgctggcaggggaaaactgacaaatattagcatccttttgattgttagaattctattggggaacataatggcataatgactagaataatcaagtccattgtccctcctgttactatcttttattttcttaaacccaccaccccactccctctgcgaagaatatgcatctgaaatattttctgttcatttaaatttattatataacttttagggtgt

SEQ ID NO: 7535 - DNA, 2849 bp, Cicer arietinum
gttacttttgaagattcccggttaattgtaaatttacaattaaagaagatttgagaaatttaaaagttaaagaatattggaggaggaataatagagaaaaagattggagaaaaattgagaagaagaagagtgagattgttattttttgaagagaaaaaaatgatcaatttgttgaccaaaaagattagtcgtccaagtagacacttaatgaatccaacaagcttaacctatcactaagtagaagtggacagaaagatctaagagaaacattttacaaaaacaaaaactatttaaaatattgacaaagtcaaaaacctgtttacgatcttgaaatgattaagattgtacaatttttattttaactttaaccacacaattatcaagaaaatgaaacacggataatctaaatttcaacaaaaagataaataatattggatcaataattatgattatgaagtgaaatgaaataattgagtatatgataaatatgtgattaatgcgtatttaatatccaaaaaggcactaagagaatgggaaagtgagggtgaactgagaatccaaatcacacaaaccccactcaacggttgaactggggaacctcgtttctacctgctcccgtcctcgccggagacccgccatggctggaaatcccgcaactccctcctccacattttctcgcgagaatttgaatttgtcgtccgatttccccacccgaatctccctcacttccgatcaggtcaagcactgcacggaagcactcgctttgttgaaggacaagcgccgaaaccctcacaccatctcccaagagtttcttcacttgcaggcgaacaggataacgccgagtgagatgacgagaagatgcagcgttgctcttaattctgtcaatatcagcaaaaatcgatacacagatgttttaccatttgataagaacagggttgttcttaattccagttcagattataggtctgcagcactggggtatatcaatgcaagctttatatcgacctcttcccctggaactgtatctgaatttctagccacacaaggcccgcttccacacacttatgaggatttctgggaaatgattatccaatatcactgtcctgcaattgtgatgcttactaggttggtcgacaattacaagatgaagtgtggagattattttcaagctgaggatagacctagagaattaggcaatatctcacttacatgtaaatgggcgaaaactactgaaacttcattagtgctgcgccattttgaggttaaccatagagaggtagaaaatgcgccattatctgttttgcatattcagtatcctgagtggcctgaccatggagttccaaatgatactttggctgtgcgtgaaattttgaaaagattatatcatttgccaccaaaccttggcccaatagtggtgcactgcagtgcaggtattggcagaactggaacatactgcacaattcacaacacaattcagcgaatacttgctggtgatatgtctgcagtagatattgctaacacaatatctgtgttcagatcccagcgtattggaatggttcagacccaggaccagtacattttttgctatcaagctatcatagatgaactggaagaccttgtatctcaacagtaaggatagtagaagtgctagataaaaggatgtcaagctgcttgcctcattcttctgaagccaactctctattcttcggtgtgcttgttgggtcctgctatgcttatgattttcagtagctgactcagaagctttaacattctggagattttatgattttcactgaacttgtttattttttgcgttcatgtataattttgcaggcaggagaaatcttacaaatatcagcatatttttcaatatatttctacatttctgttgaacagaagcatactaatgaccatgataatctaaattccattgtcctcttattatttttcttcaagtgccatagtgacatgtgtagttaccccgttgaccagggcaaggggatctttgacaacagggaatccgttttcatttgcttcaagctgatctactgcaatcttgtaggttgacactgtggtcctaaatatctaggccttggttgttaaagagctgttgaatcattatttgacatgtagactagatgccaaattctgaaactttccagatgagtgttgactatctatctactctcaagtttttaaccggacttgcccaattgaatacaagaagttgtccagtgtcaaactgtcaataactatactagatatggacaaaaaatggataaagaaaaaaattaatcttaatgccataaattacagatgagtagatcacagatgctatatttcgatcaaagagagactagccataaatcttaatgccatgtaggattagctaacaagggtaacttcacatgggggaatagatcggggagatacaggtccatgttctattttttttgttgacaaaaggtccatgttcttgttcaaggcaaataattgaaaaatagtttcctcccctatttttggttttgtttcctcatcaaacagcaagaaatttcttcgaagtttcacaaagtaatttcctgaaaaagtaccatattaaatattttagatcgttgaaagactagttgaagtggcccgagtaagagaaaacgtgacgtgctttacacaacaattgagttactttgtgcccatcctgtcgtgaagatatccaaatttgcttgttttggatgtgaactgagagtggagtcgtggagaaaatgttgttttcacttcctaagaattacttctgctgagaagtgaaaaatgtggcttgattcagtgctgagaaggaaataccaatgaaactgcct

SEQ ID NO: 7536 - DNA, 1264 bp, Arachis hypogaea
acgcaagattcgactcccaataacgtcgaatccacgctgctctctctactcaactggggaaccgcgcctccgcccgctctcgtccccgtcggacgtccgccatggcagcctcttccgccggaaatccgccgacctcctccctttcctcatccgcagcattatctcgcgagaaattgaatttctcggcggattatcccgcgcgaatcgcactctcctccgatcagctgaaacactgtacggaagcgctctcgttcttcaaggagaagctccacactcctcagaggatagctcaagagtttgctcgcttgcaggcaaataggataacgccaagtgagatgaggagaagatgcactgtggctctcgatgctgtcaatttgaacaaaaatcgatatactgatgtgttgccatttgacaataacagggttgttctcaagtctagcacggattataggcctgaagcacagggatatatcaatgcaagctgcatatctgcctctttgcccggaaatgtgtcgcaatttatagccacacaagggccgttgcctcacacatatgaggatttctgggaaatggtaatccaatatcattgccctgcaattgtgatgcttactaagttggtcgacaattacaagacgataaagtgtggagattactttcaagctgaggatggacctagagaatgtggtaatatctctattatcagtaaatggataaaatctactgaaacttcactggtgttgcgccatttggaagtaaaccataaagaggccgaagatacaccgttatcagttttgcacattcagtatcctgaatggccagaccatggagttccaagagatacatctgctgttcgtgagatttttagaagattgcaccatttaccggcaaaccttggcccaatagtggtgcactgcagtgcaggcattggtagaactggaacctactgcacaattcacaacacaattcagagaatacttgctggtgatatgtccgctttagatatctcaagtacaatagctatgttcaggtcccaacgaattggaatggttcagacccaggatcagtttgttttctgctatgaagctatcatagatgaactagaagaccttgtttctctacagaagtgagagttgaagagtgctgaatcaagggctatgctaactcttgcatctatttgaagccaggttccaattcttccgttttctatttgagtccagcgatgctagtcgggttcccggcagctgatgaatataactattggtac

SEQ ID NO: 7537 - DNA, 1512 bp, Arachis hypogaea
gacgcaagattcgactcccaataacgtcgaatccacgctgctctctctactcaactggggaaccgcgcctccgcccgctctcgtccccgtcggacgtccgccatggcagcctcttccgccggaaatccgccgacctcctccctttcctcatccgcagcattatctcgcgagaaattgaatttctcggcggattatcccgcgcgaatcgcactctcctccgatcagctgaaacactgtacggaagcgctctcgttcttcaaggagaagctccacactcctcagaggatagctcaagagttcgctcgcttgcaggcaaataggataacgccaagtgagatgaggagaagatgcactgtggctctcgatgctgtcaatttgaacaaaaatcgatatactgatgtgttgccatttgacaataacagggttgttctcaagtctagcacggattataggcctgaagcacagggatatatcaacgcaagctgcatatctgcctctttgcccggaaatgtgtcgcaatttatagccacacaagggccgttgcctcacacatatgaggatttctgggaaatggtaatccaatatcattgccctgcaattgtgatgcttactaagttggtcgacaattacaagacgataaagtgtggagattactttcaagctgaggatggacctagagaatgtggtaatatctctattatcagtaaatggataaaatctactgaaacttcactggtgttgcgccatttggaagtaaaccataaagaggccgaagatacaccgttatcagttttgcacattcagtatcctgaatggccagaccatggagttccaagagatacatctgctgttcgtgagatttttagaagattgcaccatttaccggcaaaccttggcccaatagtggtgcactgcagtgcaggcattggtagaactggaacctactgcacaattcacaacacaattcagagaatacttgctggtgatatgtccgctttagatatctcaagtacaatagctatgttcaggtcccaacgaattggaatggttcagacccaggatcagtttgttttctgctatgaagctatcatagatgaactagaagaccttgtttctctacagaagtgagagttgaagagtgctgaatcaagggctatgctaaactcttgcatcattttgaagccaggttccaattcttccgttttctatttgagtccagcgatgcatgggttcccgggcagctgatgaatataaactattggcattctaatttatgactttccaatgaactcatgttattctcaagatttcatgtataatagcaggcagggaaaatctaactaacattggcatcctttttgctacatgatttatttatggggaacacaaggacataatgtctaaaatagtttgaattccaccttcctgtactatttcaactgcttatagcatgctctgctatattagcttgaccttttttttggtgaaattctctatgttagtttatatatc

SEQ ID NO: 7538 - DNA, 2047 bp, Glycine max
attaacaattttctaattctattggttttcttttcttctcaaacaaactcttgagattctctaattccgttccttccgtaggcccctagatccggagatgaagaaccccaggaagaagaagaggccgaagccggcgcagaagaaggtacttgaggagaacaacaaaggtgttgttgttgctgggaatgaaaacgaagaagaagagaagagaaaacgcagcgttttggaggcactggttgaggctttctccttgtcttcaatcagggaagcttccatggcctatgagattgcagggggagatcccgacagggcttcggagatcctgaggaagggttcttcggacagattcgaggattcgttctcgtgtttttcttatggttcttcttctagcggcggaagcagcggtgggggcggttcttcttcttgttcggggttggaattgggttcgaaaggtgggaggcagcagaagaagaaggtggttgcttcaactggcactgtttcaacggttttggggaaggaatatgtgaggaggaacaatataaggaacaaggggtttagttctaatggagtttttgaaatggaggaggcagagcaattcctctgctctatgctgggggatgattctgatattaacttggctgttgttagagacgttctttgtcagtgtggatatgatattgaaacggcctcagatgtattgcttgatttagctgcttccacaaatgacaaaccgaatactgatagacatcctaactacagagtggacaacattgatgatgagaggttctttgctgaccccaatgacagtttgatagacaggagatcagagtgcacatctctttcatcggaaggttatctttctgataatccatggccttttggaaggaaatatgtggaggttctcaatagttctaaagctgattctgctattagcccaggatgtacaaagtctgaaattcctcagaaggtgttggaatctttgtttaatattcccaaaagcactgaacatgacaaagataccatgaattggagaaatgtagtaaagaaaatccagtctttgggacctgggttcaatgtttctccgcatgttgcagaatctcagcaacatacgtgtgctaagggagatgaatatcatgtgtttagggaagattcaaagcagcaatgggattcagtgaaatcttattatacgaaagctgcaacagcatataccaaacgggaacgagcttatgctgcatatctttctgaccagggtaaagaacaaactagattagctcagaaagcagacactaaggccagccatgacatatttattgctagaaacaaaggtatagaaaatatgataactattgacttacatgggcagcacgtgaaacaagcaatgagaatgctgaaactacaccttctgtttggatcatatgttccctctgtccagactctaagggttattacaggatgtggatcacatggtgttggaaagtctaagctgaaacaatcagttataaaccttttagatagagaagcaattgaatggagggaagagaaccagggaactgtattgattaaactcagcggatggagagagtatagctttctagacaccagcagtgacagtgacagtaatgattaagcatgtctaagtgcatcagcttgttgtaccatatttagattaatagcctggtgaaaataaataaattagagctgtgacattgacatgtacattattgttagccgagctagatcttgggacttcttggttctatcatatcatgtggaacctgtagctctattgaatctggttgtattgtatgagtcagaattgcatttccggattaggctaatgacccagtggtgtacatacatgaatatgtaaagatgatgtttgattttcaggattttatgtttaatttctctatgtttttttttttaaaatttgttgagggtaataattatacacactagtatgcttgatgccacgggcattggttggctcaaaggtatggttgttaatctctggttaaattgtaaatttgtttgagtttacgggctc

SEQ ID NO: 7539 - DNA, 1902 bp, Glycine max
ttttcttttcttctcaaacaaactcttgagattctctaattccgttccttccgtaggcccctagatccggagatgaagaaccccaggaagaagaagaggccgaagccggcgcagaagaaggtacttgaggagaacaacaaaggtgttgttgttgctgggaatgaaaacgaagaagaagagaagagaaaacgcagcgttttggaggcactggttgaggctttctccttgtcttcaatcagggaagcttccatggcctatgagattgcagggggagatcccgacagggcttcggagatcctgaggaagggttcttcggacagattcgaggattcgttctcgtgtttttcttatggttcttcttctagcggcggaagcagcggtgggggcggttcttcttcttgttcggggttggaattgggttcgaaaggtgggaggcagcagaagaagaaggtggttgcttcaactggcactgtttcaacggttttggggaaggaatatgtgaggaggaacaatataaggaacaaggggtttagttctaatggagtttttgaaatggaggaggcagagcaattcctctgctctatgctgggggatgattctgatattaacttggctgttgttagagacgttctttgtcagtgtggatatgatattgaaacggcctcagatgtattgcttgatttagctgcttccacaaatgacaaaccgaatactgatagacatcctaactacagagtggacaacattgatgatgagaggttctttgctgaccccaatgacagtttgatagacaggagatcagagtgcacatctctttcatcggaaggttatctttctgataatccatggccttttggaaggaaatatgtggaggttctcaatagttctaaagctgattctgctattagcccaggatgtacaaagtctgaaattcctcagaaggtgttggaatctttgtttaatattcccaaaagcactgaacatgacaaagataccatgaattggagaaatgtagtaaagaaaatccagtctttgggacctgggttcaatgtttctccgcatgttgcagaatctcagcaacatacgtgtgctaagggagatgaatatcatgtgtttagggaagattcaaagcagcaatgggattcagtgaaatcttattatacgaaagctgcaacagcatataccaaacgggaacgagcttatgctgcatatctttctgaccagggtaaagaacaaactagattagctcagaaagcagacactaaggccagccatgacatatttattgctagaaacaaaggtatagaaaatatgataactattgacttacatgggcagcacgtgaaacaagcaatgagaatgctgaaactacaccttctgtttggatcatatgttccctctgtccagactctaagggttattacaggatgtggatcacatggtgttggaaagtctaagctgaaacaatcagttataaaccttttagatagagaagcaattgaatggagggaagagaaccagggaactgtattgattaaactcagcggatggagagagtatagctttctagacaccagcagtgacagtgacagtaatgattaagcatgtctaagtgcatcagcttgttgtaccatatttagattaatagcctggtgaaaataaataaattagagctgtgacattgacatgtacattattgttagccgagctagatcttgggacttcttggttctatcatatcatgtggaacctgtagctctattgaatctggttgtattgtatgagtcagaattgcatttccggattaggctaatgacccagtggtgtacatacatgaatatgtaaagatgatgtttgattttcaggattttatgtttaatttctctatgtttttttttttaa

SEQ ID NO: 7540 - DNA, 1734 bp, Glycine max
gaaaaggaatagacagacacgtccccctcttcctcatcacccctctctcttttgtttccaccgcatccaaaccaaacgctgacataaacacactgcacaaacccctaaccttccttccattcactactcctccttcacttaaaaaatttcagccttccaaatcctcaacttttacaattattacaatttagcatcactctttctcttcctcaatccaatcccctctcgatcgaaccaagaaaatttaagaacccaaaccatgtatttatcggagaagcctcgccccatcgatttctacaaggaggaaggcgcgcgtgacatgatgatcgaggtcgtctccaacggcgacctccctcctccgcctcctccgccgcctccgccgatgatcctcggcgagagcagcggcgaggaccccgaggtcgagataaaggccccgaagaagcgcgccgaaacctgggttcaggacgagacgcgctccctcattggccttcgccgcgagatggactcgctcttcaacacctccaagtccaacaagcacctgtgggagcagatatcggcgaagatgagggagaagggtttcgaccgttctcccaccatgtgcaccgataagtggcgcaatctcttgaaggagttcaagaaggccaagcaccaggaccgagggagtggctccgcgaagatgtcgtattacaaggagattgacgagatcctcagagagaggagcaagaatgtgcagtataagagccctactcctccgcccaaggttgattcctttatgcagtttgctgataaaggtattgatgataccagcatctcttttgggcctgttgaagctactggaagaccaacactcaatcttgagagaagtttggatcatgatggacatcctcttgccattaccacagctgatgctgttgcagcaagtggagtccctccttggaattggagagagactcctggaaatggtggagaaagtcagtcatgttgtggaagggttatatcggttaaatggggtgattatacaaggcgaataggtattgatggcaccccagaagccattaaagaagcaattagggctgcttttaggttgagaactaaacgtacattttggttggaggatgaagatcagattatcagaagtatcgaccgtgaaatgcctttaggaaattacactcttcacattgatgaaggaatggccattaaattacccctctatgatgagcctgaccatatacctgtgcatactgaagataagatattttacactgaagacgatttccgtgattttctgacccgccggggttggatatgtttaagagaatttgacagctatagaaatattgacaatatggatgatcttcgacccggtgccatatatcgtggtgtgagttgaaagcaggtgcatggtgtggtcaatcttcagctacctacataaaatgtctggagaactgtggtggggactgttcagatctttgatgtatgtgtggcactaacctcgaattgtatttgttttaagttttgataatgctgtttatagttttgtgataggaaaaggaactagtccctctgcacaaattccgttccaatcataacatgtttgtaaatatgcatttgtagtgagaacatattgtctaattttttagtggatcattttcatcactctaactctatgtagctaagttggccacatgcatattatgaagcaccaacacctttcttgttcaacgagtaactgtg

SEQ ID NO: 7541 - DNA, 1681 bp, Glycine max
cctctctcttttgtttccaccgcatccaaaccaaacgctgacataaacacactgcacaaacccctaaccttccttccattcactactcctccttcacttaaaaaatttcacccttccaaatcctcaacttttacaattattacaatttagcatcactctttctcttcctcaatccaatcccctctcgatcgaaccaagaaaatttaagaacccaaaccatgtatttatcggagaagcctcgccccatcgatttctacaaggaggaaggcgcgcgtgacatgatgatcgaggtcgtctccaacggcgacctccctcctccgcctcctccgccgcctccgccgatgatcctcggcgagagcagcggcgaggaccccgaggtcgagataaaggccccgaagaagcgcgccgaaacctgggttcaggacgagacgcgctccctcattggccttcgccgcgagatggactcgctcttcaacacctccaagtccaacaagcacctgtgggagcagatatcggcgaagatgagggagaagggtttcgaccgttctcccaccatgtgcaccgataagtggcgcaatctcttgaaggagttcaagaaggccaagcaccaggaccgagggagtggctccgcgaagatgtcgtattacaaggagattgacgagatcctcagagagaggagcaagaatgtgcagtataagagccctactcctccgcccaaggttgattcctttatgcagtttgctgataaaggtattgatgataccagcatctcttttgggcctgttgaagctactggaagaccaacactcaatcttgagagaagtttggatcatgatggacatcctcttgccattaccacagctgatgctgttgcagcaagtggagtccctccttggaattggagagagactcctggaaatggtggagaaagtcagtcatgttgtggaagggttatatcggttaaatggggtgattatacaaggcgaataggtattgatggcaccccagaagccattaaagaagcaattagggctgcttttaggttgagaactaaacgtacattttggttggaggatgaagatcagattatcagaagtatcgaccgtgaaatgcctttaggaaattacactcttcacattgatgaaggaatggccattaaattacccctctatgatgagcctgaccatatacctgtgcatactgaagataagatattttacactgaagacgatttccgtgattttctgacccgccggggttggatatgtttaagagaatttgacagctatagaaatattgacaatatggatgatcttcgacccggtgccatatatcgtggtgtgagttgaaagcaggtgcatggtgtggtcaatcttcagctacctacataaaatgtctggagaactgtggtggggactgttcagatctttgatgtatgtgtggcactaacctcgaattgtatttgttttaagttttgataatgctgtttatagttttgtgataggaaaaggaactagtccctctgcacaaattccgttccaatcataacatgtttgtaaatatgcatttgtagtgagaacatattgtctaattttttagtggatcattttcatcactctaactctatgtagctaagttggccacatgcatattatgaagcaccaacacctttcttgttcaa

SEQ ID NO: 7542 - DNA, 2291 bp, Cajanus cajan
tctacctcatcacccctctttccaccgcatccaaaagcttctacttcacgctgacatactctctctacagtctacacccaaacccaaacccctaaccttcccttcccatgtgccttctccactcctccaaaacccaccacttcataattccactcccacaattaccatctcccgcaacccaatccctcaccccaacaccatgtacttatcggagaagccgcgtcccatcgacttctacaaggaggagggggcgcgcgacatgatgatcgaggtcgtctccaacggcgacctccctccgccgccgccgctccaccccgcgccgccccccatgatcctcggcgagagcagcggcgaggaccccgaggtcgagatcaaggcgcccaagaagcgcgccgagacctgggttcaggacgagacgcgctccctcatcggcctccgccgcgagatggacgcgctcttcaacacctccaagtccaacaagcacctctgggagcagatttcggccaaaatgagggaaaagggcttcgatcgttcccctaccatgtgcaccgataagtggcgcaacctcttgaaggagttcaagaaggccaagcaccaggaccgcgccggaagcggctctgcgaagatgtcgtattacaaggagattgatgagatcctcagagagaggagcaagagcgtgcagtataagagtcccactcctccgcctaaggttgattccttcatgcagttcgctgacaaaggtattgacgatactagcatctcttttggacctgtagaagctactggaagaccaacactcaatcttgagagaagtttggatcatgatggacatcctcttgccattaccacagctgatgctgttgcagcaagtggagtccctccttggaattggagagaggctcctggaaatggtggagaaagtcagtcatgttgtggaagggttatatccgttaaatggggtgattatacaagacggataggtattgatggcactccagaagccatcaaagaggcaattagggctgcctttaggttgagaactaaacgtacattttggttggaggatgaagaccagattatcagaagtattgaccgtgaaatgcctataggaaattacactcttcaccttgatgaaggaatggccattaaattgtgcctctatgatgaatctgaccatatccctgtgcataccgaagataagatattttacactgaagatgattaccgtgattttctgacccgccggggttggatatgtctgagagaatttgacggctatagaaatattgacaatatggacgatcttcgacctggtgccatgtaccgtggtatgagttgaaagcacgtacatggtatgatcaatcttcagctacctacataaaacgcctgaagaattgtggtggggactgttcagatctctgatatatgtgcggcactaacccggaattgtatttgttttagttttgatactgctgtttatagtattatgataggaaaatgaactagtccctctgcacaaattccgttgcaatcattggcctaacgtgtctgtaaatatgcgtttgcagtgagaacataatattgtccagattttttagtggatcattttcatcacgtcttcctatacttttagtttatttagttaacttggacgggttgcatattttcgacactgcctaagcaggaaccttctgaacaatcgagctgttaacattaatcagatgagtttttgtttgggatttattgcttgccaggagtcctaagaattctgtccaccaaaccatgactgatattgcatcagaagggacgtaagatgtgaaatatcgtatttaatacaagcagactggtctcctagaaagtggaaactttggtgaagggagcaattattttgctgaaaaatgcagttgttggaagtggtgtactaaaccagactatggtgggtactatgtctcttggatgttttacatggatttgccttaggttccactcgatggattattacgatatatgcttagattgatgcatcattccgtaagcttgaagaagggtgaaagaatttttaaatattaaggcgatgcattgccatgttgaatgtagatattgaccatcttgttaatgtagtagtaattggatacggatcaccgcagtcggagaaatgactgcaggggtgcattttcatctctaaccatacatttttaaaataatattttctatcattattctgtttaattaaaaataatattaagttgagattcatgcagttcaaaaaagaactgctggaaatcttgata

SEQ ID NO: 7543 - DNA, 1712 bp, Phaseolus vulgaris
tgacatacacaaacacacacacaacacaaaacccctaaccttcttcttcttcttcttcactacttcaccacttcaaaatttcaccccaaaacccaatccctaacttttacaattacaattaccattaccataaccatcactctctctttctcaatccttcttctgcaacagaatccctcaactcaacaacaattcacactcacagcaacgaactcacccaaccatgtacctgtcggagaagccgcgcccaatcgacttctacaaggaggaaggcgcgcgcgacatgatgatcgaggtcgtctccaacggcgacctcgcgccgccgccgccgcaccaccctccgccgatgatcctcggcgagagcagcggagaggaccccgaggtggagatcaaagcccccaagaagcgggcggagacgtgggtgcaggacgagacgcgctcgctcattggcctccgccgcgagatggacgcgctcttcaacacttccaagtccaacaagcacctctgggagcagatatccgccaagatgagggagaagggtttcgatcggtctcccaccatgtgcaccgataagtggcgcaacctactcaaggagttcaagaaggccaagcaccaggaccgtggagggagcggctctgccaagatgtcgtattacaaggagattgatgagatcctcagagagaggagcaagaatgtgcagtacaagagccccactcctccgccgaaggttgattctttcatgcagtttgctgataaaggtattgatgatactagcatctcttttggacctgtagaagctactggaagaccaacactcaatcttgagagaagtttggatcatgatggacatcctcttgccattaccacagctgatgctgttgcagctagtggagtccctccttggaattggagagagacttctggaaatggtggagaaagtcagtcatgttgtggaagggttatatcagttaaatggggtgattatacaagacgaataggtattgacggcactccagaagccatcaaagaggcaatcagggctgcttttaggttgagaactaagcgcacattttggttggaggatgaagaccagatcatccgaagtattgaccgtgaaatgcctataggaagttacactcttcacctggatgaaggaatggccattaaattatgtctgtatgatgagtccgagcatcttcctgtgcatactgaagacaaggtattttacactgaaaatgattaccgtgattttctgacccgccggggttgggtatgtttaagagaatttgacggatatagaaatattgacaacttggatgatcttcgacctggtgccatatatcgtggtgtgagttgaaacttgacagaaagtagatgatggtatgatcaaattctgtggagaactatggtggccactgttcaggttttttttatatatgtgcgatactaacctggaattgtattagttttactttcgataatgctgtttatagtttttgataggaaaattaactagcccctctgcacaaagtgcccttcacatgtctgtaaatatgcatttgcagtgaggacatattgttgtctagattttttaatggatcattttcatctcatattttgctatatacttcttctacttctctgtacctatatctttgacacttgcaataactattaacttcaacttaaatcagattattttttgtttggaa

SEQ ID NO: 7544 - DNA, 1746 bp, Phaseolus vulgaris
tttccaccgcatccaaaaggcttttacttcacgctgacatacacaaacacacacacaacacaaaacccctaaccttcttcttcttcttcttcactacttcaccacttcaaaatttcaccccaaaacccaatccctaacttttacaattacaattaccattaccataaccatcactctctctttctcaatccttcttctgcaacagaatccctcaactcaacaacaattcacactcacagcaacgaactcacccaaccatgtacctgtcggagaagccgcgcccaatcgacttctacaaggaggaaggcgcgcgcgacatgatgatcgaggtcgtctccaacggcgacctcgcgccgccgccgccgcaccaccctccgccgatgatcctcggcgagagcagcggagaggaccccgaggtggagatcaaagcccccaagaagcgggcggagacgtgggtgcaggacgagacgcgctcgctcattggcctccgccgcgagatggacgcgctcttcaacacttccaagtccaacaagcacctctgggagcagatatccgccaagatgagggagaagggtttcgatcggtctcccaccatgtgcaccgataagtggcgcaacctactcaaggagttcaagaaggccaagcaccaggaccgtggagggagcggctctgccaagatgtcgtattacaaggagattgatgagatcctcagagagaggagcaagaatgtgcagtacaagagccccactcctccgccgaaggttgattctttcatgcagtttgctgataaaggtattgatgatactagcatctcttttggacctgtagaagctactggaagaccaacactcaatcttgagagaagtttggatcatgatggacatcctcttgccattaccacagctgatgctgttgcagctagtggagtccctccttggaattggagagagacttctggaaatggtggagaaagtcagtcatgttgtggaagggttatatcagttaaatggggtgattatacaagacgaataggtattgacggcactccagaagccatcaaagaggcaatcagggctgcttttaggttgagaactaagcgcacattttggttggaggatgaagaccagatcatccgaagtattgaccgtgaaatgcctataggaagttacactcttcacctggatgaaggaatggccattaaattatgtctgtatgatgagtccgagcatcttcctgtgcatactgaagacaaggtattttacactgaaaatgattaccgtgattttctgacccgccggggttgggtatgtttaagagaatttgacggatatagaaatattgacaacttggatgatcttcgacctggtgccatatatcgtggtgtgagttgaaacttgacagaaagtagatgatggtatgatcaaattctgtggagaactatggtggccactgttcaggttttttttatatatgtgcgatactaacctggaattgtattagttttactttcgataatgctgtttatagtttttgataggaaaattaactagcccctctgcacaaagtgcccttcacatgtctgtaaatatgcatttgcagtgaggacatattgttgtctagattttttaatggatcattttcatctcatattttgctatatacttcttctacttctctgtacctatatctttgacacttgcaataactattaacttcaacttaaatcagattattttttgtttggaa

SEQ ID NO: 7545 - DNA, 1335 bp, Lotus japonicus
aagtcgacctcaagttcagccccttcccaccgcaagcaaaagcttttacttcacgctgacacttgattgatacacaaaccctgaatcccaattttacccaaccaagtcaaatcctctattctctgttgaactcgaacaacacagagacagagaaagataagaacaacaacaacaacaacagcaacaacatgtatttatcagaaaaacctcgtcccattgatttctacaaacaggaagggacacgagacatgatgatagaggtggtatccaacgctgaacttccaccgccgcaacaccaccagccaccgccgatgatcctcggtgagagcagcggcgaggacccggaactggagatcaaggctccgaagaagcgcgctgagacatggattcaagacgagacgagaagccttattgggcttcgtcgcgagatggatgcgcttttcaacacttcgaaatcgaacaagcatttgtgggaacagatttcggcgaagatgagggaaaagggtttcgatcggtcacccaccatgtgtactgataagtggaggaacctgttgaaggagttcaagaaggctaagcaccatgatagaggtgggagtggctctgctaagatgtcttattacaaagagattgatgagatcctgagagagaggagcaagtgtgtgcagtataagagccatactcctccttccaaagttgactcctttatgcagtttgctgataaaggtattgatgataccagcatttcttttgggccagttgaagctgctggaagaccaacactcaatcttgagagaagtttagatcatgatggacatcctcttgccattaccgcagctgaggctgttgtggcaagtggagtccctccttggaattggagagaaacagaaactcctggaaatggtggtgaaagtcagtcatgtggaagggttatttcagtcaagtggtgtgattatacgagacgaataggtattgacggcaccccagaagccatcaaggaggcaattagggctgcttttcggttgagaactagacgtgcattctggttagaggatgaggaccagattatcagaagtattgatcgtgacatgcctataggcaattacactcttcaccttgatgaaggaatggctattaaagtatgcctttacgatgagcctgaccatattgctgtgcatactgaagagaagatattttacaccgaagatgattaccgcgattttctgacgcgtcgtggctggacttgtctaagagaatttgacggctatagaaacattgacaatatggatgatcttcgacctggtgccatatatcgtggggtgagttgagggcagatgc

SEQ ID NO: 7546 - DNA, 2007 bp, Cicer arietinum
atttattctctacacatcaaacaaaagcttttacttcacgctgacagatttatacattactgaaagaaaccccaaaacttaccttctaaccctttgctacagtttttcttttttccattttttactacaaatttacaatagataaaaaaaaaaacgagaatcattctattttcctttctctttctctcgaattgaatcaaaaaacaatcacaatttcgcagcaatgtatctatcatccgaaaagcctcgtccaatcgatttctacaaagaagaagcaagagacatgatgatggaagtagtaaccagcagcgatcttccaccgccgccgccaccacaccaccaccaaccacaaccgcaaatgattctaaacgccgagagcagcggggaagatcctgagatggagatcaaagcaccgaagaaacgagcagagacttgggtacaagatgagacacgaagcctcattggtctacgacgcgagatggattcgcttttcaacacttcgaagtcgaataaacatctctgggaacagatttcggcgaagatgagggagaagggtttcgatcggtctccgacgatgtgtactgataagtggaggaatcttttgaaagaattcaagaaagcaaagcatcaagatagaggagggagtggttctgcgaagatgtcttgttataaagagattgatgagatcttaagagagaggaataaatgtacgcagcagtataagagtcctacacctacctccaaagttgaatcttacatgcagttttctgataaaggtattgatgatgccaacatttcttttgggcctgttgaagcttccggaagaccaacactcaatctcgagagaggtttggatcatgatgggcatcctcttgccattgcggcagatgctgttgcagcaagtggagtccctccttggaattggagagaaactcccggaaatggtggcgaaagtcagtcttgttgtggaagggttatatcagtcaaatggggcgattatacaagacggataggtattgacgggactccggaagccatcaaggaggcaattagggctgcttttaggttgagaactaaacgtgcattttggttggaggacgaggaacagattatccgaagtattgatcgtgagatgcctataggaaattacactcttcaccttgatgaaggaatggccattaaagtatgcctatatgatgagtctgatcatatccctgtgcatactgaagataagatattttacaccgaagatgattaccgtgattttctggcacgcagagcttggacatgtcttagagaatttgacggctatagaaatattgacaatatggatgatcttcgacctggtgccatataccggggtgtgagttgagggcaggtgcatggtatgatctatcttcagctatttgtatgaaatgtcttgagaagtgaagggaactgtttagactttagatctttgatgatagtatatatgtgcagcactaacctgaatctgtatttgtttagtttgataacgctgcttattttgtccaaaagaaagataatgctgtttataatccgttatgataggagaacgaacggtccctttgccctctgtaaatatgcattggcagtgtgaaaatgttatcagtggctttttttccttctctggcacgctgctccagcaagaaccttatgaaccattctaactgtaacctctatagaacaaacattttgtcataaaaaattatatctagacaaatttgcatctgaagggacacaaaatatgatacagttgttatggattcacttgtctccaaactccttcaattgttacacttacagtatatacttgtgatatttataccaaaagcttcaaagcacttgtgtgctgggatataattgtacacttattagatggggataaaatatacgacaagatcactgctgctctgtatagtcattaggtaccatctattgttggtgaatgaattagatgctgctgcgtattttagattcttacgtata

SEQ ID NO: 7547 - DNA, 1479 bp, Trigonella foenum-graecum
tccaaaaccatctcaattccgcagcaaaaatgtatttatcatcagaaaagcctcgtccaatcgatttctacaaagaagaagcacgcgacatgatgatggaagtagtaaccaacaccgatcttcaaccaccaccaccaccgcaccaccaccttcaacaaccaccaccgccgcaaatgattctcaccgccgagagcagcggcgaggatcccgaaatggagatcaaagctccgaagaaacgcgccgaaacctgggtgcaagacgaaacacgaagcctcattggtttacgacgcgagatggattcgcttttcaacacttcgaagtcgaataagcatctttgggagcagatttcagcgaagatgagagaaaagggttttgatcggtcaccgactatgtgtactgataagtggaggaatcttttgaaagagtttaagaaagcgaagcatcatgatagaggtggaagtggttctgggaagatgagttgttataaagagattgatgagatcttaagagagagaagtaagtgtggacaatataagactgttgttacacctacttctaaagttgaatcttcttacatgcactttgataaaggtattgatgatgccaacatttcttttgggcctgttgaagcttctggaagaccaacactcaatctcgagagcagtttggatcgtgatggacatcctcttgccattgccgcagcggatgttgcagcaagtggagtccctccttggaattggagagaaactccgggaaatggtggggaaagtcagtcttgttgtggaagggttatatcagtcaaatggggcgattatacaagacgaataggtatcgatggcactccagaagccatcaaggaagcaattagggccgcttttaggttgagaaccaagcgtgcattttggttggaggacgaggagcagattatcagaagtattgaccgtgacatgcctataggaaattacactcttcaccttgatgaaggaatggccatcaaagtatgcctatatgatgagtctgaccatatccctgtgcatactgaagagaagatattttatactgaggatgattaccgtgattttctggcacgccgggcttggacaagtctacgagaatttgatggttatagaaatattgacaatatggatgaccttcggcctggtgcaatataccgaggtgtgagttgagggcaggtgtatggtatgaacaatcttcagctatttgcatcaattgtctagagaaatggatggaactgttaggatctttgatgatatatatgtgcagcattaacctgaaactgtatttgtttagtttgataacgctgtttataaccggtctataatagcagttcttattaataggagaatgaacaagttcctttgccatctgtaaatatgcattggcagcaagagaaaaaattattgtcaaggtattctacaggataattttcaattgttacttctactgtgtagttctcca

SEQ ID NO: 7548 - DNA, 1651 bp, Arachis hypogaea
gacgctctctctcccccaatccttccctttcccttctacaaatccctttttccttttcctaaacttcacataattcaagcactgatttttcattttcatttttgttttcaattcaaatttcaattccaaccgaatgcactaccaaccaacaccaaccaccaccacctttgaattcgaacaccattgaactcactccccataaagagcaacatgtacttgtcggaaaaaccccgacccatagatttctataaggaagaaagcagcacgcgtgacatgatcatcgaggtcgtctccaacggcgcggcggacctacctcctccgccgtcccaccagcagcagcagatgatcctgggtgacagcagcggcggcgaagaccctgaggttgagatcaaggcgccaaagaagcgcgcggagacgtgggtccacgaagagactcgaaccctgatcgcgctccggcgagaaatggacgcccttttcaacacttctaagtccaacaagcacttgtgggagcagatttcttccaagatgagggataagggtttcgatcgctcgccgaccatgtgcaccgacaagtggaggaacctcttgaaggagttcaagaaggccaagcacaatgatggcgcagcaggaggtggcggcggcggagggagtggctccgcgaagatgtcgtattacaaggagattgaggagattttgagggataggagcaagtgcgtgcagtataagagccccactcctccaccgcctccaccatctaatcacaaagttgaatctttcatgcaattcactgataaaggtattgaggataccagcatctcttttggtccagttgaagctactggaagaccaacactcaatcttgagagacgtttggatcatgatgggcatccccttgccattacaacagctgaggctgtcgcagctagtggcgttcctccctggaattggagagaaactcctggaaatggtgaagagggccagtcatgttgtggaagggttatatctgtcaaatggggtgattatacgagaagaataggtattgacggtgcttcagaagccatcaaggaggccataagagctgctttccgactgagaactaaacgtgcattttggttggaggatgaggaccagataatcagaagtcttgaccgtgacatgcctttaggaaattatactcttcaccttgatgaaggaatggccattaaagtgtgtctttatgacgagtctgaccatatccctgtgcatactgaagagaagatcttctatacagaagacgattatcgtgattttttgactcgccggggttggacatctctaagagaatttgacggctataggaatattgataacatggatgatcttcgacccggtgccatatacaggggtgtgacttgagtgcagatgccccgttggtttggacaaaggtgtttccattgtttcaaagaaaaaaatatttgttaagctatgtggagaggactgtttataaatcttttgacttatgtggggttactaacattgatcatattttgatttttggtgtttataaaactgcccatgttttgatgataggaaaatgatggaggcactttgctcactcgcctccactctgtctgtaaatatgaatttgatagtggaaacatattaatgagaa

SEQ ID NO: 7549 - DNA, 1164 bp, Prunus persica
tcaccaaccaccatgtacttgtcggaaaagcctcgagcaatcgatttttacaaagaggaaggcagccgagacatgatgattgaggtggtttccaatgacgacctctctcaatctcaaactcatcaccccaaccatcaaccacagcagcagcagcagcagatgcttttgggggaaagcagcggcgaggaccatgaagttaaggccccgaagaagcgagccgagacttgggtccaagacgagactcggagtttgatagctctgcgccgtgaaatggacggtttgtttaacacttccaagtctaacaagcacttgtgggagcagatttcggctaagatgagagagaaagggttcgatcggtctcctactatgtgcaccgacaagtggagaaacttgcttaaagagttcaaaaaggctaagcaccatgacaggggaagtgggtcagctaagatgtcatattacaaggagattgaggagattttgaaagagcgaaacaagaacgcgcagtacaaaagtcccacacctccaaaggttgattcttttatgcaattctcggacaaaggtattgaagatgcaagcatttcttttgcacctgttgaagctagtgggaggccaacgctcaatctggaacgacgtttggatcatgatggtcatcctcttgccataactgcagctgatgcagttacagcgagtggagttccaccttggaattggagagaaacccctggaaatggtggggagggtcaatcatgtggtagagtcatattagtcacttggggtgattatactagaaggattggtattgatggaactgccgatgccattaaggaggcaattaagtctgcttttaggttgagaacaaaacgtgccttctggttggaggatgaagaccagatagtccgcagtcttgacagggacatgcctctggggaattacacccttcatcttgatgaaggggtggccatcaaactgtgcctctatgatgagtcagaccatataccagtacatacagaggagaagattttctacactgaagatgattatcgtgattttctgacccgccgggggtggtcatgtctgagggagtttgatgggtacagaaatattgaaaatatggatgatcttcgacctggtgcaatataccgtggtgtgagttgagggaaccag

SEQ ID NO: 7550 - DNA, 1477 bp, Lupinus angustifolius
tcaaaaaagaaaaagagaacacaaaaaaatgtactcattagaaaaaccacgacccattgatttctacaaagaagaagaagaaaccccagaaatgatgatcgaagtggtccccaccaccgacaacaacaacaatcaccacctccaacaaccaccaccaccgccaccaccgttaatgctcaccgagagcagcggcgacgacccagaactcgaccaaatcaaagcccccaaaaaacgcgccgagacatgggtccaagacgaaacgcgtaacctaatttcccttcgtcgtgaaatggacgcgcttttcaacacttcaaaatcgaacaagcatctttgggatcagatttcggcgaagatgagggataagggtttcgatcgttctccaactatgtgcactgataaatggaggaacttgcttaaggagtttaagaaagcaaagcaccaagataatagaggaagtagtaaaatgagttattataaagagattgatgagattttgagagagagaagttgtaaaagtgtgcattataagacacccattcccccaactctttctaaagttgattcctttatgcattttgctgacaaaggtattgaggatactagcatatcttttgggcctgttgaagctaatggaagaccaacactcaatcttgagagaagtttggatcatgatgggcatcctcttgccattaccacagctgacgctgttgctgcaagtggagtccctccttggaattggagagaaactcctgacaatggtggggaaagtcagtcatgttgtggaagggttatatcggtgaaatggggtgattatacaaggcgtattggtattgatggcactgcagaagccatcaaggaggcaattaggtctgcttttagattgagaactagacgtgcattttggttggaggatgaagaacaaattatcagaagtattgaccgtgacatgcccttaggaaattacactcttcaccttgatgaaggaatggctgttaaagtatgtctctatgatgagtctgaccatatctctgtgcacactgaagagaagatcttctacactgaagatgattaccgtgattttctgacgcgccgaggttggacatgtctaagggagtttgatggctatagaaatattgacaatatggatgatcttcgacctggtgccatatatcgtggtgtgagttgagagtgcaggtacatggtatgatcgatgtttagctgtttaactataagatgagaactttggaggagactgtttatgtcagtactatacgtgtaatatttaagtttgtaaaatgctgcttatctaatctactactatagagaaaatgaactatggcccatgcacagattcagttccaatcattggcctcaacatgtttgtaaataattaaatatgcatttgctgttcaaacatattaattactgttttgtgatgattttatacactatacttttcatcaccttttcatattta

SEQ ID NO: 7551 - DNA, 1679 bp, Medicago truncatula
atcctcctttacacatcaaagcctttacttcacgctgacagatttttacaaaaacccaaaacccaccttctacccttttatttactcttccaacattttttactacaaaaaaattacaattgtagatagaaaacacaaaaaacattgtcttttccctttcctcttcttcttcaatcttcaattgattacaatcgaagaatctcaattccgtagcaaaaatgtatttatcatcagagaagccgcgcccaatcgatttctacaaagaagaagcacgcgacatgatgatggaagtagtaaccaacaccgatcttcagccaccaccacctccaccgtcgcaacaccaccaccaccttcaacaacaacaaccgcaaatgattctcaccgccgagagcagcggcgacgatcctgagatggagatcaaagctccaaagaaacgcgcggaaacctgggttcaagacgagacacgaagcctcattggtctacgacgcgagatggattcattattcaacacttcgaagtcgaataagcatctttgggaacagatttcagcgaagatgagagaaaagggttttgatcggtcaccgactatgtgtactgataaatggaggaatcttttgaaagagtttaagaaagcaaagcatcatgatcgaggtggtggaagtggttctggtgggaaaatgagttgttacaaagagattgatgagatcttaagagagagaagtaagtgtggacaatataagaatgttgttacacctacttctaaagttgaatcttcttacatgcaatttgataaaggtattgatgatgccaacatttcttttgggcccgttgaagcttctggaagaccaacgctcaatcttgagagaagtttggatcatgacgggcatcctcttgccattgccgcagcagatgtagcagcaagtggagtccctccttggaattggagagaaactcccggaaatggcggagaaagtcagtcttgctgtggaagggttatatcagtcaaatggggtgactatacaagacgaataggtattgatggcactccggaagccatcaaggaggcaattagggccgcttttaggttgagaactaaacgcgctttttggttggaggatgaggaacagattatcagaagtattgaccgtgatatgcctattggaaattacactcttcaccttgatgaaggaatggccatcaaagtatgcctatatgatgagtctgaccatatccctgtgcatactgaagagaagatattttatacggaggatgattaccgtgattttctggcacgtcgagcttggacaggtctaagagaatttgatggttatagaaatattgacaatatggatgatcttcggcccggtgctatataccgaggcgtgagttgagggcaggtgcatggtatgaacaatcttcaaatatttgcatcaaatgtctagagaagtggagggaactgtgaggatctttgacaatatatatgtgcagcattaacctgaaactgtatttgtttagtttgataatgctgtttataaattagtctataataggataatgaacaagttcttttgccttgtgtaaatatgcattgacagtgagaaaaagaattattgtcaatatattctatgggataattttcaattgttacttctgctgctggtgaagttctccaggatagt

SEQ ID NO: 7552 - DNA, 1639 bp, Medicago truncatula
caaagcctttacttcacgctgacagatttttacaaaaacccaaaacccaccttctacccttttatttactcttccaacattttttactacaaaaaaattacaattgtagatagaaaacacaaaaaacattgtcttttccctttcctcttcttcttcaatcttcaattgattacaatcgaagaatctcaattccgtagcaaaaatgtatttatcatcagagaagccgcgcccaatcgatttctacaaagaagaagcacgcgacatgatgatggaagtagtaaccaacaccgatcttcagccaccaccacctccaccgtcgcaacaccaccaccaccttcaacaacaacaaccgcaaatgattctcaccgccgagagcagcggcgacgatcctgagatggagatcaaagctccaaagaaacgcgcggaaacctgggttcaagacgagacacgaagcctcattggtctacgacgcgagatggattcattattcaacacttcgaagtcgaataagcatctttgggaacagatttcagcgaagatgagagaaaagggttttgatcggtcaccgactatgtgtactgataaatggaggaatcttttgaaagagtttaagaaagcaaagcatcatgatcgaggtggtggaagtggttctggtgggaaaatgagttgttacaaagagattgatgagatcttaagagagagaagtaagtgtggacaatataagaatgttgttacacctacttctaaagttgaatcttcttacatgcaatttgataaaggtattgatgatgccaacatttcttttgggcccgttgaagcttctggaagaccaacgctcaatcttgagagaagtttggatcatgacgggcatcctcttgccattgccgcagcagatgtagcagcaagtggagtccctccttggaattggagagaaactcccggaaatggcggagaaagtcagtcttgctgtggaagggttatatcagtcaaatggggtgactatacaagacgaataggtattgatggcactccggaagccatcaaggaggcaattagggccgcttttaggttgagaactaaacgcgctttttggttggaggatgaggaacagattatcagaagtattgaccgtgatatgcctattggaaattacactcttcaccttgatgaaggaatggccatcaaagtatgcctatatgatgagtctgaccatatccctgtgcatactgaagagaagatattttatacggaggatgattaccgtgattttctggcacgtcgagcttggacaggtctaagagaatttgatggttatagaaatattgacaatatggatgatcttcggcccggtgctatataccgaggcgtgagttgagggcaggtgcatggtatgaacaatcttcaaatatttgcatcaaatgtctagagaagtggagggaactgtgaggatctttgacaatatatatgtgcagcattaacctgaaactgtatttgtttagtttgataatgctgtttataaattagtctataataggataatgaacaagttcttttgccttgtgtaaatatgcattgacagtgagaaaaagaattattgtcaatatattctatgggataattttcaattgttacttctgct

SEQ ID NO: 7553 - DNA, 1768 bp, Prunus mume
ttccagctgagttcattctcctttcttcgctaataacaagcaaagcttttacttcacgctctctctctctagctctctgtctgagctaaaaacccaaacttccgtctgcaaaaagggaggcaataatcctaagcaaggcccaaatctccatctctttctcgctgaagaaagcacaagagaccttctaataatgggcttgctgctgctgctcatggagaccctcactttcttcttgaacctcatccccttctaatcaaactcagtctcagtctctctctctctagcgcgcgcccaacggatttaaagacccaattttgagtaaacccagtttctcaatttcaacccccagtcaccaaccaccatgtacttgtcggaaaagcctcgagcaatcgatttttacaaagaggaaggcagccgagacatgatgattgaggtggtttccaatgacgacctctctcaatctcaaactcatcaccccaaccatcaaccacagcagcagcagcagcagatgcttttgggggacagcagcggcgaggaccatgaagttaaggccccgaagaagcgagccgagacttgggtccaagacgagactcggagtttgatagctctgcgccgtgaaatggacggtttgtttaacacttccaagtctaacaagcacttgtgggagcagatttcggctaagatgagagagaaagggttcgatcggtctcctactatgtgcaccgacaagtggagaaacttgcttaaagagttcaaaaaggctaagcaccatgacaggggaagtgggtcagctaagatgtcatattacaaggagattgaggagattttgaaggagcgaaacaagaacgcgcagtacaaaagtcccacacctccaaaggttgattcttttatgcaattctcggacaaaggtattgaagatgcaagcatttcttttgcacctgttgaagctagtgggaggccgacgctcaatctggaacgacgtttggatcatgatggtcatcctcttgccataactgcagctgatgcagttacagcgagtggagttccaccttggaattggagagaaacccctggaaatggtggggagggtcaatcatgtggtagagtcatattagtcacttggggtgattatactagaaggattggtattgatggaactgccgatgccattaaggaggcaattaagtctgcttttaggttgagaacaaaacgtgccttctggttggaggatgaagaccagatagtccgcagtcttgacagggacatgcctctggggaattacacccttcatcttgatgaaggggtggccatcaaagtgtgcctctatgatgagtcagaccatataccagtacatacagaggagaagattttctacactgaagatgattatcgtgattttctgacccgccgggggtggtcatgtctgagggagtttgatgggtacagaaatattgaaaatatggatgatcttcgacctggtgcaatataccgtggtgtgagttgagggaaccagatatttatcatgtttccttcttaatgtaagtgcggatgatccatattgttaagtcatgtttaatgctgcactttatgttatggtagaacaaggacaaggacaaagcactcgggcacagattttaatattgcacatactggcctggactttgatgtttgtaaatatgtacttttcaaaatataaagaagtttcaagccttctacaattcatttttggacagattaaaaatatccttttctagtaattacgtttggg

SEQ ID NO: 7554 - DNA, 1800 bp, Quercus alba
tctctatgcgtttgcaaaaacccccaaaattaccgtttgcaataaagtgaaaccaaatccaaaaaagagagaaaagaaccgcactcaacttcaatcccttacttattacaacaacaaaatgaactttttttactctcactcccacttcctcatctcaatctaattctctctctctctttctcggaggcattttcacaaacacctacatcagagaaaaaacaaaagcccaccaccatgtacttgtccgagaagccgcgccccatagacttctacaaagaagaaggcgcacgcgacatgatgatcgaggtcgtctccaatggcggcggcggcggcggcgacctgccacctcaccacgctcctcaacctcaccctcacacgcacgcccactctcaccaccagcaccagcaaatgattctcggcgacagcagtggcggcgacgaggaccatgaagtcgaggtcgaagtcaaggctcccaagaagcgagccgagacgtgggtccaagacgagactcgtagcttaatctctctgcgcagagaaatggacgggttgttcaacacttcgaagtcgaacaagcacttgtgggagcagatttcatcgaagatgagagaaaaagggttcgatcgatcacccactatgtgcaccgacaagtggaggaacttgcttaaagagttcaagaaggctaagcaccaagatagaggtagtgggtctgctaagatgtcttattacaaagagattgaagagattttgagagataggagtaagaatgcacagtacaagagccccactccacctaaggttgatacctatatgcaattctctgataaaggtattgaggatgctggcatttcttttggaccagtggaagctactggcaggccaacactcaatcttgagagacgtttggatcatgatggacatcctcttgccattaccacagctgatgcagttgcagcaagtggtgttcctccttggaattggagagaaacccctggaaatggtggggagagtcagtcatattgtgggagggtaatatcagtcaagtggggtgattacactagaaggataggtattgatggcagcacagatgccatcaaggaggcaataagatgcgctttcaggttgagaaccaaacgtgcgttttggttggaggatgaggatcagataatccgaagccttgaccgggatatgcctttggggaattatatgcttcatcttgatgaaggattggccattaaagtgtgtctttatgatgagtccgatcacataccagcaatgcatactgaagataagattttttacactgaagatgattaccgtaattttctgtctcaacgaggctggtcatgtctaagggagcttgatgggtatcgaaacattgatagtatggatgatcttcgacctggtgcaatataccgtggtgtgagttgaagacagctcatcattgtctggatggagggacctcattctgttttcttcttgatatgagtgcgaccggcttggaaccgtctagctcagttgtgtataatgctgttctccagttaatttggttaaatacttacactggagggactttgttattctgtttaccatacctactgatcaggttccatgttgcttagttgtgtataattcagtattatatagtagcacatggaaaaaagcctgttgcacaaattcagatctcaacgtatagtggcctgaacagcttgtgtgtaaatatgtatttccaatgacaacaaagggtttccgagttcattaccagtaaaatcatttttcccactatggatttgctgaaaaaaa

SEQ ID NO: 7555 - DNA, 1800 bp, Fagus grandifolia
acaaagacacactcttgttgacctaaaaccccaaaattaccgttggcatgaataaaagtgaaaccaaatccaaataaagaaagtgcacccaatccttacacagcacacacaacgctcttcacctcaatcaacctcatctctctttaattcagtaataaatcactttctgtctctctgagacattaacacaaacacttatatcccaaggaaaaaaaaagagaagaaacgaaaaagagaaagaaagctaccatgtccatctacttatcggagaagcctcgccccatagatttctacaaagaggaaggcacgcgtgatatgatgattgaggtggtctccaatggtgacctgccacctcatcacccgcagcctcaccctcatcctcacccccactcacaccatcaccagcagatgattttaggcgatagcagtggcggcgacgaggaccatgaggtcgaggtcgaagtcaaggcccctaagaagcgagctgagacgtgggtccaggacgagactcgtagcttaatctctctacgaagagaaatggatggcttgtttaacacttcgaagtcgaacaagcacttgtgggagcagatttctgccaagatgagagaaaaagggttcgatcgctcccccactatgtgcaccgacaagtggaggaacttgctcaaggagttcaagaaggctaagcaccaagatagaggtagtggctctgccaagatgtcttattacaaggagattgaagagattttaagggaaaggagtaagaatgcacagtacaagagccccactccgcctaaggttgatacctatatgcaattctccgataaaggtattgaggatgccggcatatcttttggacctgtggaagctactggcaggccaacactcaatcttgagagacgtttggatcatgatgggcatcctcttgccattactgcagctgatgcagttgcagcaagtggcgttcctccttggaattggagagaaacccctggaaatggtggggagagtcagtcatattgtgggagggtcatatcagtcaagtggggggattacactagaaggataggtattgatggcagcacagatgccatcaaggaggtaattagatgcgcttttaggttgagaactaaacgcgcattttggttggaggatgaggaccagataataagaagtcttgaccgggatatgcctttggggaattacgtgcttcatcttgatgaaggattggccatcaaagtgtgtctttatgatgagtccgatcacatacccgcaatgcatactgaagacaagattttttacactgaggatgattaccgtaattttctgtctcaccgaggctggtcatgtctgagggagcttgatgggtatagaaacattgatagtatggatgatcttcgacctggtgcaatttaccgtggtgtgaattaccgtggcgtgaattgaaggcagatccatcattcttcacatggagggacttcgttttgttttcttcttgattataagtgcgacactctcagttgtgtataatgctgttctccagttcatttgcttaaatacttttgatacaaacactggaggtggagggactttctttgttattccgtacaccatactactgatcaggaaccaaccatcttgcttagttgtgtataatgcagtattatggtaggacatggaaaaagcccgttgcacattctgatctctacgtatagtggcctgaacatctctcatttctgtatatattatgttcaatgacaacaaagaaaagaaatttcaagttcttttaaaaaaaaaaaaaaa

SEQ ID NO: 7556 - DNA, 1563 bp, Manihot esculenta
acactcaacttaccgtcttcaaaaaggtgaagaaaagcatcgtcaaacaaaattctactctatcctttaattcattcttcacgatcatgggttctcttcttcttcttctcatgaaatccctcactttcttcaatcccatttctttctaaaactacccatttccccaaacccccagattctgatcttcttcaaccatgtatttatcggaaaagcctcgccccatcaatttctacaaggaagaagttccacccgccaccagagataacatgattatcgaagttgtctcaagcaacggtgatttgccacctcatcaacaccatcttcacaatcctcaccagcaacagccgcctcagcagcaacaacagatgattctcggtgagagcagtggcgaggataatcatgaagtgaaagcgcctaaaaagcgagctgagacatgggtccaagatgaaactcgaagcttgatagctcttcgtcgagaaatggatggtttgttcaatacttctaagtctaacaagcacttgtgggagcaaatatcggctaaaatgagggagaagggatttgatcgatctcctactatgtgcaccgacaagtggaggaacttgttgaaagagttcaagaaggctaagcatcaagatagaggaagtgggtccgcaaaaatgtcttattataaggagattgacgagatattaagggagcggagcaaaaatgcacagtataagagtcccactcctactaaagttgattcctacatgcaatttgctgataaaggctttgatgaagcaagtatctcttttggacctgtagaagccagtggcaggtcagcactcaaccttgaaagacgtctggatcatgatggacatcccctggccatcactgcagctgaggcagttgcagcaagtggagttcctccctggaactggagggagactcctggaaatggtgctgagagtcaatcatttgttggaagagtaataacagttaagtatggggactatacaaggagaattggtattgatggcactgcagatgccatcaaggaggcaatcaagtcagctttcagattgaggaccaaacgtgcattttggttggaggatgaagaccaggtaattcgtagtcttgacagggacatgcctgtgggaaattacacccttcaccttgatgaaggattagctgtaaaagtgtgtctatatgatgattcagaccacatgccagtgcatacggaggaaaaaattttttacacagaagatgactaccgtgattttctaactcgccggggctggtcatgcctgagggagtttgatgggtatagaaatattgataacatggatgatcttcgacctggtgctatatatcgtggtgtgagttgatagcatctattagtccattttcacatcttggagcgtcctgaatgccagaccactgtggaactgtatcaagcaattgtgtatagaaagaatgctgtattatgttgaatggaccaagttgcatatgctcatccaattattgtaaatatgtgtgtatctccattgacaaacgacggagtcgtcccagatttttctgacg

SEQ ID NO: 7557 - DNA, 1909 bp, Theobroma cacao
gacggacaggccacgacgcaacgcaaatcgaaaacaacggccaaaggcaaagagaaagaaaagacgagcccactttcagctcattcctctttctccgctaatcatacactcatcacttcccaagcttttacttgacgctctcttcttctagctttctctccctctgctgaatcttaaagaaacacccatcgaataaaatccaatccccatgatttcacttctccttctccttgtcaagaccctcactcttttcaactcctaaacccctttgcccaaccaaatttataccctgcaaaaacaaagaagaacaacccatttcccattcagattcaattccgccatgtacctatcggagaagccccgcccaatagacttatacaaagaggaaggtcctaccaccgcccgggacatgatcatcgaggtcaccaccaacgtggatttgccacctcatcaccaccctcctcctctccaacaacagcaacagcaaatgatccttggtgacagcagcggcgaagacccagaagtcaaagccccaaagaaacgagctgagacctgggtccaagacgaaacacgaagccttattggcttccgaagggaaatggacggccttttcaacacatccaaatcgaacaagcacttgtgggagcagatatcggctaagatgagagagaaagggttcgatcgatcgccgactatgtgtacagacaagtggaggaacttgttgaaggagtttaagaaagctaagcatcaagatagggggagtgggtcagctaagatgtcttattataaagaaattgaagagattttaagggagaggacaaagaatgcgtataagagcccaactcctcctcctaaggtggattcctttatgcatttcgccgataagggttttgaggatactggcatatcatttggtcctgttgaagcaagtggcaggccaacacttaatcttgaaagacgtttagatcatgatgggcatccgcttgctatcactgcaactgatgcagttgcagccagtggagttcctccttggaattggagagagacccctggaaatggtggggactgtcaatcatacggaggaagggttataactgtcaagtttggggactacaccagaaggatcggtatagatggtacagcagatgccatcagagaggcaattaaatctgcttttagattgagaactaagcgtgcattttggttggaggatgaagaccatatagttcgtagtcttgacagggaaatgcctctagggatttatactctccacgttgatgaaggtttggccataaaggtgtgcctctacgatgagtcagatcatataccagtccacacagaggagaagattttttacacagaagatgattaccgtgaatatctggcccgtcggggctacacaggtctcagggatattgatggctacagaaatgttgataatatggatgaccttcgaactaatgttatatatagaggtgtgagctgaaagctggcacatcttgcttgcaaaaatgcagtgctctcgagaggctataataaagatgccttgtcttgacataagtgtgcacgtgagattctgatatttgcttctggtgctttatgaagattgtgattatgttcgagttagcacatactaatcctgaaccctataactgagctgtttatagcatgttgtataatgtttcttcttaggccacggatgtcagtacagtttcttttaatgttgccatgacgcccccgcttgtaaatacgcacttcagatgaaaacaatgtatttctaaattttcaatgttgtcaattttacagcatttgattgcagtcagcaacttaacttgaactacagttttgagaatttatattgcttttggttctctttaataagactgcataatgaaaccttagttttcaa

SEQ ID NO: 7558 - DNA, 1858 bp, Theobroma cacao
gagacggacaggccacgacgcaacgcaaatcgaaaacaacggccaaaggcaaagagaaagaaaagacgagcccactttcagctcattcctctttctccgctaatcatacactcatcacttcccaagcttttacttgacgctctcttcttctagctttctctccctctgctgaatcttaaagaaacacccatcgaataaaatccaatccccatgatttcacttctccttctccttgtcaagaccctcactcttttcaactcctaaacccctttgcccaaccaaatttataccctgcaaaaacaaagaagaacaacccatttcccattcagattcaattccgccatgtacctatcggagaagccccgcccaatagacttatacaaagaggaaggtcctaccaccgcccgggacatgatcatcgaggtcaccaccaacgtggatttgccacctcatcaccaccctcctcctctccaacaacagcaacagcaaatgatccttggtgacagcagcggcgaagacccagaagtcaaagccccaaagaaacgagctgagacctgggtccaagacgaaacacgaagccttattggcttccgaagggaaatggacggccttttcaacacatccaaatcgaacaagcacttgtgggagcagatatcggctaagatgagagagaaagggttcgatcgatcgccgactatgtgtacagacaagtggaggaacttgttgaaggagtttaagaaagctaagcatcaagatagggggagtgggtcagctaagatgtcttattataaagaaattgaagagattttaagggagaggacaaagaatgcgtataagagcccaactcctcctcctaaggtggattcctttatgcatttcgccgataagggttttgaggatactggcatatcatttggtcctgttgaagcaagtggcaggccaacacttaatcttgaaagacgtttagatcatgatgggcatccgcttgctatcactgcaactgatgcagttgcagccagtggagttcctccttggaattggagagagacccctggaaatggtggggactgtcaatcatacggaggaagggttataactgtcaagtttggggactacaccagaaggatcggtatagatggtacagcagatgccatcagagaggcaattaaatctgcttttagattgagaactaagcgtgcattttggttggaggatgaagaccatatagttcgtagtcttgacagggaaatgcctctagggatttatactctccacgttgatgaaggtttggccataaaggtgtgcctctacgatgagtcagatcatataccagtccacacagaggagaagattttttacacagaagatgattaccgtgaatatctggcccgtcggggctacacaggtctcagggatattgatggctacagaaatgttgataatatggatgaccttcgaactaatgttatatatagaggtgtgagctgaaagctggcacatcttgcttgcaaaaatgcagtgctctcgagaggctataataaagatgccttgtcttgacataagtgtgcacgtgagattctgatatttgcttctggtgctttatgaagattgtgattatgttcgagttagcacatactaatcctgaaccctataactgagctgtttatagcatgttgtataatgtttcttcttaggccacggatgtcagtacagtttcttttaatgttgccatgacgcccccgcttgtaaatacgcacttcagatgaaaacaatgtatttctaaattttcaatgttgtcaattttacagcatttgattgcagtcagcaacttaacttgaactacagttttgagaattta

SEQ ID NO: 7559 - DNA, 1571 bp, Populus trichocarpa
gagacagacagacagaatgccgctgttcgtcttcttctctccttgccactctcttccaatccccatttctatcctgtaaacaaaaccctccctttccttcctaaaccttaaaaaaaaataaaaagaccgaacatgtacttgtcagagaagcctcgccctctcgatttctacaaagaagaagtaggaccatcgtcttctagagacaacatgattatcgaagttgtctcttccaacggcgatttgccacctcttcatcttcaccccatcaccgctgctaccaacccacaccagatgattctcggcgaaagcagcggcgatgacaaccacgaagtcaaagcacccaagaagcgagctgagacatgggttcaagacgaaacccgaagtctgatcgggtttcgcagagaaatggatggtctcttcaatacttccaagtcaaataagcacctgtgggagcaaatttctactaaaatgagggataaaggtttcgatcgatcgccgactatgtgcaccgacaagtggaggaacttgttgaaagagttcaagaaggcgaagcatcaagataggggaagtgggtctgctaaaatgtcgtattacaaggagattgatgagattttgaggggaaggaataagaattctcagtataagtgccctactcctaaagttgattcttacatgcaattttctgataaaggctttgaagatacaagtatatcatttggaccagtggaagccagtgccaggccaacactcaatttggaaagacgtctggatcacgatggacatccccttgccatcaccgcggctgatgcagttgcagcaagtggagttcctccttggaattggagggagacccctgggaatggtgctgagagtcaatcatttggtgggagggtgatatcagtcaaatctggggactacacaagaaggattggcattgatggcaccacagatgccattagggaggcaatcaagtctgctttcagattgagaactaagcgagcattctggttggaggatgaagaccagataattcgtgctcttgacagggacatgcctttagggaattacactcttcaccttgatgaagggctagctatcaaagtttgtctgtatgatcagtcagaccacatcccaatgcacactgaagagaaaatcttctatactgaagacgactaccgtgattttctttctcgccggggctggacttgtctaagggagtttgatggctatagaaacattgatagtatggatgatcttcggcatgatgctatataccggggcgtgagttgaagcatctcatacctgctactactcctctttaattgctcacattgccaccataaagtcgctgttatgccatagccggggaactgtattacacaattgtacagcatgctgtaattttgttgaatggtaggagactagatcaagtttctcttaatccatggacatccagtgtttgtaaatatgtattttcattgacaaaaagtatcatttatttcactgacatcagattttaccaccttttttaatcgtcgccctctactttattaagcgcacccttgttgttt

SEQ ID NO: 7560 - DNA, 1669 bp, Vitis vinifera
gtccacctcacctcttccccatttccgtatacgaagctttcactccacgcactctccttcactgagaaactgaacgggaaagtttaaaaattttcagggaaatttctctctccgctgcacttgggagccaaacattcactttacccgtctgaaaaccctaatttgtcctaacccacctctccaaatcccgcccaaatcacagtccaaccatgtacttgcccgaaaagcctcgtccactcgatttctacaaggaagaagaagagggccgcgacatgatgatcgaggtggtctccaatggcgggcttccacatcagcagcagcagatgattctcggcgacagcagcggcgaggaccacgagcccaaggcccccaagaagcgagccgagacttgggtccaagacgagactcgaagtctcatagcatttcggagagacatggactgtttgtttaatacttccaagtcgaataagcatttgtgggagcagatttcggcgaaaatgagagagaagggcttcgatcgttcgccgactatgtgcaccgacaagtggaggaacttgttgaaagagttcaagaaagccaagcatcaagataggggaagtgggtcggcgaagatgtcgtattataaggaaattgaagagattttgaaggagcggagcaagaatgcgcattacaagagccccaccatgtcaaaagtcgatcccttcatccaattctccgataaaggtattgatgataccagcattccatttggaccagtcgaagctagtggcaggccaacactcaatcttgagagacagttggatcatgatggacatcctcttgctataacctcagctgatgcagtcactgcaaatggagttcctccttggaactggagagagacccctggaagtggtggtgagagtcaatcatatggtgggagggtaatatcagtcaagtggggggattatacaagaaggattggtattgatggcactgcagatgccatcaaggaagcaatcaagtctgcattcaggttaagaactaaacgtggattttggctggaggatgaagatcagataattcggactcttgacagggacatgcctttgggaagctacagtcttcaccttgatgaaggaataggcataaaagtgtgccattatgatgagtcggagcacataccagtccacacagaggagaagacgttttatactgaagaagatttccgtgattttctgacccgtcggggatggtcttctcttagggagttaaatgggtacagaaacattgacaatatggatgatcttcgtcctgattcattataccgtgggatgagttaaaaaagagcaagcgcgcaatggggcacacacgcctctgcgcaccccaacttgggtggtgagaaagattttaccagtgaagctctaaaatgttgtttgacacaagggaaagtattctaaaagaatgcttcttaattgtgcataaaataaatagtagactcatgtttgattataggaatgggagtttgggtttttgtttccctgggacataccgtgggggccgcttgtaaatagactacacactattctcgcaaatgtcaatttatgattggagttggtctctctgatgcctggtttttgactacacacaccttcattgctgagaaatctcagtacttggaatagttgca

SEQ ID NO: 7561 - DNA, 1570 bp, Vitis vinifera
cgaagctttcactccacgcactctccttcactgagaaactgaacgggaaagtttaaaaattttcagggaaatttctctctccgctgcacttgggagccaaacattcactttacccgtctgaaaaccctaatttgtcctaacccacctctccaaatcccgcccaaatcacagtccaaccatgtacttgcccgaaaagcctcgtccactcgatttctacaaggaagaagaagagggccgcgacatgatgatcgaggtggtctccaatggcgggcttccacatcagcagcagcagatgattctcggcgacagcagcggcgaggaccacgagcccaaggcccccaagaagcgagccgagacttgggtccaagacgagactcgaagtctcatagcatttcggagagacatggactgtttgtttaacacttccaagtcgaataagcatttgtgggagcagatttcggcgaaaatgagagagaagggcttcgatcgttcgccgactatgtgcaccgacaagtggaggaacttgttgaaagagttcaagaaagccaagcatcaagataggggaagtgggtcggcgaagatgtcgtattataaggaaattgaagagattttgaaggagcggagcaagaatgcgcattacaagagccccaccatgtcaaaagtcgatcccttcatccaattctccgataaaggtattgatgataccagcattccatttggaccagtcgaagctagtggcaggccaacactcaatcttgagagacagttggatcatgatggacatcctcttgctataacctcagctgatgcagtcactgcaaatggagttcctccttggaactggagagagacccctggaagtggtggtgagagtcaatcatatggtgggagggtaatatcagtcaagtggggggattatacaagaaggattggtattgatggcactgcagatgccatcaaggaagcaatcaagtctgcattcaggttaagaactaaacgtggattttggctggaggatgaagatcagataattcggactcttgacagggacatgcctttgggaagctacagtcttcaccttgatgaaggaataggcataaaagtgtgccattatgatgagtcggagcacataccagtccacacagaggagaagacgttttatactgaagaagatttccgtgattttctgacccgtcggggatggtcttctcttagggagttaaatgggtacagaaacattgacaatatggatgatcttcgtcctgattcattataccgtgggatgagttaaaaaagagcaagcgcgcaatggggcacacacgcctctgcgcaccccaacttgggtggtgagaaagattttaccagtgaagctctaaaatgttgtttgacacaagggaaagtattctaaaagaatgcttcttaattgtgcataaaataaatagtagactcgtgtttgattataggaatgggagtttgggtttttgtttccctgggacataccgtgggggccgcttgtaaatagactacacactattctcgcaaatgtcaatttatgattgcagttggtctc

SEQ ID NO: 7562 - DNA, 1219 bp, Manihot esculenta
ccatgtatttgtcggaaaagcctcgccccattgatttctacaaagaagaagtactgcccaccactagagataacatgattatcgaagttgtctcgagcagtggtgatttgccacctcatcagcaccatcttcacaatcctcacaaccctcacccgcaacagccgcctcagcaacagcaacagcaacagcagcaacagataattctaggtgagagcagcggcgaggatacccatgaagtgaaagcgcctaaaaagcgagctgagacatgggttcaagacgaaactcgaagcttgataggtcttcgccgagaaatggatggtttgttcaatacttctaagtcaaacaagcacttatgggagcaaatatcggccaaaatgagggaaaagggattcgatcgatctcccactatgtgcaccgacaagtggaggaacttgttgaaagagttcaagaaggctaagcatcaagatagaggaagtggatctgccaaaatgtcttattataaggagattgacgagatattaagggacaggagcaagaatgcccagtacaagagtcccactcccacttcaaaagttgattcctacatgcaatttgctgataaaggctttgatgatacaagtatatcttttggaccagtggaagctagtggtagaccaacactcaacctcgaaagacgtttggatcatgatggacatcctcttgccatcactgcagctgaggcagttgctgcaagtgcagttcctccgtggaattggagggagactcctggaaatggtgctgagagccaatcatttgttggaagagtgataacggtcaagtatggggactatacaagaagaattggtattgatggtactgcagatgccatcaaggaggcaatcaaatcagctttcagattaaggactaaacgtgcattttggttggaggatgaagacgagataattcgtagccttgatagggacatgcctgtggggaattacactcttcaccttgatgaaggattatctgtcaaagtatgcctatatgatgagtcggaccacattccagtgcataccgaggaaaaaactttttacagtgaagatgactaccgcgatttccttactcgccgggggtggtcatgcctaagggagtttgatggctatagaaacattgataacatggatgatcttcgacctggtgccatatatcgtggtgcgagttgagagcatttattccatct

SEQ ID NO: 7563 - DNA, 1494 bp, Populus trichocarpa
caaacatacacctacatgtactcatcagagaagcctcgtcctctcgatttctacaaagaagaagtgacaccctcttcaagagacaacatgattatcgaagttgtctcttccaatggtgatttgccacctcaccatcttcccaccaccaccaatactaacccacaccagatgattctcggcgacagtagcggcgacgataaccacgaagtcaaagcacccaagaagcgagcagagacgtgggttcaagacgaaacgcggagtttgattgggcttcgcagagaaatggatggtctcttcaatacttccaagtcaaacaagcatctgtgggagcaaatttcggctaaaatgagggagaaagggttcgatcgatcgccgactatgtgcaccgacaagtggaggaacttgttgaaagagttcaagaaggctaaacataaagataggggaagtgggtctgctaaaatgtcgtattataaggagattgatgagattttgagagaaaggaataagaatcctcagtataagagtcccattccttctaaagttgattcttacatgcaatttgctgataaaggctttgaagatacaagcatatcatttggacccgtggaagccagtcccaggccaacactcaatctggaaagacgtctggatcacgatgggcatcctcttgccatcactgcagctgatgcagttgcagcaagtggagttcctgcttggaattggagggagacccctgggaatggtgctgagaatcaatcatatggtgggagggtgatatcagtcaagtatggggactacacaagaaggattggcgttgatggcactgcagatgccatcaaggaggcaatcaagtctgctttcagattaagaagtaagcgagcattctggttggaggatgaagaccagataattcgtagtcttgacagggacatgcctccagggaattacactcttcacctcgatgaaggactagcaatcaaagtttgcctgtatgacgagtcagaacacatgccagtgcatactgaagagaaaattttctataccgaagatgactaccgtgaatttctatctcgccggggctggacatgtctaagggagttcgatggttatagaagcattgatagcatggatgatcttcggcatgatgctatataccgtggtgtgagttgaagcatatgctacaactcgtatctgctatttatccattttaattgctcacatcacctctataaagtcactgttatcatgctacttcattttatcacaatgccacagcggtgtaattgtatcacacaattgtacagcatgctgtaattttgtttaatggtaggactagatcaagttttttcttaacgataatgcagtgtttgtaaatttgtgttttcattggcaacaaagtaatttcatttatcacttgggtagactgtcgatccagtctggttgaaaatacttgcaacgcaaatcgagtaaaaaaccccagccccgattgctgtt

SEQ ID NO: 7564 - DNA, 1539 bp, Gossypium hirsutum
ctcaaactccccaaaccttctactctacgctttcttcttcttcagattcaaaacaaccatgtacttatcggagaaaccccgtcctattgacttatacaaagaggaaggtccgctgctgcccccgtgacatgatcatcgaggtcacctccaatggggatttgccacctcaccaccaccaccaccaccctcctcctcctcaccaccaccaccaacaccaacaacagcaacagcaaatgatcttaggtgaaagcagcggcgaagatcctgaagtcaaagcccccaagaaacgagccgagacatgggttcaagacgaaacccgtagccttatcggcttccgaagagaaatggacggccttttcaatacttccaaatccaacaagcacttgtgggagcagatttccgctaagatgagagagaaagggttcgatagatcccccactatgtgtaccgacaagtggaggaacttgttgaaagagttcaagaaagctaagcatcaggacagagggagtgggtcggccaagatgtcttattataaggaaattgaagagattttaagggagaggaccaaaaatgcctacaagagtccgactcctcctcctaaacccgattcttttatgcatttcgctgataagggttttgaggatgctggtatttcatttggtcctgttgaagctagtggtaggccgacacttaatcttgaaagacgtttagatcatgatggacatcctcttgctatcactgcagctgatgcagttgcggcgagtggagttcctccttggaattggagagagaccccgggaaatggtggggactgccagtcatatggaggaagggttataactgtcaagtacggggactacaccagaaggattggtatagatggaactgctgatgccatcagagaggcaattaaatctgcatttggattgagatcaaagcgatcattttggttggaggatgaagacaatatagtacgcagtttcgacagggaaatgcctttagggaattatacgctccaccttgatgaaggtttggctataaaagtgtgcctctatgatgagtcagatcatataccagtccacactgaggacaagattttttacacagaagatgattaccgtgaatatctagcccgtcgaggctacacaggtctcagggatatcgatggatacagaagtgtagataatatggatgacttacgacctaatgctatatatagaggagtgagctgattaccagtacattgtgctttgcacaaatgcagtcctctcaagaggctatatgaagttgctcttgacaatacgagtatgcatgtcagatattctaatattcactctgctgcattataaagatttgtatgctgtttgcattgtactaatccactcagctgtaaatagcttgtcgtctgatgtttcttctcaggacatgggatccagtttccagtaccggtttcgttcatgcagcctggatgtacgttgtctgtaaatatgcttttcagattaattgcaggtctgcaatttgaaattgaactccaaattt

SEQ ID NO: 7565 - DNA, 1844 bp, Gossypium raimondii
atcataatactgattaaatggattgggttattttattgtttagaagagaaaataatggaaagagaataagggcaaaaaggcaaagcaaatgcaacgcccaaaggcaaagagaaagaaaagggaagtccgcttagaaaacaatatattatcatacgctcactctcaaactccccaaaccttctactctacgctttcttcttcttcagattcaaaacacccatgtacttatcggagaaaccccgtcctattgacttatacaaagaggaaggtcccgccgccgccccccgcgacatgatcatcgaggtcacctccaatggggatttgccacctcaccaccaccaccaccaccctcctcctcctcaccaccaccaccaacaccaacaacagcaacagcaacagcaaatgatcttaggtgaaagcagcggcgaagatcctgaagtcaaagcccccaagaaacgagccgagacatgggttcaagacgaaacccgtagccttatcggcttccgaagagaaatggacggccttttcaatacttccaaatccaacaagcacttgtgggagcagatttccgctaagatgagagagaaagggttcgatagatcccccactatgtgtaccgacaagtggaggaacttgttgaaagagttcaagaaagctaagcatcaggacagagggagtgggtcggccaagatgtcttattataaggaaattgaagagattttaagggagaggaccaaaaattcctacaagagtccgacacctcctcctaaacccgattcctttatgcatttcgctgataagggttttgaggatgctggcatttcatttggtcctgttgaagctagtggtaggccgacacttaatcttgaaagacgtttagatcatgatggacatcctcttgctatcactgcagctgatgcagttgcggcgagtggagttcctccttggaattggagagagaccccgggaaatggtggggactgccagtcatatggaggaagggttataactgtcaagtacggggactacaccagaaggatcggtatagatggaactgctgatgccattagagaggcaattaaatctgcatttggattgagaacaaagcgatcattttggttggaggatgaagacaatatagtacgcagttttgacagggaaatgcctttagggaattatacactccaccttgatgaaggtttggctataaaagtgtgcctttatgatgagtcagatcatataccagtccacactgaggacaagattttttacacagaagatgattaccgtgaatacctagcccgtcgaggctacacaggtctcagggatattgatggatacagaagcatagataatatggacgacttacgacctaatgctatatatagaggagtgagctgattaccagtacattgtgctttgcacaaatgcagccctctcaagaggctatatgaagttgctcttgacaatacgtgtatgcatgtcagatattctaatattcactctgctgcattataaagatttgtatgctgtttgcattgtactaatccactcagctgtaaatagcttgtcgtctgatgtttcttctcaggacatcggatccagtttccagtgccggtttcgttcatgcagcctggatgtacgttgtctgtaaatatgcttttcagattaattgcaggtctgcaatttgaaattgaactccaaattttgaaacttgttttgcttttttattgcatattttcttaaaacctttctagaaatgcatgatatcaatgctatggactttccatcgcatatttggatatgattctataaaaaatttagaaaatttgttttctaagtaa

SEQ ID NO: 7566 - DNA, 2508 bp, Gossypium raimondii
cgcaatctttattaaaacagtcataacttgagctctcgagctcgaaatcgagtgattcagagtgcgtttcgaagctaagagagatctttgaatgccataaagacatctcaacccagaaatgcctagatcccatgcaaaaagtcgtcacaagtctattgatttcccaaacttaaaaattgacagattcagtaaatgaaatttaataaatttcaccccatcagtgcatgtatcattaaaagcagtcctgataatttatttattaacatttctatgtaacccattatttaattttaccaaaaaacatattattttatccctactaatctcatattttatccaagttatcttaaagagatagagtaggatttcaaaccgattctattccctaagaatttgattgggtagaatcagtaaaaccatagttgttaattcaattataaaaaaaataaaaaaatatacacagatatataataaaatataaaacatatattttataacttataaaactaatctcaaaacatctattcacaattcaaccatgaaaaaaattaaatatatacaaataaataataatataaacatacattttataaattataacaataaaaataaataacctcaccgcgattcaactgtgtttatcataatactgattaaatggattgggttattttattgtttagaagagaaaataatggaaagagaataagggcaaaaaggcaaagcaaatgcaacgcccaaaggcaaagagaaagaaaagggaagtccgcttagaaaacaatatattatcaaacgctcactctcaaactccccaaaccttctactctacgctttcttcttcttcagattcaaaacacccatgtacttatcggagaaaccccgtcctattgacttatacaaagaggaaggtcccgccgccgccccccgcgacatgatcatcgaggtcacctccaatggggatttgccacctcaccaccaccaccaccaccctcctcctcctcaccaccaccaccaacaccaacaacagcaacagcaacagcaaatgatcttaggtgaaagcagcggcgaagatcctgaagtcaaagcccccaagaaacgagccgagacatgggttcaagacgaaacccgtagccttatcggcttccgaagagaaatggacggccttttcaatacttccaaatccaacaagcacttgtgggagcagatttccgctaagatgagagagaaagggttcgatagatcccccactatgtgtaccgacaagtggaggaacttgttgaaagagttcaagaaagctaagcatcaggacagagggagtgggtcggccaagatgtcttattataaggaaattgaagagattttaagggagaggaccaaaaatgcctacaagagtccgactcctcctcctaaacccgattcctttatgcatttcgctgataagggttttgaggatgctggtatttcatttggtcctgttgaagctagtggtaggccgacacttaatcttgaaagacgtttagatcatgatggacatcctcttgctatcactgcagctgatgcagttgcggcgagtggagttcctccttggaattggagagagaccccgggaaatggtggggactgccagtcatatggaggaagggttataactgtcaagtacggggactacaccagaaggatcggtatagatggaactgctgatgccatcagagaggcaattaaatctgcatttggattgagatcaaagcgatcattttggttggaggatgaagacaatatagtacgcagtttcgacagggaaatgcctttagggaattatacgctccaccttgatgaaggtttggctataaaagtgtgcctctatgatgagtcagatcatataccagtccacactgaggacaagattttttacacagaagatgattaccgtgaatatctagcccgtcgaggctacacaggtctcagggatatcgatggatacagaagcatagataatatggatgacttacgacctaatgctatatatagaggagtgagctgattaccagtacattgtgctttgcacaaatgcagtcctctcaagaggctatatgaagttgctcttgacaatacgagtatgcatgtcagatattctaatattcactctgctgcattataaagatttgtatgctgtttgcattgtactaatccactcagctgtaaatagcttgtcgtctgatgtttcttctcaggacatcggatccagtttccagtgccggttccgttcatgcagcctggatgtacgttgtctgtaaatatgcttttcagattaattgcaggtctgcaatttgaaattgaactccaaattttgaaacttattttgcttttttattgcatattttcttaaaacctttctagaaatgcatgatatcaatgctatggactttccatcgcatatttggatatgattctataaaaaatttagaaaatttgttttctaagtaattgcaaccccaccccgccccccaa

SEQ ID NO: 7567 - DNA, 1722 bp, Citrullus lanatus
ttctccggcatcacacgcgaccttcgtctttgagtccagtggcttgagctgagccctcagactttttacggacctgcggaagaaaggaccgagtctgaacttaagagtcagaaatgaaaatttgaaggtggtgggctcgtcgttccttcgtactccgcacgctcgctctcccaagtcccatctttctcgaaatttcacggaattccccgaatcagagactatgtacttgtctgataagcctcgcccaatcgatatttacaaggaagaaggtagcagagatatgatgatcgaggtcgcctccaatggcgaccaccatattcaacctcatcagccacagccacagccacagcagactcatcagcagcaccaaatgatgcttggtgacagcagtggtgaggatcatgaagtcaaggctcccaagaagcgagcggagacttgggttcaggatgagactcgaagcttaattgccctacgccgggagatggatggcttgtttaatacttcgaaatccaacaagcatttgtgggagcagatatcggctaagatgagggaaaggggatttgatcgctccccgactatgtgtactgataagtggaggaacttgctcaaggagttcaagaaagcaaagcaccatgacaggggaagtggctctgctaagatgtcgtgttacaaggagattgaagaaattttgaaggagagaagcaaaagtacgcagtacaagagtcccacgccacccaagattgattcatatatgcaattctcagacaaaggaatagaggataatggtctatcgttcggacctgttgaagcaggtggcagaccttcactcaatcttgaaagacaactagatcatgatggacatccccttgccatcacagcagctgatgcagttgctgcaacgggcattccaccttggaattggagggaggcatcaggaaatggtggggagagtcaagcatttggcgggagagtaatatcagtgaagtggggggactacacaagaagaattggtgttgatggcacctcagaggcaatcaaggaggcaatcaagtctgcattcagattgagaaccaaacgtgcattttggttagaggatgaggaccaggttgtcagaagtctggacagggacatgcctttaggaaactacactcttcaccttgatgaaggtgtggctgttaaaatctgcctatatgatgaatctgaccacttaccggtacatactgaagacaaagttttttacattgaagaagattaccgagattttttagctcgtcgaggctggacatgccttcgggagtttgatgggtatagaaacatcgataatatggatgacctccgtcctggtgcaatataccgtggtataagttgagcaagtgcacaatcatgccaatatgataaagaattttggctttagtgcccttggtaatgagacttcgttatagtactccatctttacttgtaatccatactctaaatccaaccatgtaaacaagtatagcctttgtgcagactctgcttatgcatttttgacaggttatattccctctgtatatatcaatatggattgttggcaatatcgtctcatctgtacagtgagtattgcatgtttccgaagatgtctatgaaatacataaatgtaaaaagtgatgccattgtcgctaccacacaagtttacttcagtttcttaattcccgtttatcatttgggtacatatctttggaa

SEQ ID NO: 7568 - DNA, 3173 bp, Glycine max
ccccaacgttctccttgacgcccttctgccctacctcgaccctcattgttctcactgaacctagagtggaaattttggttgagatgggaaagaagaacaaagtgaaggaaaatggaggcaaagagcattgcccctcgactctttttgtctccaacttgccctattccttttccaattctcagttggaggagacgttcagtcaggttgggcctgtcaggcgttgcttcatggtcactcagaaaggatcagctcaacatcgtggtttcggttatgtccaatttgccgttgaggaagacgctaaccgtgctattgagctgaagaatggtacatctgttgaaggccggaaaattgtagtgaagcatgcaatgcctcgtcctccccgtgaagaacgacaatcaaaaccaaatcaagcgggcaagacagatgatctcacaaagccaaaagatgatgatgaagacggcagatcatctggatcagagaagaatgtttcagtttcgaaggaagaagaattgcaagtcagtaaacaaaaaagcacaaggaagcccatggaaattaaaaaatcagctctttgtgatgatgtagcagatgagggtggttgctcagaaaagcagagggttgctagaactgttatatttggtggtcttataaattctgatatggctgaagaagttcacagcaaagccaaagagattggcactgtgtgttcaattaagtaccctctttcagggaaagatcttgagcaacatggtctcctgcaagatggatgtactttagatgcttcggctgtgctttatacaagtgtaaaatcagctcgagcttctgttgcaacattacataaaaaagagataggagggggaaacgtttgggcacgccaacttggtggagagggctccaagactcagaaatggaagcttattatcagaaaccttcctttcaaggcaaaagataatgaaataagagatatgttttcatctgcagggtatgtgtgggatgtatttattccacaaaagccagacacaggtctgtctaagggttttgcatttgtaaaattcacctgcaagcaagatgcagaaaaggccattcaaaagctcaatggatcaaagtttgcaaaacgactcatagctgttgattgggctgtttcaaaaaagatatttagcagtgatacaaataatgctcttgcctcagagaaaggacaaaaaaacttgagcgatgaggatagtactgatgacgattttgagcttgatgataaaagatctggtcaaggagatgatagtgatacagactactctagtgccatggaggaagaaggcactcctgaagataatttcgataaggaagcagacattgcaaaaaaggttcttaacaacttgcttacatcctcgagtaaaggaacatctgcaaacaatgattctatgctgatcaaagaaaacaaggagtcaagatctgatgaaattgttaaggatgcagatgaaaaaaatgagtctggaaaggtttcaggtgtttctaagcctgaaatttccagcagaaacaacttatcaattcctaagagaacagaagaagatgatttgcagggaacagtttttatatgtaatcttccctttgaatgtgataacgaagaagtgaaacagcgtttttctggatttggggaagtagaatactttgttcctgttctccaccaagttaccaagcgaccgagagggactggttttctaaaatttaaaactgtagaagcagctaatactgcaatttcaactgccagtgctgcttctgggatgggtattttattgaaaggtagaccattaaaagttttgaaggctttggataagaaatcagcacatgacaaggaactggagaaagcaaaaaatgaggttcatgaccaccgcaatctttacttggctaaggagggacttattcttgagggaactacagctgctgaaggggtttcagccagtgatatgttaaaacgccaagagttggaaaagaaaaagaagacaaagcttcaatctcccaattttcatgtttcaagaactagactcattatctacaacttacccaagtcaatgaatgagaaagaactcaagaagctttgcattgatgcagttatctctagagctaccaagcaaaaacctgtaattcggcagataaagtttttgaaaaatgaaaagaaaggaaatgttgctcaagaacgctattcacggggagttgcctttgttgaattttcggagcatcagcatgcccttgtggctctgagagttcttaacaataatcctgaaacttttggtcctgagcatcggccgatcgtggagtttgctcttgataatgttcaaacacttaaacttcggaaggcaaagctacaatctcagctgcaggctcctcaagatgacaacaatgccatggataatgacaaacctggcacagtagaaggtcacaagcctgtaaagaacagaaaacgaaaatctcaagagcatgacaaaccagcaatggaatcagcactgaatacaaatggtgaattgggtgttgcagtgtcaaacggaaaatcccctcaaggacacaaatccaaaagacagaaaggcaacaataagagtaaaaaggcactgaaagaaaatccagaagccttgtccatgaagccaaagaataatgaaaatggccagagcaatggtggtgcatcactagaaggtcaaaacactgccacttactcaaatagaagaaaatcagggaacagagaagattgggggtttagaaaaagaaagattcaaaaccaagaacaagaagcaggccaaaaggtttctaagaaacggcctaagaagaataaagattcagtagggaaggacgtgggagacaagcttgacatgcttatagaacaatatagatccaagttctcacacaagggttcccaagagaatgatggagagagaaaaccttctaaacagcttaggaaatggttccaatcatagtttactatttcttgatatgaattttgttacttaaattatttttttacttccgaaagtttaagcaatgtaactttagttgcaccatatcttatgttgattttctttttttctccttgacaatatttatctggaatgtttaacatttatctggtatttttgttatgcttgaggaatgtgtgtgcaaaatatctaaatcattttatttttagatcatttcga

SEQ ID NO: 7569 - DNA, 3149 bp, Glycine max
cgcccttctgccctacctcgaccctcattgttctcactgaacctagagtggaaattttggttgagatgggaaagaagaacaaagtgaaggaaaatggaggcaaagagcattgcccctcgactctttttgtctccaacttgccctattccttttccaattctcagttggaggagacgttcagtcaggttgggcctgtcaggcgttgcttcatggtcactcagaaaggatcagctcaacatcgtggtttcggttatgtccaatttgccgttgaggaagacgctaaccgtgctattgagctgaagaatggtacatctgttgaaggccggaaaattgtagtgaagcatgcaatgcctcgtcctccccgtgaagaacgacaatcaaaaccaaatcaagcgggcaagacagatgatctcacaaagccaaaagatgatgatgaagacggcagatcatctggatcagagaagaatgtttcagtttcgaaggaagaagaattgcaagtcagtaaacaaaaaagcacaaggaagcccatggaaattaaaaaatcagctctttgtgatgatgtagcagatgagggtggttgctcagaaaagcagagggttgctagaactgttatatttggtggtcttataaattctgatatggctgaagaagttcacagcaaagccaaagagattggcactgtgtgttcaattaagtaccctctttcagggaaagatcttgagcaacatggtctcctgcaagatggatgtactttagatgcttcagctgtgctttatacaagtgtaaaatcagctcgagcttctgttgcaacattacataaaaaagagataggagggggaaacgtttgggcacgccaacttggtggagagggctccaagactcagaaatggaagcttattatcagaaaccttcctttcaaggcaaaagataatgaaataagagatatgttttcatctgcagggtatgtgtgggatgtatttattccacaaaagccagacacaggtctgtctaagggttttgcatttgtaaaattcacctgcaagcaagatgcagaaaaggccattcaaaagctcaatggatcaaagtttgcaaaacgactcatagctgttgattgggctgtttcaaaaaagatatttagcagtgatacaaataatgctcttgcctcagagaaaggacaaaaaaacttgagcgatgaggatagtactgatgacgattttgagcttgatgataaaagatctggtcaaggagatgatagtgatacagactactctagtgccatggaggaagaaggcactcctgaagataatttcgataaggaagcagacattgcaaaaaaggttcttaacaacttgcttacatcctcgagtaaaggaacatctgcaaacaatgattctatgctgatcaaagaaaacaaggagtcaagatctgatgaaattgttaaggatgcagatgaaaaaaatgagtctggaaaggtttcaggtgtttctaagcctgaaatttccagcagaaacaacttatcaattcctaagagaacagaagaagatgatttgcagggaacagtttttatatgtaatcttccctttgaatgtgataacgaagaagtgaaacagcgtttttctggatttggggaagtagaatactttgttcctgttctccaccaagttaccaagcgaccgagagggactggttttctaaaatttaaaactgtagaagcagctaatactgcaatttcaactgccagtgctgcttctgggatgggtattttattgaaaggtagaccattaaaagttttgaaggctttggataagaaatcagcacatgacaaggaactggagaaagcaaaaaatgaggttcatgaccaccgcaatctttacttggctaaggagggacttattcttgagggaactacagctgctgaaggggtttcagccagtgatatgttaaaacgccaagagttggaaaagaaaaagaagacaaagcttcaatctcccaattttcatgtttcaagaactagactcattatctacaacttacccaagtcaatgaatgagaaagaactcaagaagctttgcattgatgcagttatctctagagctaccaagcaaaaacctgtaattcggcagataaagtttttgaaaaatgaaaagaaaggaaatgttgctcaagaacgctattcacggggagttgcctttgttgaattttcggagcatcagcatgcccttgtggctctgagagttcttaacaataatcctgaaacttttggtcctgagcatcggccgatcgtggagtttgctcttgataatgttcaaacacttaaacttcggaaggcaaagctacaatctcagctgcaggctcctcaagatgacaacaatgccatggataatgacaaacctggcacagtagaaggtcacaagcctgtaaagaacagaaaacgaaaatctcaagagcatgacaaaccagcaatggaatcagcactgaatacaaatggtgaattgggtgttgcagtgtcaaacggaaaatcccctcaaggacacaaatccaaaagacagaaaggcaacaataagagtaaaaaggcactgaaagaaaatccagaagccttgtccatgaagccaaagaataatgaaaatggccagagcaatggtggtgcatcactagaaggtcaaaacactgccacttactcaaatagaagaaaatcagggaacagagaagattgggggtttagaaaaagaaagattcaaaaccaagaacaagaagcaggccaaaaggtttctaagaaacggcctaagaagaataaagattcagtagggaaggacgtgggagacaagcttgacatgcttatagaacaatatagatccaagttctcacacaagggttcccaagagaatgatggagagagaaaaccttctaaacagcttaggaaatggttccaatcatagtttactatttcttgatatgaattttgttacttaaattatttttttacttccgaaagtttaagcaatgtaactttagttgcaccatatcttatgttgattttctttttttctccttgacaatatttatctggaatgtttaacatttatctggtatttttgttatgcttgaggaatgtgtgtgcaaaatatctaaatcattttatttttagatca

SEQ ID NO: 7570 - DNA, 3237 bp, Phaseolus vulgaris
catttgggttttcgaataaacgagtaatcgtgtataatgctgaatcaaaattcctcctttacagatacaaggatttttggttgagaaacgaagaagaagaagaagaaggagaagaagaagagggtgtgaagagagatgggaaagaagaacaaagtgaaggataatggaggcaaagagcattgctcctccacactttttgtctccaacttgccctattccttttccaattctcagttggaggagacgttcagtgagattggacctgtgaggcgttgcttcatggtcacacagaaaggatcagcacagcatcgtggtttcggttatgtccaatttgctgttgaggaagacgccaaccgtgctattgagctgaagaatggtgtatctgttgaaggccgtaaaattggagtgaagaatgcaatgcctcgtcctccccgtgaggaacgaaagtcgaaaccaaataaagtagctaatgtagtagcgggaacaccagatgatcttgtaaaaccaaaagatgatgatgtgaaagacagcatatcatctggaacagagaagcatgtttcagttttgaaggaagaagcacaagtcacaagtaaacagaaaagctctaagaagcctgtggaaacgaaaaaatcagctctttgtaaagatgcagcagatgatggtggttgctcagaaaaacagagggttgctagaactgttatttttggtggccttatcgattctgatatggctgaagaagttcacaaccaagccagagagattggcactgtgtgttctgttaactaccctctttcaaggaaagatcttgatcaacatggtctcatgcaagatggctgtaccatggatgctacgtctgtactttatacaagtgttaaatcagcccgagcttctgttgcaaagttgcataaaaaagtgataagaggggaaacagtttgggcccgccaactgggtggagagggctccaagactcagaaatggaagcttattatcagaaaccttcctttcaaggcgaaagatactgaaataagagatatgttttcatctgctggatatgtgtgggacgtatttattccacaaaagtcagacacaggtctgtctaagggctttgcatttgtaaagttcacctgcaaacaagatgcagaaaatgccattcaaaagctgaatggatcaaagtttgctaaacgagtcatagctgttgattgggctgttccaaagaaaatatttagtagtgaaatgaatgatcctcgtgcatcagagaaaggacaacaaaacttgagtgatgaagatagtgatgaggaagatgtcgagcttgttgataaaatatctggtcaaggagatgataatgatatgaacagccctagtgccatggaggaagagggagctcctcctgaagataattttgacgaggaagcagaccttgcaagaaaggttcttaacaacttgcttggatcctcaagcaaaggaacatctgaaaacaatgattctatgttgtccaaagaaaagaaagagtcaagatcggatgaagattttaagaatgcagatggaaaagtatccgatgattctgaaaaggtttcaggtgcttctaatcctgaaatttccagcaaaaacaacttatcaaatcctaacggaaccgaagaagatttgcagagaacagtttttataactaatcttccctttgaatgtgataacgaagaagtaaaacaacgattttctgggtttggggaagtagaatactttgctcctgttctccaccaagttaccaagcgaccaagaggaactggttttctaaagtttaaaactgtagaagcagctaataccgcaatttcaactgctattgctgcttctgggacaggtattttacttcagggtagaccattgaaagttttaaaggctttggataagaaatcggcacatgacaaggaactggagaaagcaaaaaatgaggttcacgaccaccgaaatctttacttggcaaaggagggacttattcttgagggatctacagccgccgaaggggtttcagccagtgatatgttaaaacgccaagagttggagaggaaaaagaagacaaagcttcaatctccgaattttcatgtttcgagaactcgactcgtggtctacaacttacccaagtcaatgcatgagaaagaactcaagaagctttgcattgatgcagtcatctctagagctaccaagcaaaaacctgtaattcggcagataaaatttttgaaaaatgataagaatggaaaggtagctcaagaacgatattctaggggagttgcctttattgaattttctgagcatcagcatgctcttgtggctctgagagttctcaacaataatcctgaaacattcggtcctgaacatcgaccgatcgtggagttcgcgcttgataatgttcaaacacttaaacttcggaaggcgaagctacaacaatttcagcagcaggctcctcaagatgacaacaatgccatgcgaaatgacaaacctggcaacaaagaagttcacacgccggacagaaaacgaaaggctagggagcatggtgaaccggcaaaggaaacagtactgaatacaaatggtgaatcagaggcaaatggaaaatcccctcaaggacaaaagttcaaaagacagaaaggcaacaacaagaccaaaagggcactgaaagaaaatccagaagccttgtccatgaagccaaagaataaccaaaatggccagaaaagtggtggtgcagcagttgaagatcaaaacactgccactgccactaacagaagaaaatcaggaaacaaagtcgatgatgatactggatttagaaaaagaaagatgcagaatcaagaacaagaagcaggccataaggtggtttctaagaaacggcctaagaagaataaaaattcagttggaaaggacgtagtagacaagcttgacatgcttatagaacaatatagatccaagttctcacacaagggttcccaagagaatgcagagaaaaaaccttcaaaacagcttaggaaatggttccaatcatagtctactttttctttgcttcatatgaattttgttacttgtattattctcttactgcctttgaaaaagtttaagcaatctaacattagttgcaccatatcttatgttgttttgcctttttttgtccctaacaagatttcaaatattgatgatttttctggtattttttgctgtgtttgtgtttgaggaatgtgtgtgcaaaatatctaattgatt

SEQ ID NO: 7571 - DNA, 3246 bp, Phaseolus vulgaris
cttcaacaaaaccctggttacagcgcaaactgcaacccctaacacagacccaactcaactctctctgcctcagatacaaggatttttggttgagaaacgaagaagaagaagaagaaggagaagaagaagagggtgtgaagagagatgggaaagaagaacaaagtgaaggataatggaggcaaagagcattgctcctccacactttttgtctccaacttgccctattccttttccaattctcagttggaggagacgttcagtgagattggacctgtgaggcgttgcttcatggtcacacagaaaggatcagcacagcatcgtggtttcggttatgtccaatttgctgttgaggaagacgccaaccgtgctattgagctgaagaatggtgtatctgttgaaggccgtaaaattggagtgaagaatgcaatgcctcgtcctccccgtgaggaacgaaagtcgaaaccaaataaagtagctaatgtagtagcgggaacaccagatgatcttgtaaaaccaaaagatgatgatgtgaaagacagcatatcatctggaacagagaagcatgtttcagttttgaaggaagaagcacaagtcacaagtaaacagaaaagctctaagaagcctgtggaaacgaaaaaatcagctctttgtaaagatgcagcagatgatggtggttgctcagaaaaacagagggttgctagaactgttatttttggtggccttatcgattctgatatggctgaagaagttcacaaccaagccagagagattggcactgtgtgttctgttaactaccctctttcaaggaaagatcttgatcaacatggtctcatgcaagatggctgtaccatggatgctacgtctgtactttatacaagtgttaaatcagcccgagcttctgttgcaaagttgcataaaaaagtgataagaggggaaacagtttgggcccgccaactgggtggagagggctccaagactcagaaatggaagcttattatcagaaaccttcctttcaaggcgaaagatactgaaataagagatatgttttcatctgctggatatgtgtgggacgtatttattccacaaaagtcagacacaggtctgtctaagggctttgcatttgtaaagttcacctgcaaacaagatgcagaaaatgccattcaaaagctgaatggatcaaagtttgctaaacgagtcatagctgttgattgggctgttccaaagaaaatatttagtagtgaaatgaatgatcctcgtgcatcagagaaaggacaacaaaacttgagtgatgaagatagtgatgaggaagatgtcgagcttgttgataaaatatctggtcaaggagatgataatgatatgaacagccctagtgccatggaggaagagggagctcctcctgaagataattttgacgaggaagcagaccttgcaagaaaggttcttaacaacttgcttggatcctcaagcaaaggaacatctgaaaacaatgattctatgttgtccaaagaaaagaaagagtcaagatcggatgaagattttaagaatgcagatggaaaagtatccgatgattctgaaaaggtttcaggtgcttctaatcctgaaatttccagcaaaaacaacttatcaaatcctaacggaaccgaagaagatttgcagagaacagtttttataactaatcttccctttgaatgtgataacgaagaagtaaaacaacgattttctgggtttggggaagtagaatactttgctcctgttctccaccaagttaccaagcgaccaagaggaactggttttctaaagtttaaaactgtagaagcagctaataccgcaatttcaactgctattgctgcttctgggacaggtattttacttcagggtagaccattgaaagttttaaaggctttggataagaaatcggcacatgacaaggaactggagaaagcaaaaaatgaggttcacgaccaccgaaatctttacttggcaaaggagggacttattcttgagggatctacagccgccgaaggggtttcagccagtgatatgttaaaacgccaagagttggagaggaaaaagaagacaaagcttcaatctccgaattttcatgtttcgagaactcgactcgtggtctacaacttacccaagtcaatgcatgagaaagaactcaagaagctttgcattgatgcagtcatctctagagctaccaagcaaaaacctgtaattcggcagataaaatttttgaaaaatgataagaatggaaaggtagctcaagaacgatattctaggggagttgcctttattgaattttctgagcatcagcatgctcttgtggctctgagagttctcaacaataatcctgaaacattcggtcctgaacatcgaccgatcgtggagttcgcgcttgataatgttcaaacacttaaacttcggaaggcgaagctacaacaatttcagcagcaggctcctcaagatgacaacaatgccatgcgaaatgacaaacctggcaacaaagaagttcacacgccggacagaaaacgaaaggctagggagcatggtgaaccggcaaaggaaacagtactgaatacaaatggtgaatcagaggcaaatggaaaatcccctcaaggacaaaagttcaaaagacagaaaggcaacaacaagaccaaaagggcactgaaagaaaatccagaagccttgtccatgaagccaaagaataaccaaaatggccagaaaagtggtggtgcagcagttgaagatcaaaacactgccactgccactaacagaagaaaatcaggaaacaaagtcgatgatgatactggatttagaaaaagaaagatgcagaatcaagaacaagaagcaggccataaggtggtttctaagaaacggcctaagaagaataaaaattcagttggaaaggacgtagtagacaagcttgacatgcttatagaacaatatagatccaagttctcacacaagggttcccaagagaatgcagagaaaaaaccttcaaaacagcttaggaaatggttccaatcatagtctactttttctttgcttcatatgaattttgttacttgtattattctcttactgcctttgaaaaagtttaagcaatctaacattagttgcaccatatcttatgttgttttgcctttttttgtccctaacaagatttcaaatattgatgatttttctggtattttttgctgtgtttgtgtttgaggaatgtgtgtgcaaaatatctaattgatt

SEQ ID NO: 7572 - DNA, 3213 bp, Cajanus cajan
ggattttaatttttctctgcaccctaaaacgtcgttagaacaaagaagcggaactcaactctgcattgcattccttctctgcctcagatagaacagttttcggttgaggaaagaagaggaaggtgcgaagagagatgggaaagaagaacaaactgaaggaaaatggaggcaaagagcattgcgcctcaacactttttgtctccaatttgccctatacctttaccaattctcagctggaggagacgttcagtgaggttggacctgtcaggcgttgcttcatggtcacacagaaagggtcggcccagcatcgtggtttcggatatgtccaatatgccgttgaagaagatgctaaccgtgctattgagctgaagaatggttcatctgttggaggccggaaaattgtagtgaagcatgcaatgcctcgtcctccccgcgaagaaagaaattcaaaaccaaatcaagctgctcttttatatatatatatatatatatatattttcatgtatttttttttctcttgtctagaagtacaagtcacaaataaacaaaaaaactcagggaagcccatggaaacgaaaaaatcagctctttgtaatgatgtagaagatgagggtggttgctcagaaaagcagagggttgctagaactgttatatttggtggtctcataaactctgatatggctgaagaagttcaccgccaagccagagagattggaactgtgtgttctattaagtaccctctttcaagaaaagatgttgagcaacatggtctcctgcaagatggctgtactttggatgcttcggctgtactttatacaagtgtaaaatcagctcgagcttctgttgcagcgttacataaaaaagagatagcagggggaagtgtttgggcacggcaactgggtggagagggctccaagactcagaaatggaagcttattgtcagaaacattcctttcaaggccaaagataatgaaataagagatattttttcatctgctgggtatgtgtgggatgtatttattccacacaagtcagacacaggtctgtctaagggttttgcatttgtaaagttcacctccaagcaagatgcagaaaatgccattcaaaagctcaatggatcaaagtttgcaaaacggctcatagctgttgattgggctgttccaaaaaagatatttagcagtgatacaaataatgctcttgattcagaaggacaacaaaagatgagtgatgacgatagtgctgacgaagatgtcgagcttgttgacaaacgatctggtcaacgagatgatagtgatacagactactttattgccatggaggaagaagctgcttctcctgaagataattttgatatggaagcagacattgcaagaaaggttcttaacaacttgattacatcctcaagcaaaggaacatctgtaaacaatgattctgtgttgtccaaagaaaacaatgagccaagatctgatgaaattggtgaagatgcagaaggaaaagcatctaatgagtctgaaaaggtttcaggtttttctaagcctgaagtttctggcagaaactatgaatcaaatcctaaggaaactgaagatgatttgcagagaacagttttcataagtaatcttccatttgaatgtgataacgaagaagtgaaacaaagattttctggatttggggaagtagaatactttgttcctgttctccaccaagttaccaagcgaccaagagggactggttttctaaagtttaaaactgtagaagcagctaatactgcaatttcaacagccagttccgcttctgggatgggtattttactgaagggtagaccattaaaaattttaaaagctttggataagaaatcagcacatgacaaggaagtggagaaagcaaaaaatgaggttcatgaccaccgcaatctttacttggcaaaggagggacttattctagagggaactacggctgctgaaggggtttcagccagtgatatgctgaaacgtcaagggttggagaggaaaaagaagattaagcttcaatctccaaattttcatgtttcaagaactagactcgttatctacaacttaccgaagtcaatgaatgagaaaggactcaagaagctttgcattgatgcagtcatctctagagccaccaagcaaaagcctgtaattcggcagataaagtttttgaaagatgaaaagaaaggaaaggttgctcaagaacgccattcacgaggagttgcctttgttgaattttcggagcatcagcatgcccttgtggctctgagagttcttaacaataatcctgaaacttttggttctgaacatcggcctatcgtggagtttgctcttgataatgttcaaacgcttaaacttaggaaggcgaagcaacaattttatcagcagggttcccaggatgacaacaatgccatggaaaatgacaagcctggcacagtagaagttcgcacgagtttgaacaacggaaaaaggaaatctagagagcaaggtgaacaggtaaaggacacggcgctgaatacgaatggtgaatcaggtggtacagtggcaaatggaagatcccctcaaggaaacaaatccaaaagacataaaggcaacaataagagtaaaagggcactaaaagagaatccagaagcctcttccatgaagccgaagaataaccaagatggccagaacaatggtggtgcatctcttgaaggtaaattcactgccactgacactaatagaagaaaatcaggaaacaaagatgatgggagttttagaaaaagaaagatgcaaaaccaagaacaagaaccaggccaaaagttttccaagaaacggccaaagaagaataaagattctgtagggaaggacgtagtagataagcttgacatacttatagaacaatatagatctaagttctcacacaagggttcccaagagaaagatggagagaaaaaaccttctaaacagcttaggaaatggttccaatcataatttactatttgcttgatatgaattttgttatgttatattttgactgcctcttgaagtttaagcaatgtaactttttttgaatgagcaatgtaactttagttgtaccgtagcatgtgctgttttacttttgtacctgacaattatttaaaatttaaaatatttattatttttctgctatttatgctgtgttcgaggtatgtgtgttcaaatatctaaatcattttatggctagatc

SEQ ID NO: 7573 - DNA, 553 bp, Glycine max
aaagaatctgaggttcttagtgataaaaagagtagagaaccgagtatgtctaaagtggccaccctcttcactttagctcttctgttaagcttcaatttaatccatgcctcccgtcttaatccttcacttaaagttttttcttctttgcgtgaggatgttgcagctacaaaggaagagataaatgaagagagttgtgaagaaggcacagaagaatgtttgataagaaggacgctagctgcacatgtcgattatatctacactcagaagcataaacccaaaccttaatatatggcataatcacagcactttcgggaccaaatatatatagcaatatacaataatgaatcaatgaatataccatacgtatatatgtgtgtacttatttcgttagtaaacatatgctttggttgaattttttgttttctcttttggccttggttgagttttgtgtaattcccatatattgatcattctcctaattattattccatgagagagtgtgataaaatgaataacacgcatgcatctacttcttcctgaaaacttgtgatcg

SEQ ID NO: 7574 - DNA, 638 bp, Glycine max
atcttcccactcaacacaaagaatctgaggttcttagtgataaaaagagtagagaaccgagtatgtctaaagtggccaccctcttcactttagctcttctgttaagcttcaatttaatccatgcctcccgtcttaatccttcacttaaagttttttcttctttgcgtgaggatgttgcagctacaaaggaagagataaatgaagagagttgtgaagaaggcacagaagaatgtttgataagaaggacgctagctgcacatgtcgattatatctacactcagaagcataaacccaaaccttaatatatggcataatcacagcactttcgggaccaaatatatatagcaatatacaataatgaatcaatgaatataccatacgtatatatgtgtgtacttatttcgttagtaaacatatgctttggttgaattttttgttttctcttttggccttggttgagttttgtgtaattcccatatattgatcattctcctaattattattccatgagagagtgtgataaaatgaataacacgcatgcatctacttcttcctgaaaacttgtgatcgagttaatatttgttggctatgtttctcaagttctttttatcatatatgaatacaaagtacaaaccgtc

SEQ ID NO: 7575 - DNA, 534 bp, Cajanus cajan
gctcactatcttcccactccacacaaagaatctgagtaaaaagaaaaaaaaacaatagaaagaaaactcagtatgtctaaagtggccaccctcttcactttgcttcttctattgagcttcaatttaatctatgcctctcgtcctaacccttcacataacactgtctcttctttgcatgtggatgttgagttgaaggcagagatagatgatgagagttgtgaagaagacacagaggaatgtttgatgaggagaacgctagctgcacataccgattatatctacactcagaagcataaacccaaaccttaatcttaattaatgccatcacaccactttctccaccaaataccaacacaataaatcaatatacaatacgtatatatattctgtttagtgtgtacttttttccaaaataaaacatgtccatttgttgaattttgggttttctcttttgcccttggttgaatttttgttattcacatgatatatataatgaaaaactcatgcatatatatatctacatcttcttgaaaa

SEQ ID NO: 7576 - DNA, 589 bp, Glycine max
tttcaatcccaagcataccctcaattttgtctttatattaaaggctcgatctactcactgtcttcccactcaacaaagaatttgatcagtgataaaaaaaaaagaaagacgaatagagagaacccaatatgtctaaactagccactctcttgactttggctcttctactgagcttcaatttaatctatgcctcccgtccaaacccttcacttatcagtgtctcttctttgcatggggatgttgcggctacaaaggcagaagagatagatggtgagagttgtgaagaagggacagaggaatgtttggcaagaaggacacttgctgcgcatctcgattatatctacactcagaaggataaactgggtcagcattcttaatggcatcacaggcatatgaattgcaatactataaataaattaatgtaccacacatatatgtatgtgtgtacttatttcattaacaaacaaatgctttgcttgaatgttcgcatattttctcctaattattccatgcgagagaaataacaatctaccgtactccattcgatttcaaatataagataaaattactgtttttttttcttcatcaa

SEQ ID NO: 7577 - DNA, 552 bp, Glycine max
tttcaatcccaagcataccctcaattttgtctttatattaaaggctcgatctactcactgtcttcccactcaacaaagaatttgatcagtgataaaaaaaaaagaaagacgaatagagagaacccaatatgtctaaactagccactctcttgactttggctcttctactgagcttcaatttaatctatgcctcccgtccaaacccttcacttatcagtgtctcttctttgcatggggatgttgcggctacaaaggcagaagagatagatggtgagagttgtgaagaagggacagaggaatgtttggcaagaaggacacttgctgcgcatctcgattatatctacactcagaaggataaactgggtcagcattcttaatggcatcacaggcatatgaattgcaatactataaataaattaatgtaccacacatatatgtatgtgtgtacttatttcattaacaaacaaatgctttgcttgaatgttcgcatattttctcctaattattccatgcgagagaaataacaatctaccgtactccattcgatttcaa

SEQ ID NO: 7578 - DNA, 2048 bp, Glycine max
gcagcatttgatttctttatttttgtgtttgtttgttgcgaaacatgcaagaggatcatattctctcctattgtgaaattgacatgaccagttcacccctgagtgcgcgatgataatcctatcctctacggggaaactcataaaaggtagagcccacagagaggaggggggtgggtcccactgcttcttcctactcaagaaaaatgacgacactaatcacctatctccccataatcaaaacctctctataaatacctttccaccccaccatccacctcccaacccaattaatctttctttacaattccttctctcaataattctcctctgtttttcacaaagcaacatggctgcatacagagaacccatgaacatgaacatgagcgacagagccccggtttctccgcagcaaccacactctccgtggcattccccggttccgtacttgttcggagggttagcggcgatgttgggtctcatagccttcgctctattgatccttgcatgttcctactggaagctctcagggtacctcgaagggaacggggaaacagaacgggacctagaagctggcgaaacggagcaggaccagaaacctgcgaaaccatacgaggagaagatcttggtgatcatggccgggcaagagaagccaacattcttagcaactccgagtgtttcgagttgcagcactagcaggtcctcttccttcggcgacaacaccagcacgtgcacctgcgaggagaaccgaaaatcgcttgaaatggcacaggctgggactgggaccaccgaaaccgcacactcctcgtcggattagaacccttgatcgggccaaacatggccacctgttggggggttttgttttgtagccaggttgctttcgtgaaaaagcaaagctcgtgacacccgggtgtctctctaggttgcatgttcaacaattggtggtgatatgggaattctcttttcttttttcttttcttcttcttctctttcagttctcgtctgtacattattccgggaatgtaaattctttgaggtggaattgagcccttgctgtttcacaaatcacaattttgtttttttttttttggtttatgttttcttcctttttactagatgagatttgaaaacctggaacaaaaaccgaggggagaaaacagaaagaaaaaaatgggggacagagagaatttaacactcagagtagtttttctgattgattttaagacgtggagaggtggtagatgttgtggtgtcgtgttaaggagaaggtaacgtgtacaagcgagtgtgggaaagtggttttatttatgtgtgatgtgtctgatgcggcgagaagaagctgtgattcaatcaatgcagtggctgcactgtttgttcctcgtgccactcgcctaattagcttcagtttagttccttctatttattcattattctctttttttggtgttttttctgtttctgtttacgacatcccattctcaatttccgggataaaacggcccctggaaatgctcaaacagcccctagaaatagaatcatggttttggcttggtttcattgtttcaactttccttccaaacaaaacattttacataagttactcgtccctgccctgcgtctgaaacggttttagtattatgctctagattttataagtactgcagtttcattataaaaataaataaatataggtgaaacatttttttttaattttttcttttattcattttaatacattctttatttttttttttcttgtgagtgtaaatgtgccaatgtggtatgaataatattttggtaatgaaatatactttcttcttatttatactagactgctttattagttgtcgtgaggtctagaataaccttttcatcggggtccttttattgattgatattcattgaagtatagtggggtaagggtgacggtattgtgggtttaatgtatgtccatagcgtgtctccaaaatcatgataaacactaaacagaattgttggtattggtacttgtgaatgtgaagtggagtatatcaactagtattactcgtaca

SEQ ID NO: 7579 - DNA, 1944 bp, Glycine max
gcgcgatgataatcctatcctctacggggaaactcataaaaggtagagcccacagagaggaggggggtgggtcccactgcttcttcctactcaagaaaaatgacgacactaatcacctatctccccataatcaaaacctctctataaatacctttccaccccaccatccacctcccaacccaattaatctttctttacaattccttctctcaataattctcctctgtttttcacaaagcaacatggctgcatacagagaacccatgaacatgaacatgagcgacagagccccggtttctccgcagcaaccacactctccgtggcattccccggttccgtacttgttcggagggttagcggcgatgttgggtctcatagccttcgctctattgatccttgcatgttcctactggaagctctcagggtacctcgaagggaacggggaaacagaacgggacctagaagctggcgaaacggagcaggaccagaaacctgcgaaaccatacgaggagaagatcttggtgatcatggccgggcaagagaagccaacattcttagcaactccgagtgtttcgagttgcagcactagcaggtcctcttccttcggcgacaacaccagcacgtgcacctgcgaggagaaccgaaaatcgcttgaaatggcacaggctgggactgggaccaccgaaaccgcacactcctcgtcggattagaacccttgatcgggccaaacatggccacctgttggggggttttgttttgtagccaggttgctttcgtgaaaaagcaaagctcgtgacacccgggtgtctctctaggttgcatgttcaacaattggtggtgatatgggaattctcttttcttttttcttttcttcttcttctctttcagttctcgtctgtacattattccgggaatgtaaattctttgaggtggaattgagcccttgctgtttcacaaatcacaattttgtttttttttttttggtttatgttttcttcctttttactagatgagatttgaaaacctggaacaaaaaccgaggggagaaaacagaaagaaaaaaatgggggacagagagaatttaacactcagagtagtttttctgattgattttaagacgtggagaggtggtagatgttgtggtgtcgtgttaaggagaaggtaacgtgtacaagcgagtgtgggaaagtggttttatttatgtgtgatgtgtctgatgcggcgagaagaagctgtgattcaatcaatgcagtggctgcactgtttgttcctcgtgccactcgcctaattagcttcagtttagttccttctatttattcattattctctttttttggtgttttttctgtttctgtttacgacatcccattctcaatttccgggataaaacggcccctggaaatgctcaaacagcccctagaaatagaatcatggttttggcttggtttcattgtttcaactttccttccaaacaaaacattttacataagttactcgtccctgccctgcgtctgaaacggttttagtattatgctctagattttataagtactgcagtttcattataaaaataaataaatataggtgaaacatttttttttaattttttcttttattcattttaatacattctttatttttttttttcttgtgagtgtaaatgtgccaatgtggtatgaataatattttggtaatgaaatatactttcttcttatttatactagactgctttattagttgtcgtgaggtctagaataaccttttcatcggggtccttttattgattgatattcattgaagtatagtggggtaagggtgacggtattgtgggtttaatgtatgtccatagcgtgtctccaaaatcatgataaacactaaacagaattgttggtattggtacttgtgaatgtgaagtggagtatatcaagtagtattactcgtaca

SEQ ID NO: 7580 - DNA, 854 bp, Phaseolus vulgaris
aacccaatctttctcctcttttacttccagcaataattcttcttcttcttcttctgcatcttctcgattcctctgttttctacaaacatggctgcatacagagaacccatgaacgtaggtgatagagccccggtttcttcgcagcagcaaccacactcgccatggcattctccagttccctacctatttggggggctagcggctatgctgggtctcatagccttcgctctgttgatccttgcatgctcctattggaagctctccgggtaccttgaagggaacggggaaacagaacgggacctggaagctggcgagggaaaaacggaacaagaccagaaacctcagagacagtatgaggagaagatcctggtgatcatggccggccaagagaaaccaacattcttagccactccgagcgtctcttcttcaagctgcagcactagcaggtcctcttccttcggtgacaacaccagcacctgcacctgcgaagagacgcaaaaatctctggaaatggcacagaccgcaaaagagggaagtgcagagagcgggaccaccgaaacctcgtcggatcagcacccttgatcgatgagccaaacatgtggacatgttgggggattttgttttgtagccgggttgctttcgtgctaaaagcaaaagctggtgacacctgtgatttttgggtgtctctctaggtagctaggttgcatgttcaacaattggcagtgaatggcgatatagggattccgaatctcttctccttttctctttcttctctgtacattatttcgggaatgtaaattgtttgaggtggaactggaatggaatgaattctcttgctgtttcgcaatttctgt

SEQ ID NO: 7581 - DNA, 854 bp, Phaseolus vulgaris
aacccaatctttctcctcttttacttccagcaataattcttcttcttcttcttctgcatcttccctattcctctgttttctacaaacatggctgcatacagagaacccatgaacgtaggtgatagagccccggtttcttcgcagcagcaaccacactcgccatggcattctccagttccctacctatttggggggctagcggctatgctgggtctcatagccttcgctctgttgatccttgcatgctcctattggaagctctccgggtaccttgaagggaacggggaaacagaacgggacctggaagctggcgagggaaaaacggaacaagaccagaaacctcagagacagtatgaggagaagatcctggtgatcatggccggccaagagaaaccaacattcttagccactccgagcgtctcttcttcaagctgcagcactagcaggtcctcttccttcggtgacaacaccagcacctgcacctgcgaagagacgcaaaaatctctggaaatggcacagaccgcaaaagagggaagtgcagagagcgggaccaccgaaacctcgtcggatcagcacccttgatcgatgagccaaacatgtggacatgttgggggattttgttttgtagccgggttgctttcgtgctaaaagcaaaagctggtgacacctgtgatttttgggtgtctctctaggtagctaggttgcatgttcaacaattggcagtgaatggcgatatagggattccgaatctcttctccttttctctttcttctctgtacattatttcgggaatgtaaattgtttgaggtggaactggaatggaatgaattctcttgctgtttcgcaatttctgt

SEQ ID NO: 7582 - DNA, 751 bp, Vigna unguiculata
catcttttcctcttctccttcttctcactctactctgttttctacgatcatggctgcaaacagagaacccatgaacgtcggtgccagagctccggtttctcctcagcaaccacactcgccctggcattctccggttccctacctatttggggggctagcggcgatgctgggtctcatagccttcgctcttttgatccttgcatgttcctattggaagctctccggctaccttgaagggaacggggaaacagaacgggacgtggaagctggcgagggaaaaacggaacaggaccagaaacctcagagaccgtacgaggagaagatcctggtgatcatggccggccaagagaaaccgacattcctggccactcccagcgtctcttcttcttcaagctgcagcactagcaggtcctcttccttcggcgacaacacaagcacctgcacctgcgaagagacgcgaaaatcgctggagatggcacagacccttaaagagggaagtgcagagagcgggaccaccgacacctcgtcggatcagaacccttgatctagccaaacgtgtggacatgttggggggttttgtttctttcgtgctaaaagcaaaggtcgtgacacctctgaattttgggtgtctctctaggtagttaggttgcatgttcaacaattggcagtgaaccatatagggattccgattctcttttttttctttctcctctgtacattatttcgggaatgtaaattctttgaggtggaa

SEQ ID NO: 7583 - DNA, 1486 bp, Glycine max
aggtttgctatcaccatcagcctcgggtttacctcgtgaaatggaagaatcgagcacaaaaaagtccaaaacagtaccttgaagtttgaaccttgccgtttattatcaaacaggatagcattgcccttctattgttactgttatcatcgacattcttaactcttaagaactgattcaccaaggacccctctgaatttcagggttttcaattttctaaacctgcttgatcgaacagtaaccatcaatgaagggggaagtgcagcttcagcctccagcggttatgcaaaaccctagtgattcggaccctttgctccataaccaggaggaagaggatgggtctccgggaagctctggtgagatcaagaatgaggaagaagacgttgaggctggattactcccctgttgtcgaatttgcctcgaaagcgattccgacccagaggatgaattgatatctccgtgcatgtgcaaagggacccaacagtttgtccatcgttcatgtcttgatcattggcgctcagtaaaggaaggatttgccttctcacactgcacaacctgcaaagcccaatttcatcttagagttgaatcgtttgaggacaactcttggcgtaaaataaagttcagactttttgtggcaagggatgttttccttgtttttttggctgtacaaactgtgattgcagctattggtggcttttcatacatcatggacaaagatggttccttcaggaactcatttgatgatggttgggataggatactgtcaaggcatcctattccattttattattgcatcggagtgctggccttctttgtactgattgggttttttggtctcatactgcattgctcctccctcaatagcaatgaccccagaatggctggctgtcaaaactgttgttatggttggggcatcttggattgctttcctgcgtcaatggaggcatgctttgcccttgtggttgtttttgttgtcatctttgcaattcttggtatagcttatggttttcttgctgccaccatggccattcaaagaatatggcagaggcactaccatatcctcaccaagagggagcttacaaaggaatacatagtagaggatcttggtggctgttatttcccacccaagttggacccagaacatgaaggtcgcttgaaaatgcttaagctcttgtaaattagggagcacgcacctgtagaaatgtttttgaataattttgagtatcaagttgtttctttatttgaccgttacggtctcgtgctcagcaaccttgtttgctagtgcttggaaatggtttatatcatcgttttcttttatttttttaaacaaagagtctggatccttgccagattctgtatactacaaatctgactggaaaaattatgaaaatatatgctgatacttgtccatgcaccatgatttacctttaatgtatccatcacaattgtcatgagtaaggaatagtggatacctcatcactccaaacac

SEQ ID NO: 7584 - DNA, 1523 bp, Glycine max
caagaagtaggtttgctatcaccatcagcctcgggtttacctcgtgaaatggaagaatcgagcacaaaaaagtccaaaacagtaccttgaagtttgaaccttgccgtttattatcaaacaggatagcattgcccttctattgttactgttatcatcgacattcttaactcttaagaactgattcaccaaggacccctctgaatttcagggttttcaattttctaaacctgcttgatcgaacagtaaccatcaatgaagggggaagtgcagcttcagcctccagcggttatgcaaaaccctagtgattcggaccctttgctccataaccaggaggaagaggatgggtctccgggaagctctggtgagatcaagaatgaggaagaagacgttgaggctggattactcccctgttgtcgaatttgcctcgaaagcgattccgacccagaggatgaattgatatctccgtgcatgtgcaaagggacccaacagtttgtccatcgttcatgtcttgatcattggcgctcagtaaaggaaggatttgccttctcacactgcacaacctgcaaagcccaatttcatcttagagttgaatcgtttgaggacaactcttggcgtaaaataaagttcagactttttgtggcaagggatgttttccttgtttttttggctgtacaaactgtgattgcagctattggtggcttttcatacatcatggacaaagatggttccttcaggaactcatttgatgatggttgggataggatactgtcaaggcatcctattccattttattattgcatcggagtgctggccttctttgtactgattgggttttttggtctcatactgcattgctcctccctcaatagcaatgaccccagaatggctggctgtcaaaactgttgttatggttggggcatcttggattgctttcctgcgtcaatggaggcatgctttgcccttgtggttgtttttgttgtcatctttgcaattcttggtatagcttatggttttcttgctgccaccatggccattcaaagaatatggcagaggcactaccatatcctcaccaagagggagcttacaaaggaatacatagtagaggatcttggtggctgttatttcccacccaagttggacccagaacatgaaggtcgcttgaaaatgcttaagctcttgtaaattagggagcacgcacctgtagaaatgtttttgaataattttgagtatcaagttgtttctttatttgaccgttacggtctcgtgctcagcaaccttgtttgctagtgcttggaaatggtttatatcatcgttttcttttatttttttaaacaaagagtctggatccttgccagattctgtatactacaaatctgactggaaaaattatgaaaatatatgctgatacttgtccatgcaccatgatttacctttaatgtatccatcacaattgtcatgagtaaggaatagtggatacctcatcactccaaacaccttatcaatacatataatttctgtctctc

SEQ ID NO: 7585 - DNA, 1523 bp, Phaseolus vulgaris
aagaattaggtttgcgattacaatgagccttgtattttccttgtgaaactgaagaatcaaacggaaaaagaaatccaaaacagtactttgaacctgtccgtttattatcactgaggataacatttcattaggcctaaattgtcatcatccacattcttaagaactgattcaccaaggaccctctgaatttcaggtaccttgttcgaaattgatccaattgaccctttttgttttcaatctttcaccccaccgtcaaggagctgaatcttatgatccccgtgataggttcggcgatatcgtgttgggttagggttttcaaagctttcttgatcgaacagtaaccatcaatgaagggggaagtacagcttcagcctccaccggttatgcaaaaccctagtgattcggaccctttgctccttaaccaggaggaggacgatgagtcgccgggaagctctggtgagatcaaggatgacgaagaagacgttgaggcaggcttactcccctgttgtcgaatttgcctcgaaagcgattctgacccagaggatgaattgatatctccatgcatgtgcaaaggtactcaacagtttgttcatcgctcatgtcttgatcattggcgctctgtaaaggaaggatttgccttctcacactgcaccacctgcaaagcccaatttcatcttagagttgaattatttgaggacaactcttggcgtaaaataaagttcaggctttttgtggcaagggatgttttccttgtttttctggctgtacagactgtgattgcagctattggtggctttgcgtacatcatggacaaagatggttccttcaggaactcatttgatgatggctgggataagatactgtcaaggcatccaattccgttttattattgtattggagtgctggccttctttgtactgattgggtttttcggtctcatactgcactgctcctccctcaataccaatgaccccagaatggctggttgtcagaactgttgttatggatggggcattctggattgctttcccgcttccatggaggcatgctttgcccttgtggttgttttcgttgtcatctttgcaattcttggtatagcgtatggttttcttgctgccaccatggccattcaaagaatttggcagaggcactaccatatcctcaccaagagggagcttacaaaggaatacatagtagaggatcttcgtggctgttatttcccaccaaagttggacccagaacatgaaggccgcttgaaaatgctcaagcttttgtgattacaaagcacttacctgtaaaaatgtttttaaatgattacagtatcaagttgttacattgtttaactgttacagtctcatcgctctcttctcttctaaacaaagaatctggatccttgccaggttctgtatacttcaaatttgactggaaaaatgataaaaatatatgcagatatttgtccgtgcccaggttgaagctaagtaatgattagtgaaccactccaaatgccttattaattcatataa

SEQ ID NO: 7586 - DNA, 1488 bp, Phaseolus vulgaris
gcgattacaatgagccttgtattttccttgtgaaactgaagaatcaaacggaaaaagaaatccaaaacagtactttgaacctgtccgtttattatcactgaggataacatttcattaggcctaaattgtcatcatccacattcttaagaactgattcaccaaggaccctctgaatttcaggtaccttgttcgaaattgatccaattgaccctttttgttttcaatctttcaccccaccgtcaaggagctgaatcttatgatccccgtgataggttcggcgatatcgtgttgggttagggttttcaaagctttcttgatcgaacagtaaccatcaatgaagggggaagtacagcttcagcctccaccggttatgcaaaaccctagtgattcggaccctttgctccttaaccaggaggaggacgatgagtcgccgggaagctctggtgagatcaaggatgacgaagaagacgttgaggcaggcttactcccctgttgtcgaatttgcctcgaaagcgattctgacccagaggatgaattgatatctccatgcatgtgcaaaggtactcaacagtttgttcatcgctcatgtcttgatcattggcgctctgtaaaggaaggatttgccttctcacactgcaccacctgcaaagcccaatttcatcttagagttgaattatttgaggacaactcttggcgtaaaataaagttcaggctttttgtggcaagggatgttttccttgtttttctggctgtacagactgtgattgcagctattggtggctttgcgtacatcatggacaaagatggttccttcaggaactcatttgatgatggctgggataagatactgtcaaggcatccaattccgttttattattgtattggagtgctggccttctttgtactgattgggtttttcggtctcatactgcactgctcctccctcaataccaatgaccccagaatggctggttgtcagaactgttgttatggatggggcattctggattgctttcccgcttccatggaggcatgctttgcccttgtggttgttttcgttgtcatctttgcaattcttggtatagcgtatggttttcttgctgccaccatggccattcaaagaatttggcagaggcactaccatatcctcaccaagagggagcttacaaaggaatacatagtagaggatcttcgtggctgttatttcccaccaaagttggacccagaacatgaaggccgcttgaaaatgctcaagcttttgtgattacaaagcacttacctgtaaaaatgtttttaaatgattacagtatcaagttgttacattgtttaactgttacagtctcatcgctctcttctcttctaaacaaagaatctggatccttgccaggttctgtatacttcaaatttgactggaaaaatgataaaaatatatgcagatatttgtccgtgcccaggttgaagctaagtaatgattagtgaaccactcca

SEQ ID NO: 7587 - DNA, 1482 bp, Vigna unguiculata
tgaagacaagaattaggtttgtgattacaatgagccctgtattttgctggtgaaattgaagaatcaaacggaaaaagaaatcaaaaacagttcattgaacctgtttgtttatcatcactgaggatatcattacattacgcctgtatttttatcatcaagattctcacgagctgattcaccaaggacccctccgaatttcaggttcggcgatatcgtgttgcgctagggttttcaatcctcaaaacttgcttgattgaatagtaaccatcaatgaagggggaagtacagcttcagcctccaccggtcatgcaaaaccctagtgattcggaccctttgctccctaatcaggaggaggaggagtcaccgggaagctccggtgagatcaaggatgacgaagaagacgttgaggcaggattactcccctgttgtcgaatttgcctcgaaagcgattctgacccagaggatgaattgatatctccatgcatgtgcaaaggtactcaacagtttgttcaccgctcgtgtcttgatcattggcgctctgtaaaggaaggatttgccttctctcactgcaccacttgcaaagcccaatttcatcttagagttgaattgtttgaggacaactcttggcgaaaaataaagttcagactttttgtggcaagggatgttttccttgtttttctggctgtacagactgtgattgcagctattggtggctttgcgtacatcatggacaaagatggttcgttcaggaactcatttgatgatggctgggataggatactgtcaaagcatccaattccattttattattgtattggtgtgctggccttttttgtactgattgggttttttggtctcatactgcattgctcctccctcaacaccaatgaccccagaatggctggttgtcagaactgttgttatggatggggaatcctggattgctttcccgcttcaatggaggcatgctttgctcttgtggttgttttcgttgtcatctttgcaattcttggtatagcgtatggttttcttgctgccaccatggccattcaaagaatttggcagaggcactaccatatcctcaccaagagggaacttacaaaggaatacatagtagaggatcttcgtggctgttatttcccaccaaagttggacccagaacatgaaggccgcttgaaaatgctcaagcttttgtgattacaaagcacttatctgtaaaaatgcttttgaatgattacggtatcaagttgttgctttatttgacttttacagtcatcgctctcttctcttttaagcaaagaatctggatcttgccagattctgtatacttcaaatctgactgaaaaatgataaaaatgattagtggacctctccaaataccttattagtttatatcgctgtctatatttctttgtatcacatcacatatgccctccttttcaataaaaaaagcttcttggtatccacaaaaaaaaaaaaaaa

SEQ ID NO: 7588 - DNA, 1553 bp, Cajanus cajan
gacaaggagtaggtttgcgatttccatcatgcttctatttacctcgtgaaattgaagatttatgcagaaaaaaatccaaaacagtactttgaaccgtcccatacactatccaacaggatagcatttcccctgcattgttattgttttcatcgatattcttaagaactgattcactatttcaggtaccttattccaaattatttcaattgacccttttcatttaatttgttcattccacagtcaaggacctgaatcttatgatacctgtgctaggatcagcgatattgtctgttagggtttcaattctcaaaatttgcttgatcgaacagtaatcatcgatgaagggggaagtgcagcttcagcctccaccggtcctgcaaaaccctagtgataccgaccctttgctacatgatcaggaggtggacgagtcaccgggaagttctggtgtgatcaaggatgaggaagacatcgaggctggctcactcccctgttgtcgaatttgtctcgaaagcgattccgacccagaggatgaattgatatctccatgcatgtgcaaagggacccaacagtttgtccatcgttcatgtcttgatcactggcgctcagtaaaggaagggtttgccttctcacactgcaccacatgcaaagcccaatttcatcttagagttgaattgtttgaggacaactcttggcgtaaaataaaattcagactttttgtggcaagggatgttttccttgtttttctggctgtacaaactgtgattgcagctattggtggctttgcgtacatcatggacaaagatggttccttcaggaactcatttgatgatggctgggatagaatactgtcaaagcatccaattccattttattattgtattggagtgctggccttctttgtactgattgggttctttggtctcatactgcattgctccgctctcaattccaatgaccccagaatggctggttgtcagaattgttgttatggatggggcattttggattgctttcccgcatcaatggaggcatgctttgcccttgtggttgttttcgttgtcatctttgcaattcttggtatagcttatggttttcttgctgccaccatggccattcaaagaatttggcagaggcactaccatatcctcaccaagagggagcttacaaaggaatatattgtagaggatcttcgcggctgttacttcccaccaaagttggatccagaacatgaaggtcgtttgaaaatgcttaagctcttgtgattacggagcacgtaactgtaaaaatgttttgaatgattcaagttgtcgctttatttgaactgttacagtctcatgcttaccaaccgtgtttgctagtgcttttaaatggtttatatcatcgttttttttttttttttttttaaatctgtatactgcaaatctaactgacttgaaaaatgatgaaaatatatatgcagatatttgtccatgcacaggatttacctttgatttatacatcacaattgttatgagtaatgataatgattggtaaacatattttcactccaaaca

SEQ ID NO: 7589 - DNA, 1357 bp, Lotus japonicus
aaaacagtaatttggatccttccttgagaataccattattcacccagcattgctatcttcgatattcctcaggattcaccgattcaccgactgacccctctgaatttctctgtaatttccagggtttctaaatttcgaagcttgcttgatcaaaaagtacccattattggttcatcaatgaaaggggaagtgcaactccaacctcctccgattatgcaaaaccctagtgattccgaccctttactccttgaccatgatgaggatgagtcccctttgagctctgctgagattaaggatgaggaggatgttgaggctggttcactcccttgttgtcgaatttgcctcgaaagcgattccgacccagaagatgaattgatatctccatgcatgtgcaaagggacccagcagttcgtccatcgttcatgtcttgatcactggcgctcagttaaggaaggatttgccttctcacactgtaccacctgcaaggcccaatttcatcttagagttgaatcgtatgaggacaactcttggcgtaaaataaagttcagactttttgtggcaagggatgttttccttgtttttgttgctgtacaaactgtgattgctgctattggtggctttgcctacatcatggacaaagatgggaccttcagaaactcatttgatgatggttgggataggatactgtcaaagcatcctataccattttattattgtataggagtgctggccttctttgtactgattggattttttggtctcatactgcactgctcctcactcaattccaatgatcccagaatggctggctgtcagaactgttgttatggatggggcatcctggattgctttcctgcatcagtggaagcgtgcttcgctctcgtggttgtttttgttgtcatctttgcaattcttggtatagcttacggttttcttgcaaccaccatggccattcaaagaatttggcagaggcactaccatatcctcaccaagagggagcttacaaaggagtacatagtggaggatcttggaggatgttattccccaccaaagttagaccctgaacatgaagctcgcttgaaaatgcttaagcttttgtgattcactgaacacttatctgtaaaaatgtgattttcaatgatttacatatcaagttgttgctctagtcgataattaccatctcttatgtttaacaaccttgtttgagcttggaaatcgtctacatcatgttttttatttaatctggatccttaccagattcttttttctttttaaatgaaaatccttaccagattctgtatactgccaattttactattggaaaaaattgagacaaatataaagcagttatttgtcc

SEQ ID NO: 7590 - DNA, 1338 bp, Arachis hypogaea
ataaataaataaaattgcaaaggatagcatttgctcttctattgttatcatcacagatattcacactcatataactctcaatcatcgaaggagccctctgaatttcgcactaatttcaagcgagattgttttagggttttcagtttctgaaactcggttggtatagaaccgttcatcaatgaaaggggaagtgcagctgcaaccaccggtggttcagcagaaccttagtgattccgagcctttactcgaaaaccaggaggaggatgtgtcccctgtaagctccactgagatcaaagatgaggacttggaggctggttcactcccttgctgtcgaatttgtcttgaaagcgattccgacccagaggatgaactgatatctccatgcatgtgcaaagggacccaacaatttgtccaccgttcatgtcttgatcactggcgctcggtaaaggaaggatttgccttctctcactgcactacttgcaaagcccaatatcatctcagggttgaattgtttgaggacaattcttggcgtaaagcaaagtttagactctttgttgcaagagatgttttccttgtttttctggctgtacagaccgtaattgcgggtataggtggctttgcatacatcatggacaaggatgggaacttcaggaactcttttgatgatggttgggataggatactgtcaaaacatcctataccattctattattgtattggagtgctggctttctttgtactgatcgggtttttcggtctcatactgcattgcacctccctcaacagcaatgaccccagaatggctggttgtcagaattgttgttatggatggggcatccttgattgctttcctgcatcaatggaggcttgctttgcccttgttgtggttttcgtagtcatctttgctattctcggcattgcttatggtttccttgcagccaccatggcaatccaaagaatttggcaaaggcactaccatattctcaccaaaagggagcttacaaaggaatacgtagtagaggatctatgtgggacctatgtcccaccaaagttggatccagaacatgaagctcgcttgaaaatgctcaagcttttgtaaatcacggtgcacaaacctgtaaagatgatttttttaagtattgagttgctttattatacggtaacattctcttatgattaccaaccttgcttgccagagcttggattggtttatgtgctcttttgtttcttttttcataaatctttttatctgggccttcaccaaattctgtatactgaaaatatgagtcctgagagaaatgaggaaaatacaaatatatgcatttgtttgtggaggca

SEQ ID NO: 7591 - DNA, 1268 bp, Medicago truncatula
ttttttcattattcgtcaaatatttcccgtgttcttttgttttagggtttgtgttagggttttcaatttcgaacattcaaaatcgaaatcgaacggtgattcattatgttaggggaagttcagctacaacctccaccgattcagcaaaaccctagcgattccgatcctttacttgctcatcaagatgaggttgaagatgatgattcccatggaagtggaaattctaatgagattaaggatcaagaagatattgaagctgggtcactaccttgttgtcgaatttgcctcgaatccgattctgatccagaggatgagttgatatctccatgcatgtgcaaaggaacccaacagtttgttcatcgttcatgtcttgatcactggcgctcagtgaaggaaggatttgccttttcacactgcaccacctgcaaagcccaattccatcttagagttgaaacgtatgaggacaactcttggcgtaaaataaagttcagacttttcgtggcaagggatgttttccttgtttttctggctgtacaaactgtgattgctgctattggtggttttgcgtacatcatggacaaagatgggaacttcaggaactcatttgatgatgggtgggataggatactgtcaaggcatcctataccattttattattgtattggagtggtggccttctttgttctaattggattttttggcctaatactgcattgctcttccctcaatagcaatgaccccagaatggctggttgtcaaaactgttgctatggatggggcatcttggattgctttcctgcatcaatggaggcatgctttgcccttgtagttgtttttgttgtcatctttgcaattcttggtgtagcctatggctttcttgcatccaccatggcaattcaaagaatttggcagaggcattaccacatcctcaccaagagggagcttacaaaggaatacatagtagaggatctacaaggcagttatttcccacccaagatagaccctgaacatgaaagtcgcctgaaaatgcttaagcttttgtgattcacggaacaaatctgtaaaaatgtgctttcaaattattttcgtatcaagttgttgctttgtgacacggtttcaatctcttatgcttggcaacctgctagagcatggaaatggtttatatcatcgtttcttttttatatataattctgggatcctcccagattctgtatactccaaatctgactgtcagaaaaaatgaggaaaatataagcagttaattgtcc

SEQ ID NO: 7592 - DNA, 1257 bp, Medicago truncatula
ttttcattattcgtcaaatatttcccgtgttcttttgttttagggtttgtgttagggttttcaatttcgaacattcaaaatcgaaatcgaacggtgattcattatgttaggggaagttcagctacaacctccaccgattcagcaaaaccctagcgattccgatcctttacttgctcatcaagatgaggttgaagatgatgattcccatggaagtggaaattctaatgagattaaggatcaagaagatattgaagctgggtcactaccttgttgtcgaatttgcctcgaatccgattctgatccagaggatgagttgatatctccatgcatgtgcaaaggaacccaacagtttgttcatcgttcatgtcttgatcactggcgctcagtgaaggaaggatttgccttttcacactgcaccacctgcaaagcccaattccatcttagagttgaaacgtatgaggacaactcttggcgtaaaataaagttcagacttttcgtggcaagggatgttttccttgtttttctggctgtacaaactgtgattgctgctattggtggttttgcgtacatcatggacaaagatgggaacttcaggaactcatttgatgatgggtgggataggatactgtcaaggcatcctataccattttattattgtattggagtggtggccttctttgttctaattggattttttggcctaatactgcattgctcttccctcaatagcaatgaccccagaatggctggttgtcaaaactgttgctatggatggggcatcttggattgctttcctgcatcaatggaggcatgctttgcccttgtagttgtttttgttgtcatctttgcaattcttggtgtagcctatggctttcttgcatccaccatggcaattcaaagaatttggcagaggcattaccacatcctcaccaagagggagcttacaaaggaatacatagtagaggatctacaaggcagttatttcccacccaagatagaccctgaacatgaaagtcgcctgaaaatgcttaagcttttgtgattcacggaacaaatctgtaaaaatgtgctttcaaattattttcgtatcaagttgttgctttgtgacacggtttcaatctcttatgcttggcaacctgctagagcatggaaatggtttatatcatcgtttcttttttatatataattctgggatcctcccagattctgtatactccaaatctgactgtcagaaaaaatgaggaaaatataagcagt

SEQ ID NO: 7593 - DNA, 1698 bp, Arachis hypogaea
ataaaaaaatcgagcccagcaaatccaaaacagttctttcaaccttttcttttgttatcatattcaagatatatattgtatagcctttaataaaaaagtttttttttttacataaataaataaaattgcaaaggatagcatttgctcttctattgttatcatcacagatattcacactcatataactctcaatcatcgaaggagccctctgaatttcgcactaatttcaagcgagattgttttagggttttcagtttctgaaactcggttggtatagaaccgttcatcaatgaaaggggaagtgcagctgcaaccaccggtggttcagcagaaccttagtgattccgagcctttgctcgaaaaccaggaggaggatgtgtcccctgtaagctccactgagatcaaagatgaggacttggaggctggttcactcccttgctgtcgaatttgtcttgaaagcgattccgacccagaggatgaactgatatctccatgcatgtgcaaagggacccaacaatttgtccaccgttcatgtcttgatcactggcgctcggtaaaggaaggatttgccttctctcactgcactacttgcaaagcccaatatcatctcagggttgaattgtttgaggacaattcttggcgtaaagcaaagtttagactctttgttgcaagagatgttttccttgtttttctggctgtacagaccgtaattgcgggtataggtggctttgcatacatcatggacaaggatgggaacttcaggaactcttttgatgatggttgggataggatactgtcaaaacatcctataccattctattattgtattggagtgctggctttctttgtactgatcgggtttttcggtctcatactgcattgcacctccctcaacagcaatgaccccagaatggctggttgtcagaattgttgttatggatggggcatccttgattgctttcctgcatcaatggaggcttgctttgcccttgttgtggttttcgtagtcatctttgctattctcggcattgcttatggtttccttgcagccaccatggcaatccaaagaatttggcaaaggcactaccatattctcaccaaaagggagcttacaaaggaatacgtagtagaggatctatgtgggacctatgtcccaccaaagttggatccagaacatgaagctcgcttgaaaatgctcaagcttttgtaaatcacggtgcacaaacctgtaaagatgatttttttaagtattgagttgctttattatacggtaacattctcttatgattaccatccttgcttgccagagctcggattggtttatgtgctcttttttcttttttcataaatctttttatctgggccctcaccagattctgtatactgaaaatatgagtcctgagagaaatgaggaaaatacaaatatatgcatttgtttgtggaggcattgttcagttagatatattagtataatattttagcaagaatagtccattactccattttgcttttctatatattcactttattgttaacttccaagtatacaaagttttcttgagttctaagaaatcacaagaaagcttccagttaagaagtagatgtgctaagatttaaaatcctaaaatttctttttgtatttttactgtaacaagagagatttacaatttataggttgatactactggtttaagagta

SEQ ID NO: 7594 - DNA, 1542 bp, Cicer arietinum
gcgagaaaggagtaggtgtactctataccatcgtgtttccattcacatttcaccgaatgaaattaagcagaagaaaaatccaaaagaatagtgatagaggacacacctaccatttaggcatttaccctcctccactgcactgttaccatcgacattcctaaagtaatcaacacccttcctagtttccctcttttttccaaattcattctattcactctttccatttttagtattcatttccatccttgactttgtcttagggttttcaatttctaagcttcattgattgaacggtttcattatgattggagaagttcagcttcagcctccaccgattctgcaaaaccctagtgattctgatcctttactcgatcatcaagatgatgttcaagatgaatcatcccctggaagttctactgagattaaggatcaggaagatgttgaggctggtttactcccttgttgtcgaatttgcctcgaaaccgattctgattttgaggatgaattgatatctccatgcatgtgcaaaggaacccaacagtttgttcatcgttcttgtcttgatcactggcgctcagtaaaggaaggatttgccttttcacattgctccacctgcaaagcccaatttcatcttcgagttgaaatgtttgaggacaactcttggcgtcaaataaagttcaggctttttgtggcaagggatgttttccttgtttttctggctgtacaaactgtgattgctgctattggtggctttgcgtacatcatggataaagatgggaacttcaggaactcatttgatgatggttgggataggatactgtcaaagcatcctataccattttattattgtattggagtggtggccttctttgtacttattggattttttggtctcatactgcattgctcctccctcaatagcaatgaccccagaatggctggttgtcaaaactgttgctacggatggggcatcttggattgctttcctgcatcaatggaggcatgctttgctcttgtggttgtttttgttgtcatctttgcaattcttggtgtagcttatggttttcttgcatcaaccatggcaattcaaagaatttggcagaggcattaccatatcctcaccaagagggagcttacaaaggaatacatagtagaggatcttcagggctgttatttcccaccaaagttagacccagaacacgaaagtcgcctcaaaatgcttaagcttttgtgattcacggaacaaatatgtaaaaatctgttttttaattattgatgtatcaagttgttgctttatttgaaggtttcaatcttttatgcttggcaaccttgtctgccagagcttggaaatggtttatatcatcattatatatatatatttatatcaatctaggatcgtaccagattctgtatactccaaatctgttgtttgttgggaaaaatgaggaaaatataagcagttatttgtccatgcactgtacttgtgtttatttattcattgccattgtcatgttgtatggtcgggtgaccaatgcatgcata

SEQ ID NO: 7595 - DNA, 1881 bp, Lupinus angustifolius
acgtaggaccattccaaaatacaaagcaaacatccttgacttcaattgaaagtgtgaacgcaagaataaaagaaacaaaaagcttaataaaagaacaacatcttctaccttccctaactcataaatcctacccatcttcaaagatgccatcaataacacttagagggttatcatcgtcattcttcattactttcatagttgtttttcacttttctttcccttgccacggtgacgttggtactgcttctcgttactcacctccatatataccatcgggttgttatggcagcgacgccacagagtttccgtcaagcaatctttttgcggcggcgggagatggaatatgggataatggagctgcatgtggtagggaatatatagtgaggtgtataagtgcagaggaaccaagaacttgcattccaaaccaaagcattcagattaagattgttgattacgttgattctgcagtttcacttccttcaattaatggaactactatggttctttctgatatgacatttggaactattgctaatacatctgccacattcatcaatattgaatttcagcagttataatctatatattgatatacaaattttggtgtcgtggcttgtgtgttggagaatgaagctgaattggtgccaacagtgttattcatcaaaagagggtaaatggataagatccaccatgaaggggaagtgcagcttcagccaccacaaattgtgcaaaaccctagtagagattccgatcctttactcgaaaatcaagaggaggaggaagaggagcgtgaatcccctgcagcaacctccactgagattaaggatgaggatgaggatgttgaggctggtttactcccttcttgtcgaatttgtctcgaaagcgattctgacccagaggatgaattgatatctccatgcatgtgcaaaggtactcagcaatttgtccatcgttcatgtcttgatcactggcgctcagtgaaagaaggatttgccttctcacactgcaccacttgcaaagcccaatttcatcttagagttgaatcgtttgaggataactcatggcgtaaagtaaagttcagactttttgttgcaagggatgttttccttgtttttgtggctgtacaaactgtgattgctgctatcggtggctttgcttacatcatggacaaagatgggaacttcaggaactcttttgacgatggttgggataggatactgtcaagacacccgattccattttattactgtattggagtgctgtcgttctttgtactgattggattttttggtctcatactgcattgttcctccctcaataacaatgaccccagaatggctggttgtcagaattgttgttatggatggggcatcttggactgttttccggcatcaatggaggcgtgctttgcccttgtggttgttttcgttgtcatctttgcaattctcggtatagcatatggtttccttgctaccaccatggccattcaaagaatctggcagaggcattaccatatcctcaccaagcgggagcttacaaaggaatacatagtagaggatcttggtggcagttattccccaccaaagttggacccagaacatgaagctcgcttgaaaatgcttaaccttttgtgattcacaatatgtaaaagtgtgttgttggaatgtgaagataattgttgagctgttactttatttgacagttgcaaaatctgtatgtttggcaactttatttgcaagcttggaaatggtttttatataatccttttttaataatctggaccctcactagattctgtacactgcaactattactcctccaaattgatggtatttgttaacttgaagttggttaagtattctgtcaagcaactacaagaaa

SEQ ID NO: 7596 - DNA, 1122 bp, Trigonella foenum-graecum
tcagcaaaccctagcgattccgatcctttattggctcatcaagatgaggttgaagatgatgattcccatggaagtggaaattctaatgagattaaggatcatgaagatgttgaagctgggtcactcccttgttgtcgaatttgcctcgaatccgattctgatcctgaggatgagttgatatctccatgcatgtgcaaaggaacccaacagtttgttcatcgttcatgtcttgatcactggcgctcagtaaaggaaggatttgccttttcacactgcaccacctgcaaagcccaatttcatcttagagttgaaacgtatgaggacaactcttggcgtaaaataaagttcagactttttgtggcaagggatgttttccttgttttcctggctgtacaaactgtgattgctgctattggtggctttgcgtacatcatggacaaagatgggaactttaggaactcatttgatgatgggtgggataggatactgtcaaagcatccaataccattttattattgtattggagtggtggccttctttgtactaattggattttttggcctaatactgcattgctcctccctcaatagcaacgaccccagaatggctggttgtcaaaactgttgctacggatggggcatcttggattgctttcctgcatcaatggaggcatgctttgcccttgtagttgtttttgttgtcatctttgcaattcttggtgtagcttatggctttcttgcatccactatggcaattcaaagaatttggcagaggcattaccacatcctcaccaagagggagcttacaaaggaatacatagtagaggatctacaaggcagttatttcccacccaagttagaccctgaacatgaaagtcgcctgaaaatgcttaagcttttatgattcacggaacaaatctgtaaaaatgtgcttttaagttgtttttgtatcaagttgttgctttatgtgacggtttcaatctcttatgcttggcaaccttgtttgctagagcatggaaatggtttatatcatcgcttcttttataaatctgggatcctaccagattctgtatactccaaatctgactgttggaaaaaatgaagaaaatataagcagttaatt

SEQ ID NO: 7597 - DNA, 1720 bp, Prunus mume
atggggcccatagaaaacagaacccaagtttacccagtcaagtcatccaggcgcgccgtacgcaccgcgcgtcgtatagaaaacatcaaaatcctccaacagcctatacctatcgatttcgtaaaatcaccgatttacgattttgccttgataattctctgcaaaaactcagtggtttgaacgatttctgcggccgatcaatgaaaggagaagtgcagctagagccagcaggtgaaagggaacgagaccctactgacgtggaccctctgctagaggaccaggaagattcgtcacctggaagctcgactgagatttacaatgaagacctcgagtctggctccattccctgttgtcgcatttgtcttgaaagcgatgctgaaccaggggatgaattgatttcaccttgcatgtgtaaaggcacccagcagtttgttcatagctcctgtcttgaccactggcgctctgttaaggagggatttgctttctcacactgcacaacttgcaaagcccaatttcaccttcgagttgaatcatatgaggacaattcttggcgtaaaataaaattcagagtttttgtggcaagggatgttttcctcgtatttttagctgtacaatcagtaattgctgcaattggtggctttgcatatgtcatggacaaagatggtgccttcaggaattcatttagtgatggttgggatcgtatcttgtcaaaacatcctataccattttattattgtataggggtactggccttttttgtgctgcttggattttttgggcttatactacactgttcatccctcaatagcaatgacccaagaatggctggctgccagaattgttgttatggttggggaatcttggattgtttccccgcatctatggaggcttgctttgccttagttatcgtttttgttgtcatatttgccatacttggcatagcttatggtttccttgctgctaccatggctattcagaggatctggcagagacattatcacatcctgaccaagagggaactcacaaaggagtacatagtggaggatcttcatggatgttataccccaccaaaattggatccagaacatgaagcacgtctgaaaatgctcaagttgttgtagtgatggatgaggaggtaaaataaatttatcaggtaatgaaatcgtcgatgtgtatttgcttgacgttaaaggagcagagaaggaaaatattttagtctcattcttccttgaattcaccaaaatgtgaccacctgtgcagtagttttatactctcaagtctcttatgattttgctctgctctggtattgtacgagtttggatattcttggacttgtctcctcccgagtcccatgaagcctgcgtgtatttgtcttccatgaagtggattttaggctggtgttgtatgctttacctcaatgctgccatctgttctccaccctcggccactctttggggttggtaggattataggataattaatacataacccaaattattattatcttcttcgtcaaaagttaccgatcttgatcgcaaggtagcgtcctgtcatcaaccaaagtataaaaaatctgccatggctccttcctttgaactggagctgtgcttgcataaactgcagtgaaaatccagcgattcaactattcaccacaaaaatcaaattcgaaagtctcatttgaatcaagaagatataaatttgggattaatcaatttttaca

SEQ ID NO: 7598 - DNA, 1387 bp, Prunus persica
atggggcccatcaaaacagagcccaagtttacccagtcaagtcatccaggcgcgcatggtttgaacgatttctgcggccgatcaatgaaaggagaagtgcagctagagccagcaggtgaaacggaacgagaccctactgacgtggaccctctgctagagaaccaggaagattcgtcacctggaagctcgactgagatttacaatgaagacctcgagtctggctctattccctgttgtcgcatttgtcttgaaaccgatgctgaaccaggggatgaattgatttcaccttgcatgtgtaaaggcacccagcagtttgttcatagctcctgtcttgaccactggcgctctgttaaggagggatttgctttctcacactgcacaacttgcaaagcccaatttcaccttcgagttgaatcatatgaggacaattcttggcgtaaaataaaattcagagttttcgttgcaagggatgttttccttgtatttttagctgtacaatcagtcattgctgcaattggtggctttgcgtatgtcatggacaaagatggtgccttcaggaattcatttagtgatggttgggatcgtatcttgtcaaaacatcctataccattttattattgtataggggtactggccttttttgtgctgcttggattttttgggcttatactacactgttcatccctcaatagcaatgacccaagaatggctggctgccagaattgttgttatggttggggaatcttggattgtttccctgcgtctatggaggcttgctttgccttagttatcgtttttgttgtcatatttgccatacttggcatagcttatggtttccttgctgctaccatggctattcagaggatctggcagagacattatcacatcctgaccaagagggaactcacaaaggagtacatagtggaggatcttcatggatgttataccccaccaaaattggatccagaacatgaagcacgtctgaaaatgctcaagttgttgtagtgatggatgaggaggtaaaataaatttatcaggtaatgaaatcggcgatgtgtatttgcttgacgttaaaggagcagagaaggaaaagattttagtctcattcttccttgaattcaccaaaatgtgaccacctgtgcagttgttttatactctcaagtctcttatgattttgctctgctctgatattgtaccagtttggatattcttggacttgtctcctcccgagtcctatgaagcctgcgtgtatttgtcttccatgaagtggattttaggctggtgttgtatgctttacctcaatgctgccatctgttctccaccctcggccactctttggggttggtaggattataggataattaatacataacccaaattactatta

SEQ ID NO: 7599 - DNA, 1187 bp, Vitis vinifera
ctcgtttcgagtctttcttttatctcacccgacgcctgtgaaaagttgagagattttccttacggtttctgttcaaatttcaggcttcgtcaatgaaaggagaagtacagctagaaccatcaggtgagcgaaaccctagggactctgatcctctgcttgagaaccaggcggattcatccacaggaagttcaagcgagataaatagtgaggacattgaagctggctctgtaccctgttgtcgcatttgtctcgagtgcgatggagaaccagatgatgaattgatatctccatgcatgtgcaaaggcacccaacagtttgttcatcgttcatgccttgatcattggcgttcagtgaaggaaggatttgctttctcacattgcacaacttgcaaggcgcaataccatcttcaagttgcattattcgaagacaactcttggcgtaagataaagttcagactttttgtggccagagatgttttccttgtatttttggctgtacaaactgtcatcggtgctatgggtggatttgcatacatcatggacaaagatggggctttcaggaattcgttcagtgatggttgggatcgaatattgtccaggcatcctataccattctactactgtataggggtactggccttctttgttttgctggggttttttggtctcatattgcattgctcctccttaaatagcaatgatcctcatatggcgggctgccagaactgctgctatggatggggcatcttggattgttttccagcatctatggaagcatgcttcgcacttgtcatagtttttgttgtcatctttgccattctgggagttgcctatggtttccttgctgccaccatggccattcaaagaatttggcagaggcattaccacatactaaccaaaagggagctcacgaaggagtacattgtggaggatctccggggctgttatacgccaccaaaactggatccagaacatgaagaacgtctgaaaatgcttaaacttttgtaggacgggatgatgagatgaaattgttgtatgtcttattgaattgttttaaagtcacggaactgagagttataatgtgtatttgctcagaagttgtgaagaatgagaaaagataattgctgttttgagtcgataagctaactgaacaaatgttgcaaaaagtgaagataaataacaatctgt

SEQ ID NO: 7600 - DNA, 1617 bp, Vitis vinifera
atgaagagcataggcgagctcaaaaatcttgttgggctcagcccaggactttcaagcttttgggtcgaagacgacctcgtttcgagtctttcttttatctcacccgacgcctgtgaaaagttgagagattttccttacggtttctgttcaaatttcaggcttcgtcaatgaaaggagaagtacagctagaaccatcaggtgagcgaaaccctagggactctgatcctctgcttgagaaccaggcggattcatccacaggaagttcaagcgagataaatagtgaggacattgaagctggctctgtaccctgttgtcgcatttgtctcgagtgcgatggagaaccagatgatgaattgatatctccatgcatgtgcaaaggcacccaacagtttgttcatcgttcatgccttgatcattggcgttcagtgaaggaaggatttgctttctcacattgcacaacttgcaaggcgcagtaccatcttcaagttgcattattcgaagacaactcttggcgtaagataaagttcagactttttgtggccagagatgttttccttgtatttttggctgtacaaactgtcatcggtgctatgggtggatttgcatacatcatggacaaagatggggctttcaggaattcgttcagtgatggttgggatcgaatattgtccaggcatcctataccattctactactgtataggggtactggccttctttgttttgctggggttttttggtctcatattgcattgctcctccttaaatagcaatgatcctcatatggcgggctgccagaactgctgctatggatggggcatcttggattgttttccagcatctatggaagcatgcttcgcacttgtcatagtttttgttgtcatctttgccattctgggagttgcctatggtttccttgctgccaccatggccattcaaagaatttggcagaggcattaccacatactaaccaaaagggagctcacgaaggagtacattgtggaggatctccggggctgttatacgccaccaaaactggatccagaacatgaagaacgtctgaaaatgcttaaacttttgtaggacgggatgatgagatgaaattgttgtatgtcttattgaattgttttaaagtcacggaactgagagttataatgtgtatttgctcagaagttgtgaagaatgagaaaagataattgctgttttgagtcgataagctaactgaacaaatgttgcaaaaagtgaagataaataacaatctgtgcagtcatatgttctcatgtctttgtatggttttttctctgccacctttccaccacgagttgtacatcacactgtcactataggtattctagatggctgatctaggacagcactcagattggtagcacttggtgggtgatttccttgtgtatatgcacatgctcttgtgggagtgtgttcttggaagttgcaccgaaacacatgctataaggatacacccttgactcaagtttatgtgcaggcaaactattgtggtcattccttgtctttgggtccttgaacctgaatctcgacatgattggaggcttcttttttcattctttagaatgataataaaatatggttccgattccgc

SEQ ID NO: 7601 - DNA, 1259 bp, Carpinus betulus
ctcgctaacaatcactccaatcggcgccttcgaaaagttcagtgactttttgttgggtttctttgcaaattcagggttgaggaggctctattcgtcgagaaacgttaccatcgatgaaaggggaagttcagctagagccgacaggaacagctgcagggaaccctagtgactccgatcctctgctagagaaccaggccgattcgccaccagggagctctagtgagatcaaggatgaagatatcgaggccggtacgattccgtgctgtcgcatttgcctcgagagcgagagcgagggcgagccagaggatgaattaatatctccatgcatgtgcaaaggcactcagcagtttgttcatcgttcatgtcttgatcattggcgttcagttagggaaggatttgctttctcacattgcaccacttgcaaagctcaatttcaccttcgacttacagtttttgaggacaactcttggcgtaaaataaaaattcagactttttgtggcaagggatgtcttccttgtattcttagctgtacaaactgtaattgctgcaataggtggctttgcatacgtaatggataaagatggggccttcaggaactccttcagtgacagttgggatcggattctatcaaaacatccaataccctttttattactgtatagggtatcggccttctttgtgctgcttggattttttgggcttatacttcattgctcctcctcaatgtaatgatccgcgatggctggctgccagaattgctgttatggatggggcatcttggattgttttcctgcatctatggaggcatgttttgccttggttatagtttttgttgtcatctttgccattcttggaatagcttatgggttccttgctgccaccatggccattcagaggatctggcaaagacactaccacatccttaccaagagggagctcactaaggagtacatagtggaggatcttcgtggttgttatactccaccaaaactggatccagaacacgaagcacgtctgaaaatgcttaagcttttatagtaatggacgctgaagtgaatttatgtctttttcaagtgtttttaaattaatcagcatatgagagctacaatgtgtatttgctccgcaactttgtttaatacagtggggagtaaagagaatgggtcttatgttgtaagtgctcaccaaggtgcgtactcgatctttcaaagctgactgaaaaatgatttgaaaatgccctaatataatcatctgtgcagtta

SEQ ID NO: 7602 - DNA, 1428 bp, Gossypium raimondii
atcaaattcccaaagaaaacgaaaatacaaggtttgtttttgggttttattattcgatcaatgtcgggggaattgcagttagagccagcaggtgctcgaaaccctagtgattctgatcctcttttaggaaaccagatcgattcgccgtcgccggcgagttcgagtgagattcggagtgaagatatcgagaatggttcggctccttgttgccgcatttgcctcgagtgcgatggtgaagaagatgatgaattgatatctccatgtatgtgcaaaggcacccaacaatttgttcatcgtgcttgccttgatcattggcgttcggtaaaggaagggtttgctttctcccattgcacgacttgcaaggctcagtttcaccttcgtgttgaattgttcgaggacaactcttggcgtaaaataaagttcagactttttgttgcaagagatgtctttctcgtattcttggccgtacaaactgtcattgctgcaatgggaggctttgcatatgtcatggataaagatggggcttttcggaaatcattcagtgatggttgggatcgcatactgtcaaaccatcctataccgttttattattgcgtaggggtgcttgccttctttgtgttgcttggatttttcgggctcatattgcattgctcctctctcaatagcaatgacccacgaatggctggatgccagaattgctgttatgggtggggtatattggattgctttcctgcatctatggaagcatgctttgcactggtggtcgttttcgttgtaatctttgccattctggggatagcttatggtttccttgctgccacaatggcaattcagcggatctggcagaaacactaccacattcttactaagagggagcttactaaggagtacattgttgaagaccttcacggctcttataccccacctaaacttgatccggaacacgaagagcgcttgaaaatgatgaagcttttgtagttagatgaagtgaaggaggtggtgaggaaagccataagaggtatttgagtctttccaaattattcagaatacaaaaagataaaatttggtcggctgcttggccatttttgtcaaaaagagttgaggaggagggggaggggggagagtgatgtccttttgtccctaaatctcactttgaagtctttacatcggtattgctgacagtgaacaaggtaaccagccgtgctggggtggcgggggtgcataataatctgtgcagttatatatatatgtatcttctttcttgatgttttgtctaataacaaaccatactttgcctatgaaaaccattgagtaggtaaattgttcttatctccacattgttctaccaaatatacttttgcctattaagattttataaaaatcattacttcaaaacattgttccaaattcagaatttaaaataaataa

SEQ ID NO: 7603 - DNA, 1406 bp, Gossypium hirsutum
ttgtttttgggttttattattcgatcaatgtcgggggaattgcagttagagccagcaggtgcgcgaaaccctagtgattctgatcctcttttaggaaaccagatcgattcgccgtcgccggcgagttcgagtgagattcggagtgaagatatcgagaatggttcggctccttgttgccgcatttgcctcgagtgcgatggtgaagaagatgatgaattgatatctccatgtatgtgcaaaggcacccaacaatttgttcatcgtgcttgccttgatcattggcgttcggtaaaggaagggtttgctttctcccattgcacgacttgcaaggctcagtttcaccttcgagttgaattgtttgaggacaactcttggcgtaaaataaagttcagactttttgttgcaagagatgtctttctcgtattcttggccgtacaaactgtcattgctgcaatgggaggctttgcatatgtcatggataaagatggggcttttcggaaatcattcagtgatggttgggatcgcatactgtcaaaccatcctataccgttttattattgcgtaggggtgcttgccttctttgtgttgcttggatttttcgggctcatattgcattgctcctctctcaatagcaatgacccacgaatggctggatgccagaattgctgttatgggtggggtatattggattgctttcctgcatctatggaagcatgctttgcactggtggtcgttttcgttgtaatctttgccattctggggatagcttatggtttccttgctgccacaatggcaattcagcggatctggcagaaacactaccacattcttactaagagggagcttactaaggagtacattgttgaagaccttcacggctcttataccccacctaaacttgatccggaacacgaagagcgcttgaaaatgatgaagcttttgtagttagatgaagtgaaggaggtggtgaggaaagccataagaggtatttgagtctttccaaattattcagaatacaaaaagataaaatttggtcggttccttggccatttttgtcaaaaagagttgagaaggagggggaggggggagagtaatgtccttttttgtccctaaatctcactttgaagtctttacatcggtattgctgacagtgaacaaggtaaccagccgtgctggggtggcgggggtgcataataatctgtgcagttatatatatgtatcttctttcttgatgttttgtctaataacaaaccatactttgcctatgaaaaccgttgagtaggtaaattgtccttatctccacattgttctaccaaatatacttttgcctattaagattttataaaaatcattacttcaaaacattgttccaaattcagaatttaaaataaataattcatgcagga

SEQ ID NO: 7604 - DNA, 1427 bp, Malus domestica
tctttaatttccattggaatccccgttaaacttctgcgaaagttaccaattctcactcataaattacgaattgcgcttgaattctgacaaattttaggggttttgttctgttctggttggcgattgggagctggagtagggtttcgagcgatttctgaggccgatcaatgaaaggggaagtgcagctggagccaacaggtgaaggggagcgagaccgagaccctactgacatcgagcctctgctaccgaaccaggacgattcgtcgccggcaagctcgagtgagatcaacaacgaagaccttgagtctggctctatcccttgctgtcgcatttgtctcgaaagcgatgccgaaccagaggatgagttgatttcaccttgcatgtgcaaaggcacccagcagtttgttcataggtcctgtctcgatcactggcgctccattaaagaaggatttgctttctcacactgcacaacttgcaaagcccaatttcaccttcgagttgagacatatgaggacaatgtctggcgcaaaataaaattccgagtttttgtggcgagggatgttttcctcgtgtttttggctgtacaatcagttatagctgcaattggtggctttgcatatgtcatggacaaagatggggccttcaggaattcatttagtgatggttgggatcgtattttgtcaaaacatcctataccattttattattgtataggggtactggccttctttgtgctgcttggatttttcgggctcatactacactgttcatcgttcaatagcaatgacccacggatggccgggtgccagaactgttgctatggttggggaatcttggattgtttccccgcatctatggaggcttgctttgccgtcgtgattgtgtttgttgtcatctttgccattcttggcatagcttatggtttcctggccgctaccatggctattcagaggatttggcagagacattatcacatcctgaccaagagggaactcacaaaggagtatatagtggaggatcttcatggatgctataccccaccaaaactagatgccgaacatgaagcgcgtctgaaaatgctgaagttgttgtagagatagaaacaaatttcaggatatgaaatccgctgtgtgtatttgcatttgtaacttagaaagatccaacaaatgttggggggattaccactagtgcagtactttgtactctcatgacttgtgatttttgctttgctccgggattgtaccgattgagctattcttcgacttgtgtcctctgagtcttgtgtatgcctccagcgaagcgagtttttaccgttgtatttccaccccaggtcactcgtgtaacgtcatgtataacccaagaaactattttgttgttcaaatttaagctacaggtctcaaatccaaaaatctctcatttgaatccaa

SEQ ID NO: 7605 - DNA, 1308 bp, Momordica charantia
cggccggggagaggagcccagcgaatttacggatgaggcgaggccctgagacgatgaatgaacattatctgctatcatgaatcacaatcagcggcgccgggaatcgttaaaggaaacatcgcatctgcttaggccctccttcaggattattacagttcatattaatatcatacacatctgcagagagtctaatctgaatctttcctcgatttcagggcagtgaaagcttcggtctttcggataaggagataatcaatgaaaggggaagtacaattggattcgtcaattggccaaaaccctagtgactctgatcctctgctcgagaatcaggccgattcatcatcccatggaacctccgatgaaatcaagaatgaggatactgaagctggttccattccgtgttgtcgtatttgcctagagagcgatgcagaaccagaagatgaactgatttctccatgcatgtgcaaaggcacacagcagtttgtccatcgatcttgtcttgatcattggcgctccgttaaggaagggtttgctttctcacattgcacaacatgcaaagcccaatttcacctgaaagtttccttgtttgaggacaactcttggcgtaaagttaaattcaggctttttgtggcaagagatgttctccttgtatttctagctgtacaaactttaatagctgcaatgagtggttatgcatacattatggacaaagacgggacattcagaaattctttcagtgatggatgggatcgcattctgtcgaaacatcctattccattttattattgtatcggggttctggccttctttgttctgcttggatttttcgggctcatcctgcattgttcctccctaaatagtaacgatcctcgagttgctgggtgtcacaactgttgctatggttggggtatcttggattgtttccctgcatctatggaggcgtgcttcgcacttgttatcgtttttgttgttatctttgtcatccttgggatagcttacggtttccttgctgccactatggctattcaaaggatctggcagaggcattaccacattctcaccaaaagggagctgactaaagagtacgtggtggaggatcttcacggttgttatacccctccaaaattggatccagaacatgaacaacacttgaaaatgctacgacttctgtaacgaatggcagatgaggtgttcaatttctgtcatttatcgtttcttatgttcttttcaacttctgtaagatacgatatatgcatttccttgaaaactttgttataattataaatgagcaatgtaggaaaatagtaa

SEQ ID NO: 7606 - DNA, 1312 bp, Castanea mollissima
gcgataactgatcaaccttcttatattggaattgaattttgaatttggagaatttgatatttgcgcttgatttttagggttttgatttttgatcaatctttttgtgtatctggtaattggaggtgtgaatttttagggtttttgggagggaaaaaaaaagggttttgatcaatgaaaggggaagtacagctagaggtaacgagtgcaggggaccctattcctagtgatgctgatcctctgctagagaaccatgccgattcatcgtcaccagggagctcgagctcgagctcgaatgagatcaggaatgaagatattgaggccggttcgaattcgtgttgtcgcatttgcctcgaaagcgatgcggagccagaggatgaattaatatctccatgcatgtgcaaaggtacccagcagtttgtgcatcgttcgtgtcttgatcattggcgttcagttaaggaaggatttgctttctcacattgcaccacttgcaaagctcaatatcaccttcgtgttgcattgtttgaggacaactcttggcgaaaactaaaattcaggattttcgtggcaagggatgtttttcttgtattcttggctgtacaaactgttattgctgcaatgggtggctttgcatacctaatggataaagatgggaccttcaggaactcattcagtgatagttgggatcggattctgtcaaaacatcctatacctttttattattgtataggggtactggccttctttgtgctgcttggattttttgggcttatactacattgctcctccctcaatagtaatgaccctcggatggctggctgccagaactgttgctatggatggggaatcttggattgttttcctgcttcaatggaggcatgctttgccttggttattgtttttgttgtcatttttgccattcttggcatagcttatggtttccttgctgccaccatggccattcagaggatctggcagagacactaccatatccttactaagagggagctcactaaggagtacatagtggaggatcttcatggttgttatgccccaccaaaattggatccagaacatgaagcacgtctgaaaatgcttaaacttttgtagtgctggagggggaagtgaagttatgtctgttaacgtgctgttaaattaatcaccatttgggagcaacaatgtgtatttgttccacaactttgtttaatacagtggggaggaaagagaacggtcttatattctaagtgctcagaggtatgtaaccaatcttgcaaagctaagtgaaaaatatttgggaaatgggcttatataacca

SEQ ID NO: 7607 - DNA, 4003 bp, Theobroma cacao
gccaccttgataagaccaaacctccccaagtaaaagcaattcctcttccaaaacaaaaaccaaaaccccgaggcaagtcaaactctctctcctcatattcctctctaagtttctcgcccaactccagggttttctttttcgatcaatgacgggggaattgcagctagagccagcaggtgcacgaaaccctagtgactctgatcctctgttacaaaaccaggccgactcgttatcttctgcgagttcaagtgagattaggagtgaagatattgagaatgtttctgctccttgttgtcgcatctgcctcgaatgtgatggcgaagaagatgatgaactgatatccccatgcatgtgcaaaggcacccagcagtttgttcatcgttcctgccttgatcattggcgttcggtaaaggaaggatttgctttctcccattgcacaacttgcaaagcgcagtttcaccttcgagttgaattgtttgaggacaactcttggcgtaaaataaaattcaggctttttgtggcaagagatgtgtttcttgtgttcttggctgtacaaactgtaattgctgctatgggaggctttgcatatttcatggacaaagatggggcttttcggaaatcattcagtgatggttgggatcgcatactgtcaaaacatcctataccattttattattgcatcggggtgcttgccttcttcgtgctgcttggattttttgggcttatattgcattgctcctccctcaatagcaatgacccacgcatggctggatgccagaattgctgttatgggtggggcatcttggactgctttcctgcatctatggaagcatgctttgcactggtggtggtttttgttgttatctttgccattttggggatagcttatggtttccttgctgccacaatggcaattcagcgaatctggcagaaacactaccacattcttactaagagggagcttactaaggagtacatagtagaggaccttcacggatcttatacccagccaaaacttgacccagaacatgaagaacgcttgaaagtgatgaagctattgtagtgatggatggataggtgaaaagcacgagatgtattcgaatctttcaaattattcaggatacaaaagttaaaattttgtggattggtcggcaactttatcaatagagtgagtgggggaaagagtgctgtcctttgtctctcacatctcacaatctcactcttaagtcttacctcattgctgactgaaaacgaggcaaaccaggccagcagggaggtacataaatgatctgtgcagttaatatatttatatgtatacaaatatgtatctcttttccttgatgtttgtctaaccagtcacacttttattatactcgtggcaatttcccttgcctttgaataccctcgtcctgttaataatccgtacgttcttaagttatatctatgctcaaattggataatgaattttcagtttttctttacatataaatattgatgaagctatttttttcctatattacaatctttcataatgcaatgcgaggctgaatcaagctggacttgttcactttgaaattttcaattgcaacaatagaaaacatcctttaaaaaagaaaaacaattatattcttattttagttaaaaggaaaataataacaaagtcaaattagtcattacaaccgaattttaattaaccaaaaaaagattacatgaacaacggtagcaccgcccgttcaatggataatctaagaagtccattcacaggggtccttcacgacttcaaaggaagaaaatcatgttacaagcaggactgggctgctggacgttgtacgggcctcaggatattggcaccaactacttatgtattcttcgcttctgctcttcccgtcattgccttcggagctcaacttaaccgagaaacagatggaagcttgagcactgtggaaactctagcttcaactgccatatgtggcatcatacactctatcttcggaggccaacctctgttgattttaggagttgctgagccaacggttataatgtactcttatttatacagctttgcaaatggaagggacgatcttggcaaagaactcttcttggcttgggctggatgggtgtgtgtctggaccgctttccttctcgttcttcttgcaatatttaatgcttgtacgataatcaataaatttacaaggattgctggggagctttttggcatgttaattgctgttctattcattcaacaggccatcaaggggattgtgagtgaatttgaagtaccggatgctggaaatcaaaactcagaaaaagatagtttccagtggctttatgtaaacgggctgttgggtgttatatttacgtttggactactcatcaccgctttgaagagcaggggggcaagatcatggcgatacggcacagggtggtgtcgaagcttgattgcggattatggtgttccattgatggtcgtagcatggtcagcaatgtcatttattgttcctggcaaagttccttctggagttcccaggagacttgttagtcccctcccttgggagtctgcctcgttggagcactggacagtaatgaaggatatggcaaacgtcccaccggtccacgtatttactgctttcttaccagctataatgatcgctggtctttacttttttgaccacactgttgcttcacaattggcacaacagaaggagtttaatctcaagaagccatctgcttatcactacgacattttcattctcggcattatgactctgatctgtggtttgattggactccctccttccaatggagtactcccacaatctcccatgcacacaaagagcctcgctgttctcaaaagacagataattagaaagaaaatggtgaagggcgccaaggaatgcttgaaacaaaaagctagcaaatctattatttatggcaggatgcaagaaatttttgaagaaatggactcgacttcagctgtaagcactcttgttctttgcatattggggttccttaagatataccataatgatcacccttctgcagctcaagacttgaaggatttgaaggctgcagttttcaaagctgaggatggaggaaacacagattgtaaatttgatcctgaaaagcatatagaggctcacctacctgtaagggttaatgagcaaagagtgaccaatctattacagtcaattctagtgggagtatcattactagccatgccgataatcaagaaaataccaacatcagttctctggggatattttgcatacatggctattgacagtctacctggaaaccagttctgggaaagaatgttactgcttgtcattgctcctagccggcggtacaaggttttagaaggggctcatgcttcttttgtggagtccgtgcctttcaaaaatattgctgtatttacactcctacagctggtttatcttctgatgtgttttggggtgacatggataccgattgctggaatattattccccttgcccttctttctgctcataagcataagacagcatattctccccaaattttttcaaccacttcatcttcatgagctggatgcagctgagtacgaagaaattcctgctggaacctataatcacaatcatggcattttattcaaggtacgtaacctcactgcatatatcactgagcaaaatcattcaggggatgaagatagtgaagtagaaacggacgatcaagagctatttgatgagctgaccactagcagaggagagttgaagcttagatcaagaagcttcagagaagataagcatggtcaggttcatcagggagaggttgacccagaaaatggaatgtaacattaagtcgttaacctgaagttaacagaatggaaactgatgattcgattggtgatcaaaagatttgacatagtgatatgtgcaaaaatggctaagcatcgtccgtgcttagtagtaagggaaggcaaagaaagaaatccaaaacaggaatgaggtgcagaaaaagaagtgaa

SEQ ID NO: 7608 - DNA, 1418 bp, Theobroma cacao
caaaaaccaaaaccccgaggcaagtcaaactctctctcctcatattcctctctaagtttctcgcccaactccagggttttctttttcgatcaatgacgggggaattgcagctagagccagcaggtgcacgaaaccctagtgactctgatcctctgttacaaaaccaggccgactcgttatcttctgcgagttcaagtgagattaggagtgaagatattgagaatgtttctgctccttgttgtcgcatctgcctcgaatgtgatggcgaagaagatgatgaactgatatccccatgcatgtgcaaaggcacccagcagtttgttcatcgttcctgccttgatcattggcgttcggtaaaggaaggatttgctttctcccattgcacaacttgcaaagcgcagtttcaccttcgagttgaattgtttgaggacaactcttggcgtaaaataaaattcaggctttttgtggcaagagatgtgtttcttgtgttcttggctgtacaaactgtaattgctgctatgggaggctttgcatatttcatggacaaagatggggcttttcggaaatcattcagtgatggttgggatcgcatactgtcaaaacatcctataccattttattattgcatcggggtgcttgccttcttcgtgctgcttggattttttgggcttatattgcattgctcctccctcaatagcaatgacccacgcatggctggatgccagaattgctgttatgggtggggcatcttggactgctttcctgcatctatggaagcatgctttgcactggtggtggtttttgttgttatctttgccattttggggatagcttatggtttccttgctgccacaatggcaattcagcgaatctggcagaaacactaccacattcttactaagagggagcttactaaggagtacatagtagaggaccttcacggatcttatacccagccaaaacttgacccagaacatgaagaacgcttgaaagtgatgaagctattgtagtgatggatggataggtgaaaagcacgagatgtattcgaatctttcaaattattcaggatacaaaagttaaaattttgtggattggtcggcaactttatcaatagagtgagtgggggaaagagtgctgtcctttgtctctcacatctcacaatctcactcttaagtcttacctcattgctgactgaaaacgaggcaaaccaggccagcagggaggtacataaatgatctgtgcagttaatatatttatatgtatacaaatatgtatctcttttccttgatgtttgtctaaccagtcacacttttattatactcgtggcaatttcccttgcctttgaataccctcgtcctgttaataatccgtacgttcttaagttatatctatgctcaaattggataatgaattttcag

SEQ ID NO: 7609 - DNA, 1213 bp, Cucumis melo
ggcgctgagaaatcgttaaaggaaacatcccatctgctttgtacttgtgcaaccttcttcaacgtttttgttatactttacattaaaatttatcatcatctgtagaaatttcactctgaatctttcctcaatttcaggctttggatttttggagaagaagataatcaatgaaaggggaagtacaattggagtcatcaattgggcaaaaccctagtgattctgatcctctgcttgagaatcagaacgattcatcatcccatggaacctctgatgaaatcaaggatgaggatactgaagctggttccattccttgttgtcgtatttgcttagagagcgatgccgaaccagaagatgaactgatttctccatgcatgtgcaaaggcacacagcagtttgtccatcgatcttgtcttgatcattggcgctccgttaaggaagggtttgctttctcgcattgcacaacttgcaaagcccaatttcatttgaaagtttccttatttgaggacaactcttggcgtaaagttaaattcaggctttttgtggcaagagatgttctccttgtatttatagctgtacaaactttaatagcagcaattggtggttatgcatatatcatggacaaagacggggcatttaggaattctttcagtgatggatgggatcgtattctgtccaaacatcctattccattttattattgtatcggggtcctagctttctttgttctgcttggattctttgggctcatactacattgttcgtccctgaatagtaatgacccaagagttgctgggtgtcacaactgttgctatggatggggaatcttggattgtttccctgcatcaatggaagcctgttttgcacttgttatcgttttcatagttatctttgtaatccttggcatagcttatggcttccttgctgctactatggccattcagaggatctggcaaagacattaccacattctcacaaaaagggaactgactaaagaatatgtggtggaggatcttcatggatgttatactcctccaaaattggaaccagaacacgaacagcacttgaaaatgctacagcttctgtaatgaaacggcaaaaatgagatgttaaaatttctgtcatttagttttttgttatgttgttttgtttgatgagaagatacaatgtgcattttgcttgacaaggttgttataaatgagcaatgtggaaatta

SEQ ID NO: 7610 - DNA, 1524 bp, Carica papaya
gtcctctttcgtgtttagtcatcaccgtcctccgaagataaaagccgctgactcttttcctcgggaattctctgcaactttctaggtacttgaaatatgttcctaataattatgtgatctaaacctataatcaattattgatttgtcatccgatgattccaaaatttcctccagaatcttcactctatgccgtcttgacttgttgttaaagaaattcaaactggaaaggggaagagaattcgacgatctttctctttttattctatgcagctcttcgtgctcgcctagggtttccgattgttccttgtgctgtaggctttgtttatattcgttactaaaaagtcggagaaaaagaagaagacggttttaggtcatcaatgaaaggggaagtacagcttgagccagcagttgcggagagccctagcgattctgctcctctgcttgagaaccaacctgattccttgtcgtcgccgttgtcggggtcgccggaaagttcgagtgagattagggatgaagatgtggagaacggttctgctccatgttgccgcatttgcctcgagagcgacagcgaatttgtaggtgatgaattaatatctccatgtatgtgcaaagggacccagcagtttgttcatcgttcatgtctcgatcattggcgttcggtgaaggaaggatttgcattctcacattgcacaacttgtaaagcccaatttcaccttcaagttgcattgtttgaggacaactcatggcagaaagcaaagttcagaatttttgtggctagggatgtcctgcttgtattcttggctgtacaaactgtcattgctgcaatgggaggatttgcatacctcatggacaaagatggggccttccgcaattctttcagtgatggatgggatcgtatattgtcaaaacatccaatacccttctattattgcataggagttctggccttctttgtgctgctgggattttttgggctcatattacactgttcctccctcaatggtaatgaccctcggatggctggctgtcaaaattgctgttatgggtggggtgttttggattgcttccctgcttccatggaggcatgcttcgcactggtgatagttttcattgtgatctttgcaattcttggcattgcttatggtttccttgctgccactatggctattcagaggatctggcagagacactatcacattctcacaaagagagagctcacaaaggagtacgtagtggaggatctccatggctgttatacccctccaaagctggatccagaacatgaaggacgcttgaaaatgcttaagcttttgtaataaaggataccgtgttttgaaagtgaatgttggaatatcttaccttaaataacgtatcaaaagatacgccgtgtattcttttgacaactctgtaactgattaaagagaaactagagaccgcataattttctctttagattgctcgaatgaagtgggaaaccaattttgcgggactaaatcaaagaatgaacagaattgggtacataat

SEQ ID NO: 7611 - DNA, 1201 bp, Citrullus lanatus
ccccaagttattgtttttttgaatgattgacttcgagatatataattcctgttctgggtattggttctcgatctctgaatttgtgattgagtttgttttaaggctgtgaaagcttcgggtttttgggaagaagatacccaatgaaaggggaagtacaattggagtcatcaattggccaaaaccctagtgactctgatcctcttcttgagaatcagaccgattcatcatcccatggaacctctgatgaaatcaaggatgaggatactgaagctggttccattccttgttgtcgtatttgcttagagagcgatgccgaaccagaagatgaactgatttctccatgcatgtgcaaaggcacacagcagtttgtccatcgatcttgtcttgatcattggcgctccgttaaggaagggtttgctttctcgcattgcacaacatgcaaagcccaatttcacctgaaagtttccttatttgaggaaaactcttggcgtaaagttaaattcaggctttttgtggcaagagatgttctccttgtatttatagctgtacaaactttaatagcggcaatgggtggttatgcgtatataatggacaaagatggggcatttaggaattctttcagtgatggatgggatcgtattctgtccaaacatcctattccattttattattgtatcggggtcctagccttctttgttctgctcggattcttcgggctcatactgcattgttcctcccttaatagtaatgatccaagagttgctgggtgtcacaactgttgctatggatggggaatattggattgtttccctgcatctatggaagcctgctttgcacttgttatcgttttcgtggttatctttgtaattcttggcatagcttatggtttccttgctgctacaatggctattcaaaggatctggcaaaggcattaccacattctcacaaaaagggaactgactaaagaatatgtggtggaggatcttcatggatgttatactcctccaaaattggaaccagaacatgaacaacacttgaaaatgctacagcttctgtaatgaaaatggcaaatgaggtgttcaatttctgtcattttgtttgttatgttcttttgtttgagaagatatacaatgtgcatttgcttgacaaccttgttataaatgagcaatgtggaaaatatattttaactaattcgttacct

SEQ ID NO: 7612 - DNA, 1140 bp, Cucurbita pepo
cattttattgtactttgcattaatatcgatcagcatctgcagaaaaatcgagtccgaatctttcctcgacttcagtttgttctagggctgggcaagaagataaccaatgaaaggggaagtacaattggagtcatcaattggccaaacccctagtgactctgatcctctgcttgagaatcagcccgattcatcccatgaaacctctgatgaaattaagaacgaggatactgaagctggttccattccttgttgtcgtatttgcctagagagcgatgccgaaccagaagatgaactgatttctccatgcatgtgcaaaggcacacagcagtttgtccatcgatcttgtcttgatcattggcgctccgttaaggaagggtttgctttctcgcattgcacaacatgcaaagcccaatttcacctgcaagtttccttatttgaggacaactcttggcgtaaagttaaattcaggctttttgtggcaagagatgtcctccttgtatttctagctgtacaaactttaatagcggcaatgggtggttatgcatatattatggacaaagatggggcattcaggaattctttcaatgatggatgggaccgtattctgtccaaacatcctattccgttctattattgtatcggggtcctggccttctttgttctgctcggattcttcggcctcatactacattgttcctccctgaatagtaatgatccacgagttgctggatgtcacaactgttgctatggatggggcatcttggattgtttccctgcgtctatggaggcctgctttgcacttgttattgtcttcgttgtcatctttgtaatccttggcatagcttatggtttccttgctgccactatgggtattcaaagaatctggcaaaggcattaccacattctcaccaaaagggagctgactaaagaatacgtggtggaggatcttcatggttgttatactcctccaaattggaaccagaacacgaacagcacttgaaaatgctacagcttctgtaatgaatggcagatgaggttgttcagtttctgtcattttgtttgttatgttcttttgtttgagatgatacaatgtgcatctgcttgacaccgttgttatgaatgagcaatgtggaaaataga

SEQ ID NO: 7613 - DNA, 1020 bp, Manihot esculenta
atgataagggaagtgcagctggagccagtgggtgcagagaatccgagcgattctgatcctctgctcgtagacaaggctgattcatcatcgccgccaccattaagttcgagtgagattaacaatgaagatgacatcgagaatggttctattccttgttgccgcatttgtcttgagagcgattgcgaactaggtgatgaattaatatctccatgcatgtgcaaaggcactcaacagtttgttcatcgtttatgccttgatcattggcgctcagtaaaggaaggatttgctttctctcactgcacaacatgcaaggcccaatttcatcttcgagttgcattatttgaggacaactcatggcgtaaagtgaaatttagacttttcgtgacaagagatgttatcattgtatttctggctgtgcaaactgtgattgctgcaattggtggctttgcatattttatggataaagatgggacctttaggaattcattcagcgatggttgggatagaatcctgtcaaaacatcctataccattttattattgtataggtgtactggcattctttgtgctgcttgggttttttggcctcatactacattgctcctccctcaatagtaatgatccaggaatggctggctgccagaactgctgttatggatggggaatcctggactgtttccctgcttctatggaggcatgctttgccttagttttggtgtttgttgttatctttgccattctaggcatagcttatggtttccttgctgccaccatggccattcagaagatctggcagagacattaccacatccttactaagagggagctgacaaaggaatacatagtagaggatcttcatggctgttatacaccaccgaagttggattcagaacatgaagaacgtctgaaaatgcttaagcttttataattatggcagagatgagtgaagtcataagacatatttacagtgggatgcatatcactgctcgtgtataaatataatttaaaattcaacccctta

SEQ ID NO: 7614 - DNA, 1708 bp, Quercus alba
cttttctttctgcgaagcactcgcagactttgttggtattttcggcgataactgttcaaccttcttataccggaattggattttgaatttgaaatctgcgcttgatttttagggtttttaattttgatcaatctttttgtgtatttggtaattggaggtgtgaatttttagggttttgggagggaaaaaaaaaggttttgatcaatgaaaggggaagtacagctagaggtaacgagtgcagagaaccctagtcctagtgatgctgatcctctgctagacaaacatgccgattcatcgtcaccaaggagctcgagctcgagctcgaatgagatcaggaatgaagatattgagaccggttcgaattcgtgttgtcgcatttgcctcgagagcgatgcggagccagaggatgaattaatatctccatgcatgtgcaaaggtacccagcagtttgtgcatcgttcgtgtcttgatcattggcgttcagttaaggaaggatttgctttctcacattgtaccacttgcaaagctcaatatcacttttgtgttgcattgtttgaggacaactcttggcgaaaactaaaattcaggattttcgtggcaagggatgtttttcttgtattcttggctgtacaaactgttattgctgcaatgggtggctttgcatacctaatggataaagatggggccttcaggaactcattcagtgatagttgggatcggattctgtcaaaacatcctatacctttctattattgtataggggtactggccttctttgtgctgcttggattttttgggcttatactacattgctcctccctcaatggtaacgaccctcggatggctggctgccagaactgttgctacggatggggaatcttggattgttttcctgcttcaatggaggcatgctttgccttggttattgtttttgttgtcatttttgccattcttggcatagcttatggtttccttgctgccaccatggccattcagaggatctggcagagacactaccacatccttactaagagggagctcactaaggagtacatagtggaggatcttcatggttgttatgccccaccaaaattggatccagaacatgaagcacgtctgaaaatgcttaagcttttgtagtgatggaggggtgagtgaaattatgtcttttaacttgctgttaaattaatcaccatttgggagcaacaatatgtatttgttccacaactttgtttaatacagtggggaggaaagagaacggtcttatattctaagtgctcagaggtatgtaaccaatcttgcaaagctaagtgaaaaatatttgggaaatgggcttatatgaccacctgtgctgttatatatatatatagagagagagcttgcaccattgataggcctctgaaatgagcagtatgtcacacaatgcctccattttcagtttaaaatagctgttccggtttgtgtagatcagaaataaagataagtctggatgggccgttcttgtactatgccattgcctcctcaggtcctcgcatttgctcgtcaattggctgacctatttatggtacattctatggcctgttccacttggctctgtccatcgttttggaatgagttgtgcgctttatgtagctcactgaaggttagggttttttttttttttttctatgcaaccattttgtactttctagttgtgtaattttattgt

SEQ ID NO: 7615 - DNA, 1091 bp, Cucurbita pepo
ttcatcaacatctgcaaaaagtccagtccgaatattcctcgattcagggctgaaagcttcggtcgttctctttcgggtaaggagataaccaatgaaaggggaagtacagttggaatcgtctattgcccaaaaacctactgactctgatcctctgcttgagaatcagtccgattcatcccatggtggaacctccgatgaaatcagggacgatgaggatgctgaagctggttccattccctgttgtcgtatttgcctagagagcgacgctgaaccagaagatgaactgatttctccatgcatgtgcaaaggcacacagcagtttgtccatcgatcttgtcttgatcattggcgctccattaaggaagggtttgctttctcgcattgcacaacatgcaaagcccaatttcatctgaaagtttccttatttgaggacaactcttggcgtaaagttaaattcaggttttttgtggcaagggatgttctccttgtatttctagctgttcaaactttaatagctgcaataggtggttatgcgtatattatggacaaagatggggcattcagaaactctttcagtgatggatgggatcgtattctctccaaacatcctattccattttattactgtattggtgttctggccttctttgttctgcttggatttttcgggctcatactacattgttcctccctgaatagtaacgatccacgagttgctgggtgtcacaactgttgctatggctggggtatcttggattgtttccctgcatctatggaggcctgctttgcacttgttattgttttcgtcgttatctttgtaatccttggcatagcttatggtttcctcgctgctactatggctatccaaaggatctggcaaaggcattaccacattctcaccaaaagggagctgactaaagaatatgtggtggaggatcttcacggttgttatacccctccaaaattggatccagaacatgaacagcacttgaaaatgctacagctcctgtaatgaatggcagatgaggtgttaaattttcattttgtttgctatgatcttttgtttgagacgatacaatgtgcatttgctt

SEQ ID NO: 7616 - DNA, 1426 bp, Fragaria vesca
gcggacggcacgtcgtataggaagtatcgctcttttctcaatcttcgtcttcctcaattctcctgtctccgattttctccattcatcgtttctctgcacaactccagggtttgatcaatgaatcgggaagtgcagctggaaccagtagtagtaggggaacgggaaccgaatgatcctagtgacttggaccctctgctacagagcagccacgacgacgacgacgagtcgtcggctccggcgagctccagtgagattagaaatgaagacattgagaatggctcctctgttgcttgttgtcgcatttgcctcgaaagcgattccgatgcaggtgatgagttgatatcgccgtgcttgtgcaaaggcacccagcagtttgtgcacatatcctgtcttgatcactggcgctcggttaaggaaggatttgctttctcgcactgcaccacttgcaaagcccaatttcatcttcgagttgaatcgtatgaggacaacacttggcgtaaaatgaaattcagaatttttgtggcaagggatgttatacttgtatttgtggctgtacaaacagtaattgccgcaattggtggctttgcatatctgatggacaaagatggtggcttcaggaattcgttcagtgatggttgggatcgtatcttgtcaaagcaccctataccattttactattgcataggtgtcattgccttttttgtgctgcttggattttttgggcttatagtacactgttcatctttcaatagcaatgacccacggatggctggctgccagaactgttgttatggatggggaatattggattgtttccctgcgtctatggaggcatgctttgccctggttattgtttttgttgtcatctttgctattcttggcatagcttatggtttcctggctgctactatggctattcagagaatctggcagagacattaccatatcctgaccaaaaaggaactcacaaaggagtacgtagtggaggatcttcatggttgttataccccaccaaagttggatcctgaacatgaagagcgtctgaaaatgctcaagttactgtagtgatagacgaggagtttcaaattgcctttcgagtgtttaatgtatcagaatttgacatccctgatgtatacttatgcttggtaagagtaacattataaaggaacatctctccaaaaaaaaaaaacattataaaggagcatacaagggaaaggatagtctcacttgtattcattaaaatgtcatcctgctctaggaaactgaccaacagtggtcataaatgacgtttttgggagagaagtgtcctatagtaaccgcaaggctgtaaattgtgttggtctcgtcaaaatctggaaaatgatattcaagcctcaaactagttgtacaattttgaggcgtagctcgttctactgctttaattttt

SEQ ID NO: 7617 - DNA, 1285 bp, Catharanthus roseus
gtctctgcaaatttcaggtcgcgatgaaaggagaagtgcagctggaatcaagggtagagcggaaccctagagactccgatcccctacttgacgaacaccgccactgtgtagagccaccgcagcctcctttgcctttttcatcatcatcgccgaccagcaccagtgagatagaggatgaggacctcgaggctggttccttgccctgttgtagaatttgccttgaatgcgatggtgaagatgatgacgaactgatatctccatgcatgtgcaaaggcactcagcagtttgttcatcggtcatgccttgaccactggcggtcagtcaaggaagggtttgcgttttcacattgcaccacctgtaaagctcaatttcatcttcgagtggcagagttggaggacaattactgtagaaaaataaaattcagactctttgtggcaagagatgtcttccttgtatttttggcagtacaaactgtaatagcagtgatcgctggtttcgcttactttatggacaaagatggatctttcaggacttcatttaatgatagttgggaccgcatactttctaagcatcctattccattttactactgcataggagttcttggcttctttgtgctgcttggatttttcgggctcatactgcattgctcctcccttaacaataatgacccacgtgtagctggttgtcaaaattgctgttacggatggggtatcttggattgttttcctgcatctatggaagcgtgctttgcacttgtaattgtttttgttgttatctttgctattcttggcattgcatatggatttctcgctgccacaatggctatccagaggatctggcagagacattatcacatccttacaaaaagagaactcacacaggaatacattgttgaggatctcagcggaaattactcgccaccaaaattagaccctgagcacgaagagcgcctgaaaatgctgaagctgttgtaaggaggtattttgacatacaaaacttgctgaatatctttataagttattgctcgagacaccaaagctatttttgttttgtgatttgccaactattccatgtagtcaaatatagaatggaggttcacagatagttcggtcatattcagctggagcaaccattggtgcagttgaagaggaaaatgtttctgtaacatttataaatgttttctgtaaccctttgcatgaatttcttggaaagatttgccttgtacagttatcgcatttgacatttggtggttctgaatctcatctgtattttggatgtagct

SEQ ID NO: 7618 - DNA, 1458 bp, Panax ginseng
ataccattttgacaaaacaatcttcttcgttgacgccatagatcggttcgtcaatttcctctatttacaaattccagaaatacacaagatgactggtgaattacagctggagccatcaggcgatcgaaaccctagcgactctgatcctctgcttgacaatcaccatggaccagccagttctagtgagataataaagaatgatgatgctgatattgaagctggttccgtcgcttgttgtcgaatttgcctcgaatgtgacggtgaagatgatgatgaattgatctctccctgcatgtgcaaaggcacccagcagtttgtgcaccgcatgtgtcttgatcattggcgttcagttaaggaaggatttgctttctctcactgtacaacttgcaaagctcagtttcattttcgagtagcagagttggaggataactcttggcgcaaaataaaatttcgactgtttgtggccagagatgtattccttgtatttttagcagtacaaactgtgattgcagtgatagctggctttgcatatctcttggataaagatggaactttcaggaattcattcaatgatagttgggatcgtatactgtcaaaacatcctatacctttctactactgtataggagtactgggcttctttgtgctgcttggatttttcgggctcatactgcattcccttaatagcagtgacccccgcatggctggctgtcagaactgttgttacggatggggcatcttagattgttttcctgcatcaatggaagcatgcttcgcactggttattgtttttgttgttatatttgctattcttggtattgcatatggtttccttgctgccacgatggccattcaaaggatctggcagaggcactaccacatcctcaccaagagggaactaacacaggagtacgtagtggaggatcttcatggctgttacactcccccaaagctggatccagaacatgaagagcgtttgaaaatgctgaagcttctatagtgagggaattgctgatgttgtaagctgccttcaagtttggtttaattaattattaaccaagatctaaaagctatactgctgtatttattttgtgatgatagtccagtatagaatgagaagaaccaccatgagtatgaaccttgtcaagaagagcagacccgactgaatcctgaaaaaaataaaaatgagttaaataagtatacatgctattctgtatgtgcttgtatatttgttgaatgctccaagttccattccttttttttctccgttcattgttggattttgtataggtatcaatgggaagagcttacttaaaaccaaaaaaaaaagaaaaaaaaaaaaaaaaagaaaaaaaaaaaaaaaagaaaaaaaaaaaaagaaaaaaaaaaaagaaaaaaaaaaaagaaaaaaaaaagaaaaaaaagaaaaaaagaaaaagaaagaaagaagaagaagaa

SEQ ID NO: 7619 - DNA, 1683 bp, Euonymus alatus
gcgtcaatcatggtggtgatcgtttaggggaatttggtgattgagattttttttgggtttggttggagcaatctgattgcagtcaataagcgattatcgatggaaggcgaattgcagcttgaaccattacctgcagctggtgctattggtgctggtgatgaaggagatcgtgatgaatctgatcctctactggagaaccagcctgattcgcctccaggaagttcaagcgagattaaacatgaagacgacgttgagggtggttcgattccttgttgccgcatttgcctcgattatgatggcgaatcagatgatgaactaatatctccgtgcctctgcaaaggcacccaacaacttgttcaccgctcatgcctcgatcattggcgctctgtaaaggaaggttttgctttctctcattgcacaacttgcaaagctcagtatcatctccgagttgaattgtttgaggacaattcttggcataagataaagttcagactttttgtggcaagggatgtttttcttgtatttttggctgtacaaacaattattgctgcaattggtggctttgcatacgccatggataaagatggaacctttaggaactcattcagtgatggttgggatcgcatactgtcgaaacatcctatcccattttattactgtataggggtactggccttcttcatgctgcttggattttttgggcttatactacattgctcttccctcaataacaatgatccacggatggctggctgccaaaactgctgttacggatggggtattttggattgttttcccgcatctatggaggcatgctttgccttggttattgtttttgttgtcatctttgccattctgggcatagcgtatggctttctcgctgccacaatggcagtccagaggatttggcaaagacactatcacatcctcactaaaagggagcttacaaaggagtacatagtggaagatcttcatgggtgttatactccacccaaattggatgcagagcatgaagaacgtctaaaaatgttaaagctgttgtaataatgaatggatgtatgaagttcagatattctaaaagtgtgatattaaatttgtttaagtgaggaagaagagagtgatattaggattctacaaagtgctcagtaaattgtgagacttgtctttgctggttattttgtatgtatactcttgacctcttttatcccccaaaaagagaagtgtcactctctaagtcagtctgtgagtagtgcgtatcctcaccttctgatcgctggatgtagttaataagaagatggtgaaatgtgccaaagaatgcaaaaaccagaaagttagtaaccctgaaatttatggcgaaatgcacttattgttcatacaaatggactcaactccagctataagtttgtttcaggaagaaaaaagtagagcaacatcatttggttcaccagtcagcagaatctgcattgctttttctagtcattgatggtggggttaaggtctcttgcagtcagctgctgctcatgagctgaaggactcgaagaattcaattagaagtacggatggaggaaaagattatcaggaagttcacagaaaatacagcacatccatcctaagctggctgtttccaccactgtacctagatgagttagatgcaggtcaatatgagcagattgttggagctcc

SEQ ID NO: 7620 - DNA, 1088 bp, Cucumis sativus
ataatcaatgaaaggggaagtacaattggagtcatcaattgggcaaaaccctagtgattctgatcctctgctcgagaatcagaacggttcatcatcccatggaacctctgatgaaatcaaggatgaggatactgaagctggttccattccttgttgtcgtatttgcttagagagcgatgccgaaccaggtgaatttcattaagatgaactgatttctccatgcatgtgcaaaggcacacagcagtttgtccatcgatcttgtcttgatcattggcgctccgttaaggcaaatttctttattttagaagggtttgctttctcgcattgcacaacttgcaaagcccaatttcacctgaaagtttccttatttgaggacaactcttggcgtaaagttaaattcaggctttttgtggcaagagatgttctccttgtatttatagctgtacaaactttaatagcggcaatcggtggttatgcatatattatggacaaagacggggcatttaggaattctttcagtgatggatgggatcgtattctgtctaaacatcctattccattttattattgtattggggtcctagctttctttgttctgctcggattcttcgggctcatactacattgttcatccctgaatagtaatgacccaagagttgctgggtgtcacaactgttgctatggatggggaatcttggattgtttccctgcatcaatggaagcctgttttgcacttgttatcgttttcgtagttatctttgtaatccttggcatagcttatggcttccttgctgctactatggccattcagaggatctggcaaagacattaccacattctcacaaaaagggaactgactaaagaatatgtggtggaggatcttcatggatgttatactcctccaaaattggaaccagaacatgaacagcacttgaaaatgctacagcttctgtaatgaaacggtaaaaatgaggtgttaaatttctgtcatttagttttttttttatgttgttttgtttgtggaatttgcttgacaaggttgttataaatgagcaatgtggaaattagattttaactaaattgtgtta

SEQ ID NO: 7621 - DNA, 1298 bp, Eutrema halophilum
cttttgtccctcctttttctcatctcccaaaaatgctttctttctttctctcccgcattgaccttctccatttttggctctctccacttctgtaatctacttctcacatcctcgcacgaatttctgctagcagaccgaaattcatagaccctattttttttttgatcgattcgattcgaatccttcgatctcaccaatcgatttacatccatagatttctcccttttcctgtttcctctgaaatttagggttagcgtaggtttcatcaatgatgcaaggtgaagtacaattgcagccaccggattcgcagaagctgagtgattcggatcccttattgggaaattctccatcttcttcttcttctgcgtctccttccgatgagataaatgctgaagatttggagagtggttctgcatcagctccttgctgtcgtatatgtctggagaacgatagcgaattgttaggcgatgaactgatatcaccgtgtatgtgcaaaggcactcagcaattcgttcatcgttcatgtctcgatcattggcgatccgtcaaggaaggttttgctttctctcactgcaccacctgcaaagcgcagttccacctccgtgtcgaaccctttgaagataacaactcttggcgtcgaaaagccaaattcagactctttgtcgccagagatgtgcttttggttttcgtcgctgtgcagactgttatagctgtgatggccggatttgcgtacatgatggacaaagacggagagtttcgcaactctttcaacgatgattgggatcgtatactgtcaaaacatcccatcccgttttactactgcatcggggttgtaaccttctttgtgctgattgggtttcttgggctcattcttcattgctcttctctcaacggtaatgacccgaggatggctgggtgccagaactgctgttacggatggggtatcttggattgtttccctgcatcaatggaagcttgtttcgctcttgttgttgtgtttgtcgtcatcttcgccattcttggcttagcttatggttttcttgctgctacgatggccattcaaaggatttggcagagacattaccatattctaaccaagagagagctcacaaaggagtacattgtggaggatcttcacggatgttacactcccccgaagctggatgcagagcacgaagcaagactgaaattgctgaaacttatgtgaccgttctttaattgcaaataaaggtcatatggattcggacaaaaagttttatgcatgtttgttcgtaaatgtctttctatttttttatctc

SEQ ID NO: 7622 - DNA, 1546 bp, Eutrema halophilum
aatcataaatggggtggtggcgcagttggctagcgcgtaggtctcatagcttctgagtgatcctgaggtcgagagttcgagcctctctcaccccaattaaacttttgtccctcctttttctcatctcccaaaaatgctttctttctttctctcccgcattgaccttctccatttttggctctctccacttctgtaatctacttctcacatcctcgcacgaatttctgctagcagaccgaaattcatagaccctattttttttttgatcgattcgattcgaatccttcgatctcaccaatcgatttacatccatagatttctcccttttcctgtttcctctgaaatttagggttagcgtaggtttcatcaatgatgcaaggtgaagtacaattgcagccaccggattcgcagaagctgagtgattcggatcccttattgggaaattctccatcttcttcttcttctgcgtctccttccgatgagataaatgctgaagatttggagagtggttctgcatcagctccttgctgtcgtatatgtctggagaacgatagcgaattgttaggcgatgaactgatatcaccgtgtatgtgcaaaggcactcagcaattcgttcatcgttcatgtctcgatcattggcgatccgtcaaggaaggttttgctttctctcactgcaccacctgcaaagcgcagttccacctccgtgtcgaaccctttgaagataacaactcttggcgtcgaaaagccaaattcagactctttgtcgccagagatgtgcttttggttttcgtcgctgtgcagactgttatagctgtgatggccggatttgcgtacatgatggacaaagacggagagtttcgcaactctttcaacgatgattgggatcgtatactgtcaaaacatcccatcccgttttactactgcatcggggttgtaaccttctttgtgctgattgggtttcttgggctcattcttcattgctcttctctcaacggtaatgacccgaggatggctgggtgccagaactgctgttacggatggggtatcttggattgtttccctgcatcaatggaagcttgtttcgctcttgttgttgtgtttgtcgtcatcttcgccattcttggcttagcttatggttttcttgctgctacgatggccattcaaaggatttggcagagacattaccatattctaaccaagagagagctcacaaaggagtacattgtggaggatcttcacggatgttacactcccccgaagctggatgcagagcacgaagcaagactgaaattgctgaaacttatgtgaccgttctttaattgcaaataaaggtcatatggattcggacaaaaagttttatgcatgtttgttcgtaaatgtctttctatttttttatctctgtctttatatattgttgaccttttcctatttataactctccaaaatcgaaatataaaaataagcgaccacagtgggagtcgaacccacgaccttctgatccgaagtcagacgcgctaatccactgcgctatgcggtcgttgttgta

SEQ ID NO: 7623 - DNA, 1386 bp, Panax ginseng
aggttaagaagcttttcccattgatacctatacaaaatccaacaatgacggagaaaaaagatggaacttggagcattcaacaaatatacaagcacatacagaatagcatggatacttatttaactcatttttatttttttcaggattcagtcgggtctgctcttcttgacaaggttcatactcatggtggttcttctcattctatactggactaccatcacaaaataaatacagcagtatagcttttagatcttggttaataattaattaaaccaaacttgaaggcagcttacaacatcagcaattccctcactatagaagcttcagcattttcaaacgctcttcatgttctggatccagctttgggggagtgtaacagccatgaagatcctccactacgtactcctgtgttagttccctcttggtgaggatgtggtagtgcctctgccagatcctttgaatggccatcgtggcagcaaggaaaccatatgcaataccaagaatagcaaatataacaacaaaaacaataaccagtgcgaagcatgcttccattgatgcaggaaaacaatctaagatgccccatccgtaacaacagttctgacagccagccatgcgggggtcactgctattaagggaggagcaatgcagtatgagcccgaaaaatccaagcagcacaaagaagcccatcactcctatacagtagtagaaaggtataggatgttttgacagtacacgatcccaactatcattgaatgaattcctgaaagttccatctttatccaagaggtatgcaaagccagctatcactgcaatcacagtttgtactgctaaaaatacaaggaatacatctctggccacaaacagtcgaaattttattttgcgccaagaattatcctccaactctgctactcgaaaatgaaactgagctttgcaagttgtacagtgagagaaagcaaatccttccttaactgaacgccaatgatcaagacacatgcggtgcacaaactgctgggtgcctttgcacatgcagggagagatcaattcatcatcatcttcaccgtcacattcgaggcaaattcgacaacaagcgacggaaccagcttcaacatcagcatcagcatcatcattctttattatctcactagaactggctgtatgtccatggtgattgtcaagcagaggatcggagtcgctagggtttcgatcacctgatggctccagctgtaattcaccagtcatcttgtgtatttctgaaatttgtaaatagaggaaattgatgaaccgatctatggcgtcaacgttttgtcaaaatggtatgataaaaaacaaagggtagttgtttgattggcacgtagcgcgtatgacgtactcgctgtaggttgacag

SEQ ID NO: 7624 - DNA, 1197 bp, Platanus occidentalis
tcacgtctttggttttatcgctaccgaaacttgtcgtctctcctctctctggaatctctagggtttcttggttgaatctcctcacaaatttcggggtttttgaatttcgtcgttgtttgctgtaaatatcgatgacgggggaggtgcagttagaaccatcgggtgaacggaatccaagcgactccgatcccctccttgagaatcaagcgaactcattgacgggaagctcgaatgagataaaggatgaagagattgaagctgcttcggctgcttgctgccgtatctgccttgagtacgacggtgaaccagatgaagacctgatatctccatgcatgtgcaaaggaacccagcagttcgttcatcgctcatgccttgatcattggcgctcagtgaaggaaggatttgctttttcacattgcacgacttgcaaggcacaattccatcttcgagttgaattattagaggacaattcctggcgtaaagtaaagtttagaatttttgtggccagagatgttctccttgtattcttggtggtacaaactgtgatcgctgctatgggtggctttgcttacttaatggacaaaaatggaaatttcaggaattcattcagtgatggttgggaccgtatactgtcaaagcatccaatacccttttactattgcattggtgtactggccttctttgtgctactggggttttttggtctcatactacattgctcctccttcaacaataatgacccatgcatggctggctgccggaattgttgttatggatggggcatcttggactgcttcccggcctctatggaagcatgctttgcgctggttatcatttttgtcatcatcttcgccatcctaggtattgcgtatggttttcttgccgccaccatggccatccagagaatatggcaaagacactaccacatcctcaccaagagggagctcacaaaggaatacgtagtagaggatcttcatgggaattatacaccaccaaagctggacccagaacatgaagagcgtttgaaatcactcaagctcatgtagagagaaagaagctggttgaggtaaataataaataataaatataaaaaaaattgaaagaagggctttgagatgtcttggacttggttctcaattatctcagatatcaaaatatgatgtgtgtacttgcaacacaacttgttaatagagggag

SEQ ID NO: 7625 - DNA, 1324 bp, Citrus clementina
ccgagagcgattatctatctctctctaattatttcatgtacgccttctaaaaagtgcagtaactttttctctgcaaatcaatctgtaatttccaggatttttggaaaaaggctatttgctagacgatccatgaaaggggatttacagctggagcagttttccgaacggaaccctagcgatgcagatcctttgcttgggagccaggaggtctccgacgcgcctgttgtaagttcgccttcgagctccagctccagtgagattaaggatgaagatatcgagaatggttctcttccttgctgtcgcatttgcctcgaaaacgatggtgaaccagatgatgaattgatatctccatgcatgtgcaaaggcacacaacagtttgttcatcgtgcatgtcttgatcattggcgctccgttaaggaaggatttgcattttcgcattgcacaacctgcaaagcccaatttcaccttcgagttgaactttttgaggataactcttggcgcaaaataaaattcagactttttgtggcaagggatgttttctttgtatttttggctgtacaaactataattgctgcaatgggtggctttgcatacctcatggataaagatggggccttccgtaattcattcagtgatggttgggatcgtattctgtcaaagcatcctataccattttattattgtataggggttatggccttctttgtgctgcttggattttttgggctcatactacattgctcatccttcaatactaacgacccacggatggctggctgccagaactgctgctatgggtggggagtcttggattgtttccctgcatctatggaagcatgctttgccctggttatcgtttttgttgtcatttttgccattcttggtatagcttatggtttccttgctgctaccatggctattcaaaagatctggcagaaacactaccatattcttaccaagaaggagctcacaaaggagtatgttgtggaggatcttcatggcagttacacgccaccaaaattagattcagaacatgaagaacgtctgaaaatgcttaagcttttgtagttgatggatcggaggttaaggaagtgatatgatgtctttggaataatttaaattcttcgggatctgaaaactacaatgtatatttgctcggctaacttgtttatttagaacatggaaaaaaaagaaaagctctcattcctttttggtcttgcaaaggtcgactgacatgagggtaatgagggtagaaataatactctcgggagtgcccagaagtgatgacaaatttactctcgttggaattaacagtgcagccccc

SEQ ID NO: 7626 - DNA, 1324 bp, Citrus sinensis
ccgagagcgattatctatctctctcaaattatttcatgtacgccttctaaaaagtgcagtaactttttctctgcaaatcaatctgtaatttccaggatttttggaaaaaggctatttgctagacgatccatgaaaggggatttacagctggagcagttttctgaacggaaccctagcgatgccgatcctttgcttgggagccaggaggtctccgacgcgcctgttgtaagttcgccttcgagctccagctccagtgaaattaaggatgaagatatcgagaatggttctcttccttgctgtcgcatttgcctcgaaaacgatggtgaaccagatgatgaattgatatctccatgcatgtgcaaaggcactcaacagtttgttcatcgtgcatgtcttgatcattggcgctccgttaaggaaggatttgcattttcgcattgcacaacctgcaaagcccaatttcatcttcgagttgaactttttgaggataactcttggcgcaaaataaaattcagactttttgtggcaagggatgttttctttgtatttttggctgtacaaactataattgctgcaatgggtggctttgcatacctcatggataaagatggggccttccgtaattcattcagtgatggttgggatcgtattctgtcaaagcatcctataccattttattattgtataggggttatggccttctttgtgctgcttggattttttgggctcatactacattgctcatccttcaatactaacgacccacggatggctggctgccagaactgctgctatgggtggggagtcttggattgtttccctgcatctatggaagcatgctttgccctggttatcgtttttgttgtcatttttgccattcttggtatagcttatggtttccttgctgctaccatggctattcaaaagatctggcagaaacactaccatattcttaccaagaaggagctcacaaaggagtatgttgtggaggatcttcatggcagttacacgccaccaaaattagattcagaacatgaagaacgtctgaaaatgcttaagcttttgtagttgatggatcggaggttaagcaagtgatatgatgtctttggaataatttaaattcttcgggatctgaaaactacaatgtatatttgctcggctaatttgtttatttagaacgtggaaaaaaaagaaaagctctcattcttttctggtcttgcaaaggttgactgacatgagggtaatgagggtagaaataatactctcgggagtgcccggaagtgatgacaaatttactctcgttggaattaacagtccagccccc

SEQ ID NO: 7627 - DNA, 1433 bp, Eucalyptus grandis
tctctcttcagcaccttcaccttcatcttcgtcttcaacgtcgcttccgattccctgcgcgttccaggcactttcctcgattcggaagccttacgtcgatcacacggtcggtatctcgaaccgaattcgatcagtcggggctagggttctcgatcatcggccgccgcgcgcgtggcgattgccaagctcggatttttcggggagggagaggaggaggatgacgacgacgacgacgggggaagtgcagctcgagcctcccggagtgcagcacgcgagcgacaccgatcctctgctgaagggccaggatgagtcggcccccgggagcccgagcgagattagggacgatcgggaccgtgtcgtgttcggcgggggcggcggcggcgagggcgaggacgaggacctcgaggccgggtcggtcccgtgttgccgcatttgtctggagagcgagtgtgaaccaggggatgaattaatctctccttgcatgtgcaaaggcactcagcagtttgtccatcgttgttgtcttgatcattggcgctcagttaaggaagggtttgccttttcacattgcacgacttgcaaagcgcaatttcaccttcgagttgcgttgtttgaggacaatacctggcgaaaagttaaattcagactctttgtggctagagatgtcttccttgttttcttggcagtgcaaactgtaatttctgtgattggtggctttgcctacataatggacaaagatgggtcttttaggaactcttttagtgatgggtgggatcgcatactgtccaagcatcccattccattctactactgtataggagtactggcatttttcgtgctgcttgggtttttcggaattatattgcattgctcctccctaaatggcaatgatccaaggatggcagggtgccagaactgctgttatgggtggggcatcttggactgctttccagcatccatggaagcttgctttgctcttgttattgtatttgttgtcatctttgcgatccttggcattgcctatggtttcctggcggcgaccatggcgatccaaaggatctggcagagacattaccatatacttacaaagagggagctcactaaggagtacatagtggaagatctccgaggctgttactacccaccgaagttggatgcagaacatgaagaacggcttcgaatactaaagctcttgtaaaaattttccaaatatgacttgcaaataagcatgcggagggaactctatataatataatccctttctaatctactgtcacaccaccaacattgtcctatcgttttcatttgacaaatgttcccttatcgaggaagcatcatcagaagagctctactcaacctttttctgtaattgatcgatgaatcttttctgttaccactatcgcgagatttcactctattgaaatgccgcattttgt

SEQ ID NO: 7628 - DNA, 1598 bp, Tropaeolum majus
taacgcttttgaaaaaacaaattcccaaagacttttcctatccaggtacttttaaattctcattcatctactttaatttctacaaatcaatccatcaatccatcaatcaattttccggatattttatcgagagattctttgtactttgccatattggtaggaattctactttgaaacgagttcagattaggaaatttctttcaatttcttcaagatcaccttttgctcctgaggttttttctttattcgagagttttgttcagttaaaagaaggtttttctaccgatgaaaggtgaagtgcagttagagcaagctggtgttccaaaccctagcgactctgatccgttgcttggtaatcaccctgactcgtcttcatcgtcgtctttgtcatctacacccgaaagttgtggtgaaatcgggagtgaagatttggagattggttcttctgctccttgttgccgcatttgcctggagaatgatagcgaattcgatgatgaattaatatctccatgcatgtgcaaaggcactcagcagtttgttcatcgttcatgtcttgatcattggcgctcggtgaaggaaggatttgctttctctcactgcacaacttgtaaagcccagtatcatcttcaagttgcatcgtttgaagacaactcatggcgtaaagcaaaattcagaattttgtggcaagggacgtggtactagtatttttcgctgtacaaattgtaattgcagcaatgggaggtattgcgtacataatggacaaagatggggccttccgggattctttcagtgatggttgggatcgtatactgtcaaaacatccaataccattctattattgcattggggtgatagccttctttgtgttgcttggattttttggactcatattacattgttcatccctcaatggaaatgatccacggatggctggctgccagaactgttgttacgggtggggtatcttggattgctttccagcatcactggaggcttgctttgcacttgctgttgtttttgtggtcatctttgccattcttggcattgcatatggatttcttgcagccactatggccgttcaaaggatttggcaaagacactatcacattcttactaagagagagcttacaaaggagtacgtagtggaggatcttcatggcagttatacccctccaaagctggacccggaacatgaacaacgattgaaaatactcaagctcttgtagtgatgaaagagaaactaacattgaaaagcttctctctttttttcaagtgtgctaaattattcagtattggtaatgttgtctgtttgagatatatgtcgaaagtgaaaaacgttacaaaaatactaagctaagtgtgaacataatgttgcaaacctaattgagcaagatgaagagttaaaaagtgtggataatgatttgtgcaggttttttactcttgtgccttaaagttttggtgtagtgtaggcataggtttacaaaagaggttatcttttgtacgtttttgttccattttgaaatagttctggtgtgcattcgaacacttgttcaaaatggtagactgcacactaaatttgatataagaggaatttaagt

SEQ ID NO: 7629 - DNA, 1388 bp, Ricinus communis
agttttatacttttctttcatttcatttcagtaatcaatttagggtttagaatcagatgaaaggagaagtgcagctagaggcattgagtgcagacaatcctcctagtgactctgatcctttgttacagaaccaggctcactcaccgtcatcatcattgccggtaccaggacgtttgagtgagattgataatgaagaagatgatgatgatgttgatgatatagagaatgcttctgttcctacttgtcgaatttgtctcgagagcgattgtgaaccaggtgatgagttaatatctccatgcatgtgcaaaggtactcaacagtttgtccatcgatcatgccttgatcattggcgctcagttaaggaaggatttgctttctcacattgcacaacatgtaaagcccaatttcatcttcaagttgctttgtttgaggacaactcatggcgtaagatgaaattcagaatttttgtgacgagagatgttattattgtatttttggttgtgcagactgtaattgctgcaatgggtggctttgcataccttatggacaaagatggcgcctttaggaactcatttagtgatggttgggatcgcatcctgtcaaaacatcctataccattttattattgcataggagtactggctttttttgttcttcttgggtttttcggcctcatattacattgctcgtcccttaatagtaatgatccacgtatggctggctgccagaattgctgttatggatggggaattctggactgtttcccggcatctatggaagcatgctttgcgttggttttggtttttgttgttatctttgccattcttggcatagcttatggtttccttgctgccaccgtggccattcagaagatctggcagagacactatcacatccttactaagagggagttaacaaaggaatacatagtagaggatcttcatggttgttatacaccagcaaaattggattcagaacatgaagaacgtctgaaaatgcttaagctgttgtagtatgatatgatggttgatgcaattacaagatctgttttaaagtgtaactaatttatcagagattttaaagtagcaaagcttttgttaccaagctaaagaagttacattttgtatttgtttgacaatcgtatttaatagagcaaggatgaaagagagtatattttcatttctctctaaatgttatgcgacttttgaacctgatattctggaacttactggaggacgtttatcaatctcagttcacgtttaaattcattcacgccttgactgtaatctgtatcaattttcagcaagagtgtggtcagttgccattttgctttgggcgtgacaggatcggcttcccttaacaaatcgggctgtgactgattcaattgg

SEQ ID NO: 7630 - DNA, 1592 bp, Gossypium raimondii
aataatgcataatttaattacgttttagcccaattttcattcggaaaattctctactttttgttgactcaaagactcgaattctttatcctttcactctctctgtttgttttcgggattaaagcatcagaattttatgatcgctttgttgtttttaaagtttggttattgatattttgctgtgattttatttattccgatcaatgacgggggaattgcaactagaatcagcagatgaaagaaaccttactgactctgatcctcttttagaaaacccggtcgattcgtcgtcgccggtcagttcgactgagattaggaatgaagatattgagaatgtttctgctccttgttgtcgtatttgcctcgagtgcgatggcgaagaagatgatgaactgatatctccatgcatgtgcaaaggcactcagcagttcgttcatcgtgcttgccttgatcattggagatcggtaaaggaaggattttccttctctcattgtacaacttgcaaggctcggtttcaccttcgagttgaattattcgaggacaactcttggcgtaaattaaaattcagaattttcgtggcaagagatgtctttcttgtgttcttggcagtacaaactgtaattgcagcaataggaggctttgcatatgttatggacaaagatggtgcttttcgaaattcattcagtgatggttgggatcgcatgctatcgaaacatcctataccattttattattgcattggtgtgctggccttctttgtcttgcttggattttttgggctcatagtacattgcacctccttcaacagcaatgatgcacggatggctggatgccagaattgctgttatggttggggtgtcttagattgttttcctgcttccatggaagcttgctttgcactgctcgtggtttttgttgtaatctttgtcattctggggatagcttatggtttgcttgctgccacaatggcaattcagcgaatctggcagaaacactaccacattcttacaaagagggaacttactaaggagtacatagtagaggacctccatggctcttatactccacctaaacttgatccagaacacgaagaacgcttgaaaatgatgaagctattgtaatgatggatgaagggttaaaagccatgagaggtatttgattatttcgaattattcaggtttcgtaaaatacaaaatatgtggactgctcggtcgtttgtcaccaaaatcactcaatttagatctttacctcatcgccgatagaaaatgaagcaaaccggcgttgaaggggatccataaattatctgtgcagttatttatacacacagtatctttcttccttgatgtttgtctaataactaaatcagccacagttatattattgtagcaaatataccataccttttatacatgtcatagttctgacatgatatttgttttaggtaaacaaatccttatgtgttcatcatgtccatggacaattgctgatcctatcatttatataaggtttacatgaacaaaccagggcaacaccgggcattgttgcctcacagaatggtttcatcgtatcccatgtattttaaccttaggtggg

SEQ ID NO: 7631 - DNA, 1636 bp, Gossypium hirsutum
tgaaataatgcctaatctaattacgttttagtcccaattttcattcggaaaattctctactttttgttgactcaaagactcgaattatttattcctttcactctctttgtttgttttcgggattaaagcatcagaattttatgatcgctttgttgtttttaaagtttggttattgatattttgctgtgattttatttattccgatcaatgacgggggaattgcaactagaatcagcagatgaaagaaaccttactgactctgatcctcttttagaaaacccggtcgattcgtcgtcgccggtcagttcgactgagattaggaatgaagatattgagaatgtttctgctccttgttgtcgtatttgcctcgagtgcgatggcgaagaagatgatgaactgatatctccatgcatgtgcaaaggcactcagcagttcgttcatcgtgcttgccttgatcattggagatcggtaaaggaaggattttccttctctcattgtacaacttgcaaggctcggtttcaccttcgagttgaattattcgaggacaactcttggcgtaaattaaaattcagaattttcgtggcaagagatgtctttcttgtgttcttggcagtacaaactgtaattgcagcaataggaggctttgcatatgttatggacaaagatggtgcttttcgaaattcattcagtgatggttgggatcgcatgctatcgaaacatcctataccattttattattgcattggtgtgctggccttctttgtcttgcttggattttttgggctcatagtacattgcacctccttcaacagcaatgatgcacggatggctggatgccagaattgctgttatggttggggtgtcttagattgttttcctgcttccatggaagcttgctttgcactgctcgtggtttttgttgtaatctttgtcattctggggatagcttatggtttgcttgctgccacaatggcaattcagcgaatctggcagaaacactaccacattcttacaaagagggaacttactaaggagtacatagtagaggacctccatggctcttatactccacctaaacttgatccagaacacgaagaacgcttgaaaatgatgaagctattgtaatgatggatgaagggttaaaagccatgagaggtatttgattatttcgaattattcaggtttcgtaaaatacaaaatatgtggactgctccgtcgtttgtcaccaaaatcactcaatttagatctttacctcatcgccaatagaaaatgaagcaaaccggcgttgaaggggatccataaattatctgtgcagttatttatacacacacagtatctttcttccttgatgtttgtctaataactaaatcagcaacagttatattattgtagcaaatataccgtaccttatatacatttcatagttttgacatgatatttgttttagttaaacaaatccttagtgttcatcatgtccatggacgaattgctgatcctatcatttatataaggtttacatgaacaaatctgtgcaacactggccattgttgcctcacagaatagtttcatcgtatcccatgtattttaaccttaggtgggaccttaaaatcatatttgttctcgccgttataaaacg

SEQ ID NO: 7632 - DNA, 1643 bp, Gossypium raimondii
taatttgactctatgaaataatgcataatttaattacgttttagcccaattttcattcggaaaattctctactttttgttgactcaaagactcgaattatttatcctttcactctctctgtttgttttcgggattaaagcatcagaattttatgatcgctttgttgtttttaaagtttggttattgatattttgctgtgattttatttattccgatcaatgacgggggaattgcaactagaatcagcagatgaaagaaaccttactgactctgatcctcttttagaaaacccggtcgattcgtcgtcgccggtcagttcgactgagattaggaatgaagatattgagaatgtttctgctccttgttgtcgtatttgcctcgagtgcgatggcgaagaagatgatgaactgatatctccatgcatgtgcaaaggcactcagcagttcgttcatcgtgcttgccttgatcattggagatcggtaaaggaaggattttccttctctcattgtacaacttgcaaggctcggtttcaccttcgagttgaattattcgaggacaactcttggcgtaaattaaaattcagaattttcgtggcaagagatgtctttcttgtgttcttggcagtacaaactgtaattgcagcaataggaggctttgcatatgttatggacaaagatggtgcttttcgaaattcattcagtgatggttgggatcgcatgctatcgaaacatcctataccattttattattgcattggtgtgctggccttctttgtcttgcttggattttttgggctcatagtacattgcacctccttcaacagcaatgatgcacggatggctggatgccagaattgctgttatggttggggtgtcttagattgttttcctgcttccatggaagcttgctttgcactgctcgtggtttttgttgtaatctttgtcattctggggatagcttatggtttgcttgctgccacaatggcaattcagcgaatctggcagaaacactaccacattcttacaaagagggaacttactaaggagtacatagtagaggacctccatggctcttatactccacctaaacttgatccagaacacgaagaacgcttgaaaatgatgaagctattgtaatgatggatgaagggttaaaagccatgagaggtatttgattatttcgaattattcaggtttcgtaaaatacaaaatatgtggactgctccgtcgtttgtcaccaaaatcactcaatttagatctttacctcatcgccgatagaaaatgaagcaaaccggcgttgaaggggatccataaattatctgtgcagttatttatacacacagtatctttcttccttgatgtttgtctaataactaaatcagccacagttatattattgtagcaaatataccataccttttatacatgtcatagttctgacatgatatttgttttaggtaaacaaatccttagtgttcatcatgtccatggacgaattgctgatcctatcatttatataaggtttacatgaacaaatctgtgcaacactggccattgttgcctcacagaatagtttcatcgtatcccatgtattttaaccttaggtgggaccttaaaatcatatttgttctcgccgttataaaa

SEQ ID NO: 7633 - DNA, 1064 bp, Euphorbia peplus
gcaattagagacggtgcgaggagaagaagaagaagggaatcatagcgactcggatcctctgctacaaaaccaggttgattcttcatcggcgcctcctataatctccggtgaaatcaactctgaagaagacctcgaaagcggctccattccaagctgtcgcatttgtctcgagaccgattgcgaaccaggtgatgaattaatatctccttgcatgtgcaaaggcacacagcagtttgttcatcgatcgtgccttgatcattggcgctcagttaaggaaggatatgctttctctcactgcactacttgcaaagctcaatttcatcttcgagttgaattgtttgaagataactcatggcgtagaatgaaattcagactttttgttacaagagatgttgtcattgtatttttggcagtgcaaactctaatcgctgcaatgggtggctttgcatatcttatggataaggatggtgccttcagaaactcatttagtgatggttgggatcgaatcttgtcaaaacatcctataccattttattattgtataggggtactggcgttctttgtgcttcttgggttttttggcctgatcctacactgttctgccctcaatactaacgatccaacgatggctggctgccagaattgctgctatggatggggaattttagactgctttcctgcttcaatggaggcatgctttgccttggttctggtttttgttgttatttttgccattcttggcatagcatacggtttccttgctgccaccatggccattcagaagatatggcagagacactatcacatacttactaagagggagctaacaaaggaatacatagtagaggatcttcatggctgttatacaccaccaaagttggatcctgaacacgaagaacgcctgaaaatgctgaagcttttgtgaccccttacaaggctgcaagacatctgttttcaagtatctaatcaatcaatccatctggatttcaaagcagctagctgcactttgtaaaattgtttataaagcttatttaacagacacagaagattcttaatttatccaa

SEQ ID NO: 7634 - DNA, 3191 bp, Phaseolus vulgaris
gattagtgtaataaagtgagtatgtatctctttcccgcttccaacgctggaattagagaaagagcagaaggagcaccctgcaaaaccctctgaacattacattattagggttttagtctttcctcttcatcttcttcctcttgtcagaatggcctcttgcatttctctttctctctgtcctcacaccttctgttgccgccaccgtccttactctacgcgccgttccctttcttgctctctctcctcttcttccctcctcgatacggatggacataaagttctgcgtaaaagatcgagaaggatagaaggtccgagaaaaagcatggaagattctgttcaacgcaagatggaggaattttatgaaggacgggatgggccacccctcagagttcttcccattggtgggttgggtgaaattgggatgaattgcatgcttgttggtaactatgatcgctacatcctcatcgatgctggtatcatgtttccagactatgatgagcttgggatccagaagatcatacctgatacaacgtttataagaaaatggagacacaaaattgaagcagttattataacacatggtcatgaagatcatattggtgcattgccttgggtcatcccagcattagattctcatacgccaatttttgcgtcatcctttacaatggagcttataaggaagcgtttgaaggatcatggtatttttgttccatctcgactgaaagtttttagaacgaggaagaagtttatggctgggccatttgaaatagagcctatcacagtgactcattctatccctgattgctgtggcctagtgctccgatgttctgatggtaccattctccacactggggattggaagattgatgaaacaccattagatggtaaagtttttgatcgggaagctctagaggaactctctaaagaaggagtcacattgatgatgagtgattcaacaaatgtactctcacctggaaggacaaccagtgaatctattgtggcagatgcattattgaggaatatttcagcagctaaaggacgtgttataacgacccagtttgcatcaaatatacatcgtcttggaagtgtgaaagctgctgctgattcaagtggtagaaagttggtatttgttggcatgtcgctaagaacatatttagatgcagcttggaaggatggaaaagctccaattgatccatcaactctggtgaaagcggaggatattgatgcttatgcaccaaaggatttgctaattgttacaacagggtctcaagcagaaccacgtgctgccttaaatcttgcatcttacggaagtagtcattctttcaagctaacaaaggaggatattgtgttgtattccgccaaggttatccctggcaacgagtctcgtgttatggaaatgctaaaccgcatatcagatattggatcaactataattatggggaagaatgaatgtctgcacacatctggtcatgcgtatcgtggagaattggaggaagtgcttagaattgtgaaaccacagcattttctacccatacatggagagctcttgttcttgaaggaacatgaattacttggaaaatcaactggcattcggcacacaactgttattaagaatggagagatgcttggtgtttctcacttgagaaacaaaagagtcctttcaaatggtttcatttcacttggaaaagagaatttccagttgatgtatagtgatggcgagaaagcatttggtacatcaagtgaactctttattgatgaaagaatgagaattgcattagatggcatcatagttattagcatggaaatctttcgcccacaaaatttagaaagtccagttgagaacaccttaaaaggaaaaataagaattaccacaagatgcctgtggcttgacaagggtaagctgttggatgcactccataaagctgctcatgctgccctttcaagctgccccgcgagctgtccactggctcatatggaaagaattgtgtctgaggtggtgaggaaaatggtgaggaagtacagtggcaaacggcctgaagttattgtcattgccgtagaaaatcctgcagctgttcttgctagtgagataaacatgaagctgtctggaaaatttcacatggatggaacatcggcattgaaaaaagtggtggttggacgtgggaaagaaaatcagagaaccaaaacgcaaataagagaacgaattgatgtcggtggtatactacctactgaagacattgctatctcaagtggagttgaggatgacttatcggatgcggaaaattcagatgatttttttaaaccacttgttggatcctctccagttgagaagtcaattaaagctaacaatggttatgttccacaaaaggagaagccatccccttttaaggatggtagttctgaagacactgaagaagaatgcaattctgtaaatacatcaaattccgaacctaaatcttcaaaatcagcaaagaaaaataaatggaaacatgatgaagttaagaagcttattggcatgcgtggggagatgaatgaccgatttcaagttgtgaaaggaaggatggccctctgggaagaaatatctcagaatttgttgtctaatgggatcagcagaagtcctgggcagtgtaaatctctctggacatctctgttacagaaatacgaggaggtgaagaatgagaaaaatggcaagaagaaatggccgtatcttgaggaaatggaaaggattctgtctgatagcgagacactggcatctaaatgatcattaaggtgatagaccagacaagaaaaatttgcaagagttttctgcattatgattggtaatatgtctaaacatggtcgctgggaaggtaatccgttagctgcattattcttccatcttgaactcgttcattgaatattcatatttttgaggagacagacagcataaaaggaattgacattttacgtaacacaagttaatgaggagatcatgctggttccgtggatgatttatccccccttcctccaaaagctccacgcccacccagtggcagcactgtaggatcgtttcgatggtactgactgacattgaaaaaatattttaatgataatgaacagttaattaatgtaacgagatcaaactacatttctctgttaattatcataattgatttcattatttttgttagtggcgccgtcttggaatgaaacaa

SEQ ID NO: 7635 - DNA, 3304 bp, Phaseolus vulgaris
aaaaaaacccatagcgataagaaagatatttcgggaagtgaagtagctgattagtgtaataaagtgagtatgtatctctttcccgcttccaacgctggaattagagaaagagcagaaggagcaccctgcaaaaccctctgaacattacattattagggttttagtctttcctcttcatcttcttcctcttgtcagaatggcctcttgcatttctctttctctctgtcctcacaccttctgttgccgccaccgtccttactctacgcgccgttccctttcttgctctctctcctcttcttccctcctcgatacggatggacataaagttctgcgtaaaagatcgagaaggatagaaggtccgagaaaaagcatggaagattctgttcaacgcaagatggaggaattttatgaaggacgggatgggccacccctcagagttcttcccattggtgggttgggtgaaattgggatgaattgcatgcttgttggtaactatgatcgctacatcctcatcgatgctggtatcatgtttccagactatgatgagcttgggatccagaagatcatacctgatacaacgtttataagaaaatggagacacaaaattgaagcagttattataacacatggtcatgaagatcatattggtgcattgccttgggtcatcccagcattagattctcatacgccaatttttgcgtcatcctttacaatggagcttataaggaagcgtttgaaggatcatggtatttttgttccatctcgactgaaagtttttagaacgaggaagaagtttatggctgggccatttgaaatagagcctatcacagtgactcattctatccctgattgctgtggcctagtgctccgatgttctgatggtaccattctccacactggggattggaagattgatgaaacaccattagatggtaaagtttttgatcgggaagctctagaggaactctctaaagaaggagtcacattgatgatgagtgattcaacaaatgtactctcacctggaaggacaaccagtgaatctattgtggcagatgcattattgaggaatatttcagcagctaaaggacgtgttataacgacccagtttgcatcaaatatacatcgtcttggaagtgtgaaagctgctgctgattcaagtggtagaaagttggtatttgttggcatgtcgctaagaacatatttagatgcagcttggaaggatggaaaagctccaattgatccatcaactctggtgaaagcggaggatattgatgcttatgcaccaaaggatttgctaattgttacaacagggtctcaagcagaaccacgtgctgccttaaatcttgcatcttacggaagtagtcattctttcaagctaacaaaggaggatattgtgttgtattccgccaaggttatccctggcaacgagtctcgtgttatggaaatgctaaaccgcatatcagatattggatcaactataattatggggaagaatgaatgtctgcacacatctggtcatgcgtatcgtggagaattggaggaagtgcttagaattgtgaaaccacagcattttctacccatacatggagagctcttgttcttgaaggaacatgaattacttggaaaatcaactggcattcggcacacaactgttattaagaatggagagatgcttggtgtttctcacttgagaaacaaaagagtcctttcaaatggtttcatttcacttggaaaagagaatttccagttgatgtatagtgatggcgagaaagcatttggtacatcaagtgaactctttattgatgaaagaatgagaattgcattagatggcatcatagttattagcatggaaatctttcgcccacaaaatttagaaagtccagttgagaacaccttaaaaggaaaaataagaattaccacaagatgcctgtggcttgacaagggtaagctgttggatgcactccataaagctgctcatgctgccctttcaagctgccccgcgagctgtccactggctcatatggaaagaattgtgtctgaggtggtgaggaaaatggtgaggaagtacagtggcaaacggcctgaagttattgtcattgccgtagaaaatcctgcagctgttcttgctagtgagataaacatgaagctgtctggaaaatttcacatggatggaacatcggcattgaaaaaagtggtggttggacgtgggaaagaaaatcagagaaccaaaacgcaaataagagaacgaattgatgtcggtggtatactacctactgaagacattgctatctcaagtggagttgaggatgacttatcggatgcggaaaattcagatgatttttttaaaccacttgttggatcctctccagttgagaagtcaattaaagctaacaatggttatgttccacaaaaggagaagccatccccttttaaggatggtagttctgaagacactgaagaagaatgcaattctgtaaatacatcaaattccgaacctaaatcttcaaaatcagcaaagaaaaataaatggaaacatgatgaagttaagaagcttattggcatgcgtggggagatgaatgaccgatttcaagttgtgaaaggaaggatggccctctgggaagaaatatctcagaatttgttgtctaatgggatcagcagaagtcctgggcagtgtaaatctctctggacatctctgttacagaaatacgaggaggtgaagaatgagaaaaatggcaagaagaaatggccgtatcttgaggaaatggaaaggattctgtctgatagcgagacactggcatctaaatgatcattaaggtgatagaccagacaagaaaaatttgcaagagttttctgcattatgattggtaatatgtctaaacatggtcgctgggaaggtaatccgttagctgcattattcttccatcttgaactcgttcattgaatattcatatttttgaggagacagacagcataaaaggaattgacattttacgtaacacaagttaatgaggagatcatgctggttccgtggatgatttatccccccttcctccaaaagctccacgcccacccagtggcagcactgtaggatcgtttcgatggtactgactgacattgaaaaaatattttaatgataatgaacagttaattaatgtaacgagatcaaactacatttctctgttaattatcataattgatttcattatttttgttagtggcgccgtcttggaatgaaacaactatttagtttgcatcttggccacatacgacagtgaaaaagtgagtcttggttttacttgccccc

SEQ ID NO: 7636 - DNA, 3169 bp, Cajanus cajan
atggccacttgcacttctctttccctctctcctcacaccttctgttgccgccatcgcccttaccctacgcgccgttcccttacttgctctctctcctcttcgcccctcccagatacggatggaccgaaagtactacgtaaaagatcaagaagaacagaaggtcctaaaaaaagcatggaagactctgttcaacgcaagatggaggaattttatgaaggacgggatgggccacccctcagagttcttcctattggcgggttgggtgaaattgggatgaactgcatgttggttggcaactacgatcggtatatcctcattgatgccggtgtcatgtttccagactatgatgagcttggggtccagaagatcatacctgatacaacatttataagaaaatggagacacaaaattgaggcagttgttataacacatggccatgaagatcatattggtgcattgccttgggttatcccagcattagattctcatacgccaatttttgcttcatcctttacaatggagcttataaggaaacgtttgaaggatcatggtatcttcgttccatctcgactcaaagtatttagaacaaggaagaagtttgtggctgggccatttgagatagagcctatcacagtgactcattctattcctgattgctgtggactagtgcttcgctgttctgatggtaccattcttcataccggggattggaagattgatgaaacaccattagatggcagagtttttgatcgtgaagctctagaggaactctctaaagaaggagtcacattaatgatgagtgattcaacaaatgtactctcacctggaaggacaatcagtgaatctgttgtggcagatgcattattgaggaaaatttcagctgctaaaggaagggttataacgacccagtttgcatcaaatatccatcgtcttggaagtgtgaaagctgcagctgatttgactggtagaaagttggtatttgttggcatgtcattaagaacatacttagatgcagcttggaaggatggaaaggctccaattgatccatctactctggtgaaagcggaggatattgatgcttatgcaccaaaggatttgcttattgtaacaactggctctcaagcagaaccacgtgctgccttaaatcttgcatcttatggaagtagtcattctttcaagctgacaaaggaagatgttgttttgtattcagctaaggttatcccgggtaatgagtctcgtgttatggaaatgctaaaccgcatatcagagattggatcagctataattatggggaagaatgaatgtctgcacacatctggtcatgggtatcgtggagaattggaggaagtacttagaatagtgaagccacaacattttctacccatacacggagaactcttgttcttgaaagagcatgaattacttgggaaatcaactggcattaggcacacaactgttattaagaatggagagatgcttggtgtttctcatttgagaaatagaagagtcctttcaaatggtttcatgtcatttggaaaagagaatttgcagttgatgtatagtgatggtgagaaagcatttggtacatcaagtgaactctttattgatgaaagaatgagaattgcgttagatggcatcatagtggttagcatggaaatatttcgtcctcaaagcctagacaatccggatgaaaacaccttaaaaggaaaaataagaattaccacaagatgcctgtggcttgacaaagggaagctgttggatgcactccataaggctgctcatgctgctctttcaagctgccctgtaagctgtccactggctcacatggaaagaattgtgtctgaggtgttgagaaaaatggtgaggaagtacagtggcaaacggcctgaagttattgccattgccatagaaaatcctgcagctgttcttgctaatgaaataaacacaaggttgtctggaaaattccatgtagatgggatatcaccattgagaaaagtcgtggatgggaaagaaaacctgagaaccaaaaagcaaataagaggtaacatcaatttacatttgaagaatacatatagaattgtggagatctggttggtatgcttttatggtctaccacctactgaagacatcactatctcaagtggatatgaggatgacttgtctgagacaggggattcagatgcaattttgaaaccatttgttgaatcatctccagttgagaagtcaattaaagctaacaatggttatgttcgacgaaaggaaaagttgtccccactgagggatgatggttctgaagacactgaagaatgcaattctgtagatacatcaaattctgaacctaaatcttcaaaatcagcaaagagaaataagtggaaacatgatgaagttaggaagctgattggcatgcgtggggaactgaatgataaatttcaagttgtgaagggcaggatggccctatgggaagaaatatctcagaatttgttggctaatgggatcagcagaagtcctgggcagtgtaaatctctgtggacatctttgttacagaaatatgaggaggtcaagaatgtcaagagcaagaaaaaatggccgtatcttgaggacatggaaaggattctgtctgataacgaagcactagcaacaaaatgattataaaggtgatggatcagacaagaaaattttgcaagagttttctgcattaagattggtatatgtctgagcatggtcgctgggaaggtaatccatcagttgcataattctttcttgcaacttgaactcgttcattggatatccatagtttcctgaggagattaacagcattaaaggccatggcattttacattaacacaagttaatgagggagactacgctggttcaggggatgatttatccccttcctcaaaactcaaaaggcagccatccaccaaatggcagcactttagggtcattttgatggtattgattgacattgcaaaactattttaatgataatgaagggttgatagtaaactcaaaacattttgttatttatcataattagtttcattattttagttagtggcacgcgttgatatgaaacaaccatgttggctacatacgacagtaaaaagtgagtcttgatgcttttacttatcatttgcccgcctgcaactcgtagactatctcttgtaac

SEQ ID NO: 7637 - DNA, 5712 bp, Glycine max
cgtttgagttttttaggtgttgtttaatttatctcgggaaaaagaaaaatatttaaagaaaagaaagaaagaaagtatatatataagagcccaaaagacggtagagaaaggaacaagaaaccgtcgtggaagagcaaaaggtgagtgagtgagtgagccaaaccaaagagtttgacacgacgaagaccaaaatcattgcagagatgactactaaacccacatccacactctcggagaaattacacctttatttctttcacttcacttggggtttcatcgctattgcttcctcatgaagaaagctactaatcccaaccccttctccaccccccgccgccacgatttccaccgtccgccaccacccacccacggctgcggttggactccccgcccagtccaccaccgtccctaccaccaatggaggccccgattccacccccacgccgcccgcatcgaccgccctccggagccttatttcagggtggagctccgcctcggccgctgccccctccaccgcgacgacgtcgaggccctgatcgacgaatgccgctccagccacgacagcttcactttctacccaaccgacgacgtcgccgccgttctcaactaccggagctgggagcaggcgcgcgatgccgtcgtctggttctgggaggcgcggctcgcggagaagcacgatttcacgccggcgttggattccaacgttgtcgtcgtcaaggacgatgtggattgtcgccttcgaccggttttcgcgaggcacgtgaaagggttgatgatgatggaagaaggtaaggaggtgaagtttgggatggatgagtgtgaacggttggcgaaagaaatttctcggctttcgagttcgctgagtaagcccttgcgaattggcacgcaaaacgagcttatgaagaagaagaaagggctcgttgatgagaagaatctggttgaaaggaggttgaaggagtttgagtctgcgatgcagtgtttgttgaagtatttggaggatggcggtgatgacgtggagggtgttaaggtgtttaggtttgatggaggttttgattggaagcggattcactgtcttatcaaaagggagtgtcggaggcttgaggatgggttgcctatttatgcttaccggagggatattcttcaggaaatacattatcagcagataatggtattaattggagcgactggttcagggaagagtacgcagctggtacagtttcttgctgattcaggcgttggttctgacaaatccattgtatgcacccaacctcgcaagattgctgccaaagcagtggctcaaagggtccagcaagaaagcagtggatgttatgaaggccaatcaatcaaatattgttctacatttttatcctcgcgtgagtttgattccaggataacattcatgactgatcattctttattgcagcactacatgagtgataataatttgtctggggtctcgtgcatcataattgatgaggctcacgagaggagcttaaatacagattttctgttgactttgttgaagagtttactttgtaggagggttgaaatgcggcttatcattatgtctgctacagctgatgcaaagcagctatctgattacttttttggttgtggaatttttcatgtgcttgggagaagctttccggtggatatcaaatatgttccttctgactgtggtggagattctggttctgctgttgttgcgtcatatgtttctgatgttgtcagaatggcaactgagattcacaaaactgagaaagagggaactattcttgcctttttgacctctcagatagaagtagaatgggcctgtgaaaagtttcaagctgcctctgcagtagctttgcccttgcatggaaaactttcatctgacgagcagttccgtgtttttcagaactaccctggaaagagaaaagtgatattttcaacaaatcttgcagagacatcacttacaattcctggtgttaggtatgtgatagattctggggtggttaaagacagcagatttgatcctagcagtgggatgagtgtacttaaggtttgctggatcagccagagctctgctgatcaacgggctggtcgtgctgggaggaccgagcctggtgtgtgctatagaatgtacttggaagccgattatcagtctatggacctaaatacagagccggagattcggaaagttcatcttggtgtagcagttctgagaatccttgctttaggagtgaaggacatgcaagattttgattttgtggatgctccaagtcctagctcaatagatatggcaatccggaatctaattcaattaggagccattgaactgaacaataatgctcatgatttaacttctgaaggttggtgcttggtgagaatgggaattgaacctaggcttgggaaacttattcttggttgtttcaaacatggtttgggtagggagggtatcatccttgctgctgtgatggccaatgctagtagcatcttttgcagagttggcagtgaatttgataagcaaagatctgattgtcttaaagtgcaattttgccattgtgatggtgacctctttactcttctctctgtgtacaaggaatgggaagctttgcctcgagaaaggaagaacaaatggtgttgggaaaacagcatcaatgccaaatccatcaggaggtgtcaagacacaattttggagttagaaacttgccttgagcgtgaacatgacattgttactccaagttactggctttgggacccttgtatgccctctaatcatgataagaatttgaaaagggtaatactgtcctcacttgttgagaatgtagccatgtactctggctgcaatcaacttggttatgaagtggcgcaaactgggcaacatgttcaactacatccatcttgttcattgcttgtatttgctgagaaaccaagttgggtagtttttggtgagcttctttccatttctaatcaatatttggtctgtgtgtgtgcatttgactttcaatctttattcaacctttgccctgctcccttgtttgatgtatccaaaatggaagagcggaagttgctaatgaagacactgtctggtctcggctgtattcttctcaagagattttgtggaaaagccaactgcgatttgcttgctcttgtttcacgtataaggaaagcttgtatggatgaacgcatcttcattgaagtgaatgttgacaagaatgaaatccacttatatgccacttcaaatgagatggatatagcccttgggttggttaatggtgttctagaatatgagaggaagttgttacgcacggaatgtatggataagtttttgtatcatgggtctggtttctctccacctgtagctttgtttgggtctggtgctgagataaaacatttggaacttgagaaacgttccttgagtgttgatgtgtgtcatccaaacataaatgaaattgatgacagggagctcttgatgttttttgagaagaatacctctggttgcatctgtgctgtgcacaaattcacaggcaatatgagggatggagatagggataagtggggcaggataatatttatgtcccctgatgttgtcagaagagctgctgagctagatggacaagagttttgtggctcatccttgaaaattgttccttcacagttgggatgggataaaacattttcgttccctgctgttaaagcaagaatttcttggcctcgtaggcttagcaggggatttgccatagttaaatgtgatataaaggatgtcaattatatcttgagagatttctataaccttgcagtaggaggaaggtatgttcgatgtgaaattggcaaaaagagtattgacagcgttgttataaatgggcttgacaaagagctttcggaagctgaaatagtggatgtgctaagaactgctacaagtagaaggattttggattttttcttggtgagaggggatgctgctggaaatccaccatgcagtgctttggaagaggcactcctaaaagaaatttacccctttttgccgaaaaggaaccctcacattattccttgccgagttcaggtgtttgcacctgagcctaaggattctttcatgagagctttgatcacttttgatggaagattacatttagaggcagcgaaagcattggagcaaattgagggaaaggtgttacctggatgtctttcatggcaaaagataaagtgccagcagttgtttcatagctccattatatttcccactccagtgtatcatgtgattaaggaacaactggatgaagtacttgcaagcttcaggaatttgaaaggtcttgaatgcaacctgggcaggacagttaatggttctcaccgagtgaagataacggcaaatgccacaaggacagtggcggaagttagaagacctctggaagaactattgagagggaaaaccattgagcatgacagcctcacccctgtagttttccaactcatgttgtccagggatggctttagtcttaaaaactcattgcagcaagagacgggaacttatattctttttgacagacacaacttaaatttacgggtgtttggttccccaaacaaggttgctttggctcaggagaaggtgatacagtccctcctttctctccatgaagaaaagcagttagaaattcatctgagagggatggatctacctcctgatttaatgaagcaaatgattaagaattttgggccagatctccgtggactgaaagagagggtacctggggtagatcttacactcaacacacgtcgccatatagtcattcttcatggtagcaaggagttgaaaccgagagtagaggaaataatttttgagattgctcgttcaagccatcatttggttgagagatttgaaaatggacccagttgcccaatttgcttgtgcgaggttgaggatggataccggcttgaaggctgtggtcatttgttctgccggttgtgtctggttgagcaatttgaatctgctattaataaccaaggcactttcccagtatgttgtactcacagggactgtggagatcccatcctgcttacagatttgagatctcttttatttggtgataagttggaggatcttttcagggcttctttgggagcttttgtggcaacgagtgggggagcttacaggttttgcccttctcctgactgcccctcaatttatcgagttgcagatcccgagtctgctggtgagccatttgtttgtgggtcttgttattcagagacttgtaccaggtgccacttagagtatcatccttacctttcatgtgagagatatcaagaattcaaggaagatccggactcatctctgaaagagtggtgcagagggaaagaacaagttaagtgctgctcggcatgtgggtatgtaattgagaaggtagatgggtgcaaccacgttgagtgcaagtgcggaaagcatgtctgttgggtttgcttagagttctttagtactagtaatgactgttataaccatttgagaaccatacacttggccatcatataaattgccatctgcataccatttttccgagacgtgtaattaagcctagcggtatataataatactgtacatggaaatagcaatttgtacagctttcttaaactaatgtatatatatcacagcatttccgcttcatacttgtatatctaattctaatataagtttcacggtgtatataggttgtgacttttctgctatgcaagctctacatt

SEQ ID NO: 7638 - DNA, 5834 bp, Glycine max
cgtttgagttttttaggtgttgtttaatttatctcgggaaaaagaaaaatatttaaagaaaagaaagaaagaaagtatatatataagagcccaaaagacggtagagaaaggaacaagaaaccgtcgtggaagagcaaaaggtgagtgagtgagtgagccaaaccaaagagtttgacacgacgaagaccaaaatcattgcagagatgactactaaacccacatccacactctcggagaaattacacctttatttctttcacttcacttggggtttcatcgctattgcttcctcatgaagaaagctactaatcccaaccccttctccaccccccgccgccacgatttccaccgtccgccaccacccacccacggctgcggttggactccccgcccagtccaccaccgtccctaccaccaatggaggccccgattccacccccacgccgcccgcatcgaccgccctccggagccttatttcagggtggagctccgcctcggccgctgccccctccaccgcgacgacgtcgaggccctgatcgacgaatgccgctccagccacgacagcttcactttctacccaaccgacgacgtcgccgccgttctcaactaccggagctgggagcaggcgcgcgatgccgtcgtctggttctgggaggcgcggctcgcggagaagcacgatttcacgccggcgttggattccaacgttgtcgtcgtcaaggacgatgtggattgtcgccttcgaccggttttcgcgaggcacgtgaaagggttgatgatgatggaagaaggtaaggaggtgaagtttgggatggatgagtgtgaacggttggcgaaagaaatttctcggctttcgagttcgctgagtaagcccttgcgaattggcacgcaaaacgagcttatgaagaagaagaaagggctcgttgatgagaagaatctggttgaaaggaggttgaaggagtttgagtctgcgatgcagtgtttgttgaagtatttggaggatggcggtgatgacgtggagggtgttaaggtgtttaggtttgatggaggttttgattggaagcggattcactgtcttatcaaaagggagtgtcggaggcttgaggatgggttgcctatttatgcttaccggagggatattcttcaggaaatacattatcagcagataatggtattaattggagcgactggttcagggaagagtacgcagctggtacagtttcttgctgattcaggcgttggttctgacaaatccattgtatgcacccaacctcgcaagattgctgccaaagcagtggctcaaagggtccagcaagaaagcagtggatgttatgaaggccaatcaatcaaatattgttctacatttttatcctcgcgtgagtttgattccaggataacattcatgactgatcattctttattgcagcactacatgagtgataataatttgtctggggtctcgtgcatcataattgatgaggctcacgagaggagcttaaatacagattttctgttgactttgttgaagagtttactttgtaggagggttgaaatgcggcttatcattatgtctgctacagctgatgcaaagcagctatctgattacttttttggttgtggaatttttcatgtgcttgggagaagctttccggtggatatcaaatatgttccttctgactgtggtggagattctggttctgctgttgttgcgtcatatgtttctgatgttgtcagaatggcaactgagattcacaaaactgagaaagagggaactattcttgcctttttgacctctcagatagaagtagaatgggcctgtgaaaagtttcaagctgcctctgcagtagctttgcccttgcatggaaaactttcatctgacgagcagttccgtgtttttcagaactaccctggaaagagaaaagtgatattttcaacaaatcttgcagagacatcacttacaattcctggtgttaggtatgtgatagattctggggtggttaaagacagcagatttgatcctagcagtgggatgagtgtacttaaggtttgctggatcagccagagctctgctgatcaacgggctggtcgtgctgggaggaccgagcctggtgtgtgctatagaatgtacttggaagccgattatcagtctatggacctaaatacagagccggagattcggaaagttcatcttggtgtagcagttctgagaatccttgctttaggagtgaaggacatgcaagattttgattttgtggatgctccaagtcctagctcaatagatatggcaatccggaatctaattcaattaggagccattgaactgaacaataatgctcatgatttaacttctgaaggttggtgcttggtgagaatgggaattgaacctaggcttgggaaacttattcttggttgtttcaaacatggtttgggtagggagggtatcatccttgctgctgtgatggccaatgctagtagcatcttttgcagagttggcagtgaatttgataagcaaagatctgattgtcttaaagtgcaattttgccattgtgatggtgacctctttactcttctctctgtgtacaaggaatgggaagctttgcctcgagaaaggaagaacaaatggtgttgggaaaacagcatcaatgccaaatccatcaggaggtgtcaagacacaattttggagttagaaacttgccttgagcgtgaacatgacattgttactccaagttactggctttgggacccttgtatgccctctaatcatgataagaatttgaaaagggtaatactgtcctcacttgttgagaatgtagccatgtactctggctgcaatcaacttggttatgaagtggcgcaaactgggcaacatgttcaactacatccatcttgttcattgcttgtatttgctgagaaaccaagttgggtagtttttggtgagcttctttccatttctaatcaatatttggtctgtgtgtgtgcatttgactttcaatctttattcaacctttgccctgctcccttgtttgatgtatccaaaatggaagagcggaagttgctaatgaagacactgtctggtctcggctgtattcttctcaagagattttgtggaaaagccaactgcgatttgcttgctcttgtttcacgtataaggaaagcttgtatggatgaacgcatcttcattgaagtgaatgttgacaagaatgaaatccacttatatgccacttcaaatgagatggatatagcccttgggttggttaatggtgttctagaatatgagaggaagttgttacgcacggaatgtatggataagtttttgtatcatgggtctggtttctctccacctgtagctttgtttgggtctggtgctgagataaaacatttggaacttgagaaacgttccttgagtgttgatgtgtgtcatccaaacataaatgaaattgatgacagggagctcttgatgttttttgagaagaatacctctggttgcatctgtgctgtgcacaaattcacaggcaatatgagggatggagatagggataagtggggcaggataatatttatgtcccctgatgttgtcagaagagctgctgagctagatggacaagagttttgtggctcatccttgaaaattgttccttcacagttgggatgggataaaacattttcgttccctgctgttaaagcaagaatttcttggcctcgtaggcttagcaggggatttgccatagttaaatgtgatataaaggatgtcaattatatcttgagagatttctataaccttgcagtaggaggaaggtatgttcgatgtgaaattggcaaaaagagtattgacagcgttgttataaatgggcttgacaaagagctttcggaagctgaaatagtggatgtgctaagaactgctacaagtagaaggattttggattttttcttggtgagaggggatgctgctggaaatccaccatgcagtgctttggaagaggcactcctaaaagaaatttacccctttttgccgaaaaggaaccctcacattattccttgccgagttcaggtgtttgcacctgagcctaaggattctttcatgagagctttgatcacttttgatggaagattacatttagaggcagcgaaagcattggagcaaattgagggaaaggtgttacctggatgtctttcatggcaaaagataaagtgccagcagttgtttcatagctccattatatttcccactccagtgtatcatgtgattaaggaacaactggatgaagtacttgcaagcttcaggaatttgaaaggtcttgaatgcaacctgggcaggacagttaatggttctcaccgagtgaagataacggcaaatgccacaaggacagtggcggaagttagaagacctctggaagaactattgagagggaaaaccattgagcatgacagcctcacccctgtagttttccaactcatgttgtccagggatggctttagtcttaaaaactcattgcagcaagagacgggaacttatattctttttgacagacacaacttaaatttacgggtgtttggttccccaaacaaggttgctttggctcaggagaaggtgatacagtccctcctttctctccatgaagaaaagcagttagaaattcatctgagagggatggatctacctcctgatttaatgaagcaaatgattaagaattttgggccagatctccgtggactgaaagagagggtacctggggtagatcttacactcaacacacgtcgccatatagtcattcttcatggtagcaaggagttgaaaccgagagtagaggaaataatttttgagattgctcgttcaagccatcatttggttgagagatttgaaaatggacccagttgcccaatttgcttgtgcgaggttgaggatggataccggcttgaaggctgtggtcatttgttctgccggttgtgtctggttgagcaatttgaatctgctattaataaccaaggcactttcccagtatgttgtactcacagggactgtggagatcccatcctgcttacagatttgagatctcttttatttggtgataagttggaggatcttttcagggcttctttgggagcttttgtggcaacgagtgggggagcttacaggttttgcccttctcctgactgcccctcaatttatcgagttgcagatcccgagtctgctggtgagccatttgtttgtgggtcttgttattcagagacttgtaccaggtgccacttagagtatcatccttacctttcatgtgagagatatcaagaattcaaggaagatccggactcatctctgaaagagtggtgcagagggaaagaacaagttaagtgctgctcggcatgtgggtatgtaattgagaaggtagatgggtgcaaccacgttgagtgcaagtgcggaaagcatgtctgttgggtttgcttagagttctttagtactagtaatgactgttataaccatttgagaaccatacacttggccatcatataaattgccatctgcataccatttttccgagacgtgtaattaagcctagcggtatataataatactgtacatggaaatagcaatttgtacagctttcttaaactaatgtatatatatcacagcatttccgcttcatacttgtatatctaattctaatataagtttcacggtgtatataggttgtgacttttctgctatgcaagctctacattatgtgttcaaaagcagttcaatacggttgtgaaagttgctttaccgttgcaaacaacagcaattgtattaatctattaaatgagcggaaagagaattagaattgattaaaagtcgattagca

SEQ ID NO: 7639 - DNA, 5473 bp, Phaseolus vulgaris
atgaagaaaacttcgtaccctaaccccacttatcgtcgctgtgatgctcattctgacgcaccaccgcatggctgttccactccccgcccaatcttccaccgtcccttccaccaatcgagaccacgcttttatccacatcccgtccgcctccaccgtcctccggagccttatttcaaggtggagctccgcttcagccttcgccctcctagccgcgacgaggtggaggctctgatcaaagaatgtgagcacgagcctcagtcgttcgctttctaccccggagacgacgtcgccgccgcgctcagttaccggaactgggaggaggcgtgtgacgcggccgcttggttctgggagtcgctgcttttggagaaacacggttacacgccggcgctggactccaacgttgcggtcacgggcgatctcgatggccgccttcgagtgttgttcacgaggcacgttcagagggtgatggaggggagagaggttaagcggtgggtggaggagagtgaacggttgtcgaaggagattgcgagggtttcaactttgcttcggaatggcttgcatattgacttgagtagtcactatattgagcagaagaaaggactcaatgttgagaaaaaccaggttgagaggaggttgaaggagttcgaatctgcgatggattgtatactgaagtatctggcggagggtgatgacgaggagggtggtggaagtgtgaatgtgttcaagtttgatggatgttttgattggaatcgcattcactgtctgatcagaagggagtgtcgaagactggaggatggattgcccatttatacttaccggacagatattcttcgggaaatacattatcagcagataatggtgttaataggagagactggttctggaaagagtacacagttagttcagtttcttgctgattctggcattggtgctgatgaatccattgtatgcacccaacctcgcaagattgctgccagatcagtggctcaaagggtccaggaagaaagcagtggatgttatgaagggcaatcaatcaaatgttctatgttttcatccttgcatgagtttgattccaggataatattcacgacagatcactgtttattgcagcactacatgcgtgataacaatttgtctgggatctcatgcatcataattgatgaggctcacgagaggagcttaaatacagatttactgatgactttgttgaagaatttactttatagaaggggtgagatgcggcttatcattatgtctgctacagctgatgcaaagcagctatctgatttcttttattgttgtggaatttttcgtgtgactgggagaagttttccagtggatgtcaaatatgttccttctgaccatgccgggcattctggttctgttggtgttgcctcgtatgtttctgatgttgtcagaaaggcaactgaggttcataaaacagagaaagagggaactatcattgcctttttgacctctcagatagaagtggaatatgcctgtgaaaagtttcaaataccttctgcagttgccctgccattgcatggaaaactttcatctgaagagcaatttcgtgtttttcaaaactaccctggaaagagaaaagtgatattttcaacaaatcttgcggagacatcactgacaattcctggtgttaagtatgtgattgattctggtttatttaaagactgcagatatgatcctggcagtgggatgaatgtacttaaggtttgctggattagtcagagctctgctgatcaaagggctggtcgtgctgggaggactgagcctggtgtgtgctatagactgtattcagaaactgattatcaatcaatggacctaaatcaagaaccagagattcggcgagttcatcttggtgtagccgttttgaggatcctagctttaggagtgacgaatgtgcaggattttgattttgtggatgctccaagttctagctcgattgatatggcaatcaggaatctaattcagttacgagcaattgagaagaaaaatgatgttcacaatttaacgccggagggttggtgcctggtaaaaattggaattgaacccaggctgggtaaacttattcttggctgtttcaaagatggtttgggcagggaaggtattgttcttgctgctgtgatggccaacgccagtaccatattttgcagagttggcagtgaatttgataaacaaagatctgattgtcttaaagtgcaattttgccattgtgatggggacctctttactcttctctctgtgtacaaggaatgggaagctttgcctttggaaaggaggaacaaatggtgttgggaaaacagcatcaatgccaaatctatgaggaggtgccaagacacagttttggagttagaaagttgcctggaacgtgaacacgaccttgttactccgagttgttggcgatgggatccatgtatgccctctagttatgataagaatttgaagagggttatactgtcctcacttgccgagaatgtagcgatgtactctggctgcaatcaacttggttatgaagtggcacaaactgggcaacatgttcaactacatccatcttgttcattgcttgtttttgctcagaaaccaagttgggtggtttttggtgagcttctttctgtctctaatcaatatttggtctgtgtgagcacatttgactttcaatcattatatgaccttcgccctgctcccttgtttgatgtatctaaaatggtggagcggaagttgcaaatgaagaccttgtgtggtcttggctgtattcttctcaagagattttgtggaaaagccaactgtaatttgcttgcacttatttcacgtataaggaaagcttgtatggatgaacgtatctacattgaagtgaatgttgaccagaatgcaatccacttatttgccacttcaaatgatatggatgcagcccttgtgttggttaatggtgctctagaatatgagagaaagttgcaacgcgctgaatgcatggataagtgtttgtatcatgggtctggtctttctccacctatagctttgtttggttctggtgctgagatcaaacatttggaacttgagaaacgttccttgagtattgatgtgtgtcatgccgacataaatgcaattgatgacaaagagctcttaatgtttttagagaagaatacctctggtagtatctgtgctgtgtacaaattttcaggcaatatgaaagatgaagataaggataagtggggcaggatattgtttacgtcccctgattttgttgaaagagctactgaactagatggacatgagttttgtggctcctccttgaaaattttaccttcgcagttgggaggggataaaatgttttcgttccctgctgttaaagcaaaagtttcttggcctcgtaggtctagcaggggatttgccgtagttaaatgtgatataaaagatgtcaaccatatattgagagatttctacaaccttgcaatagggggaaggtatgttcgatgtgaagttggaaaaaagagtatggacagtgttactataaatgggcttggcaaagacctctcggaagctgaaatactggatgtgctaagaactgctacaagtagaaggattttggattttttcttggtaagaggggatgctgttgaaaatcctccatgcagtgctttggaagaggcactcctaaaagaaatttacccctctttgcccaaaaggaaccctcacattagttcttgccgagttcaggtgtttgtacctgagcctaaggatgcctttatgagagctctaatcagtttcgatggaagattgcatttagaagcagcaaaagctttggagcagattgaaggaaaggtgttacctggatgtttatcatggcaaaagataaagtgccagcggttgtttcatagctccttgatatttcctataccagtgtttcgtgtgattagggaacaactggatggagtacttgcaaggttcaggaatttaaaaggtgttgaatgcaacctggacaggacagttaatggttcccaccgagtgaagataactgcgaacgcaacaaagacagtggcagaagttagaagacctctggaggaactattgagagggaaaactgttgagcatgacagcctcacccctgcagttctccagctcctgatgtccaaggatggctttaatcttaaaaactcattgcagcaagagacaggaacctacattctttttgacaggcacaacttgaatttacgtgtgtttggttccccaaacaaggttgccttggctcatgacaagttgattcaatccctcctttctctccatgaagaaaagcagttaaaaatccatctgagaggaagggatttacctcctgatttaatgaagcaaatgattaagaattttgggccagatctccgtggactgaaagaaagggtacctggggtagatcttatgctcaacataaatcgccacgtaatcagtcttaatggtaggaaggagttgaaacccagggtagaggaaataatttttgagattgctcgttcaagccatcatttggttgggacatttgataatgatggtcctaattgcccgatttgcttgtgcgaggttgaggatgcataccggcttgaaggctgtggtcatgtgttctgccggttgtgtctggtggaacaatgtgaatctgctattagaaaccaaggcaccttcccaatatgttgtactaacaaggactgtggagatatcatcctgcttacggatctgagatctctcttagttggtgataagttggaggatcttttcagggcttctttgggagcttttgtgactacgagtgggggaacttacaggttttgcccatctccagactgcccctcaatttatcgagttgcagatcctggaactgctggtgagccatttgtttgtggggcttgttattcagagacatgtaccaggtgccacttagagtatcatccatacctttcatgcgagagatataaggagttcaaggaagatccggattcatctctgatacagtggtgcagagggaaagacgaagttaagagttgtttggcgtgtggatatgtaattgagaaggtggatgggtgcaaccatgttgagtgcaagtgtggaaaacatgtgtgctgggtttgcttagagttcttcagcgctagtgatgaatgctatagccatctgagaaatgttcacaagaccatcatataatagccatttgtccactatttttccgagatatgtaaatttagcgtagcggtatataacactgtatatggaattagcaaaatgtacagttttcttaaactattatatatatatatatatatatatatatatatatatcgtaactgttttgcttcttcacctgtatatctaatataagttgcatagtgtatgttgcttgtgacttttctgcaatgtatgcttatttgttttttcaaaacagttcaataaggctgctgcaactgtattcatatattaaattagc

SEQ ID NO: 7640 - DNA, 2295 bp, Glycine max
cacctaaccccagtcagattctaaccccggttgggtttatataaagcgagtgcaattcagaaactctaccgggatgtgaaactactcatcactcactccaaacccaccacaccaccattattcatatctcattctctaacctttcactattccctctcattcactctctagctagtttcctcatcatcgtagaagaaccaatacttgtactctctcttactttttaaccatgtagaatgattcacctaaggaaaaattagtagcttcttgttgtgctttttattttgttttgttttgtgtagagataaatctgtttggtattgttttgtgttttatgaattatttgatgggtgaagagggagaagaagtggtgagaaagcaaggacaaaggggtgttgatggagataaatggtacttgtatagctgcttacaagactgtaaatattggtgctgtaatttaatacacgagactagcagttctttttcgatggttccttttgagtgaaaaaaaccttgtcttctcatcagctttctttggagagatcttaaagacgacattgactgctaacaacaataaagtggatcaatcattaaaggcttacttcttcttcttcttcttcttcttcttcttctaacaacaataagatcccatctttcccactcatgaagagacttaacagctcagattcttccactgccctcatgacaatttttccatcatcatcaacagaggaacatagtccgaggaacagccaccacatgtatggcagggagttccgatcgatgttggacggactcgacgaggaagggtgtgttgaagaaccggggcatcaatctgagaagaagcgtcgactaagtgtggaacaagtgaaggctttggagaagaactttgaggttgaaaacaagcttgaacctgagaggaaggtcaagcttgcccaagaacttgggttgcaacctagacaagtagccgtttggttccaaaaccgccgagccagatggaaaaccaaacaattggagagagattatggtgtcctcaaagccaattatgatgctcttaagcttaactttggcaccctcaatcaggacaacgaagccttacgaaagcagataaaggaattgaaatcgaggctgctgcaagaagagaacacagcaggaagcggtgtttcggtgaaggaagaagagataacaacgatgcctgcagactcagaagagaaaacgatggaacaaagtaagagtgacccaccttctgaaacctcgaacattaatcctagttcggagtcgtcggaggaggaccacttgaattacgaatgtttcaacaacaacagcgacgactgtgtcgtcggaggatccgccgcagcatcgctcttgcaagtggacttcatgaaagacggttcttccgacagcgacggatcaagcgcgatcttgaacgaagacaccatgtacttgccgtcttcgatgaactgttttcagttccagaaaccgtatcatcacgcgcagtacgtgaagacggaggagcacaatttcttgagcgccgatgaggcctgcaatttcttctccgatgaacaagcaccgaccctgcaatggtactgtccagaacagtggagctgagatagaagaaacatgggaaaattggaaaccgctttcagaaatttttgtttaatatgttgcacggttgtgttgaacacagctcattgaggtaaaagttgtaaaaaaaggttgccacttgccaacagaggctgcttgaaggtagaaaatgaaacactgtgcagaagatagagttacgaaagagagaacagagatcaatggctgcatggcgtggggtcggagatgaaggatgacgattaaggttaattattactctcgatcgtgggtaatatcaataattattcaatcgtaaagcaaaccatgctgtaaaaaacaaatttcaattcaagtatagaataacgatgtagtactttatcaaacagaaaacgaaaaaaaaaattataaatctgttaaacaatatccttttgcctcactgaactcagtttactagtgtttatgattgattatccttttcctgtaaaagtatttttttttcaccaacaattgctactaaactgaatttgagttggaggcaacatatgagttgttttttaatgttcatttccattgacattgtttattcattagtcgtgtcaagtaaaaatatttttgttattagtatatcattcaaataaaatttattttatcaacatattttaaaaaaaaaatcaaacataaatcatattatactaaacattttttttatcaaac

SEQ ID NO: 7641 - DNA, 2244 bp, Glycine max
tataaagcgaccgcctgcaggaaaaccgggatgtgaaactactcatcactcactccaaacccaccacaccaccattattcatatctcattctctaacctttcactattccctctcattcactctctagctagtttcctcatcatcgtagaagaaccaatacttgtactctctcttactttttaaccatgtagaatgattcacctaaggaaaaattagtagcttcttgttgtgctttttattttgttttgttttgtgtagagataaatctgtttggtattgttttgtgttttatgaattatttgatgggtgaagagggagaagaagtggtgagaaagcaaggacaaaggggtgttgatggagataaatggtacttgtatagctgcttacaagactgtaaatattggtgctgtaatttaatacacgagactagcagttctttttcgatggttccttttgagtgaaaaaaaccttgtcttctcatcagctttctttggagagatcttaaagacgacattgactgctaacaacaataaagtggatcaatcattaaaggcttacttcttcttcttcttcttcttcttcttcttctaacaacaataagatcccatctttcccactcatgaagagacttaacagctcagattcttccactgccctcatgacaatttttccatcatcatcaacagaggaacatagtccgaggaacagccaccacatgtatggcagggagttccgatcgatgttggacggactcgacgaggaagggtgtgttgaagaaccggggcatcaatctgagaagaagcgtcgactaagtgtggaacaagtgaaggctttggagaagaactttgaggttgaaaacaagcttgaacctgagaggaaggtcaagcttgcccaagaacttgggttgcaacctagacaagtagccgtttggttccaaaaccgccgagccagatggaaaaccaaacaattggagagagattatggtgtcctcaaagccaattatgatgctcttaagcttaactttggcaccctcaatcaggacaacgaagccttacgaaagcagataaaggaattgaaatcgaggctgctgcaagaagagaacacagcaggaagcggtgtttcggtgaaggaagaagagataacaacgatgcctgcagactcagaagagaaaacgatggaacaaagtaagagtgacccaccttctgaaacctcgaacattaatcctagttcggagtcgtcggaggaggaccacttgaattacgaatgtttcaacaacaacagcgacgactgtgtcgtcggaggatccgccgcagcatcgctcttgcaagtggacttcatgaaagacggttcttccgacagcgacggatcaagcgcgatcttgaacgaagacaccatgtacttgccgtcttcgatgaactgttttcagttccagaaaccgtatcatcacgcgcagtacgtgaagacggaggagcacaatttcttgagcgccgatgaggcctgcaatttcttctccgatgaacaagcaccgaccctgcaatggtactgtccagaacagtggagctgagatagaagaaacatgggaaaattggaaaccgctttcagaaatttttgtttaatatgttgcacggttgtgttgaacacagctcattgaggtaaaagttgtaaaaaaaggttgccacttgccaacagaggctgcttgaaggtagaaaatgaaacactgtgcagaagatagagttacgaaagagagaacagagatcaatggctgcatggcgtggggtcggagatgaaggatgacgattaaggttaattattactctcgatcgtgggtaatatcaataattattcaatcgtaaagcaaaccatgctgtaaaaaacaaatttcaattcaagtatagaataacgatgtagtactttatcaaacagaaaacgaaaaaaaaaattataaatctgttaaacaatatccttttgcctcactgaactcagtttactagtgtttatgattgattatccttttcctgtaaaagtatttttttttcaccaacaattgctactaaactgaatttgagttggaggcaacatatgagttgttttttaatgttcatttccattgacattgtttattcattagtcgtgtcaagtaaaaatatttttgttattagtatatcattcaaataaaatttattttatcaacatattttaaaaaaaaaatcaaacataaatcatattatactaaacattttttt

SEQ ID NO: 7642 - DNA, 1744 bp, Glycine max
gtctttgtaccttaggccggtaaagagaaccgagcgagtaaggctgcgtttgggtcgggttgaactttgaacttcgaagagtcttgatcgacgacgacgacgacgttgagcttctctcttcgttcaactcaatccggggtaagaagctggcaatagctgcagcatctgaataggaatggattatatctgtttttttgtcaccttcactgcgattgcgctcttagggtttgtctctgtagtgttttttgaagcatataaaagaagaaacaaccatcagcatattgaagttccggctatttttgaggatcctagctcgttgaaacaggttccttgcccacatattgttgatccagccacaaagtatatttctttgattatccctgcattcaatgaggagcataggcttccaggagctcttgaggaaactatgaattatcttcatcaacgtactttaaaggattcttcatttacatatgaggttgtaattattgatgatggaagtgctgatgagacaaaaagagtagcttttgaatttgtgaggaaatacacagtagacaaggtaagggtcatccttctaggaagaaatcacggcaaaggagaagcaatcagaaaaggaatgatgcattcacgtggtgaactacttcttatgcttgatgctgatggagcaactaaggtcactgacctagaaaagcttgaaaatcagattcaagctgttgccaaaagggaatatcaccatggagattcaagcgatagtgatcccagatttagaatatctgatatcccagctgctgtatttggctcaagagctcatctagaggagaaagctttagctacaaggaagtggtaccgcaattttttgatgaagggcttccatcttgtggttctcatggctgctggtcctggaatttgtgatacacagtgtggtttcaagatgtttactagggctgcagccaggaagcttttttcaaatgtacgcctaaaaaggtggtgcttcgatgttgagttagtctttctgtgcaagtggtttaggatctcaatttcagaaatttctgtgaattggtctgagattccaggatccaaggtgaatcttctgagtatacctaacatgctttgggagcttgtgctcatgtctgtggggtacaggactggtatgtggagaatttctaattctgcctgagtgagcgtccatgatcaacttaactgggaagagaagtggcattttcctatctaaacaagagtcacctcttacacgagaacatatgctctcatgctgggcttaagggacgatcatgcaatttttaaagtttgtaggactaaccataaccttccggattatttcccttcagtttgagatcacagaggctttcatcctttttacttttagtattgctatttctactaggtaaaaatatattcaacaaagtatgttgttactgttggctgggaatagtttttaatcacattggtttttatttttcttaatcaaaatattctatagataacttttcattcctttcgtcccatttgaaagacattgtttagtattggtgagttgttgatgctttttgttcatctctcctggaagtaaatgttatggctgctgcagattgtgttaatatcgtgttagcaaagctgtgtactgttcccataaacacaagaagctgaaaccctgctttatttcgtgcaattctcatagctcttgcacatattacttgagaataaaaactacaaaattcacacatgt

SEQ ID NO: 7643 - DNA, 1735 bp, Glycine max
ccttaggccggtaaagagaaccgagcgagtaaggctgcgtttgggtcgggttgaactttgaacttcgaagagtcttgatcgacgacgacgacgacgttgagcttctctcttcgttcaactcaatccggggtaagaagctggcaatagctgcagcatctgaataggaatggattatatctgtttttttgtcaccttcactgcgattgcgctcttagggtttgtctctgtagtgttttttgaagcatataaaagaagaaacaaccatcagcatattgaagttccggctatttttgaggatcctagctcattgaaacaggttccttgcccacatattgttgatccagccacaaagtatatttctttgattatccctgcattcaatgaggagcataggcttccaggagctcttgaggaaactatgaattatcttcatcaacgtactttaaaggattcttcatttacatatgaggttgtaattattgatgatggaagtgctgatgagacaaaaagagtagcttttgaatttgtgaggaaatacacagtagacaaggtaagggtcatccttctaggaagaaatcacggcaaaggagaagcaatcagaaaaggaatgatgcattcacgtggtgaactacttcttatgcttgatgctgatggagcaactaaggtcactgacctagaaaagcttgaaaatcagattcaagctgttgccaaaagggaatatcaccatggagattcaagcgatagtgatcccagatttagaatatctgatatcccagctgctgtatttggctcaagagctcatctagaggagaaagctttagctacaaggaagtggtaccgcaattttttgatgaagggcttccatcttgtggttctcatggctgctggtcctggaatttgtgatacacagtgtggtttcaagatgtttactagggctgcagccaggaagcttttttcaaatgtacgcctaaaaaggtggtgcttcgatgttgagttagtctttctgtgcaagtggtttaggatctcaatttcagaaatttctgtgaattggtctgagattccaggatccaaggtgaatcttctgagtatacctaacatgctttgggagcttgtgctcatgtctgtggggtacaggactggtatgtggagaatttctaattctgcctgagtgagcgtccatgatcaacttaactgggaagagaagtggcattttcctatctaaacaagagtcacctcttacacgagaacatatgctctcatgctgggcttaagggacgatcatgcaatttttaaagtttgtaggactaaccataaccttccggattatttcccttcagtttgagatcacagaggctttcatcctttttacttttagtattgctatttctactaggtaaaaatatattcaacaaagtatgttgttactgttggctgggaatagtttttaatcacattggtttttatttttcttaatcaaaatattctatagataacttttcattcctttcgtcccatttgaaagacattgtttagtattggtgagttgttgatgctttttgttcatctctcctggaagtaaatgttatggctgctgcagattgtgttaatatcgtgttagcaaagctgtgtactgttcccataaacacaagaagctgaaaccctgctttatttcgtgcaattctcatagctcttgcacatattacttgagaataaaaactacaaaattcacacatgt

SEQ ID NO: 7644 - DNA, 1639 bp, Cajanus cajan
cgggtaaacgagaactgagtaacggtgcgtttggtcgggttgaagtctcgatcgacgacgttgagcgttctcttctctgtctctgtctctctcttcattcaggtcaatctggggcaaggaactggcaatagctgcggcatctgaataagaatggagtttgtgtgtctttttgtcaccttcactgcgattgcggtcttagggcttgcttttgtagtcttctttgaagcatataagagaagaaacaaccatgagcatattgaagttccggctattttcgaggatcctagctcattgaaacaggttccttgcccacatattgttgatccagccacaaagtatatttctttgattattcctgcattcaatgaggagcacaggcttccgggagctcttgaggaaacaatgaattatcttcaacaacgctcttcaaaggatccttcattttcatatgaggttttaattattgatgatggaagtgctgatgagacaaaaaaagtagcttttgaatttgtaaggaaatacacagtagacaaggtaagggtcatccttctaggaagaaatcatggcaaaggagaagcaatcagaaaaggaatgttgcattcacgtggtgaactacttcttatgcttgatgctgatggagctactaaggtcactgacctagaaaagcttgaaaatcagattcaagctgttgccaaaagggaatatcaccaaggagattctggtgatagtgatcccagatttagaatatctgatattcctgttgctgtatttggttcaagagctcatctagaggagaaagctttagctacaaggaagtggtaccgcaattttttgatgaagggcttccatcttgtggttctcatggctgctgggccgggaattcgtgatacacagtgtggtttcaagatgtttactagggctgcagccaggaagcttttttcaaatgtgcgattaaaaaggtggtgctttgatgttgaattagtctttctgtgcaaatggtttaggatccccgtttcagaaatttctgtgaattggtctgagattccaggatctaaggtgaatcttctgagtatacctaacatgctttgggagcttgtgctcatgtccgtggggtacaggactggtatgtggagagtttctaattctacctgagctttgatgatcaacttagctgggaagaagaggggcattttccctatcaaaagattcacctcttatacgagaacatatactctcatgccaggcttaagggacaataatgcaatatttaaagtttgtaggactaaccataaccttccggattacgccattcagtttgggatcatggaggcttttgtcttttttttagtattgctatttataggtaaaaatatattcaacaaattatgttgttactcttggctgggaatagtttctaatcaatcactttgctttgtatttttcttgatcaaaattttctatagataatttttattcctctcgtcccatttgcaagacgttatcaaatattggcattttgttgatggctgctgtagattgtgtttgcaagctgtgtattgttcccataaaacgagaagctgaaacccttgttcattttttgggttgcgcactgtataatacgatgactgctgtgttgttt

SEQ ID NO: 7645 - DNA, 1505 bp, Phaseolus vulgaris
gtttgggtcgggttgaagttttgatcgacgacgacgttgaggtgctctctctctctgttcaactcaatttggggcaaggaactggcagtagctgcggcatctgaaaaagaatggagtatacgtgtcttttgatcaccttctctgcgactgcgatcttagggtttgtctttgtagtgttttttgaagcatataagagaagaaacaaccatcagcatattgaagttccagctatttttgaggatcctagctcattgaaacaggttccttgcccacatattgtcgatccagccacaaagtatatttcattgattattcctgcattcaatgaggaggacaggcttccaggagctcttgatgaaactatgaattatcttcaacggcgtactttaaaggatccttcatttacatatgaggtaataattatcgatgacgggagtgccgatgatacaaaaagagtagcttttgaatttgtgaggaaatacacagtagacaaggtaaggatcatccttctaggaagaaatcatggcaaaggagaagcaatcagaaaaggaatgttgcattcacgtggtgaactacttcttatgcttgatgccgatggagcaactaaggtcaccgacctagaaaagcttgaaaatcagattcaagctgtggccaaaagcaaatatcaccagggagattcaagcaatactgatcctagatttagaatttctgatatcccagttgctgtatttggttcaagagctcatctagaggaaaaagctatagctacaaggaagtggtaccgcaattttttgatgaagggcttccatcttgtggttctcttggctgctggtcctggaattcgtgatacacagtgtggtttcaagatgttcactagggctgctgccaggaagcttttttcaaatgtccacttaaaaaggtggtgctttgatgttgaattagtctttctgtgcaaacgatttaagatcccaatttcggaagtttctgtgaattggtctgagattccaggatccaaggtgaatcttctaagtatacccaacatgctttgggagcttgtgctcatgtctgtagggtacaggactggtatgtggagaatttctaactctacttgagcttccatgatcaactaaactaggaagaaatgggacattttcctatcaaacgaagagtcatgtatttctagggaacatgtactctcataccggctcaagggagaataatgtgatatttaatgtttgtagccttccggttatgccgttcagtttctggtcatggaggctttcggcttctttgtttttctagttttgcgatttgtactaggtaacagtttgttcaactaattattctgttatttttggctgggaatagtttctaatcacatgttgatgcttttttgttcatctctcctcgtaaaacaagaaggtgaaacccttgtctcatgcattggctaatacactgacgctgctagtgtttggtttcacagaatctgagacccttgttttatt

SEQ ID NO: 7646 - DNA, 1688 bp, Phaseolus vulgaris
gtagctttgtagctagggcccgcaaataagaggaggaaaagttcggttaaacgaaagagcaccgatcaaataacggtctgtttgggtcgggttgaagttttgatcgacgacgacgttgaggtgctctctctctctgttcaactcaatttggggcaaggaactggcagtagctgcggcatctgaaaaagaatggagtatacgtgtcttttgatcaccttctctgcgactgcgatcttagggtttgtctttgtagtgttttttgaagcatataagagaagaaacaaccatcagcatattgaagttccagctatttttgaggatcctagctcattgaaacaggttccttgcccacatattgtcgatccagccacaaagtatatttcattgattattcctgcattcaatgaggaggacaggcttccaggagctcttgatgaaactatgaattatcttcaacggcgtactttaaaggatccttcatttacatatgaggtaataattatcgatgacgggagtgccgatgatacaaaaagagtagcttttgaatttgtgaggaaatacacagtagacaaggtaaggatcatccttctaggaagaaatcatggcaaaggagaagcaatcagaaaaggaatgttgcattcacgtggtgaactacttcttatgcttgatgccgatggagcaactaaggtcaccgacctagaaaagcttgaaaatcagattcaagctgtggccaaaagcaaatatcaccagggagattcaagcaatactgatcctagatttagaatttctgatatcccagttgctgtatttggttcaagagctcatctagaggaaaaagctatagctacaaggaagtggtaccgcaattttttgatgaagggcttccatcttgtggttctcttggctgctggtcctggaattcgtgatacacagtgtggtttcaagatgttcactagggctgctgccaggaagcttttttcaaatgtccacttaaaaaggtggtgctttgatgttgaattagtctttctgtgcaaacgatttaagatcccaatttcggaagtttctgtgaattggtctgagattccaggatccaaggtgaatcttctaagtatacccaacatgctttgggagcttgtgctcatgtctgtagggtacaggactggtatgtggagaatttctaactctacttgagcttccatgatcaactaaactaggaagaaatgggacattttcctatcaaacgaagagtcatgtatttctagggaacatgtactctcataccggctcaagggacaataatgtgatatttaatgtttgtagccttccggttatgccgttcagtttctggtcatggaggctttcggcttctttgtttttctagttttgcgatttgtactaggtaacagtttgttcaactaattattctgttatttttggctgggaatagtttctaatcacatgttgatgcttttttgttcatctctcctcgtaaaacaagaaggtgaaacccttgtctcatgcattggctaatacactgacgctgctagtgtttggtttcacagaatctgagacccttgttttatttgttgttggtttggttgttacttcttaaactcacttctcgatgtgaaaacaaacatgggagacattggtggatggcttggctttgttaattgtgtaatcccgtg

SEQ ID NO: 7647 - DNA, 1515 bp, Lupinus angustifolius
agtggagtaagttcagaaattgtgaaatcaaaatctgaatctgagtttgttttccgttttatcggtgcctctcacccacaccaccggcggcgccaccacccactctgccacgggaagcatattgggaatagctgcagcatcttaatcagtgcctaaacgaatggagtatatatgtcttcttgctaccttctttgtgattgtagtcttaggatttgtctctgtaatcttcttcgaagcatatagaagaagaaacaaccatgagcatgttgcagttccggccatttttgaggatcctaattcgttgaaacaggttccttgcccacacgttgttgatccagcagcaaagtatatttctttaataattcctgcattcaatgaggagcataggcttcctggagctcttgatgaaacaatgaattatcttcaacaacgagcctcaaaggatccttcattttcatatgaggtcgtaattattgatgacggaagtgctgatgggactaaaaaagtagcttttgaatttgtaaagaaatacactgtagacaaggtaagggttatccttcttggaagaaatcatggcaagggagaagcaatcagaaaaggaatgctgcattcacgtggtgaactactacttatgcttgatgctgatggagccactaagatcactgacctagaaaagcttgaaaaccagattcacgctgttgccaaaaaggaatttaacagtagagattcaagtgctagtgatcctagctttagaatatctgatatccctattgctgtatttggttcaagagctcatctagaggagaaggctttggcttcaaggaagtggtaccgcaatattttgatgaaggggttccatcttgtggttcttttggctgctggtcctggaattcgtgatacacagtgtggtttcaagatgtttacgagggctgcagcaaggaagctcttttcaaatgtccgcctgaaaaggtggtgctttgatgttgaattagtgtttctttgcaaatgttttcggatcccaattttcgagatttcggtcaattggtccgagattccaggatccaaggtcaatcttctgagtatacctaacatgctttgggagcttgtgctcatgtctgtggggtacagaactggtatgtggagaatttccaattctacctgatcttccatgatcaattataaccatgaatagtagctgcattaccctagattattctaccatgcaaggttttgaaggacagtaatgaagtatttaaaatttgtaggactaaccttaaccttcagtgttttaccatttaggtttggggtcatggaggcctcattttttaataccatttgaacaattaatactgttactgtttgaagagtaaagcttcttgtcacattactttgtatttgttttcttatgcaatcaaaatgttctatagctaaattttcattcctttgatgtttgtgaaatacattattcaacactggtgaatagttaatgctttttgcaaatcacacctacatgta

SEQ ID NO: 7648 - DNA, 1819 bp, Cicer arietinum
caagcccaatctacttccttttgaagaggcccgtcaactcaaacatctcaatcaaataaaataaaacagcagcggctgttttacacttgtaaatctgaaacaacttggagtcgcaccactgaactactcaactggccagaaaacgctgccggagttcgtcgtcggccaccgtcataaacggtggaagatattaggaataactacaggatctcatagagtagagaaaaggaatggagtttatgtgtttaattgtgaccctctctgtgattttggtcttaggacttgtctttgtaatattcctagaagcgtatagaagaagaaataaccaccagcacattgaagttcctgctatttttgaggatcctaattcattgaaacaggttccttgcccacacgtagttgatcctgcctcaaagtatatctctttgataattcctgcattcaatgaagagcataggctccctggtgcactcgaggaaactatgatttatctgcaacaacgtgcttcaaaggatccttcattttcatatgaggttgtgattgtagatgatggaagtgttgatgggactaaaagagtagctttcgaatttgtaaggaaatacacagtagacaaggtaagggtcatccttcttggaagaaatcatggcaagggagaagcaatcagaaaagggatgttgcactcacgcggtgagctacttctcatgcttgatgctgatggagcaactaagatcaccgacctagaaaaacttgaaaatcagattcgagctgttgctgagaaggaatttcaccatggagattcaagtggtaatgatcctagctttagaatatctgacacccctgttgttgtatttgggtcacgagctcatctagaggagaaagctttggctacaaggaagtggtaccgcaattttttgatgaaggggttccatcttgtggttctcttggctgctggtcctggaattcgtgatacacagtgtggtttcaagatgtttactagggctgcagctaggaaacttttttcaaatgtccgcttgaagaggtggtgctttgatgttgagttagtctttctgtgtaaatggttccggatcccaatttcagaaatttctgtaaattggtctgagatcccggggtccaaagtgaatcttctgagtataccaaacatggtttgggagcttttgctcatgtctgtaggctacaggattggcatatggagaatttctaattctacctgagcttcaatgatcaattttgggaagaaaattgacattttctatccaaagtatttaaagtttgtaggactaaccataaccttccggattgtgctgtgttcaggatggggtcatggaggctttgatttttttcttttatactgttgttatatctactaggtaaatgtattcaacatttcatagttacttaccattgactgagaaaatatctaataacaagtttgtatttgttttcttagttagcatattctacagataacatttcattccttaggtgtcatttgaaagattatctaacaatggtaagttatttgatgcttaaactatgaaattcgtacacatatatgtaatatttcatattgtatttttatgtaaccatttcattatttttacacttgcacttctgaagacagacaacatttgcagtttagaacttgtgcaatgtggcaaatcttgatttgtttgtttatttaagcagccagcgtaagtgaaatttaatagaatgaactactctgtactccttaaaaaagggttgtatattacaggcttgaatcttcgatgataaaaattgaataaaaagttttataaaa

SEQ ID NO: 7649 - DNA, 1622 bp, Trigonella foenum-graecum
gacccttttatcagaaacatcaagttatagtcgtcgcactgatctcaactcgccggaaaacgctaccggagttgctcatcagctgccggaaccagtgacaaactccgcaacaaggtggaagatattagggaagagatacagaattccatagagaagagaaaaggaatggagtttatatgtttaattgggactttcgctgtgattttggtgttagggtttttctttgtaatcttctttgaagcttatagaagaagaaataatcatcagcacattgaggttccggcgatttttgaggatcctaattcattgaaccaggttccttgcccacacgttgttgatcctgcttcaaagtatatctctttgataattcctgcatacaatgaggagcataggcttcctggtgctcttgaggaaactatgatttatctgcaacatcgtgcttcaaaggatccttcattttcatatgaggttgtaattattgatgatggaagtgttgatgggactaaaagagtagctttcgaatttgtgaagaaatacacagtagacaaggtaagggtcatccttcttggaagaaatcatggcaagggagaagcaattagaaaaggaatgttgcactcacgaggtgaactacttctcatgttggatgctgatggagcaaccaagataaccgacctagaaaaacttgaaaatcagatccgagctgttgccaaaaaaggatggagattcaagtggtagtgattctagctttagaatatctgacacccctgttgttgtgtttgggtcacgagctcatctagaagagaaagctttggctacaaggaagtggtaccgcaattttttgatgaaggggtttcatcttgtggttctaatggctgctggtcctggaattcgtgatacgcagtgcggtttcaagatgtttactagggctgctgcgaggaaactattttcaaatgtccgcttgaaaaggtggtgctttgatgttgaattagtctttttgtgtaaatggtttcggatcccagtttcggagatttctgtaaattggtccgagatcccgggatcaaaggtgaaccttctgagtataccaaacatggtttgggagcttctgctcatgtctgttgggtacaggatcggtatatggagaatttctaattccatatgagtttcagtgagcaattttgggaagaaaactggcattttcatatccaaagagtgacatcttaatgatacatttaaggtttgtaggactaaccataaccttccggattgtgctgttcagatatggtcatcgagggtttgggttttttcatttttcactgttgttatttatactaggtaaatgtattaaacaatcaatagttaccattgactgagaaaagcatctgatcacaagtttgtatttgttttcgtattaagttaacatattctacaaataacttttcattccttaggccatctgaaagagaatatataacactggtgagttattttgatgctttttttctcatcactcctagcagtaaatggtatgtgtatgtctgtctctaaactgttgtaattcatgttaacgtaactgtgtattgctttcataaaacaagaagctgcaggattatcttttgggttgc

SEQ ID NO: 7650 - DNA, 1680 bp, Medicago truncatula
agtcaaataaaaaaaaacagcagcttccactttgaccctttgatcagaaacaacaagatagagtcgtcgcactgatctcaactcaccggaaaacgttgccggagttgatcctcagctaccggaaacagacagaaacaccgccacaaggtggaagatatttagacagagatacagaatttcgtgataaggaatggagtttttgtgtttaattgtgactttcgctgtgactttgatgttagggtttttcttggtcatctttgttgaagcttatagaagaagaaataatcatcagcacattgaagttccggcgatttttgaggatcctaattcattgactcaggttccttgtccacatgttgttgatcctgcctcaaagtacatctctttgataattcctgcatacaatgaggagcataggcttccaggtgcccttgaggaaactatgatttatctgcaacatcgtgcttcaaaggatccttcattttcatacgaggttgtaattgttgatgatggaagtgtcgatgggacaaaaagagtagcttttgaatttgtaagaaaatacacagtagacaaagtaagggtcatccttcttggaagaaatcatggcaagggagaagcaatcagaaaaggaatgttacactcacgcggtgaactacttctcatgcttgacgcagatggagcaaccaagatcaccgacctagaaaaacttgaaaatcagattcgagctgttgctaaaaaggatggcgattccagtggtagtgattctagctttagaatgtctgacacccctgttgttgtatttggttcacgagctcatctagaggagaaagctttggctacaaggaagtggtaccgtaattttttgatgaaggggttccatcttgtggttctattggctgctggtcctggaattcgtgatacacagtgtggtttcaagatgtttactagggctgcagctaggaaactcttttcaaatgtccgtttgaaaaggtggtgctttgatgttgaattagtctttttgtgtaagtggtttcggatcccaatttcggagatttctgtaatttggtctgagatcccgggatcaaaggtgaaccttctgagtataccaaacatggtttgggagcttctgctcatgtctgtaggttacaggattggcgtatggagaatttctaattccacatgaacttcaatgatcaattttaggaagaaaaatggcattttcatatccaaagagtgacatcataatgacacatttgaagtttgtaggactaaccataatcttccggattgtgctgttcagatcgggtcattgagggtttgggttttttaattttttactgttatttatactagataaatgtattaaagaatctttagttaccatcgactgagaaaagcatctgatcacaagtttgtatttcttttcttattaacatagtctacatataacatttcattccttaggccatttgaaaaaaaaatgtccaacactggtgagttattttgatgctttctgtgctcatcattctggggtagtaaatgtttcgactgtctgtactctgtagactgttgcacttcatgttaaagacgctgcttattgctttcatataacaataagccgcatgattatcttttgggttgttaattgtatgatacacaaacaatatacgattgatttat

SEQ ID NO: 7651 - DNA, 1659 bp, Medicago truncatula
aaaaaaaacagcagcttccactttgaccctttgatcagaaacaacaagatagagtcgtcgcactgatctcaactcaccggaaaacgttgccggagttgatcctcagctaccggaaacagacagaaacaccgccacaaggtggaagatatttagacagagatacagaatttcgtgataaggaatggagtttttgtgtttaattgtgactttcgctgtgactttgatgttagggtttttcttggtcatctttgttgaagcttatagaagaagaaataatcatcagcacattgaagttccggcgatttttgaggatcctaattcattgactcaggttccttgtccacatgttgttgatcctgcctcaaagtacatctctttgataattcctgcatacaatgaggagcataggcttccaggtgcccttgaggaaactatgatttatctgcaacatcgtgcttcaaaggatccttcattttcatacgaggttgtaattgttgatgatggaagtgtcgatgggacaaaaagagtagcttttgaatttgtaagaaaatacacagtagacaaagtaagggtcatccttcttggaagaaatcatggcaagggagaagcaatcagaaaaggaatgttacactcacgcggtgaactacttctcatgcttgacgcagatggagcaaccaagatcaccgacctagaaaaacttgaaaatcagattcgagctgttgctaaaaaggatggcgattccagtggtagtgattctagctttagaatgtctgacacccctgttgttgtatttggttcacgagctcatctagaggagaaagctttggctacaaggaagtggtaccgtaattttttgatgaaggggttccatcttgtggttctattggctgctggtcctggaattcgtgatacacagtgtggtttcaagatgtttactagggctgcagctaggaaactcttttcaaatgtccgtttgaaaaggtggtgctttgatgttgaattagtctttttgtgtaagtggtttcggatcccaatttcggagatttctgtaatttggtctgagatcccgggatcaaaggtgaaccttctgagtataccaaacatggtttgggagcttctgctcatgtctgtaggttacaggattggcgtatggagaatttctaattccacatgaacttcaatgatcaattttaggaagaaaaatggcattttcatatccaaagagtgacatcataatgacacatttgaagtttgtaggactaaccataatcttccggattgtgctgttcagatcgggtcattgagggtttgggttttttaattttttactgttatttatactagataaatgtattaaagaatctttagttaccatcgactgagaaaagcatctgatcacaagtttgtatttcttttcttattaacatagtctacatataacatttcattccttaggccatttgaaaaaaaaatgtccaacactggtgagttattttgatgctttctgtgctcatcattctggggtagtaaatgtttcgactgtctgtactctgtagactgttgcacttcatgttaaagacgctgcttattgctttcatataacaataagccgcatgattatcttttgggttgttaattgtatgatacacaaacaatata

SEQ ID NO: 7652 - DNA, 1399 bp, Arachis hypogaea
aaagtcttcatctccaaaacttgatcgaagttccaaaccatcgttgagctctctctgttagttaactttctcttcgttcagctcaatctggaatggaggagtacatgtatcttcttgtcaacttcttcctgattgcggtcgtagggttcatcttcgtagtcatcgttgaagcatatagaagaagaaacaatcatctgcatgttgaagttccggcgatttttgaggatcctaactcgttgaaacaggttccttgcccacatgttgttgatccagcagaaaagtacatgtccttgataattcctgcattcaacgaggagcataggcttcccggagctcttgaagaaactatgaattatcttcaacaacgtgcttcaaaggatccttcattttcctatgaggttgtcattattgatgatggaagtgctgatgggactaaaagagtagcttttgaatttgtaaggaaatacacagtagacaaagttagagttatccttcttggaagaaatcatggcaagggagaagcaataagaaaaggaattctgcattcacgtggtgagctaattcttatgcttgatgctgatggagcaactaaagtcaccgacctagaaaagcttgaaaatcagattcaagttattgctaaaaagcaatttcaacaaggaaaatcaagccctagtgatccaacctttagagtatctgatattcctgttgctgcatttggttcacgagctcatcttgaagagaaggctttggctacacgaaagtggtaccgcaattttttgatgaaggggttccatcttgtggttctcttggctgctggtccaggagttcgtgatacacagtgtggtttcaaaatgtttactagggcagcagcaaggaggcttttttcaaatgtccgcttgagaaggtggtgttttgatgttgaattagtctttctgtgcaaatggtttaggatcccaatttcagaaatttctgtgaattggtctgaaattccaggatccaaggtaaatcttatgagcatacctaacatgctttgggagcttgtgctcatgtctgcgggatacaggactggtatgtggagaatttctggttctacctaagctttgatgatcgattttaaccgggaagaatagcggcattttattatcaaaagaagagtgaccccttttctgggagagcatattatacttccatgcttgaccttgaagaacaaagaacagaatgcaatatttaagttttaggactaaccataaccctcaggatttttacctattagattggggtcatggagactctggctcattttgctgttgcgtactgggtagatatatttaacaattcatgttactattgaatgggaaaacgaaaagggttattatcacgtgagtttgtacttgtaata

SEQ ID NO: 7653 - DNA, 3190 bp, Glycine max
cttcgatctcgtgttcaaatcccgagttccatttgggatgaacctattttgtttcccacctcatttctgaacagtttttggtttgggttgcgtggcgtcgcgttgcggcgagggactcaccttcttcttcttcttcctcttctcgttattctctcgtccattctatggagcttcagaggcgtccagatcagtgcctcccggagaggaaagggcagaagaggaagctcgaggaggaattcgatgacgacccacagatctcccctcctcccaccggcgacgctcgcgacgccctcctctccgacgttaaggaacaggtttccctcctcgattccactttctcctggaacgaacccgatcgtgccgccgccaagcgcgccacgcacgccctcgccgatctcgccaaaaacgaggaagtcgttaacgtgattgttgaaggaggcgccattccggcgttggttaagcatcttcaagtgcctcctctgcctctgcccgaaaccgaccgtgtgccaagaccaatgccgtttgagcacgaggtcgagaaagggagtgctttcgcgcttggacttctcgctgtcaagccagagcatcaacaactcattgttgacagtggtgccttaaaacatcttgttgatcttttgaagaggcataagaatggcttaacatctcgtgccattaatagtctcattcgtagggctgcagatgccatcactaatcttgctcacgagaacagcagcattaagactcgtgtcaggaaggaaggcgggattccaccgcttgttcatttgcttgaatttgcggatacaaaggtgcaaagagcagctgctggtgcactgcgaacccttgcttttaaaaatgatgaaaataaaaatcagattgttgaatgcaatgcccttccaactctgattctaatgctttgctcagaagatgctgctattcattatgaagcggttggtgtcattggaaatctggtccactcttcccctgatataaagaaagaagttcttcttgctggagccttgcaacctgttattggactacttagctcctgttgctctgaaagccagagggaagcagcattgttacttggacagtttgcagcaactgattcagactgcaaggttcacattgttcagagaggtgctgtccgacctctgatagagatgcttcagtcctctgatgttcagctaaaagaaatgtctgcctttgcattggggagattagcccaggacacacataaccaagctggtattgcacacaatggtggcttgatgccattactgaagcttcttgactccaaaaatggctctttgcaacataatgctgcatttgctctttatggccttgcagataatgaggataatgtgtccgattttattagggtaggtggaattcagagactgcaggatggagagtttattgttcaggcaactaaagattgtgttgcaaagacattgaaaagattagaagagaagattcatggccgagtgctgaaccatttgttatatctcatgcgagtttcagaaaaggcttttcaaagacgagttgctttaactcttgctcacctttgttctgcagatgatcaaagaaaaatatttattgattataatggtttggagttgcttatggggcttcttggctcttataaccccaagcaacagcttgatggagctgtggctttatgcaagttggccaataaagctatgactctgtctcctgtagatgccgcacccccatctccaacaccccaggtctatttgggagagcagtatgtaaacaatgttaccttgtccgacgttacatttttggttgaaggcaaacgattttatgctcacagaatctgcctccttgcatcttcagatgcatttcgtgcaatgtttgatggtggttatagggagaaggaggcacgagacatagagattccaaacattagatgggaggtttttgagccgatgatgagatttatatacactggatcagttgatatcactcttgatattgcccaagatctcctccgagcagctgatcaatatcttttagaaggacttaagagactctgtgagtacacaattgcacaggatatatcactggagaatgtgtcaagtatgtatgaactttcagaggcctttaacgctatatcattgaggcacacatgcatcctttttatcttggagcactatgataaattgagtggaaagccaggacactctcatctgattcagcgtataatacccgagatccagaattactttgttaaagcccttacaaaggccaattccaacatcctgccgtaatgcgctgttatattattgacatctaaccagttgcgatgtacataatgtggttgatgttctttttgttgagcctgcgaagtaaatctcctggatcaagtacagcatggcttaaaaaatatatctaacatcaggtcatgtacgttcatttctgatgctgtgctagtcccgtctagctgtaacgtcattgtcttagatatagcaaaaatgaccttcacgaacattgtttttttctcctgcaatattgtgatggttctggcttgatagttctctttctcaattgatttggcattacaattgttgagtttatgagtagtataggtttcccaagcatctaatgtatatatgacaattagatagttgtttgtgattgctgatgaatgtattgtaaattaaatgcaaatgcatttaaagaattcgtcatttaagccatgctgaattcagttgctgcttataaaaattggctctttgtctatgcagtcaagcggcaacggaatcgaggtttcacgtacaagaattgctatgggtccctaccaacttttagaattcatggaaaaaattattttaccccagttcaaattcaccacatcctctcttcaatgtaatttttttagaatcatggttttatgtacaaaatctttgctggactagattgtggcagggatgagtgatttcacaaccatccctgattaagggaagcgcgattgtggaatcctctctaattgctaataattccccaaagctttgctgctaataattccccaaagctttgcctacgttcacttgattcaagtttaagcatagaaactatattaattaattcacggtactcgttgcaccatagcgctgtatgaattttaatctgtacttgacaatctaaggtgactgcatcacgtaaactg

SEQ ID NO: 7654 - DNA, 3110 bp, Glycine max
ctcgtgttcaaatcccgagttccatttgggatgaacctattttgtttcccacctcatttctgaacagtttttggtttgggttgcgtggcgtcgcgttgcggcgagggactcaccttcttcttcttcttcctcttctcgttattctctcgtccattctatggagcttcagaggcgtccagatcagtgcctcccggagaggaaagggcagaagaggaagctcgaggaggaattcgatgacgacccacagatctcccctcctcccaccggcgacgctcgcgacgccctcctctccgacgttaaggaacaggtttccctcctcgattccactttctcctggaacgaacccgatcgtgccgccgccaagcgcgccacgcacgccctcgccgatctcgccaaaaacgaggaagtcgttaacgtgattgttgaaggaggcgccattccggcgttggttaagcatcttcaagtgcctcctctgcctctgcccgaaaccgaccgtgtgccaagaccaatgccgtttgagcacgaggtcgagaaagggagtgctttcgcgcttggacttctcgctgtcaagccagagcatcaacaactcattgttgacagtggtgccttaaaacatcttgttgatcttttgaagaggcataagaatggcttaacatctcgtgccattaatagtctcattcgtagggctgcagatgccatcactaatcttgctcacgagaacagcagcattaagactcgtgtcaggaaggaaggcgggattccaccgcttgttcatttgcttgaatttgcggatacaaaggtgcaaagagcagctgctggtgcactgcgaacccttgcttttaaaaatgatgaaaataaaaatcagattgttgaatgcaatgcccttccaactctgattctaatgctttgctcagaagatgctgctattcattatgaagcggttggtgtcattggaaatctggtccactcttcccctgatataaagaaagaagttcttcttgctggagccttgcaacctgttattggactacttagctcctgttgctctgaaagccagagggaagcagcattgttacttggacagtttgcagcaactgattcagactgcaaggttcacattgttcagagaggtgctgtccgacctctgatagagatgcttcagtcctctgatgttcagctaaaagaaatgtctgcctttgcattggggagattagcccaggacacacataaccaagctggtattgcacacaatggtggcttgatgccattactgaagcttcttgactccaaaaatggctctttgcaacataatgctgcatttgctctttatggccttgcagataatgaggataatgtgtccgattttattagggtaggtggaattcagagactgcaggatggagagtttattgttcaggcaactaaagattgtgttgcaaagacattgaaaagattagaagagaagattcatggccgagtgctgaaccatttgttatatctcatgcgagtttcagaaaaggcttttcaaagacgagttgctttaactcttgctcacctttgttctgcagatgatcaaagaaaaatatttattgattataatggtttggagttgcttatggggcttcttggctcttataaccccaagcaacagcttgatggagctgtggctttatgcaagttggccaataaagctatgactctgtctcctgtagatgccgcacccccatctccaacaccccaggtctatttgggagagcagtatgtaaacaatgttaccttgtccgacgttacatttttggttgaaggcaaacgattttatgctcacagaatctgcctccttgcatcttcagatgcatttcgtgcaatgtttgatggtggttatagggagaaggaggcacgagacatagagattccaaacattagatgggaggtttttgagccgatgatgagatttatatacactggatcagttgatatcactcttgatattgcccaagatctcctccgagcagctgatcaatatcttttagaaggacttaagagactctgtgagtacacaattgcacaggatatatcactggagaatgtgtcaagtatgtatgaactttcagaggcctttaacgctatatcattgaggcacacatgcatcctttttatcttggagcactatgataaattgagtggaaagccaggacactctcatctgattcagcgtataatacccgagatccagaattactttgttaaagcccttacaaaggccaattccaacatcctgccgtaatgcgctgttatattattgacatctaaccagttgcgatgtacataatgtggttgatgttctttttgttgagcctgcgaagtaaatctcctggatcaagtacagcatggcttaaaaaatatatctaacatcaggtcatgtacgttcatttctgatgctgtgctagtcccgtctagctgtaacgtcattgtcttagatatagcaaaaatgaccttcacgaacattgtttttttctcctgcaatattgtgatggttctggcttgatagttctctttctcaattgatttggcattacaattgttgagtttatgagtagtataggtttcccaagcatctaatgtatatatgacaattagatagttgtttgtgattgctgatgaatgtattgtaaattaaatgcaaatgcatttaaagaattcgtcatttaagccatgctgaattcagttgctgcttataaaaattggctctttgtctatgcagtcaagcggcaacggaatcgaggtttcacgtacaagaattgctatgggtccctaccaacttttagaattcatggaaaaaattattttaccccagttcaaattcaccacatcctctcttcaatgtaatttttttagaatcatggttttatgtacaaaatctttgctggactagattgtggcagggatgagtgatttcacaaccatccctgattaagggaagcgcgattgtggaatcctctctaattgctaataattccccaaagctttgctgctaataattccccaaagctttgcctacgttcacttgattcaagtttaagcatagaaactatattaattaattcacggta

SEQ ID NO: 7655 - DNA, 2779 bp, Cajanus cajan
cgtgttcaaatcccatatttcatttgtgctcacgctctcccctctcccacctcaattctgaacagtgtagcgtgagagagagagagagagagagggaccgtcaccttcttcttcttcttcctcttctcgttcttctctcgtcgatggagctgcaaagacgaccagatcagtgccttccggagaggaaagggcagaagaggaagctcgaggaggaattcgaagaggaccgacagatctccgcgcctcccaccggcgacgctcgcgacgccctcctctccgacgttcaggagcaggtttccgtcctcgattcaactttctcctggaaggaatcagaccgcgctgccgccaagcgcgccacgcacgccctcgccgatctcgccaaaaacgaggaagttgtgaacgtgattgttgaaggtggcgccattccggctttggttaagcatcttcaagcgcctcctctctccgaaaccgaccgcgtccagaggccattgccgtttgagcacgaggtcgagaaagggagtgctttcgcgcttggacttcttgccgttaagccagagcatcaacaactcattgttgagagtggtgccttaaaatatcttgttgatcttttgaagaggcataagaatgggttaacatctcgtgccattaatagtctcattcgtagggctgcagacgctatcactaatcttgctcatgagaacagcagcattaagactcgtgtcaggatggaaggtgggattccaccgcttgttcatttgcttgaatttgcggatacaaaggtgcaaagagcagctgccggtgcgttgcgaacccttgcctttaaaaatgatgaaaataaaaatcagatcgttgaatgcaatgccctgccaactctgattctaatgcttcgatcagaagatgctgctattcattatgaagcggttggtgtgattggaaatctggtccactcttcccctaatataaagaaagaagttcttcatgccggagccttgcaacctgttattggattacttagctcctgttgctctgaaagccagagggaagcagccttgttacttggacagtttgcagcaactgattcagactgcaaggttcacattgttcagagaggtgctgtccgacctctaatagagatgcttcagtcctctgatgttcagttaaaagaaatgtctgcttttgctttggggagattggcccaggacacacataaccaagctggtatagcacacaatggtggcttgatgccattactaaagcttcttgactcgaaaaatggatctttacaacataatgctgcttttgctctttatggccttgcagataatgaggataatgtgcccgattttattagggtcggtggaattcaaaaactgcaggatggagagtttattgttcaagcaactaaagattgtgttgcaaaaacattgaaaagattagaagagaagattcatggccgagttctgaaccatttgttatatctcatgcgagtttcagaaaaggcttttcaaaggcgagttgctttggctcttgctcatctttgttcttcagatgatcagcgaaaaatatttattgatcaccatggtttggagttgcttatggggcttcttggctcttataaccctaagcaacaacttgatggagctgtggctttatgcaagttggccaataaagctatgactcagtctcctgtagatgctgcacccccatctccaacaccccaggtctatttgggagagcagtatgtaaacaatgctaccttgtccgacgttacatttttggttgaaggcaaacggttttatgctcacagaatctgcctgcttgcatcttcagacgcatttcgtgcaatgtttgatggtggttatcgggagaaggaggcacgggatatagaaattccaaacataagatgggaggtttttgagctgatgatgagatttatatacactggatcagttgatgtcactcttgatattgcccaagatctcctccgagcagctgatcaatatcttttagaaggacttaagagactctgtgagtacacgattgcacaggatatatcactggagaatgtgtcatgtatgtatgaactttcagaagcctttaatgctacatcgttgaggcacacatgcatcctttttatcttggagcactatgataaattgagtggaaagccaggacactctcatctgatacagcgtataatacccgagatccagaattactttgttaaagctcttacaaaggccaattccaacctccagctatagttagcactgttctattattgacatctaaccatttacaatgtacataacatggtagatgttcttccttttgttgaacgtgcgaaggaagtctcctggatcgagtacagcatggcttaaaaaaatatttaacatcaggttatgtacgatcatttctgatgcagtgtatgtccattctggctgtaacatcattgtcatagatgtagcaaatatgaccttcacgaacattgttttttctcgtgcaatattgtgatggttatgactcgatagttctttctcaattgatttggcattacaattggtgagttcatgagggtagtataggttgcctaagcacctaatgtatatatgacaattagatagttgtctgcaattgtgctgatggttacgttactcatgtcaagcctttattcttgttttctgacatggaaatgtgttgtaaattaattgcaaaatgcaatacatcattttaagttgcaaatgtatcctttaaatacccgattagttgtatgtcccaa

SEQ ID NO: 7656 - DNA, 2982 bp, Phaseolus vulgaris
atgggaactccttttcgattggtcggtcggatgcttctctcttcctctgaaaaccgatgctctacttctattttgctactctacccctcgtcctcaaaatctccagtctcggataatacctgcaaaagacactcggtattcaacattcagtattccgagtactgtatgatgatgacgagagtgaaaagaaaaaagagaaaagggcatggaggaaatttcggaattacccctccgatctggcactcactcgcgtgttcaaatcccgaattccatttggagcacccttttttttccttcttctcttcttcttcttctcttccgcgcctcgtttctaacactttgggttgcgtctcccaaagacagagggaccttctccttcttcttcctcttctccttcttttctcgtccatggaccttcacgcgcgaccagatcactgcctcccggagaggaaaggtcagaagaggaagctggaggaggatttcgaagacgaccgacagatctccgcgcctcccaccggccacgctcgggacgccctcctctccgacgtcaaggaacaggtcatcgtcctcgattccaccttctcatggaaggaatccgatcgtgctgccgccaagcgcgccacgcacgcccttgccgatctcgcaaaaaacgaggaagtggtgaacgtgattgttgaaggaggcgccattcctgctctggttaaacatcttaaagcgcctcctctagtcggaagcgacctgttgcagaggccaatgccgtttgagcacgaggtcgagaaaggaagtgctttcgcgcttggacttctcgcagtcaagccggagcaccagcagctcatcgttgacagtggtgctctaaaacatctcgttgatcttttgaaaagacatgaaaacggcttaacatctcgtgccattaatagtctaattcgtagggctgcagacgcgattactaatcttgctcatgagaacagcagtattaagactcgtgtcaggatcgaaggtgggattccaccgcttgttcatttacttgaatttgcggatacaaaggtgcaaagagcagctgctggtgcattgagaacccttgctttcaaaaatgatgaaaataaaaatcagatcgttgaatgcaatgcccttccaactctgattctaatgcttcgttcagaagatgctgctattcattatgaagcggttggtgtgattggaaatctggtccactcttcccctaatataaagaaagaagttcttcttgctggggccctacaaccggtcattggattacttagctcctgttgctctgaaagccagagggaagcagccttgttacttggacagtttgcagcaactgattcagactgcaaggttcacattgttcagaggggtgctgtccgacctctgatagagatgcttcagtcccctgatgttcagctaaaagaaatgtctgcctttgcattggggagattggcccaggacacgcataatcaagctggtattgcacacaatggtggcttgattcccttactgaagcttcttgactcaaaaaatgggtctttgcaacataatgctgcttttgctctttatggccttgcagataatgaggataatgtggccgattttattagggtaggtggaattcagagactgcaggatggagagtttattgttcaagcaactaaggattgtgttgcaaagacattgaaaagattagaagagaagattcacgggcgagtgctgaaccatttgttatatctcatgcgagtttcagagaaggcttttcaaagacgagttgctttggctcttgctcacctttgttccgctgatgaccagagaaaaatatttatagaacaccatggtttggagttgcttatggggcttcttggctcttattataactctaagcaacaacttgatggagctgtggctttatgcaagttggccaataaaggcacgactctgtctccagtagatgctgcacccccatctcccacaccccaggtctatttgggagagcagtatgtaaacaatgctaccttgtccgatgttacatttttggttgaaggcaaacgattttatgctcacagaatttgtctgcttgcatcttcagacgcattccgtgctatgtttgatggtggttatagggagaaggaggcacgggacatagagattccaaacattagatgggaggtttttgagctgatgatgagatttatatacactggatcagttgagatcactcttgacattgcccaagatctcctccgagcagccgatcaatatcttttagaaggactcaagagactctgcgagtacacaattgcgcaggatatatcacttgagagcgtatcaagtatgtatgaactttctgaagcatttaatgctatatcgttgaggcacacatgcatcctttttatcttggaacacttcgataaattgagtggaaagccaggacactcccacctgattcagcgtataatacctgagattcagaattactttggtaaagcccttacaaagggcatttccaacaatcagccgtagaatttactgttctatttgacatctaaccagttgcaatgtacataatgtggtcgatgttaattgaacctgcgaaggaagtctcctggattgagtgcagcatggcttaaaaaatatttaacatcaggtcgtgtacgttcttttctgattcagtgtaagtccttctaggctctacctgtaatgtcattctcgtagatgtagcaaatgaccttcacgaacattgttttttctcgtgcaatattgtgatggttatgatttgatagtgttcattttctcatttgtttaggcattataattgctgtatttctgagagtagtataggttgcccaagcacctcatgtttatatgacaattaaatatttgtctgtaatgtgctgatgattaattgcaaatacatgtagctttaacgcaaattaattgcaaaatgcaaatacgtcgcaaatgcgtcattgg

SEQ ID NO: 7657 - DNA, 3067 bp, Phaseolus vulgaris
atgggaactccttttcgattggtcggtcggatgcttctctcttcctctgaaaaccgatgctctacttctattttgctactctacccctcgtcctcaaaatctccagtctcggataatacctgcaaaagacactcggtattcaacattcagtattccgagtactgtatgatgatgacgagagtgaaaagaaaaaagagaaaagggcatggaggaaatttcggaattacccctccgatctggcactcactcgcgtgttcaaatcccgaattccatttggagcacccttttttttccttcttctcttcttcttcttctcttccgcgcctcgtttctaacactttgggttgcgtctcccaaagacagagggaccttctccttcttcttcctcttctccttcttttctcgtccatggaccttcacgcgcgaccagatcactgcctcccggagaggaaaggtcagaagaggaagctggaggaggatttcgaagacgaccgacagatctccgcgcctcccaccggccacgctcgggacgccctcctctccgacgtcaaggaacaggtcatcgtcctcgattccaccttctcatggaaggaatccgatcgtgctgccgccaagcgcgccacgcacgcccttgccgatctcgcaaaaaacgaggaagtggtgaacgtgattgttgaaggaggcgccattcctgctctggttaaacatcttaaagcgcctcctctagtcggaagcgacctgttgcagaggccaatgccgtttgagcacgaggtcgagaaaggaagtgctttcgcgcttggacttctcgcagtcaagccggagcaccagcagctcatcgttgacagtggtgctctaaaacatctcgttgatcttttgaaaagacatgaaaacggcttaacatctcgtgccattaatagtctaattcgtagggctgcagacgcgattactaatcttgctcatgagaacagcagtattaagactcgtgtcaggatcgaaggtgggattccaccgcttgttcatttacttgaatttgcggatacaaaggtgcaaagagcagctgctggtgcattgagaacccttgctttcaaaaatgatgaaaataaaaatcagatcgttgaatgcaatgcccttccaactctgattctaatgcttcgttcagaagatgctgctattcattatgaagcggttggtgtgattggaaatctggtccactcttcccctaatataaagaaagaagttcttcttgctggggccctacaaccggtcattggattacttagctcctgttgctctgaaagccagagggaagcagccttgttacttggacagtttgcagcaactgattcagactgcaaggttcacattgttcagaggggtgctgtccgacctctgatagagatgcttcagtcccctgatgttcagctaaaagaaatgtctgcctttgcattggggagattggcccaggacacgcataatcaagctggtattgcacacaatggtggcttgattcccttactgaagcttcttgactcaaaaaatgggtctttgcaacataatgctgcttttgctctttatggccttgcagataatgaggataatgtggccgattttattagggtaggtggaattcagagactgcaggatggagagtttattgttcaagcaactaaggattgtgttgcaaagacattgaaaagattagaagagaagattcacgggcgagtgctgaaccatttgttatatctcatgcgagtttcagagaaggcttttcaaagacgagttgctttggctcttgctcacctttgttccgctgatgaccagagaaaaatatttatagaacaccatggtttggagttgcttatggggcttcttggctcttattataactctaagcaacaacttgatggagctgtggctttatgcaagttggccaataaaggcacgactctgtctccagtagatgctgcacccccatctcccacaccccaggtctatttgggagagcagtatgtaaacaatgctaccttgtccgatgttacatttttggttgaaggcaaacgattttatgctcacagaatttgtctgcttgcatcttcagacgcattccgtgctatgtttgatggtggttatagggagaaggaggcacgggacatagagattccaaacattagatgggaggtttttgagctgatgatgagatttatatacactggatcagttgagatcactcttgacattgcccaagatctcctccgagcagccgatcaatatcttttagaaggactcaagagactctgcgagtacacaattgcgcaggatatatcacttgagagcgtatcaagtatgtatgaactttctgaagcatttaatgctatatcgttgaggcacacatgcatcctttttatcttggaacacttcgataaattgagtggaaagccaggacactcccacctgattcagcgtataatacctgagattcagaattactttggtaaagcccttacaaagggcatttccaacaatcagccgtagaatttactgttctatttgacatctaaccagttgcaatgtacataatgtggtcgatgttaattgaacctgcgaaggaagtctcctggattgagtgcagcatggcttaaaaaatatttaacatcaggtcgtgtacgttcttttctgattcagtaacttctggtgagtttttctgtgggcagatggaaggtcttgttgaaaaggggctttgattgttatttttgaagacaaataaaagcattgaactgctttttccttgggcatcatgtgttaccatcgaggaaaaagaatcccctcaagtcactcccaacggtgtactttcacttggaatgggccaatcggctgaactcaagtctttttattatacttgtttcatgattagagtagactgcacgtgcatgagataggtatgtcttctgctttggagggtttgtatgccagtatccgtcaaacatgagttatggatatactaacttaattcacaagccttcatttagcaagtctctttcattattgccgttgaaagcaaattcataga

SEQ ID NO: 7658 - DNA, 2995 bp, Cicer arietinum
gaaaatatttcgcatatttggaacaaaataatttgaaattgttattttaaatgatgtggacgaaaagtgagtgggcactgttcatacattcgatcagaaacttgaatgcggccgtttcacaacacaagccgacaccattcagacaaaacaaaagaaaaaactaggtgtataattcccgtattgcccctccgatttggaactcgcatcatcatctgtatattcaaatcccaaatccaattttggatcagcctcttctctctctctctctcctcgtttttaattacacagtttctcttctctctatatcccatagagagagaaagagagaaaaagagaaagagagagagggagcgaaggagagggacttcttctctttctttttcttcatcttcatggagcttcagaggcggccggatcataatctccaagagaagaaaggcctgaagaggaaattggaagacgaattcgaacaagactcacagatctctctccctcccaccggagaagcacgcgacgctcttctctccgatgttaaccaacacgtttccatcctactttctactttttcatccaacgaatccgatagagcttccgctaagcgcgccactcacgccctcgccgatcttgctaaaaacgaggaagttgttaacgtgattgttgaaggaggcgctgttccggctttgattatgcatcttcaaccgcctcctttgcttgaaaacgatcccgttcagaaaccgttgccgtttgaacacgaggttgagaaagggagtgctttcgctcttggtcttcttgccgttaagccagaacatcaacaactcattgttgacagtggcgccttgaagcatcttgttgatcttttgaagagacataagaatggattaacatcacgtgccattaatagtctcattcggagggctgcagatgcaatcactaatcttgctcatgagaatagcagtattaaaacccgtgtcaggatggaaggtgggattccaccattagttaatttgcttgaatttgctgatacaaaagtgcaaagagcagctgctggtgcactgcgaaccctggcttttaaaaatgatgaaaataagaatcagattgttgaatgcgatgcgcttccaactctgattctgatgcttcggtctgaagacgctgctattcattatgaagcggttggtgttatcggaaatctagtccactcttcccccaatataaagaaagaagttattcttgctggagccttgcaacctgttattggactacttagctcctgttgttctgaaagccagagggaagcagcgttgttacttggacagtttgcagcgactgattcagactgcaaggttcacattgttcagagaggtgctgtacggcctttgatagagatgcttcagtcccctgatgttcagctcagagaaatgtctgcgtttgcattggggagattggcccaggatgcacataaccaagctggtattgcacacactggcggcttaatgccattactgaagcttcttgactcaaaaaatgggtctttgcaacataatgctgcttttgctctttatggcctcgcagataatgaggataatgtgccagattttatcagggtaggtggaattcagagactacaggatggagagtttattgttcaagcaactaaggattgtgttgctaagacattgaaaagactagaagagaagattcatggccgtgtgctgaaccatttgctgtatcttatgagagtttcagataaggcgttccaaaggcgagttgctttggctcttgctcatctttgttctgcagatgaccagagaaaagtatttgttgaccacaatgggttggaattgcttattgggcttctttgctcatccagccctaagcagcaacttgatggtgctgtggctttatgcaagttggccaacaaagctactgctgtgtctcccgtagatgctgctcctccatctccaacaccccaggtctatttgggagagcagtatgtaaacaatgctacattgtccgacgttacatttttggttgaaggtaaacggttttatgctcacaggatctgtctactggcatcttcagatgcatttcgtgcaatgtttgatggcggttatagggagaaggatgcaagggacattgagattccaaatattagatgggaggtctttgagctgatgatgagatttatatatactggatcagttgatatcactcttgatattgctcaagatctcctccgagcagctgatcaatatctcttagaagggcttaagagattatgtgaatacacgattgcacaggatgtatcgctggagaacgtgtcaagtatgtatgaactttcggaagccttcaatgctatatcattgagacacacatgcatcctttttatcttggagcactttgaaaaactaagtgcaaggccaggacactctcatttgattctgcttataataccagagatccgcaattactttgttaaagctctttcaaaggggagctccagcatccaagcgtagcatgtgccattctattattgacatctaacagattgcaatgtacataatgttatttctttcattgaatgtgtgagggaggtctccttgattcagaaaagcgtggctttgaagaaatgtcttaacaccaggtggtgcctgttcttttctgatgtggtgttggccccttatggttgtaatgtaattgtcatagatgtagcatacacgacgaccttcacgaacattgttttttttctcttacaatattgtgatggttttgaattgatagttctttgtctcaatcgattttgcaattgttgagtttatgatcatgctgtaggttacccaaacacttcatgtatatacgacaattagatattcctctgcaagaaagttctgttgattggttgcttatgttaatcacttagttttttctgccatggatgtaaactaatgtcaaatacatcatttatgtgttcaagagagcttacaattttttttataat

SEQ ID NO: 7659 - DNA, 2619 bp, Arachis hypogaea
ctctctctctctctctctctggcacctcatttctgcggagtgttgtgtgtcacagagagaggggttctttgttgttggcgcttcttcctctcctctcgttgtttctcatggagcttcaaggtccctcagatcagtgccatcccgagaggaaaggtcagaagaggaagctcgaggacgagttcgaagaagaccaccaccagatctccactcctcctaccggcgacgcccgcgacgccatccttgccgacgtccaggagcaggtttccatcctcaactctactttctcatggaaggagtcagatcgagccgccgccaagcgcgccactcacgcgctcgccgatcttgccaaaaacgaggaagtggtaaacgtgattgtcgaaggaggagctattccggctttggttcagcacctccaagctcccctcgtgacggaagaagacctcgttcagaagctgttgccgtttgagcatgaggtcgagaaagggagtgcttttgcacttggacttcttgccgtcaagcctgaacatcaacagctcattgttgacaatggtgccttaaaacaccttgttgatctactaaagaggcataagaatggtttaacatctcgtgccattaatagtctcattcgtagggctgcagacgctatcactaatcttgctcatgagaacagctgcattaaaacccgagtcaggatggaaggtggaattccgcctcttgttcatttgcttgaatttgcagatacaaaggtgcagagagcagctgctggtgcattgcgaacccttgcttttaaaaatgatgaaaataaaaatcagattgttgaatgcaatgctctaccaactctgattctaatgcttcgtgctgaagatgcagctattcattatgaagcggttggtgtgattggaaatctggtccattcctcccccaatatcaagaaagaagttcttcttgctggggctttgcaacctgttattggattgcttagttcttgttgctccgagagtcagagggaagctgccttgttgcttggacagtttgctgcaactgattcagattgcaaggttcacattgtacagaggggtgctgttcgacctctgatagagatgctccattcccctgatgtgcagctcagagaaatgtctgcttttgcattggggagattggcccaggacacacataaccaagctggtattgctcacaacggtggcttagtccctttgctgaagctccttgattcgaagaatgggtctttgcaacataatgcagcctttgctctttatggccttgcagataatgaggataatgtgtcagattttattagggtaggcggaattcagagattgcaggatggagaattcattgttcaagcaactaaagattgtgttgcaaagacattgaaaagattggaagagaagatacatggccgtgtgttgaaccatttgctatatctgatgcgagtttcagagaaggccttccagagaagagtggctttggctcttgctcatctttgtgcagcagaggatcagaaaaaaatatttatcgatcaccatggtcttgagttgcttattgggctgcttggttcatccagccctaagcagcaactagagggggctgttgctttgtttaaggtggctaacaaagctatgactctgtctcctgtcgatgccgctcctccttctccaacaccccaggtctatttaggagagcaatatgtcaacaattctaccttgtccgatgtaacatttttggttgaaggcaaacggttttttgctcacagaatctgcctgcttgcatcttcagatgcatttcgtgcaatgtttgatggtggttacagggagaaggatgcaagagatattgagattccaaatattagatgggaggtctttgaactgatgatgagatttatatatactgggtcagttgatgtcactcttgatattgcccaagatctacttcgagcggctgatcagtatcttttagagggacttaagagacattgtgaatacaccattgcacaggatatatcactagagaacgtgtcaagtatgtacgaactttcagaagcttttaatgctatatcattaaggcacgcatgcatcctttttatcctggagcaatttgataaactgagtgcaaggccaggacacacacttctgattcagcggataactccagagatccggaattactttgttaaagctcttaccaaggccaattccaacacccagctgtagtatgtgttgttctactattgacatctaaccgattgtaatgtacagaatgtggtagatgttcttcttttcgttgaaaccagcaaaagaggtctcccattttcgttgcagcattgcttagagaaatatctaacacggccatgcatgttcgtttctgatgtagtgtaagtccctgttggttgtaacgtcattgttatagatgtagcagatatgaccttcacgaacattgttttttctcatgcaatattgtgatggttatggcttcatagttctctttcccgattgattttgcattacgattgttatgattgtaggttggcccaagcacttgatgtatatatagcatttagttagttgtctgcaagaggttgtctgggtggataatttacat

SEQ ID NO: 7660 - DNA, 2759 bp, Phaseolus vulgaris
atgtcacccgttcaaatctccaattgcatttctcaccctctcttttctttctcgcaccagacagagcaaacactctgttctcagaaccttcctttgctttttctctcgttcatggagctccagaggcgccaggatcagagtctctcccagcggaaggggcagaagcggaagctcgacgatgaacatcacgacgaggggcagatctcggcggcgccgcccaccgccgacgagcgagcggcgctcctctacgacgttgccgaacaggtgagcgtcctcgagtcgactttcacgtggaacgaagtggatcgatccgcggccaaacgcgccactcacgcgctcgccgatctcgcgaagaatgaggaagtggtgaacgtgattgttgaaggaggcgcgattccggcgttggtgaagcatcttcaggcgccgcctctggttgaccgtgtcgagaagccattgccgttcgagcacgaggttgagaaggggagcgctttcgcactaggacttcttgccgtcaagccagaacatcaacagctcattgttgacagtggtgccttaatacatcttgttgatcttttaaagaggcacaaggacggcttaacgtcccgtgctattaatagtcttattcgtagggctgcggatgcaattactaatcttgctcatgaaaacagcagcattaaaacccgtgtcaggatggaaggtggaattccaccacttgttcatttgcttgattttgctgatgcaaaggttcaaagagcagctgctggtgctctacgaactctggcttttaaaaatgatgaaaataaaaatcagattgttgaatgcaatgctcttccaactttgattttaatgctacgttctgaagacgctgctgttcattatgaagcggttggtgtgattggaaatctagtgcactcttcacctaatataaagaaagaagttcttctcgctggagctttacagccagttattggattactcagttcctgctgctctgaaagccagagagaagcagccttgttacttggacagtttgcagcaactgattcagactgcaaggttcacattgtacagagaggtgctgtccaacctttgatagaaatgcttcagtcatctgatgtacaactcagggaaatgtccgctttcgctttgggaagattagcccaggacacacataaccaagctggtattgctcacaatggtggcttagtgccattactcaagcttcttgactcaaaaaatgggtctttgcaacataatgctgcttttgctctttatggccttgcagacaatgaggataatgtgtccgatttcattagggtaggtggagttcagaggctgcaagatggagaatttattgttcaagcaactaaagattgtgttgccaagacgttgaaaagattagaggagaagattcagggccgtgtgctgaaccatctgttatatcttatgcgagtttcagaaaagggttgtcaaaggcgagttgctttggctcttgcgcatctttgttctgcagatgatcagagaaaagtttttattgatcactacggtcttgagttgcttatcgggcttcttggctcatctagctctaagcagcaacttgatggtgctgtggctttatgcaagttggccaataaagcatcaaccttgtctcctattgatgctcctcctctttctccaacgccacaggtatatttaggagagcagtatgtaaacaatgctacattgtccgacgttacatttttggttgaaggcaaacaattttatgcacatagaatttgtctacttgcatcttcagatgcatttcgtgcaatgtttgacggtggctacagggagaaggaggcaagggacatagagattccaaatattagatgggaggttttcgagttgatgatgagatttgtgtattgtggatcagttgatgtcacactggatattgctcaagatcttcttcgagcagccgatcaatatcttttggaaggacttaagaggctctgtgagtacacaattgcacaggatatatcactagaaaatgtttcaagtatgtacgaactttcagaagccttcaatgcagtaccactgaggcatgcatgcatcctttttatcttggagcaatttgacaaattgagtgcgaggccagggcattctcttctgattcagcgtgtaataccagagatccgcaattactttgttaaagcacttacaaaggccaactcccataacaaccgactgtagtatgcacccattctatactcttgacctctaaccgattgtgttgtacagaatgtagtagatgttattccttttgttgtaccaggaaggggtctcctgtttgtgatatacaactcggctaaaagaaatacctaacgactgagtcgtgcttcttcttttctttttaaacgaggtgtaagccccttttggtctgtaacttcattatcatagatatagcaaatatgaccttcacgaacattttttttctctcatgcaatgtgatggttatatgacttaccagttcttctctcagatgcctacgttcaggaaattaccattgttaactttatgattgtaggtgtaaatatttgttcccaatgtatatatggacaaaattatagttttctgcaaggaaattgtgctgctggggtaacttctgccagactgttaaatcctgtcatttgacatggaatttgttgtaaattattgttgcaaatacttgatttcaatattcttacgttaatattcctcttatgaatcaagtcagcaac

SEQ ID NO: 7661 - DNA, 2827 bp, Phaseolus vulgaris
cttttcctttcccaaaatgccccttctacatgtcacccgttcaaatctccaattgcatttctcaccctctcttttctttctcgcaccagacagagcaaacactctgttctcagaaccttcctttgctttttctctcgttcatggagctccagaggcgccaggatcagagtctctcccagcggaaggggcagaagcggaagctcgacgatgaacatcacgacgaggggcagatctcggcggcgccgcccaccgccgacgagcgagcggcgctcctctacgacgttgccgaacaggtgagcgtcctcgagtcgactttcacgtggaacgaagtggatcgatccgcggccaaacgcgccactcacgcgctcgccgatctcgcgaagaatgaggaagtggtgaacgtgattgttgaaggaggcgcgattccggcgttggtgaagcatcttcaggcgccgcctctggttgaccgtgtcgagaagccattgccgttcgagcacgaggttgagaaggggagcgctttcgcactaggacttcttgccgtcaagccagaacatcaacagctcattgttgacagtggtgccttaatacatcttgttgatcttttaaagaggcacaaggacggcttaacgtcccgtgctattaatagtcttattcgtagggctgcggatgcaattactaatcttgctcatgaaaacagcagcattaaaacccgtgtcaggatggaaggtggaattccaccacttgttcatttgcttgattttgctgatgcaaaggttcaaagagcagctgctggtgctctacgaactctggcttttaaaaatgatgaaaataaaaatcagattgttgaatgcaatgctcttccaactttgattttaatgctacgttctgaagacgctgctgttcattatgaagcggttggtgtgattggaaatctagtgcactcttcacctaatataaagaaagaagttcttctcgctggagctttacagccagttattggattactcagttcctgctgctctgaaagccagagagaagcagccttgttacttggacagtttgcagcaactgattcagactgcaaggttcacattgtacagagaggtgctgtccaacctttgatagaaatgcttcagtcatctgatgtacaactcagggaaatgtccgctttcgctttgggaagattagcccaggacacacataaccaagctggtattgctcacaatggtggcttagtgccattactcaagcttcttgactcaaaaaatgggtctttgcaacataatgctgcttttgctctttatggccttgcagacaatgaggataatgtgtccgatttcattagggtaggtggagttcagaggctgcaagatggagaatttattgttcaagcaactaaagattgtgttgccaagacgttgaaaagattagaggagaagattcagggccgtgtgctgaaccatctgttatatcttatgcgagtttcagaaaagggttgtcaaaggcgagttgctttggctcttgcgcatctttgttctgcagatgatcagagaaaagtttttattgatcactacggtcttgagttgcttatcgggcttcttggctcatctagctctaagcagcaacttgatggtgctgtggctttatgcaagttggccaataaagcatcaaccttgtctcctattgatgctcctcctctttctccaacgccacaggtatatttaggagagcagtatgtaaacaatgctacattgtccgacgttacatttttggttgaaggcaaacaattttatgcacatagaatttgtctacttgcatcttcagatgcatttcgtgcaatgtttgacggtggctacagggagaaggaggcaagggacatagagattccaaatattagatgggaggttttcgagttgatgatgagatttgtgtattgtggatcagttgatgtcacactggatattgctcaagatcttcttcgagcagccgatcaatatcttttggaaggacttaagaggctctgtgagtacacaattgcacaggatatatcactagaaaatgtttcaagtatgtacgaactttcagaagccttcaatgcagtaccactgaggcatgcatgcatcctttttatcttggagcaatttgacaaattgagtgcgaggccagggcattctcttctgattcagcgtgtaataccagagatccgcaattactttgttaaagcacttacaaaggccaactcccataacaaccgactgtagtatgcacccattctatactcttgacctctaaccgattgtgttgtacagaatgtagtagatgttattccttttgttgtaccaggaaggggtctcctgtttgtgatatacaactcggctaaaagaaatacctaacgactgagtcgtgcttcttcttttctttttaaacgaggtgtaagccccttttggtctgtaacttcattatcatagatatagcaaatatgaccttcacgaacattttttttctctcatgcaatgtgatggttatatgacttaccagttcttctctcagatgcctacgttcaggaaattaccattgttaactttatgattgtaggtgtaaatatttgttcccaatgtatatatggacaaaattatagttttctgcaaggaaattgtgctgctggggtaacttctgccagactgttaaatcctgtcatttgacatggaatttgttgtaaattattgttgcaaatacttgatttcaatattcttacgttaatattcctcttatgaatcaagtcagcaactcttaatattgttcttcttaatattgttcttgattaatg

SEQ ID NO: 7662 - DNA, 2908 bp, Glycine max
gtagtagttcgcatttcccgcgaaattcctaaaacgccccttccaaatgtcacccattcaaatctccaattccacttcttaccaccctctctttctctctggccactgtctgttaacttgagcaatcactctgttccttcgcttctatcgttcatggagcttcagaggcgccaagatcagagcctctcccagcggaagggccagaagcggaagctcgacgaggagcagcaccacgaggaccgccagatctcgccggcccctcccaccgccgacgagcgcgccgccctcctctccgacgtcgccgaacaggtgagcatcctcgagtcgactttcacgtggaacgaagcggaccgatccgcggccaagcgcgccactcacgcgctcgccgatctcgcgaagaatgaggatgtggtgaacttgattgttgaaggaggcgcgattccggctttggtgaagcatcttcaggcgccgcctctcagtgaccgtgtccagaatccgttgccgttcgagcacgaggttgagaaagggagcgctttcacactaggacttcttgccgtcaagccagaacatcagcagttcattgttgacagtggtgccttaacacatcttgttgatcttttgaagaggcacaggaatggcttaacttctcgtgctattaatagtctcattcgtagggccgcagatgctattactaatcttgctcatgagaacagcagcattaaaacccgtgtcaggatggagggtggaattccaccacttgttcatttgcttgattttgctgatgcaaaggtgcaacgagcagctgctggtgctctgcgaaccctggcttttaaaaatgatgaaaataaaaatcagattgttgaatgcaatgctcttccaactttgattctaatgctacgttctgaagatgctggtgttcattatgaagcggtcggtgtgattggtaatttagtccactcttcccctaatataaagaaagaagttcttctcgctggagctttacaaccggttattggattacttagttcctgctgctctgaaagccagagagaagcagcattgttacttggacaatttgcagcaactgattcagactgcaaggttcacattgtacagagaggtgctgtccaacctttgatagagatgcttcagtctcctgatgtacagctcagggaaatgtctgcttttgcattggggagattggcccaggacccacataaccaggctggtattgcacacaatggtggcttagtgccgctgctcaagcttcttgactcaaaaaatggctctttgcaacataatgctgcttttgctctttatggccttgcagataatgaggataatgcgtctgatttcataagggtaggtggagttcagagactgcaggatggagaatttattgttcaagcaactaaagattgtgttgccaaaacattgaaaagattagaggagaagattcatggccgtgtgctgaaccatttgttatatctcatgcgagtttcagaaaagggttgtcaaagacgagttgctttggctcttgcacatctttgctcttcagatgatcagagaataatttttattgatcactatggtcttgagttgcttattgggcttcttggctcatctagctctaagcagcaacttgatggtgctgtggctttatgcaagttggcggataaagcctcgaccttgtctcctgtggatgctgctcctccttctccaacaccacaggtctatttaggagagcagtacgtaaacaatgctacgttgtctgacgttacatttttggttgaaggcaaacgattttatgctcatagaatttgtcttcttgcatcatcagatgcatttcgtgcaatgtttgatggtggttacagggagaaggaggcaagggacatagagattccaaatattagatgggaggtttttgagttgatgatgagatttgtatattgtggatcagttgatgtcactctggatattgctcaagatcttcttcgagcagccgatcaatatcttttggaaggacttaagagactctgtgagtacacaattgcacaggatatatcgctagagaatgtgtcaagtatgtatgaacttacagaagccttcaacgcaatatcattgaggcatgcatgcatcctttttatcttggagcaatttgataaattgagttcaaggccagggcactctcttctgattcagcgcataacaccagagatccgtaattacttcgttaaagctcttacaaaggccaactctcaaaacgaccgactctagtatgcacccattttattcttgacctctaaccgattgtgttgtacaaaatgtagatgttgttcctttttttgtaccaggtagcaatctcctgtatggtatacagtttggctaaaagaaatatctaacgccggagtcatgcttcttcttctttttaaatgaggtgtaagcccctttctgtctgtaacgtcattatcatagatatagcaaatatgaccttcacgaacattgtttttttctcatgcaatgtgactgctatatgatttaacagttcttctctcagatgcctacgttcagggaattaccattgttgactttatgattataggtgtaaatattgtttcccttatgtatatatgaacaaaaagttttctgcaaggaagttgtgccgctgggtttacttctgccagaccattaaatcctgtcttctgacatggaatgtgttgtaaactattgttgcaaatccttcattcaaatactcgaaggcatgctgctgacgtggcccaaaaatttaccattatgcatccagtcctgcaactacaaatatcgttcttgatttatgatttagaaatggtctatcaaaaacagtaattatatttgattggttgttacttgatagcatggatttaaaaaa

SEQ ID NO: 7663 - DNA, 2859 bp, Glycine max
tagtagttcgcatttcccgcgaaattcctaaaacgccccttccaaatgtcacccattcaaatctccaattccacttcttaccaccctctctttctctctggccactgtctgttaacttgagcaatcactctgttccttcgcttctatcgttcatggagcttcagaggcgccaagatcagagcctctcccagcggaagggccagaagcggaagctcgacgaggagcagcaccacgaggaccgccagatctcgccggcccctcccaccgccgacgagcgcgccgccctcctctccgacgtcgccgaacaggtgagcatcctcgagtcgactttcacgtggaacgaagcggaccgatccgcggccaagcgcgccactcacgcgctcgccgatctcgcgaagaatgaggatgtggtgaacttgattgttgaaggaggcgcgattccggctttggtgaagcatcttcaggcgccgcctctcagtgaccgtgtccagaatccgttgccgttcgagcacgaggttgagaaagggagcgctttcacactaggacttcttgccgtcaagccagaacatcagcagttcattgttgacagtggtgccttaacacatcttgttgatcttttgaagaggcacaggaatggcttaacttctcgtgctattaatagtctcattcgtagggccgcagatgctattactaatcttgctcatgagaacagcagcattaaaacccgtgtcaggatggagggtggaattccaccacttgttcatttgcttgattttgctgatgcaaaggtgcaacgagcagctgctggtgctctgcgaaccctggcttttaaaaatgatgaaaataaaaatcagattgttgaatgcaatgctcttccaactttgattctaatgctacgttctgaagatgctggtgttcattatgaagcggtcggtgtgattggtaatttagtccactcttcccctaatataaagaaagaagttcttctcgctggagctttacaaccggttattggattacttagttcctgctgctctgaaagccagagagaagcagcattgttacttggacaatttgcagcaactgattcagactgcaaggttcacattgtacagagaggtgctgtccaacctttgatagagatgcttcagtctcctgatgtacagctcagggaaatgtctgcttttgcattggggagattggcccaggacccacataaccaggctggtattgcacacaatggtggcttagtgccgctgctcaagcttcttgactcaaaaaatggctctttgcaacataatgctgcttttgctctttatggccttgcagataatgaggataatgcgtctgatttcataagggtaggtggagttcagagactgcaggatggagaatttattgttcaagcaactaaagattgtgttgccaaaacattgaaaagattagaggagaagattcatggccgtgtgctgaaccatttgttatatctcatgcgagtttcagaaaagggttgtcaaagacgagttgctttggctcttgcacatctttgctcttcagatgatcagagaataatttttattgatcactatggtcttgagttgcttattgggcttcttggctcatctagctctaagcagcaacttgatggtgctgtggctttatgcaagttggcggataaagcctcgaccttgtctcctgtggatgctgctcctccttctccaacaccacaggtctatttaggagagcagtacgtaaacaatgctacgttgtctgacgttacatttttggttgaaggcaaacgattttatgctcatagaatttgtcttcttgcatcatcagatgcatttcgtgcaatgtttgatggtggttacagggagaaggaggcaagggacatagagattccaaatattagatgggaggtttttgagttgatgatgagatttgtatattgtggatcagttgatgtcactctggatattgctcaagatcttcttcgagcagccgatcaatatcttttggaaggacttaagagactctgtgagtacacaattgcacaggatatatcgctagagaatgtgtcaagtatgtatgaacttacagaagccttcaacgcaatatcattgaggcatgcatgcatcctttttatcttggagcaatttgataaattgagttcaaggccagggcactctcttctgattcagcgcataacaccagagatccgtaattacttcgttaaagctcttacaaaggccaactctcaaaacgaccgactctagtatgcacccattttattcttgacctctaaccgattgtgttgtacaaaatgtagatgttgttcctttttttgtaccaggtagcaatctcctgtatggtatacagtttggctaaaagaaatatctaacgccggagtcatgcttcttcttctttttaaatgaggtgtaagcccctttctgtctgtaacgtcattatcatagatatagcaaatatgaccttcacgaacattgtttttttctcatgcaatgtgactgctatatgatttaacagttcttctctcagatgcctacgttcagggaattaccattgttgactttatgattataggtgtaaatattgtttcccttatgtatatatgaacaaaaagttttctgcaaggaagttgtgccgctgggtttacttctgccagaccattaaatcctgtcttctgacatggaatgtgttgtaaactattgttgcaaatccttcattcaaatactcgaaggcatgctgctgacgtggcccaaaaatttaccattatgcatccagtcctgcaactacaaatatcgttcttgatttatgatttagaaatggtctatcaaaaac

SEQ ID NO: 7664 - DNA, 3504 bp, Cajanus cajan
ctgtaaaccagagcaaggaagcactctgttcagaatagaactttccttcgcttctttcgttcatggagtttcagaggcgccaagatcagagcctctcccagcgcaagggccagaagcggaagctcgacgaggaacaccaccacgagcggcagatctcgccgccgccgcccaccgccgtcgagcgcgcggcgctcctctccgacgtcgccgaacaggtgagcatcctcgagtcgactttcacgtggaacgaagcggaccgatccgcggccaagcgcgccactcacgcgctcgccgatctcgcgaagaacgaggaagtggtgaacgtgattgttgaaggaggtgcgattccggctttagtgaagcatcttcaggcgccgcctcttagtgaccgcgtccagaagccattgccgttcgagcacgaggttgagaaagggagcgctttcgcactaggacttctcgccgtcaagccagagcatcaacagctcattgttgacagtggcgccttaacacatcttgttgatcttttaaagaggcacaagaatggcttaacttctcgtgcaattaatagtctcattagaagggctgcagatgctattactaatcttgctcatgagaacagcagcattaaaacccgtgtcaggatggaaggtggaattccaccacttgttcatttgcttgatttcgctgatgcaaaggtgcaaagagcagctgctggtgctctgcgaaccctggcttttaaaaatgatgaaaataaaaatcagattgttgattgtgatgctcttccaactttgattttaatgctacgttctgaagatgctgctgttcattatgaagcggttggtgtgattggaaatctagtccactcttcacctaatataaagagagaagttcttcttgctggagctttacagccagttattggattacttagttcctgctgttctgaaagccagagagaagcagccttgttacttggacaatttgcagcaactgattcagactgcaaggttcacattgtacagagaggtgctgttcgacctttgatagagatgcttcagtctcctgatgtacaactcagggaaatgtctgcttttgcgttggggagattggcccaggacacacataaccaggctggtattgcacacaatggtggcttagtgccgttgctcaagcttcttgactcaaaaaatgggtctttgcaacataatgctgcttttgctctttatggccttgcagataatgaggataatgtgtccgatttcattagggtaggtggagttcagagactgcaggatggagaatttattgttcaagcaactaaagactgtgttgccaagacgttgaaaagattagaggagaagatccatgaccgcgtgctgaaccatttgttatatcttatgcgagtttcagaaaagggttgtcaaagacgagttgctttggctcttgcacatctttgttctgcagatgatcagagacaaatttttattgatcactatggtcttgagttgcttcttgggcttcttggctcatctagctctaagcagcaacttgatggtgctgtggctttatgcaagttggccaataaagcctcaaccctgtctcctgtggatgctgctcctccttctccaacaccacaggtctatttaggagagcagtatgtaaacaatgccacattgtctgatgttacctttttggttgaaggcaaacgattttatgctcataggatttgtctacttgcatcttcagatgcatttcgtgcaatgtttgatggtggttacagggagaaggaggcaagagacatagagattccaaatattagatgggaggtttttgagttgatgatgagatttgtatattgtggatcagttgatgtcactctggatattgctcaggatcttcttcgagcagctgatcaatatcttttggaaggacttaagagactctgtgagtacacaattgcacaggatatatcgttagagaatgtgtcaagtatgtatgaactttcagaagccttcaatgcaatatcattgaagcatgcatgcatcctttttatcttggagcaatttgataaattgagtgcaaggccagggcactctcttctgattcagcgaataataccagagatccgcaattactttgttcaaactctgtaaaaggccaacaactcccataacaaccgactgtagtatgcatccattctattcttgacctctaaccaattgtgttgtacagaatgtagatgatgttatttcttttgttgaaccagaaggggatagcttggccaaaagaaatatctaacgcctaagtcatacttctctttttaaatgaggtgtaagcccctttctgtctgtaatgtcattatcatagatatagcaaatatgaccttcacgaacatttttttttcttgcaatgtgatagtgacttgacagttctctcagatgactacgtgaggaaattaccattgttgacttcatgactataggtgtgaatattgtttcccgaatgtatatatggcgaaaagttggttttctgcaaggaaattgagctgctgtgataacttccgccggaccattaaatcctgtcatatgacatggaaatctgttgtaaattattgttgcaattacttcatttaaatattcggatgtccgaaggcatgcttctgacgctgctcaaaattttactatattatgcatatagtccagcaacaagagtttttgatttatgattgaaaagaaataattagttgatggcagaaactggaagtgtcatatgtatacagttagctttgatctaattatcgtaactgactagtgattaagctgcaaaccctaattgacttcttactaaccgtaaaagcatgtgtatcacatcaacgctcgacaatggccaacagagatgttcggtgcttgcataatccaagcatgaagattgaagagtcctctgatgccttgcaccgggggaaggtacccagcccgacttcggaaggaattattgaaacgctgaagccagaagatggtaaagatagtctgttggacaaaaatagttggcataaaatgtttatagacctagaagtgttggataaaagcagttaagttaaaagtaaacgatagctgttcgataataagtgttgtgtgtgaaaaaaatgttttaaaataattgttttgttaattttttaatatagcattaattatgtagtataaaattaattatgtaatataaaattaattttgtaaaattatcattcttttccatataataactacttattccgtactattttgtttggtgctttaggaatttgtctttcaatttgaatgttattttacgatattaatataatattaattatttttttctcattattggtgagaatataaaggtttaaggatatattgaaaaattacataatttattttatgaaattagacacattattgtatttcttatacattgtatcaaaatcttaaaaagtaaaaagaaaaaaaaaaaaaagaaacaagcaaa

SEQ ID NO: 7665 - DNA, 2851 bp, Glycine max
tcgcatttttggcgaaattccgaaagcaccccttccagatgtcatccattcaaatctccaattccacttcttacccccctctttctcgtcactgtctgttaacttgagcaaacactctgttccttccttctctcgttcgttcatggaacttcagaggcgccaagatcagagcctctcccagcggaagggccagaaacggaagctcgacgaggagcagcaccacgaggaccgccagatcttgccggcgccgcccaccgccgacgagcgcgccgcactcctatccgacgtcgccgaacaggtgagcatcctcgagtcgactttcacgtggaacgaagcggacagatccgcggccaagcgcgccactcacgcgctcgccgatctcgcgaagaatgaggatgtggtgaacgtgattgttgaaggaggcgcgattccggcgttggtgaagcatcttcaagcgccgcctctcagtgaccttgtccagcatccgttgccgtttgagcacgaggttgagaaagggagcgctttcgcactaggacttcttgccgtcaagcctgaacatcagcagctgattgttgacagtagtgctttaactcatcttgttgatcttttgaagaggcacaggaatggcttaacttctcgtgctattaatagtctcattcgtagggcagcagatgctattactaatcttgctcatgagaacagcaacattaaaacccgtgtcaggatggaaggtggaattccaccacttgctcatttgcttgattttgctgatgcaaaggtgcaaagagcagctgctggtgctctgcgaaccctggcttttaaaaatgatgaaaataaaaatcagatagtcgaatgcaatgctcttccaactttgattctaatgctacgttctgaagatgctgctgttcattatgaagcggttggtgtgattggaaatttagtccactcttcacctaatataaagaaagaagttcttctcgctggagctttacaaccagttattggattacttagttcctgctgctctgaaagccagagagaagcagccttgttacttggacaatttgcagcaactgattcagactgcaaggttcacattgtacagagaggtgctgtccgacctttgatagagatgcttcagtctcctgatgtacaactcagggaaatgtctgcttttgcattgggaagattggcccaggacccacataaccaggctggtattgcacacaatggtggcttagtgccgttgctcaagcttcttgactcaaaaaatgggtctttgcaacataatgctgcttttgctctttatggccttgcagataatgaggataatgtgtccgatttcattagggtaggtggagttcaaagactgcaggatggagaatttattgttcaagcaactaaagattgtgtagccaaaacgttgaaaagattagaggagaagattcatggtcgtgtgctgaaccatttgttatatctcatgcgagcttcagaaaagggctgtcaaagacaagttgctttggctcttgcacatctttgctcttcagatgatcagagaataatttttatcgatcactatggtcttgagttgcttattgggcttcttggctcatctagctctaagcagcaacttgatggtgctgtagctttaagcaagttagccaataaagccttgaccttgtctcctgtggatgctgctcctccttctccaacaccacaggtctatttaggagagcagtatgtaaacaatgctacattgtctgacgttacatttttggttgaaggcaaacgattttatgctcatcgaatttgtcttcttgcatcatcagatgcatttcgtgcaatgtttgatggtggttacacggagaaggaggcaagggacatagagattccaaatattagatgggaggtttttgagttgatgatgagatttgtatattgtggatcagttgatgtcactctggatattgctctagatcttctccgagcagccaatcaatatcttttggaaggacttaagagactctgtgagtacacaattgcacaggatatatcgccagagaatgtgtcaagtatgtatgaactttcagaagccttcaatgcaatatcattgaggcatgcatgcatcctttttatcttggagcaatttgataaattgagttcaaggccagggcactctcttctgattcagcgcataataccagagatccgcaattactttgttaaagctcttacaaaggccaactctcatgacaaccaactgtagtatgcacccattttattcttgacctctaaccgattgtgttgtacagaatgtagtagatgttattccttttgttgtaccaggtagcagtctcctgtatggtatacagcttgggtaaaagaaatatctaacgccggagtcatgcttcttcttctttttaaatgaggtgtaagcccctttgtgtctgtaacgtcattatcatagatatagcaaatatgaccttcaggaacattgtttttttctcatgcaatgtgacggttatatgacttaacagttcttctctcagatagctacgttcagggaattaccattgttgactttatgattatatgtgtaaatattgtttcccgtgtatatatgaacaagaagttttctgcaaggaaattgtgccgctggggttacttctgccagaccattaaattctgtcacctgacatggaatgtgttgtaaattattgttgcaaatacttcattcaaatattcaaagtcgaaggcatgctgctgatgcggcccaaaattgttcttgatttatgattgagaagaaatgattgattgatggcagaaactgcaaatgtcacacacacaacac

SEQ ID NO: 7666 - DNA, 2731 bp, Glycine max
tgtctgttaacttgagcaaacactctgttccttccttctctcgttcgttcatggaacttcagaggcgccaagatcagagcctctcccagcggaagggccagaaacggaagctcgacgaggagcagcaccacgaggaccgccagatcttgccggcgccgcccaccgccgacgagcgcgccgcactcctatccgacgtcgccgaacaggtgagcatcctcgagtcgactttcacgtggaacgaagcggacagatccgcggccaagcgcgccactcacgcgctcgccgatctcgcgaagaatgaggatgtggtgaacgtgattgttgaaggaggcgcgattccggcgttggtgaagcatcttcaagcgccgcctctcagtgaccttgtccagcatccgttgccgtttgagcacgaggttgagaaagggagcgctttcgcactaggacttcttgccgtcaagcctgaacatcagcagctgattgttgacagtagtgctttaactcatcttgttgatcttttgaagaggcacaggaatggcttaacttctcgtgctattaatagtctcattcgtagggcagcagatgctattactaatcttgctcatgagaacagcaacattaaaacccgtgtcaggatggaaggtggaattccaccacttgctcatttgcttgattttgctgatgcaaaggtgcaaagagcagctgctggtgctctgcgaaccctggcttttaaaaatgatgaaaataaaaatcagatagtcgaatgcaatgctcttccaactttgattctaatgctacgttctgaagatgctgctgttcattatgaagcggttggtgtgattggaaatttagtccactcttcacctaatataaagaaagaagttcttctcgctggagctttacaaccagttattggattacttagttcctgctgctctgaaagccagagagaagcagccttgttacttggacaatttgcagcaactgattcagactgcaaggttcacattgtacagagaggtgctgtccgacctttgatagagatgcttcagtctcctgatgtacaactcagggaaatgtctgcttttgcattgggaagattggcccaggacccacataaccaggctggtattgcacacaatggtggcttagtgccgttgctcaagcttcttgactcaaaaaatgggtctttgcaacataatgctgcttttgctctttatggccttgcagataatgaggataatgtgtccgatttcattagggtaggtggagttcaaagactgcaggatggagaatttattgttcaagcaactaaagattgtgtagccaaaacgttgaaaagattagaggagaagattcatggtcgtgtgctgaaccatttgttatatctcatgcgagcttcagaaaagggctgtcaaagacaagttgctttggctcttgcacatctttgctcttcagatgatcagagaataatttttatcgatcactatggtcttgagttgcttattgggcttcttggctcatctagctctaagcagcaacttgatggtgctgtagctttaagcaagttagccaataaagccttgaccttgtctcctgtggatgctgctcctccttctccaacaccacaggtctatttaggagagcagtatgtaaacaatgctacattgtctgacgttacatttttggttgaaggcaaacgattttatgctcatcgaatttgtcttcttgcatcatcagatgcatttcgtgcaatgtttgatggtggttacacggagaaggaggcaagggacatagagattccaaatattagatgggaggtttttgagttgatgatgagatttgtatattgtggatcagttgatgtcactctggatattgctctagatcttctccgagcagccaatcaatatcttttggaaggacttaagagactctgtgagtacacaattgcacaggatatatcgccagagaatgtgtcaagtatgtatgaactttcagaagccttcaatgcaatatcattgaggcatgcatgcatcctttttatcttggagcaatttgataaattgagttcaaggccagggcactctcttctgattcagcgcataataccagagatccgcaattactttgttaaagctcttacaaaggccaactctcatgacaaccaactgtagtatgcacccattttattcttgacctctaaccgattgtgttgtacagaatgtagtagatgttattccttttgttgtaccaggtagcagtctcctgtatggtatacagcttgggtaaaagaaatatctaacgccggagtcatgcttcttcttctttttaaatgaggtgtaagcccctttgtgtctgtaacgtcattatcatagatatagcaaatatgaccttcaggaacattgtttttttctcatgcaatgtgacggttatatgacttaacagttcttctctcagatagctacgttcagggaattaccattgttgactttatgattatatgtgtaaatattgtttcccgtgtatatatgaacaagaagttttctgcaaggaaattgtgccgctggggttacttctgccagaccattaaattctgtcacctgacatggaatgtgttgtaaattattgttgcaaatacttcattcaaatattcaaagtcgaaggcatgctgctgatgcggcccaaaattgttcttgatttatgattgagaagaaatgattgattgatggca

SEQ ID NO: 7667 - DNA, 3005 bp, Cicer arietinum
gtcaattcttttataacggtggtttatattttgacatgcactgtccgaaatacccctcccatctgtcatccattcaaatcacaatttccaaatatcgccattttctatctcatttctctttcctttctgttaagcagaccgccaacacactctcaataacccgcctcttcttctctctcgttcatggagtttcagaggcgccaagatcactgcctctctgagaggaaggggcaaaaacggaagctagacgaagaattacacgacgaacgacagatctcggcggcggcgccgccaaccgccgacgaacgtgcgaaactcctcgccgaagttgccaaccaagtcaccatcctcgagtcgactttcacgtggaacgaagccgatcgatcagcggctaagcgagctactcacgcgctcgccgatctcgcgaagaatgaggaagtggtgaacgtgattgtcgaaggaggttcgattccggctttaattaagcatcttcaggcgccacctttgagcgattctgttcagaaaccactgccatttgagcatgaagttgagaaaggaagcgctttcgcgctaggacttcttgccgtcaagccagaacatcaacagctaattgttgacaatggtgccttaacacatctcgtggaccttttaaagaggcataaaaatggcttaacttctcgtgccatcaatagtctcattcgtagggctgcggatgctgttactaatcttgcacatgagaatagcaacatcaaaactcgagtcaggatggagggtggaattccaccacttgttcatttgctagagtttgccgatgcaaaggtgcaaagagcagctgctggtgcactgcgaaccctagcttttaaaaatgatgaaaataaaaatcagattgttgaatgcaatgctcttccaactctaattttaatgttgcggtctgaagattctgctatacattatgaagcggttggtgtgattggaaatttagttcactcttctcctaatataaagaaagaggttctccttgctggtgctctacaaccagttattggattacttagctcctgttgctctgaaagtcagagggaagcggcattgttacttggacaattcgcagcaactgattcagactgtaaggttcacattgtacaaagaggtgctgtccgcccattgatagagatgcttcagtctcctgatgtacaactaagagaaatgtctgcctttgcattaggaagattggcccaggacacacataatcaggctggtattgcacacaatggtggtttagtgccattgctcaagcttctcgactcaaaaaatgggtctttgcaacataatgctgcttttgctctttatggccttgcagataatgaggataatgtgtctgatttcattagggtaggtggagttcagagactacaagaaggagagtttattgttcaagcaacaaaggattgtgttgccaagacattgaaaagattagaggagaagattcacggtcgtgtgctgaaccatctgttatatctcatgcgagtttcagaaaggggttttcaaaggcgaattgctttggttcttgcacatctttgttctgcagatgatcaaagaagaattttcattgaacaccatggtcttgagttgcttattgggctccttggctcatctagctccaagcagcaacttgatggtgctgtggctttatgcaagttggcaaataaagtctcgactttgtctcctgtggatgctgctcctccttctccaacaccacaggtttacttaggagagcagtatgtaaacagtgctacattgtccgatgtcacatttttggttgaaggcaaacgtttttatgctcatagaatttgtctacttgcatcttcagatgcatttcgtgcaatgtttgatggtggttatcgggagaaggatgcaagggacatagagatcccaaatattagatgggaagtttttgagttgatgatgagatttatatatactggatcagttgatgtcacttcagatattgctcaagatcttctgcgagcagctgatcaatatcttttagaaggactaaagagactctgtgagtacacgattgcacaggatatattactagagaatgtgtcaagtatgtatgagctttcagaagccttcaacgcaatatcattgaggcatacatgcattctttttatcttggagcactttgataagctgagcacaaggccaggacaccctcttctgattcagcgtataataccagagattcgcaagtactttgttaaagctcttaccaatggcaactcccataacagctgactgtaatgtacgaccattctattcttgacctctaacagattgtgatgtacagagtgtagatgttattcctgtgttgaatcaggaaaggggtgtcctttattatggtatacaggttgactaaaggaaatatcttataccagagtaatgtatgttctctttctatttttcaccttttctttgatgcagtgcaagtccttttctgtctgtagcgtcatatcatagatatagcaaatatatggccttcacgaacattgttttttggtatgcaatattgtgatggttctattcctcatgatttgtacactcaagagattacgattgttgagtttatgatcatagatgtaaaatattgtttccccaatgtatatatgacaattagactgctgggtaatttatgtcaggccgttaagtcctgtcatctgttacatcatggaactgttgtaaattactgtagcaaatacttaatttaaatactcgtatgcctaaggcatgctgatggtgtcaattccccaattctattgacctttatttgttctcataacttacggtgggaatcgtttggtgtgtctcatagctgtatatggcacagttaggttgggctaagattttaaaaaaaaaaaataaaatagataaaataaaagttaagatagtcaggtttcacatcttctaattctaaaaaatattttaagtcaatcagattgatg

SEQ ID NO: 7668 - DNA, 2569 bp, Trigonella foenum-graecum
tccattcaaatcttcattttccaattctcgccattttctatcttattttctctctccattctgttaaccatagcgccaacaacaacacactcttcttcacccacctcttcttctctctggttcatggagtttcagagacgccaaggtcactgcttctctgagaggaaggggcaaaaacgtaagctagacgaagaattaacggaagaccgtcagatctcgtcggcgccgcctaccgccgacgaacgtgcggcacttctcgccgaagtcgccaaacaggtctctgtcctcgagtctactttcacgtggaatgaagccgatcgagccgcggctaagcgtgccactcatgcgcttgccgatctcgcgaagaatgaggaagtggtgaatgtgattgtggaaggaggtgcgattccggctttgattaagcatcttcaggcaccgccggtgactgattgtgttcagaagccattgccgtttgagcatgaggttgagaaaggaagtgctttcgctctaggacttcttgctgtcaagccggaacatcaacaactaattgtggacagtggtgccttaacacaccttgttgatcttttaaagaggcataataatggtttaacttctcgtgccattaatagtctcattcgtagggctgcagatgctgttactaatcttgcacatgagaatagcaacattaaaacccatgtcaggatggaaggtggaattccaccacttgttcatttgctggaatttgccgatacaaaggtgcaaagagcagctgctggtgcactgcgaacccttgcttttaaaaatgatgaaataaaattcagattgttgaatgtgatgctcttccgactctgattctaatgctgcgttctgaagatgctgctattcattatgaagcggttggtgtgatcggaaatctagttcactcttctcctaatataaagaaagaggttctatttgccggtgctttacaaccagttattggattacttagctcccgctgccctgaaagtcagagggaagcggcattgttacttggacagttcgcagcaactgattcagactgcaaggttcacatcgtacagagaggtgctgtccgacctttgatagagatgctttcgtctcctgatgtacaacttagagaaatgtctgcctttgcattagggagattggcccaggatacacataaccaagctggtattgcgcacaatggtggtttagtgccactgctcaagcttcttgactcaaaaaatgggtctttgcaacataatgctgcttttgctctttatggccttgcggagaatgaggataatgtgtcggatttcattagggtaggtggagttcaaagactacaggaaggagagtttattgttcaagcgactaaagattgtgttgccaagacattgaaaagattagaggagaagattcacggtcgtgtgttgaaccatctgttatatcttatgcgagtttcagaaaggggttttcaaaggcgaattgctttggttcttgcgcatctttgccctgcagatgatcaaagaagaatttttattgaacaccatggtcttgagttgcttatcagtcttcttggctcatccagctccaagcagcaacttgatggtgctgtggctttatgcaagttggccaataaagcctcagccctgtctcctgtagacgctgctcctccttctccaacaccacaggtctacttaggagagcagtatgtaaacaatgctacattgtccgatgttacatttttggttgaaggcaaacgtttttatgctcatagaatttgtctacttgcatcttcagatgcatttcgtgcaatgtttgatggtggttatagggagaaggatgcaagggacatagagatcccaaatattagatgggaagtttttgagttgatgatgagatttatatatactggatcagttgatatcactccagatattgctcaagaccttctccgagcagctgatcaatatcttttagaaggactaaagagactctgtgagtatacaattgcacaggatatattactagagaacgtgtcaagtatgtatgaactttctgaagccttcaatgcaatatcattgaggcatgcatgcattctttttatcttggagcactttgataagttgagcacaaggccagggcactctcttctgattcagcgtataataccagagatccgcaattactttgttaaagctcttacaaatggcaactcccatagaccgtaatgtgcagcgattctattcttgacctctaaccaattgtgatgtacagattgtagatgttattccttgtgttgtaccaggaagggggtctcctttatggtatacaggttgactaaaagaatatgttacaccagagagtagtgtacgttctctttttttttcttttctttctttgatgtggtgtaagcccctttctgtctctagcatcatcatcatatagtaaatatatacggccttcacgaacattgttttttcttatgcaatattgtgatggttctattcctcatatgataattgtttccccaatgtatatatgacaattagttattagataa

SEQ ID NO: 7669 - DNA, 2577 bp, Theobroma cacao
tttgtctcttcctttctttgttccttcttgatggagcttcagaggagccaggaccagggcctcccagaacgaaaggggcaaaaacggaaactggaggaagaaaaccaagaggaccgcgaaacctctctccctaccggcgacgcccgccgtgctctcttggccgaagtcaccgctcaggttagcgtcctcgactccaccttctcttggcgcgaacctgatcgcgccgctgccaagcgagccactcacgtgctggccgagcttgcaaagaacgaggaagtggtgaatgtgattgttgaaggtggtgcggttccggctctagttaagcatctgcaagcgcctccgtgtagtgacggcgaccgaagcccgaagcctttcgagcacgaggttgaaaaaggaagtgcttttgcgctgggacttctcgccgtaaagccagaacatcagcaacttatagttgattctggggccttatcacatcttgtgaatttgttgaggcggcacaaggatggttctacttctcgtgctgtgattagtgtcattagaagagcggctgatgctatcaccaaccttgctcatgagaatagcagcattaaaacccgtgtcagaatggaaggtgggattccacctcttgttgagttgcttgattttactgatacaaaggtgcagagagcagctgctggggcattgcgaaccctagcattcaaaaatgatgaaaacaagaatcagattgttgaatgcaacgctcttccttctcttattctcatgctacgatcagaggatgctgctatacactatgaagcggttggtgtgattggcaatttggtgcattcatcaccgaacataaaaaaagaagttcttgctgctggggctttgcaacctgtcattggcttgcttacctcctgctgctcagagagccaaagggaggcagctttattacttggacaatttgctgcaacggattccgattgcaaggttcatatcgtacaaaggggtgctgtcagaccgttgatcgatatgcttcactctccagatgtacagctgaaagagatgtcagcctttgctttggggaggttggcacaggacacacacaaccaagctggtattgcacataatggtggtttggtgcctttgttgaaacttctagattcaaagaatggatctttgcaacacaatgctgcatttgctctttatggtcttgcagataatgaggataacgtatctgattttattatggtgggtggggtccaacggctgcaagatggagagtttattgttcaagcaacaaaagactgtgttgccaagacactgaaaagactggaggagaagattcatgggcgggttttgaaccatttgctgtatctgatgcgtgtagctgagaagccagtccaacgacgagtggctttggctcttgctcatctttgttccccagaggatcagagaactatattcattgataacaatggacttgagctgcttcttgggcttcttggttctacaagtcctaagcagcaacttgatggtgctgttgctctgtacaagttggccaacaaagctatgagtctttctcctatggatgcagctcccccttctccaacaccacaggtctatttgggggagcagtatgtgaacaatgctacattatctgatgttacgttcctagttgaaggtagacggttctatgctcacagaatctgcctgcttgcttcttccgatgcatttcgtgctatgtttgatggtggttatcgggaaaaagatgcaagggatattgaaattccaaacattagatgggaggtttttgagttgatgatgagatttatatacaccggatcagtagatgttacattggatattgctcaagatctgcttagagcagctgaccaatatcttttggagggacttaagcgactctgcgagtataccattgcacaggatatatcgctggaaaatgtttcaagcatgtatgaactctcagaagccttccatgctatatcattgaggcacacttgcattttgtttatcttggagaatttcgataaattgagcacaagacctgggcacttgcatctaatccagcgcataattccggagatccgcaattactttgccaaagcacttacaaaacctaacccacataaccttcggctatagaaggctggtttttaactcctgatctctaactagatacgttgtacagaaagtagcagatcttctttgatgttgtggagccgatggaaggttctaattggttctttgtagcgtggttcataatcattactgatgccagagttaccgttgcttgtagaaaaagctataaggtttcttctttaattcattgtcttttggcctccacttttgatcttcgtggactgtgttggttattagatttaaatgtattccaactacttacaaagttggcattcattgaaaatgcttgtacttttttttttttttttcttttggcctaagaaaatgcttgttcaaatgagcagttacaagtttcttggtgaacgcttgatttcctgtgtaaaagttgaagaatgcttgaaaagaccaatgaatctagtagtgcttccatacaag

SEQ ID NO: 7670 - DNA, 2615 bp, Lotus japonicus
cactgaacaacaaacctccctcttctcctctcgttcatggagtttcagaggcgccaagaccacagcctctccgagaggaaagggcagaagcggaagctagatgaccaattgcacgacgaccggcagatctcgctctcgccgcccaccgccgacgaacgtgcggcactgctcgcagacgtcgccgtacaggtctccgtcctcgactctactttcacgtggaacgaatccgatcgagccgcggccaagcgcgccactcatgcgcttgccgatctcgctaagaacgaggaagttgtgaacgtgattgttgaaggaggtgcgattccggcgttggttaagcatcttcaggcgccacctctgagtgattttgctcagaagccattgccatttgagcacgaggttgagaaagggagcgcgttcgctctaggacttcttgccgttaagccagaacatcagcagctcattgttgacagtggtgccttaacacatcttgttgatctcttaaagaggcagaaaaatggtttaacttctcgtgccattaacagtctcatacgtagggctgcggacgccattactaatcttgctcatgagaatagtagcattaaaaccagtgtcaggatggaaggtggaattccaccacttgttcatttgcttgaatttgccgatacaaaagtgcaaagagcagctgctggtgcacttcgaaccctagcttttaaaaatgatgaaaataaaaaccagattgttgaatgcaatgctcttccgactctaattctaatgctgcgttctgaagatgctgctatccattatgaagcggttggtgtgattggaaacctagtccattcttctcctaatataaagaaagaagttcttcttgctggagctttacaaccagtcattagattacttagctcctgctgctcagaaagccagagggaagcagccttgttacttggtcagtttgcagcaactgattcagactgcaaggttcacattgtacagagaggtgctgtccgacctttgatagagatgcttcagtctcctgatgtacaactcagagaaatgtctgcctttgcattagggagattggcacaggacacacataaccaagcgggtattgcacacaatggtggcttagtgccattgctcaagcttcttgactcaaaaaatgggtctttgcaacataatgcagcttttgctctttatggccttgcagataatgaggataatgtgtccgatttcattagggtaggtggagttcagagactgcaggaaggagagtttattgttcaagcaactaaagattgtgtagcaaagacattgaaaagattagaggagaagattcacgaccaaaagggttttcaaagacgagttgctttggctcttgcacatctttgctctgcagatgatcaaagaagaatttttattgataatcatggtcttgagttgcttattggccttcttggctcatctagctctaagcagcaacttgacggtgctgtggctttatgcaagctagccaataaagcctcgactctgtctcctgtggatgctgctcctccttctccaacaccacaggtctatttaggagagcagtacgtaaacaatgctacattgtccgacgttacatttttggttgaaggcaaacgattttatgctcatagaatttgtttacttgcatcttcagatgcatttcgtgcaatgtttgatggtggttatagggaaaaggatgcaagagacatagagatcccaaatattagatgggaagtttttgagatgatgatgagatttatatatactggttcagttgatatcactgtggatattgctcaagatctacttcgagcagctgatcaatatcttttagaaggacttaagagactctgtgagtacacgattgcacaggatatatcactagagaatgtgtcatgtatgtacgaactttcagaagccttcaatgcaatatcattgaggcatgcatgcatcctctttatcttggagcaatttcataagttgagcgaaaggccagggcactctcttctgattcagcatataataccagatatccgcagttattttgttaaagctctttcaaagaccaactcccataactaccgactataatgtgcggcccttctactgttgacctcttaagcaactgtgatgtacagaaaagtagatatcattccttatgttgaacaggaagggggtctcctgtatgacaccagagtaatgagcgtctttcccctcatttttttaatggggtgtaatcccctttttgtctgtaacgtcgtcattattatagatatagcaaatgtggccctcacgaacattgtttttttcttatgcaatattgtgatggttatattacttcacttcatggttctcttcctcaggtgattttatacagggaactacgattgttgattttatgatttatagatgtaaatattgtttccccccagtgtacatatgaccattattagatagttgtctgctaatttgccaggccattaaatcctgtcatctgacatggaaatgcattgtaaattgctgttccaaatacttaattttgaatacacgtattatgacccaaggcatgctggagtcactgctcaaac

SEQ ID NO: 7671 - DNA, 2563 bp, Trigonella foenum-graecum
gaaaggaaccttcttccactctttcttctcatcattgatggatcttctaccaacagagaagaagaaaggccagaagagaaaacttgaagtggaagaagaacaattccaacaagacacacagatctctcttcctctcaccggagaagcacacgacgctattctctccgacgttaaccaacacgtttcaattctcctttccactttctcgtccaacgattccgatagagcttccgctaaacgcgccactcacgctctcgccgatcttgccaaaaacgaggaagctgtgaatgtgattgttgaaggaggtgctgttccggctttgattaagcatcttcaaccgcctcctcatgaaaataattttgttcagaagccgttgccgtttgagcatgaggttgagaaaggaagcgctttcgcacttggacttcttgctgtcaagccagaacatcaacaactcatcgttgacagtggtgccttgaagcatcttgttgatcttttaaagagacataagaatggactaacatcacgtgccattaatagtctcattcggagggctgcagatgcgatcactaatcttgctcacgagaacagcagtattaaaacccgtgtcaggacggaaggtgggattccaccattagttcatttacttgaatttgcggatacaaaggtgcaaagagcagctgctggtgcattacgaaccttggcttttaaaaacgatgaaaacaagaatcagattgttgaatgcaatgctcttccaactctgattctgatgcttcggtcagaagatgctgctattcattatgaagcggttggtgtgatcggaaatctggtccactcatcccccaatataaaaaaagaagttattcttgctggagccttgcaacctgttattggattacttagctcctgttgctctgaaagccagagggaagcagccttgttacttggacagtttgcagcaactgattcagactgcaaggttcacattgtacagagaggtgctgtacgacctttgatagagatgcttcagtcttcggatgttcagctcagagaaatgtctgcttttgcattggggagattggcacaggacacacataaccaagctggtattgcacacactggcggattaatgccattactgaagcttcttgactcaaaaaatgggtctttgcaacataatgctgcttttgctctttatggccttgcagagaatgaggataatgtgcccgactttattagggtaggtggaattaagaggctccaggatggagagtttataattcaagcaactaaggattgtgttgctaagacattgaaaagactagaagagaagattcatggtcgtgtgctgaaccatttgttatatcttatgagagtttcagaaaaggcattccaaagacgagttgctttggctcttgctcatctttcttctgcagatgaccagagaaaaatatttattgaccacaatgggttggaggtgcttattggacttcttggctcatcttgccctaaacagcaacttgatggtgccatggctttattcaagttggcaaacaaagctatgactctgtctcctgtagatgctgctcctccatccccaacacctcaggtctatttgggagagcagtatgtaaacaatgctaccttgtccgacgttacatttttggttgaaggtaaacggttttatgctcataggatctgtctacttgcatcttcagatgcatttcgtgcgatgtttgatggtggttatagggagaaggatgcaagggatattgagattccaaatattagatgggaggtctttgagcttatgatgagatttatctacactggatcggttgatgtcactcttgaaattgctcaagatctcctccgagcagctgatcaatatctcttagaagggcttaagagactatgtgaatacacgattgcacagcatgtatcactcgagaacgtgtcaagtatgtatgaactttcggaagccttcaatgctatatcattgagacacacatgcatcctttttatcttggggcactttgataagctacgtgaaacatcagggaactccgattttattcagaatacaataccagagatccgcaattactttgttaatgctcttgcaaaggggaattccagcatccaggcgtaatatgtgccattctatcattgacatctaacagattgcaatgtacataatatgaagatgttatttcttttattgaacgtgtgagggaggtctcctggattcagaacaacatgaacatggctttgaagaaatgtctatcaccaagtggtgtctgttcttttttgatgatgtgtctctcccttctggttgtaatgtcgctgtcatagatgtagcgcacatgaccttccacgaacattgtttttttctttcacttgtgcaatattgtgatctttatgaattgattgttctctatctcaatcgattatggtttacaattgttgagtttatgattatgttacaggttagttacccaatcatttcatgtatatatgacaattagatagtcctttgcaagaaaactgtgttgttgggctgctc

SEQ ID NO: 7672 - DNA, 2689 bp, Medicago truncatula
cattttgtatcacgctcttctccctctcacacctatctaactcttatctatctcacacagagagagagagagagaaagagagggagaggaaccttctagactctttcttcttattcttcttaaccgttgatggagcttctaccatcatcagagaagaaaggccagaaaagaaaactggaacaacaagaagaacaattccaacaagtcacacagatctcccttcctctcaccggagacgctctcgacgccgttctctccgacgtcgatcaacacgtttcaattctcctttcatctttctcatccaacgaattcgatagagcttccgctaaacgcgccactcacgctctcgccgatcttgccaaaaacgaggaaattgtgaatgtcattgttgaaggaggtgctgttccggctttgattaagcatcttcaaccaccgactcaaaatgattctgttcaaaagccgttgccgtttgaacatgaggttgagaaagggagtgctttcgcgcttggacttcttgctgtcaagccagaacatcaacagctcattgtagacagtggtgccttgaagcatcttgttgatcttttgaagagacataagaatggactaacatcacgtgccattaatagtctcattcggagggctgcagatgcgatcacgaatcttgctcacgagaacagcagtattaaaacccgtgtcaggacggaaggtgggattccaccattagttcatttgcttgaatttgcggatacaaaagtgcaaagagcagctgctggtgctttacgaaccctggcttttaaaaatgatgaaaacaagaatcagattgttgaatgcaacgctcttccaactctgattttgatgcttcggtcagaagatgctgctattcattatgaagcggttggtgtgatcggaaatctggtccactcatcccccaatataaagaaagatgttattcttgctggagccttgcaacctgttattggattacttagctcctgttgctctgaaagccagagggaagcagcattgttacttggacagtttgcagcgactgattcagactgcaaggttcacattgtacagagaggtgctgtacgacctttgatagagatgcttcagtcttcagatgttcagctcaaagaaatgtctgcttttgcattggggagattggcacaggacacacataaccaagctggtattgcacactctggcggattagtgccactactgaagcttcttgactcaaaaaatgggtctttgcaacataatgctgcttttgctctttatggccttgcagagaatgaggataatgtgcccgactttattaggataggtggaattaagagatttcaggatggagagtttataatccaagcaactaaggattgtgttgctaagacattgaaaagactagaagagaagattaatggtcgtgtgctgaaccatttgttatatcttatgagagtttctgaaaaggcattccaaagacgagttgctttggctcttgctcatctttgttctgcagatgaccagaaaaaaatatttattgaccacaatgggctggagttgcttattggacttcttggctcatcttgccctaagcagcaacttgatggtgctgtggctttattcaagttggccaacaaagctatgactctgtctcctgtagatgctgctcctccatccccaacacctcaggtctatttgggggagcagtatgtaaacaatgctaccctgtccgacgttacatttttggttgaaggtaaacggtttcatgctcatagaatctgtctacttgcatcttcagatgcatttcgtgcgatgtttgatggtggttatagggagaaggatgcaagggacattgagattccaaatattagatggcaggtctttgagcttatgatgagatttatctatactggatcagttgatgtcactcttgaaattgctcaagatctcctccgagcagctgatcaatatctcttggaagggcttaagagactatgtgaatacacgattgcacagcatgtatcactcgagaatgtgtcaagtatgtatgaactttcagaagccttcaatgctacatcattgagacacacgtgcatcctttttatcttggggcacttcgataaattaagtgaaacgccagggaactctgatttaattcagcgtacaataccagatatccgcaattactttgttaatgctcttacaaaggggaactccaacatccaggcgtagcatgtgccattcttacttctaacagattgcaatgtacataatatgcagatgttatttattgaagtgtgaggtcttctggattcagaacaacatggttttgaagaaatgtccaacaccaagtggtgtatgttcttttttgatgatgtgtctctctcatctgattttaatgtcgatgtcatagatgtagcacacatgaccttcacgaacattgttttttttcctcctgcaagattgtgatggttatgaattaattgttctctatctcaatcgattttcctttacaattgttgagtttatgattatgttacaggttacccaatcatttcatgtatatatgacaattagtcgtttgcaagaaagttgcgttgatggtctggttatgtagtcttttagttgttttctgacataaaaaggtgttgttaactaatgttacaaatacatcttttatgta

SEQ ID NO: 7673 - DNA, 2578 bp, Medicago truncatula
cgctcttctccctctcacacctatctaactcttatctatctcacacagagagagagagagagaaagagagggagaggaaccttctagactctttcttcttattcttcttaaccgttgatggagcttctaccatcatcagagaagaaaggccagaaaagaaaactggaacaacaagaagaacaattccaacaagtcacacagatctcccttcctctcaccggagacgctctcgacgccgttctctccgacgtcgatcaacacgtttcaattctcctttcatctttctcatccaacgaattcgatagagcttccgctaaacgcgccactcacgctctcgccgatcttgccaaaaacgaggaaattgtgaatgtcattgttgaaggaggtgctgttccggctttgattaagcatcttcaaccaccgactcaaaatgattctgttcaaaagccgttgccgtttgaacatgaggttgagaaagggagtgctttcgcgcttggacttcttgctgtcaagccagaacatcaacagctcattgtagacagtggtgccttgaagcatcttgttgatcttttgaagagacataagaatggactaacatcacgtgccattaatagtctcattcggagggctgcagatgcgatcacgaatcttgctcacgagaacagcagtattaaaacccgtgtcaggacggaaggtgggattccaccattagttcatttgcttgaatttgcggatacaaaagtgcaaagagcagctgctggtgctttacgaaccctggcttttaaaaatgatgaaaacaagaatcagattgttgaatgcaacgctcttccaactctgattttgatgcttcggtcagaagatgctgctattcattatgaagcggttggtgtgatcggaaatctggtccactcatcccccaatataaagaaagatgttattcttgctggagccttgcaacctgttattggattacttagctcctgttgctctgaaagccagagggaagcagcattgttacttggacagtttgcagcgactgattcagactgcaaggttcacattgtacagagaggtgctgtacgacctttgatagagatgcttcagtcttcagatgttcagctcaaagaaatgtctgcttttgcattggggagattggcacaggacacacataaccaagctggtattgcacactctggcggattagtgccactactgaagcttcttgactcaaaaaatgggtctttgcaacataatgctgcttttgctctttatggccttgcagagaatgaggataatgtgcccgactttattaggataggtggaattaagagatttcaggatggagagtttataatccaagcaactaaggattgtgttgctaagacattgaaaagactagaagagaagattaatggtcgtgtgctgaaccatttgttatatcttatgagagtttctgaaaaggcattccaaagacgagttgctttggctcttgctcatctttgttctgcagatgaccagaaaaaaatatttattgaccacaatgggctggagttgcttattggacttcttggctcatcttgccctaagcagcaacttgatggtgctgtggctttattcaagttggccaacaaagctatgactctgtctcctgtagatgctgctcctccatccccaacacctcaggtctatttgggggagcagtatgtaaacaatgctaccctgtccgacgttacatttttggttgaaggtaaacggtttcatgctcatagaatctgtctacttgcatcttcagatgcatttcgtgcgatgtttgatggtggttatagggagaaggatgcaagggacattgagattccaaatattagatggcaggtctttgagcttatgatgagatttatctatactggatcagttgatgtcactcttgaaattgctcaagatctcctccgagcagctgatcaatatctcttggaagggcttaagagactatgtgaatacacgattgcacagcatgtatcactcgagaatgtgtcaagtatgtatgaactttcagaagccttcaatgctacatcattgagacacacgtgcatcctttttatcttggggcacttcgataaattaagtgaaacgccagggaactctgatttaattcagcgtacaataccagatatccgcaattactttgttaatgctcttacaaaggggaactccaacatccaggcgtagcatgtgccattcttacttctaacagattgcaatgtacataatatgcagatgttatttattgaagtgtgaggtcttctggattcagaacaacatggttttgaagaaatgtccaacaccaagtggtgtatgttcttttttgatgatgtgtctctctcatctgattttaatgtcgatgtcatagatgtagcacacatgaccttcacgaacattgttttttttcctcctgcaagattgtgatggttatgaattaattgttctctatctcaatcgattttcctttacaattgttgagtttatgattatgttacaggttacccaatcatttcatgtatatatgacaattagtcgtttg

SEQ ID NO: 7674 - DNA, 2759 bp, Medicago truncatula
caattttaccgtaactaccgaaaataccccttcagttctgtgatccattcaaatcttcatttccaattctcgccatttctatctgattttctctttccattccattctgttaaccatagcgccaaccaacaccacactcttcttcacccttcttctctctctttcatggagtttcagagacgccaaggtcactgcctctccgagaggaaggggcaaaaacgtaagttagacgaagaattaccggaagaccgtcagatctcgtcggcaccgcctaccgccgacgaacgtgcggcacttctcgtcgaagttgctaatcaggtcaccgttctcgagtctactttcacgtggaatgaagccgatcgagccgcggctaagcgtgctactcatgcgcttgccgatctcgcgaagaatgaggaagtggtgaatgtgattgtggaaggaggtgcgattccggctctgattaagcatcttcaagcgccgccggtgactgattgcgttcagaagccgttgccgtttgagcatgaagttgagaaagggagtgccttcgcgttaggacttctcgccgtcaagccggaacatcaacaactaattgtggacggtggtgccttaacacatcttgttgatcttttaaagaggcataataatggtttgacttctcgtgccattaatagtctcattcgtagggctgcggatgctgttactaatctcgcacatgagaatagcaacattaaaacccatgtcaggatggaaggtggaattccaccacttgttcatttgctggaatttgctgatacaaaggtgcaaagagcagctgctggtgcactgcgaactctagcttttaaaaatgatgaaaataaaattcagattgttgaatgtgatgctcttccgactctgattctaatgctgcgttctgaagatgctgctattcattatgaagcggttggtgtgattggaaatctagttcactcatctcctaatataaagaaagaggttttatttgcaggtgctttacaaccagttattggattacttagctcacgctgccctgaaagtcagagggaagcggcattgttacttggacagtttgcagcaactgattcagactgcaaggttcacattgtacagagaggtgctgtccgacctttgatagagatgctttcgtctcctgatgtacaacttagagaaatgtctgcctttgcattggggagattggcccaggacacacataaccaagcgggtattgcacacaatggtggtttagtgccactgctcaagcttcttgactcaaaaaatgggtctttgcaacataatgctgcttttgctctttatggccttgcagagaatgaggataatgtgtcggatttcattagggtaggtggagttcaaagactacaagaaggagagtttattgttcaagcgactaaagattgtgttgccaagacattgaaaagattagaggagaagattcacggtcgtgtgttgaaccatctgttatatcttatgcgagtttcagaaaggggttttcaaaggcgaattgcgttggttcttgcacatctttgccctgcagatgatcaaagaagaatttttattgaacaccatggtcttgagttgcttatcagtcttctcagctcatccagctccaaacagcaacttgatggtgctgtggctttatgcaagttggccaataaagcctcagccctatctcctgtagacgctgctcctccttctccaacaccacaggtttacttaggagagcagtatgtaaacaatgctacattgtccgatgttacatttttggttgaaggcaaacgtttttatgctcatagaatttgtctactggcatcttcagatgcatttcgtgcaatgtttgatggtggttatagggagaaggatgcaagggacatagagatcccaaatattagatgggaagtttttgagttgatgatgagatttatatatactggatcagttgatatcactccagatattgctcaagaccttcttcgagcagctgatcaatatcttttagatggactaaagagactctgtgagtacacaattgcacaggatatattactagagaacgtgtcaagtatgtatgaactttcagaagccttcaatgcattatcgttgaggcatgcatgcattctttttatcttggagcactttgataagttgagcgcgcggccagggcactctcttctgattcagcgtataataccagagatccgcaattactttgttaaagctcttacaaatgtcaactcccatagactgtaatgtgcagcgattctcttgacctctaaccaattgtgatgtacagaatgtagatgttattcctagtgttgtaccaggaagggggtcttctttatggtatacaggtcgactaatagaaatattacaccagagagtagggcatgttctctttcttttttttctttgatgtggtgtaagcccctttctgtctctagcattattacaatcatagatatagtaaatatacggccttcacgaacattgttttttcttctgcaatattgtgatggttccattccttatatggcaattgttccccgttgtatatatgacaattggatattagataattgtctacgaaaattgaactgctgggtaatttatgccaggccgttaaatcctgtcgtctgacatggaactgttgtaaattgctgtagcaaatactctacttgtatggcccaaggcatgctgctggtgtcactgctaaattttttacaatttct

SEQ ID NO: 7675 - DNA, 2603 bp, Medicago truncatula
ctgattttctctttccattccattctgttaaccatagcgccaaccaacaccacactcttcttcacccttcttctctctctttcatggagtttcagagacgccaaggtcactgcctctccgagaggaaggggcaaaaacgtaagttagacgaagaattaccggaagaccgtcagatctcgtcggcaccgcctaccgccgacgaacgtgcggcacttctcgtcgaagttgctaatcaggtcaccgttctcgagtctactttcacgtggaatgaagccgatcgagccgcggctaagcgtgctactcatgcgcttgccgatctcgcgaagaatgaggaagtggtgaatgtgattgtggaaggaggtgcgattccggctctgattaagcatcttcaagcgccgccggtgactgattgcgttcagaagccgttgccgtttgagcatgaagttgagaaagggagtgccttcgcgttaggacttctcgccgtcaagccggaacatcaacaactaattgtggacggtggtgccttaacacatcttgttgatcttttaaagaggcataataatggtttgacttctcgtgccattaatagtctcattcgtagggctgcggatgctgttactaatctcgcacatgagaatagcaacattaaaacccatgtcaggatggaaggtggaattccaccacttgttcatttgctggaatttgctgatacaaaggtgcaaagagcagctgctggtgcactgcgaactctagcttttaaaaatgatgaaaataaaattcagattgttgaatgtgatgctcttccgactctgattctaatgctgcgttctgaagatgctgctattcattatgaagcggttggtgtgattggaaatctagttcactcatctcctaatataaagaaagaggttttatttgcaggtgctttacaaccagttattggattacttagctcacgctgccctgaaagtcagagggaagcggcattgttacttggacagtttgcagcaactgattcagactgcaaggttcacattgtacagagaggtgctgtccgacctttgatagagatgctttcgtctcctgatgtacaacttagagaaatgtctgcctttgcattggggagattggcccaggacacacataaccaagcgggtattgcacacaatggtggtttagtgccactgctcaagcttcttgactcaaaaaatgggtctttgcaacataatgctgcttttgctctttatggccttgcagagaatgaggataatgtgtcggatttcattagggtaggtggagttcaaagactacaagaaggagagtttattgttcaagcgactaaagattgtgttgccaagacattgaaaagattagaggagaagattcacggtcgtgtgttgaaccatctgttatatcttatgcgagtttcagaaaggggttttcaaaggcgaattgcgttggttcttgcacatctttgccctgcagatgatcaaagaagaatttttattgaacaccatggtcttgagttgcttatcagtcttctcagctcatccagctccaaacagcaacttgatggtgctgtggctttatgcaagttggccaataaagcctcagccctatctcctgtagacgctgctcctccttctccaacaccacaggtttacttaggagagcagtatgtaaacaatgctacattgtccgatgttacatttttggttgaaggcaaacgtttttatgctcatagaatttgtctactggcatcttcagatgcatttcgtgcaatgtttgatggtggttatagggagaaggatgcaagggacatagagatcccaaatattagatgggaagtttttgagttgatgatgagatttatatatactggatcagttgatatcactccagatattgctcaagaccttcttcgagcagctgatcaatatcttttagatggactaaagagactctgtgagtacacaattgcacaggatatattactagagaacgtgtcaagtatgtatgaactttcagaagccttcaatgcattatcgttgaggcatgcatgcattctttttatcttggagcactttgataagttgagcgcgcggccagggcactctcttctgattcagcgtataataccagagatccgcaattactttgttaaagctcttacaaatgtcaactcccatagactgtaatgtgcagcgattctcttgacctctaaccaattgtgatgtacagaatgtagatgttattcctagtgttgtaccaggaagggggtcttctttatggtatacaggtcgactaatagaaatattacaccagagagtagtgcatgttctctttcttttttttctttgatgtggtgtaagcccctttctgtctctagcattattacaatcatagatatagtaaatatacggccttcacgaacattgttttttcttctgcaatattgtgatggttccattccttatatggcaattgttccccgttgtatatatgacaattggatattagataattgtctacgaaaattgaactgctgggtaatttatgccaggccgttaaatcctgtcgtctgacatggaactgttgtaaat

SEQ ID NO: 7676 - DNA, 2483 bp, Vitis vinifera
gcggacctcaggtctcaatcctttgccttgatggagcttcagaagcgccaagatcagggccagcccgagaggaaggggcaaaaacggaaactggaggaagaattcgaagaggagcgggagatctccgtggcgccgtccggcgaggcgcaccaggcgttatcctgcgaggtcagtgcgcaggttaatatcctcaacaccaccttttcgtggaaagaagccgatcgagccgccgctaagagagccactcacgtactcgccgagcttgctaagaacgaggaagttgtgaatgtaatcgtcgacggtggggctgttccggcactggtgaagcatctgcaggcaccgccttccagcgatggcgaccatgaccagaggcccttcgagcacgaggttgagaaagggagtgcttttgctctgggtctccttgctgtaaagccagagcatcagcaactcatagttgataatggtgctttgtctcatctagtggatcttttaaagaggcacagagatggttctaactctcgagctgtcaatagtgtcattcgaagagcagccgatgctgtcactaaccttgctcatgagaatagcagtattaaaaccagagtcaggatggaaggcgggataccacccctcgttcagttacttgaatttgctgatacaaaggtgcaacgggcagctgctggggcactgagaaccctggcatttaaaaatgatgaaaataaaaatcagattgtagaatgtaatgctcttcctaccctgattctaatgcttcgatctgaggatgctgctatacattatgaagcagttggtgtaattggaaatttggtacactcttcgccaaacataaagaaagaagtgcttttggctggagctttacagcctgttataggattacttagttcgtgctgctctgagagccaaagggaggcagctttgttacttggacaatttgctgcaactgattcagattgcaaggtgcatattgcacagagaggtgctgtgcgacctttgattgagatgcttcaatctgcagatgtacagctgagggaaatgtcagcctttgcattggggagattggcacaggacacacacaatcaagccggtattgctcataatggcggtctagtcccattattgaagcttcttgattcaaaaaatggatcactgcaacataatgctgcatttgcactttatggccttgcagataatgaggacaatgtatctgattttatcaaggtgggaggggttcagaagctgcaggatggagaatttattgttcaagcaacaaaagattgtgtagccaagacattgaaaagattagaggaaaagattcatggaagagttttgaaccatttgttatatctgatgcgtgtatctgagaaggctgttcaaagacgagttgctttagctcttgctcatctttgttctgcagatgatcagaggacaatcttcattgataacaatggattggagttgcttcttgggcttcttggttcttcaagcccaaagcagcaacttgatggttctgtggctctctacaaattggccaacaaagccatgactctctctcctgtggatgcagctcctccttctcccacaccccaggtctatttgggagagcaatatgtaaacagtgctacattgtccgatgttacctttctagttggaggtaaaaggttctatgctcacagaatttgccttttggcatcttcagatgcattccgtgcaatgtttgatggtggttatcgggagaaggatgcaagagatatagagatcccgaatatcagatgggaggtttttgagttgatgatgagatttatatacactggatctgtagaaattacattggatattgcacaagatctcctcagagctgctgatcagtatctcttggagggactaaagcgtctctgtgagtataccattgcccaggatatatcactggaaaatgtttcaagtatgtatgagctttcagaagccttccatgctatttcattaagacacacatgcatcctgtttatcttggagcagttcagtaaactgagttctaggcccgggcattctcatctgatccaacgaataattccagagatccgcacctactttgctaaagcacttaccaagcctaacccacataattcgaggctataatacggctgtcatttgattcttgatctctaactaaatacattgtacagaaagtggtagatcttcgtggcggtggtgagcaggtggaaggatctaactggttgattgtagtgtggcccaaatgttttgctgattcaagagttctgttgcttgtaagttgtaaacaattactgtaagttacgtctataatgctattgtcttttagctattgctgggaagtatgacctcttttattcattctgaaggttataatggctatatgatgtactctactcaggcctgactcacaagtgtattatcactcagtgggaggtggcatctttcaccgagcattaggt

SEQ ID NO: 7677 - DNA, 2815 bp, Vitis vinifera
ggctcgcttcttgtatctgatgtctcatctctgagcggacctcaggtctcaatcctttgccttgatggagcttcagaagcgccaagatcagggccagcccgagaggaaggggcaaaaacggaaactggaggaagaattcgaagaggagcgggagatctccgtggcgccgtccggcgaggcgcaccaggcgttatcctgcgaggtcagtgcgcaggttaatatcctcaacacaaccttttcgtggaaagaagccgatcgagccgccgctaagagagccactcacgtactcgccgagcttgctaagaacgaggaagttgtgaatgtaatcgtcgacggtggggctgttccggcactggtgaagcatctgcaggcaccgccttccagcgatggcgaccatgaccagaggcccttcgagcacgaggttgagaaagggagtgcttttgctctgggtctccttgctgtaaagccagagcatcagcaactcatagttgataatggtgctttgtctcatctagtggatcttttaaagaggcacagagatggttctaactctcgagctgtcaatagtgtcattcgaagagcagccgatgctgtcactaaccttgctcatgagaatagcagtattaaaaccagagtcaggatggaaggcgggataccaccccttgttcagttacttgaatttgctgatacaaaggtgcaacgggcagctgctggggcactgagaaccctggcatttaaaaatgatgaaaataaaaatcagattgtagaatgtaatgctctccctaccctgattctaatgcttcgatctgaggatgctgctatacattatgaagcagttggtgtaattggaaatttggtacactcttcgccaaacataaagaaagaagtgcttttggctggagctttacagcctgttataggattacttagttcgtgctgctctgagagccaaagggaggcagctttgttacttggacaatttgctgcaactgattcagattgcaaggtgcatattgcacagagaggtgctgtgcgacctttgattgagatgcttcaatctgcagatgtacagctgagggaaatgtcagcctttgcattggggagattggcacaggacacacacaatcaagccggtattgctcataatggcggtctagtcccattattgaagcttcttgattcaaaaaatggatcactgcaacataatgctgcatttgcactttatggccttgcagataatgaggacaatgtatctgattttatcaaggtgggaggggttcagaagctgcaggatggagaatttattgttcaagcaacaaaagattgtgtagccaagacattgaaaagattagaggaaaagattcatggaagagttttgaaccatttgttatatctgatgcgtgtatctgagaaggctgttcaaagacgagttgctttagctcttgctcatctttgttctgcagatgatcagaggacaatcttcattgataacaatggattggagttgcttcttgggcttcttggttcttcaagcccaaagcagcaacttgatggttctgtggctctctacaaattggccaacaaagccatgactctctctcctgtggatgcagctcctccttctcccacaccccaggtctatttgggagagcaatatgtaaacagtgctacattgtccgatgttacctttctagttggaggtaaaaggttctatgctcaccgaatttgccttttggcatcttcagatgcattccgtgcaatgtttgatggtggttatcgggagaaggatgcaagagatatagagatcccgaatatcagatgggaggtttttgagttgatgatgagatttatatacactggatctgtagaaattacattggatattgcacaagatctcctcagagctgctgatcagtatctcttggagggactaaagcgtctctgtgagtataccattgcccaggatatatcactggaaaatgtttcaagtatgtatgaactttcagaagccttccatgctatttcattaagacacacatgcatcctgtttatcttggagcagttcagtaaactgagttctaggcccgggcattctcatctgatccaacgaataattccagagatccgcacctactttgctaaagcacttaccaagcctaacccacataattcgaggctataatacggctgtcatttgattcttgatctctaactaaatacattgtacagaaagtggtagatcttcgtggcggtggtgagcaggtggaaggatctaactggttgattgtagtgtggcccaaatgttttgctgattcaagagttctgttgcttgtaagttgtaaacaattactgtaagttacgtctataatgctattgtcttttagctattgctgggaagtatgacctcttttattcattctgaaggttataatggctatatgatgtactctactcaggcctgactcacaagtgtattatcactcagtgggaggtggcatctttcaccgagcattaggtattttgattttggttctttgttaggttctctctctatggtgatgaaccaaatgtaatagactttctagtaatgtaaaacagagaggcaaggaaaaaaaaaaaaaaactgctgaattggtgtgacatccgtgaacatcccaagtttttgatatcgaatactagaatggtcggtcaacgatttcttgtcggtggactcagctttttagtgaagacactcgacgatttctcaaatttattttttcggagctgtcaattcttgcattggagttttggcctttgtgccgatcttagaattgcc

SEQ ID NO: 7678 - DNA, 2617 bp, Citrullus lanatus
ctctctctcttctcctctctctcccttttcccacttgatcaaacccctccagatttggttctttggatcagcttcttccatctctcgttatccaagctcctctggttgtttatggagcttcagaagcgcctagatcatagtctcccagagaggaaaggccataagcggaaactggaggaggaatttgaagaggaacgggagatctctgtacctacaggggacgccaagcaagcgttactcaccgaggtcagtgatcaagttgaaattctcaattccactttttcatggaaggaagccgatcgagctgctgctaagcgagctactcatgttcttgccgagcttgctaagaacgaagaagtagtaaacgtgattgtggaaggtggagccgtgccggctttagtcaagcatctacaagcaccgcctactgttgaaggtgatcgcagtcttaagccattcgagcacgaggttgagaaaggaagtgcttttgctcttggactactggctgtaaagccagagcaccagcaactgatagttgacattggcgctctatcacacctggttgagctattgaagaggcacaaggatggttcttctcgagctgtaaacagtgttattcgtagagctgcagatgccattactaatcttgcccatgagaacagtttcatcaaaacacgggttaggatggaaggtggaattcctccgcttgttgaattgcttgaatttactgacacaaaggtgcaaagagctgctgctggggcattacgaacattggcctttaagaacgatgagaacaaaaaccaaattgttgagtgcaatgctctccctacactcattttgatgcttcgttctgaggatgctgctatacattatgaagcggttggtgttatcggtaatttggtgcactcatccccaaatataaagagagaagttcttcttgcaggagctttgcaacctgttattggattactcagttcttgctgctctgagagccaaagggaggcagcgttattacttggacaatttgcagcaactgattcggattgtaagattcacattgtacagagaggtgctgtccgacccttaattgagatgcttcaatcacctgatgtacagcttcgagaaatgtcagcttttgcattggggaggttggcacaggaaactcataatcaagctggtattgctcacaatggtggtctaatgccactactgaagcttctggattcaaaaaatggttctttgcaacataatgcggcatttgctctttatggtcttgcagacaatgaggataatgtatctgattttattagggtgggaggagttcagaagcttcaagatggagaatttatagtgcaagcaacaaaagattgtgtagcaaagacactcaagagattagaggagaaaatacatggaagggttttaaatcacttattacatctaatgcgtgtagctgagaaagctgtgcaaagacgagtctcccttgctcttgctcatctttgttcacctgatgatcagaggaccatatttatcgataataatggtctggagctgcttcttggcctgcttggttcttcaagtctcaagcagcagcttgatggtgctgttgcgctgtacaagctggcaaataaagccacgactctttctcctgtggatgctgctccaccatctccaacaccacaggtttacctcggtgagcagtatgtgaacaatccgacactatctgatgtgacttttcttgttgaaggaagacgcttccatgcccacagaatttgcttgcttgcttcttcggatgcattccgtgccatgtttgatggtggctatcgggagaaggatgctaaggatatagaaattccaaatattagatgggaagtttttgagctaatgatgagatttgtttacaccggatctgtggatgttttgttggatattgctcaagatctcctgagagctgccgatcagtatctcttggagggacttaaacgattgtgcgaatacaccattgcacaggatatatcattggaaaatgtttcaagcatgtatgaactctcagaagcctttaatgccatatctttgagacacacgtgcatcctttttatcttggaacaatttgaaaaactcagtggaatgccagggcattctcttctaattcagcgcatacttcccgagatccgcaattattttgctaaagccctgaccaaggctaatctccagagctcacggctgtagatggctgcactgtttcgttattcatcattgctaaccaacaaacacgatgtacagatagtggtagatttggttgctgctgccgggctagattgaggttcgaatttagctgatttgttttatggctcatgatcctttgatttttttccctccccccctaatggtaagggttttgatattttgtataaagtcttaagtaataccattgctagatagaatgaccttagtccttacgagaatcttgtccttgaaatgcattgcatttattttatgaattgatgtatcttcccgaatgactaagctctggtgaagaggcattcagttggagaacattgtaaatttgacaccagtaatatcaatttcaggggtttaagagttcatcttttgaaataatttt

SEQ ID NO: 7679 - DNA, 2454 bp, Gossypium hirsutum
ctaatatccaaatacccctcgatctagtctctctgtgtgtgtcaaatcacgcttctcatttccgataacaccttctctctcctctctttctctcgcaagtcccttctttaatccttcttgatggagcttcagcgttcggaggaccagggcctccctgaacggaaggggcaaaaacggaaactggaggaagaaattcaagaggaccgtgaaatctctctccctaccggcgacgcccgccgtgccctcttggccgaagttaccgctcaggttaccgtactcgaatccgccttcacttggcgcgaatctgatcgctctgctgccaagcgtgccactcacgtgctcgctgagcttgccaagaacgaggaggttgttaatgtgatcgttgaaggtggtgctgttccggctctagtgaagcatctgcaagcgccgccatgcgaggacggcgaccgaagcccgaagcctttcgagcacgaggttgaaaaaggaagtgcttttgcattggggctgcttgccgtaaagccagaacatcagcaacttatagttgattctggggctttgtcgcatcttgtgaacttgttgcggcgtcacaaggatagttctatttctcgtgctgtgatcagtgtcattagaagagcagctgatgctctcaccaaccttgctcatgagaatagcagcattaaaacgcgtgtcagaatggaaggtgggattccacctcttgttgagttgcttgaatttactgatactaaggtgcaaagagcagctgctggcgcattacgaaccctagcattcaaaaatgatgaaaacaagaatcagattgttgaatgcaatgctctacctactctcatcttaatgctaagatcagaggatgctgctatacactatgaagcggttggtgtgattggcaatctggtgcattcatcgccaaacataaaaaaagaagttcttgctgcgggggctctgcaacctgtcattggtttgcttaactcctgctgctcagagagccaaagggaggcagctttattgcttggacaatttgctgcaactgattctgattgcaaggttcatattgtacaaaggggtgctgtccgacccttgattgaaatgcttcactctcctgatgtacagctgaaagagatgtcgacctttgctttggggaggttggcacaggatacacacaatcaagctggtattgcgcatagtggtggtttggtccctttgttgaagcttctagattcgaagaatggatctttgcaacacaatgctgcatttgctctttatggtcttgcagataatgaggataatgtatccgattttattagggtggggggtgtccaacggctgcaagatggagagtttattgttcaagcaacaaaagactgtgtagccaagacattgaaaagactagaagagaagattcatgggcgagttttgaaccatttgctgtatctgatgcgcgtagcggagaagccagtccaaagacgagtggctttggctctagcttatctttgttcccctgatgaccagagaaccatattcattgataataatggacttgaactgcttcttgggcttcttggttctactagcactaagcagcaacttgatggtgctgtagctctgtacaagttgtccaacaaagctatgacgctttctcctatggatgcagctcccccttctccaacaccacaggtctatttgggggagcaatatgtgaacaacgctacattgtctgatgttaccttcctagttgaaggtagacggttctatgctcacagaatctgtctgcttgcttcttcagatgcatttcgtgctatgtttgatggcggttaccgggaaaaagatgcaagggatattgaaattcctaacatcaaatgggaggtttttgagttgatgatgagatttatatatactggatcagtagatgttactttggatattgcacaagatctgctcagagcagctgatcaatatcttttggagggacttaagcgactttgcgaatataccattgcacaggatatatcgcttgaaaatgtttcaagcatgtatgagctgtctgaagcttttcatgcaatatccttgaggcacacttgcattttatttatcttggagcattttgataaattgagtgcaagacccgggcacttgcatctaatccagcgaatagttcccgagattcgcaattactttgctaaagcacttacaaaacctaacccacataaactgcggctatagaaggctgggtctttttaactcctgatctcttgctaggtttgttgtacagaaagtagtcagatccgatctcttcgatgttgtggagccgattgaaggttctaattggttatttgtagcgtggttcataatcatttgcctgtagagcaaaaagcattagtttcttctttgattcattgttcttagatgtttggagaatatcatgtaatgtgttggttgtta

SEQ ID NO: 7680 - DNA, 2826 bp, Gossypium raimondii
aaaagaatgaaaaagcttcccgttttactaaatatccaaaatacccctgatctagtctctctgtgtgtgtcaaatcacgcttctcatttccgataacaccttctctctctctctctttctctcgcaagtcccttctttaatccttcttgatggagcttcagcgttcggaggaccagggcctccctgaacggaaggggcaaaaacggaaactggaggaagaaattcaagaggaccgtgaaatctctctccctaccggcgccgcccgccgtgccctcttggccgaagttaccgctcaggttaccgtactcgaatccgccttcacttggcgcgaatctgatcgctctgctgccaagcgtgccactcacgtgctcgctgagcttgccaagaacgaggaggttgttaatgtgatcgttgaaggtggtgctgttccggctctagtgaaacatctgcaagcgccgccatgcgaggacggcgaccgaagcccgaagcctttcgagcacgaggttgaaaaaggaagtgcttttgcattggggctgcttgccgtaaagccagaacatcagcaacttatagttgattctggggctttgtcgcatcttgtgaacttgttgcggcgtcacaaggatagttctatttctcgtgctgtgatcagtgtcattagaagagcagctgatgctctcaccaaccttgctcatgagaatagcagcattaaaacgcgtgtcagaatggaaggtgggattccacctcttgttgagttgcttgaatttactgatactaaggtgcaaagagcagctgctggcgcattacgaaccctagcattcaaaaatgatgaaaacaagaatcagattgttgaatgcaatgctctacctactctcatcttaatgctaagatcagaggatgctgctatacactatgaagcggttggtgtgattggcaatctggtgcattcatcgccaaacataaaaaaagaagttcttgctgcgggggctctgcaacctgtcattggtttgcttaactcctgctgctcggagagccaaagggaggcagctttattgcttggacaatttgctgcaactgattctgattgcaaggttcatattgtacaaaggggtgctgtccgacccttgattgaaatgcttcactctcctgatgtacagctgaaagagatgtcgacctttgctttggggaggttggcacaggatacacacaatcaagctggtattgcgcatagtggtggtttggtccctttgttgaagcttctagattcgaagaatggatctttgcaacacaatgctgcatttgctctttatggtcttgcagataatgaggataatgtatccgattttattagggtggggggtgtccaacggctgcaagatggagagtttattgttcaagcaacaaaagactgtgtagccaagacattgaaaagactagaagagaagattcatgggcgagttttgaaccatttgctgtatctgatgcgcgtagcggagaagccagtccaaagacgagtggctttggctctagcttatctttgttcccctgatgaccagagaaccatattcattgataataatggacttgaactgcttcttgggcttcttggttctactagcactaagcagcaacttgatggtgctgtagctctgtacaagttgtccaacaaagctatgacgctttctcctatggatgcagctcccccttctccaacaccacaggtctatttgggggagcaatatgtgaacaacgctacattgtctgatgttaccttcctagttgaaggtagacggttctatgctcacagaatctgtctgcttgcttcttcagatgcatttcgtgctatgtttgatggcggttaccgggaaaaagatgcaagggatattgaaattcctaacatcaaatgggaggtttttgagttgatgatgagatttatatatactggatcagtagatgttactttggatattgcacaagatctgctcagagcagctgatcaatatcttttggagggacttaagcgactttgcgaatataccattgcacaggatatatcgcttgaaaatgtttcaagcatgtatgagctgtctgaagcttttcatgcaatatccttgaggcacacttgcattttatttatcttggagcattttgataaattgagtgcaagacccgggcacttgcatctaatccagcgaacagttcccgagattcgcaattactttgctaaagcacttacaaaacctaacccacataaactgcggctatagaaggctgggtctttttaactcctgatctctagctaggtttgttgtacagaaagtagtcagatccgatctctttgatgttgtggagccgattgaaggttctaattggttatttgtagcgtggttcataatcatttgcatgtagagcaaatagcattagtttcttctttgattcatttttcttagatgtttggagaatatcatgtattgtgttggttgttactactttcggagtcggccctcattgaaaatgcttttgttaggtttgagcagttgctcgtttctttttatgccagaaattcgaatgcatgcatgattttaatgtgtaaaagctgagatctgagaatgattgaacaaggtttcgttgaatgaggcctaccaggcttgtgcaatgtcaatgtaaaccgtcttagactatgaaccaaaactcatacgtcacaaacagttcatggtagagttcggaaatcggaaacctgcattttaattgtggtgggtttcaaatttggatactcaatcctgtttttactgtgttaaagctttattgatactttttatatttatttta

SEQ ID NO: 7681 - DNA, 2860 bp, Gossypium hirsutum
actaaatctccaaaatacccctgatccacactgtttcttttcaaatcactggtctcatttccgataataaacctttcctctctttggtttccttcttgatggagcttcagaggtgcgaggaacagggcctgcaagaacgaaaggggcaaaaacggaaacttgaggaagaaattcaagaggatagagatgctactccgctacctaccggcgacgcccgccgtgctctcttggccgaagtcaccgctcaggttaaggtcctcgactccgccttctcctggcacgaatccgatcgcgccgctgccaagcgtgccactcacgtgctcgctgagctcgcaaagaacgaggaagttgttaatgtgatcgttgaaggtggtgcgattccagctctagttaagcatctgcaagcacctttgtctgatgaaggtgacctaagcttgaagccttttgagcacgaggttgagaaaggaagtgctttcgctttgggacttcttgccgtaaagccagaacatcagcaacttatagttgattctggggccttgtcgcatcttgtgaatttgttgaggcgacacaaggatagttctacttctcgtgctgtgatcagtgtcattagaagagcggctgatgctatcaccaaccttgctcatgagaatagcagcattaaaacccgtgtcagaatggaaggtggaattccacctcttgttgagttgcttgaatttactgacacaaaggtgcaaagagcagctgctggggcattacgaaccctggcattcaaaaatgatgaaaacaagaatcagatcgttgaatgcaatgctcttcctactctcatctcgatgctgagatcagatgatgctgccatacactatgaagcggttggtgtgattggcaatctggtgcattcatcaccgaacataaaaaaggaagttctcgctgctggggctttgcaacctgtcattggtttgcttacctcctgctgctcagaaagccaaagagaggctgctttgctacttgggcaatttgccgcaactgattctgattgcaaggttcatattgtacaaaggggtgctgtcagacccttgattgaaatgcttcactctcctgatatacagctgaaagagatgtcagcctttgctttggggaggttggcacaggacacgcacaatcaagctggtattgcacatatgggtggtttggtgcctttgttgaagcttctagattcaaagaatggatctttgcaacacaatgctgcatttgctctttatggtcttgcagataatgaggataatgtatccgactttattagggtgggtggtgtccaacggctgcaagatggagaatttattgttcaagcgacaaaagactgtgtagccaagacattgaaaagactagaggagaagattcatgggcgagttttgaaccatttgctgtatctgatgcgtgtagccgagaagcctgtccaaagacgagtggcttttgctctagctcatctttgttctcctgatgatcagagaactatattcattgataataatggacttgagttgcttcttgggcttcttggttctacgaaccctaaacagcaacttgatggtgctgtagctctgtacaagttggccaacaaagctatgacgctttctcctatggatgcagctcccccttctccaacaccacaggtctatttgggggagcaatacgtcaacaatgctacattatctgatgttactttcctagttgaaggtagacggttctatgcgcacagaatctgccttcttgcttcttcagatgcatttcgtgctatgtttgatggtggttatcgggaaaaagatgcaagggatattgaaattccaaacattagatgggaggttttcgagttgatgatgcgatttatatacactggatcagtagatgtttcattggatattgcacaagatctgcttggagctgctgatcaatatcttttggaagggcttaagcgactctgtgagtacaccattgcacaggatgtaacactggacaatgtttctagcatgtacgaactctccgaagcttttcatgctatatcattgaggcacacttgcattttgtttatcttggagcatttctctcaattgagcgacagacccgggcactcacatctgatccagcgtataattccagagatccgcaattactttgcgaaagcgcttacgaatcctaacccacataaccagcggccgtagaaggcaaccagtggctgtagaaggctggtttttaactcatctcatctctaacaagatacgttgatgtacagaaatgtagtagctgttgttgatgtggagccaattgaaggttctctaattcgtttctttgtagcacggttcgtaatcgtttccgatgcccgagttgtttcgtggtgtttgtagaaaacaaggtgtaagtttctcattttaattcattgtcttgtctgcatttagatgtttacacgaacaaaaacctgtatcacgatttgttagctattggactttgctttattaacttctgtgtatatccttacgtagaatctgatcggaactagggcatatattgtttcataaactaacaagatctgtagctttaaaggtttaaacacagtatctttgaggatcgctttcaaaagataggtgtaatgatatggtctacaaaagttagagccaaaggttatgttatatggtttacaaaagtatgattggatgcatatatgaatcttgttttggagggtcgattcttgattggtcctccaacaactgaaggtattgtctttcgagagttgtcttcttataatgtcgagagctggtgtgcggtgaacgattgtcctgagggtctagttcacagagttggaagtgcc

SEQ ID NO: 7682 - DNA, 3075 bp, Gossypium raimondii
ttaaaaattaagttaggcattataccataaaagtttaacagaaaaacagaggcttaagtaaacatttaaattttaatcgtcaaataaaaaggaaaataaagatgtcctggtccggccggtttaaatcggccattaatctttcattttcattttagagaaaaaaagtaaaagaggaaaagaaaaagaaaagaaaagggaagaaaaagaatgaaaaagcttcccgttttactaaatatccaaaatacccctgatctagtctctctgtgtgtgtcaaatcacgcttctcatttccgataacaccttctctctctctctctttctctcgcaagtccattctttaatccttcttgatggagcttcagcgttcggaggaccagggcctccctgaacggaaggggcaaaaacggaaactggaagaagaaattcaagaggaccgtgaaatctctctccctaccggcgccgcgcgccgtgccctcttggccgaagttaccgctcaggttaccgtactcgaatccgccttcacttggcgcgaatctgatcgctctgctgccaagcgtgccactcacgtgctcgctgagcttgccaagaacgaggaggttgttaatgtgatcgttgaaggtggtgctgttccggctctagtgaaacatctgcaagcgccgccatgcgaggacggcgaccgaagcccgaagcctttcgagcacgaggttgaaaaaggaagtgcttttgcattggggctgcttgccgtaaagccagaacatcagcaacttatagttgattctggggctttgtcgcatcttgtgaatttgttgcggcgacacaaggatagttctatttctcgcgctgtgatcagtgtcattagaagagcagctgatgctctcaccaaccttgctcatgagaatagcagcattaaaacgcgtgtcagaatggaaggtgggattccacctcttgtcgagttgcttgaatttactgatactaaggtgcaaagagcagctgctggcgcattacgaaccctagcattcaaaaatgatgaaaacaagaatcagattgttgaatgcaatgctctacctactctcatcttaatgctaagatcagaggatgctgctatacactatgaagcggttggtgtgattggcaatctggtgcattcatcgccaaacataaaaaaagaagttcttgctgcgggggctctgcaacctgtcattggtttgcttaactcctgctgctcggagagccaaagggaggcagctttattgcttggacaatttgctgcaactgattctgattgcaaggttcatattgtacaaaggggtgctgtccgacccttgattgaaatgcttcactctcctgatgtacagctgaaagagatgtcgacctttgctttggggaggttggcacaggatacacacaatcaagctggtattgcgcatagtggtggtttggtccctttgttgaagcttctagattcgaagaatggatctttgcaacacaatgctgcatttgctctttatggtcttgcagataatgaggataatgtatccgattttattagggtggggggtgtccaacggctgcaagatggagagtttattgttcaagcaacaaaagactgtgtagccaagacattgaaaagactagaggagaagattcatgggcgagttttgaaccatttgctttatctgatgcgcatagcggagaagccagtccaaagacgagtggctttggctctagcttatctttgttcccctgatgaccagagaaccatattcattgataataatggacttgaactgcttcttgggcttcttggttctactagcactaaacagcaacttgatggtgctgtagctctgtacaagttgtccaacaaagctatgacgctttctcctatggatgcagctcccccttctccaacaccacaggtctatttgggggagcaatatgtgaacaacgctacattgtctgatgttaccttcctagttgaaggtagacggttctatgctcacagaatctgtctgcttgcttcttcagatgcatttcgtgctatgtttgatggcggttaccgggaaaaagatgcaagggatattgaaattcctaacatcaaatgggaggtttttgagttgatgatgagatttatatatactggatcagtagatgttactttggatattgcacaagatctgctcagagcagctgatcaatatcttttggagggacttaagcgactttgcgaatataccattgcacaggatatatcgcttgaaaatgtttcaagcatgtatgagctgtctgaagcttttcatgcaatatccttgaggcacacttgcattttatttatcttggagcattttgataaattgagtgcaagacccgggcacttgcatctaatccagcgaatagttcccgagattcgcaattactttgctaaagcacttacaaaacctaacccacataaactgcggctatagaaggctgggtctttttaactcctgatctctagctaggtttgttgtacagaaagtagtcagatccgatctcttcgatgttgtggagccgattgaaggttctaattggttatttgtagcgtggttcataatcatttgcctgtagagcaaaaagcattagtttcttctttgattcattgttcttagatgtttggagaatatcatgtaatgtgttggttgttagtactttcggagtcggccctcattgaaaatgcttttgttaggtttgagcagttgctcgtttctttttatgccagaaattcgaatgcatgcatgattttaatgtgtaaaagctgagatctgagaatgattgaacaaggtttcgttgaatgagacctaccaggcttgtgcaatgtcaatgtaaaccgtcttagactatgaaccaaaactcatacgtcacaaacagttcatggtagagttcggaaatcggaaacctgcattttaattgtggtgagtttcaaatttggatactcaatcctgtttttactgtgttaaggctttattgatactttttatatttattttattttgagattatattattaggtcaattataaatttgtggtggctttac

SEQ ID NO: 7683 - DNA, 2702 bp, Gossypium hirsutum
cgcaagtccattctttaatccttcttgatggagctacagcgttcggaggaccagggcctccctgaacggaaggggcaaaaacggaaactggaagaagaaattcaagaggaccgtgaaatctctctccctaccggcgccgctcgccgtgccctcttggccgaagttaccgctcaggttaccgtactcgaatccgccttcacttggcgcgaatctgatcgctctgctgccaagcgtgccactcacgtgctcgctgagcttgccaagaacgaggaggttgttaatgtgatcgttgaaggtggtgctgttccggctctagtgaaacatctgcaagcgccgccatgcgaggaccgcgacagaagcccgaagcctttcgagcacgaggttgaaaaaggaagtgcttttgcattggggctgcttgccgtaaagccagaacatcagcaacttatagtcgattctggggctttgtcgcatcttgtgaatttgttgcggcgatacaaggatagttctatttctcgcgctgtgatcagtgtcattagaagagcagctgatgctctcaccaaccttgctcatgagaatagcagcattaaaacgcgtgtcagaatggaaggtgggattccacctcttgtcgagttgcttgaatttactgatactaaggtgcaaagagcagctgctggtgcattacgaaccctagcattcaaaaatgatgaaaacaagaatcagattgttgaatgcaatgctctacctactctcatcttaatgctaagatcagaggatgctgctatacactatgaagcggttggtgtgattggcaatctggtgcattcgtcaccaaacataaaaagagaagttcttgctgcgggggctctgcaacctgtcattggtttgcttaactcctgctgctcggagagccaaagggaggcagctttattgcttggacaatttgctgcaactgattctgattgcaaggttcatattgtacaaagaggtgctgtccgacccttgattgaaatgcttcactctcctgatgtacagctgaaagagatgtcgacctttgctttggggaggttggcacaggatacacacaaccaagctggtattgcgcatagtggtggtttggtccctttgttgaagcttctagattcgaagaatggatctttgcaacacaatgctgcatttgctctttatggtcttgcagataatgaggataatgtatccgattttattagggtggggggtgtccaacggctgcaagatggagagtttattgttcaagcaacaaaagactgtgtagccaagacattgaaaagactagaggagaagattcatgggcgagttttgaaccatttgctttatctgatgcgcatagcggagaagccagtccaaagacgagtggctttggctctagcttatctttgttcccctgatgaccagagaaccatattcattgataataatggacttgaactgcttcttgggcttcttggttctactagcactaaacagcaacttgatggtgctgtagctctgtacaagttgtccaacaaagctatgacgctttctcctatggatgcagctcccccttctccaacaccacaggtctatttgggggagcaatatgtgaacaacgctacattgtctgatgttaccttcctagttgaaggtagacggttctatgctcacagaatctgtctgcttgcttcttcagatgcatttcgtgctatgtttgatggcggttaccgggaaaaagatgcaagggatattgaaattcctaacatcaaatgggaggtttttgagttgatgatgagatttatatatactggatcagtagatgttactttggatattgcacaagatctgctcagagcagctgatcaatatcttttggagggacttaagcgactttgcgaatataccattgcacaggatatatcgcttgaaaatgtttcaagcatgtatgagctgtctgaagcttttcatgcaatatccttgaggcacacttgcattttatttatcttggagcattttgataaattgagtgcaagacccgggcacttgcatctaatccagcgaatagttcccgagattcgcaattactttgctaaagcacttacaaaacctaacccacataaactgcggctatagaaggctgggtctttttaactcctgatctctagctaggtttgttgtacagaaagtagtcagatccgatctctttgatgttgtggagccgattgaaggttctaattggttatttgtagcgtggttcataatcatttgcatttagagcaaatagcattagtttcttctttgattcatttttcttagatgtttggagaatatcatgtattgtgttggttgttactactttcggagtcggccctcattgaaaatgcttttgttaggtttgagcagttgctcgtttctttttatgccagaaattcgaatgcatgcatgattttaatgtgtaaaagctgagatctgagaatgattgaacaaggtttcgttgaatgagacctaccaggcttgtgcaatgtcaatgtaaaccgtcttagactatgaaccaaaactcatacgtcacaaacagttcttggtagagttcggaaatcggaaacctgcattttaattgtggtgagtttcaaatttggatactcaatcctgtttttactgtgttaaggctttatgatactttttatatttattta

SEQ ID NO: 7684 - DNA, 2737 bp, Gossypium raimondii
aggaaaggaagaaaaaggaaaaagctccgccctttttttactaaatctccaaaatacccctgatccacactgtttcttttcaaatcactggtctcatttccgataataaaccttttcctctctttggttttccttcttgatggagcttcagaggtgcgaggaacagggcctgcaagaacgaaaggggcaaaaacggaaacttgaggaagaaattcaagaggatagagatgctactccgctacctaccggcgacgcccgccgtgctctcttggccgaagtcaccgctcaggttaaggtcctcgactgcgccttctcctggcacgaatccgatcgcgccgccgccaagcgtgccactcacgtgctcgctgagctcgcaaagaacgaggaagttgttaatgtgatagttgaaggtggtgcgattccagctctagttaagcatctgcaagcacctttgtctgatgaaggtgacctaagcttgaagccttttgaacacgaggttgagaaaggaagtgctttcgctttgggacttcttgccgtaaagccagaacatcagcaacttatagttgattctggggccttgtcgcatcttgtgaatttgttgaggcgatacaaggatagttctacttctcgtgctgtgatcagtgtcattagaagagcggctgatgctatcaccaaccttgctcatgagaatagcagcattaaaacccgtgtcagaatggaaggtggaattccacctcttgttgagttgcttgaatttactgacacaaaggtgcaaagagcagctgctggggcattacgaaccctggcattcaaaaatgatgaaaacaagaatcagatcgttgaatgcaatgctcttcctactctcatctcgatgctgagatcagatgatgctgccatacactatgaagcggttggtgtgattggcaatctggtgcattcatcaccgaacataaaaaaggaagttctcgctgctggggctttgcaacctgtcattggtttgcttacctcctgctgctcagaaagccaaagggaggctgctttgctacttgggcaatttgccgcaactgattctgattgcaaggttcatattgtacaaaggggtgctgtcagacccttgattgaaatgcttcactctcctgatatacagctgaaagagatgtcagcctttgctttggggaggttggcacaggacacgcacaatcaagctggtattgcacatatgggtggtttggtgcctttgttgaagcttctagattcaaagaatggatctttgcaacacaatgctgcatttgctctttatggtcttgcagataatgaggataatgtatccgactttattagggtgggtggtgtccaacggctgcaagatggagaatttattgttcaagcgacaaaagactgtgtagccaagacattgaaaagactagaggagaagattcatgggcgagttttgaaccatttgctgtatctgatgcgtgtagccgagaagcctgtccaaagacgagtggcttttgctctagctcatctttgttctcctgatgatcagagaactatattcattgataataatggacttgagttgcttcttgggcttcttggttctacgaaccctaaacagcaacttgatggtgctgtagctctgtacaagttggccaacaaagctatgacgctttctcctatggatgcagctcccccttctccaacaccacaggtctatttgggggagcaatacgtcaacaatgctacattatctgatgttactttcctagttgaaggtagacggttctatgcgcacagaatctgccttcttgcttcttcagatgcatttcgtgctatgtttgatggtggttatcgggaaaaagatgcaagggatattgaaattccaaacattagatgggaggttttcgagttgatgatgcgatttatatacactggatcagtagatgtttcattggatattgcacaagatctgcttggagctgctgatcaatatcttttggaagggcttaagcgactctgtgagtacaccattgcacaggatgtaacactggacaatgtttctagcatgtacgaactctccgaagcttttcatgctatatcattgaggcacacttgcattttgtttatcttggagcatttctctcaattgagcgacagacccgggcactcacatctgatccagcgtataattccagagatccgcaattactttgcgaaagcgcttacgaatcctaacccacataaccagcggctgtagaaggctggtttttaactcatctctaacaagatacgttgatgtacagaaatgtagtagatgttgttgatgtggagccaattgaaggttctctaattcgtttctttgtagcacggttcgtaatcgttaccgatgcccgagttgtttcgtggtgtttgtagaaaacaaggtgtaagtttctcattttaattcattgtcttgtctgcatttagatgtttacacgaacaaaaacctgtatcacgatttgttagctattggactttgctttattaacttctgtgtatatccttacgtagaatctgatcggaactagggcatatattgtttcataaactaacaagatctgtagctttaaaggtttaaacacagtatctttgaggatcgctttcaaaagataggtgtaatgatatggtctacaaaagttagagccaaaggttatgttatatggtttacaaaagtatgattggatgcatatatgaatct

SEQ ID NO: 7685 - DNA, 3081 bp, Gossypium raimondii
taagaagacaaaaccataacggaaagaaaaggaaaggaagaaaaaggaaaaagctccgccctttttttactaaatctccaaaatacccctgatccacactgtttcttttcaaatcactggtctcatttccgataataaaccttttcctctctttggttttccttcttgatggagcttcagaggtgcgaggaacagggcctgcaagaacgaaaggggcaaaaacggaaactggaggaagaaattcaagaggatagagatgctactccgctacctaccggcgacgcccgccgtgctctcttggccgaagtcaccgctcaggttaaggtcctcgactgcgccttctcctggcacgaatccgatcgcgccgccgtcaagcgtgccactcacgtgctcgctgagctcgcaaagaacgaggaagttgttaatgtgatagttgaaggtggtgcgattccagctctagttaagcatctgcaagcacctttgtctgatgaaggtgacctaagcttgaagccttttgaacacgaggttgaaaaaggaagtgctttcgctttgggacttcttgctgtaaagccagaacatcagcaacttatagttgattctggggccttgtcgcatcttgtgaatttgttgaggcgatacaaggatagttctacttctcgtgctgtgatcagtgtcattagaagagcggctgatgctatcaccaaccttgctcatgagaatagcagcattaaaacccgtgtcagaatggaaggtggaattccacctcttgttgagttgcttgaatttactgacacaaaggtgcaaagagcagctgctggggcattacgaaccctggcattcaaaaatgatgaaaacaagaatcagatcgttgaatgcaatgctcttcctactctcatctcgatgctgagatcagatgatgctgccatacactatgaagcggttggtgtgattggcaatctggtgcattcatcaccaaacataaaaagggaagttctcgctgctggggctttgcaacctgtcattggtttgcttacctcctgctgctcagaaagccaaagagaggctgctttgctacttgggcaatttgccgcaaccgattctgattgcaaggttcatattgtacaaaggggtgctgtcagacccttgattgaaatgcttcactctcctgatatacagctcaaagagatgtcagcctttgctttggggaggttggcacaggacacgcacaatcaagctggtattgcacatatgggtggtttggttcctttgttgaagcttctagattcaaagaatggatctttgcaacacaatgctgcatttgctctttatggtcttgcagataatgaggataatgtatccgactttattagggtgggtggtgtccaacggctgcaagatggagaatttattgttcaagcgacaaaagactgtgtagccaagacgttgaaaagactagaggagaagattcatgggcgagttttgaatcatttgctgtatctgatgcgcgtagccgagaagcctgtccaaagacgagtggcttttgctctagctcatctttgttctcctgatgatcagagaactatattcattgataataatggacttgagttgcttcttgggcttcttggttctacgaaccctaaacagcaacttgatggtgctgtagctctgtacaagttggccaacaaagctatgacgctttctcctatggatgcagctcccccttctccaacaccacaggtctatttgggggagcaatacgtcaacaatgctacattatctgatgttactttcctagttgaaggtagacggttctatgcgcacagaatctgccttcttgcttcttcagatgcatttcgtgctatgtttgatggtggttatcgggaaaaagatgcaagggatattgaaattccaaacattagatgggaggttttcgagttgatgatgcgatttatatacactggatcagtagatgtttcattggatattgcacaagatctgcttggagctgctgatcaatatcttttggaagggcttaagcgactctgtgagtacaccattgcacaggatgtaacactggacaatgtttctagcatgtacgaactctccgaagcttttcatgctatatcattgaggcacacttgcattttgtttatcttggagcatttctctcaattgagcgacagacccgggcactcacatctgatccagcgtataattccagagatccgcaattactttgcgaaagcgcttacgaatcctaacccacataaccagcggccgtagaaggtgtagaaggctggtttttaactcatctcatctctaacaagatacgttgatgtacagaaatgtagtagatgttgttgatgtggagccaattgaaggttctctaattcgtttctttgtagcacggttcgtaatcgttaccgatgcccgagttgtttcgtggtgtttgtagaaaacaaggtgtaagtttctcgttttaattcattgtcttgtctgcatttagatgtttacacgaacaaaaacctgtatcacgatttgttagttattggactttgctttattaacttctgtgtatatccttacgtagaatctgatcggaactagggcatatattgtttcataaactaacaagatctgtagctttaaaggtttaaacacagtatctttgaggatcgctttcaaaagataggtgtaatgatatggtctacaaaagttagagccaaaggttatgttatatggtttacaaaagtatgattggatgcatatatgaatcttgttttggagggtcgattcttgattggtcctccaacaactgaaggtattgtcttttgagagttgtcttcttataatgtcgagagctggtgtgcggtgaacgattgtcctgagggtctagttcacagagttgggagtgccttgactgtgcatgggtgtacggtcactcaccaaggggaagtggtaccaccttcctaaaaggtgaccaatatgatataggttatgggttcaaaccctatcaagggtaaggcgctcaagtccccttgatgggtgacggtatgcctatgtgcagccgatgcactc

SEQ ID NO: 7686 - DNA, 2583 bp, Manihot esculenta
tccgtgcgttactgttcttgatggagcctcagaggagccaacaagatcagggtctcccggagaggaagggacagaagcgcaaattggaggaagaaatcgaagaggagcaacgagagatctcgccggcggccacctttggcgatgcgcgccaagctcttttacatgaggttgctgcgcaggtaaatatccttaactcgaccttctcttggaacgaggccgatcgggcagctgtcaaacgagccactcacgtccttgcagagttcgctaaaaacgaggaattggtgaacgtaattgttgaaggaggcgcagttccagctctagtaaagcatcttcaagcgccccagtcaggtgaagctgaccgtaattcaaagccgtttgagcacgaggtggagaaggggagtgctttcgcgctaggactgcttgctgtgaagccggagcatcagcaactcatagttgacgcaggggcactgtcacttcttgtggacttattgaagaggcataaggatggttctatttctcgggcagtgaatagtgtaattagaagggcagctgatgctatcaccaatttagctcatgagaacagtagcattaagactcgtgttaggatggaaggtggaattcctcctctagttgagttgcttgaattcactgatacaaaggtgcaaagagcagctgctggggcactacgaaccctggcttttaagaatgatgagaataaaaagcagattgttgaatgtaatgctcttcccaccctcattctaatgctacgatctgaggatgctgctatacactatgaagcagttggtgtgattggaaatctggtgcattcatccccaaacataaaaaaagaagtccttgctgctggtgctttgcaacctgttattggcttacttagctcctgctgttctgagagccagagagaggctgctttattactcggacaatttgctgcaacagattcggattgcaaggttcacattgttcaaaggggtgcagttcaacctttgatagagatgcttcagtcccctgatttgcagctgagggaaatgtcagcatttgcactggggaggttggcacaggattcgcataatcaagctggtatagctcataatggtggtttggtgccattactgaagcttttggattcaaaaaatggatctcttcaacataatgctgcatttgcgctatatggtcttgcagataacgaggataacatgtccgattttattagggtgggaggtgtccagaagctgcaggatggagagtttattgttcaagcaacaaaagattgtgtctcaaagactttgaagagattagaggaaaagattcatggacgagttttaaaccatttattatatctaatgcgtgtagcagagaaggctgtccaacgacgtgttgctttagctcttgcgcatctttgttccccagatgatcagagaacgatattcattgataacaatggcatgattggagttacttctcgggcttcttggctctacaaacctgaagcaacagattgatggagctgtagctctctacaagttggcaaataaagctatggctctctctcctgtggatgcagctcccccttctccaacaccacaggtatatttaggggagcagtatgtaaacaatgctacattatctgatgtaacctttttggtcgaaggtagaaggttctatgcccatagaatttgcctacttgcttcttcagatgcatttcgtgcgatgtttgatggaggttaccgggagaaggatgcaagggacattgaaattccaaacattagatgggaggtttttgagttgatgatgagattcatatacacaggatcaatagatatttcattagatattgcacaagatctcctgagggccgctgatcaatatcttttggagggccttaagcgactctgtgaatataccatagcacaggatatatcactggaaaatgttgcaagcatgtatgaactttcagaatctttccatgctatttcactgaggcacacatgcattttgtttatcttggagcagtttgataaattgaatgctaagcccaggcattcccatttgatccagcgtattgtacctgagattcggaattactttgccaaagcacttaccaaagctaacccacataatttgcggctgtagattgctggtctttgattctcgatgtctaactagataacattgtacagagagtggtagatgttctaattgatgtcgagccatttgaaagtcctaataggttggttaatatggctccataatcttccctggtaccagattgctactaaatgtgtatgcaactgtaacattgtttccattttcttggatgttgatgggctatgttcttcaccaacattattgttgttgcatgtactgatgcattttgtaactctttaatgagttgacgtttggtgagagagcaagagttgattccctgaaaatttggggcagagcttcaggtttgtaatgctccctctcaaggacttcggtggcttaatatgttatagcgctttagacattgctctttatgtgaagagactaggaagttgcaataaaaatatatatgtgtatatc

SEQ ID NO: 7687 - DNA, 3073 bp, Cannabis sativa
atgcactctttttagtgaatttttatttattttaaaagaaaaaaaaaattggtccaatacctatcccacactcactatccctgtttgtcacttggcatgcgcacattagcataacccgctcatttaaggatattttgcacctttctccgatgagtgcgcacgttagcttcactatcaacaaataatcaaaattaaacctcagaaattaatcaagttatttggccggtttaaagccgacaattcaccggaaaaaggaaaaggaaaaagaaaataaattaaataaaataaaaggaaaagaaaagaaaagcgttacttttatgaaaatccccaaactaccctcccatctattctctccgaaactcattcaaatccgaaattttggttttggatcagccttcttgcgtctgtttctatctctctctcacacattccttgtctgagtggtttgggtttcgcccttctcatcagagttggtctactcgtttatggagttacagaggcgccaagatcagtatctgccggagaagaaaggtcagaagcggaaactggaggacgaaattgaagaagacgaccctgaaatctctgtgccgtccggagacgtcaagcaagctttactttccgatgtcggtgtccaggttaatatccttaactccgccttctcttggagcgaagccgatcgcgctgccgctaagcgggctactcatgtcctcgccgagctcgctaagaacgaggaagtagtgaacgtgattgttgaaggtggagcagttccggctctagtaaagcaccttcaagcgcctccgtcgctcgagagtgatcgtggttcgaagccatacgagcatgaggtcgagaaaggatgtgcttttgcattaggacttcttgcagtgaagccagagcatcaacaactcattgttgacaccggtgctttgtctcatcttgtggatctattaaagaggtataagagtggttcaatatctcgggctgtgaatagtgttattcgtagggctgctgatgccatcaccaaccttgctcacgagaatagtagcattaaaacacgtgtcaggattgaaggtggaattccaccattggttgagttgcttgattttactgatacaaaggtgcaaagggcagctgctggtgcactgagaacactggctttcaaaaatgatgaaaataagaatcagattgttgaatgtaatgctcttccaacactcattttaatgcttcggtctgaggatgctgctatacattatgaagcggttggtgtgatcggaaatttggtacattcttctccaaatataaagaaagaagttcttctagcaggagctcttcaaccggttattgggttactcagttcttgctgttcagagagccaaagagaagcagctttgttacttggtcagtttgctgctactgattcagattgcaaggttcacattgtacagaggggtgcagtcccgcctctcattgagatgcttcaatcaccggatgtacaactgagggaaatgtcagcttttgcattgggaagactggcacaggatgcgcacaaccaggccggtattgctcacaatgggggtatagtgccattactcaagcttcttgattccaaaattgggtctctacaacataatgctgcatttgctctatatggtcttgctgataatgaggataatgtatccgattttattagggtgggaggtgtgcagaagctgcaggatggagaatttattgttcaagcgacaaaggattgcgtagcaaagacattaaagagattagaggagaagattcatggaagagttttaagccatctcttgtatctgatgcgtgttggggaaaaggcagtgcaaagacgtgttgctttggcccttgcccacctttgttctccagatgatcagagaaatatattcattgacagcaatggattggaattacttattggaattcttggttctacaagcctcaaacagcaaaatgatggcgctgtggctctgtacaagttggcgaacaaagccttgactctttctcctgtagatgcggcccccccatcacctactccacaggtctatttgggggagcagtatgtaaacagtcctacattgtctgatgttacatttctggttgaaggtagacgattctatgcgcatagaatttgccttcttgcctcttcagatgcattccgtgcaatgtttgatggtggttaccgagaaaaggatgcaagagatatagagattccaaatattagatgggaggtctttgagttgatgatgaggttcgtttacaccggatcgatagagatcgcagtagatattgctcaagatcttttaagagctgctgatcagtatctcttagaagggcttaagcgactttgtgagtacacgattgcacaggatatatccttggaaaatgtttcaagcatgtacgaactttcagaagctttcaacgctgcttctttgaggcacacttgcattttgtttatccttcagcaatttgaaaagttgagtgctaggcctgggcacactcatctagttcagcgaatattacctgagatccgcatttactttgctaaagcacttactaagcctaacctacataaccagaggccgtagatttcccatctcgttattttgatctctaacaaaatacgttgtacagaaagcagtagatgttcttgttgtcatcattgtcattatgatcgttttcgttgttgtttttgggccattagaaggttctaattatttgttgattgtagctttgcttataatccaattccaaaggcgagagagttgagtgttcttgcttgtctaatttttttttaacggacttgtcttgtctgtgttagtgtctggactctgtaacggactggacttgtagtggcactcttcttggtctttgttctctagtgaatttgacaaagtagtacatgtttgttaaaagtccctacccacatctaaattagttggatgcaaggatgccaaataattagtatttttgtcctgaacatactaacaagttgtgtcctcaatagtatatgattttattaataatattactcgaaatataatttattttattaata

SEQ ID NO: 7688 - DNA, 2485 bp, Lupinus angustifolius
agttattttgaattgaattgggattctgttatggagagggatccagatgagtggctccctgagaggaaagggcagaagaggaagcaacttgaccaaaatgatttccatttcccttctcagatctgtatctccgaacaagtttccattctcaattccactttctcttccaacctttctcatcgctctgctgctaagcgtgccactcacctcctcgccgatctcgccaaaaacgaggaagtagttcacgacattgttgaaggaggagcaattccggctttggttatgcatcttcaaccacctccgttggatcaaaatgatcgttttcagaagccattgccctttgagcacgaggtcgagaaagggagcgcattcgcacttggtcttcttgccgtcaagccagaacatcaacaattgattgttgacaatggtgccttaaaacacctcgttgatcttttgaagaggcacgacaatgtcctaacatctcgtgctgttaatagtctcatccgtagggctgcagatgccattactaatcttgctcacgagaacagcagcattaaaacccgtgtcaggatggaaggcgggattcctcctcttgttgacttgcttgaagtcgctgatacgaaggtacaaagagcagcagccggtgcattacggaccctggcttttaaaaatgatgaaaataaaaacgagattgttgaatacaatgctcttccaactttgattttaatgcttcgttcggaagatgctgctgttcattatgaagcggttggtgtgatcggaaatctggtccactcttcccctaatataaagaaagaagttcttcttgctggtgctttacaacctgttattagattacttagctcctgctgctctgaaagccagagggaagcagctttgttacttggacaatttgctgcaactgattcagactgcaaggttcacattgtacagagaggtgcagtcaggcctctgatagagatgcttcagtcccctgacgtacagctcagagaaatgtctgcctttgcactggggagattggctcaggactcacataaccaagcaggtattgcacatgatggtggcttaatgccattgctgaagcttctcgactcaaaaaatgggtctttgcaacataatgctgcttttgctctttatggccttgcagataatgaggataatgtgtccgattttattagggtaggtggaattcagagacttcaggaaggagagtttatagttcaagcaactaaggattgtgtggcaaagacattgaaaagattagaagaaaaaattagtggacctgtgctgaaccatctgttacagcttatgcgagattcagaaaaggctttccaaagacgtgttgctttgtctcttgctcatctttgttcagcggctgatcagagaaaaatatttattgatcaccatggtttggagttgcttattgggcttcttggctcttccagccctaagcagcaacttgatggtgcagtggctttatggaagttggccaataaagctatgaccttgtctcccatcgatgctgcccccccgtcaccaacaccccaggtctatttaggggagcagtatgtaaacaattgtagtgtgtctgacgttacatttttggttgaaggcaaacggttttatgctcacagaatatgcctacttgcatcttcagatgcatttcgtgcaatgtttgatggtggttatcgggagaaggatgcaagggacatagagattccaaatatcagatgggaggtttttgagttgatgatgagatttatatatactggatcagttgatgttactcttcatattgcccaagatctccttcgagcagctgatcaatatcttttagaaggacttaagagactctgtgagtacacgattgcacaggatatatctctggagaatgtgtcaagtatgtatgaactttcagaagcttttaatgccatatcgttgaggcatacatgcatcctttttattttggagcaatttgataaattgagtgcaagacaaggacactctcttttaatccagcgtgtaatgccagagattcggaattactttgttaaagctcttacaaagaccaattctcgcatccagccatagtatgcaccaatctactattgtgtatcatcattggcatagatgcagaaaatatgaccttcacgaacattgtttttttgtcgtgcaatattgtgatggtttttcgttacaaatgttgagtttatgattataggttatccaagcacttcatgtatatatgacaattagatagttgtgtgcaagaaaactgtgctgttaggtaaaacaacttatttaatgccaagttattggttgtctgttgtaaactaatgatgcaggtatcccatttaaaatgtacgcactaacaatatattaattttatactctgtcactgtattatttattattcgcggtcatcactgattcgttaaaataaataatacaattgaatgatgaatga

SEQ ID NO: 7689 - DNA, 2756 bp, Gossypium hirsutum
accttttcctctctttggttttccttcttgatggagcttcagaggtgcgaggaacagggcctgcaagaacgaaaggggcaaaaacggaaactggaggaagaaattcaagaggatagagatgctactccgctacctaccggcgacgcccgccgtgctctcttggccgaagtcaccgctcaggttaaggtcctcgactgcgccttctcctggcacgaatccgatcgcgccgccgccaagcgtgccactcacgtgctcgctgagctcgcaaagaacgaggaagttgttaatgtggtagttgaaggtggtgcgattccagctctagttaagcatctgcaagcacctttgtctgatgaaggtgacctaagcttgaagccttttgaacacgaggttgaaaaaggaagtgctttcgctttgggacttcttgctgtaaagccagaacatcagcaacttatagttgattctggggccttgtcgcatcttgtgaatttgttgaggcgatacaaggatagttctacttctcgtgctgttatcagtgtcattagaagagcggctgatgctatcaccaaccttgctcatgagaatagcagcattaaaacccgtgtcagaatggaaggtggaattccacctcttgttgagttgcttgaatttactgacacaaaggtgcaaagagcagctgctggggcattacgaaccctggcattcaaaaatgatgaaaacaagaatcagatcgttgaatgcaatgctcttcctactctcatctcgatgctgagatcagatgatgctgccatacactatgaagcggttggtgtgattggcaatctggtgcattcatcaccaaacataaaaagggaagttctcgctgctggggctttgcaacctgtcattggtttgcttacctcctgctgctcagaaagccaaagagaggctgctttgctacttgggcaatttgccgcaaccgattctgattgcaaggttcatattgtacaaaggggtgctgtcagacccttgattgaaatgcttcactctcctgatatacagctcaaagagatgtcagcctttgctttggggaggttggcacaggacacgcacaatcaagctggtattgcacatatgggtggtttggttcctttgttgaagcttctagattcaaagaatggatctttgcaacacaatgctgcatttgctctttatggtcttgcagataatgaggataatgtatccgactttattagggtgggtggtgtccaacggctgcaagatggagaatttattgttcaagcgacaaaagactgtgtagccaagacgttgaaaagactagaggagaagattcatgggcgagttttgaatcatttgctgtatctgatgcgcgtagccgagaagcctgtccaaagacgagtggcttttgctctagctcatctttgttctcctgatgatcagagaactatattcattgataataatggacttgagttgcttcttgggcttcttggttctacgaaccctaaacagcaacttgatggtgctgtagctctgtacaagttggccaacaaagctatgacgctttctcctatggatgctgctcccccttctccaacaccacaggtctatttgggggagcaatacgtcaacaatgctacattatctgatgttactttcctagttgaaggtaggcggttctatgcgcacagaatctgccttcttgcttcttcagatgcatttcgtgctatgtttgatggtggttatcgggaaaaagatgcaagggatattgaaattccaaacattagatgggaggttttcgagttgatgatgcgatttatatacactggatcagtagatgtttcattggatattgcacaagatctgctcggagctgctgatcaatatcttttggaagggcttaagcgactctgtgagtacaccattgcacaggatgtaaccctggacaacgtttctagcatgtacgaactctccgaagcttttcatgctatatcactgaggcacacttgcattttgtttatcttggagcatttctctcaattgagcgacagacccgggcactcacatctgatccagcgtatagttccagagatccgcaattacttcgcgaaagcgcttacgaatcctaacccacataaccagcggctgtagaaggctggtttttaactcatctctaacaagatacgttgatgtacagaaatgtagtagatgttgttgatgtggagccaattgaaggttctctaattcgtttctttgtagcacggttcgtaatcgttaccgatgcccgagttgtttcgtggtgtttgtagaaaacaaggtgtaagtttctcgttttaattcattgtcttgtctgcatttagatgtttacacgaacaaaaacctgtatcacgatttgttagttattggactttgctttattaacttctgtgtatatccttacgtcgaatctgatcggaactagggcatatattgtttcataaactaacaagatctgtagctttaaaggtttacacacagtatctttgaggatcactttcaaaagataggtgtaatgatatggtctacaaaagttagaacctaaggttatgttatatggtttacaaaagtatgattggatgcatatatgaatcttgttttggagggtcgattcttgatcggtcctccaacaactgaaggtattgtcttttgggaattgtcttcttattctgttgagagctggtatgtggtaaacgattgtcttgagggtctagttcacagag

SEQ ID NO: 7690 - DNA, 3022 bp, Ricinus communis
ggaaaagataacaaaagaaaaagaaaaagaaataaaaaagcaaaagaaaattacaaaagttacattaaagcttccaatattaaaaaattaaaattattaaaaaaggaataaggatatttcaaaattccaaaaatacccctgatctatccatctctgaatcttttcgaacttttttttggtttatttttttttcgtcatcatttttaattatcctcacctccatttcacacagcccctgcggtgtgcgtttctctgtttgatggagccacagagaagccaaagtaaagatcaaggtcgtcctgaaaggaaaggccaaaagagaaagctggaggaagagatcgaagacgagcagcaagagatctctgcgtctgctacggcggcggctgcggcagcggttcctttcggggacgcacggcaagcgcttttatatgaggtagcttctcaggttaatatcctgaactctactttctcttggaacgaagccgatcgtgctgctgctaaacgcgccattcatgtcctcgctgagttcgctaaaaacgaggaattagtgaacgtaattgttgaaggaggtgcagttccggctcttgttaagcatcttcaagcgccaccatcatcatcgagcgaagttgatcgtagtacgaaaccatttgagcatgaggttgagaaaggaagtgccttcgcgcttggattacttgctgttaagccagagcatcagcagcttatagttgacataggggctttatcacatcttgtggaactgttgaaaaggcacaaggatggttctgtttctcgagcagtgaatagtgtaattagacgggcagctgatgctatcaccaatctagctcatgagaatagcagcattaagactcgtgttagggtggaaggtgggattcctcctctggttgagttgcttgaatttgttgacacaaaggtgcaaagagcagctgctggggcactacgaaccctggcctttaagaatgatgagaataaaaaacagattgttgaatgtaatgctcttcctaccctcattctaatgctacggtcagaggatgctgctatacactatgaagcagttggtgttattggaaatctggtccattcatccccaaacataaaaaaagaagtccttgctgctggagctctgcaacctgttattggcttacttagctcctgctgctctgagagccaaagagaggctgctctgttacttggacagttcgctgctactgattctgattgcaaggttcatattgtacaaaggggtgctgttcaacctttgatagagatgcttcagtctcctgatgtacaactgagagaaatgtctgcatttgcacttgggaggttggcacaggacttgcacaaccaagcgggtatagctcacaatggtggtttagtgccattgctgaagcttctggattcaaaaaatggatctcttcaacataatgcagcatttgctctatacggtcttgcagataatgaggataatgtgtccgattttattagggtgggaggtgtacagaagttgcaggatggagaatttattgttcaagcaacaaaggattgtgtagccaagactttaaaaagattagaggaaaagattcatggacgagtcttacatcatttactatatctgatgcgtgtaaccgagaaggctgtccagcgacgcgttgctttagctcttgcacatctctgttccccagatgatcagaggaccattttcattgataacaatggattggagttacttcttggccttcttggctctacaagcccgaagcaacaattagatggagcagtggctctgtataagttggcaaataaagcagcgactctttctcctgttgatgcagctcctccttctccaacaccacaagtatatttgggagagcagtttgtaaacaatgctacattgtctgacgttacctttctagttgaaggtagacgtttctatgcccatagaatttgcttacttgcttcttcagatgcatttcgtgcaatgttcgatggaggttaccgggagaaggacgcaagggacattgaaattccaaatattagatgggaggtttttgagttaatgatgagattcatatacactggatcagtagatgtatcattagatattgcccaagatctcctaagggctgcagatcagtatctcttggaggggcttaagcgactttgtgagtatactatagcacaggatatatctttggagaatgttgcaagcatgtatgaactttctgaagctttccatgccatttcattgaggcacacatgcattttatttatcttggaacaattcgataaattgaacgctaagcccaggcactccaacttgattcagcgaattatacctgagattcggaattactttgccaaagcacttaccaaacctaacccacataactcgcggctgtagatggctggtatttgattcttgatgtctaactggaaaatgttgtacagaaagttgtagatcttcacattgttgtctagccatttgagcatcctaatggccgtaatcaccaatcacccctgatgcaagagtgttgtcacatttgcacgcattgtagcatcagttccattttcatggatattgatggagttatgtaaggtggtcatgtatcttgtatgcacccctttgatgagtctgcttgcatcgagtgtaagcaagatttcttctggaaataccaggaaaatttggggcagaagttcaggtctgtaatctaatctttgtctccaggactcggttgctaaaggtgtttgagcacgagaagcttttatgtaaagagactaggaaattaaaagaaaattgttacattttgaatttttttttcttttccaaattgtaatttagttgcagaggtttatatattgttttactggtgcgtgatcccacccaatctttgaacagaactgtgcaaggaactgaactttattcatgttctaatattattggattgaaaattgacgctgttttgacacgaacattatatgtattccaaagctagcagcattagac

SEQ ID NO: 7691 - DNA, 2491 bp, Euphorbia peplus
gagccacagagaaaccaagatcaaggtctcccggagcgtaaaggtcggaaacggaaactggaggaagagatcgacgacgagcaccgtgagatctcgccggcgctctccttcggcgatgcgcggcaagctttgttatctgaagtttcttctcaggttaacatcctcaattcgagtttctcctggaacgagcccgatcgcgcagctgccaaacgcgccactcatgttctcgccgagttcgctaaaaacgaggaattagtgaacgtaattgttgaaggaggtgctgttccggcgctggttaagcatcttcaagcgccaccgttgagggaagatgatcggaatccaaaggcgtttgagcatgaggttgagaaggggagtgcgttcgcgcttggactacttgctgtcaagccagagcatcagcagctcatagttgacaatggggcattgtcacatctcgtggagttgttgaagaggcaaaaggatggttctatttctcgggcggtgaatagtgttattagaagggcagctgatgctatcaccaatctagcccatgagaatagcagcattaagactcgtgttaggaaggaaggtggaattcctcctcttgttgaactgcttgagttcattgattcaaaggtgcaaagagcagctgctggggctctaaggaccctggcttttaagaatgatgaaaataaaaaacagatagttgagtacaatgcccttcctaccctcatcttaatgctaagatcagaggatactgctatacactatgaagcggttggtgtgattgggaatctagtgcattcatctccgaacatcaagaaagaagtccttgctgccggtgccctgcaacctgtcattggtttacttcgctcctgctgctctgagagccagagagaggctgctttgttactgggacaatttgctgcaacagattctgattgcaaggttcacattgtgcaaaggggtgcagttcaacctctaatagatatgcttcagtctcctgatgtacaactgagggaaatgtcagcatttgcactggggaggttggcgcaggactcgcataaccaagcaggtatagcacatactggtggtttactgccattactgaagctgctggattcaaaaaatggatctcttcaacataatgctgcatttgctctgtatggtcttgcagaaaatgaggataatgtgtccgattttattagggtgggaggtgtccagaaactgcaggatggagagttcattgttcaagcaacaaaagattgtgtatctaagaccttaaagagactagaggaaaaaattcatggacgggttttgagccatttgttatatctcatgcgtgtaccggacaaggctgtccaacggcgtgttgctttagctcttgcccatctttgttctccagatgatcaaagaaccatattcgtcgaaaacaatggattagagttactccttgggcttcttggttctacgaatccaaaacaacaacttgatggtgctgttgctctgtttaagttggctaacaaggcaatggctctttctcctgtggatgcagcacccccttctccaacaccacaggtatatttaggagagcagtatgtgaatagtgctacattgtctgatgttacctttctagttgaagacagacggttctatgcccataggatttgcctacttgcttcctcagatgcatttcgtgcaatgttcgatggaggttaccgggaaagagatgctagggacattgaaattccaaatattagatgggaggtttttgagttgatgatgagattcatatacacgggatcagtggatgtttccttggatattgcacaagatcttctaagggctgcagatcagtatctcttggagggccttaagcgactttgtgaatatacgatagcacaggatatatctctggagaatgttgctagcatgtacgaactctcagaagcttttcatgctatttcattgaggcacacgtgcattttgtttatcttagagcagttcgataaattgaatgctaagcccaggcactctcatctaatccagcgtattgtaccggagattcgcaattattttgctaaagcacttgcgaaatctaacccacataacttgcggctatagatggctggtgattgattcttgatgcctgactagataattttgtacagaaagtggtaggagtttagatcctttcgttgatgtctagctaagtaaagttctctacgaggttatttagacttaatcattcagttgttttttggatgttgatcgggggcatggtcttcatgaacgttgctccaaaaaatatagcaacggtcatgtatcctttactaagtcgggatttggtgagagagagcaagagtgattgcttctgcaaaacgtgacgattgtcgcagccttaattcgggtctataacctaatttctttgtcaaggattttggctgctctaagttttttcctttttaggttgtgagaagcattgatcttaatg

SEQ ID NO: 7692 - DNA, 2649 bp, Manihot esculenta
aatctttcaatctattcgacaaaattcccgtttctgtttagcctctttctgtcggtctatctcaatctccgcgcgttccagctgttgatggagccgcagaggagccaagatcagagtctctccgagaggaagggacagaagcggaaactggaggaagagatagaagagaagcagcgagagatctcagctgcggtccccttcggcgatgcgcgtgaagcacttttatacgaggtgactgcgcaggtaaatatccttaactcgaccttctcttggaacgaggccgatcgggcagctgccaagcgcgccactcacgtccttgcagagttcgccaaaaacgaggaattagtgaacgtaattgttgaaggaggtgcagttccagctcttatcaagcatcttcaagcgccttacacgaatgaagctgaccgtaatccgaaaccgtttgagcacgaggtggaaaaggggagtgctttcgctctaggactgcttgccgtcaagccagagcatcagcaactcatagttgatgctggcgctctgtcacttcttgtggacctgttgaagaggcacaaggatggttctagttctcgggcagtaaatagtgtaattagaagggcagctgatgctatcaccaatctagctcatgagaacagcagcattaagacacgtgttagggtggaaggtgggattcctcctctggttgagttgcttgaattcactgacacaaaggtgcaaagggctgctgctggggcactacgcactctggctttcaagaatgatgagaataaaaagcagattgttgaatgtaatgctcttcccaccctcattctaatgctacggtccgaggatgctgctatacactatgaagctgttggtgtgataggaaatctggtgcattcatccccaagtataaagaaagaagtacttgctgctggtgctctgcaacctgttattggcttacttagcagttcctgctgctctgagagccagagggaggctgctttgttacttggacaatttgctgcaacagactccgattgcaaggttcacattgtacaaaggggtgcagttcaacctttgatagagatgcttcagtctccagatgtacagctgagagaaatgtcagcctttgcactggggaggttggcacaggactcgcataatcaagctggtatagctcataatggtggtttagtgccactactgaagcttctggattcaaaaaatggatctcttcaacataatgctgcatttgccctatatggtcttgccgacaatgaggataatgtgtccgattttattagggtgggaggtgtccagaagctgcaggatggggaatttattgttcaagcaacaaaagattgtgtatcaaagactttgaaaagattagaggagaagattcacggacgagttctaaaccatttgttatatctaatgcgtgtagcagagaaagctgtccaacgacgtgttgctttagctcttgcacatctttgttccccagatgatcagagaaccatattcattgataacaatggcatgccatattcttcctagattggagttgctgcttggtctcctaggctctacaagcccaaagcaacaaattgatggcgctgtcgctctctacaggttggcaaataaagcaatgtctctctcccctgtggatgcagccccaccttctccaacaccacaggcgagtatatttgggggagcagtatgtaaacaattctactttgtctgatgttacctttctggtcgaaggtagacggttctgtgcccatagaatttgcctgcttgcttcttcagatgcatttcgtgcaatgtttgatggaggctacctggagaaggatgcaagggatattgacattccaaacattagatgggaggtttttgagttgatgatgagattcatttacacaggatcaatagatatttcattagatattgcacaagatctgctaagggctgcagatcagtatcttttggaggggcttaagagactctgtgaatatacaatagcacaggatatatcactggaaaatgttgcgagcatgtatgaactttcagaagcttttcatgctatttcgttgaggcacacatgcattttgtttatcttggagcattttgataaattgaatgctaagcccaggcactcccatttgatccagcgtattatacctgagattcggaattactttgccaaagcacttaccaaaattaacccacgtaacttgcggttgtagattgctggtatttgattcttgatctctaactagataacattgtacagattggtagatctcatcgatgtcaagccatttgaaggttcttataggatggttaatatggctcataatcttccccaataccagagtgctgttccacgtgtatacattgtaacattgtttccattttcttgaatgttgatcggcatgttcttcaccgacattattgttgccatgtattgttatgtattctgtgtaagagttgatttctctggggcagaatttcaggtccaaaatctaaacctcattaacggctcgtgtggtttaatatgtttagtgctagctttgtgtgaagatagccacacccaaaaagaaaagaaaaaaccttactttttaaataatactatttttgaaggtgacgttccctagc

SEQ ID NO: 7693 - DNA, 2468 bp, Cucumis sativus
ctcccctggttgtttatggagcttcagaagcgcctagatcagaatctcccagagaggaaaggccataagcggaaactggaggaggaatttgaagaggaacgggagatctccgtgcctacaggggacgccaagcaagcgatacttaccgaggtcagtgatcaagtcgaaattctcaattctactttttcatggaaggaggccgatcgagctgctgctaagcgagctactcatgttcttgccgagcttgctaagaacgaagaagtagtaaacgtgattgtggaaggtggagctgtgccggctttagttaagcatctacaagcaccgcctactattgaaggtgatcgtagtcttaagccattcgagcacgaggttgagaaaggaagtgcttttgctcttggactactggctgtaaagccagagcaccagcaactgatagttgacattggcgctctatcacacctcgttgagctattgaagagacacaaggatggttcttctcgagctgtgaacagtgttattcgtagagctgcagatgccattacaaatcttgcccatgagaacagtttcatcaaaacacgggttaggatggaaggtgggattcctccgcttgttgagttgcttgaatttactgacacaaaggttcaaagggctgctgctggggcactacgaacattggcctttaagaacgatgagaataaaaaccagattgttgagtgcaatgctctccctacactgattttgatgcttcgttctgaggatgctgctatacattatgaagcggttggggttattggaaatttggtgcactcatcccccaatataaagagagaagttcttctcgcaggagctttgcaacctgttattggattactcagttcttgctgctctgagagccaaagggaggcagcattattacttggacaattcgcggcaactgattcggattgtaagattcatattgtacaaagaggtgctgttcgacccttaattgagatgcttcagtcacctgatgtacagcttcgagagatgtcagcttttgcgttggggaggttggcacaggaaactcataaccaagctggtattgctcataatggtggtttaatgccattactgaagcttctggattcaaaaaatggttctttgcaacacaatgctgcgtttgctctttatgggcttgcagataatgaggataatgtatctgattttattagggtgggaggagttcagaagcttcaagatggagaatttatagtgcaagcaacaaaagattgtgtagcaaagacactaaagagattagaggagaagatacatggaaggaaagctgtgcaaagacgggtctctcttgctcttgctcatctttgttcacccgatgatcagaggaccatatttatcgataataatggcatgtctagagttgcttcttggcctacttggttcttcaagtctcaagcagcagcttgatggtgctgttgcactgtacaagctggcaaataaagccacgactctttcttctgtggatgctgccccaccatccccaacaccacaggtgtaccttggtgagcagtatgtgaacaatccgacactatccgatgttacttttcttgttgaaggtcgcagacgcttccatgcccacagaatttgcttgcttgcttcttcagatgcattccgtgccatgtttgatggtggctatcgggagaaggatgctaaggatatagaaattccaaatattagatgggaagtttttgagctaatgatgagatttgtttacaccggatctgtggatgtttcgttggatattgctcaagatcttctgagagctgcggatcagtatctcttggaaggacttaaacgactgtccgaatacaccattgcacaggatatatcactggaaaatgtttcaagcatgtatgaactctccgaagccttcaatgccatatctttgagacacacgtgcatcctttttatcttggaacaatttgaaaagctcagtttaatgccggggcattctcttctaattcagcggatacttcccgagatccggaattattttgctaaagctttgaccaaggttaatctccagagctcacggctgtagatggctgcactgtgttgttattcatcatcgctaaccaaaaaacacgatgtacagatagtggtagatttggtcgctgctgcggagctagattgaggttcaaattagcttatttgttttatggctcatgatcctttgatttttttttatcctaatggtaagggttttgatctttttgtataaagtctcaagtaataccattgcttagatagaatgacctttagtccttacgagaatgttatccttgaaatgcattgcatttattttatgaattgatgtatcttcccaaatgactaagctcttgtgaagagacattcagttggagaacactgtaaatttgacgtcagtaatatcaatttcagggtttttttcttct

SEQ ID NO: 7694 - DNA, 2554 bp, Citrus clementina
tctgatcacactcctctcttcgcttcgccttctctctcagtgctttgtccctgatttgatggatccacagagacgccaagggccgagcgtccccgagaggaaggggcaaaagcggaaactagatgaagaaacagtgatcggagacgagcagcagcagatgcaacaacgagagatctcgtcttcttctgctggaacttcttcatccgatgcgcggcaagcgctattgagcgaggtcagtgctcaggttaacgtccttaacaccactttctcttggctcgaagccgatcgcgctgcggctaaacgcgccactcacgtcctcgccgagctcgccaagaacgaggaggttgtgaactggattgtcgaaggtggcgcggttcctgctcttgtgaagcatctacaggcgccgccgacgagtgaagctgaccggaatttgaagccttttgagcatgaagtcgagaaaggaagcgcttttgctcttggacttcttgctgtaaagccagagcatcagcaactcatagttgataatggtgcattgtcacatcttgtgaatttgctgaagaggcacatggacagtaattgttcccgtgccgtgaatagtgttattagaagagcagctgatgctatcaccaaccttgctcacgagaacagcagcatcaaaacccgtgtcaggatggaaggtgggattccacctctggttgagttgcttgaatttactgacacaaaagtgcaaagagcagctgctggtgccctgcgaactttggcatttaaaaacgatgaaaataagaatcagattgttgaatgtaatgctcttcctaccctcattcttatgctacgatctgaagattctgctatacattatgaagcggttggagtaattgggaatctggtacattcatcccccaacataaagaaagaagttcttgctgctggggcattgcaacctgtcattggactacttagttcgtgctgctccgagagccagagggaggcagctttgttacttggacagtttgctgcaactgattcagattgcaaggtacacattgtacagaggggtgctgtgcggccactaattgaaatgcttcaatcacctgatgtgcaactgagggaaatgtcagcctttgccttggggaggttggcacaggacatgcacaaccaggctggtattgcacataatggtggtttagtgccattgctgaagcttcttgattcaaaaaatggttctctgcaacataatgcagcatttgctctatatggtctcgcagataatgaggataatgtagctgattttattagggtaggaggtgtgcagaagcttcaggatggagaatttattgttcaggcaacaaaagattgtgtggcaaagacattgaaaagattggaagagaagattcatggacgggttttgaaccatttgttatatctgatgcgtgtagcagagaagggtgtccaaagacgtgttgctttggctcttgctcatctgtgttcccctgacgatcagagaactatatttatcgatggtggtggattggagttacttcttgggcttctgggttcaacaaacccaaagcagcaacttgatggtgctgtggctttgttcaagttggcaaacaaagcaacaactctttcttctgttgatgcagctcccccatctccaacccctcaggtctatttaggagaccagtttgtaaacaatgctacgttgtcagacgttacctttctagttgaaggaagacgtttctatgcccaccgaatttgtctacttgcatcttcagatgcattccgtgcaatgtttgatggtggttaccgggaaaaggatgctagggacattgaaattccaaacattagatgggaagtgtttgagttgatgatgagatttatctacactggatctgtagatgttacattggatattgcacaagatctccttagagcggctgatcagtatctcttggagggacttaagcgactctgtgaatataccattgcacaggatatatctttggaaaatgtttctagcatgtacgaactttcagaagcttttcatgctatatcattgaggcacacatgcatcttgtatatcatggagcactttgataaattgagtactaggcccgggcattctaatctgatccagcgtatcattccagagatccacaattactttgcaaaagctctcaccaaacctaacccacataattcgcggctgtagatggccagtcattgattcttgatcgctaactagttatgatgtacagaaaatagtagatcttttcactgatatcaagtcaagtgaagctcctaattggttgattgtagtgtggctcataatcatttcctgatgccagagttatgttggttgtagactgtaagttgcttcttcaagttaattgttgtaggtactgcttgaaatataaccttcacaaaacattattgattttcatggattgtgatggttgtatgtctcgaaatgtattttatgactattcactgaaattgaattcgttgagatgtatcttttgcttgtgcaatagtaggcttctttgataactaa

SEQ ID NO: 7695 - DNA, 2554 bp, Citrus sinensis
tctgatcacactcctctcttcgcttcgccttctctctcagtgctttgtccctgatttgatggatccacagagacgccaagggccgagcgtccccgagaggaaggggcaaaagcggaaactagatgaagaaacagtgatcggagacgagcagcagcagatgcaacaacgagagatctcgtcttcttctgctggaacttcttcatccgatgcgcggcaagcgctattgagcgaggtcagtgctcaggttaacgtccttaacaccactttctcttggctcgaagccgatcgcgctgcggctaaacgcgccactcacgtcctcgccgagctcgccaagaacgaggaggttgtgaactggattgtcgaaggtggcgcggttcctgctcttgtgaagcatctacaggcgccgccgacgagtgaagctgaccggaatttgaagccttttgagcatgaagtcgagaaaggaagcgcttttgctcttggacttcttgctgtaaagccagagcatcagcaactcatagttgataatggtgcattgtcacatcttgtgaatttgctgaagaggcacatggacagtaattgttcccgtgccgtgaatagtgttattagaagagcagctgatgctatcaccaaccttgctcacgagaacagcagcatcaaaacccgtgtcaggatggaaggtgggattccacctctggttgagttgcttgaatttactgacacaaaagtgcaaagagcagctgctggtgccctgcgaactttggcatttaaaaacgatgaaaataagaatcagattgttgaatgtaatgctcttcctaccctcattcttatgctacgatctgaagattctgctatacattatgaagcggttggagtaattgggaatctggtacattcatcccccaacataaagaaagaagttcttgctgctggggcattgcaacctgtcattggactacttagttcgtgctgctccgagagccagagggaggcagctttgttacttggacagtttgctgcaactgattcagattgcaaggtacacattgtacagaggggtgctgtgcggccactaattgaaatgcttcaatcacctgatgtgcaactgagggaaatgtcagcctttgccttggggaggttggcacaggacatgcacaaccaggctggtattgcacataatggtggtttagtgccattgctgaagcttcttgattcaaaaaatggttctctgcaacataatgcagcatttgctctatatggtctcgcagataatgaggataatgtagctgattttattagggtaggaggtgtgcagaagcttcaggatggagaatttattgttcaggcaacaaaagattgtgtggcaaagacattgaaaagattggaagagaagattcatggacgggttttgaaccatttgttatatctgatgcgtgtagcagagaagggtgtccaaagacgtgttgctttggctcttgctcatctgtgttcccctgacgatcagagaactatatttatcgatggtggtggattggagttacttcttgggcttctgggttcaacaaacccaaagcagcaacttgatggtgctgtggctttgttcaagttggcaaacaaagcaacaactctttcttctgttgatgcagctcccccatctccaacccctcaggtctatttaggggaccagtttgtaaacaatgctacgttgtcagacgttacctttctagttgaaggaagacgtttctatgcccaccgaatttgtctacttgcatcttcagatgcattccgtgcaatgtttgatggtggttaccgggaaaaggatgctagggacattgaaattccaaacattagatgggaagtgtttgagttgatgatgagatttatctacactggatctgttgatgttacattggatattgcacaagatctccttagagcggctgatcagtatctcttggagggacttaagcgactctgtgaatataccattgcacaggatatatctttggaaaatgtttctagcatgtacgaactttcagaagcttttcatgctatatcattgaggcacacatgcatcttgtatatcatggagcactttgataaattgagtactaggcccgggcattctaatctgatccagcgtatcattccagagatccacaattactttgcaaaagctctcaccaaacctaacccacataattcgcggctgtagatggccagtcattgattcttgatcgctaactagttatgatgtacagaaaatagtagatcttttcactgatatcaagtcaagtgaagctcctaattggttgattgtagtgtggctcataatcatttccggatgccagagttatgttggttgtagactgtaagttgcttcttcaagttaattgttgtaggtactgcttgaaatataaccttcacaaaacattattgattttcatggattgtgatggttgtatgtctcgaaatgtattttatgactattcactgaaattgaattcgttgagatgtatcttttgcttgtgcaatagtaggcttctttgataactaa

SEQ ID NO: 7696 - DNA, 2577 bp, Malus domestica
cgttgatggaattgcagaggggccaggatcagagccgtccggagcggaaggggcagaagcggaagctggaggaggaaaccggtggcgagcgggagatctcggtgaagtccggcgaagcaagaaaggcgcttctgagcgaggtcagcgagcaggtgaaggtcctcaactccaccttctcttggagcgaagccgatcgagcttcggccaagcgcgccacgcacgttctcgccgagatcgccaagaacgaggaggtagtgaacgtgatcgtcgaaggcggcgcggttccgtctctggtaaagcatcttcaagcgccgccgttaagcgacggcgaccggagttcgaagccgttcgaacacgaggtcgagaagggaagtgcctttgccctgggccttctcgcagttaagcctgagcatcaacaactcattgttgacactggtgcattggctcatcttgtggatttgttaaagaggcacaaggatagtcctgtatctcgggctctgtatagcgtcattcgtagagctgctgatgccatcaccaaccttgctcatgagaatagcagcattaaaacccgtgtcagaatggaaggtggaattccacctctagttgagttgcttgaatttgctgataccaaggtgcaaagagcagctgctggagcactacgaactctggcatttaaaaatgacgagaataagaatcagattgttgaatgcaatgcgcttcctactctcattctaatgcttcggtctgaggatgctgcaatacattacgaagcagttggtgttattggaaatctggtacactcatctccgaacataaagaaagaagttcttcttgcgggagctttacaacctgttattggattgcttagttcctgctgctctgagagccaaagagaggcagctttattaattggacaatttgctgcaactgattcagattgcaaggttcacattgtacagaggggtgctattcagcctctgattgaaatgcttcagtcccctgacgtacaactaagggagatgtcagcttttgcgttggggagactcgcacaggacacaaacaaccaagctggtattgcacataatggtgctttagtgccattgctgaagcttcttgattcgaaaaatggttctttacaacataatgctgcatttactctttatggtcttgcagataacgaggataatgtctccgattatattaggattggaggtgttcagaagctgcaagatggagaatttatttttcaagcaacaaaggattgtgtgaccaaaacattgaaaagattagaggagaagattcgtggacgagttttgtcccatttgctatatttgatgcgtgtagcagagagggcagtccaaagacgagttgctttggcttttgctcatctttgttcaccagatgatctgagaacaatattcattgacaacaatggtctggagttgcttcttgggcttcttggttccagtacccataaacagcaacttgatggtgctacggctttatataagttggctaacaaagccatgactctttctcctgtggatgcagctcccccatctccaacaccacaggtgtatctgggggaacagtatgtaaacaatcctacgctgtccgatgttattttcttagttgaaggtaaacggttctatgctcacagaatttgcctgcttgcttcttcagatgcgttccgtgcaatgtttgatggtggttaccgggagaaggatgcgagggacatagagataccaaatattagatgggaagttttcgagttgatgatgagatttatatacactggatcagtcgacattactcttgatattgctcaagatctcctcagagctgcagatcagtatcttttggagggactcaagcggctttgcgagtacacaatagcacaggacatatcgttggagaacgtttcaaacatgtatgaactttcagaagccttccatggaatgtcattaaggcacacatgcattttgtttatcttggagcagttcgaaaaattgagtgccagaccagggcactctcatctgatcatgcgtatattacccgagatcagcacttactttactaaagcgcttacgaagcctaacccacatagcttgcggctataagtcgctgccttcaacccttgagttctaacaccccgatgtacagaaaacggtactagatgctcttgctgttgtcgagccgtgagatttctctaattctttgattgtagtttgcttacaatcggtcatgattacttgtaaaaacgacgccacctttgtagtacaattctgacatttctcggaatatttatgatcttcgcccgcatggtctcttcaacaatctcaaaagtttctgagccgttggatgtagcagtgcagtcgaagctagaatgattgaaactctgttcgtataggaaatgaaataggctgaatccaaaatcatctaaaagttattaaaattgctggtgagttgtttactattaacactttatagctgtaatatatggattcgaacagaatttggccgaatgaagcctgtaattgatgaaaacgggattatattattatagtacaattttca

SEQ ID NO: 7697 - DNA, 2311 bp, Prunus persica
cttttttggtttggcctcgttgatggagttgcagaggcgccaggatcagaaccacccggagaggaaggggcaaaagcggaaactggaggaagaaatcggagacgaacgagagatctcggtgaagtccggcgaagccagaaaggccctgctcagcgaggtcagcgagcaggtgaaggtcctcaactctacgttctcttggagcgaagccgatcgagcgtcggctaagcgcgccacgcacgtcctcgccgagctcgctaagaacgaggaggtagtgaacgtgatcgttgaaggcggtgcggttccggctctggtgaagcatcttcaagcgccgcctttaagcgaaggagaccggagttcgaagccgtacgaacacgaggtcgagaagggaagtgcctttgcactaggccttctcgcagttaagcctgagcatcaacaactcatcgttgacactggtgcattggctcatcttgtggatttgttgaagaggcacaaggatagtcctgtatccagggctttgtatagcgtcattcgtagagctgctgatgccatcaccaaccttgctcatgaaaacagcagcattaaaacacgtgtcagaatagaaggcggaattccacctttagttgagttgcttgaatttgctgataccaaggtgcaaagggcagctgctggagcactacgaaccctggcatttaaaaatgacgagaataagaatcaaattgtcgaatgcaatgctcttcctaccctcattctaatgcttcggtctgaggatgctgccatacattatgaagcggttggtgttattggaaatctggtacactcatctccaaacataaagaaagaagttcttcttgcgggagctttacaacctgttattggattgcttagttcttgctgctctgagagccaaagagaggcagctttattacttgggcaatttgctgcaactgattcagattgcaaggttcacattgtacagaggggtgctgtccgacctttgattgagatgcttcaatcccctgacgtacaactgagggagatgtcagcttttgcattggggcgattggcacaggacacaaacaaccaagctggtattgctcataatggtggtttattgccattgctgaagcttcttgattcaaaaaatgggtctttgcaacataatgctgcatttactctttatggccttgcagataatgaggataatgtgtccgattttattagggttggaggtgttcagaagctgcaggatggagaatttatttttcaagcaacaaaggattgcgtgaccaaaacattgaaaagattagaggagaagattcatggacgagttttgtcccatttgttatatttgatgcgtgtagcagagagggttgtccagaaacgtgttgctttggcttttgctcatctttgttccccagatgatttgagaacaatattcattgacaacaatggcataaacttatattgtttatatatttatgttgggctggagttgcttcttgggcttcttggctctactgcccataaacagcaacttgatgctgctatggctttgtataagttggccaacaaagccatgactctttctcctgtggatgcagctcccccatctccgacaccacaggtctatctaggggagcagtatgtaaacaatcccacactgtccgatgtcatatttttagttgaaggtagacggttctatgctcacagaatttgcctgcttgcttcttcagatgcatttcgtgcaatgtttgatggtggttaccgggagaaggatgcaagggacatagagataccaaatattagatgggaggttttcgagttgatgatgagatttatatacactggatcagtggacattactctcgatattgctcaagatctcctcagagctgcagatcagtatcttctggagggactgaagcggctttgtgagtatacaatagcacaggacgtatcattggagaatgtttcaaacatgtatgaactttcagaagccttccatgcaatgtcattaaggcacacgtgcattttgtttattttggagcagtttgaaaaattgagtgccagaccagggcactctcatttgatcatgcgtataatacccgagatctgcacttactttactaaagcgcttactaagcctaacccacataatttgcggctataaattgccgcctttgattcttgagttctaacaccctcttgtacagagaccggtagtagatgttcgtgctgttgttgagcagtggaagtttctaattctttgattttagtttgcttatagtcaattctgattccattacatgta

SEQ ID NO: 7698 - DNA, 2355 bp, Malus domestica
tttctcttcttcttcgcttccgtcgtcgttgatggagttgcagaggcgccaggaccagagacgtccagagcggaaggggcagaagcggaagctagaggaggaaaccggcggcgagcgggagatctcggtgaagtccggcgaagccagaaaggcgctgctgagcgaggtcagtgagcaggtgaaggtcctcaactccactttctcttggagcgaagccgatcgagcttctgctaagcgcgccacgcacgtcctcgccgagctcgccaagaacgaggaggtagtgagcgtgatcgtcgaaggcggcgcggttccggctctggtgaaacatcttcaagctccgccgttaagcgacggcgacgggagttcgaagccgttcgaacacgaggttgagaagggaagtgcctttgccctgggccttctcgcagttaagccggagcaccaacaactcattgttgacactggcgcattggctcatcttgtggatttgttaaagaggcacaaggatagtcctgtatctcgagctttgtatagcgtcattcgtagagctgctgatgccatcaccaaccttgctcatgagaatagcaacattaaaacccgtgtcagaatagaaggtggaattccacctctagttgagttgcttgaatttgctgataccaaggtgcaaagagcagctgctggagcattacgaaccctggcatttaaaaatgatgagaataagaatcagattgttgaatgcaatgcgcttcctactctcattctaatgcttcggtctgaggatgctgcaatacattacgaagcggttggtgttattggaaatctggtacattcatctccgatcataaagaaagaagttcttcttgcgggagctttacaacctgtcattggattgcttagttcctgctgctctgagagccaaagagaagcagctttattacttggacaatttgctgcaactgattcagattgcaaggttcacattgtacagaggggtgctgttcggcctctgattgagatgcttcagtcccctgacgtacaactaaaggagatgtcagcttttgcattggggagactggcacaggactcaaacaaccaagctggtattgctcacaatggtggtttagtgccattgctgaagcttcttgattcgaaaaatggttctctacaacataatgccgcatttactctttatggccttgcagataatgaggataatgtttccgattatatcagggttggaggtgttcagaagctgcaagagggagaatttatttttcaagcaacaaaggattgtgtgaccaaaacattgaaaagattagaggagaagattcatggacgagttttatcccatttgttatatttgatgcgtgtagcagagagggctgtccaaagacgagttgctttggcttttgctcatctttgttcgccagatgatctaagaacagtattcatcgacaacaatggcatgtcacatccccggctggagttgcttctcgggcttcttggttccagtgcccataaacagcaacttgatggtgctacggctttgtataagctagccaacaaagccatgactctttctcctgtggatgcagctcccccatctccaacaccacaggtctatctgggggagcagtatgtaaacaatcctacgctgtccgatgttattttcttagttgaaggtagacggttctatgctcacagaatttgcctgctagcttcttcagatgccttccgtgcaatgtttgatggtggttaccgggagaaggatgcgagggacattgagataccaaatattagatgggaggttttcgagttgatgatgagatttatatacactggatcagtcgacattactattgatattgctcaagatctcctcagagctgctgatcagtatcttttggagggactcaagcggctttgtgagtatacaatagcacaggacatatcgttggacaacgtttcaaacatgtatgaactttcagaagccttccatgcgatgtcattgaggcacacatgcatattgtttattttggagcagttcgataaattgagtgccagaccagggaactctcacctgatcatgcgtatattacccgagatccgcacttactttaccaaagcgcttactaagcctaacccacatagcttgcggctataaattgctgccttaaattcttgagtcctaacaccctgatgtacagaaaccgctagtagatgctcttgctgttgtcgagccatgagaattttctaattctttgattgtagtttgcttacaatccgttctgattcaattacttgtaaaaacgatgccccgtcattaccttcgcccattgtcttggctttgctcttttt

SEQ ID NO: 7699 - DNA, 2736 bp, Prunus mume
cggaaagaaaaagcttttacttctttttcgtaattttttttggaattccaaaagtgcccctctgcactctctttctctttcttgtctctgtctttcactctcacctattcaaatccaaaaattttccatttcggatcagcttcttctcctcatcttcgcttttttggtttggcctcgttgatggagttgcagaggcgccaggatcagaaccacccggagaggaaggggcaaaagcggaaactggaggaagaaatcggagacgaacgagagatctcggtgaagtccggcgaagccagaaaggccctgctcagcgaggtcagcgagcaggtgaaggtcctcaactctacgttctcttggagcgaagccgatcgagcgtcggctaagcgcgccacgcacgtcctcgccgagctcgctaagaacgaggaggtagtgaacgtgatcgttgaaggcggtgcggttccggctctggtgaagcatcttcaagcgccgcctttaagcgaaggagaccggagttcgaagccgtacgaacacgaggtcgagaagggaagtgcctttgcactaggccttctcgcagttaagcctgagcatcaacaactcatcgttgacactggtgcattggctcatcttgtggatttgttgaagaggcacaaggatattcctgtatccagggctttgtatagcgtcattcgtagagctgctgatgccatcaccaaccttgctcatgaaaacagcagcattaaaacacgtgtcagaatagaaggcggaattccacctttagttgagttgcttgaatttgctgataccaaggtgcaaagagcagctgctggagcattacgaaccctggcatttaaaaatgatgagaataagaatcaaattgtcgaatgcaatgctcttcctaccctcattctaatgcttcggtctgaggatcctgctatacattatgaagcggttggtgttattggaaatctggtacactcatctccaaacataaagaaagaagttcttcttgcgggagctttacaacctgttattggattgcttagttcttgctgctccgagagccaaagagaggcagctttattacttggacaatttgctgcaactgattcagattgcaaggttcacattgtacagaggggtgctgtccgacctttgattgagatgcttcaatcccctgacgtacaactgagggagatgtcagcttttgcattggggagattggcacaggacacaaacaaccaagctggtattgctcataatggtggtttattgccattgctgaagcttcttgattcaaaaaatgggtctctgcaacataatgctgcatttactctttatggccttgcagataatgaggataatgtgtccgattttattagggttggaggtgttcagaagctgcaggatggagaatttatttttcaagcgacaaaggattgcgtgacgaaaacattgaaaagattagaggagaagattcatggacgagttttgtcccatttgttgtatttgatgcgtgtagcagagagggttgtccagaaacgtgttgctttggcttttgctcatctttgttccccagatgatctgagaacaatattcattgacaacaatggcatgtcacatcctctatatttaaatcatacttttcatgggctggagttgcttcttgggcttcttggctctactacccataaacagcagcttgatgctgctatggctttgtataagttggccaacaaagccatgactctttctcctgtggatgcagcacccccatctccgacaccacaggtctatctaggggagcagtatgtaaacaatcccacactgtccgatgttatatttttagttgaaggtagacggttctatgctcacagaatttgcctgcttgcttcttcagatgcatttcgtgcaatgtttgatggtggttaccgggagaaggatgcaagggacatagagataccaaatattagatgggaggttttcgagttgatgatgagatttatatacactggatcagtggacattactcttgatattgctcaagatctcctcagagctgcagatcagtatcttctggagggactgaagcggctttgtgagtatacaatagcacaggacgtatcattggagaatgtttcaaacatgtatgaactttcagaagccttccatgcaatgtcattaaggcacacgtgcattttgtttattttggagcagtttgaaaaattgagtgccagaccagggcactctcatttgatcatgcgtataatacccgagatctgcacttactttactaaagcgcttactaagcctaacccacataatttgcggctataaattgccgccttcgattcttgagttctaacaccctcttgtacagagaccggtagtagatgttcgtgctgttgttgagccagtggaagtttctaattctttgattttagtttgcttatagtccattctgattccattacttgtagacacgcagcctcatttgtaacacaattccgacattgcttggaatgtgaccttcacctacattttctcttggtattcccccaagtttttgctctttaatgagatagtattcagtaagagatacaattgtgcataaacatgatttgtgctttgatcttgttgcctttaaagggtaactattttttaattattttattattattttgaatagcattgggtggcttctcaaatttaaatctagaaaaatatcataagtttatt

SEQ ID NO: 7700 - DNA, 2525 bp, Fragaria vesca
tgcgccttccgatttcgttgatggagcttccgcggcgccaagatcagagccaatcggagaggaaggggcagaagcggaagctggaagaggaaatcggagagatcaccaccgctcactccggcgacgacgccagaaaagcgattctcgttcaggtcgccgagcaggtcaagcttctcgactcttccttctcctggagcgaagctgatcgccacgccgccaagcgcgccactcacgtcctcgccgagctcgccaagaacgaggacgtggtgaacgtgatcgttgaaggcggcgcggttccggctctggtgaagcatctgcaagcgccgccgcgcagcgaggtcgaccggagctctacgaagcattgcgaacacgaggttgagaagggcagtgcttttgcgctaggccttctcgccgttaagccagagcatcaacaactcattgttgacaacggtgcactgtctcatctagttgatttgttgaagaggcgtacagatagtcacgtaaatcgacctttgaatagcgtcattcgtagagctgctgatgccatcaccaatctcgctcatgaaaacagcagcattaaaacccgtgtcaggatagaaggtggaattccacctctagttgaattgcttgaatttgccgatacaaaggtgcaaagagcagcagctggagcgctacgaaccctcgcatttaaaaatgacgagaacaagaatcagattgtcgaatgcaatgctcttcctaccctcattctaatgcttcgatctgaggatgctgctattcattacgaagcggttggtgtaattggaaatctggttcactcttctccaaacataaagaaagaggttcttcttgctggagctttacaacctgttattggattgcttagttcctgctgctttgagagccaaagagaggcagctttgctacttggacaatttgctgcaactgattcagattgcaaggttcacattgtacagaggggtgctgtccggcctttaattgagatgcttcaatcctcagatgtacaactgagggagatgtcagcttttgcgttggggaggttggcgcaggactcacacaaccaagctggtattgtgcataatggtggtttaaagccattgttgaaccttctggattctaaaaatgggtctctgcaacacaatgctgcatttaccctttatggccttgcagataatgaggataatgtgtccgattttattagaaatggaggtgttcaaaagttgcaggatggagaattcattttccaggctacaaaggattgtgtgaccaagacattaaaaagattagaggagaagattcatggacgagtattgtcgcatttgttatacttgatgcgtgtaggagagaggaatgtctcaaaatgtgttgctttggcttttgctcacctttgctccccagaggatctcagaactattttcattgataacaatggcatgtcactctgtctggaattgcttcttgggcttcttggttctattaagcccaaacaacagcttgatggtgctacggctctgtacaagttggccaacaaagccatgactctttctcctgtggatgcagctcctccatctccaacaccacaggtctatttaggggagcagtatgtaaacaaccctacgctgtccgatgttacgtttttagttgaaggtaaacggttttatgcgcacagaatttgcctgcttgcttcttcagatgcatttcgcgcaatgtttgatggtggttaccgggagaaggatgcaagggacattgagataccaaatattagatgggaggtttttgagttgatgatgagatttatatacaccggatcagtagacattactttggatattgctcaagatctcctcagagctgcagatcagtatcttttggagggactcaagcggctttgtgagtattcaatagcacaagacatatctttggagaatgtttcaaacatgtatgaactctcagaagccttccatgcaatgtcattaaggcaaacatgtattttgtttgtcttggagcaattcgaaaaattgagtgcaagaccagggcactccgaactgatcaaagatatgttgaaagagatcagaacttacttcactaaagcactcactatgcctaacccacataacttgcggctgtagtttgctgtcttttattcttcagctctaacccccaagtacgatgtacagaaacccgtaatagatgttcttgttgttgagccagtggaagtttcgactttttttttttctgttttagttctatagaggtgtctaattctttgactgtagtttgtcttataatccattctggttccctgagtccttgttgtaaacacaatgtttcatccctaatacaattccgacattgcttggaatatgaccttcccgaacgttactctgtatttccagtttttgctatttagtgaaatatcattcactaagatatacagttattatgaacagttacggttgattaaaagaacttatcaagcactgcttggtttctcaagcttgaatctg

SEQ ID NO: 7701 - DNA, 2780 bp, Populus trichocarpa
aaaaatgtaaatctccaaagtacccctgatccagtgatctcttcaaaatcctaaaatttcatttctaaccagcctctcactttctctgtgttgatggagctgaagaagcaccaagatcagagagtccctgagaggaaggggcaaaagaggaaactagaggaggaaatcgaggaggggaagagggagatctcggcggcggaggcggcagccgcagctccatacggtgaggcacggagagtgatattgaacgaggtctatacccaggttaatatcctcaactctaccttctcatggcacgaaactcatcgcggtgctgctaaacgcgccactcacatcctcgcggaactcgccaagaacgaggaagtggtgaacgtgattgttgaaggaggtgcagttcctgcactggttaagcatcttgaagcaccaccgtcaagtgaaattgatcacaataactcgaagccttttgagcacgaggtcgagaaagaaagtgcttttgcgcttggactgcttgctgtcaagccagagcatcagcaaatcattgtcgacgctggggctttgtcacatcttgtgagcttgttgaagaggcagagggatgttcacagggacggttctaattctcgagctgtgaatagtgtaattaggagagctgctgatgctattaccaatcttgctcatgagaacagcagcattaaaactcgtgttaggatggaaggtgggattcctcctctggttgagttgctcgaattcactgacacaaaggtgcaaagagcagctgctggggcacttcgaaccctggcttttaaaaatgatgagaataagaatcagatagttgaatgctatgctcttcccacccttatattaatgttgcgatctgatgatgctgccatacactatgaagcagtaggtgtgattgggaatctggtacattcgtccccaaacattaaaagagaagttcttgctgctggggctctgcaacctgttataggtttacttagctcctgctgctctgagagccaaagggaggctgctttattacttggacaatttgcagcaaccgattcagattgcaaggtgcacattgtacaaaggggtgcagttagacctttgattgagatgctccagtctcctgatgtccaactgagggaaatgtcggcatttgcactggggaggttggcgcaggacacacacaaccaagctggtatagcccacaacggtggtttggtgccattactgaagcttctggattcaaagaatggatctcttcaacataatgctgcatttgctctgtatggtcttgcagataatgaggacaatgtctctgattttatcagtgtgggaggagttcagaagctgcaggatggagagtttattgttcaagcgacaaaagattgcgtagccaagactttgaaaagattggaggagaagattcatggaagagttttaaaccacttattatatctaatgcgtgtagcggagaaggctgtccaacgacgtgttgctctagctcttgcacatctttgttctccagatgaccagagagcaatattcattgataattgtggattggatttacttcttgggcttcttggctcttcaagcctgaagcaacaacttgatggagccatagctctttacaggctggccaacaaagcaacgaccctttctcctgtggatgcagctcctccttctccaacaccgcaggtatatttaggggagcagtatgtaaacaatcctacattgtctgacgttacctttctagttgaaggtagaagattctatgcccatagaatttgcctgcttgcttcttcagatgcatttcgggcaatgtttgatggtggttatcgggaaaaggatgcaagggacattgaaattccgaatattagatgggaggttttcgagttgatgatgagattcatttacacaggttcagtagatgttacattaattattgcacaggatctcctcagggctgctgatcagtatctcttggaggggcttaagcgactgtgcgagtataccatagcacaggatataacattggaaaacattggaagcatgtatgaactttcagaagctttccatgctatttcattgaggcacagatgcattttgttcattttggagcagtttgataaattgagtgataagcccaggcactctcaattaatccagcgcataatacccgagattcgcaattactttgaaaaagcactcaccaaccctcaccaacataactcgcggctgtagatggctggtctgattcttcatatctaactagatatttttgtacagaaagtggtagatgttctcatttatttctagctattcaaatgttctaataggttggtaaataggatggctcctaaaatcctaatcatccccgttgccagagttatgttgcaaatgcactgggagtttccaaaattagttctgatgagaatgttgatggaaacatggcccactcccaacgttattgtgttcatggattgtgatgcttatgtattttcccctcggcattagcgagagattcatcggtttgtggacaatagtagttgttgcttgagttatttacttcgcaaacgaaatagtggaaaaaaatccaagtctagaatccttcttgaagaagcgcttggttactgctagtgtgactttcaatgtgaactgtatgtccggtggcggactgggagaagtccaatcagttttagtggttcaaatttactctcgatctttagaaatttgtgccccatatttctcgaaacttcctcttgacccttcgtgca

SEQ ID NO: 7702 - DNA, 3501 bp, Populus trichocarpa
gtcgattctcaaagaaagctttagaaacagtatcatactctgatatcttgcaagacaagtgaaccatggcattgcagaaaataaaagccataaacattgctagcagccttaaaatattcaatttgtccagtggaaagtcacaaacaaaagaggtctctcctctccactccaatcccttcccttcccttgtttctttgactgttgccagcacccacgattatcccggtatgaatcatgactagccacgcatcattcacttccccgatgcaatccaggtggaccccaacgttggtgtggacccatctcttttctacctactcacctagcatgcgcacgttagagcatttcactgcttttccccacctctccggcgggagggcacgctagcaatttaaagcaaatcaatcaccaaggcgcacttcccacctaactagagccggaaagtgaagtgcccggtttaaactccgacatatttagcactcaacatccttcaccagagcaggaaaaaggaaagtaaaaactaaaaagtaaagaaaagaaacaaagcgaaaataacaaaagtacaaataaaagcgttttaaaaaatctaaatctcgaaagtacccctgatccagtgatcccttcaaaatcctaaaatttaatttctgagcagcctctcactttctacgtgtggatggagctgaagaagcaccaagatcagaggctccctgagaggaaggggcaaaaaaggaaacttgaagaggaaatcgaggaggagcagagagagatctcggcggtggaggaggccgctgcagctccctacggcgaggcacggaaagtgatattgaacgaggtttatgctcaggttaatatcctcaactctaccttctcatgggacgaagctcatcgcgccaccgccaaacgcgctactcacgtcctcgcagaactcgcaaaaaacgaggaagtagtgaacttgattgttgaaggaggtgcagttcctgcactggttaagcatcttcaagtaccaccgtcaagtgaaattgatcatgataattcgaagccgtttgagcatgaagtcgagaaaggaagtgcttttgcgcttgggctgcttgcagtcaagccagagcatcagcaactcattgttgacgctggggctttgtcacatcttgtgagcttgttgaagaggcaaagggatgttcataaggatggttctgattctcgagctgtgaatagtgttattaggagggctgctgatgctatcaccaatcttgctcatgagaacagcagcattaaaactcgtgttaggatggaaggtgggattcctcctctggttgagttgcttgaattcactgacacaaaggtgcaaagagcagctgctggggcacttagaaccctggcttttaagaatgatgagaacaagaatcagattgttgaatgcaatgctcttcccgcccttatattaatgttacgatctgatgctgctgccatacactatgaagcagtaggtgtgattggaaatctggtacattcatccccaagcataaaaagagaagttcttgctgctggggctctccaacctgttattggtttacttagctcctgctgctctgagagccaaagggaggctgctttattacttggacaatttgcagcaacagattcagattgcaaggtgcacattgtacaaaggggtgctgttcaacctttgatcgagatgctccagtctcccgatgtccaactgagagaaatgtcagcatttgcattggggaggttggcacaggacacacacaaccaagctggtatagcccacaatggtggtctagtgccattactgaagcttctggattcaaagaatggatctcttcaacataatgctgcattttctctgtatggccttgcagataatgaggacaatgtctctgattttatcagtgtgggaggtgttcagaagctgcaggatggagagtttagtgttcaggcaacaaaagattgtgtagccaagactttgaaaagactggaggagaagattcatggaagagttttaaaccacttattgtatctaatgcgtgtagcggagaaggctgtccaacgacgtgttgctctagctcttgcacatctttgttccccagatgaccagagagcaatattcattaataatagtggattggatttactccttgggcttcttggctcttcaagcccgaagcaacaacttgatggagccatagctctttacaggttggccaacaaagcaacgattctttctcctgtggatgcggctcctccttctccaacaccgcaggtgtatttaggagagcagtatgtaaacaatgctacattgtcggacgtcacctttctcgtcgaaggtagacgattctatgcccacagaatttgcctgcttgcttcctcagatgcatttcgggcaatgtttgatggtggttaccgggaaaaggatgcaagggacattgaaattccaaatatcagatgggaggtttttgagttgatgatgagattcatatacacaggttcagtagatgttacattaggtatcgcacaggatctcctcagggctgctgaccaatatctgttggaggggcttaagcgactatgcgagtataccatagcacaggatataacattggaaaacatttcaagcatgtatgaactttcggaagctttccatgctatttcattgaggcacagatgcattttgtttattttggagcagttcgataaattgagtgataagcccaggcactctcaattaatccaccgtataatacctgagattcgtgattactttgacaaagcactcaccaaacctaaccaacataactctcggctctaggtggctggttttgattcttcgtatctgactagatatttttgtacagaaagtggtagatgttctcattgatgctgagccattgaaatattctaataggttggttaatagtatggctcctaaattcttaatctttcctgttgcctgagttacgttgcatgttagcactctgtaactttccacattagttccgctgagattgttgatggaaacacgggccacctccaacatgattgcgatgttcatgtattctctgattggcattagcgggagatgcatctttttgtgcgcaataacagagtcgttgcttgaagcaaattcttggcaaactaaaaactaggaaaagattccaggtctagaatctctttccttgaaggacttttagtctcggaaagtgacttttaaggtgaactacatggctgagggtggacttggaggagtggggcaatgggcctcccaaattattaaaaaaaactattttagtcacttttagttctaggagttcaaatttaccctccgtttttagacgtttgtgctctatatttcttgaaactctctttgtgccacgttatctttgaattctatccccccctgtacatgggtttatgtaaaaccactatttaccctttccgggtgcaaagattttggggtatgatttttttattggctcctcaaca

SEQ ID NO: 7703 - DNA, 2493 bp, Panax ginseng
cattgtcaacttggctgattttgaaatatggaacaatcaattggaaggtctgttgcccactgaaattggaagctctttttacccactgaaattggaacaatcaattggaagggcttgaatggattttcagaagcgccacgacaaggtaaataaaccggagaggaaagggcaaaaaaggaaactactgcacgaagagttcgacggagaccgacagatctctgtaccgtcagcttctttctccggcgactcccaccggtcgctattgtgcgaggtggctgcgcaggttaatacactgaactccaccttctcttggaacgaagccgatcgagctgcggctaagcacgccactcatgttctagctgagctcgcgaagaacgaggaaattgtgaatgttatagttgatggtggtgcggtcccggcgctggtgaagcatcttgaagggccaccgtctagtgaaggtgaaattaagccatttgagcatgaggttgagaaaggaagtgcttttgcgttggggcttcttgctgtaaagccggagcatcagcaactcatagtcgacactggcgctttgcctcatcttgtgaatttgttgaatagacacaaggatggtcctgtttctcgggctgtcaacagtgtcatccggagagcagctgatgcaattactaatcttgctcatgagaatagcagcatcaaaacccgcgttaggttggaaggtgggattccacctcttgtggagttgcttgaatttagtgatccaaaggtacaaagagcaactgctggagctctgcgaactttggcatttaaaaatgaggagaacaaaaatcagatttttgaatgcagtgcccttcccaccctgattttgatgctccgctctcaagatgctgctatacattatgaagcagttggtgtgattggaaatctggtacactcttctccaagcatcaagaaagaagttcttctagctggtgctttacaacctgttattggattgctcagttcatgttgctctgagagccaaagggaggcagcattactacttggacagtttgcggctacagattcagattgcaaggtgcatattgttcaaagaggtgctgtccgaccattgattgagatgcttcaatcaccagatgtgcagcttagagaaatgtcagcttttgcactagggaggttggctcaggacatgcacaaccaagctggtattgctcatagtggtggtttggtgccattattgaaactacttgattcaaagaatgggtctttgcagcataatgctgcatttgctctttatggtcttgcagataacgaggataatgtgtccgacttcatcaaggtgggaggcatccagaaacttcaagatggggaattcattgttcaagcaacaaaagattgtgtagccaagacattgaaaagattagaggagaagattcatggacgagttttgaaccatttgttatatctgatgcgtgtagcagagaagggtattcaaagaagagttgctttggctcttgcccatctttgctccccagaagatcagaggatcatattcattgataataatggactggagttacttcttgcccttcttggttctacaagcctgaagcagcagcttgatggttccgtggccatgtacaagttggctaataaagccctcagtctttcacctgacgatgcagcacctccatctcctacaccacaggtttatttgggggagcaatatgtaaacaattctacactgtctgatgttacgtttctagttgaaggaaagcgattctacgcccatcgaatttgccttcttgcttcatcagatgcatttcgtgcaatgtttgatggtggttatcgggagaaggatgcaagagacgttgagattcctaatataagatgggaagttttcgagttgatgatgagatttatctacacagggtccgtagatgtctcattagatattgcccaagatctcctcagtgctgctgatcagtatctgttggagggcctcaagcgtctctgtgaatatactattgctcaggatatatctttggaaaatgtttcaagcatgtatgagctttcagaggctttccacgctgtatcactgaggcacacatgcattttatttctcttggagcactttgataaattaaatgctaggcctgggttctcgcatctgatccagcgattaattccagagatccgtaattacttttatagtgcacttactaggcctagcacacatagcttgaggctgtagattttcaccctttaattcttgatctaactagatatgatgtacagaaagctgtagatcttgtggtggttgtgaaagtgattattactgattgattgtagagggcccaatttctcttgtgctgctagagttctgttgcttgtaaaaactgtaagttcatcctgcagtgtcactgtaattttcaaactgctggtgatatgcaccagaagtattcattatacgttgtgatgtaaaaactgtaagttcatcct

SEQ ID NO: 7704 - DNA, 2603 bp, Panax ginseng
tcttccgatctctgaaagcttaatcctccacctctgaccaaagcctttccttccttgggcttgaatggattttcagaagcgccacgacaaggtaaatagaccggagaggaaagggcaaaaaaggaaactactgcacgaagagttcgacggagaccgacagatctctgtaccgtcagcttctttctccggcgactcccaccggtcgctattgtgtgaggtggctgcgcaggttaatacactgaactccaccttctcttggaacgaagccgatcgagctgcggctaagcacgccactcatgttctagctgagctcgcgaagaacgaggaaattgtgaatgttatagttgatggtggtgcggtcccggcgctggtgaagcatcttgaagggccaccgtctagtgaaggtgaaattaagccatttgagcatgaggttgagaaaggaagtgctttcgcgttggggcttcttgctgtaaagccggagcatcagcaactcatagtcgacactggcgctttgcctcatcttgtgaatttgttgaatagacacaaggatggttctgtttctcgggctgtcaacagtgtcatccggagagcagctgatgcaattactaatcttgctcatgagaatagcagcatcaaaacccgcgttaggttggaaggtgggattccacctcttgtggagttgcttgaatttagtgatccaaaggtacaaagagcaactgctggagctctgcgaactttggcatttaaaaatgaggaaaacaaaaatcagatttttgaatgcagtgcccttcccaccctgattttgatgctccgctctcaagatgctgctatacattatgaagcagttggtgtgattggaaatctggtacactcttctccaagcatcaagaaagaagttcttctagctggtgctttacaacctgttattggattgctcagttcatgttgctctgagagccaaagggaggcagcattactacttggacagtttgcggctacagattcagattgcaaggtgcatattgttcaaagaggtgctgtccgaccattgattgagatgcttcaatcaccagatgtgcagcttagagaaatgtcagcttttgcactagggaggttggctcaggacatgcacaaccaagctggtattgctcatagtggtggtttggtgccattattgaaactacttgattcaaagaatgggtctttgcagcataatgctgcatttgctctttatggtcttgcagataacgaggataatgtgtccgacttcatcaaggtgggaggcatccagaaacttcaagatggggaattcattgttcaagcaacaaaagattgtgtagccaagacattgaaaagattagaggagaagattcatggacgagttttgaaccatttgttatatctgatgcgtgtagcagagaagggtattcaaagacgagttgctttggctcttgcccatctttgctccccagaagatcagaggatcatattcattgataataatggactggagttacttcttgcccttcttggttctacaagcctgaagcagcagcttgatggttccgtggccatgtacaagttggctaataaagccctcagtctttcacctgacgatgcagcacctccatctcctacaccacaggtttatttgggggagcaatatgtaaacaattctacactgtctgatgttacgtttctagttgaaggaaagcgattctacgcccatcgaatttgccttcttgcttcatcagatgcatttcgtgcaatgtttgatggtggttatcgggagaaggatgcaagagacgttgagattcctaatataagatgggaagttttcgagttgatgatgagatttatctacaccgggtccatagatgtctcattagatattgcccaagatctcctcagtgctgctgatcagtatctgttggagggcctcaagcgtctctgtgaatatactattgctcaggatatatctttggaaaatgtttcaagcatgtatgagctttcagaggctttccacgctgtatcactgaggcacacatgcattttatttatcttggagcactttgataaattaaatgctagtcctgggttctcgcatctgatccagcgattaattccagagatccgtaattacttttatagtgcacttactaggcctagcacaacacatagcttgtggctgtagattttcaccctttaattcttgatctaactagatatgatgtacagaaagctgtagatcttgtggtggttgtgaaagtgattattactgattgattgtagagggcccaatttctcttgtgctgctagagttctgttgcttgtaaaaactgtaagttcatcctgcagtgccactgtaattttcaaactgctggtgatatgcaccagaagtattcattatacgttgtgatggatatagtgaataacatttactctatcttctaaaagtgaatgctactgggatatagattcatctctattttttgcattgtcatgccttgttctggatcatgttctctaaaggtagagggcctatcgaagtgggtccctgcgcagcaaagacaatgatggatggtaccaaagacaatgggcaa

SEQ ID NO: 7705 - DNA, 2561 bp, Quercus alba
gagagagagagagagagagagagagcaatttttcatctcctatttgttaaagagtgcatggaggaggataatcatcctcatcatctaagacatcatcatcatcaagatcacaacttcccggagaggaaggggcaaaagcgtaaactggaagtagaagatgaaatcatcgaagaagaggaagaagatgagcgaggcggcggcggcggaggcgtcggaggagagatctccggccctccctccggcgacgccaagcaagctctactctgcgaggtcgctgctcaggtcactgtcctcaactcctctttctcttggagagagcccgatcgctccgccgccaaacgcgccactcacgtcctcgccgaactcgccaaaaacgaggaagtggttaacgtgattgttgaaggcggcgcagtaccggctttggtgaagcatctacaagcgccggcttgtagtgaaggtgagcggagttcgaagccgtacgagcatgaagtcgagaaaggaagtgcttttgcgctagggcttcttgctgtgaagcctgagcatcaacagcttatagttgacactggtgcattgtcatatcttgtggatctgttaaagaggcacaaggagggttctagttctcgtgctgtgaatagtgttattcgtcgagctgctgatgctatcaccaaccttgctcatgaaaatagcagcattaaaacccgtgtcaggatggaaggtgggattccgcctcttgttgaattgcttgaattcactgatacaaaggtgcaaagagctgctgctggggcactgcgaaccctggcatttaaaaacgatgaaaacaagaatcagattgttgaatgcaatgcacttcctaccctcattctgatgcttcgatctgaagatactgctatacattatgaagcggttggtgtgatcggaaatctggtgcactcatctccaaacataaagaaagaagttcttcaggctggagctctgcaacctgttattggattacttagttcgttgtgttctgagagtcaaagggaggcagccttgttacttggacaatttgctgcaactgattctgattgcaaggttcacattgtacagaggggtgctgtcaaacctttgattgagatgcttcaatcttctgatgttcagcttagggaaatgtcagcctttgcattggggaggacacacacaaccaagctggtattgctcataatggtggtttggtgccattactgaagcttctggattccaaaaatgggtccttgcaacataatgctgcatttgctctctatggcctagcagataatgaggataatgtgtctgattttattagggtgggaggcgttcagaagctgcaggatggagagtttatagttcaagcaacaaaagattgtgtagccaagacattgaaaagattagaggagaagattcatggacgggtcttgaaccatctgttatatcttatgcgtgtagcagagaaggctgtccaaagacgagttgctttggctcttgcccatctttgttccccagatgaccagagaaccatatttattgataacaatgggttggagttgctccttgggcttcttagttcttctagccctaagcagcaacttgatggtgctgtggctctatacaggttgtccaataaagccatggctctttctcctgttgatgcagctcccccatctccaacaccacaggtctatttaggggagcaatatgtaaacaatgttacattatctgacgttacatttctagttgaaggtaaacggttttatgctcatagaatctgcctgcttgcttcttcagatgcatttcgtgcaatgtttgatggtggttaccgggaaaaggatgccagggacatagagattccaaatattaaatgggacgttttcgagttgatgatgagattcatatacactggatctgtagacgttacattggatattgcacaagatctcctcagagctgctgatcagtatctcttggaggggcttaagcgactttgcgagtatagtattgcacaggatatatcattggagaatgtgtcaagcatgtacgaactttcagaagcctttcatgcaatgtcattgaggcacacgtgcatcttgtttatcttggagcaatttgataaattgagtgatagggcagggcactcgcactctcatctgatccagcgtataataccagagatccgtaattactttgctaaagcacttactaagcataactcacataacatgcggctgtagattgctgcccttctattcttgatctctaaccaaatgtgtacagaaatggtagttcttgttgttgagccggtggaaggttctaatttgttgattgtagtgaggctcgtaatctttctctgatgccagagtcctgttgcttgtgatcacgctgtgagtttcttctgtaacgccattgtcttagatattgaggggaatatgaccatgatcatattgtcattcatgcactgatggttatttgacttcaaagtgtagtcccaagtgtagtgaatttggcattccctgaaagatgcttttttgtgcaataataatacattg

SEQ ID NO: 7706 - DNA, 2319 bp, Euonymus alatus
gtccggtgatgcgcggcaggcgttactctccgaggtggttgcccatgttaagattcttaactccgccttttcttggaacgaagccgaccgagccgctgcaaagcgcgccacgcatgtcctcgctgagctcgccaagaatgaggaggttgtgaacgtgatcgttgaaggtggtgcggtccctgcactagtgaagcatctgcagtccccgccgtcgggcgaagatgaccgtggactcaagccgtttgagcacgaggtcgagaaggggagtgccttcgccttggggctccttgccgtaaagccagagcatcaacaacttatagttgacaatggatctttgttgcatctggtggatctgttgaagagacacaaggttggttcttgttctcgggctgtgactagtgttattagaagagcggcggatgccatcactaatcttgctcatgagaacagcagcattaagacccgtgttaggttggaaggtgggattcctccacttgttgagttgcttgaatttactgatacaaaggtgcaacgagcagctgccggagcgctgcggacacttgcatttaaaaatgatgagaataagaatcagattgttgaatgcaatgctctcccgacgctcattctaatgctgcgatctgaggatgctgcaatacactatgaggcggttggtgtgattggaaatttggtacactcatccccaaatattaagaaagaagttcttaatgctggagctttgcaaccagttattggtttgctcagctcttcctgctctgaaagccagagggaggcggctttgttacttggacaatttgccgcgacagactcagattgcaaggtgcacattgtgcagaggggtgctgtcggacctttaattgatatgcttcagtcccaggatgtccagttgagggaaatgtcagcctttgcgctggggagattggcacaggatgcacataatcaagctggtatagtacacaatggtggcttagggccattgctgaagcttcttgattccaaaaatgggtctctgcagcataatgctgcatttgcactttatggcctagcagacaacaaggataatgtatcagattttattagggtgggaggtgtccagaagctgcaggatggagagttcattgtgcaagcaactaaagactgtgtagccaagactttaaagagattagaggagaagattcatggccgagttttaaaacacttgttatatctattgcgcgtagcagagaagtctgtccaaaggcgcgttgctttggcgctagctcatctttgttctccagatgatcaaagaacaatattcattgaaaaaaatggattggagttgcttcttgggcttcttggttctactaacagtaagcaacaactcgatggcgccgtggccctctataagatggccaacaaagcaacgactctatctcctgttgatgcagctccgccatctccgactccacaggtctatttaggggagcagtatgtgaacaattcaactttgtctgatgttacatttctagttgaaggaagacggttctatgcccacagaatttgcctacttgcttcttcagatgcattccgggcgatgtttgatggtggctatagggaaaaggatgcaagagacattgagattcctaacattagatgggaggtttttgagttgatgatgagatttatttatactgggtctgtggtggtctcactggatattgcgcaagatcttctgagagcagcagatcagtatctcttggagggactgaagcgactttgtgaatataccattgcacaggatatatcactggaaaatgttgcaagcatgtatgaactctcagaagccttccacgctatgtcactgaggaacacatgcattttgtttatcctcgaacagttttctagactgagtcagaggcctgggcactcccatctgatgcagcgtatcttaccggagattcgtgattactttaccaaagcacttactaaacctaattcccactccttgcttttgtagaaggcttgccattgattcttgatctcttactagaactattgtacagaaaacggtaggtctcgttgttcttgagccatttgaaggttctcataggtcggttgcagcggggctcattatcagtcctggtgctggagttatgatgacgcgagttgtaagttgttttttcattccattgttttagatattgcaggaatatggccttcaccaacattttttttaacttctatgtaccatgttggttgtatgactcaaatctcttccctaaacaagctaaatggctttcagtaaaagacgcatcttttttc

SEQ ID NO: 7707 - DNA, 2459 bp, Panax ginseng
tttcattcccgaaatgcccccgatctgtcttctgttgaaagcttaatcctccacctctgaccaaagcctttccttccttgggcttgaatggattttcagaagcgccacgacaaggtaaatagaccggagaggaaagggcaaaaaaggaaactactgcacgaagagttcgacggagaccgacagatctctgtaccgtcagcttctttctccggcgactcccaccggttgctattgtgcgaggtggctgcgcaggttaatatactgaactccaccttctcttggagcgaagccgatcgagctgcggctaagcacgccactcatgttctagctgagctcgcgaagaacgaggaaattgtgaatgttatagttgatggtggtgcggtcccggcgctggtgaagcatcttgaagggccaccgtctagtgaaggtgaaattaagccatttgagcatgaggttgagaaaggaagtgctttcgcgttggggcttcttgctgtaaagccggagcatcagcaactcatagtcgacactggcgctttgcctcatcttgtgaatttgttgaatagacacaaggatggtcctgtttctcgggctgtcaacagtgtcatccggagagcagctgatgcaattactaaccttgctcatgagaatagcagcatcaaaacccgcgttaggttggaaggtgggattccacctcttgtggagttgcttgaatttagtgatccaaaggtacaaagagcaactgctggagctctgcgaactttggcatttaaaaatgaggagaacaaaaatcagatttttgaatgcagtgcccttcccaccctgattttgatgctccgctctcaagatgctgctatacattatgaagcagttggtgtgattggaaatctggtacactcttctccaagcatcaagaaagaagttcttctagctggtgctttacaacctgttattggattgctcagttcatgttgctctgagagccaaagggaggcagcattactacttggacagtttgcggctacagattcagattgcaaggtgcatattgttcaaagaggtgctgtccgaccattgattgagatgcttcaatcaccagatgtgcagcttagagaaatgtcagcttttgcactagggaggttggctcaggacatgcacaaccaagctggtattgctcatagtggtggtttggtgccattattgaaactactggattcaaagaatgggtctttgcagcataatgctgcatttgctctttatggtcttgcagataacgaggataatgtgtctgacttcatcaaggtgggaggcatccagaaacttcaggatggggaattcattgttcaagcaacaaaagattgtgtagccaagacattgaaaagattagaggagaagattcatggacgagttttgaaccatttgttatatctgatgcgtgtagcagagaagggtattcaaagacgagttgctttggctcttgcccatctttgctccccagaagatcagaggatcatattcattgataataatggactggagttacttcttgcccttcttggttctacaagcctgaagcagcagcttgatggttccgtggccatgtacaagttggctaataaagccctcagtctttcacctgacgatgcagcacctccatctcctacaccacaggtttatttgggggagcaatatgtaaacaattctacactgtctgatgttacgtttctagttgaaggaaagcgattctacgcccatcgaatttgccttcttgcttcatcagatgcatttcgtgcaatgtttgatggtggttatcgggagaaggatgcaagagacgttgagattcctaatataagatgggaagttttcgagttgatgatgagatttatctacaccgggtccatagatgtctcattagatattgcccaagatctcctcagtgctgctgatcagtatctgttggagggcctcaagcgtctctgtgaatattctattgctcaggatatatctttggaaaatgtttcaagcatgtatgagctttcagaggctttccacgctgtatcactgaggcacacatgcattttatttctcttggagcactttgataaattaaatgctaggcctgggttctcgcatctgatccagcaattaattccagagatccgtaattacttttatagtgcacttactaggcctagcacacatagcttgaggctgtagattttcaccctttaattcttgatctaactagatatgatgtacagaaagctgtagatcttgtggtggttgagaaagtgattattactgattgagtgtagagggcccaatttctcttgtgctgctagagttctgttgcttgtaaaaactgtaagttcatcctgcagtgccactgtaattttcaaactgctggtgttatgcaccagaagtattcattatacgttgtgatgtaaaaactgtaagttcat

SEQ ID NO: 7708 - DNA, 2744 bp, Eucalyptus grandis
attcctccctcatccatggactgcaaccgcagcgacgatctgcaggacatccaggagaagaagggccagaagaggaagctggaggacgaggcggccgccgccgacagcgagatctccgcctccgccggcggcggcggcggcggcggcgacggcggccggcagtcgctgctcagcgaggtggccgcgcaggtcaaggtcctcgagtccgccttctcctgggtcgagaccgatcgagccgccgccaagcgcgccacgcacgtcctcgccgagctcgccaaaaacgaggagctggggagcctgcttgtcgaaggcggtgtggttccggccctggtgaagcatctgcgggcgccgccgtcggcggagggcgaccggggtgtgaggccgtacgagcatgaagtggagaagggatgcgcttttgcgctgggtcatctggctgttaagcctgagcttcaacaacttatagtcgactgtggtgccttaccacatctaatagatctgctgaagaggcataaagatggttcaaccacacgagctgtcaacagtttaattaggagagcggccgatgctatcactaaccttgctcatgagaatagcagcatcaagattcgtgtcaggatggaaggtgggattcaaccgctagtagaattgctagattttatggataccaaagtgcaaagagctgctgctggagcattgcgtaccctggctttcaaaaacgatgaaaacaagaatcagattgtggagtgtaatgctcttccaacgctcattttgatgctccgttcagaggatgctgcaatacattatgaggctgtcggtgtcattggcaatctggtacactcatctccgaacataaaaaaagaagttctttctgccggggctttgcagcctgttattggattgctaagttcttgctgtcctgagagccaaagggaggcagctttgctcctagggcagtttgctgctgctgattcagactgtaaggttcacattgtccagaggggagctgttcgtcctttaatcgacatgcttcagtccgacgactttcagctgagggaaatgtcagcatttgcattagggagattggcccaggacgctcacaatcaagctggtatagcttataatggtggcttgattccattgttgaagcttcttgattcaaaaaatgggtccttgcagcataatgctgcctttgcgctttatggacttgcagacaatgaggacaatgtctccgattttattagagtaggaggtgttcaaaagctgcaagacggagaatttattgtccaggctacaaaagattgtgttgccaaaactttgaaaagattagaggagaagattcacggccgagttttgaatcatttactatatttgatgcgcatagcagagaagactgttcaaagacgtgttgctttggctcttgctcatctctgttctccggatgaccagcaaacaatttttgttgataacaatgggttggagctgcttgttggcctgcttatttgttcgagcgctaggcagcaacttgatggtgctgtggcattgttcaagttagctaacaaagcaatgtctctttctcctgttgatgcagctcctccctctccaacgccacaggtttacctaggggaacagtatgtgaacaaccctacgctgtccgatgtaacatttctagttgaaggaagacggttctatgcgcacagaatttgcttgcttgcttcttctgatgcatttcgtgcaatgtttgatggtggatatcgggagaaagatgctagggacatagaaattccaaatatcagatgggaggtttttgagttgatgatgagatttatatacactggatcaattgatgttacgctggaaattgctcaagatctcctcagagcttctgatcagtatctcttggagggactcaagcgactttgtgaatattccattgcacaggatatttcgttggaaaatgtctccagcatgtatgaactttcagaagccttcaatgctatttccttgaggcactcatgcatcttgttcattctggagcattttgacaaattgagacctgggaatttccctctcattcaccgtataataccagaaatccaacagtactttgtgaaagcacttactaagtctaaccagcgtagcaccttgaggccttaagaccctgtggtttcgctctccctactctaaccgattgttgtacaggaagtggtagatttatgagcagttggtagcaggtggatggctctgactgtttggtaattggaactcacattcttttccagacgcaagatgtggactccctgtaagtctccacccatttttgttgtaagatgtaactgggatggtgatcttcccattattgtcgaaatccaagcatgtagccatggattgtagcgtttcgagttagctttgccgacgtgcgttccatgaattgaaatgggatgtttcagtagacgtaagaaaaaaaggggaattggttggactctgttgactgtttcctcaaaaacgagtatgaagatgatgaatatcgtgtcatcttcagaggctcttgttgagggaacagatattggttccaatattcattgacatatttgcctgtggttcaatgtctcgggacttctggattgttgggcgtggttgtgaaagagtgtcattttctactgggaaacgctgtaattcatggaatgaaaggatggcttttgcttgtgtggcatgttcttcgacgaagagtgattttttaaacggag

SEQ ID NO: 7709 - DNA, 2323 bp, Castanea mollissima
cgaggtcgctgctcaggtcactgtcctcaactcctctttctcttggagagagcccgatcgctccgccgccaaacgcgccactcacgtcctcgccgaactcgccaaaaacgaggaagtggttaacgtgattgttgaaggcggcgcagtaccggctttggtgaagcatctacaagcgccggcttttagtgaaggtgagcggagttcgaagccgtacgagcatgaagtcgagaaaggaagtgcttttgccctaggtcttcttgctgtgaagcctgagcatcaacagctcatagttgacactggtgcattgtcacatcttgtggatctgttaaagaggcacaaggagggttctagttctcgtgctgtgaatagtgttatccgtcgagctgctgatgctatcaccaatcttgctcatgaaaatagcagcattaaaacccgtgtcaggatggaaggtgggattccacctcttgttgaattgcttgaattcactgatacaaaggtgcaaagagctgccgctggggcgctgcgaaccctggcatttaaaaacgatgaaaacaagaatcagattgttgaatgcaatgcacttcctaccctaattctaatgcttcgatctgaagatactgctatacattatgaagcggttggtgtgatcggaaatctggtgcactcatctccaaacataaagaaagaagttcttcaggctggagctctgcaacccgttattggattacttagttcgttgtgttctgagagtcaaagggaggcagccttgttacttggacaatttgctgcaactgattctgattgcaaggttcacattgtacagaggggtgctgtcaaacctttgattgagatgcttcaatcttctgatgttcagcttagggaaatgtcagcctttgcattggggaggttggcacaggacacacacaaccaagctggtattgctcataatggtggtttggtgccattactgaagcttctggattccaaaaatgggtctttgcaacataatgctgcatttgctctctatggcctagcagacaatgaggataatgtgtctgattttattagggtgggaggcgttcagaagctgcaggatggagagtttatagttcaagcaacaaaagattgtgtagccaagacattgaaaagattagaggagaagattcatggacgggtcttgaaccatctgttatatcttatgcgtgtagcagagaagactgtccaaagacgagttgctttggctcttgcccatctttgttccccagatgatcagagaaccatatttattgataacaatgggttggagttgctccttgggcttcttagttcttctagccctaagcagcaacttgatggtgctgtggctctatacaggttgtccaataaagccatggctctttctcctgttgatgcagctcccccatctccaacaccacaggtctatttaggggagcaatatgtaaacaacgttacattatctgacgttacatttctagttgaaggtaaacggttttatgctcatagaatctgcctgcttgcttcttcagatgcatttcgtgcaatgtttgatggtggttaccgggaaaaggatgccagggacatagagattccaaatattaaatgggatgtttttgagttgatgatgagattcatatacactggatctgtagaagttacattggatattgcacaagatctcctcagagctgctgatcagtatctcttggaggggcttaagcgactttgcgagtatagtattgcacgggatatatcattggagaatgtgtcaagcatgtacgaactttcagaagccttccatgcaatgtcattgaggcacacgtgcatcttgtttatcttggagcaatttgataaattgagtgatagggcagggcactcgcactctcatctgatccagcgtataataccagagatccgtaattactttgctaaagcacttactaagcataactcacataacttgcggctgtagattgctgcccttctattcttgatctctaaccaaatgtgtacagaaatggtagttcttgttgttgagccagtggaaggttctaatttgttgattgtagtgaggctcgtaatctttctctgatgccagagtcctgttgcttgtgatcacgctgtgagtttcttctgtaacgccgttgtcttagatattgaggggaatatgaccatgatcattattgtcattcatgcactgatggttatatgacttcaaagtgtagtcccaagtgtagtgaatttggcattccctgaaaggtgcctttttgtgcaataataatacgttgcttgatttctatttaaa

SEQ ID NO: 7710 - DNA, 2797 bp, Theobroma cacao
atccaatctctctctctttcaaatcacgattctcatttccgataaaaccttctctctctttgtctcttcctttctttgttccttcttgatggagcttcagaggagccaggaccagggcctcccagaacgaaaggggcaaaaacggaaactggaggaagaaaaccaagaggaccgcgaaacctctctccctaccggcgacgcccgccgtgctctcttggccgaagtcaccgctcaggttagcgtcctcgactccaccttctcttggcgcgaacctgatcgcgccgctgccaagcgagccactcacgtgctggccgagcttgcaaagaacgaggaagtggtgaatgtgattgttgaaggtggtgcggttccggctctagttaagcatctgcaagcgcctccgtgtagtgacggcgaccgaagcccgaagcctttcgagcacgaggttgaaaaaggaagtgcttttgcgctgggacttctcgccgtaaagccagaacatcagcaacttatagttgattctggggccttatcacatcttgtgaatttgttgaggcggcacaaggatggttctacttctcgtgctgtgattagtgtcattagaagagcggctgatgctatcaccaaccttgctcatgagaatagcagcattaaaacccgtgtcagaatggaaggtgggattccacctcttgttgagttgcttgattttactgatacaaaggtgcagagagcagctgctggggcattgcgaaccctagcattcaaaaatgatgaaaacaagaatcagattgttgaatgcaacgctcttccttctcttattctcatgctacgatcagaggatgctgctatacactatgaagcggttggtgtgattggcaatttggtgcattcatcaccgaacataaaaaaagaagttcttgctgctggggctttgcaacctgtcattggcttgcttacctcctgctgctcagagagccaaagggaggcagctttattacttggacaatttgctgcaacggattccgattgcaagctttttgtatcatttcctttgtccttgtaatggaataagaggagctctggttcatatcgtacaaaggggtgctgtcagaccgttgatcgatatgcttcactctccagatgtacagctgaaagagatgtcagcctttgctttggggaggttggcacaggacacacacaaccaagctggtattgcacataatggtggtttggtgcctttgttgaaacttctagattcaaagaatggatctttgcaacacaatgctgcatttgctctttatggtcttgcagataatgaggataacgtatctgattttattatggtgggtggggtccaacggctgcaagatggagagtttattgttcaagcaacaaaagactgtgttgccaagacactgaaaagactggaggagaagattcatgggcgggttttgaaccatttgctgtatctgatgcgtgtagctgagaagccagtccaacgacgagtggctttggctcttgctcatctttgttccccagaggatcagagaactatattcattgataacaatggacttgagctgcttcttgggcttcttggttctacaagtcctaagcagcaacttgatggtgctgttgctctgtacaagttggccaacaaagctatgagtctttctcctatggatgcagctcccccttctccaacaccacaggtctatttgggggagcagtatgtgaacaatgctacattatctgatgttacgttcctagttgaaggtagacggttctatgctcacagaatctgcctgcttgcttcttccgatgcatttcgtgctatgtttgatggtggttatcgggtgagttcacttttgcggcatgttaatgtctcagttggtcattcctcctcttcccaagagtggccaagaaatcccttcaccctgggtgttgggatgggagttattgttcaagaaaaagatgcaagggatattgaaattccaaacattagatgggaggtttttgagttgatgatgagatttatatacaccggatcagtagatgttacattggatattgctcaagatctgcttagagcagctgaccaatatcttttggagggacttaagcgactctgcgagtataccattgcacaggatatatcgctggaaaatgtttcaagcatgtatgaactctcagaagccttccatgctatatcattgaggcacacttgcattttgtttatcttggagaatttcgataaattgagcacaagacctgggcacttgcatctaatccagcgcataattccggagatccgcaattactttgccaaagcacttacaaaacctaacccacataaccttcggctatagaaggctggtttttaactcctgatctctaactagatacgttgtacagaaagtagcagatcttctttgatgttgtggagccgatggaaggttctaattggttctttgtagcgtggttcataatcattactgatgccagagttaccgttgcttgtagaaaaagctataaggtttcttctttaattcattgtcttttggcctccacttttgatcttcgtggactgtgttggttattagatttaaatgtattccaactacttacaaagttggcattcattgaaaatgcttgtactttttttttttttttttttttctgttggcctaagaaaatgcttgttcaaatgagcagttacagtttcttggtgaacgcttgatttcctgtgtaaaagttgaagaatgcttgaaaagaccaatgaatctagtagtgcttccataca

SEQ ID NO: 7711 - DNA, 2396 bp, Panax ginseng
ggatttccagaagcgccacgacaaggtaaataaaccggagaggaaagggcaaaaaggaaactactgcacgaagagttcaacggagaccgacagatctctgtaccgtcagcttctttctccggcgactcccaccggtcgctattgtgcgaggtggctgcgcaggttaatatactgaactccaccttctcttggaacgaagccgatcgagctgcggctaagcacgccactcatgttctagctgagctcgcgaagaacgaggaaattgtgaatgttatagttgatggtggagcggtcccggtgctggtgaagcatcttgaagggccaccgtctagtgaaggtgaaattaagccatttgagcatgaggttgagaaaggaagtgctttcgcgttggggcttcttgctgtaaagcttgagcatcagcaactcatagtcgacactggcgcgttgtctcatcttgtgaatttgttgaatagacacaaggatggtcctgtttctcgggctgtcaacagtgtcatccggagagcagctgatgcaattactaaccttgctcatgagaatagcagcatcaaaacccgcattaggttggaaggtgggattccacctcttgtggagttgcttgaatttagtgatccaaaggtacaaagagcaactgctggagctctgcgaactttggcatttaaaaatgaggagaacaaaaatcagattgttgaatgcagtgcccttcccaccctgattttgatgctccgctctcaagatgctgctatacattatgaagcagttggtgtgattggaaatctggtacactcttctccaagcatcaagaaagaagttcttctagctggtgctttacaacctgttattggattgctcagttcatgttgctctgagagccaaagggaggcagcattactacttggacagtttgcggctacggatacagattgcaaggtgcatattgttcaaagaggtgctgtccgaccattgattgagatgcttcaatcaccagatgtgcagcttagagaaatgtcagcttttgcactagggaggttggctcaggacatgcacaaccaagctggtattgctcatagtggtggtttggtgccattattgaaactacttgattcaaagaatgggtctttgcagcataatgctgcatttgctctttatggtcttgcagataacgaggataatgtgtctgacttcatcaaggtgggaggcatccagaaacttcaggatggggaattcattgttcaagcaacaaaagattgtgtagccaagacattgaaaagattagaggagaagattcatggacgagttttgaaccatttgttatatctgatgcgtgtagcagagaagggtattcaaagacgagttgctttggctcttgcccatctttgctccccagaagatcagaggatcatattcattgataataatggactggagttacttcttgcccttcttggttctacaagcctgaagcagcagcttgatggttccgtggccatgtacaagttggctaataaagccctcagtctttcacctgacgatgcagcacctccatcacctacaccacaggtttatttgggggagcaatatgtaaacaattctacactgtctgatgttacgtttctagttgaaggaaagcgattctacgcccatcgaatttgccttcttgcttcatcagatgcatttcgtgcaatgtttgatggtggttatcgggagaaggatgcaagagacgttgagattcctaatataagatgggaagttttcgagttgatgatgagatttatctacaccgggtccatagatgtctcattagatattgcccaagatctcctcagtgctgctgatcagtatctgttggagggcctcaagcgtctctgtgaatattctattgctcaggatatatctttggaaaatgtttcaagcatgtatgagctttcagaggctttccacgctgtatcactgaggcacacatgcattttatttctcttggagcactttgataaattaaatgctaggcctgggttctcgcatctggtccagcaattaattccagagatccgtaattacttttatagtgcacttactaggcctagcacacatagcttgaggctgtagattttcaccctttaattctagatctaactagatatgatgtacagaaagctgtagatcttgtggtggttgagaaagtgattattactgattgagtgtagagggcccaatttctcttgtgctgctagagttctgttgcttgtaaaaactgtaagttcatcctgcagtgtcactgtaattttcaaactgctggtgatatgcaccagaagtattcattatacgttgtgatgtaaaaactgtaagttcatcctgcagtgccacactatcttcgaaga

SEQ ID NO: 7712 - DNA, 2545 bp, Eutrema halophilum
ctggattgatttcaaaacgcttcttcttcttcttcctctctgatctcctcttcttggcatcgtctttgtctgcggaacttgtgaacgatggagcaacaaccggagaggcgagaaggacggagcttcccggagcgcaagggacagaagagaaagctagaggaaggagcagccgcttcagaggatcgagagatctctgccacaaccaccgacggcggccacgctcttctcagcgaggttgctgctcaagtctccgttctaaactccgccttctcctggaaagaatccgatcgtgctgccgcaaagcgcgccactcaagtcctagccgagctcgccaaaaacgaggatttagtgaacgtgattgttgacggaggagccgttccagctcttatgacgcatctacaggcgccgccgtacagcgacgaggagatggctcaaaagccattcgaacatgaggtcgagaaaggaagcgcttttgcgcttggtcttcttgcaattaagccagagtatcagaaattgatagtggataaaggtgccttacctcatctcgtgaatctgttgaagagaaacaaagatggctcttgttctcgagctgttaatagtgttatcagaagagcggctgatgccatcaccaatcttgctcatgagaacagcagcatcaagactcgtgttaggctagaaggcggtattccacctctcgtggagttgcttgaattttctgattccaaggttcagcgagcagcagcaggggcattgagaacccttgcatttaaaaatgatgataacaagaaccagatagttgaatgcaatgctcttcccacgctcattctaatgctaggatcagaggatgctgctatccattatgaagcggttggagttataggcaatctagtacattcgtctccaaacattaaaaaagaggttctttctgctggggcgttgcaacctgtcattggtcttctaagctcttgttgccctgagagccaaagagaggcggctttattacttggacagtttgcctcaactgattctgattgtaaggtacacattgttcaaaggggtgctgtccgccctttgattgagatgcttcagtcaccggacgttcagttgaaggaaatgtcggccttcgcactgggtagattggcgcaggattcccacaatcaagctggtattgcccatagtggtggtttaggacctttattgaagcttcttgattcaagaaatggatccttgcaacacaatgctgcattcgctctttatggccttgccgataatgaggataatgtgtcggattttatcagggtgggaggtatccagaggctacaggatggagagtttattgttcaagcgactaaagattgtgtctccaaaacattgaagagattggaggagaagattcatggaagagttctgagacatctgttgtacctaatgcgcatatcagagaagtctatccaaagacgagtttctcttgctcttgctcatctttgttcaccagaggatcagagaaccatattcatagatgacaatgggttggagttgctacttggtcttcttggttctacaaacattaagcagcaacttgatggtgctgcagcattgtacaaattagcgaataaatctatggcactttctccagttgatgctgctcctccgtctccaacacaaagggtttatctcggagagcaatatgtaaataatgctacgctgtctgatgtaacttttctagtcgaaggaaggacattctatgcacacagaatttgtctgctggcttcctcagatgcatttcgtgcaatgtttgatggtggttacagggaaaaagacgctagagatattgagattccgaatatcaaatgggaggtttttgagttaatgatgaggtttatatacactggatcagtcgacataacaattgagatagcacaagatcttttaagagcagcggatcaatatctcttggaggggctgaagcgactctgtgaatacacaattgctcaggatataacgttggaaaacataggaagcatgtacgatctctcagaagcgttccacgcgatgtcgctgaggcaatcttgtatcttgttcatcctggagcacttcgataaactgagttcaatggatgggcataatcagctggtgcagcgaacagtaccagagataagagagtatttttgtagagctctaacaaagtctactacaaacctgcaaagcttgaggttgtagaatgtggaagaagaagaagaagaagaagaagaagattgcatctaactagagaggtaagtagacaaggaacttatagagagagagagagaaagagggagccgctattagaggtctttatcgtcctgtcctatcccgagttgccagggccgtgcccatgttaagaatatggttcattacggttcattctcgtcactatattgtgattgtattagtctcttcttcttattactgtcgtcttcaaagaaatgatcacgttgtatccaaatggtaaacttccattattcatttcaaaaatctcggtctatataatactctctgttgaagg

SEQ ID NO: 7713 - DNA, 2783 bp, Eutrema halophilum
caacaaaaaacatgtagatgaattttttaaaaatgcgtacgagttatattctacttcgttaggacatatttaaccacaggatgtattttctgtccaacattcgattttgaatttttattttcccacacagtccagtttaaaacaattttaaaactaatatatgtacgaaaaaaaataaaaataaaggcgttttttcgtcgaacgaaaatacccaaagtacccctgatctcctttccgactggattgatttcaaaacgcttcttcttcttcttcctctctgatctcctcttcttggcatcgtctttgtctgcggaacttgtgaacgatggagcaacaaccggagaggcgagaaggacggagcttcccggagcgcaagggacagaagagaaagctagaggaaggagcagccgcttcagaggatcgagagatctctgccacaaccaccgacggcggccacgctcttctcagcgaggttgctgctcaagtctccgttctaaactccgccttctcctggaaagaatccgatcgtgctgccgcaaagcgcgccactcaagtcctagccgagctcgccaaaaacgaggatttagtgaacgtgattgttgacggaggagccgttccagctcttatgacgcatctacaggcgccgccgtacagcgacgaggagatggctcaaaagccattcgaacatgaggtcgagaaaggaagcgcttttgcgcttggtcttcttgcaattaagccagagtatcagaaattgatagtggataaaggtgccttacctcatctcgtgaatctgttgaagagaaacaaagatggctcttgttctcgagctgttaatagtgttatcagaagagcggctgatgccatcaccaatcttgctcatgagaacagcagcatcaagactcgtgttaggctagaaggcggtattccacctctcgtggagttgcttgaattttctgattccaaggttcagcgagcagcagcaggggcattgagaacccttgcatttaaaaatgatgataacaagaaccagatagttgaatgcaatgctcttcccacgctcattctaatgctaggatcagaggatgctgctatccattatgaagcggttggagttataggcaatctagtacattcgtctccaaacattaaaaaagaggttctttctgctggggcgttgcaacctgtcattggtcttctaagctcttgttgccctgagagccaaagagaggcggctttattacttggacagtttgcctcaactgattctgattgtaaggtacacattgttcaaaggggtgctgtccgccctttgattgagatgcttcagtcaccggacgttcagttgaaggaaatgtcggccttcgcactgggtagattggcgcaggattcccacaatcaagctggtattgcccatagtggtggtttaggacctttattgaagcttcttgattcaagaaatggatccttgcaacacaatgctgcattcgctctttatggccttgccgataatgaggataatgtgtcggattttatcagggtgggaggtatccagaggctacaggatggagagtttattgttcaagcgactaaagattgtgtctccaaaacattgaagagattggaggagaagattcatggaagagttctgagacatctgttgtacctaatgcgcatatcagagaagtctatccaaagacgagtttctcttgctcttgctcatctttgttcaccagaggatcagagaaccatattcatagatgacaatgggttggagttgctacttggtcttcttggttctacaaacattaagcagcaacttgatggtgctgcagcattgtacaaattagcgaataaatctatggcactttctccagttgatgctgctcctccgtctccaacacaaagggtttatctcggagagcaatatgtaaataatgctacgctgtctgatgtaacttttctagtcgaaggaaggacattctatgcacacagaatttgtctgctggcttcctcagatgcatttcgtgcaatgtttgatggtggttacagggaaaaagacgctagagatattgagattccgaatatcaaatgggaggtttttgagttaatgatgaggtttatatacactggatcagtcgacataacaattgagatagcacaagatcttttaagagcagcggatcaatatctcttggaggggctgaagcgactctgtgaatacacaattgctcaggatataacgttggaaaacataggaagcatgtacgatctctcagaagcgttccacgcgatgtcgctgaggcaatcttgtatcttgttcatcctggagcacttcgataaactgagttcaatggatgggcataatcagctggtgcagcgaacagtaccagagataagagagtatttttgtagagctctaacaaagtctactacaaacctgcaaagcttgaggttgtagaatgtggaagaagaagaagaagaagaagaagaagattgcatctaactagagaggtaagtagacaaggaacttatagagagagagagagaaagagggagccgctattagaggtctttatcgtcctgtcctatcccgagttgccagggccgtgcccatgttaagaatatggttcattacggttcattctcgtcactatattgtgattgtattagtctcttcttcttattactgtcgtcttcaaagaaatgatcacgttgtatccaaatggtaaacttccattattcatttcaaaaatctcggtctatataatactctctgttgaagg

SEQ ID NO: 7714 - DNA, 2475 bp, Arabidopsis thaliana
cttcttcttcttctctgatctctcctcttcttcggatcgtcttttactttgtgaacgatggaccaacaaccggagaggcgagaaggccggagttttccggagcgtaaaggacagaagcggaagctagaggaaggagccgccgccgtagaagatcgagagatctctgccgtcagcaccgacggaggccaagcgcttcttagcgaggttgctgctcaagtctcggtactaaactctgccttctcttggcaagagtccgatcgcgctgctgccaagcgagccactcaagttctggctgagctagccaaaaacgaggatttagtgaacgtgattgtcgacggaggtgctgttccagctcttatgacgcatctacaggcgccaccatacaacgacggggacttggctgagaagccgtacgaacacgaagttgagaagggaagcgcttttgcgcttggtcttcttgctattaagccagagtatcagaaactgatagtagacaaaggtgccttacctcatttagtgaatttgttgaagagaaacaaagatggttctagctctcgagctgtgaatagtgttatcagaagagcggctgatgccatcaccaatcttgctcatgagaacagcagtatcaagacccgtgttagggtagaaggcggtattccacctctcgtggagttgcttgaattttctgattcaaaggtccagagagcagcagcaggggcattgagaacccttgcatttaaaaatgatgataacaagaatcagatagttgaatgcaatgctcttcccacacttattctaatgctaggatcagaggatgctgctatacattatgaagcggttggagttataggcaatctagtacactcgtctccacacattaaaaaagaggttcttactgccggggcgttgcaacctgtcattggtcttcttagctcctgttgccctgagagtcaaagagaggcggctttattacttgggcagtttgcctcaactgattctgattgtaaggtgcacattgtgcaaaggggtgctgtccgtcctttaattgagatgcttcagtccccggatgtccagttgaaggaaatgtcggcctttgcactgggtagattggcacaggatgcccacaatcaagctggtattgcccatagtggtggtttaggacctttattgaagcttctcgattcaagaaatggatcattgcaacacaatgctgcatttgctctttatggccttgccgataatgaggataatgtgtcagattttatcagggtgggaggtatccaaaagctacaggatggagagtttattgttcaagcaactaaagattgtgtttccaaaacactaaagagattggaggagaagattcatggaagagttctgagacatctgttgtacctaatgcgcatttcagagaagtctatccaaagacgagttgctcttgcccttgctcatctctgttcacccgaggatcaacgaaccatattcatagatgacaacgggttggagttgctactcggtcttcttggttctttaaacactaagcagcaacttgacggtgcagcagcgttgtacaaattagcaaataaatctatggcactttctccagttgatgctgctcctccttctccaacacaaagggtttatctcggagagcaatatgtaaataatgctacgctgtctgatgtaacctttctagtcgaaggaaggacattctatgcacacagaatttgtctgctggcatcctcagatgcatttcgtgcaatgtttgatggtggttacagagaaaaagacgctagagatattgagattccaaatatcaaatgggaggtgtttgagttaatgatgaggtttatatacactggatctgtcgacataacaaatgagatatcaaaagatcttctaagagcagcggatcagtatctcttggagggcctgaaacgactctgtgaatacacaattgctcaggatattacgttggaaagtataggagacatgtacgagctatcagaagcattccatgcgatgtcgctgaggcaagcttgtatcatgttcatcctggagcatttcgataaactgagttcaatgccttggcagaacgagctggtgcagagaacaataccagagataagagagtacttttgtagagccctaacaaagtctactacaaacctgcaaagcttgaggttgtagaatgcggaagaagaagactgcacttaactagaggtaagtagacaaggaattatatagagagaaagagagagagagatcaagagccgccattagaggtctttatcgtcctgtactgggttgtcttagttatttgctgtgctttttggttcgttttggtcattttgtattgtattaattaatctcctctgatcacaatcggtcttgaatgaaatcgctaccctttgtatccaaaaataccattgtggtataacttccactattcaattcaaaatccactctccaact

SEQ ID NO: 7715 - DNA, 2763 bp, Brassica napus
gaactcgtgaaacgatggagcaacaacaaccggagaggcgagaaggccgaagcttccccgagcgcaagggacagaagagaaagctagaggaaggagcagccgccgccgcagaggatcgagagatctccgcctcaaccaccaccgacggcggcggcgatgcgattctcaacgaaatcgctgctcaagtctccgttctaaactccgccttctcatggcaagagtccgatcgcgctgcggcgaaacgcgccactcaagtcctcgccgagctcgctaaaaacgaggatttagtgaacgtgattgttgatggaggagctgttccagctcttatgacgcatctacaagcgccgccgtacatcgacggagacttggctcagaagccgtttgaacatgaggttgagaaggggagcgcctttgctcttggtctacttgcaattaagccagagtatcagaagctgatagtggacaaaggtgctttacctcatctcgtcaatctgttgaagagaagcaaagatggttctacttcccgtgctgttaatagtgttatcagaagagcggctgatgccatcaccaatcttgctcacgagaacagcagcatcaagactcgtgttaggctcgaaggcggtattccacctctcgttgatttgcttgagttttctgattcaaaggttcagcgagcagcagcaggggcgttgagaacccttgcgtttaaaaacgatgataacaagaaccagattgtcgagtgcagtgctcttcccaagctcattctaatgttaggatcagaggatgctgctatacattatgaagcggttggagttatcggcaatctagtacattcttctccaaacattaaaaaagaggttctttctgctggggcgttgcaacctgtcattggtcttctcagttcatgttgccctgagagtcaaagagaggcggctttattacttggacagtttgcgtcgactgattccgattgtaaggtgcacattgtgcaaaggggtgctgtccgtcctttgattgagatgcttcagtcacctgacgtgcagttgaaagaaatgtcggcctttgcactgggtagattggcgcaggattctcacaatcaagctggtattgcccatagtggtggtttaggacctttgttgaagcttcttgattcaagaaatggatccctgcaacacaacgcggcatttgctctctatggccttgccgataatgaggataatgtatcagattttatcagggtgggaggtatccagaagctacaggatggagagtttatagttcaggcaactaaagattgtgtctccaaaacactgaagagattggaggagaagattcatggaagagttcttagacatctgttgtacctaatgcgcatttctgaaaagtctatccaaagacgggttgctctcgctcttgctcatctctgttcaccagaagatcagagaaccatattcatagatgaaaatgggttggagttgctacttggtcttcttggttctacgaacactaaacagcaacttgatggcgctgcagcattgtacaaattagcaaataaatctatggcactttctccagttgatgctgctcccccttctccaacacaaagggtttatctcggagagcagtatgtaaatagtgccacgctgtctgatgtaacttttctagtcgaaggaaggagattctatgcacacagaatatgtctcctggcatcttcagatgcatttcgcgcaatgtttgatggtggttacagagaaaaggacgctagagatattgagattcctaatatcaagtgggaggtttttgagttaatgatgaggtttatatacactggatccgtcgacataacaattgagatatcacaagatcttctaagagcagcggatcagtatctattggaggggctaaagcggctctgtgaatacacaattgctcaggatataacgttggaaaacataggaggcatgtacgatctctcagaagcattccatgcaatgtcgctgaggcaagcttgtatcctgttcatcctggagcatttcgataaactgagcacaatgcatgggcaaaaccagctggtacagcgaacaataccagagataagagagtacttttgtagagctctaacaaagtctacgacaaacctgcaaggcctgaggctgtaagaagaagaagactggtacctaactagagaggtaagtagacaaggaatatcatatagagagagaaagctcgctattagtaagaggtcttttatggtcttgtcctatcctgagtcgttttagtaaaatttgctgtgcgtttggttcattgtattttgtatcaaattctcttctgatcacaatcgcgtcttaaaaagagatcgccactttgtatccagaacaccaatatggtgaaactttcactattcaattcaagatccacggaccacggtccaacgatcctgtgttagaagaaaatatacactgtgatgatggaatatggtagtgacaaatcagttcttgactaaatgattaatcagagaggaaaaataataatatttgttaatttttaatattatttgaggaaccgacgacatatacagtaataatatcccgttttggctttacaactaaataattgaaagaaatggcttgccattaggttattataaaatagcaactctaatatttttggagtttctgccggcagatatatttttttttattatttcagaatgatagaaaatgaaaggtatataattataaataattttttttgaatatactc

SEQ ID NO: 7716 - DNA, 2491 bp, Arabidopsis lyrata
gcttctgcttcttctctgatctctcctcttcttcggatcgtcttttactttgtgaacgatggagcaacaacctgagaggcgagaaggccggagtttcccggagcgtaaaggacagaagcgaaagctagaggaaggagcagccgccgtagaagatcgacagatctctgccgtcaccaccgacggaggccaagcgcttctcaccgaggttgctgctcaagtttcggttctaaactctgccttctcttggcaagaatcggatcgcgctgctgctaagcgcgcaactcaagtcctggctgagctagctaaaaacgaggatttagttaacgtgattgtcgacggaggtgctgttccagctcttatgacgcatctacaggcgccgccctacaacgacggggacttggctgagaagccgtacgaacacgaggttgagaagggaagcgcttttgcgcttggtcttctagcaattaagccagagtatcagaaactgatagtagacaaaggtgccttacctcatctagtgaatctgttgaagagaaacaaagatggttctagctctcgagctgtgaatagtgttatcagaagagcggctgatgccatcaccaatcttgctcatgagaacagcagtatcaagacccgtgttagggtagaaggtggcattccgcctctcgtggagttgcttgaattttctgattcaaaggttcagagagcagcagcaggggcactgagaacccttgcatttaaaaatgatgataacaagaaccagatagttgaatgcaatgctcttcccactctcattctaatgctaggatcagaagatgctgctatacattatgaagcggttggagttattggcaatctagtacactcgtctccacacattaaaaaagaggttcttgctgccggggcgttgcaacctgtcattggtcttcttagctcctgttgccctgagagccaaagagaggcggctttattacttgggcagtttgcctcaactgattctgattgtaaggtgcacattgtgcaaaggggtgctgtccgtcctttgattgagatgcttcagtcaccggatgtccagttgaaggaaatgtcggcctttgccctgggtagattggcgcaggatacccacaatcaagctggtattgcccatagtggtggcttaggacctttattgaagcttctcgattcaagaaatggatcattgcaacacaatgctgcatttgctctttatggccttgccgataatgaggataatgtgtcggattttatcagggtgggaggtatccaaaagctacaagatggagagtttattgttcaagcaactaaagattgtgtctccaaaacactgaagagattggaggagaagattcatggaagagttctgagacatctgttgtacctaatgcgcatttcagagaagtctatccaaagacgagttgctcttgctcttgctcatctctgttcacccgaggatcagagaaccatattcatagatgacaatgggttggagttgctactcggtcttcttggttctttaaacactaagcagcaacttgatggtgcggcagcgttgtacaaattagcaaataaatctatggcactttctccagttgattctgctcctccttccccaacacaaagggtttatctcggagagcaatatgtaaataatgctacgctgtctgatgtaacctttctagtcgaaggaaggacattctatgcacacagaatttgtctgctggcatcctcagatgcatttcgtgcaatgtttgatggtggttacagagaaaaagacgctagagatattgagattccgaatatcaaatgggaggtgtttgagttaatgatgaggtttatatacactggatctgtcgacataacaaatgagatatcaaaagatcttctaagagcagcggatcagtatctcttggagggcctgaaacgactctgtgaatacacaattgctcaggatataacattggaaagcataggagacatgtacgagctctcagaagcattccatgcaatgtcgctgaggcaagcttgtatcttgttcatcctggagcatttcgataaactgagttcaatgccttggcagaacgagctggtgcagagaacaataccagagataagagagtacttttgtagagctctaacaaagtctactacaaacctgcaaagcttgaggctgtagaatgtggaagaagaagaagaagaagaagactgcacttaactagaggtaagtagacaaggaaaatatagagaaaaagagagatcaagagccgccattagaggtctttatggtcatgtcttgagttgttatagttatttgctgtgcttttggttcgttttggtcatttgtattgtattaatctcttctgatcacgatcggtcttgaaagaaatcgccacctttgtatccaaaagataccgttgtggtaaacttgcgattattcaattcaaaatccaatctccaactatcctctctttgttga

SEQ ID NO: 7717 - DNA, 2857 bp, Brassica rapa
gtctggattgatttcaaaacgctccttcttctctgatctcctcctctcctcgcatcgtcgtctgtgtctctagagaactcgtgaaacgatggagcaacaacaaccggagaggcgagaaggccgaagcttccccgagcgcaagggacagaagagaaagctagaggaaggagcagccgccgccgcagaggatcgagagatctccgcctcaaccaccaccgacggcggcggcgatgcgattctcaacgaaatcgctgctcaagtctccgttctaaactccgccttctcatggcaagagtccgatcgcgctgcggcgaaacgcgccactcaagtcctcgccgagctcgctaaaaacgaggatttagtgaacgtgattgttgatggaggagctgttccagctcttatgacgcatctacaagcgccgccgtatagcgaaggagacttggctcagaagccgtttgaacatgaggttgagaaggggagcgcctttgctcttggtctacttgcaattaagccagagtatcagaagctgatagtggacaaaggtgctttacctcatctcgtgaatctgttgaagagaagcaaagatggttctacttcccgagctgttaatagtgttatcagaagagcggctgatgccatcaccaatcttgctcacgagaacagcagcatcaagactcgtgttaggctcgaaggcggtattccacctctcgttgatttgcttgagttttctgattcaaaggttcagcgagcagcagcaggggcgttgagaacacttgcgtttaaaaacgatgataacaagaaccagattgtcgagtgcagtgctcttcccaagctcattctaatgttaggatcagaggatgctgctatacattatgaagcggttggagttatcggcaatctagtacattcttctccaaacattaaaaaagaggttctttctgctggggcgttgcaacctgtcattggtcttctcagttcatgttgccctgagagtcaaagagaggcggctttattacttggacagtttgcgtcgactgattccgattgtaaggtgcacattgtgcaaaggggtgctgtccgtcctttgattgagatgcttcagtcacctgacgtgcagttgaaagaaatgtcggcctttgcactgggtagattggcgcaggattctcacaatcaagctggtattgcccatagtggtggtttaggacctttgttgaagcttcttgattcaagaaatggatccctgcaacacaacgcggcatttgctctctatggccttgccgataatgaggataatgtatcagattttatcagggtgggaggtatccagaagctacaggatggagagtttatagttcaggcaactaaagattgtgtctccaaaacactgaagagattggaggagaagattcatggaagagttcttagacatctgttgtacctaatgcgcatttctgaaaagtctatccaaagacgggttgctcttgctcttgctcatctctgttcaccagaagatcagagaaccatattcatagatgaaaatgggttagacttgctacttggtcttcctggttctacgaacactaaacagcaacttgatggcgctgcagcattgtacaaattagcaaataaatctatggcactttctccagttgatgctgctcccccttctccaacacaaagggtttatctcggagagcagtatgtaaatagtgccacgctgtctgatgtaacttttctagtcgaaggaaggagattctatgcacacagaatatgtctcctggcatcttcagatgcatttcgcgcaatgtttgatggtggttacagagaaaaggacgctagagatattgagattcctaatatcaagtgggaggtttttgagttaatgatgaggtttatatacactggatccgtcgacataacaattgagatatcacaagatcttctaagagcagcggatcagtatctattggaggggctaaagcggctctgtgaatacacaattgctcaggatataacgttggaaaacataggaggcatgtacgatctctcagaagcattccatgcaatgtcgctgaggcaagcttgtatcctgttcatcctggagcatttcgataaactgagcacaatgcatgggcaaaaccagctggtacagcgaacaataccagagataagagagtacttttgtagagctctaacaaagtctacgacaaacctgcaaggcctgaggctgtaagaagaagaagactggtacctaactagagaggtaagtagacaaggaatatcatatagagagagaaagctcgctattagtaagaggtcttttatggtcttgtcctatcctgagtcgttttagtaaaatttgctgtgcgtttggttcattgtattttgtatcaaattctcttctgatcacaatcgcgtcttaaaaagagatcgccactttgtatccagaacaccaatatggtgaaactttcactattcaattcaagatccacggtccaacgatcctgtgttagaagcaaaaatacactctgtgatgattacatatggtagtgactaatcgctacttgtataaatgattaatcagatgacccaagacaggaaaatgaataatatttgttaatttttaatattgtttgaggaaccgacgacatatacagtaataatattaatatcccgttttggctttacaactaaataattgaaagaaagggctgccattaggttattataaaatagcaactctaatatttttggagtttctgtcggcagatatatttttttttatttcagaatgtatatagaaaatgaaaggtatataattataaatacttttttttgaatatactcaaagaaaaaa

SEQ ID NO: 7718 - DNA, 1367 bp, Glycine max
agaaaaataattagaagaactaacgtgagcgattttgtctaacactgatagaagaagcgcagttaacgaaggtataagactgcagagagactgagagagaaagagatctggaagaagaaatgagtgaagcgcagaagcacgtttgggaaggggcaattcctctccagattcacctccacgaatccgaagtcaccactctccctcctcctccacccgctctcgtgttggcacctcggctaggttatttgcctttgctgatttcgctattgaagcctcagttcagcagcacgcttccacctggagtcgacaccatttggtttgagtacaaaggcctccctctcaagtggtatatacctactggagttctttttgatcttttgtgcgtggagccagagaggccgtggaatttaacggtacacttcagaggatatccaagtaatattttacttccctgtgaaggtgaagacagtgtaaagtggagctttattaactcactgaaagaggctgcatatataataaatgggaatagcaaaaatgtgatgaacatgtctcaaactgatcaggtggagctctggggctctgttttaaatggtaatttggaaacttatcgacgggtggcatcgaagcttaagcttggaacttttgaagatgaatatatggaaaatgttagttcagtcttgattaaatctccacaaagtccaggggatactgatgttacgggacaagtgaagactggtaggattcctgttcgtttatatctgtggactgtcaatgaggagtttgatgattttgaagatgctccacaaattgataattgggacaaagtctcatatatcaatcgacctgttgagatttataaggaagatggtaaatactttagcttaaatgatgcagttaaaagaatattgcccgagttttttccggaaaattcctttgtaactgaaggagatgcaaacatcaaccaaattgaagagggagaaagttcatctgatccagggtcatcttgcaacacacttgagattgctgaaatcaaatttgtacgcgttcaaggaatagaaccaattttagacatacctttttcttgggtggttaacaacttgatgaatcccgagtattttcttcatatgtgtgtttgcttaaaagtttcaaagtccaatgctgtgcaatagggataattttagttatgttggacattttactggaaaaatcagaaggtgcaattcttttgtacatatatgtacataacggtttcatatcatatattcatttcatgattcgattgctattttccacttccaagtgtaataaatgttgacagatgattattttttaaatccaatcaagggtaccgtttccctgcataattg

SEQ ID NO: 7719 - DNA, 1367 bp, Glycine max
agaaaaataattagaagaactaacgtgagcgattttgtctaacagtcatagaagaagcgcagttaacgaaggtataagactgcagagagaccgagagagaaagagatctggaagaagaaatgagtgaagcgcagaagcacgtttgggaaggggcaattcctctccagattcacctccacgaatccgaagtcaccactctccctcctcctccacccgctctcgtgttggcacctcggctaggttatttgcctttgctgatttcgctattgaagcctcagttcagcagcacgcttccacctggagtcgacaccatttggtttgagtacaaaggcctccctctcaagtggtatatacctactggagttctttttgatcttttgtgcgtggagccagagaggccgtggaatttaacggtacacttcagaggatatccaagtaatattttacttccctgtgaaggtgaagacagtgtaaagtggagctttattaactcactgaaagaggctgcatatataataaatgggaatagcaaaaatgtgatgaacatgtctcaaactgatcaggtggagctctggggctctgttttaaatggtaatttggaaacttatcgacgggtggcatcgaagcttaagcttggaacttttgaagatgaatatatggaaaatgttagttcagtcttgattaaatctccacaaagtccaggggatactgatgttacgggacaagtgaagactggtaggattcctgttcgtttatatctgtggactgtcaatgaggagtttgatgattttgaagatgctccacaaattgataattgggacaaagtctcatatatcaatcgacctgttgagatttataaggaagatggtaaatactttagcttaaatgatgcagttaaaagaatattgcccgagttttttccggaaaattcctttgtaactgaaggagatgcaaacatcaaccaaattgaagagggagaaagttcatctgatccagggtcatcttgcaacacacttgagattgctgaaatcaaatttgtacgcgttcaaggaatagaaccaattttagacatacctttttcttgggtggttaacaacttgatgaatcccgagtattttcttcatatgtgtgtttgcttaaaagtttcaaagtccaatgctgtgcaatagggataattttagttatgttggacattttactggaaaaatcagaaggtgcaattcttttgtacatatatgtacataacggtttcatatcatatattcatttcatgattcgattgctattttccacttccaagtgtaataaatgttgacagatgattattttttaaatccaatcaagggtaccgtttccctgcataattg

SEQ ID NO: 7720 - DNA, 1317 bp, Phaseolus vulgaris
agtggagcgaatgaagttaaaagtagagagagtgagagagaaatagaaagagatctgaaagagatgagctcggcgcagaagcaggtgtgggaaggggcaattcctctgcagattcacctccacgaatctgaagtcaccactctccctcctcctccacccgctctcgtgttggcccctcggatagggtacttgcctctgttgatttcgctcgtaaagcctcacttcagcagcacgcttccccctggacttgacgccgtttggtttgactacaaaggcctccctctcaagtggtatatacccaccggtgttctttttgatcttctgtgcgtggagccggagagaccgtggaatttaacggtacactttagaggatatccaagtaatgtattgcttccttgtgaaggtgaagatagtgtaaagtggagctttattaactcactgaaagaggctgcatatgtaataaatgggaatagcaaaaatgtcatgaacatgtctcaacctgatcaggtggagctctggagctctgttttaaatggtaatttagaaatttatcggcgggtggcatctaagcttaagcttggaatatctgaagatgaatatacggaaaatgttagttcagtcttgattaaatctccacaaagtacaggggatactgatgttactggacaagttaaaactggtaggattcctgttcgtttatatctatggacagtcaatgaggagtttgatgattttgaagatgctcctcaaattgataattgggacaaagtctcatatatcaatcgtcctgttgagcttcataaggaagatggtaaatactttagtttaaatgatgcggttaaaagaatattacccgagttttttccggaaaattcctttgtaatagaaggaaatgcaaacattaaccaaagtggagaagagggagaaagatcatctgatcccgggtcatcttgcaacgcagctgagattgctgaaatcaaatttgttcgcattcaagggatagaaccagttttagatatacctttttcttgggtggttaacaactttgtgaatcctgagtattttcttcatatgtgcgtatgcttaaaagttaatgccaatgccgtgcaatagggataaatttagttttgttgggtatacatttactagaaaaaaatcagaaggtgcaattttttttgtatataaaatgtacaaaacggtttcttttcatatttatttcataattcgattgctattttccagtgcaaagtgtagtaattgttgacagatcgatttttttttaactcaaattaatgttactgctgtttccctgcaaaa

SEQ ID NO: 7721 - DNA, 1381 bp, Phaseolus vulgaris
aaagatgagtgagaaacttaacggaaaaggcaaggtgagcgatctgatgaaagtggtagaagaagtggagcgaatgaagttaaaagtagagagagtgagagagaaatagaaagagatctgaaagagatgagctcggcgcagaagcaggtgtgggaaggggcaattcctctgcagattcacctccacgaatctgaagtcaccactctccctcctcctccacccgctctcgtgttggcccctcggatagggtacttgcctctgttgatttcgctcgtaaagcctcacttcagcagcacgcttccccctggacttgacgccgtttggtttgactacaaaggcctccctctcaagtggtatatacccaccggtgttctttttgatcttctgtgcgtggagccggagagaccgtggaatttaacggtacactttagaggatatccaagtaatgtattgcttccttgtgaaggtgaagatagtgtaaagtggagctttattaactcactgaaagaggctgcatatgtaataaatgggaatagcaaaaatgtcatgaacatgtctcaacctgatcaggtggagctctggagctctgttttaaatggtaatttagaaatttatcggcgggtagcatctaagcttaagcttggaatatctgaagatgaatatacggaaaatgttagttcagtcttgattaaatctccacaaagtacaggggatactgatgttactggacaagttaaaactggtaggattcctgttcgtttatatctatggacagtcaatgaggagtttgatgattttgaagatgctcctcaaattgataattgggacaaagtctcatatatcaatcgtcctgttgagcttcataaggaagatggtaaatactttagtttaaatgatgcggttaaaagaatattacccgagttttttccggaaaattcctttgtaatagaaggaaatgcaaacattaaccaaagtggagaagagggagaaagatcatctgatcccgggtcatcttgcaacgcagctgagattgctgaaatcaaatttgttcgcattcaagggatagaaccagttttagatatacctttttcttgggtggttaacaactttgtgaatcctgagtattttcttcatatgtgcgtatgcttaaaagttaatgccaatgccgtgcaatagggataaatttagttttgttgggtatacatttactagaaaaaaatcagaaggtgcaatttttttttgtatataaaatgtacaaaacggtttcttttcatatttatttcataattcgattgctattttccagtgcaaagtgtagtaattgttgacagatcgatttttttttaactcaaattaatgttactgctgtttccctgcaaaa

SEQ ID NO: 7722 - DNA, 1304 bp, Cajanus cajan
aatgcgcaagtaagagtgaatagagagagagagagagagatctggaagaagagatgagtgaggcgcagaagcaggtgtgggaaggggccattcctctgcagattcatctccaccaatctgaagtcaccactctccctcctcctccacctgctctcctgttggcccccaggataggctacttgcctttgttgatttcgcttttgaagcctcacttcagcacggcgcttccccctggagttgacaccatttggtttgaatacaagggccttcctcttaagtggtatatacccactggtgttctttttgatcttctatgcgtggagcccgagaggccgtggaatttgacggtacactttagaggatatccaagtaatttgttgcttccctgtgaaggtgaagacagcgtgaagtggagctttataaactcattgaaagaggctgcatatgtaataaatggtaattgcaagaatgtcatgaacatgtcgcatcctgatcaggtggagctttggggctctgttttaaatgggaacctggaatcttatcaacgggtggcatctaagcttaagcttggaacttttgaagacgaatatgctgaaaatatcagttcaggctcgatcaaatctccacaaagtacaggggatatggatgctgcgggacaagtgaagaccggtaggattcctgttcgtttatatctgtggactgtgaatgaggagtttgatgattttgaagatgctcctcaaattgataattgggacaaagtctcgtatatcaatcgacctgttgagattcacagggaagatggtaaattctttagcttaaatgaggcagttaaaagaatattgcccgagttttttccggaaaattccttcgtaagtgaaggagatgctaacatcaaccaaagtgcaggagaagagggagaaagttcatccgatccgtggtcatcttgccacccacttgagcttgctgaaatcaaatttatacgcattcaagggatagaaccaattttagacatacctttttcttgggtggttaacaacttgatgaatcccgagtattttcttcatatttgtgtttgcttgaaagtttcgaaggtcaatgctatgctatagggataaatttaattatgttgggcatacatttaatggaaaaatcagaaggtgcaattcttttgtacataaatgtacagacagtttcatatcatattcttttcataattcgattgctattttccactgcaaggtgtaataaatgtttacagattattttttaaatccaattatgtgtactgtttccctgcaaatagt

SEQ ID NO: 7723 - DNA, 1379 bp, Cicer arietinum
cagcaagaaacatcccgatcagtaattagttcaactttattcagctttagaagaaggaaaaataaaaaagagagtaaatagaaaggaaaaagaaaaaaaagagagaaagaaggaattgaacttaaattgattttgtgaaaaaacggcagaaagagaagcgattttgtgaagttgatgaatagagagatctagaagagaagcgatgagtgaagcgcagaagtacgtttggaaaggagcaattcctcttcaaattcatcttcacgaatctgaagtcaccactcttcctcctcctccacccgctcacgtcttggctcctaggatagggtacttgcctttgttgatttctctattgaagcctcagttcagcgctacacttcctcctggagttgacactatttggtttgagcacaaagggcttcctctcaagtggtatataccaaccggagttcttttcgatcttttatgtatggagccagaaaggccgtggaacttaacagtacactttagaggatttccaagcaatttattgcttccatgtgaaggtgaagacagtgtaaagtggagctttattaactcactgaaagaggctgcatatgtaataagtggaaattgcaagaatgtcatgaacatgtctcaaactgatcaggtggagctctggggctctgttttaaatggtaatttggaaacttatagacgggtgtcgtctaagcttaagcttgaaacttttgaagatgaatatatagaaaatattgattcagactcgactaaatctgaacaaagtactggggatgctgaagctgctggacaagtgaagacaagtaggattcctgttcgtttatatttgtggaccgtcaatgacgattttgatgattttgaagatgctccacaaattgataattgggacaaagtctcatatttcaatcgacctgtcgagattcataaggaagatggtaaatactttagtttaaatgatgcggttaaaagacttctgcccgagtactttccggaaagtctctttgttaacgaaggagatgcaattatagaccgaagtgctggagaagaaggagaaagttcatgtgatcccgggtcatcttgcgacaaacttgagactgcgaaaataaagtgcgtacgcattcaagggatagaaccgagtttggaaatacctttttcttgggtagttaacaacttaatgaatcctgagtatttccttcacatgtgtgtttgcttgaaagtttcagaagccagtgctgtgtagttgggataaatttaattgtttttagccttctattttacttaaaaaaacaagatgcaagcaattcttttgtatataaatgtacagaatggtttcatattatattgatttcctaattcattttcaa

SEQ ID NO: 7724 - DNA, 1306 bp, Lotus japonicus
cttttaaggggtggaagagattctacaagggtaggagaagtctcatcattcatcaacgactgcacagtaacacagaaagagagagttgagtgtggcgatcttgaagaagagatgagcgaagcgcaaaagtatgtgtgggaaggagccatccctctccagattcacctccatgaatctgaagtcaccactctccctcctcctccacccgctctcgtcttagcccctcggatagggtacttgccattgttgatttctctgttgaagcctcacttcagcagtacacttccccctggacaagacaccatttggtttgagtacaaagggcttcctctcaagtggtacataccaactggtgttcttttcgatcttttatgtgtggagccagaaaggccatggaatctaacagttcactttagaggatatccaagtaacttgttgcttccatgtgaaggtgaagacagtgttaagtggagctttattaactcactgaaagaggctgcctatgtaataaatggtaattgcaagaatgtcatgaatatgtctcaacctgatcaggttgagctctggggctctgttttaaatggtaacttggaatcttatcgacgggtgtcatctaagcttaagcttggaacttttgaagataaacatacagaaaacatcaattcagtcttgcctaagtctgaaagtactggggatactgatgctgctggacaagtgaagagtggtcggatacctgttcgtttatacgtatggactgtcaatgagagtttgatgattttgagatgctcctcagttgatgattgggacaaagtctcgtataccaatcgacctgttgagattcacaatgaagatggtaaattctttagcttaaatgatgcggttagaagactattgcctgagttttttcagggaagttcctttgataatgaaggagacacaaacatcaaccgaactacagaagagggagaaaattcaggtgatcccgggtcatctttcgacgcacatgagattgcagaaatcaagcttgttcgcattcaagggatagaaccaattttggagatacctttttcttgggtggttaacaacttaatgaaccctgagtattttcttcacatgtgtgtttgcttgaaaatttcagaagctagtgctgtgcaatagggataaatttgattatgttggccgtaaattccaagatgcaattcttttgtatataaatgtacagaacggtttcacttgtattcatttcatgattcgttttcgactttacctgcaaagtcaagaatgtatttcttcttttagaatctta

SEQ ID NO: 7725 - DNA, 1334 bp, Medicago truncatula
agagagagagagagagagagagagatctggaagagatgaatgaaggacaagaatacgtatggatgggttcaattcctcttcaaattcatcttcatgaatctgaagtcaccactcttcctcctcctccacccgctctcgttttggctcctaggatggggtacttgcctttgttgatttctctattgaagcctcatttctgtaccacacttcctcctggagtagataccatttggtttgagtacaaaggattgcctctcaagtggtatataccaactggagttctttttgatcttttgtgtatggaaccagaaaggccgtggaatttaacagtacactttagaggatacccaagtaatttattgcttccatgtgacggtgaagacagtgtgaagtggagctttatcaactcactgaaagaggctgcatatgtaataaatggaaattgcaagaatgtcatgaacatgtctcaaactgatcaggtggagctctggggctctgttttaaatggtaatctggaatcttatagacgggtgtcatctaagcttaagcttgaaactattgaagatttcgtcccaaaaaaagaaactatagaagatgaacatacagaaaatattgattcagtctcaaataaatctgaacaaagtaccggggatgctgaagctgctggacaagtgaagacaagtaggattcctgttcgtttatatttgtggactgtcaacaacgattttgatgattttgaagatgctccaaacattgataactgggacaaagtctcgtatatcaatcgacccgttgagatttacaaagaagatgataagtactttagcttaaacgatgcagtgaaaagacttctgcccgagtactttccagaaagttcctttgttaatgaagaagatgcaaacataaatcaaagcacagaagagggagaaaattcatctgatccagcgtcatcttcccacccgcttgagattgcagaaatcaagtgcgtacgcattcaagggatctctgacctgcctttggaaatacctttttcttgggtggttcacaacttaatgaatcctgaatatttccttcacatgtgtgtttgcttgaaagtttcagaagccaatcctgtgcagtagggataacttctactattttagccttctctttttttttttttttcactgaaaaaacataatgcaattcttttgtatataatagatgtacagaatggtttcatattatattgattgatttcctaattcgttttctattttacactacaaagtgtaatatatattaactggtgatatattttctaaattcccaatcaagggaactgtttttcccct

SEQ ID NO: 7726 - DNA, 1332 bp, Medicago truncatula
aagaagggttgcagtagagttgaagttgatcaagaactgcggagagagagagagagagagagagagagatctggaagagatgaatgaaggacaagaatacgtatggatgggttcaattcctcttcaaattcatcttcatgaatctgaagtcaccactcttcctcctcctccacccgctctcgttttggctcctaggatggggtacttgcctttgttgatttctctattgaagcctcatttctgtaccacacttcctcctggagtagataccatttggtttgagtacaaaggattgcctctcaagtggtatataccaactggagttctttttgatcttttgtgtatggaaccagaaaggccgtggaatttaacagtacactttagaggatacccaagtaatttattgcttccatgtgacggtgaagacagtgtgaagtggagctttatcaactcactgaaagaggctgcatatgtaataaatggaaattgcaagaatgtcatgaacatgtctcaaactgatcaggtggagctctggggctctgttttaaatggtaatctggaatcttatagacgggtgtcatctaagcttaagcttgaaactattgaagatttcgtcccaaaaaaagaaactatagaagatgaacatacagaaaatattgattcagtctcaaataaatctgaacaaagtaccggggatgctgaagctgctggacaagtgaagacaagtaggattcctgttcgtttatatttgtggactgtcaacaacgattttgatgattttgaagatgctccaaacattgataactgggacaaagtctcgtatatcaatcgacccgttgagatttacaaagaagatgataagtactttagcttaaacgatgcagtgaaaagacttctgcccgagtactttccagaaagttcctttgttaatgaagaagatgcaaacataaatcaaagcacagaagagggagaaaattcatctgatccagcgtcatcttcccacccgcttgagattgcagaaatcaagtgcgtacgcattcaagggatctctgacctgcctttggaaatacctttttcttgggtggttcacaacttaatgaatcctgaatatttccttcacatgtgtgtttgcttgaaagtttcagaagccaatcctgtgcagtagggataacttctactattttagccttctctttttttttttttttcactgaaaaaacataatgcaattcttttgtatataatagatgtacagaatggtttcatattatattgattgatttcctaattcgttttctattttacactacaaagtgtaatatatattaactg

SEQ ID NO: 7727 - DNA, 1618 bp, Lupinus angustifolius
agaagagaagaagaagcataagcgattttgtgaagcaagggttgtatagagagcaaaaagatcttaaagtgaaagagaaagagatgagtgaagcgcagaaattggtgtgggaaggttccattcctcttcagattcatctccatcaatctgaaatcaccacacttcctcctcctccacccgctttggtattagcccctcggatagggtacttacccttgttgatttctctcataaagcctcacttcagcactacactcccccctggtatagataccatttggtttgagtacaaaggactgcctctcaaatggtatataccaactggagttctctttgatctcttatgcatggagcctgaaaggccatggaatttaacagtacactttagaggatatccaagcaatttattgcttccttgtgaaggtgtagatagcgtaaagtggagttttattaactcactgaaagaggctgcatatgtaataaatggaaattgcaagaatatcatgaacatgtctcaacctgatcaagcggagctctggcactctgtctttagcggtaatttggaatcttatcgccgggtttcatctaagctcaagcttggaacttttgaagatgaatatgcggaaaatatcaatccagtctcgactaaatctcaacaaagtactgaggagacagaggtcgctggacaattgaagactggtagaattcctgttcgtttatatgtgtggactgttagcgaggactttgatgatttagaagatgcacctcaaattgataattgggacaaagtctcttatatcaacagacccgttgaggttcataaggacgatggtaaatatttcagcttaaatgacgcggttaggagtcttcttcctgagttttttccaggaagttccttagttaatgaagaagatgcaagcatcaaccaaagtactggagaagaggaagagaatacatgtgatcccatgtcatctttccagccacttgagaatgccgaaatcaagcttgtacgcattcaagggatagaaccaaagttggagatacctttttcttgggtggttaacaacttaatgaatcctgagtattttctgcatatctgtgtctgcttgaaactttcaggagccaaagctttgcaataggtatagtttaaacattttctgaatgtttttattgtgaaacacaagatgcagttttaggagcatgtctttgtcccaaaatgtatatcactctacgtaccttttcattctcattggtcagaaatatatttaattcatgtttcacttttatgaaagatgagaaatgagtgatacacactttgagacatcacatatagcccctgcaattcttttgtaaatacacgcacagaatggtcacattaatatccatttcattatttgtttgttatgtgagtatgcaagccaagcatgaccttttagatgttaagaatctctggcataagatgatgtgttatctatcaattatactgaaccttatgggtagtggcatgtaatttcttatgtcagtaatgtgtaaaaataatgtatgtatcactaccagtcttacattgattcaaatctcatgtccaagattgaatgcatttacttattcatttaatcta

SEQ ID NO: 7728 - DNA, 1045 bp, Glycine max
ctttgctattaatttagaacaattttatttttagaaaggcttgaagttgaagggaaggtgataagggagcagcagagagagtaatactgggtggacagaacagaacagttatctgaatggatcttcgtgtgcagcaccctgttgatgtttcccttccctgcttctctcattctcagaatgtgaagttgcaattgcaaagaaggagattatccaccgtttcttttgcactggctgagactgcagcttcaatggcagtagctgtaactgttgttggtgcagcagctactcttcttgtaaagagatccaaaacttctgagtcaacacagattcaattcaaagtatgtgaagattgtggaggttctggtatatgttctgaatgcaaaggtgaaggattcgttcttaggaaacgttctgatgaaagtgctgagaaggcaagagtgcaagctaagaatatggccacccgattcacggcagggcttccaaagaagtggagctattgcacaaagtgctcttctggtcgatcctgttcaacctgtggtggcagtggaaagctaagttactagtttagcattacgtgttgtctacccagttcaaaagacagttagttcctcagcatttcacatgctcttgtttaaatcccggttcagaatgaggcaacataatgaactcaagctgatgagtggttcacattcacttgttttccttaatttattctgcataaagcaaaattgtatatgtatgtaattcaatggcagtgtatagtatgcatttgttgcatttgcagcactagacagatgttgagtttaaatcgacccagtagggtcttgatagaataggatttgagtttactgtcaatacacaaaaagtattggaatttgcactaacttgcacactccatatgctccccatgcaaattgttggataacaccctgatcacatgttaattgctaacttcttttaaacattcaggttatgtccgtaccttggttttgctagtatcttttccttatatgaagaatggtgattgaagttgagtttcctttta

SEQ ID NO: 7729 - DNA, 1003 bp, Glycine max
agaaaggcttgaagttgaagggaaggtgataagggagcagcagagagagtaatactgggtggacagaacagaacagttatctgaatggatcttcgtgtgcagcaccctgttgatgtttcccttccctgcttctctcattctcagaatgtgaagttgcaattgcaaagaaggagattatccaccgtttcttttgcactggctgagactgcagcttcaatggcagtagctgtaactgttgttggtgcagcagctactcttcttgtaaagagatccaaaacttctgagtcaacacagattcaattcaaagtatgtgaagattgtggaggttctggtatatgttctgaatgcaaaggtgaaggattcgttcttaggaaacgttctgatgaaagtgctgagaaggcaagagtgcaagctaagaatatggccacccgattcacggcagggcttccaaagaagtggagctattgcacaaagtgctcttctggtcgatcctgttcaacctgtggtggcagtggaaagctaagttactagtttagcattacgtgttgtctacccagttcaaaagacagttagttcctcagcatttcacatgctcttgtttaaatcccggttcagaatgaggcaacataatgaactcaagctgatgagtggttcacattcacttgttttccttaatttattctgcataaagcaaaattgtatatgtatgtaattcaatggcagtgtatagtatgcatttgttgcatttgcagcactagacagatgttgagtttaaatcgacccagtagggtcttgatagaataggatttgagtttactgtcaatacacaaaaagtattggaatttgcactaacttgcacactccatatgctccccatgcaaattgttggataacaccctgatcacatgttaattgctaacttcttttaaacattcaggttatgtccgtaccttggttttgctagtatcttttccttatatgaagaatggtgattgaagttgag

SEQ ID NO: 7730 - DNA, 538 bp, Cajanus cajan
aagaggacagttatctaaatggatcttgctgtaactgtatcacttccctgcttctctcagactcacactaatgtgaagttacaattgcaaagaaggagaatatccacagtttcctctgcactggctgagactgcagcttcaatggcagttgctgtaactgttgttggagcagcagctactcttcttgtaaagagatccaaaacgtctgagtcaacacagattcaattcaaagcctgtgaagattgtggaggttctggtatatgttctgaatgcaaaggtgaaggatttgttcttaggaaacgttctgatgaaagtgctgagaaggcaagagttcaagctaagaatatggcaactcgattcacggccggggcttccaaagaagtggagctattgtacaaagtgctcttctggtcgatcctgttcaacctgtggtggcactgggaagttaagttactagtttagcactacatgttgtctacacagttcaaagaaagttcatcagcattacacatgctcttgttgaaatcactgtttagaa

SEQ ID NO: 7731 - DNA, 902 bp, Cajanus cajan
gaaatagagtggacagaagaggacagttatctaaatggatcttgctgtaactgtatcacttccctgcttctctcagactcacactaatgtgaagttacaattgcaaagaaggagaatatccacagtttcctctgcactggctgagactgcagcttcaatggcagttgctgtaactgttgttggagcagcagctactcttcttgtaaagagatccaaaacgtctgagtcaacacagattcaattcaaagcctgtgaagattgtggaggttctggtatatgttctgaatgcaaaggtgaaggatttgttcttaggaaacgttctgatgaaagtgctgagaaggcaagagttcaagctaagaatatggcaactcgattcacggccgggcttccaaagaagtggagctattgtacaaagtgctcttctggtcgatcctgttcaacctgtggtggcactgggaagttaagttactagtttagcactacatgttgtctacacagttcaaagaaagttcatcagcattacacatgctcttgttgaaatcactgtttagaatgaggcaacataatgaactcaagctgatgagtgatttacatcacttgttttccttgacctactctgcatgaagcaaatattttgtgtatatgaatttcaatggctgagtatagcatacttttgtagcatttccggaactaaaaaggtgttgagtttaaacggatcatgtaggttctagatacaataggatttgaattttatttacggtcaacaatatttgtgaaaagagtattgctatttgcataacaccctgatcccatataacttttttaagaattcagattatgcagtaccatgttttttgcaagtatcttttccttataaaaatattgaagatgagttctcattt

SEQ ID NO: 7732 - DNA, 987 bp, Phaseolus vulgaris
gttaaaacctaacacaaaagttttggtatacaataatgttaaaacatttatttttggaaattgtgggagtgaagatgataagtgagctgcagagaaagtagtagtgggtggacagaaacaagcacagttatctgaatggctacctctgtatcacttccctgcttctctcacactcactctcataatgtgaagttacaactgcaaagaaggagaatatccaccgtttcctctgcactggctgagactgcagcttcagtggcagtagctgtaactgtcgtaggtgcagcagctactcttcttgtaaagagatccaaaacttctgagtcagtacagattcaattcaaagcatgtgaagattgtgaaggttctggtatatgctctgaatgcaacggtgaaggattcgttcttaggaaacgttctggtgaaagttctgagaaggcaagagtggaagccaagaatatggcaactcgattcacatctaggcttccaaagaagtggagctattgtacgaaatgctcttctgctcgatcctgttcaacctgtggtggcagtggaaagctaagtttgtagtttagaactacatgctctcaaccatgctaaaaaaaaagcctcctcagtactacagtctacacacatgctcttgttgaagtcatggttcagaaggaggcaacataatgaactcaacgcttattagagattcacatccacttgatttccgtgatctattctgcatgaagcaaaattttatgtatatgttttttaatggaagtgtatagtgtgcttttgctgcatttagagaggtgttagatttaaaatgtggggtcttgatagaataggatttgagttgaactaacatgcacactctgtatactcctcttgcaaattgatggatggccattcagattatgcacataggttggtttttgcaactaaatgtcttttccttaatgaagaatggttatagaagtttagtttccttttgtctta

SEQ ID NO: 7733 - DNA, 971 bp, Phaseolus vulgaris
aaaagttttggtatacaataatgttaaaacatttatttttggaaattgtgggagtgaagatgataagtgagctgcagagaaagtagtagtgggtggacagaaacaacacagttatctgaatggctacctctgtatcacttccctgcttctctcacactcactctcataatgtgaagttacaactgcaaagaaggagaatatccaccgtttcctctgcactggctgagactgcagcttcagtggcagtagctgtaactgtcgtaggtgcagcagctactcttcttgtaaagagatccaaaacttctgagtcagtacagattcaattcaaagcatgtgaagattgtgaaggttctggtatatgctctgaatgcaacggtgaaggattcgttcttaggaaacgttctggtgaaagttctgagaaggcaagagtggaagccaagaatatggcaactcgattcacatctaggcttccaaagaagtggagctattgtacgaaatgctcttctgctcgatcctgttcaacctgtggtggcagtggaaagctaagtttgtagtttagaactacatgctctcaaccttgctaaaaaaaaagcctcctcagtactacagtctacacacatgctcttgttgaagtcatggttcagaaggaggcaacataatgaactcaacgcttattagagattcacatccacttgatttccgtgatctattctgcatgaagcaaaattttatgtatatgttttttaatggaagtgtatagtgtgcttttgctgcatttagagaggtgttagatttaaaatgtggggtcttgatagaataggatttgagttgaactaacatgcacactctgtatactcctcttgcaaattgatggatggccattcagattatgcacataggttggtttttgcaactaaatgtcttttccctgatgaagaatggttatagaagtttagtttccttttgtctta

SEQ ID NO: 7734 - DNA, 870 bp, Vigna unguiculata
gggagaacagaacagaacagttatctgaatggctacctctgtatcatttccctgcttctctcagactcactctcataatgttaagttacaactgcaaagaaggagaatatccaccgtttcctgtgcactggctgagactgcagcttcaatggcagtagctgtaactttcgttggtgcagcagctactcttattgtaaagagatccaaaacttctgagtcagcacagtcaaagattcaattcaaagcatgtgaagactgtggaggttctggtatatgttctgaatgcaatggtgaaggattcgttcttaggaaacgttctggtgaaaattctgagcaggcaagagtgcaacccaagaatatggctactcgattcacatctgggcttccaaagaagtggagctattgtacaaaatgctcttctggtcgatcgtgttcaacctgtggtggcagtggaaagctaagttactagtttagaactacatgttgtcaacctagctcatcagtactacagactacacacacgctcttgttgaagtcacggttcagaatgaggcaacataatgaactcaacgattattagtgattcacatccacttgatttccttgatccattctgcatgaagcaaagttctatgtatatgtatttcactggaagtgtatagtgtgtttttgctgcatttagagaggtgttgggtttacatatttggggtcttgatagaataggatttgagttgaattaacatccacattttatatactcctctcgcaaattgatggatggccgttcagattatatgcatacgtgggtttttgcaactatatgtcttttccttcatgaagaatggttatagaaattgagtttcctttgac

SEQ ID NO: 7735 - DNA, 2598 bp, Glycine max
gcgcgtggcacttccttctgttaattacgtttccattcgttggacgctttcgtttttttggtctcatgcttgtctttcaccgccgttgctgtttgccactcttttttccttttattcttctcttcactcactcttcattttttactattattcacaaacacaacactttctcctccttctaattccatcgtcactaagttacttattaagtttggtagcatagctctgcctctgatttagatccgcataaagttgttacttacatgtgcctttcgtctcttatatcttaatcattgctctctattgccttagcctatgcttattcttttcaccttctaagttctaaatattcattgcccagaaccaaatcactttctttttttccttctctgtccccaaagttcgttgctttacattacagggtgtccaaccaaagctatcctcaaatctcaatgctttctaccaacaatagcacaacaagtgcaatgattctggagggttgcaggaggatataaagtttctgatattttcagactttatttatttattttttatattgatttggatgatcctctcctctgagttgctgcttcaaggagagagataattatttgggatgaaagatgctagtgttgatctgggtttttgctggaaggaagaaaagaaggttctgaattctgatatatagtagcaattaagagtcaaaagtgagagattcattaggttggtgttaaatccaattccaatggacacaccaaatgcacagccacaagctgcatcagcaagcacgccaaggacgccaaggaaaaaaatgactaagcaattgacaggtaaaagggatgatacacctttgcactctgcagcaagagcagggaatatgagtgttctgaaagacacggttagtggtagtgaagagggtgaattgcgtgtgttgttgacaaagcagaaccatagcggagaaacgattctttttgttgctgctgaatatggttatgttgaaatggttagggagctgattcaatattatgatcctgctggtgctggaattaaggccagtaatggttttgatgcacttcacattgctgccaagcaaggggatttagatattgtgaagatcctgatggaggctcatcctgaattgtcaatgactgtggatccatccaacaccacagcagtgcacactgctgcattacaagggcatactgagatagtaaagcttctattggaagcaggtagtaatctggcaaccattgctagaagtaatgggaaaacagctttgcattctgctgcgagaaatggacatttggaggttgtgaaagcgctattggggaaggagcctgtggttgcaacgcggacagataagaagggacagacagcacttcacatggcagtgaagggacagagtcttgaggtggtggaggagttgataaaagctgatccctcaacaataaacatggttgataataagggtaacacagcattgcatatagcaaccaggaagggcagggctcagattattaagttgcttcttgggcagacagaaaccaatggcttggtagttaataaatctggcgaaactgcactagacacagctgagaaaactgggaattctgaaattaaagacattctccttgaacacggtgttcgaagcgccaaagccataaaggctcaaccaggaacagctacagcccgagagttgaaacaaactgtgagtgacataaagcatgaagtccactaccagttggaacacacacgccaaactcgaagaggtgttcaaggcatagccaagcgcatcaacaaaatgcatgctgaaggactcaacaatgcaataaactccacaactgtggttgcagtcctcattgccacagttgcctttgcagccatcttcacagtccctggccaatttgctgatgatccaaaagtcctccctgcaggaatgaccattggtgaagcaaacatagcaccgcaagctgcatttctcattttcttcgtctttgattccatcgcgctcttcatttctctggccgtcgtggtggtgcaaacctcagtcgtgatcatagaaagcaaagcaaagaagcagatgatggccatcattaacaaactaatgtggttggcttgtgtgcttatctctgtggccttcttggcactgtcatttgtagtggtggggaaggaccagaagtggcttgcaattggagtcacaatcatagggacaactataatggccacaactttgggcaccatgagttactgggtcattaggcatcgcattgaggcctcaaacttaaggagcattcggaaatcttcaatggaaagcaggtcaaggtctttttcagtgtctgttatgtcagattctgagctactaaacaatgagcgtaagatattgtatgcgatatagaatcactaataaagccttgttgccctttcatactaaagtgagtataatcatacttcccccatgtttaatagtatgcttaatactctattttcagtctaatcaaagattttgagtccgaattttgagtatacattacacagctacattaaaatatttggaggaaaatttttattacctaacatgatcctatccaatttgaataa

SEQ ID NO: 7736 - DNA, 2364 bp, Phaseolus vulgaris
ttttttttttccatcaaacagtttcgttttttattcccatcatttcattcatatcattcgcaacgctttctcctccttccatcgtcactactatgttatgttggaagctatctttgcctctgatttagattcgcgtaaagttgttgcttacatgtgacttttgtcacttattgccatcaccttctaaatattcatcgccttcaacccaatcactttctccttttttttttgtttttccgtctccaaagttcgtttctttgcattacagggtgtccaaccaaagctaccctctaatctcaatgctttctttgaagcccaacacaagtgcagtgattctggaggcttccaggaggatggagtagaaagtttctgatgttttgattttgtttttgggtattgatttggatgatactctcctttgagttgcttcaaggagagagaattgtttgggatgaaagatgctggtgttgatctgggtttttgctggaaggaagaaaagaaggttctgaattcttatatatagtagttggagtcaaaactgagagattgattagggtggtgtgtgaatccaaatccaatggagtcaccaactgtgcagccgcaagctgcatcggcaagcacgccaaggaaaaaaatgacaaaacaattgacaggtaaaagggatgatacctctttgcattctgcagcaagagcagggaatctgagcgttctgaaggacacagttagtggcactgaagggggtgaactgcgtgcgttgttgacaaagcagaaccatgctggagaaacggtgctttatgttgctgctgaatatggttatgttgatatggttagggagatgattcaatattatgatcttgctggtgctggaattaaggcaaggaatggttttgatgcactccacattgctgccaaacaaggcgatttagatattgtgaagatccttatggagactcattctgaattgtcaatgacagtggatctatccaacaccacagccctgcacactgctgcattacaagggcacactgagatagtgaaatttttattggaagcaggtagtagtctggcaaccattgctagaagtaatgggaaaacggctttgcattctgcagcaagaaatggacatgtagaggttgtgaaagcacttctggagaaggagcctgctgtcgcaacgcggactgataagaagggacaaacagcacttcacatggctgtgaagggacagaatcttgcggtggtggaggagttgataaaagctgatccctcgacaataaacatggttgataacaagggtaacacgccattgcatataacaacccggaagagcagggctcagattgttaagttgcttcttggacagacagaaacagattccttggcagtcaatagggctggcgaaactgcactagacactgctgaaaaaactgggaactctgaagttaaagatattctgctggaacacggtgttcgaagcgccaaagccttaaaggctcagccaacaacagcccgtgagttgaaacaaactgtgagtgacataaaacatgaagttcactaccagttggaacacacccgccaaactagacgaggtgttcaaggcatagccaaacgtatcaacaaaatgcatgctgaaggactcaacaatgcaataaactccaccactgtggttgcagtccttattgccacagttgcctttgcagctattttcacagtccctggccaatttgctgatgatccaaaagacattcctccaggttcagggatgaccattggtgaagcaaacatagccccacaagctgcatttctcattttctttgttttcgattccattgccctcttcatttctctggctgtggtggtggtgcaaacctcggttgtgatcatagaaagcaaggcaaagaagcagatgatggccatcattaacaagctgatgtggttggcttgtgtgcttatttctgtggccttcttggcactgacatttgtagtggtggggaaggatcagaagtggctagcaattggagtcactatcatagggacaactataatggccacaactttgggcaccatgtgttactgggttattaggcatcgcattgaggcctcaaatttaagaagcattcggaaatcctcaatgggaagcaggtcaaggtctttttcagtatcagttatgtcagattctgagctactaaacaatgaccgcaagatactttatgccatatagaatcactaataaagctttggttgcactttcattcactctcttcatggatttatatccaactacactcagtatcatcacacttccttgatgttttccccacctcttgttgcatcagaaatcactaaaaatttcactttacttctaga

SEQ ID NO: 7737 - DNA, 2296 bp, Phaseolus vulgaris
ctccttccatcgtcactactatgttatgttggaagctatctttgcctctgatttagattcgcgtaaagttgttgcttacatgtgacttttgtcacttattgccatcaccttctaaatattcatcgccttcaacccaatcactttctccttttttttttgtttttccgtctccaaagttcgtttctttgcattacagggtgtccaaccaaagctaccctctaatctcaatgctttctttgaagcccaacacaagtgcagtgattctggaggcttccaggaggatggagtagaaagtttctgatgttttgattttgtttttgggtattgatttggatgatactctcctttgagttgcttcaaggagagagaattgtttgggatgaaagatgctggtgttgatctgggtttttgctggaaggaagaaaagaaggttctgaattcttatatatagtagttggagtcaaaactgagagattgattagggtggtgtgtgaatccaaatccaatggagtcaccaactgtgcagccgcaagctgcatcggcaagcacgccaaggaaaaaaatgacaaaacaattgacaggtaaaagggatgatacctctttgcattctgcagcaagagcagggaatctgagcgttctgaaggacacagttagtggcactgaagggggtgaactgcgtgcgttgttgacaaagcagaaccatgctggagaaacggtgctttatgttgctgctgaatatggttatgttgatatggttagggagatgattcaatattatgatcttgctggtgctggaattaaggcaaggaatggttttgatgcactccacattgctgccaaacaaggcgatttagatattgtgaagatccttatggagactcattctgaattgtcaatgacagtggatctatccaacaccacagccctgcacactgctgcattacaagggcacactgagatagtgaaatttttattggaagcaggtagtagtctggcaaccattgctagaagtaatgggaaaacggctttgcattctgcagcaagaaatggacatgtagaggttgtgaaagcacttctggagaaggagcctgctgtcgcaacgcggactgataagaagggacaaacagcacttcacatggctgtgaagggacagaatcttgcggtggtggaggagttgataaaagctgatccctcgacaataaacatggttgataacaagggtaacacgccattgcatataacaaccaggaagagcagggctcagattgttaagttgcttcttggacagacagaaacagattccttggcagtcaatagggctggcgaaactgcactagacactgctgaaaaaactgggaactctgaagttaaagatattctgctggaacacggtgttcgaagcgccaaagccttaaaggctcagccaacaacagcccgtgagttgaaacaaactgtgagtgacataaaacatgaagttcactaccagttggaacacacccgccaaactagacgaggtgttcaaggcatagccaaacgtatcaacaaaatgcatgctgaaggactcaacaatgcaataaactccaccactgtggttgcagtccttattgccacagttgcctttgcagctattttcacagtccctggccaatttgctgatgatccaaaagacattcctccaggttcagggatgaccattggtgaagcaaacatagccccacaagctgcatttctcattttctttgttttcgattccattgccctcttcatttctctggctgtggtggtggtgcaaacctcggttgtgatcatagaaagcaaggcaaagaagcagatgatggccatcattaacaagctgatgtggttggcttgtgtgcttatttctgtggccttcttggcactgacatttgtagtggtggggaaggatcagaagtggctagcaattggagtcactatcatagggacaactataatggccacaactttgggcaccatgtgttactgggttattaggcatcgcattgaggcctcaaatttaagaagcattcggaaatcctcaatgggaagcaggtcaaggtctttttcagtatcagttatgtcagattctgagctactaaacaatgaccgcaagatactttatgccatatagaatcactaataaagctttggttgcactttcattcactctcttctttcctgggcctcatggatttatatccaacttcactcagtatcatcacacttccttgatgttttccccacctcttgttgcatcagaaatcactaaaaatttcacttt

SEQ ID NO: 7738 - DNA, 2169 bp, Cajanus cajan
cttcttcttcttctatctcccaaacccaaagttggttggtttacattacagggtgtccaaccaaagctaccctcaaatcttaatgctttctactaaggacaacacatcaaggagggagaattatttgggatgaaagatgctagagttgatctgggtttttgctggaaggaagaaaagaaggttctgaattctgatattcagtgattagagtcaaaagtgagagagattcattaggttggtaagtgaatccaattccgatggagactcagacaccaaatgtgcagccacaagctgcgtcaacaagcacgccaaggaaaaagatgaccaaacagttgacaggtaaaaaggatgatacacctttgcactctgcagcaagagcagggaatctgagtgttctgaaggacacagttagtggtgctgaagagggtgaattgcgtgcgttgttgacaaagcagaaccatgctggggaaacagttctttatgttgctgctgaatatggctatgtcgatatggttagggagatgattcagtattatgatcttgctgatgctggaattaaagcaaggaatggttttgatgcactccacattgctgccaaacaaggggattttgatattgtgaatatcctaatgggggctcatcctgaattgtcaatgactgtggatccatccaacaccacagctctgcacactgctgcaacacaagggcatactgagatagtgaagcttctaatggaagcaggtagtagtcttgtaaccattgctagaagtaatgggaaaacagctttgcattctgctgggagaaatggacatttggaggttgtggaagcgcttctggagaaggagccttctgttgcaacgcggactgataagaagggacagacagcacttcacatggcagtgaagggacagaacctggaggtggtggagaagttgataaaagctgacccctcaacaataaacatggttgataataagggtaacacggcattgcatatagcaaccaggaagggcagggctcagattgttaagttgcttcttggacaagcagaaacagatgcattggcaatcaatagatctggtgaaactgcattagacacagctgagaaaaccgggaactctgaagtcaaagacgttctactcgaacacggtgttcgaagcgcgaaagccataaagggtcagccagcaactggtacagcccgagagttgaaacaaaccgtgagtgacataaaacatgaagtccactaccagttggagcacacacgccaaactagaagaggtgtccagggcatagccaaacgcatcaacaaaatgcacgctgaaggactcaacaatgcaatcaactccacaactgtggttgcagtcctcattgccacagttgcctttgcagctattttcactgtccctggccaatttgctgatgatccaaaaactctccctccaaggatgacccttggtgaagcaaacatagccccacaacctgcatttctcattttctttgtcttcgattccatcgccctcttcatctctttggctgtggtggtggtgcaaacctcggttgtgatcatagaaagcaaggcaaagaaacaaatgatggccatcattaacaagcttatgtggttggcttgtgttcttatttctgtggccttcttggcactgtcatttgtagtggtggggaaggaccagaagtggcttgcaattggagtcacaatcatagggacaactataatggccattactttgggcaccatgtgttactgggtcattagacatcgcattgaggcctcgaatttaaggagcattcggaaatcttcaatgggaagcaggtcaaggtctttttcagtgtcagttatgtctgattctgagctactaaacaacgagcacaagatactctacgcgatttagaatcactaataaaaccttgttggcctttttcatgtacacttttttccacggcctaatggatttatatccaactcaagtgagaatcatcacacttgcctcatgcttaataatatgcttaatggtctctttcccctcctcttattgcaacagaaatgatttttcacacaagatataacatgattagtagataatcttattccttaaatacatgattagagatttgattattaatattagtgtgtacgaaaaaatatttgtttaggga

SEQ ID NO: 7739 - DNA, 2474 bp, Lupinus angustifolius
atggtccaatggttgtccttcaatggccaccactattgggtgtttggccaagctccttcaaatttattctttaatctcaatcattaatcatattcatggtggaagaagaagtagaacacaataaggaagaggaataataagtttcaacaaggcatgagagataagaacctgtctttaagatattgatttgttttgtgatgatttgaattatctctcctttgagttgcttcaaggagatgataattattattcgggatgaaagatggttgtgttgatttgggtttttgctggaaggaagaaaagaaggttgttatataacttattagagtgaagaacagtagagaggggattcattaagtttgtgaatctgatggcgccgccacaagccgtgtcagggaacacccctaggaaaaaaatgaccaaacaattgacaggaaagagggatgatacacctttacactcctcagccagagcaggaaatttggatgtaattaaggatacactttctggtgccgatgagggtgaagtgcgtaaattattggcaaagcagaatcaagctggagaaacagcactttatgttgccgctgaatacggtcatgttgatatggttagggagttgattcaatattatgatcttgctgatgctggaattaaagcaaggaatggttttgatgcactccatattgctgctaaacaaggacatttcgatgtactgaagatccttatgaatgctcatcctgagttgtcaatgaccgtggatccatcaaacaccacggctttgcacacggctgcaacacaagggcatattgagatagtcaaatttctattagaagcaggaagtagccttgcaaccattgctagaagtaatgggaaaactgctttacattctgctgcgagaaatggacatctggaggttgtgaaagcaattctcgagaaggagcctggggttgcgacgaggacggataagaagggtcagacagcgcttcacatggcagtgaagggacagagtcttgaggtggtggaggagttgataaaagctgatccctcaacaataaacatggttgataataagggtaacacctcattgcatatagcaaccaggaagggcagatctcagattgttaaattgcttcttggacagaaggaaacagatgcaaaggtggttaatagatcgggtgaaactgcattagacactgctgaaaaaagtgggagctctgatgctaaagcaattttgttggaacacggtgttcaaagtgcaaaatctataaaacctcagccaacaacggctacagcccgtgaattgaaacaaactgtcagtgacataaagcatgaagtccattaccagttggaacacactcgccaaactagaaaacgtgttcaaggaatcgccaaacgtctcaacaaaatgcatgctgaaggacttaacaatgcaatcaactccactactgtagttgcggtcctcattgccactgttgcatttgctgctattttcacagttcctggccaatttgttgatgaccctaaagatatccctccggggatgacccttggtgaagcaaatatagctccaaaagctccatttcttattttctttgtatttgattccattgccctcttcatttctctggcggtcgtggtggtgcaaacttcagttgtggttatagaaagcaaagcaaagaagcaaatgatggctattattaacaagctgatgtggttggcttgtgtactaatttcagtggccttcttggcattgtcatttattgtggttggtaaggatgagaagtggttagcaattgcagtaaccattataggcacaactataatggctacaacattaggcatcatgtgttattgggtcattaggcaccgcattgaggcctcgaacctgaggagcattcggaaatcttccatgggaagcagatcaaggtctttttcagtgtcggcgcctatgtcagattctgagataccaaacaatgaatttaagaaaatgtatgcaatttagaagtatatagacttgttctctttttcacttgcactcttttttccaggacctggtggatctatatccaactagagtgaagcttctcattgtatattacatgactaggcctactgttaataatatgcttagtcaatgaatagtctcattgccaaaaaatatgtactctccttacttccactctataaaagaaatagtcattgtatgtggagacatttaaaacctttatcgcactagatgaggtcggttacatggatcgaacatcgaacaaccccataatgaccaaattgagaacttcatacccgctttgtctgaatgaccagatcaaggccacataagacatgctgaatcagtgttgtattcctgtttctcttgttctgcagattccttctctatctaatgcaagtcacaccaatacagtaattctgttttgttttattgccttttttgtcttcaacacaaacataattgtttt

SEQ ID NO: 7740 - DNA, 2471 bp, Arachis hypogaea
acgcgagtataagcagtggtatcaacgcagagtacggggggtctttgcccaccactttctctcattctctctctctaaataattttcatcatatcatatactctctcctttcatcatcaccagcttttaatttccctttgattttgatttagattcacataaagtagttgttgttgcttacatgtgtcttaattcttactaatcttattatataaacctctcataattatttattattattggttcttctttcagacattaccttttttctttcttttgcttcaaaccttgtatatataaatacaatctcttcctttcaattcccgaatgttcgttacagggtgtatgaccaacctccccaccatgccaccctctaatttcaaccatcaatcatggtgctagaacaagaacaagaacaagaagaagaaaaagaagaagcacaacgaggaagaagtatcaattaatcaacagtttctggaacatattatgagagctaagaattgatctgtggagcattttgattacttatttggttttggtgatggttgggattataatctctcctttgagttgcttcaaggagatgattcttgctatctgggatgaaagatggtagttttgatctgggtttttgctggtaggaagaaaagaaggttctgaaattctataacactagaattagttagggttcaatttagaaagggattcattaaggttgttgaattcaatggctacaccaacagtgcagcaggaagctgcggccgtggccgctgctccaaggaagaaaatgaccaagcaattgactggaaagcgcgacgacacgaccctgcactcggcagcgagagcagggaacttggctctgataaaggacacacttagtggtgctgaagagggtcaacttcatgagttgttggcaaagcagaaccaagctggggaaacagccctttatgttgctgctgagtatggttatgttgatttggttaaggagatgattcggtattatgatctcgctgatgccggaatcaaggctaggaatggttttgatgcactccacattgctgctaaacaaggggatctagatgtgttgaagatccttatggaggctcatcctgaattgtcaatgaccgtggatccctcgaacaccacggctttgcacacagcctcgacacaagggcatactgagatagtgaagtttctattagaggcaggtagtagcttggcaaccatagctagaagcaatgggaaaacagctctgcattctgcagcaagaaacggacatttggctgttgtaaaggcacttttagagaaggagcctggggttgtgacacggaccgataagaagggccagaccgcgcttcacatggcggtgaaagggcagaatcttgaggtggtggaggagttgataaaaggggatccctcatcagtaaacatgattgataataagggtaatacggctttgcatattgcaacccggaagggtagagctcagattgtgaagttgcttcttggacaaaaagaaacagacaccacagcagttaataaatccggcgaaagtgcattagacactgctgagaaaactgggaactccgaaatcaaagccatactttcggaacacggtgttcaaagtgccaaagccatgaagccaaagccaacaacagcagctagagagttgaaacaaacagtgagtgacataaagcatgaagtccattatcaattagaacacacgcgccagaccagaaagcgcgtccagggaatcgccaagcgcatcaacaagatgcatgctgaaggactcaacaatgcaatcaactcaaccactgtggttgctgtcctcattgccacagttgcctttgcagctatcttcacagttcctggccaatttgttgatgatccaaaaaacattcctaaagggatgtcccttggggaagcaaacatagcccctacggctgcattcatcattttcattgtcttcgattccattgcgctgttcatctccctagccgtcgtggtggtgcagacctcgatcgtggtcatagagagcaaagctaagaagcagatgatggctatcattaacaagctaatgtggctggcttgtgtgcttatcactgtggcattcttggcactttcattcatagttgttggaaaagatcaaaagtggcttgcaattggagtcacagttataggaacaactataatggctacaacattaggattaatgtgttactgggtcattaggcacagaattgaggcatcaaatttgagaagcataaggaagtcttcaatgggaagcaggtcaagatcattttcagtttctgttatgtcagatactgagatactaaacaatgagtataaaaaaatgtatgcgatttagaattattttatagagagctgctaagtcatgttctctttttttccatggctagttggagctatatatcaaatacaaagtgaagccttcttaatgtatatatatc

SEQ ID NO: 7741 - DNA, 2734 bp, Cicer arietinum
ctttctctttatttttaaatattctgtaaaatatcctcaaacaatatttaacactttgtgatttcatcatcatcactacctttatgttcctgttcagtgcgtttttgtatgtatacttgtgatttagattcacataaagttgttatttacatggtgtcctacaccaacatcatattagctccctaaaagctaatccttaaatctaaatgctttcttagtgggaaaggagaagacaacacacaaaaataaggtgagattcttccttctacttattttggttttcactgaatcatttgatgatgaatgcttcaacccatctgtgatattctttctttttatcttattttcttaactaagatgtagaaaatgcaataaaaattatttcttgttgaaatggtttcaacttttaattttaacccagtttttttttttctttttgttgatcagagcaatgattttggagacagacagagttatcaaaaggaaaactaatctataataatattttggaatttttattttttggtattgatttggatgattgatgattctatcctgagttgtttcaagaagatgaaaattatttggagtgaaagatgtttatgttgttgatctaagtttttgttggaaggaagaaaaataagtttctttttttgccttaaccctttaccaaatattgtttcagctagtattcaaactcgagttatgatatactaattgaagttattagaacaaaaggggttcattagtttggtgaattgtatccaatggaaacagaaacagaagctatgcagcctcaagctgcaccagcaaaacccctaaggaagaaaatgacgaaacagttgacagggaaacgcgacgatacacctttacattcagcagcaagagcaggaaacatggcttcattgaaggacacagttgctggtgctgaagagggtaaactgcatgaattgtttgcaaagcagaaccaaggtggagaaacagcactttatgttgctgctgagtatggttatgttgattttgttagggagatgattcagtattatgatctttctgatgctggaattaaagctaggaatggttttgatgcacttcatattgctgctaaacaaggggatttagatatactaaagatcctaatggaagctcatccagaattatcaatgacagtggatccatccaacaccacagccttacacacagctgcaacacaaggacacactgagatagtcaaatttctattagaagcaggtagtagcttagcaacaatagctagaagcaatggtaaaacagctttgcattctgctgcaagaaacggacatttggatgtcgtgaaagcgattctcgagaaggaacccggggttgttacaagaaccgataaaaagggacaaacagcgcttcacatggcagtgaagggacagaatctcgaggtggtagaggaattgataaaagcagatccttcatcaatcaatatggttgataataagggtaatactgcattgcatatagctaccagaaagggaagaattcagataattaagttgctactaggacagaatgaaacaaatggtatggcaataaacaaaagtggtgaaacagcattagacacagcagagaaaacaggaaacagtcaagtaaaagaaattctaatagaacatggtattcaaattggaaaatcaataaaatctcaaccaacaacaacaacagccagagagctaaaacaaacagtaagtgacataaaacatgaagtccatcaccaactagaacacactcgccaaacgcgaaaaagcgtccaaggaatagcaaaacgcctcaacaaaatgcacacagaaggactcaacaatgcaataaactcaacaatagtcgttgcagtactaattgcaacggtggcattcgccgctatattcactgtccccggtcaatttgtggacgatccaaaacacattcctgcaggaaagtcgctgggggaagccaacattgctccgaaggcagcgtttctaatcttcttcgtgtttgattcggttgcgctattcatttcgttagcagtggtggtggtgcaaacttcaattgttgtcattgaaagtaaagcaaagaagcaaatgatggctataattaacaaactaatgtggttggcttgtgtgttaatttcagtgtcgtttttggcattgtcgtttttggttgtgggaaaagatgaaaggtggcttgcaatttcggtaacaatcattgggactattataatggctactacattgggtactatgtgttactgggttattaggcatagaattgaggcttctaatttgaggagtatacgtaaatcttcattgggaagtaggtcaaggtcattttcggtatcagttatgtctgattctgagatattgaataatgaccgtaggaaaatgtatgctatttagtgccctcatatatattaatccaattattataatgagggtggcttaccaatgtatatgactactattgagtattattatatcactactcactagacttgcctaatgttattcataatatgcataaatagtctccttttaccgtccattcatatttcctaacaccctacagctagcaacaaagatagtttcaacaaattaagggtatttttgtaaattatgcaatatcataatctgattgtgtaaattgatttgtgatacattcacttataagtgatttaaacattgaacttaaggttaaaaaattggttttgaagtcaaaa

SEQ ID NO: 7742 - DNA, 1927 bp, Medicago truncatula
tgatttagattcacataacatacataaagttgttatttacatgttgtcctacaccaacatcatatattagttccctaaaagctatccttaaatctcaatgcttttttagtggaacacacaagtaagagcaatgattttggagaaagacagaattatcaaaaggagaactaatataagattctgattctgataattgaagtcacaagaacaaaaggagttcattagtttggagaattgtattcaatggacacagaagctgaaactgtgcagcctcaggctgcaccagtaagggctcaaaggaagaaaatgacgaaacaattgacggggaagcgcgacgatacgccgttacattcagcagcaagagcagggaacatggcttctttgaaggatacagttgatggtgctgaagagggtaaactgcgcgaaatatttgcaaagcagaatcaaggtggagaaacagcactttatgttgctgctgagtatggttatgttgatatggttagagagatgattcagtattatgatcttgctgatgctggaattaaagcaagaaatggttttgatgcacttcatattgctgctaaacaaggggatttagatattgtaaagatcctaatggaagctcattctgaattgtcaatgactgtggatccatccaacaccaccgccttacacacagctgcaacacaaggacatactgagatagtgaaatatctattagaagcaggtagtagcttggctacaattgctagaagtaatggtaaaacagctttgcattctgctgcaagaaatggacacttggaggttgtgaaagcgattcttgagaaggagcctggtgttgttacaaggactgataaaaagggacagacggcgcttcacatggcggtgaagggacagagtcttgtggtggtagaggagttgataaaagcagatccatcaacaataaacatggttgataataagggtaatacagcgctgcatatagcaaccaggaagggaagaactcagattatcaagttgatacttggacaaagtgaaacaaatggcatggcagtaaacaaaagtggcgaaacagcgttagacacagctgagaaaacaggaaattctgaagtaaaaagcattcttacagaacacggtgttcaaagcagcaaatcgataaaatctcaaccaaaaacagctgcaaccagagaattaaaacaaacagtcagtgacataaagcatgaagtccatcaccaactagaacacactcgccaaacgcgaagaagcgttcaaggaatcgcaaaacgtctcaacaaaatgcacacagaaggactcaacaatgcaataaactccacaacagtcgtcgcagtcctcatagcaacggttgccttcgcagccatcttcactgtcccaggccaattcgtggatgatccaaaaaaagttcgtaaaggaaaatcccttggcgaagcaaacatagcttcagaacctgcgtttctagtattcatcgtgtttgattcggttgcgcttttcatctccctcgcggttgtggtggttcaaacatcaatagttgttgttgaaagcaaagcaaagaaacaaatgatggctattattaacaaactaatgtgggtagcttgtgtgcttatatctgtgtcatttttggctttgtcatttttagttgtggggaaaaaacaaagatggcttgcaattggggtaactattattgggactaccataatggctactacattgggtactatgagttattgggttattaggcatagaattgaagcttcaagtatacgaaaatcttcaatgggaagtaggtcaaggtctttttcagtttcagttgttatgtctgattctgagatattaaacaatgagcgtactaaaatgtatgctatttagaaatttagaaattattataataaaaaaatttcacttccactct

SEQ ID NO: 7743 - DNA, 2099 bp, Medicago truncatula
aacacttgcttcttcttttgttctgttcattttctctttcattctgtaaaatacttttttgtaacactttctgatttcatcatcactaccttttgtttcctgctggtgcatgatgtatatctgagcattgaaactatgttgtataattgtacttaccatactatagttcagattctgatttagattcacataacatacataaagttgttatttacatgttgtcctacaccaacatcatatattagttccctaaaagctatccttaaatctcaatgcttttttagtggaacacacaagtaagagcaatgattttggagaaagacagaattatcaaaaggagaactaatataagattctgattctgataattgaagtcacaagaacaaaaggagttcattagtttggagaattgtattcaatggacacagaagctgaaactgtgcagcctcaggctgcaccagtaagggctcaaaggaagaaaatgacgaaacaattgacggggaagcgcgacgatacgccgttacattcagcagcaagagcagggaacatggcttctttgaaggatacagttgatggtgctgaagagggtaaactgcgcgaaatatttgcaaagcagaatcaaggtggagaaacagcactttatgttgctgctgagtatggttatgttgatatggttagagagatgattcagtattatgatcttgctgatgctggaattaaagcaagaaatggttttgatgcacttcatattgctgctaaacaaggggatttagatattgtaaagatcctaatggaagctcattctgaattgtcaatgactgtggatccatccaacaccaccgccttacacacagctgcaacacaaggacatactgagatagtgaaatatctattagaagcaggtagtagcttggctacaattgctagaagtaatggtaaaacagctttgcattctgctgcaagaaatggacacttggaggttgtgaaagcgattcttgagaaggagcctggtgttgttacaaggactgataaaaagggacagacggcgcttcacatggcggtgaagggacagagtcttgtggtggtagaggagttgataaaagcagatccatcaacaataaacatggttgataataagggtaatacagcgctgcatatagcaaccaggaagggaagaactcagattatcaagttgatacttggacaaagtgaaacaaatggcatggcagtaaacaaaagtggcgaaacagcgttagacacagctgagaaaacaggaaattctgaagtaaaaagcattcttacagaacacggtgttcaaagcagcaaatcgataaaatctcaaccaaaaacagctgcaaccagagaattaaaacaaacagtcagtgacataaagcatgaagtccatcaccaactagaacacactcgccaaacgcgaagaagcgttcaaggaatcgcaaaacgtctcaacaaaatgcacacagaaggactcaacaatgcaataaactccacaacagtcgtcgcagtcctcatagcaacggttgccttcgcagccatcttcactgtcccaggccaattcgtggatgatccaaaaaaagttcgtaaaggaaaatcccttggcgaagcaaacatagcttcagaacctgcgtttctagtattcatcgtgtttgattcggttgcgcttttcatctccctcgcggttgtggtggttcaaacatcaatagttgttgttgaaagcaaagcaaagaaacaaatgatggctattattaacaaactaatgtgggtagcttgtgtgcttatatctgtgtcatttttggctttgtcatttttagttgtggggaaaaaacaaagatggcttgcaattggggtaactattattgggactaccataatggctactacattgggtactatgagttattgggttattaggcatagaattgaagcttcaagtatacgaaaatcttcaatgggaagtaggtcaaggtctttttcagtttcagttgttatgtctgattctgagatattaaacaatgagcgtactaaaatgtatgctatttagaaatttagaaattattataataaaaaaatttcacttccac

SEQ ID NO: 7744 - DNA, 2719 bp, Lupinus angustifolius
gttattgtcactttcttatgttctccttattttctattcttaaaactcaatcatactttctcatttcattatcactaccgagtcaggttcatttatataatgaaatcctccctctgttttagatttttacataaaaaggttctttccttacatgtgcgtttcatgtcttaattcttaacccttagcatcttatattattctatactatctattactcatatcttaatgttttgttgctttttctttcaaaatatttattagctttctgatatcacttttttgcaaacctgacttataatatatatctctatttatcccgagtgttagttacagggtgcccaaccaactgctatggttccctaaaagttattctctaattcttttcccattataagatgtagaacagaacaaggtgagtttcttccttcaaactccaaccttttggttttcacataatgatttgcaatgattctggagacaagaagaggaataacaagtttctatgagagatgagaattagtctgtaagattttggttttgattttctatgtgcgacgattttgggttttgctaatcctttgagttgcttcaaggagatgatgataatcattatttgggatgaaagatggtagtgttgatttggatttttgctggaaggaagagaagaaagttgagatatactaattacagtgaaaagtaggaagggattcattaatttttgaatccgatggcgcagccacaagctgtgccggggtcagggaacatccctaggaaaaaaatgaccaaacaattgacaggaaaaaaggatgatacacctttacactctgcagcaagagcaggaaatttggatgtaattaaggacacactttctggtactgatgagggtgaagtgcgcgaattattggcaaagcagaatcaagctggagaaacagcactttatgttgctgctgaatatggtcacatagatatggttagggagttgattcaatattatgatcttgctgatgctggaattaaagcaaggaatggttttgatgcactccacatttctgctaaacaaggacatttagatgtactaaagatccttatagaggctcatcctgaattgtcaatgactgtggatccatccaacagcacggctttgcacacggctgcaacacaagggcatattgagatagtcaaatttctattaggagtgggaagtagccttgcaaccattgctagaagtaatgggaaaaccactttgcattctgctgcgagaaatggacatttggaggttgtgaaagtaattctggagaaggagcctggggttacgacacggactgataagaagggccagacagcacttcacatggcagtgaagggacagagtcttgaagtggtggaggagttgataaaagccgatccttctacaataaacatggttgataataagggtaacacagcattacatatagcaaccaggaaggccagatctcagattattaaactacttcttggacagagtgaaacagataccaaactggttaatagatcgggcgaaactgcattagacactgctgagaaaaatgggaactccaatgttaaagcaattctgctggagcatggtgttcaaagtgcaaaagccataaagcctcaggcaacaacaactacagcccgtgaattgaaacaaactgttagtgacataaagcatgaagtccattaccagttagaacacacccgccaaactagaaaacgcgttcaaggcattgccaaacgtctcaacaaaatgcatgccgaaggacttaacaatgcaatcaactccacaactgtggttgccgtcctcattgccactgttgcatttgcagctattttcacagttccgggccaatttgttgatgatcctaaagatattcctccggggatgtcccttggtgaagcaaatatagctcaaaatgctccatttctcattttctttgtatttgattccattgccctcttcatttctctggcagtcgtggtggtgcaaacttcggttgtggttatagaaagtaaagcaaagaagcagatgatggccatcattaacaagctaatgtggttggcttgtgtacttatttcagtggccttcttggcattgtcatttgttgtggtggggaaggatgagaagtggttggcaattgtagtaaccattataggcgccactataatggctacaacattaggcatcatgtgttattgggtaattaggcaccacattgaagcctcaaatttgacgagcattcagaaatcttcgatgggaagcaggtcaaggtcgttttcagtgtcagcgcctatgtcagattctgagatactaaacaacgtgtttaacataatgtatgcaatttagaagtgctgagccttgttatcttcttcactagcactcttttttccaggatctggttgatctatatccaactagagtgtatctttccattgtatatcacaagactagagctaatgttaataatatgcttagtcaattaaatgtgaaatgtgatatagttagtatttattagtgtgaaatgtgatatagttagtacttattagtgtgaaatgtgtatatagtatgctgagtgttgatgaggtagtttgagttaggtaacaggcacccttcataaaaggtggactaccactcttcaactcttatgctcttgtttggattattcgggtaatggaaaacttttacattttaccccaaaaa

SEQ ID NO: 7745 - DNA, 1824 bp, Cajanus cajan
tgaatttgattggtaggtgaagaagccaacatggcaacaccatcgctgccgccaataatcgccccaaggaagaaaatgacaaaacaattaacaggaaaaagggatgatacgcccttgcattctgcagcaagagcagggaatttggctgtgttgaaggaaaccattttgggaacgaatgaggctgcattacgtgaattattagccaagcagaaccaagatggagaaacacccctttatattgctgctgagtatggttatgttgatgtggtcagggagatgattccgtattatgatcttgctgatgctggaattaaagccagaaatggttttgatgcattgcacattgctgccaaacaaggggatttagatgtgctgaagatccttatggagggtcatcctgagttgtcaatgactgtggatccatccaacaccacagctttgcacacagctgcattacaagggcacactgagatagtgaaattcatattggaggcagggagtagtcttgcaaccattgctagaagtaatggtaaaacagcacttcattctgctgcaagaaatggacatttagaggttgtgaaggcacttcttgagaaggagcctggggttgcaacaagaaccgacaagaagggacagacagcacttcacatggcagtgaaggggcagaatcttgaggtggtagaggagttgatcaatggagatccctcatcaataaacatggttgatagtaagggaaacacagcattgcatatagcaactaggaagggcagagctcagattgtgaagttgcttctggaacaaaaggaaacggctacaaatgccgtgaataggtgcggtgaaacagcattagacactgctgagaaaacagggaaccatgatttgaaagtcattctactggaacatggtgttcagaatgcgaggaccataaagccccagaagggcacaacggctactacagcccgtgagttgaaacaaacggtgagtgacataaagcacgaagtccaccaccagttggaacacacacgccaaaccagaaaacgagtccaaggcattgccaaacgcatcaacaaaatgcatgttgaaggactcaacaacgcaatcaactccacaactgtggtggcagtgctaattgccacggtggcatttgctgctatattcacggtccccggccaatttgttgatgaccctaacaacattcctccagggatgtcacttggtgaggcaaacatagccccacaagcctcattcatcattttctttgtgtttgattccattgcattgttcatctctttagcggtggtggtggtgcaaacttcggttgtggttatagaaagcaaggcaaagaagcagatgatggctgtgattaacaagctaatgtggctggcttgtgttcttatttcggtggccttcttggctttgtcgtttgtagtggtggggaaggaagagaagtggttggccataggagtcaccattataggggcaaccataatggctacgaccttgggaactatgtgttactgggtcattaggcatcgcattgaggcctcaaatttgaggaacgtacgaaaatcttcattgcaaagcaagtccaagtctttttcagtctcggctttttcagattctgagctactaaacagtgagtataataagaaaatgtatgcgatttagaacttgctaagcttattcccctaattcccttttttttcaatttaaaagtacctggctagatcgaactatatccaactaaagtgggacttccaaatgtatatctcaacaaatggctaatgctaataacgtgaaaataaatcataatagtaaatagta

SEQ ID NO: 7746 - DNA, 2596 bp, Glycine max
atggcaatatcttcactcgcgccactaataataattcaattgcgcgtggttcagttatttccgtttttcttcattggccaccacttgaggtttagcctctctctctctctctcatgttcccttcatggcaaggctatatttgattctcaaacatatatattcacatttttttttctattggaatcccgacatcatcacaacctttacaaaagttgcttctttatgggtgagcttgggtgtgctgccaagctcttgccttcctgaaacctcccctcaaatctcatatttccatggctttcacggtgagggttgagcttcttccttcaaccccagacacgggaagaacagaaatcagtttttttgaaagataaaagagataagaaattaataaataaaaatacttatatttgacaatgattgggatgatcctccccgttgagatgctgtggaatgaaagatgctagtgttgatctgggattttggagaaaggaagaaaagaaggttttgatatactaataattagagcatcataaagagtagaatttgataggtaggtgaagaagccaatatggcaacaccagcaatgcaggcagtaaacaccacaaggaaaaaaatgacaaaacaattgacaggaaaaagggatgatacacctttgcattctgcagcaagagcagggaatttggctgtgctgaaagataccattttggaaactgatgaggctgaattgcatgaattattagccaagcagaatcaagatggagaaacgcctctttatattgctgctgaatatggttacgttgatgtagttagggagatgattcagtattatgatcttgctgatgctgggattaaggctagaaatggttttgatgcattgcacattgctgccaaacaaggggatttagatgtacttaagatccttatggagggtcatcctgagttgtcgatgactgtggatccatccaacaccacagctttgcacacagctgcaattcaagggcacactgagatagtgaaattcctattggaagctggaagtagtctggcaaccattgctagaagtaatgggaaaacagctctgcattctgctgcaagaaatggacatttggtggttgtgaaagcacttcttgagaaggagcccggtgttgcaacgcggaccgataagaagggccagacagcacttcacatggcagtgaagggacagaacattgaggtggtggaggagttgataaaagcagatccctcatctataaacatggttgatagtaaggggaacacagcattgcacatagcaaccaggaaaggcagggctcagattgtaaagttgcttctagaacagaaggaaaatgttacaagtgcagtgaacagatgtggtgaaacagcagtagacactgctgagaaaacaggaaaccatgccgtgcaagccattcttcttgaacacggtgttgagagtgcaagaaccataaaaccccctcagggcacaacagctaccacagcccgtgagttgaaacaaacggtgagtgacataaagcacgaggtccaccaccagttggaacacacacgccaaaccagaaaacgcgttcaaggcattgccaaacgtataaacaaaatgcatgcagaaggactcaacaatgctataaattccacaactgtggtggcagtgctaattgccaccgtggcatttgctgctattttcacagtccctggccaatttgttgatgacccaaataacattcctgcgggaatgtcccttggtgaagcaaacatagccccccaagccacgttcatcattttctttgtgtttgattccattgcactgtttatctctttggctgttgtggtggtgcaaacctcggtcgtggttatagaaagcaaagcaaagaagcagatgatggctgtgattaacaagctgatgtggctggcttgtgttcttatttcggtggcattcttggcactgtcttttgttgtggtgggaaaggaagagaagtggctggccataggagtgaccattatagggacaaccataatggctacaacgttgggtactatgtgttactgggtcattaggcatcgcattgaggcctccaatttgaggagcattcggaaatcttcgttgcaaagcaagtcaaagtctttttcagtgtcggctttttcagattctgagctactaaacagtgagtattataagaaaatgtatgcgatttagagcttaccaaccctgttcctaattcactcttgctgcttctttttaaaaagcacagggccagatggaattatgttcaactaaagtggaacttaaattgtatgtctcaagaaatggctaatgctaataacatgctcaataaatcataatagtaaatagtaggtcccattcttaataaataagaaaaccagagagcgaagtggaatatctaactatcgaaacaaagcatgtatagttgaacattaattcattccgcatcatccatttcgatcttctctggcaacttgcaaaaataaacaaccaaatcagctataaacatgttttcgtttagttttgatcaacaattaatatatataaaaatgttagtaacacacattttatcattttatgatt

SEQ ID NO: 7747 - DNA, 2401 bp, Glycine max
cacaacctttacaaaagttgcttctttatgggtgagcttgggtgtgctgccaagctcttgccttcctgaaacctcccctcaaatctcatatttccatggctttcacggtgagggttgagcttcttccttcaaccccagacacgggaagaacagaaatcagtttttttgaaagataaaagagataagaaattaataaataaaaatacttatatttgacaatgattgggatgatcctccccgttgagatgctgtggaatgaaagatgctagtgttgatctgggattttggagaaaggaagaaaagaaggttttgatatactaataattagagcatcataaagagtagaatttgataggtaggtgaagaagccaatatggcaacaccagcaatgcaggcagtaaacaccacaaggaaaaaaatgacaaaacaattgacaggaaaaagggatgatacacctttgcattctgcagcaagagcagggaatttggctgtgctgaaagataccattttggaaactgatgaggctgaattgcatgaattattagccaagcagaatcaagatggagaaacgcctctttatattgctgctgaatatggttacgttgatgtagttagggagatgattcagtattatgatcttgctgatgctggaattaaggctagaaatggttttgatgcattgcacattgctgccaaacaaggggatttagatgtacttaagatccttatggagggtcatcctgagttgtcgatgactgtggatccatccaacaccacagctttgcacacagctgcaattcaagggcacactgagatagtgaaattcctattggaagctggaagtagtctggcaaccattgctagaagtaatgggaaaacagctctgcattctgctgcaagaaatggacatttggtggttgtgaaagcacttcttgagaaggagcccggtgttgcaacgcggaccgataagaagggccagacagcacttcacatggcagtgaagggacagaacattgaggtggtggaggagttgataaaagcagatccctcatctataaacatggttgatagtaaggggaacacagcattgcacatagcaaccaggaaaggcagggctcagattgtaaagttgcttctagaacagaaggaaaatgttacaagtgcagtgaacagatgtggtgaaacagcagtagacactgctgagaaaacaggaaaccatgccgtgcaagccattcttcttgaacacggtgttgagagtgcaagaaccataaaaccccctcagggcacaacagctaccacagcccgtgagttgaaacaaacggtgagtgacataaagcacgaggtccaccaccagttggaacacacacgccaaaccagaaaacgcgttcaaggcattgccaaacgtataaacaaaatgcatgcagaaggactcaacaatgctataaattccacaactgtggtggcagtgctaattgccaccgtggcatttgctgctattttcacagtccctggccaatttgttgatgacccaaataacattcctgcgggaatgtcccttggtgaagcaaacatagccccccaagccacgttcatcattttctttgtgtttgattccattgcactgtttatctctttggctgttgtggtggtgcaaacctcggtcgtggttatagaaagcaaagcaaagaagcagatgatggctgtgattaacaagctgatgtggctggcttgtgttcttatttcggtggcattcttggcactgtcttttgttgtggtgggaaaggaagagaagtggctggccataggagtgaccattatagggacaaccataatggctacaacgttgggtactatgtgttactgggtcattaggcatcgcattgagacctccaatttgaggagcattcggaaatcttcgttgcaaagcaagtcaaagtctttttcagtgtcggctttttcagattctgagctactaaacagtgagtattataagaaaatgtatgcgatttagagcttaccaaccctgttcctaattcactcttgctgcttctttttaaaaagcacagggccagatggaattatgttcaactaaagtggaacttaaattgtatgtctcaagaaatggctaatgctaataacatgctcaataaatcataatagtaaatagtaggtcccattcttaataaataagaaaaccagagagcgaagtggaatatctaactatcgaaacaaagcatgtatagttgaacattaattcattccgcatcatccatttcgatcttctctggcaacttgcaaaaataaacaaccaaatcagctataaacatgttttcgtttagttttgatcaacaattaatatatataaaaatgttagtaacacacattttatcattttatgatt

SEQ ID NO: 7748 - DNA, 2178 bp, Glycine max
tttagcccccctctctctcttattttcccttcatggcaaggctatatttgattcccaaacatggtgtgcagccaagctcatgcctgctgaaaccttccctcaaatctcacatttccatggctttcacgatgagggttgagcttcttccttcaaccccagacacaacaggaagaacagaaatctcaagttttttttgaaagataaaagagataagaaattaataaaaaaattatatttgacaatgattgggatgatcctctcggttgagatgctgtggaatgaaagatcctagagctgatctaggattttggaggaaggaagaaaagaagattttgatatagtaataattagagcataaaaagagtagaatttgataggtaggtgaagaagccaaatatggcaacaccagcgatgcaggcagtaaacaccccaaggaaaaaaatgacaaaacaattgacaggaaaaagggatgatacacctttgcattctgctgcaagagcagggaagttggctgtgttgaaagatatcattttgggaactgatgagactgaattgcatgagttattagccaagcagaatcaagatggggaaacgcccctttatattgctgctgaatatggttacgttgatgtagttagggagatgattcagtattatgatcttgttgatgctggaattaaggctagaaatggttttgatgcattgcacattgctgctaaacaaggggatttagatgtactaaagattcttatggagggtcatcctgagttgtcaatgactgtggatccatccaacaccactgctttgcacacagctgcaatacaaggtcacactgagatagtgaaattcctattggaagcgggaagtagtctggcaaccattgcaagaagtaatgggaaaacagctcttcattctgctgcaagaaatggacatttggaggttgtgaaagcacttcttgagaaggagcctggtgttgcaacgcggaccgataagaagggccagacagcacttcacatggcagtgaagggacaaaaaattgaggtggtggaggagttgataaaagcagatccctcattaataaacatgcttgatagtaagggaaacacagcattgcatatagcaaccaggaagggcagagctcagattgtaaagttgcttctagaacagaaggaaaatgttacaagtgcagtgaacagatgtggtgaaacagcagtagacactgctgagaaaacaggaaaccatgaggtgcaagccattcttcttgaacatggtgttcagagtgcaagaaccataaagccccctcagggcacaacggctaccacagctcgtgagttgaaacaaacagtaagcgacataaagcacgaggtccatcaccagttagaacacacacgccaaaccagaaaacgcgttcaaggcattgccaaacgtataaacaaaatgcatgcagaaggactcaacaatgcaataaactccacaactgtggtggcagtgctaattgccactgtggcctttgctgctattttcacagtcccaggccaatttgttgatgacccaaataacattcctccgggaatgtcccttggtgaagcaaacatagccccacaagccccgttcatcattttctttgtgtttgattccattgcactgtttatctctttggctgttgtggtggtgcaaacctcggttgtggttatagaaagcaaagcaaagaagcaaatgatggctgtgattaacaagctcatgtggctggcttgtgttcttatttcggtggcgttcttggcactgtcttttgttgtggtggggaaggaagagaagtggctggccataggagtgaccattatagggacaaccataatggctacaacgttggggactatgtgttactgggtcattaggcatcgcattgaggcttcgaatttgaggaacattcggaaatcttccttgcaaagcaagtcaaagtctttctcagtttcggccttttcagattctgagctactaaacagtgagtattataagaaaatgtatgcgatttagaacttacgaagcatgttccctaattcactcttgctgcttctttttaaaagcaccgggtcagatggaactatgtccaacttaagtggaatatctgactatcgaaacaaagcatgcatatatagttgaaaattaattcattccgta

SEQ ID NO: 7749 - DNA, 2198 bp, Glycine max
ctatatcttcactcgcgccactaaaaattcaattgcgcgtggttcagttatttccgtttttcgtcattcgccaccacttcagggtgtgcagccaagctcatgcctgctgaaaccttccctcaaatctcacatttccatggctttcacgatgagggttgagcttcttccttcaaccccagacacaacaggaagaacagaaatctcaagttttttttgaaagataaaagagataagaaattaataaaaaaattatatttgacaatgattgggatgatcctctcggttgagatgctgtggaatgaaagatcctagagctgatctaggattttggaggaaggaagaaaagaagattttgatatagtaataattagagcataaaaagagtagaatttgataggtaggtgaagaagccaaatatggcaacaccagcgatgcaggcagtaaacaccccaaggaaaaaaatgacaaaacaattgacaggaaaaagggatgatacacctttgcattctgctgcaagagcagggaagttggctgtgttgaaagatatcattttgggaactgatgagactgaattgcatgagttattagccaagcagaatcaagatggggaaacgcccctttatattgctgctgaatatggttacgttgatgtagttagggagatgattcagtattatgatcttgttgatgctggaattaaggctagaaatggttttgatgcattgcacattgctgctaaacaaggggatttagatgtactaaagattcttatggagggtcatcctgagttgtcaatgactgtggatccatccaacaccactgctttgcacacagctgcaatacaaggtcacactgagatagtgaaattcctattggaagcgggaagtagtctggcaaccattgcaagaagtaatgggaaaacagctcttcattctgctgcaagaaatggacatttggaggttgtgaaagcacttcttgagaaggagcctggtgttgcaacgcggaccgataagaagggccagacagcacttcacatggcagtgaagggacaaaaaattgaggtggtggaggagttgataaaagcagatccctcattaataaacatgcttgatagtaagggaaacacagcattgcatatagcaaccaggaagggcagagctcagattgtaaagttgcttctagaacagaaggaaaatgttacaagtgcagtgaacagatgtggtgaaacagcagtagacactgctgagaaaacaggaaaccatgaggtgcaagccattcttcttgaacatggtgttcagagtgcaagaaccataaagccccctcagggcacaacggctaccacagctcgtgagttgaaacaaacagtaagcgacataaagcacgaggtccatcaccagttagaacacacacgccaaaccagaaaacgcgttcaaggcattgccaaacgtataaacaaaatgcatgcagaaggactcaacaatgcaataaactccacaactgtggtggcagtgctaattgccactgtggcctttgctgctattttcacagtcccaggccaatttgttgatgacccaaataacattcctccgggaatgtcccttggtgaagcaaacatagccccacaagccccgttcatcattttctttgtgtttgattccattgcactgtttatctctttggctgttgtggtggtgcaaacctcggttgtggttatagaaagcaaagcaaagaagcaaatgatggctgtgattaacaagctcatgtggctggcttgtgttcttatttcggtggcgttcttggcactgtcttttgttgtggtggggaaggaagagaagtggctggccataggagtgaccattatagggacaaccataatggctacaacgttggggactatgtgttactgggtcattaggcatcgcattgaggcttcgaatttgaggaacattcggaaatcttccttgcaaagcaagtcaaagtctttctcagtttcggccttttcagattctgagctactaaacagtgagtattataagaaaatgtatgcgatttagaacttacgaagcatgttccctaattcactcttgctgcttctttttaaaagcaccgggtcagatggaactatgtccaacttaagtggaatatctgactatcgaaacaaagcatgcatatatagttgaaaattaattcattccgta

SEQ ID NO: 7750 - DNA, 2238 bp, Cicer arietinum
atttcattggccaaaacaactgcggtttttgtctctctatcttaaccctctatatttgatttgattcccaaacatatatttttttggaatcatttccaacacaatcaccaccacctttgcaaaagttgtagaaagaggctatagcaaaaaggggttgaggtttttttcttcaaccccatgtccaattcatcttcaaaacgcaggccagaaattcagaagacatgagagataagaactgattggaaatttctttgaaggagaaaaaaatattgattccacaatgaattgttgtggtgttggtatgagattttgctagaagaaaaaaaaaaggttttgataaatatttagcattaaaagataggaaacttgtaggtgggtgaaaatccaatatggcaacacaattgatgcagtcactagctgttagcactcctaggaaaaaaatgacaaaacaattgacaggaaaaagggatgatacacctttgcattcagcagcaagagcagggaatttagatgttgtgaaagatacccttaaagatgctgaagaggatgaattgcttgacttattggctaggcagaatcaagatggtgaaacagctctttatgttgctgctgagtatggttatattgatgttgtaagggaaatgattcaatattatgatcttactgctgctggagttaaagctagaaatggttttgatgcttttcacattgctgctaaacaaggagatatagatatattgaagatccttatggaggttcatcctgaattatcaatgacagtggatccatccaacaccacagctttacacacagctgcaacacaaggacatattgagatagtgaaatttctattggaagcaggaagtagcttggcaactattgctaaaagtaatgggaaaacagctcttcattctgctgcaagaaatggccatttggaggttgtgaaagcacttcttgagaaggagcctagtgttgcaataaggactgataagaagggtcagacagcacttcacatggcagtgaaaggacaaaatcttgaagtagtggagaagttgataaaagctgatccctccacaataaacatggttgatacaaagggaaacacagcattgcatatagcaaccaggaaagccaggtgtcagattgtaaagatgcttcttggagagaaggaaacaaacataagtgctgtgaatagatcaggtgaaacagcaatagacactgctgagaaagtagggagccatgatgttcaagccattctattagaacatggtgttcaaagtgccaaatccataaaaccacaaaccacagctcgcgagttgaaacaaaccgtaagcgacataaaacatgaggtacattaccaattagaacacactcgacagacccgaaaacgcgtccaaggaattgcaaaacgcatcaacaagatgcatgcagaaggactgaacaatgcaataaactcaacaacagttgttgcagtactaatagcaacagttgcatttgctgctattttcactgtccctggccaatttgttgatgatccaaacaatattccaccagggatgacacttggtgaagcaaatatagctccacaagcaccattcataattttctttgtgtttgattctattgcacttttcatttctcttgctgttgtggtagtgcaaacctctgttgttgttatagaaagcaaagcaaagaaacaaatgatggctattattaacaagcttatgtggttagcttgtgtgcttgtttctgtggcatttttggctttgtcatttgttgtggttggaaaagaagaaaagtggttggcaattggtgttacaattatagggacgactataatggctacaactttgggaactatgtgttattgggttattaagcatcgaattgagtcttcaaatttgaggaatattcggaaatcttcaatggaaagcaagtcaaagtctttttctgtgtctgctttttcagattctgagctgttaaacaatgagtttaagaaaatgtatgcaatttaggagagttttatacttgaagcacttagcatgatggaactatatccaactaaggtaggatttcaaatgtatatctctcaagaaatggctaaatgtaaacaacgcattaactatgtagtaaatagtctggccaatagggtgtttgttactgttatggtagagagtatcaaacttgattttacctcttgcataatcaattttaaataataataaaaagtacatgaat

SEQ ID NO: 7751 - DNA, 1737 bp, Phaseolus vulgaris
gtaggtgaagaagccaatatggaaagaccagcgctgcaggcaataaacacccataggaaaaaaatgacaaaacaattgaccggaaaaagggacgatacacctttgcattttgcagcaagagcagggaatttggatgtgctgaaggatgccattttgggaactgatgaggctgaattgcatgaattattatccaagcagaatcaagatggagaaacgctcctttatattgctgctgaatatggttacattgatgtagttagggagatgattcagtattatgatcttgctgatgctggaattaaagctagaaatggttttgatgcattgcacattgctgccaaacaaggggatttagatgtaatgaaggttctcatggaaagtcatcctgagttgtcaatgactgtggatccatccaacaccacagctttgcacacagctgcaatacaagggcacactgaaatagtgaagttcctattggaagcaggaagtagtctggcaaccattgctagaagtaatgggaaaacagctctgcattctgctgcgagaaatggacatgtggtagttgtgaaagcaattcttgagaaggagcctggggttgccacccggaccgataagaagggccagacagcacttcacatggcagctaaagggcagaagcttgagatggtggaggagttgataaaagcagatccctcatcaataaacatggttgacagtaagggaaacacagcattgcatatagcaaccaggaagggcaggagtaagattgtaaagttgcttttagaacagaaggaaactataacaagtgcagtgaataggtctggtgaaacagcattagacactgctgagaaaacggggaacaatgatgtgaaagccattcttttggaatatggtgttcagagtgcgaggactataaagccccctcagggcacaacggctactacagcccgtgagttgaaacagacggtgagtgatataaagcacgaggtccaccaccagttggaacacacacgccaaaccagaaaacgggttcagggcattgccaaacgtattaacaaaatgcacgccgaagggctcaacaatgcaataaactccacaaccgtggtggcagtcctaattgccaccgtggcctttgcggctattttcacagttcctggccaattcgttgatgacccacatgatattcctccagggatgtcccttggtgaggcaaacatagccccagaagtctctttcatcattttctttgtgtttgattccgttgcactgtttatctctttggcggtggtggtggtgcaaacctcggttgttgtcatagaaagcaaagcaaagaagcagatgatggcagtgataaacaagctaatgtggctggcttgtgttctcatttccgtggccttcttggcactgtcatttgtagtggtggggaaggaagagaagtggctggccataggagtgtccattataggaacaaccataatggctacgaccttggggactatgtgttactgggtcattaggcatcgcattgaggcctcaaatttgaagaacgttcgaaaatcttcattgcacagcaggtctaagtctttttcagtgtcggccttttcagattctgagctattaaacagtgagtattataagaaaatgtatgcgatttagatagaaccaacttactcagtctgttcctatttagctcttgctttctttcgctttccaatttaaaagcaccgggccaaatgg

SEQ ID NO: 7752 - DNA, 2358 bp, Phaseolus vulgaris
ggttctgttatttccgtttttcttcattggtgaccacttcatctctctcccttatgttcctttgatgcgtatttgatcatctattgagtttgtggaggaatctcctcatcacaacctttgcaattaaggatgaacttgcgtgtgcttctaggctcatgcctttctgaaagcctccctcaaatcttacatttccatggctttcgcgttgagggtcctgcttcttccttcaaccccaaacacaggaagaacggaaatatctaacttttgtgaaagatagaagagataagaagtttataaaaatatgtatatttgacattgattggatgatcctccccgttgagttgccgtggaatgaaagacgctagctttgatctgggattttggaggaacgaaagaaagaaggttttgttgatatactgataactagcatcgacagagtagaatttaataggtaggtgaagaagccaatatggaaagaccagcgctgcaggcaataaacacccataggaaaaaaatgacaaaacaattgaccggaaaaagggacgatacacctttgcattttgcagcaagagcagggaatttggatgtgctgaaggatgccattttgggaactgatgaggctgaattgcatgaattattatccaagcagaatcaagatggagaaacgctcctttatattgctgctgaatatggttacattgatgtagttagggagatgattcagtattatgatcttgctgatgctggaattaaagctagaaatggttttgatgcattgcacattgctgccaaacaaggggatttagatgtaatgaaggttctcatggaaagtcatcctgagttgtcaatgactgtggatccatccaacaccacagctttgcacacagctgcaatacaagggcacactgaaatagtgaagttcctattggaagcaggaagtagtctggcaaccattgctagaagtaatgggaaaacagctctgcattctgctgcgagaaatggacatgtggtagttgtgaaagcaattcttgagaaggagcctggggttgccacccggaccgataagaagggccagacagcacttcacatggcagctaaagggcagaagcttgagatggtggaggagttgataaaagcagatccctcatcaataaacatggttgacagtaagggaaacacagcattgcatatagcaaccaggaagggcaggagtaagattgtaaagttgcttttagaacagaaggaaactataacaagtgcagtgaataggtctggtgaaacagcattagacactgctgagaaaacggggaacaatgatgtgaaagccattcttttggaatatggtgttcagagtgcgaggactataaagccccctcagggcacaacggctactacagcccgtgagttgaaacagacggtgagtgatataaagcacgaggtccaccaccagttggaacacacacgccaaaccagaaaacgggttcagggcattgccaaacgtattaacaaaatgcacgccgaagggctcaacaatgcaataaactccacaaccgtggtggcagtcctaattgccaccgtggcctttgcggctattttcacagttcctggccaattcgttgatgacccacatgatattcctccagggatgtcccttggtgaggcaaacatagccccagaagtctctttcatcattttctttgtgtttgattccgttgcactgtttatctctttggcggtggtggtggtgcaaacctcggttgttgtcatagaaagcaaagcaaagaagcagatgatggcagtgataaacaagctaatgtggctggcttgtgttctcatttccgtggccttcttggcactgtcatttgtagtggtggggaaggaagagaagtggctggccataggagtgtccattataggaacaaccataatggctacgaccttggggactatgtgttactgggtcattaggcatcgcattgaggcctcaaatttgaagaacgttcgaaaatcttcattgcacagcaggtctaagtctttttcagtgtcggccttttcagattctgagctattaaacagtgagtattataagaaaatgtatgcgatttagatagaaccaacttactcagtctgttcctatttagctcttgctttctttcgctttccaatttaaaagcaccgggccaaatggagctatatccaactaaagtggaacttccaaatgtgtatctgaagaacaagaaatggctaatattaataacgtactaaataaatcataacagtaaatagtctccttcctaaaaacaatgaaaatgggaagtgaatttgactatggaaacaaagcatatatagtttaattaa

SEQ ID NO: 7753 - DNA, 1430 bp, Glycine max
atgaaccccaacgatggcaacaactctcccagtcccaagcccttggagatggtcaacccggttcctccgtttctttctaagaccttcgacctcgtcgacgccccgactctcgacccgatcatctcgtggaactccacgggcctcagcttcgtcgtgtgggaccctctcgagttcgcgagaattgtccttcctcgacatttcaagcacaacaacttttccagcttcgttcgccagctcaatacttatggattccgcaagattgacacagacaagtgggagtttttcaacgaagctttccagcgagggaagaagcacttgctgaagaacatccaaaggcgcaggtcatctcaatcccagccggttggtagctatattggaatcggatcttctaccgaggcaggggggtcagaggttgagattgagatagaaaggcttaggaaagaaaagactatgctgatggaagaggtggttgatttgcagcaagagcaacgaagaacagctcaccacgcaggagaagtgaatctaaggctccaatctgcagaacaaaggcagaaacaaatggtttctttccttgccaagttgatccaaaaccccgcctttttagcccgccttagacataagaaggagcaaaaggaaatagattctccaagagtggtaaggaagtttgtcaaacagcaccatgaaactggaacaacaacaacagcagaaactctccaagaagggcagatagtgaggtatcaacctgattggagaaatatagccatgtcttctgaaactccaaaactaagttcagtttccattgaacaatctcctcactacctttcacagggtttggcaggagaaatgagtgtagtaggtgcagaagaccttactgctcaaattgacaatattgtatcagatgatttggctgcagtgcacgggattacgccgtctcaagaaatgatgattggagaaggatcatctacctttggagctgaagaccccctcttcaaagggaagagtgtcatgagtccaattctagaagttcctccagagtattttccttccttcccagagggtttgaccaaggagaagaaagactttcaagatttttctgctcttggaactgaaggcatgataaagctagaagatatatgggactctggcctcaatgttagtggtgctgctttaagcagtgggaatgagctgtggggcaatcatgtcaactatgaagagtttccacaatttggagtcacaagtggtatgtctgactcagatatctgggatattggcttaggaagttttggaattgatacgtggccaactgatgaaccttctcttggtgaaacagatggtcaatctggtcagccaaatgaagataggtctaagaattttgatccatagggcttctttggtcctctgcacttgttgccctttggttactttgctat

SEQ ID NO: 7754 - DNA, 2349 bp, Glycine max
aaaaagacaagctgtcgcgattgggtggtaaagttgggttgggcgaccagacaagttgacagcactgtcgagtgtgaacacaacagaaggagtcgctctcaaaatccaacccaaccaatgaacagcaacaacagtcctacgtgtgagccctagacgcggtcgcaacacacaaccaagaagtaaccacccccagttgcaactaaccaacgtaactgccaggaaacaaaccaaacaaaaacaaaacctcaaactccttctctcacacactctgtctctcactgtgcaatggcctttcccttccaccgccatcacctctccaccctccaccgccctcacacccttttaatatccccacctccctctcttttcttttctcacccctcctcattcttcttctttgaacatgaaccccaacgatggcaacaactctcccagtcccaagcccttggagatggtcaacccggttcctccgtttctttctaagaccttcgacctcgtcgacgccccgactctcgacccgatcatctcgtggaactccacgggcctcagcttcgtcgtgtgggaccctctcgagttcgcgagaattgtccttcctcgacatttcaagcacaacaacttttccagcttcgttcgccagctcaatacttatggattccgcaagattgacacagacaagtgggagtttttcaacgaagctttccagcgagggaagaagcacttgctgaagaacatccaaaggcgcaggtcatctcaatcccagccggttggtagctatattggaatcggatcttctaccgaggcaggggggtcagaggttgagattgagatagaaaggcttaggaaagaaaagactatgctgatggaagaggtggttgatttgcagcaagagcaacgaagaacagctcaccacgcaggagaagtgaatctaaggctccaatctgcagaacaaaggcagaaacaaatggtttctttccttgccaagttgatccaaaaccccgcctttttagcccgccttagacataagaaggagcaaaaggaaatagattctccaagagtggtaaggaagtttgtcaaacagcaccatgaaactggaacaacaacaacagcagaaactctccaagaagggcagatagtgaggtatcaacctgattggagaaatatagccatgtcttctgaaactccaaaactaagttcagtttccattgaacaatctcctcactacctttcacagggtttggcaggagaaatgagtgtagtaggtgcagaagaccttactgctcaaattgacaatattgtatcagatgatttggctgcagtgcacgggattacgccgtctcaagaaatgatgattggagaaggatcatctacctttggagctgaagaccccctcttcaaagggaagagtgtcatgagtccaattctagaagttcctccagagtattttccttccttcccagagggtttgaccaaggagaagaaagactttcaagatttttctgctcttggaactgaaggcatgataaagctagaagatatatgggactctggcctcaatgttagtggtgctgctttaagcagtgggaatgagctgtggggcaatcatgtcaactatgaagagtttccacaatttggagtcacaagtggtatgtctgactcagatatctgggatattggcttaggaagttttggaattgatacgtggccaactgatgaaccttctcttggtgaaacagatggtcaatctggtcagccaaatgaagataggtctaagaattttgatccatagggcttctttggtcctctgcacttgttgccctttggttactttgctatatttatggttcctaggggtcatattattgaatcatttgacttataaacattattccttcacctgctttcattccttatttactttcaatttttcttattcttttagattaattaattctttaattgtccatatttttctttgtaaattctaattgtgtaattattgacaacttccattcaggtgaatcatacttttcctttcacctgatgaatgatttaagtaaacattcacaggtctaaggtatcatcaaacccctctttgggacttatgacttattttctctgcaatgcttatgctttgcctgttgcaaataatcatgaattcctgatatgagtgataaggtatgctgtttaaatgaattggttgatttcctgttttctctcccttttatacttatatatgctctactaaaagatcattgattttatgcttcttctcaatttgttattttacttttatttactttattatattaatactctgcaactcataaaaaatatattaatattctgcac

SEQ ID NO: 7755 - DNA, 1788 bp, Phaseolus vulgaris
cttacactcacactttcactgtgcaatggccctcctttgccaccgccattcctccaccctccaccgccctcccacccttttaataacccctttcttaccctccaaactccactctaaacctttattattattccttaattaatcttcacacttcacaatgaaccccactgatgacaactttcccaagcccttggaggttctgcaaatgaacccggttccaccgtttttgtccaaaaccttcgacctcgtcgatgaccccactctcgacccgattatctcctggggctccacgggctttagcttcgtcgtctgggaccctctggagttcgccagaatcgtgttgccgcgacatttcaagcacaacaatttctccagtttcgttcgccagctcaatacttatggattccgcaagattgacacagacaagtgggagtttttcaatgaagcattccagcgatcgaagaagcacttgctgaagaacatacaaagacgtaggtcaacacaattccagcaggttggtagctatattggaattggatcttctactgaggcagggaggtctgaggttgaggttgagatagaaaagcttaggaatgaaaggactatgttgatggaagaggtggttgatttgcagcaagaacaacgaagaacggctaaccgtgcaggagaagtgaatcaaaggctccaatctgcagaacaaaggcagaaacaaatggtttctttcctggccaagttgatccaaaacccagcctttttagcccgccttaggcataagaaggaacaaagagaaatagattctccaagagtggtaaggaagtttgtcaagcagcaccaacatgagtctggaacagtagaaactctccaagaaggacagatagtgaggtaccaacctgattggagaaatatagacatgtcttctgaaactccaaaactaagtcaggtttccattgaacagtcacctcactacctttcacagtgtttggcaggagaaatgagtggaggtgcagaagatctgacttctcaaattgagaatattgtaacagatgatttggctgcagagcacgggatcacaccaccccaagaaatgatgattggatccagctttggagctgaagaccccctttacaaagggaagagtgttatgagcccaagtctagaacttcctccagagtattttacttcattcccagaggttttgacccaggagaaaggctttcaagatttttctgctcttggaactgaagacattatcaagcttgaagacatatgggactcggacctcaatcttagtggtgctggttcaacctgtgggaatgagctgtggggcaatcctatgaattatgaagatgttccagagtttggagtaacaagtggcatgtctgaatcagacatctgggatattggctctggaagtttgggaattcataagtggccaggtgatgaaccttctattggtgaaatagatggtcaagttggtgagccaaaagaagataggcctcagaatcttgatccataggcttcatctgcttctgcacttgttgccctttgggtacttcctatgttaatggttccttgggatcatattattgagtcatttgatttataaacagaattcattatcctgctttcattccttattcactttcaaatctttattcttttacattaatattgttcataattttccatgtaagttctaattgtgtaattattgacaacttccatattcaagtaaatattcacaggtctataccatagaaggcaggttcatcataccctgctttggaa

SEQ ID NO: 7756 - DNA, 1936 bp, Phaseolus vulgaris
gtctgtgacaaaaatatctacccaacaacgcggtcccaacacacaaacactgttccccaagaatcaaccatccccagttgtaactaaccaacgtaactgccacgaaacaaaccaacctcaacctcaaatattaatcaaagtcggcactcttacactcacactttcactgtgcaatggccctcctttgccaccgccattcctccaccctccaccgccctcccacccttttaataacccctttcttaccctccaaactccactctaaacctttattattattccttaattaatcttcacacttcacaatgaaccccactgatgacaactttcccaagcccttggaggttctgcaaatgaacccggttccaccgtttttgtccaaaaccttcgacctcgtcgatgaccccactctcgacccgattatctcctggggctccacgggctttagcttcgtcgtctgggaccctctggagttcgccagaatcgtgttgccgcgacatttcaagcacaacaatttctccagtttcgttcgccagctcaatacttatggattccgcaagattgacacagacaagtgggagtttttcaatgaagcattccagcgatcgaagaagcacttgctgaagaacatacaaagacgtaggtcaacacaattccagcaggttggtagctatattggaattggatcttctactgaggcagggaggtctgaggttgaggttgagatagaaaagcttaggaatgaaaggactatgttgatggaagaggtggttgatttgcagcaagaacaacgaagaacggctaaccgtgcaggagaagtgaatcaaaggctccaatctgcagaacaaaggcagaaacaaatggtttctttcctggccaagttgatccaaaacccagcctttttagcccgccttaggcataagaaggaacaaagagaaatagattctccaagagtggtaaggaagtttgtcaagcagcaccaacatgagtctggaacagtagaaactctccaagaaggacagatagtgaggtaccaacctgattggagaaatatagacatgtcttctgaaactccaaaactaagtcaggtttccattgaacagtcacctcactacctttcacagtgtttggcaggagaaatgagtggaggtgcagaagatctgacttctcaaattgagaatattgtaacagatgatttggctgcagagcacgggatcacaccaccccaagaaatgatgattggatccagctttggagctgaagaccccctttacaaagggaagagtgttatgagcccaagtctagaacttcctccagagtattttacttcattcccagaggttttgacccaggagaaaggctttcaagatttttctgctcttggaactgaagacattatcaagcttgaagacatatgggactcggacctcaatcttagtggtgctggttcaacctgtgggaatgagctgtggggcaatcctatgaattatgaagatgttccagagtttggagtaacaagtggcatgtctgaatcagacatctgggatattggctctggaagtttgggaattcataagtggccaggtgatgaaccttctattggtgaaatagatggtcaagttggtgagccaaaagaagataggcctcagaatcttgatccataggcttcatctgctcctgcacttgttgccctttgggtacttcctatgttaatggttccttgggatcatattattgagtcatttgatttataaacagaattcattatcctgctttcattccttattcactttcaaatctttattcttttacattaatattgttcataattttccatgtaagttctaattgtgtaattattgacaacttccatattcaagtaaatattcacaggtctataccatagaaggcaggttcatcataccctgctttggaa

SEQ ID NO: 7757 - DNA, 3348 bp, Glycine max
gcatacgtgtcaattaacttgtctcctggtctggtcaatggtcttctcaaatcaaaatctcctgaaactgaaaccatgaaacgccgtgtttttcactcaatgtaccaatctcatagtcacagtagtacgatgctgtgtctttcacagccacatcaccttgtaatcgcacgaaccgctgcttttttgttggaccgaaccggagacacacaaacaacaagtattcgattttgatttaggatgagtgggaaggaaattttctggttggccacagtgttatatccgtagccttcactcacaaatttgctgagcaagagggtatataatgaagaggttctctgcctgctgcttcacaagcagaatctctaagtttcactcccactggaagcgcaaccattctcggtctcagatcatggcaggaatcatctctggcccaagtgggagcgagggtgttaatattttacttaatcatgacttctctagtgagctgaactcttggcatctcaataactgcactggctatgtaatttcggctgaatcaggtaatcaagggggaatttcaatggagtcgaatgttaattatgttgttatcaccgaccgaaaggaatgttggcaaggtcttgagcaagacattaccaacagaatttccattggttccacttacacggtttcggcttgtgtgggagtttctgggctttctcagcgatctagtgatgttatagctactctgaaactagaatatcatgattcagctactagatacttgttcattggaagaacttctgttaataaggatagctgggaaaagttggaagggacattctcattgtcaactatgcctcatagggttatattttatttggaaggacctgctcctggagttgacctgctaatacgatcagtagagatcaactgttccactccaaataatagtaccacaagcacaggatgtgtttcagctggagatgacaacatcataattaacccccaatttgatgatggtctgaataactggtctggaagaggctgcaagattatgttgcatgattccatgaatgatgggaaaattgttccaaagtctgggaaattctttgcatctgcaacagaacgcacacaaagctggaatggaattcagcaagagatcactggacgcgtgcagcgcaaactggcctatgaggtcactgctttagttagaatatttggaaacaatgtctctactgctgatgtacgggctactttgtgggtccaaacaccagatcttcgagagcagtatataggcattgcaaaggtgcaggcaacagataaagattgggttacaatgcagggaaaattccttctaaatggttctccatcgaaagtggtcctttatttagagggcccccctccaggcactgacattcttctcaataatttgatcttaaagcatgcagctaaaacacctccttcaaccccaccggatttaaagaatattgcttttggggttaatataattgagaacagcaatctggctgatagcacaaatggatggtttccccttggcaattgcactttaagtgttaaaactggttcaccacacataattccaccaatggcaagagattctcttggttctcatgagttcctaagcgggcgatacatccttgtaactaatcgaacgcaaacatggatgggtcctgctcaaactatcactgataaagttaaactctttgtgacttatcaagtgtctgcttgggtccggattggctcaggatcatccgggcctcagaatgtgaatgttgcccttggtgttgacaaccagtgggtcaatggaggacaaactcaggtttcggatgacatgtggcatgaaattggagggtcctttagaattgaaaagcagccatcaaaggttatggtttatgtccaaggtcctgcttctggtgtggacttaatggttgctggacttcaaatttttcctgtggatagacacacaagatttagatatttaaagatccaaactgataagattcgtaaacgtgatgttatcctgaaattctctggactggactctggcagctatgctaacacctcggtaaaagttatacaaacacagaatgatttcccaattggaacatgcatcagtagaatgaacattgacaatgaggactttgttaacttcgttgtgaagcattttaactgggctgtgtttgaaaatgagttgaagtggtattggactgagccacaacaaggaaatttcaattacaaagatgctgataatctgctaagcttgtgtcagaagcacaagatacaaactcgcggtcattgtatcttctgggaagtggatgaaactgttcagcagtggatcaagtcactgaacaaaaacgatttgatgacggctgtccaaaaccgcctaaacggcctgctgactcgctacaagggcaagttcagtcactatgatgttaacaatgaaatgctgcatggttcattttaccaagacaggctaggcaaggatataagggcaaacatgttcaagactgcaaaccaactagacccttctgccacactctttgtgaatgattaccacgttgaagatggacgtgacaccagatcgagtccagataagtacatccatcacattcttgatttgcaagagcaaggtgccccagttgggggaattggaattcaaggccacatagatagtccaatagggcctattgttagttcttcccttgacaagttgggtattcttggtctacctatatggttcactgagcttgatgtgtcttccgtcaatgaatatgttagagcagatgatcttgaagttatgctacgcgaagccatggctcatcctacggtggaaggcataatgctgtggggattttgggagttgtttatgagtagggacaattcacacttggtgaatgcagaaggtgacatcaatgaggctgggaaaaggttcttatctcttaaacaagagtggctttctcatagccgtggccatgttgatgagcaaggtcaatacaacttcagaggctttcatggaacatatgatgtgcaagttgtgaccccatcaaagaaaatttctaagacatttgtgcttgacaaaggtgactcgccactagtggtatccattgatttataaccataatgcttcgccccaagaactaatatcatgtcttttatatatatatatatatttgggttggctgaaaaactacattggtggtgttatgttatcttaaaatagttgggatttgagttgtctgcacaattgcacaaaatctaaacacttaaagattgtctcactttattataaatatacttgtaagaaatgaaaaataaataaaaagtgatacttgtttgcttataaatgca

SEQ ID NO: 7758 - DNA, 3348 bp, Glycine max
gcatacgtgtcaattaacttgtctcctggtctggtcaatggtcttctcaaatcaaaatctcctgaaactgaaaccatgaaacgccgtgtttttcactcaatgtaccaatctcatagtcacagtagtacgatgctgtgtctttcacagccacatcaccttgtaatcgcacgaaccgctgcttttttgttggaccgaaccggagacacacaaacaacaagtattcgattttgatttaggatgagtgggaaggaaattttctggttggccacagtgttatatccgtagccttcactcacaaatttgctgagcaagagggtatataatgaagaggttctctgcctgctgcttcacaagcagaatctctaagtttcactcccactggaagcgcaaccattctcggtctcagatcatggcaggaatcatctctggcccaagtgggagcgagggtgttaatattttacttaatcatgacttctctagtgagctgaactcttggcatctcaataactgcactggctatgtaatttcggctgaatcaggtaatcaagggggaatttcaatggagtcgaatgttaattatgttgttatcaccgaccgaaaggaatgttggcaaggtcttgagcaagacattaccaacagaatttccattggttccacttacacggtttcggcttgtgtgggagtttctgggctttctcagcgatctagtgatgttatagctactctgaaactagaatatcatgattcagctactagatacttgttcattggaagaacttctgttaataaggatagctgggaaaagttggaagggacattctcattgtcaactatgcctcatagggttatattttatttggaaggacctgctcctggagttgacctgcttatacgatcagtagagatcaactgttccactccaaataatagtaccacaagcacaggatgtgtttcagctggagatgacaacatcataattaacccccaatttgatgatggtctgaataactggtctggaagaggctgcaagattatgttgcatgattccatgaatgatgggaaaattgttccaaagtctgggaaattctttgcatctgcaacagaacgcacacaaagctggaatggaattcagcaagagatcactggacgcgtgcagcgcaaactggcctatgaggtcactgctttagttagaatatttggaaacaatgtctctactgctgatgtacgggctactttgtgggtccaaacaccagatcttcgagagcagtatataggcattgcaaaggtgcaggcaacagataaagattgggttacaatgcagggaaaattccttctaaatggttctccatcgaaagtggtcctttatttagagggcccccctccaggcactgacattcttctcaataatttgatcttaaagcatgcagctaaaacacctccttcaaccccaccggatttaaagaatattgcttttggggttaatataattgagaacagcaatctggctgatagcacaaatggatggtttccccttggcaattgcactttaagtgttaaaactggttcaccacacataattccaccaatggcaagagattctcttggttctcatgagttcctaagcgggcgatacatccttgtaactaatcgaacgcaaacatggatgggtcctgctcaaactatcactgataaagttaaactctttgtgacttatcaagtgtctgcttgggtccggattggctcaggatcatccgggcctcagaatgtgaatgttgcccttggtgttgacaaccagtgggtcaatggaggacaaactcaggtttcggatgacatgtggcatgaaattggagggtcctttagaattgaaaagcagccatcaaaggttatggtttatgtccaaggtcctgcttctggtgtggacttaatggttgctggacttcaaatttttcctgtggatagacacacaagatttagatatttaaagatccaaactgataagattcgtaaacgtgatgttatcctgaaattctctggactggactctggcagctatgctaacacctcggtaaaagttatacaaacacagaatgatttcccaattggaacatgcatcagtagaatgaacattgacaatgaggactttgttaacttcgttgtgaagcattttaactgggctgtgtttgaaaatgagttgaagtggtattggactgagccacaacaaggaaatttcaattacaaagatgctgataatctgctaagcttgtgtcagaagcacaagatacaaactcgcggtcattgtatcttctgggaagtggatgaaactgttcagcagtggatcaagtcactgaacaaaaacgatttgatgacggctgtccaaaaccgcctaaacggcctgctgactcgctacaagggcaagttcagtcactatgatgttaacaatgaaatgctgcatggttcattttaccaagacaggctaggcaaggatataagggcaaacatgttcaagactgcaaaccaactagacccttctgccacactctttgtgaatgattaccacgttgaagatggacgtgacaccagatcgagtccagataagtacatccatcacattcttgatttgcaagagcaaggtgccccagttgggggaattggaattcaaggccacatagatagtccaatagggcctattgttagttcttcccttgacaagttgggtattcttggtctacctatatggttcactgagcttgatgtgtcttccgtcaatgaatatgttagagcagatgatcttgaagttatgctacgcgaagccatggctcatcctacggtggaaggcataatgctgtggggattttgggagttgtttatgagtagggacaattcacacttggtgaatgcagaaggtgacatcaatgaggctgggaaaaggttcttatctcttaaacaagagtggctttctcatagccgtggccatgttgatgagcaaggtcaatacaacttcagaggctttcatggaacatatgatgtgcaagttgtgaccccatcaaagaaaatttctaagacatttgtgcttgacaaaggtgactcgccactagtggtatccattgatttataaccataatgcttcgccccaagaactaatatcatgtcttttatatatatatatatatttgggttggctgaaaaactacattggtggtgttatgttatcttaaaatagttgggatttgagttgtctgcacaattgcacaaaatctaaacacttaaagattgtctcactttattataaatatacttgtaagaaatgaaaaataaataaaaagtgatacttgtttgcttataaatgca

SEQ ID NO: 7759 - DNA, 3113 bp, Cajanus cajan
gatctgtgggagggaaattttgtggttggcccgtgttatccgtagccttcactcacaaatttgctgagcaagagggtatataatgaagaggttctcttgctgctgcttcacaagaagaatctctaagtttaactctcaccggaagcacaaccaacctcagtctcagatcatggcaggaaactcctctgatccaagtggcaacaagactgctaatattttaattaatcatgacttctgtagtgggctgaactcatggcatctcaataactgcaatggctatgtaatttcagctgaaacaggtactcaaggaggaacttcaatgaagtctgatggcaattatgctgttattactgaccgaaaggaatgctggcaaggccttgagcaagacatcacagacagaatttccattggttccacttacacagtttcggcttgtgtgggtgtatccgggctttctcagggacacagtgatgttctagctactctgaaactagaatatcacaattcagctactagttacttgttcattggaagaacttctgttaataaagatagctgggaaaagttggaagggacattctcattgtcaacaatgcctgatcgggttatattttatttggaaggacctgctcctggagttgacctgcttatacgatcagtagagatcaactgttccagttcaaacaataatgccacaagcacaggatgtgtttcagctggagatgacaatatcatcattaacccccaatttgatgatggcctgaataactggtctggaagaggctgcaagattatgttgcacgattccatgaatggtgggaaaattgttcccaagtctgggaaattctttgcatctgcaacagaacgcacacagaactggaatggaattcagcaagagatcactggacgcgtgcagcgcaagctggcctatgaggtcactgctttagttagaatatttggaaacaatgtctctactgctgatgtacgggctactttgtgggtccaaacaccggatcttcgagagcaatatataggcattgcaagtgtgcaggcaacagataaagattgggttacaatgcagggaaaattccttctaaatggttctccatcaaaagtagtcctttatttggaagggccccctccaagcactgacattcttctgaataatttggttttaaagcatgcagctaaaacacctccttcaaccccacctgatgtaaagaatgttgcttttggtgttaatataattgagaacagcagtctggctgataacaccaatggttggtttccccttggcaattgcactttaagtgttaaaactggctctccacatataattccaccaatggcaagagattctcttggtcctcatgaactcctaagtgggcgctacatccttgtaactaatcgaacacagacatggatgggtcctgctcaggtaatcactgataaagtgaaactatttgtgacttatcaagtgtctgcttgggtccggattcgctcaggagcatcagggccacagaatgtgaatgttgcccttggtgtggacaatcagtgggtcaatggaggacaaactgaggtttatgatgacatgtggcatgaaattggtggatcttttagaattgaaaagcagccatcaaaggttatggtttatgtccaaggtcctgcttctggtgtggacttaatggtagctggacttcaaatttttcccgtggatagacatgcaagatttagatatttaaagatccaaacagataagatccgtaaacgtgatgttatcctgaaattctctgggctggactctggcagctatgctaacacctcagttcaagttagacaaacacagaatgatttcccaattggatcatgcatcagtagaacaaacattgacaatgaagactttgttgacttcatggcgaagcattttaactgggctgtgtttggaaacgagttgaagtggtattggactgagccacaacaagggaatttgaattacaaggatgctgatgatctgttaaccttgtgtcagaagcacaagatacaaactagaggtcattgtatcttctgggaagtggatggaaccgttcagcagtgggtcaaatcactgaacaacaatgacttgatgacggcagtccaaaaccgcttaaacggcctgctgactcgctacaagggcaagttcagtcactatgatgttaacaacgaaatgctgcatggttcattctaccaagacaggctaggaaaggatataagggcaaacatgttcaagactgcaaaccaactagacccttctgctacattgtttgtgaatgattaccatgttgaagacggatgcgacaccaaatcatgtccagataagtacatccatcatattcttgatttgcaagagcaaggtgccccagttgggggaattggaattcaaggccacatagacagtccaatagggcctgttgtttcttcttcacttgacaagttaggtgttcttggcctacctatatggtttactgagcttgatgtgtcttccatcaatgaatatgttagaggagatgatctcgaagttatgctacgtgaagcaatggctcatcctgctgtggaaggcataatgctgtggggattttgggagttgtttatgagtagggacaatgcacacttggtgaatgctgaaggtgacatcaatgaagctgggaaaaggttcttagctctgaagcaagagtggctgtctcacagccgtggccatgttgatgagcaaggtcaatacaacttcagaggctttcatggaacatacaatgtgcaagttgtgaccccaacaaagaagatttccaagacatttgtgcttgacaaaggtgactcgccacttgtggtatccattgatttataagcatgctgcttcatcccagaaataatatcactacttttatatatatcctcgggttggctgaaacactatgttggtggtgtaatgttatgtaaaactgttgggatttgagttgtctgaacaactgcacaaaatctcaacacttaaaaattatctcactttattataaatatacttgtaagaactaaattaataaatgaaaagtgattcgtgattgaacttttttagaaaatgaattgaa

SEQ ID NO: 7760 - DNA, 3014 bp, Phaseolus vulgaris
atgaagaggttttctgcctgctgcttcacaagcagaatctctaagtttcactctcacaggaagcataaccaatctcagatcatggcaggaaacatttctgatccaagtgggagcaagggtgcaaatattttacttaatcatgacttttctagtggcctgagctcctggcatctcaattcctgttctggctatgtgatttcagctgaaacaggtgctcaaggaggaatttcgagggagttgagtgctaattatgctgttatcactgaccgaaaggaatgctggcaaggccttgagcaagacatcacagatagaatttccactggttacacttacacagttttggcttgtgtgggagtatccagtctttctcagggatctagtgatgttctagctactctgaaactagaatatcatgattcagctactagttacttgttcattggaagaacttctgttaataaggatagctggcaaaagttggaagggacattctcattgtcaactatgcctgatagggttgtattttatttggaaggacctgctcctggagttgacctgctcatacgatcagtggagataaactgttccactccaaataataataccacaagcacagcatgtgtttcagcgggagatgacaacatcatcatcaacccgcaatttgatgatggtctgaataactggtctggaagaggctgcaagattatgttgcatgattccatgaatgatgggaaaattgttccaaaatcagggaaattctttgcatctgcaacagaacgcacacagaactggaatggaatccagcaagatatcactggacgcgtgcagcgcaagctggcctatgaggtcactgcttcagttagaatctttggaaacaatgtatctactgctgatgtacgtgctactttgtgggtccaagcaccagatcttaaagaacaatatataggcattgcaaatttgcaggcaacagataaagattgggttactatgcagggaaaattccttctaaatggttctccatcaaaagtggtcctttatttagaggggccccctccaggcactgacattcttctcaataatttggtcttaaagcatgcagctaaaacacctccttcatccccaccagatgtaaagaatgttacttttggggttaatataattgagaacagcactctagctgatggcaccaatggatggtttccccttggcaattgcactttaagtgttaaaactggttcaccacatatagttccaccaatggcaagagattctcttggtcctagtgaactcctaagtgggcgctacatccttgtaactaatcgaacacaaacatggatgggtcctgctcagatcatcactgataaagtgaaactctttttgacttatcaagtgtctgcttgggtcaggattgtctcaggatcatcagggccacagaatgtgaatgttgcccttggtgttgacaacgagtgggtcaatggaggacaaacagaggtttctgataacacgtggcatgaaattggagggtcctttagaattgaaaagcagccatcaaaggttatggtttatgttcaaggtcctgcttctggggtggacttaatggtggctggacttcaaatttttcctgtggatagacatgcaagattgagatatttaaagatccaaacaaataagatacgtaaacgtgatgttatcctgaaattctctgggctggactctggcagctacgctaacacctcagtgcaagttagacaaacacagaatgatttcccaattggaacatgcatcagtagatcaaacattgacaatgaggactttgttgatttcatggtgaagcattttaactgggctgtgtttggaaacgagttaaagtggtattggactgagccacaacaagggaatttcaattacaaggatgctgatgatctgttaagcctatgtcagaagcacaatatacaaactcgtggtcattgtatcttctgggatgtggatggcgtagttcagcagtggatcaaatcactgaacaataacgatttgatgacggctattcagaaccgcctaaacgggcttctaactcgttacaagggcaagtttaatcactatgatgtcaacaatgaaatgctgcatggttcattctttcaagatagactaggcaaggatataagggctaacatgttcaaaactgcaaaccaactagacccttctgctacactctttgtgaatgattatcatgttgaggatggatgtgacaccagatcatgtccagataagtacatccatcatattcttgatttgcaagagcaaggtgccccagttggaggaattggaattcagggccacatagatagtccaatagggcctattgtgagttcttcccttgacaagttgggtattcttggtctacctatatggttcactgagcttgatgtgtcttccatcaatgaatacgtcagagcagatgatcttgaagttatgctacgtgaggccatggctcatcctgcagtagaaggcataatgctgtggggtttttgggagctgtttatgagtagggacaatgcacacttggtgaatgcagaaggtgacatcaatgaggcagggaaaaggttcctagctctaaaacaagagtggctttctcacagccgtggccatgttgatgaacaaggccaatacaacttcagaggctttcatggaacatacaatgtgcaagttgtgaccccatcaaagaaaatttctaagacatttgtgcttgacaaaggtgacacgccactggtgctgtccattgatttataagcattctgcctcaccccaagaactaaagttggtgtcttttttatatccttgggttcgatgaagcactgtgttggtggtttattgttgtggatttaagttgtctgcaatatgcacaactgcacaaaatctcgacaaaaaagtatattgtttcagcttataaatatacttgtaagaaactgaaaagtaaatgaaaatgatacttgtttgatcttataaactgcatacaa

SEQ ID NO: 7761 - DNA, 3262 bp, Phaseolus vulgaris
cgaatagtaactcttccgagtcgagttacgatctccaagttacgagttttttttccctctccgatccgcctccgagttattggaaagaactgatcagagcagatcaaatggatttaccctgttatgaagatgatgaggagatattgagataattatgcgcatgttcacatgaagcgtttttcatccaatgacaaatttcatagtcaaggtacaaacgcagcgtttctcacagcagcaccacctcctaatcgtacgaaccgctccttttctcgttggaccgaaccggagacacacaaacaacaactagttcattttgatttagatcatggcaggaaacatttctgatccaagtgggagcaagggtgcaaatattttacttaatcatgacttttctagtggcctgagctcctggcatctcaattcctgttctggctatgtgatttcagctgaaacaggtgctcaaggaggaatttcgagggagttgagtgctaattatgctgttatcactgaccgaaaggaatgctggcaaggccttgagcaagacatcacagatagaatttccactggttacacttacacagttttggcttgtgtgggagtatccagtctttctcagggatctagtgatgttctagctactctgaaactagaatatcatgattcagctactagttacttgttcattggaagaacttctgttaataaggatagctggcaaaagttggaagggacattctcattgtcaactatgcctgatagggttgtattttatttggaaggacctgctcctggagttgacctgctcatacgatcagtggagataaactgttccactccaaataataataccacaagcacagcatgtgtttcagcgggagatgacaacatcatcatcaacccgcaatttgatgatggtctgaataactggtctggaagaggctgcaagattatgttgcatgattccatgaatgatgggaaaattgttccaaaatcagggaaattctttgcatctgcaacagaacgcacacagaactggaatggaatccagcaagatatcactggacgcgtgcagcgcaagctggcctatgaggtcactgcttcagttagaatctttggaaacaatgtatctactgctgatgtacgtgctactttgtgggtccaagcaccagatcttaaagaacaatatataggcattgcaaatttgcaggcaacagataaagattgggttactatgcagggaaaattccttctaaatggttctccatcaaaagtggtcctttatttagaggggccccctccaggcactgacattcttctcaataatttggtcttaaagcatgcagctaaaacacctccttcatccccaccagatgtaaagaatgttacttttggggttaatataattgagaacagcactctagctgatggcaccaatggatggtttccccttggcaattgcactttaagtgttaaaactggttcaccacatatagttccaccaatggcaagagattctcttggtcctagtgaactcctaagtgggcgctacatccttgtaactaatcgaacacaaacatggatgggtcctgctcagatcatcactgataaagtgaaactctttttgacttatcaagtgtctgcttgggtcaggattgtctcaggatcatcagggccacagaatgtgaatgttgcccttggtgttgacaacgagtgggtcaatggaggacaaacagaggtttctgataacacgtggcatgaaattggagggtcctttagaattgaaaagcagccatcaaaggttatggtttatgttcaaggtcctgcttctggggtggacttaatggtggctggacttcaaatttttcctgtggatagacatgcaagattgagatatttaaagatccaaacaaataagatacgtaaacgtgatgttatcctgaaattctctgggctggactctggcagctacgctaacacctcagtgcaagttagacaaacacagaatgatttcccaattggaacatgcatcagtagatcaaacattgacaatgaggactttgttgatttcatggtgaagcattttaactgggctgtgtttggaaacgagttaaagtggtattggactgagccacaacaagggaatttcaattacaaggatgctgatgatctgttaagcctatgtcagaagcacaatatacaaactcgtggtcattgtatcttctgggatgtggatggcgtagttcagcagtggatcaaatcactgaacaataacgatttgatgacggctattcagaaccgcctaaacgggcttctaactcgttacaagggcaagtttaatcactatgatgtcaacaatgaaatgctgcatggttcattctttcaagatagactaggcaaggatataagggctaacatgttcaaaactgcaaaccaactagacccttctgctacactctttgtgaatgattatcatgttgaggatggatgtgacaccagatcatgtccagataagtacatccatcatattcttgatttgcaagagcaaggtgccccagttggaggaattggaattcagggccacatagatagtccaatagggcctattgtgagttcttcccttgacaagttgggtattcttggtctacctatatggttcactgagcttgatgtgtcttccatcaatgaatacgtcagagcagatgatcttgaagttatgctacgtgaggccatggctcatcctgcagtagaaggcataatgctgtggggtttttgggagctgtttatgagtagggacaatgcacacttggtgaatgcagaaggtgacatcaatgaggcagggaaaaggttcctagctctaaaacaagagtggctttctcacagccgtggccatgttgatgaacaaggccaatacaacttcagaggctttcatggaacatacaatgtgcaagttgtgaccccatcaaagaaaatttctaagacatttgtgcttgacaaaggtgacacgccactggtgctgtccattgatttataagcattctgcctcaccccaagaactaaagttggtgtcttttttatatccttgggttcgatgaagcactgtgttggtggtttattgttgtggatttaagttgtctgcaatatgcacaactgcacaaaatctcgacaaaaaagtatattgtttcagcttataaatatacttgtaagaaactgaaaagtaaatgaaaatgatacttgtttgatcttataaactgcatacaatcct

SEQ ID NO: 7762 - DNA, 3163 bp, Lupinus angustifolius
agagagaaggaaataagagtagccttcactctcaaatttgctgagagtgggtatataatgaagatgttcagtgcttgctgcttcacaaacaaaatctccaagtttctttctcacaagaagcacaagaaatctcagcctcagatcatagcgggaaacatctctggttcaagtaggagcatggctactaatgttttacttaatcacgacttctctggagggctgaactcttggcgtctcaattgctgcaatggctatgtaatttcagctgaagcaggttctcacaaaggagttggttcggatagtaattatgctgttatcaccgaccgaaaggaatgctggcaaggtctcgagcaagatattacggacagaatttccattggttctacttacacggtttcagcttctgttggagtatctggtctgtctcagggatctgctgatgttattgctactgtgaaacttgaatataatgataaacccactagttacttgttcatcggaagaacatctgttgtaaaggatagctgggaaaagttggaagggacattttctttgtcaactgtggctgatcgggttatattttatttggaaggacctgcttctggagttgacctgcttatacgattagtagagatcaactcttccagtccagatgataatgccacaagcataggatgtgtttccactggagatgacaacattataataaacccacaatttgaggatggcctgaataattggtctggaagaggctgcaagattctgttgcatgactccatgggagatgggaaaattctccctcagtctgggaaaggttttgcatctgcaacagaacgcacacaaagctggaacgggattcagcaggagatcactgcacgagtgcagcgcaagcttgcctatgaggtcactgctttagttcgaatatttggcaacaatgtcactacttctgatgttcgagctactttgtgggtccaaacaccagatcttcgagagcagtatataggcattgctaatgtgcaggcaacagataaagattggattaatatgcaaggaaaattccttctaaatggttccccatcaaaagttgtcatttatttagaaggtccccctccaggcactgacattcttgtcaatactttgtctataaagcatgcagctaaaacacctccttcaacacaaccagatgtaaagaatgttgcttttggggttaacgtaattgagaacagcagtctggctgatggcaataatggatggttcccccttggtaattgcactttaagcgttagaactggttcaccacatataattccaccactggcaagagattctctcgggcctcatgaactcctaagtgggcgctacatccttgtaaccaatcgcacacaaacatggaatggtcctgctcagacaatcactgagaaactgaagctctttttgacttatcaagtgtctgcttgggtccggattggttcaggatcaaatgggccacagaatgtgaacgtagcccttagtgttgacaaccagtgggtcaatggaggacaaactgaggtttctgatgacaggtggcatgaaattggtgggtcctttagaattgaaaagcagccatcaaaggttatggtttatgtccaaggtcccgctgctggtgtagacttgatggttgctggacttcaaatttttcctgttgatagacatgcaaggtttagatatttaaagatgcagacagacaagatccgcaagcgtgatgttatcatgaaattccctgggctggattctagcagctaccccaaaacctcggtgcaagttagacaaatacgaaacgatttcccaattggaacatgtatcagtagaacaaatattgacaatgaagatttcgttaactttgtggtgaaacattttaactgggctgtgtttggcaatgagttgaagtggtattggactgagccacaacaagggaatttcaattacagggatgctgatgatctgttaaacctgtgtcataaaaacagcatacaaactcggggtcattgtatcttttgggatgtggatgatactgtccagcaatggattaagtcactaaacaaaaatgatttgatgacggctgtccaaaatcgcttaactggcctgctgactcgctacaagggcaagttcagtcactatgatgtcaacaatgaaatgctacatggttcattttacccggatagactcggcaaggatatcagggccaacatgttcaaaactgcaaaccaactagacccatcagctactctttttgtgaatgattatcatgttgaagatggatgtgacaccagatcatgtccagaaaaatacattcaacatattctcgatttgcaagagcaaggtgcacccgttgggggaatcggaattcaaggccacatagacactccagtggggcctatagtttgttcttcccttgataaactgggtattcttggtctacctatctggtttacggagcttgacgtatctgccattaacgaatatatcagagcagatgatctggaagttatgctaagggaagctttggctcaccctgcagttgaaggtataatgctgtggggtttttgggagttgtttatgagcagggacaatgcacacttggtgaatgcagaaggtgatatcaatgaagctgggaatagattcctagctcttaaacaagagtggttgtctcacagacatggtaatgttgatgagcaaggtcaattcaacttcagaggctttcatggaacatacaatgtccaagttgtgactgatacaaagaaaatttctaagacatttgttcttgacaagggtgattctccactggtgatatccattgatatataagcatcccaattcacccatgaacttatattcacaatttgttttattttattttctttggcttgctgaaatataaagttggtgttttattgttaatatgttatattgattgggctctatcactctggcacataaataaaatcttaagtgaccaaaacatgcgttttcatacttagtgtgacctccttatgtactactttattcttcagaaccttgtacccatttaatgtgtggtgaatttgcataatttccatggtgttccacctatggtatattctgtaactttaattcgtctacaatggtgtttgttactttggtttaa

SEQ ID NO: 7763 - DNA, 3404 bp, Cicer arietinum
ctgaaagcgcttgaaaattcaattccacaagttgcatacgtaggaaattggaaatgtacttatatttttcaaatgcatacttattacgggtagaaaagtgatccgcacctaacactgcaaaatcttgcaatctaagtttcacacaaattggataggatctttttcaaagttaaattaattaaccaaaagaatgattccttagccttcgatcatcacttaaccttttattccaattcaagcattactaatctgcaagccaaagcaaaaaccacagatacaaaaccaaaaacaaaaacagaaaaaggaaaaaaaattatacaagaaaaaacggtgatcccaaagttttgaattaaattatgaaatatgagtggaaagaaaatttgccggttggtccctcaattttccttagccttcactcgcaaatttcgtaagcgagtgtgtatatatatttgatgaagaggttcttcacaaagtgtgtctcaaagtttcactcccactcgaagcacaagaaatctcactctcagataatggcaggaaatatgtctggtccaagtgggagcaaggctgctaatattttgctgaatcatgacttctctggtgggctgaattcttggcgtctcaactgctgcaatggctatgtaatttcagccgaagcaggcagtcaaggtggaattttgttggagtcggaacataattatgctgttatcactgaccgaaaggaatgctggcaaggtcttgaacaagatatcacagacagagtttccatgggttccacttacatggtgtccgcttttgttggagtatctggcctttctcagggatctgctgatgttctagctacactgaaactagaatatcatgattcagctacacattatgtgttcattggaagaacttctgttaaaaaaggtagctgggaaaagttggaaggaacattttcactgtctactaagccggatcgggttatattttatttcgaaggacctgctcctggagttgatttgcttataagatcagtagagatcaactgttccagtccaaataacaatgccacaaacacagaaggatgtgtttctactggagacgaaaacatcataataaatcctcagtttgaggatggcctgaataattggtcaggaagaggctgcaagattgtgttgcatgattccatggctgatggtaaaattgttccgaagtctgggaaattctttgcgtgttcaacagaacgaacacaaaattggaatggaattcagcaggagataaccggacgcgtgcagcgcaagcttgcctatgagatcgctgctttagttcggatatacggcaacaatgtcactaatgccgatgtacggtctactctgtgggttcaaacaccagatctccgagagcagtatataggcattgcaaatgtgcaggcaacagatacagattgggtgacaatgcagggaaaattccttctaaatggttcgccgtcaaaagtggttctttacttagagggccctcctcctggcactgacattcttgtcaatactttggttgtaaaacatgctgctaaaacacctccttcaacaccaccaaatgtacagaatgttgcttttggggtaaatgtaattgaaaacagcaatctatctgatgacacaaaaggatggtttcctcttggtaattgcactttaagcgttaaaacaggttctccacatataattcccccaatggcaagagattctcttggacctcatgagctcctaagtggccgctacatacttgtaactaacagatcacaaacttggaatggtcctgctcaggtgatcactgataaattgaagctctttttgacttatcaagtatcggcttgggtccgaattggttctggttcaaacgggccacaaaatgtgaatgttgcacttggtgttgacaaccagtgggtcaatggaggacaaaccgaggtttcggatgacagatggcatgaaattggtggatcgtttagaattgaaaaacaaccatcaaaagttatggtttatatccaaggtcctgcttctggtgtggattttatggttgctggacttcaaattttccctgctgatagacatgcaaggtttagatatttaaagatgcagacagacaagatccggaagcgtgatgttgtcttgaaattccctgggctagactctagcagctaccctaacaccacagtgcaagttagacaaacgcagaacgatttcccgatcggaacatgcatcagcagatcaaacattgacaatgaagatttcgtcaacttccttgtgaagcacttcaactgggctgtgtttggaaatgagttgaagtggtattggactgaaccacaacaagggaatttgaattacaaagacgccgatgatcttttaagcctgtgccaaaagtacaagatagaaactcgtggacactgcatcttctgggaagtggacggaaccgttcaacaatggattaaatcgctgaataaaaacgatttgatgacagccgttcaaaaccgtttaacaagtcttctgactcgatacaagggtaaattcagtcactatgatgttaacaatgaaatgctgcatggttcattttaccaagatagattagggaaagatataagagcaaacatgttcaagattgcaaaccaattagatccatctgctacattatttgtgaatgattatcatattgaagatggatgcgacacgagatcatgtcctgataagtacattcaacacattcttgatttgcaagagcaaggtgccccagtcagtggaattggaattcaaggacacatagatagtccaatcgggcctatcgtttgttcttcgcttgataaattaggtattcttggtctacctatatggtttactgagcttgatgtgtcttctttgaatgaatatgtgagaggtgatgatcttgaagttatgcttagagaagcttttgctcaccctgctgtagaaggcataatgttgtggggattttgggagttgtttatgagtagggacaatgcacatttggtgaatgctgaaggtgatattaatgaagctgggaaaaggtttctagctttgaaacaagagtggctatctcacagtcatggtcatgttgatgagcaaggtcaatataattttagagggttttatggaacatataatgttgatgttgtgacaccatcaaagaaaatttctaagacatttgtgcttgacaaaggtgattctccattggtggtgtcctttgatttataagtaaaagcatattgtcatgaaagaattaatgtgtgtccacttttatcattgagtttgatgaaacacaatggtgttgtaaattgtaatgttgtctctattgggttctgccactttggcaaataaataaaattgttacacttgttgttgacttgttggtcatactaacta

SEQ ID NO: 7764 - DNA, 3425 bp, Medicago truncatula
caaaatcttacgtacaatctaagtctcacacaaatccgatttattcatttaattaaggaatcaaagaatcattcctttacctttgatctttacttacttcgcctttcatttcaattcaagtattactaatctgcaagccaaagcaaaaagcacagagacacaaccccccaaaaaatattcaataaatattcgtgatcccatagttttgaatgttaattgattataaaattcatttaatcccaaagtttggattatgatatttgaattggaaggaaattttctggttggtcacccaattttccttaggcgttactcgcaaatttgagtggggggtgtattagtatatatagttaatgcatgaagagattcttcacaagctgtgtctcaaagtttcactcccactcgaaacataagaaatctcactctcactctcaggtgttgaaattcttgttagactgaacaatacttgtgccggtgttggataccgaacaagccttcaatatgaagtgttgatgctaaatagatgttaaacacacacgtagaacacatcacaaataatggcaggaaacatctctggtccaagtgtgagcaatgctgctaatattttgctgaatcatgacttctcaaatgacctgaactcttggcatctcaattgctgcaatggctatgtaatttcgtccaaagcaggtggtcaaggtgtaaatttgatggattcggattgtaattatgctgttatcaccgaccgaaacgaaggctggcaaggtcttgagcaagatatcacagacagaatttccattggttctgcttacacggtttcggcttttgttggagtatccggcctttctcaggaatctgttgatgtgaaagctacactgaaactagaatatcatgattcagctacaaattatttgttcattggaagatcttctgttatgaagggtagctgggaaaagttagaaggaacattttcactgtccactaaacccgatcgggttgtattttatttggaaggacctgctcctggaattgacttgcttataagatcagtagagatcaactgttccattccaaatgacaataagttcataagtacagaagcatgtgtttctactggagatgaaagcatcataataaacccacaatttgaggatggcctgaataattggtctggaaggagctgcaagattgtgttgcatgattccatggcagatggtaaaattgttccaaagtctgggaaatattttgcatgcgcaacagaacgaacacagttctggaatggaattcagcaggagataactggacgtgtgcagcgcaagttggcctatgagatcactgctttagttcgaatatatggcaacaatgtcactaatgccgatgtacgagctactttgtgggttcaaacaccagacctccgagagcagtatataggcattgcaaatgtgcaggcaaccgatacagattgggtgacgctgcagggaaaattccttctaaatggtcccacatccaaagcggtcctttatttagagggacctccttctggcaccgacattcttgttaatactttggttgtaaagcatgctgctaaaacacctccttcaacaccaccagctgcacagaatgttgcttttggagttaatataattgagaacagcaatctttctgatgacacaaaaggctggtttacccttggtaattgccctttaactgttaaaaccggttctcctcatatacttccaccaatggcaagagaatctcttggacctcacggaatcctaagtggccgctacatacttgtaactaataggactcaaacttggatgggtcctgctcaggtgatcaccgagaaattaaagctatttttgacttatcaagtatctgcttgggtccggattggttccagttcaaatggaccacagaatgtgaatgttgcccttggtgctgacaatcagtggatcaatggaggacaaaccgaggtttcggatgatagatggcatgaaattggtggatcctttagaattgaaaagcagccaacaaagattatggtttatatccaaggtccagcttctggtgtagacttaatggttgccggacttcaaattttccctgttgatagacatgcaagatttagatatttaaagatgcagacagacaagattcggaagcgcgatgttgtcctgaaatttgccggactagactctagcagctaccttaacaccatggtgcaagttagacaaacacaaaacaatttcccgattggaacatgcatcagcagatcaaacatcgacaatgaagattttgtcaacttccttgtgaaacacttcaactgggctgtgtttgcaaatgagttgaagtggtattggactgagccacaacaagggaatttgaattacaaagacgctgatgatcttttaaccttgtgtcagaagtacaagatccaaactcgtggacactgcatcttttgggaagtggatggaaccgttcaacaatgggtcaagtcgctgaataaaaacgatctgatgacggccgttcaaaaccgcttaaccagtcttctaactcgctacaaaggtaagtttagtcactatgatgttaacaatgaaatgctgcatggttcattttaccaagatagattaggcaaagatataagggcaaacatgttcaagactgcaaaccaactagatctgtccgctacattgtttgtgaatgattatcatattgaagatggatgtgatacaagatcgtgtccaaataaatacattgaacacattcttgatttgcaagaacaaggtgcacctgttggtggaattggaattcaaggacacatagatagtccagttgggcctgttgtttgttcttcacttgataaattaggtattcttggtttaccgatatggtttacagaacttgatgtgtcttctatgaatgaatatgtgagaggtgatgatcttgaagttatgcttagggaagccatggctcaccctgctgttgaagggataatgttgtggggattctgggagttgtttatgagtagggataatgcacatttggtgaatgcagaaggtgatattaatgaagctggaaaaaggtttctagctttgaaacaagagtggctatctcatagtcatggtcatgttaatgaacaaggtcaattcaactttagaggattttatggaacatataatgtggaaattgtgacaccatcaaagaaaatttctaagacatttgtgcttgataaaggtgattccccaatggaggtgtcaattgatttataagcaaagtatattgctatgaattaatgcctgtctttttattttctttcttatcattgggtttgatgaaacacaatgatgtaaattgtaatgttgtctctaatgtgtactgccaccttggcaaataaataaaatggttttacctcttggttattctaa

SEQ ID NO: 7765 - DNA, 2117 bp, Glycine max
gtcggacttgggcaaggcaaccctaggtagaaaaatgtaggtatgttgttgtgttgtttggtgatttgtggaaacgtaatcaacatttcgcagtgtggaggatcgtcttcttcatccctcccacaccgagttcagttcagttagggtatctattttttaatggctaatagatccgatccggatattgatgatgattttcttgagctttataaggagtacactggccccctggggtctgctactacaaacacgcaagagagggcaaaatcaaataagaggtctaatgcagggtctgatgaggaggaggaagcccgggaccctaatgctgttccaaccgatttcaccagccgagaagctaaggtttgggaggctaagtcaaaggctacggaaaggaattggaagaaaaggaaagaggaggaaatgatctgcaagctttgtggagaatcagggcatttcactcagggctgcccatctactcttggagcaaatcgcaagtctcaagatttctttgaaaggataccagccagagacaaaaatgtgcgggcacttttcacggagaaagttttaagcaagattgaaaaggatgttggctgcaaaattaagatggatgagaagtttattattgtcagtggtaaggatagattaattttggccaaaggtgttgattctgtgcacaagattcgagaggagggtgatcaaaggggaacatctagttctcaaatgacccgatcaagatcacctgaaagaagtcctgttagtgctcggtttcaacgctctgagccccaaaggtctcattctggacctcgaaatacatctcagtttcaacaaagatttggtaggcaagagcgggcggttgaagaccgtatccgggatgacgtgcaaaagttttctagaggttctccacaagcttatggaaatagtggagctagaggtcgttcaagccagtcaagatctccaagacatgccccttatacaggaaactcatataactcatttgagggtcgtaatcaaaacatgggtgcttataggaatgatgggtgggattctcatagaagagaatctggtatccggcctggtcatcagtttgattacagcgcctccccacagactttagaagaattagagttggagtacaagaatgaggcagcagagctaatgaaaatccgtgacagagaagaagatgaagaaaatttcaagcatcgtgaggctattagagatttgagggagaagtacatgagcaaagtttccttggtaagggacacacatgcaaaacagtgggaaggatttcttcagcttgatgcgcagaggcgtcaacagcaggcagttcaacagatgccttctggttatcggggttttaaacagcagagctttcctgaatatgatggatccactgccaatcctcctccttatgctggttctaatctaccattggaatcgaggaacaggttctcagacaacatggaaacttatcctaataggcctcatgataattttggtgaatttcataggcgtggagatttcgcaaaagcttacaacagatattaaaattctatatatcaattgagtgggtccagattgatcgagtaggctgtttaatgcactggaggccgtaagggtaggtaagtatgttgattaatcttaggattgggatggacatgcatttcggttggcgggtccggttttcctttgaaatatagttgctcagtcgtgttaagaactttgctgcaagttgtgatacattattgggttattatgtttgactggtaacgtgctactgcagcttggattgtgttatgaggagatcccttgaaagattgattgcttttagcagaatcaaatttacgttttgttaccacgcaggtgttttatgtaccctatagggtgcttatgatttatttacttgctataaatttcttgagggggtggtctggttagtatctttaacacttttctgaatgatttacctacaacgaaatggttttacgataatgaatgttatcggatgtgcttattttcagttgccagtttggcataaaagtcatgtattggtgataagtgaagggttttcgaagatgtttagcttaaacaatcaccatttatttgatctctatgacttt

SEQ ID NO: 7766 - DNA, 3122 bp, Cajanus cajan
gggtcgggctaaacaaccctaggtagaaaaatgcagatatgccgtgtggagtagtgatttgtggaaacgtaatcaacaattcgtagtgtggaggatcgtcttcttcatcccaaaccgtaggtctctttctctcttcaaatcaaatgtttcaacaatttcacttcattcgattatcgccttagcttctttccttttaggcctctcatttcaatgctcgcttcgcaacttccttcccttttcttgttttcgacgccttttcttttctctctgaatttttgtttctttatattcttctattgtgcgtgttttcgaattaatactttattgagtgactgcaactaccagttagagcacactaggtcgtaattggctatatgccgcggcttatttatcgaactcgttcatttcggtgatgatctgttatgcgctaatagtagcgtcttcgtgtgtgctagcaattgttaaaacctacgtgttcctttacaatcacacttagttgaaattgatccaaaacgatgcctaatttcattgaaattgatggtaaattattcatgttgtgttcctcaatggaatgaatagctttttctattggtttttccctttcctgtaattttagtggatttcagtgttgctacttcattcttgagcatgcaggagttcaatccagatagggtatctcatttttaatggcaaatagaccagatccggatattgatgatgattttcgtgagctttataaggagtacactggtcccctgggatctgctgccacaaacacgcaagagagggcaaaatcaaataaaaggtctgatgcagggtctgatgaagaggaggaagctcgagaccctaatgctgtcccaactgatttcaccagccgagaagctaaggtttgggaggctaagtcaaaggctacagaaaggaattggaagaaaagaaaagaggaggaaatgatctgcaaactttgcggagaatcagggcatttcactcagggttgtccatctactcttggagcaaatcgcaagtctcaagatttctttgaaagggtacctgctagagacaaaaatgtacgagcacttttcacggagaaagttataaataagattgaaagggatgtgggctgcaaaattaaaatggatgaaaagtttattattgtcagtggtaaggatagattaattttggcaaaaggtgttgatgccgtgcacaagattcgagaggagggtgatcaaaagggatcatctagttcccaaatgactcgatcaaggtcaccagagagaagtcctgttggtgctcggtttcaacgctctgagccccaaaggtctcattctggaccacgaaatacatctcagtttcagccaaggtttggtaggcaagagagagctgttgaagaccgtatccgggaagacgttcaaaagtttactagaggttctccacaagcttttggaaatagtggagctagaggtcgttcaagccagtcaagatctccaagacatgccccttatacagtgaactcatataattcatttgaaggccgtaatcaaaacatgggtgcttataggaatgatgggtgggattctcatagaagagaatctgttatccagcctggtcatcagtttgattataatgcctcaccacagactttagaagaattagagttggagtataagaacgaggcaacagagctaatgaaaattcgtgacagagaagaagatgaagaaaatttcaagcatcgtgaggctattagagatttgagggagaagtacatgaataaagttgcattggtaagggcaacacatgcaaaacagtgggaagagtttcttcagcttgatgcacagaggcgtcaacagcaggcaatccaacaaatgtcctctagttatcggggttttaaacagcagagctttcctgaatatgatgggtccaatgtcaatcctcctccctttactgggaccaatttacccttggaatcaaggaacaggttctctgacaacatggaaacctatcctactaggcctcatgataattttggtgaatttcataggcggggcgattttgcaaaagcttacaacagatattaaaattctatatatcaatcaagcgggtccagattgatcgagtaggcagttaaatgcacagaaggccataagttaggtaagtatgttgattaatcttaggattgggaaggatatgcaatttggttgacggatgcagttttcttttaaaatatagttgttcagtcttgttaagaactttgctgtaagttttgatgcattattgggttattatccttaactggttacgtgctactgctgctgggattgtgttgcgcaagatcctttaaaagagtgattgattttactagaatgaaatttacgttttgttaccacgcaggtgtttgatgtacctaccctattgggtacttattggtttactgaggtattgattttctaggttgatgtgttcattcttgctataaatttcttgagcggatgtgttctggttggttattaattagtattcttaacactttcctgtgatatcacatcgaatgatttccgacatcgaaatgattttacgaaaatagatggtatcaagatgtgctttagttttagtttcaagcttggcatagaagtcgtgaatattttacaatttaagagaaagtctgttttaatcacatttttaacgttttattattgactaaaatttattgaatatcataatattatgtggatctcaattattatttatcaagtttttcttatcacttttataatttttaatcataaatagagtgtaatagtattcctttaaaaaaaagagagtaacttttcggttgttttggatgataatttgtcctgaaatgtcctgcatggtacatatgttttcttcattgtaactatagtagaatggcctgcattggacaggaaattttaaaaaaaatttaggaaatttaaaactctaaaaatttgaattacattaatgtgatttttcatcatttattagagtgatataagtgaagtagagagtgagcaaaatcagataagtgaaagaggggaaaaaaaaaaagggatgagaaagaaaataaagaaagcggagagagaagagaattgagagaactaagatatata

SEQ ID NO: 7767 - DNA, 1973 bp, Phaseolus vulgaris
atgcaaccctaggtagaaaaagaaaatgtagatatgtggtcatttcagtgatttgtggaaacgtaatcaacattttgcagcgtggaggatcgtcttcttcatcccacaccgagttcaattcagctagcatttatattttttaatggcaaatagaccggatccagatattgatgatgactttcgtgagctttataaggagtacactggccccccaggttctggtactacgaacacgcaagagagggcaaaaccaaataagaggtctaatgcagggtctgatgaggaggatgaagctcgggaccctaatgctgttccgaccgatttcaccagccgagaagccaaggtttgggaggctaagtcgaaggctactgaaaggaattggaagaaaaggaaagaggaggaaatgatatgcaagctttgtggagaatcagggcatttcactcagggctgcccgtctacccttggagcaaatcgcaagtctcaagatttctttgaaaggatacctgccagagacaaaaatgtacgggcacttttcacagagaaagttttaagcaagattgaaagggatattggttgcaaaattaagatggatgaaaagtttattattgtcagtggtaaggatagattagttatggcaaaaggtgttgatgcggtacacaagattcgagaggagggtgatcaaaggggatcatctagttctcaaatgacccgatcaagatcacctgagagaagtccagttaatgcaaggtttcaacgctctgagccccaaaggtctcattctggaccacgaaatacatctcagtttcaacaaaggtttggtaggcaggagagggctgttgaagaccgaatccgggaggatgttcaaaagtttgctagaggttctccacaagcttatggaaatagtggagctagaggtcgatcaagccagtcaagatctccaagacatgccccttttacaggaaactcatatagttcttttgatggtcgcaatcaaaacatgggtgcttataggaatgatgggtgggattctcatagaagagaatctggtatccagcctggtcatcagtttgatttcaatgcctctccacagactttggaagaattagagttggagtataagaatgaggcagcagagctaatgaaaattcgagacagagaagaagatgaagaaaatttcaagcatcgtgaggctattagagatttgagggagaagtacatgagcaaagttggcttggtaagggcaacacatgcaaaacagtgggaagattttcttcagcatgatgcgcagaggcgtcaacaacaggcagttcaacagatgtcatctggttatcgaggttttaaacagcagagctttcctgaatatgatgggtcctctgtcaatcctcctccctatgctggggccaatttaccattggattcaaggaacaggttctcagacaatatggaaacttatactactaggcctcatgataattttggtgaatttcataggcgtggagattttggaaaagcttacaacagatattaaaattctctagatatcaatcaagtgggtccagattgctcgagtaggcagtttaatgcactggaggacataaggtaggtaagcatgttggttaatcttaggacattcgtttcggttacgaatccagttttcgtttgaaatatagttgctcagtcttgttaagaactttgctgttagctgtgatgcgttgggttattatccttaactggttacgtgctactgcagcttggattgtgttacgaaagatcctttgaaagattgattgattgattttagtagaatggaatttacgttttgttaccacgcaggtatttggtgtaccctatagggtacttatggtgtgctgggatattgaactctaggtttgtttgttcataaatttcttagtatcgaatgattttacccacaacaaaatggttttctataataattggtatcgagacgtgct

SEQ ID NO: 7768 - DNA, 2007 bp, Lotus japonicus
acactctgtaaacataatcgttagattacactgcgagaacgaagaagtgaggttcatcctctcctctccattccacaccacaccacaccacaccacaccgtaagtctcactctgcccctgaatcaaatcagattaggttattcatcgctcaatctcttttgtttccgctgtattcaactctctcttctcgcaatttctcgttcatgttttccgattcgctgtgttttcaatccaagggtttatcgaactactagaaccacaggtgggttcaatttcacagggtattttttttcatggcgaatagacccgatcctgataatgatgatgattttcttgagctttataaggagtacactggcccattaggatctactgctgctacgaatactcaagagggggcaaaatcaaacaagaggtctaatgcagggtctgatgaagaggacgaaccgagggaccctaatgccgtcccgaccgatttcaccagcagagaagctaaggtttgggaggctaagtcgaaggctactgagaggaattggaagaagaggaaagaggaagaaatgatctgcaaattatgtggagagtcagggcatttcactcagggttgtccatctacccttggagcaaaccgcaagtctcaagatttctttgagaggatacctgcaagagacaaaaatgtaagagcgcttttcacggagaaagttataagcaagattgaaagggatactggctgcaaaattaagatggatgagaagttcattattgtcagcggtaaggatagattgattttctccaaaggtgttgatgctgtgcacaaggttagagaggagggtgatcagaagggaacttctagttctcacaggagcaagtcaaggtcaccagagagaagtccagttagtgctcggtttaatcgctctgagccccaaagatctcattctggaccacgaagttcatctcagtttcaacaaaggtttagcaggccagagagggttgttgaagaccgtgtccgggaggacgttcaaaagtttgctagaggttctccacaagcttatggaaatagtggagctagaggtcgttcaagccactcaagatctccaagacaggccccttatccagggaattcatataattcatttgatggtcgtaatgaaaacatgggtacttataggaatgatgggtgggattctcatagaagagaatctggtttccaacctggtcatcagttggattacagtgcctcccctcagactttagaagaattagagttggagtataagaacgaggcagtggagctaatgaaaagtcgcgaccgagaagaagatgaagaaaatttcaagcatcgcgaggctattagagatttgagagagaagtacatgagtaaagttgctttattgagggctacacatgcaaaaaaatgggatgaatttcttcagcttgatgcccggaggtgtcaacagcaggcaatccaacacatgcccccttctggttatcggggttataaacagcagaatttttccgaatatgatgggtccactgccaatcctccctatgctggaaccaattttcccatggaaccaaagaacaggttctcagacactatggagacttatcctacgaggtctcatgataactttggtgaatttcagaggcgtggagattttgcaaaagcatacaacagatattaaatttcctttttcaatcaagtggtgagtaattttactgacttaatgtgtcaaacctactgaaaatgaattcaatattttagttgtcttttggttccttccttcctcaattgtacagttcttaaacttgtttcactttggtgaacattatcagatatggatcctggctcagggttggattgttattatatctaattcatctagaagtatatactggtcttcagggcccactctgagatgttgttgatgttgtcgcatacaagggtctaatgttgtaattacatagatctttagttgactaagggtgtcattgcagtttgttagggtg

SEQ ID NO: 7769 - DNA, 2128 bp, Arachis hypogaea
aacgtgaacataacataaacttgaagggcgaacgtagaattaagcaagaaaaaagcgagatgggctgagactgagcgccttgggccgcacccctaaggagacatagggtttcactctcacagctcatgtctttctcgttctgctgtttctcaaatcaaatcatctctagcacacgcaccggctaccaccatctcttacctttcgtttcatgcattttcgataatctcatctcatagctgttttcttttctctgagtcttctttctccacaatccacataggtggcgaccaaactccaaaccacgggcggaagccactctctctagcggccaccaggagttcaatatagataaggccttgtaatggcaaatagagctgatcctgatattgacgacgatttgcgtgatctttacaaggagtacactggtcctctgggatctgctcctaccaatacgcaagatagggaaaaatcaaacaaaaggtctcatgctggttcagatgaagaggaggagccacgggaccctaatgctgttccaaccgatttcaccagccgagaggctaaggtttgggaggctaagtcaaaggctactgagaggaattggaagaaaaggaaagaagaggaaatgatctgcaaactttgtggagaatcagggcatttcactcagggttgtccgactactcttggagcaaaccgcaagtctcaagatttctttgaaaggatacccgcaagggataaaaatgtaagagcgcttttcacagagaaagttctaaacaagattgaaagggatattggctgcaaaattaagatggatgagaaatttattattgtcagtggtaaggatagattaattttggcaaaaggtgttgatgcggtgcacaagattagagaggagggtgaacaaagaggaacttctagttctcacatggccaggtcaaggtctcctgagcaaagtcctgttggtgctcggtttcaacgatctgagccccagaggtctcattctggaccgcgaaatgcatctcagtttcaacaaaggtttggtaggcaagagagagctgttgaagaccgcgtgcgagaggacatgcaaaagtttgcaagaggttctccacaagcttatggtaatagtggagcaagaggtcggtcaagccattcaagatcaccaagacagcccccttacacagggaactcatataattcaattgatggccgcaatcagaacataggatcttataggaatgatgggtgggattctcacagaagagaatctgcagggatccaacccagtcatcagtttgattatagcacttcccccaagactttagaagaattagagttggagtataagaaagaggcaactgagctaatgaaaaaccgtgacagggaagaagatgaagaaaatttcaagcatcgtgaggctgttcgagacttgagggagaactacatgaacaaagttgctatgttaagggtctcacatgctaaacaatgggaagagtttcttcagcttgaagcccacaggcatcaacagcacacaatccaacaaatcccttctggttttggcagttataagcagcagaatttcaccgaatatgatggttctgctgtcaatcctcactatgctgggcccaacttacccttggaatcgaggaacaggttctcagacatggagaattatcctaccaggcctcatgataattttggtgaatttcagaggcgtggtggagattttgcaaaagctttcaacagatattaaaatgttatatgtgaatgaagtgggtccagcttgatggagaaaagtataatgcatggggaggccaaggtaggtaagtatgttgaataaacggtagggttagaatgggacatgcagtgtggttgatgaattcagttacctggtaaattagttttgtcaggacttcaatggaatattttgttatccgaaactggtaatgtggtactgcttttccgcctggttattgttgtgtagacatactctgtgttcagtagtaacattgattttggtagaacgaggttcatgcgtatattgtactattagagaatgcttattggggtttagcttctctaggtgtatgttggttggctcttgctacaaaattattcagggttctcattggta

SEQ ID NO: 7770 - DNA, 1067 bp, Solanum tuberosum
gtgtaaactacaaaattaagtgaagaaactatgtatagatttaccaacacagtaataggtttcttgaatttattcacactattagcatcaattccaatcataggtgctggattatggatggcaaggagtactacaacatgtgagaaattcctccaaacaccactcttgttcataggtttcataatcctcatagtttcattggctggtttcattggagcttgtttccatgttgcatgggcactttggctctacttatttgtcatgttgttcctcataggggcattgatggggctaactgtttttggttttgtggtaacaagccaaggtggtggaatggatgtgcctggtaaagtatataaagagtatcatcttcaaaattactcaccatggctaaggaaaaggattaaggatcctcaatattgggtcactattagagcttgtattttgggttccaagacttgtgctaatgttattacttggactccatatgattatcttaccaaagatttgactcctatccagtcaggatgttgcaaaccaccaacagcatgcaactatggattgacaacaatgacacaagaggcagattgttaccaatggaacaatgatccaaatttgttgtgctatgagtgtgattcatgcaaagctggagttcttgaagatgtgagaagggattggcaaaagatatcagttcttaatattgtcatgcttgtcttactcattggaatttattccattggttgttgtgcttttcaaaataccaagagggctgtatctgattacccacatggtgaaaaccgtatgtataaagtccgacccagatgggatttctactggtggagatggtggcacgacaggagacatcagttttattagaccaaaaatatgggcacttcgtttagttgcacatatcgttttccaaaagcaagatatcatcaaaaagtgatgctaattagtattctccttgttttcttcaatcccaacaaatattcctagcaaggtttttccacagcttgctttgatctccttttctgtacaaagaaaaagattttactactttatttcac

SEQ ID NO: 7771 - DNA, 1137 bp, Solanum melongena
cacccgtaggtagtagttataaagaaaggtgaaagaagaaaagcaaaatatgtatagaaaagaaagtgaagtgaagaaaatatgtataggttcagcaacacagtgataggtttattgaatctattcacactgttagcatcaattccaatcataggtgctggattgtggatggcaagaagcagtacaacatgcgagaaattcctccaaacaccactcttattcataggtttcataatcctcctagtttcattggcaggtttcataggagcttgtttccatgttgcatgggcactttggctctacctttttgtcatgttgttcctaataggggcattgatggggctaactgtttttggatttgtggtaacaagccaaggtggtggaatagatgtgccaggcaaagtatataaagagtatcatcttcagaattactcaccatggttgaggaagaggattaaggatcctcaatattggctcactattagagcttgtattttgggttccaacacttgtgctactgttattacttggactccctatgattatcttaccaaagacttgactcctatccagtcaggatgctgcaagccaccaacaacatgcaattatggactaacaacaatgacacaagattcagattgttaccactggaacaatgatcctaatttgttgtgctatgagtgtgattcttgcaaggctggagttcttgaagatgtaagaagagattggcaaaagatatctgttcttaacattgttatgctcgtcttgcttattggaatttactccattggttgctgtgctttccaaaacaccaagagggctacatctgattacccccatggtgaaaatcgtatgtataaagtccgacccagatgggatttctactggtggagatggtggcatgataggaggcatcaactttattaaatcaaaacatgacacttcttttcatttggtgtacaacgttctctggatgcaatatatcatcaaaagtgatgctaattaatactccctttgttttccttccatcccaacaaatatttctggctaggttttgtccatacagctttgatcaccttttctgtataaagaaaaagatttcactactttatttcacattctacactcttttttttc

SEQ ID NO: 7772 - DNA, 1077 bp, Capsicum annuum
tcagcatagtagtggaaaaatatgctgtgagtgatagtttcaaggaaaagctagtgaagtaggtaagtgaagaaaaatgtatagatttagcaacacagtgataggtttcttgaatctattcacacttttagcatcaattccaatcataggtgctggattgtggatggcaaggagcagtacaacatgcgagaaattcctccaaacaccactgttgttcataggtttcataatcctcatagtttcattggcaggtttcataggagcttgtttccatgttgcatgggcactttggctctacctgtttgtcatgttgttcctcataggggcattgatggcgctaactgtgtttggttttgtggtaacaagcccaggtggtgaagtggatgtgcctggcaaagtgtataaagagtatgatcttcagaactactcaccattgttgaggaagaggattaaggatcctcagtattgggtcactattagggcttgtattttgggttccaagacttgtgctactgttattacttggacaccctatgattatcttaccaaagacttgactcctatccagtcaggatgttgcaagccaccaacaaaatgcaactatggtttgacagcaataaaacaggaggtggattgttaccattggaaaaatgatccgaatatgctgtgctatgagtgtgattcttgcaaggctggagttcttgaagatatgagaagggattggcaaaagatctcagttcttaacattgtcatgctcgtcatcctcattggaatttactccgttggttgctgtgctttccaaaacaccaagagggctgaatcagattacccgcatggtgaaaatcgtatgtataaagtccgacccagatgggatttctactggtggagatggtggcacgacaggagacatcagctttattagaccgcacttgacccttgctcttcgtttggtgcacatcgttctgtaaaagcagcataccataaaaaatgatgctgattaatagtctcttgttttccttcaatttaaacaaatgttactactatctaggttttatccacaccttgctttgattgcct

SEQ ID NO: 7773 - DNA, 1132 bp, Nicotiana benthamiana
agacattccttcaaaaacacacacacacacacttaagagaaacttacaagctagtgaattaagtagctaaaagaaaatgtatagattcagtaacacagtgataggtttcttgaatcttttcacactgttagcatcaattccaataataggagctggattatggatggcaaggagcagtacaacatgtgaaaaattcctccaaacaccactcttgtttctaggtttcataatcctcataatttcattggctggtttcataggagcttgtttccatgttgcatgggcactttggatatacctttttgtcatgttgttcctcataggggcattgatggggttaactgtgtttggttttgtggtaacaagccaaggtggtgtggttgatgtgcctgggaaagtgtacaaagagtatcatcttgataattattcaacatggttgaagaagagaattaaggatccacaatattggatgactattagggcttgtattttgggttccaagacttgtgctactgttattacgtggagtccatatgattatcttaccaaagacttgactcctatccagtcagggtgttgcaagccaccaacagcatgcaactatggattgacaacactgtcacaggacccggattgttaccgttggagtaatgacccgaatttgctgtgctatgaatgtgactcttgcaaagctggagttgttgaagatgtgcgaagagattggcaaaagatatctgttcttaacattgtcatgctcgtcttcctcattggtatttactccattggttgctgtgctttccaaaacacaaagcgggctgtatccgattacccgcatggccaaaaccgtatgtctaaagtccgacccagatgggatttccactggtggagatggtggcacgacagaagacgtcagctttattagaccaaaaacttgccaaaatcttcgtttagtgcacattggtctgtaaaagttaatgatcaaaagggctgtcacttctctttgttttctcttcaatctcaatgaatatttcaagggattttcccacagcttttctatgtttattatagcttgttttgatttgatcgccttttctgtacaaagaaaaagattttactactacactttgtttcc

SEQ ID NO: 7774 - DNA, 999 bp, Nicotiana benthamiana
aagccagcacaaaaaagaaaaacccaacaacataaagaaatcctccaaaccccaccaactcccacgtacaaataactctaagacattccttcaaaaactcacacacacacacacttaagagaaacttacaagctagtaaattaagtagctaaaaaatcatgtatagattcagtaacacagtgataggtttcttgaatcttttcacactcttagcatcaattccaatcataggagctggattatggatggcaaggagcagtacaacatgtgaaaaattccttcaaacaccactcttgtttctaggcttcataatcctcataatttcattggctggtttcataggagcttgtttccatgttgcatgggcactttggctatacctttttgtcatgttgttccttataggggcattgatgggattaactgtgtttggttttgtggtaacaagccaaggtggtgtggtcgatgtgcctgggaaagtgtacaaagagtatcatcttgagaattattcagcatggttgaagaagagaattaaggatcctcaatattggatgactattagagcttgtattttgggttccaagacttgtgctactgttattacttggagtccatatgattatctcacaaaagacttgactcctatccagtcagggtgctgcaagccaccaacagcatgcaactatggattgacaacactatcacaggacccggattgttaccgttggaataatgacccgaatttgctgtgctatgaatgcgactcttgcaaagctggagttcttgaagatgtgagaagagattggcaaaagatatctgttcttaacattgtcatgctcgtcttcctcattggcatttactctattggttgttgtgcttttcaaaacacaaagcgggctgtatccgattacccgcatggccaaaaccgtatgtctaaagtccgacccagatgggatttccactggttcgtcacctcacatccttcaccaatttttacca

SEQ ID NO: 7775 - DNA, 1084 bp, Citrus clementina
agagagagtacagacttacagaaattttgaatcatgtatcggttcagcaacacagtcatcggattcttgaacctctttacactcttggcttcgattccgatcatcggcgcaggcctgtggatggcaaggagcagcacaacttgtgaaagcttccttcaaactcctcttctagtgataggttttgttgtgctgatagtttctcttgctggcttcattggtgcatgctttaacgttgcatgggcactatgggtgtacttagtagtcatgttgtttcttattgccaccttgatggctttaaccatttttgggtttgtggttacaagccaaggtggtggagtccaggttcctgggagggtgtataaagaatatcaccttcaagattattcaccttggttgagaaacagggttatggatcctaattattggagtactattagaagctgcttgttgggttcaaaaacttgtgccaaacttgccctttggactcctcttgattatcttgaaagagatatgactcccatacagtctggatgttgtaagccaccaacatcatgcaattacaatatgccaactatggcacaagatccggattgctaccggtggaacaatgcaccgacattgctttgctatgagtgtgattcgtgtaaagctggggtgcttgaagatgtgagaagggactggcacaagctctcagtgcttaacattgtgatgcttgtggttttgattgggatttattcaattgggtgttgtgcttttcaaaatacaagaagggcacaaacggattacccgtatggcgaaaaccagatgaccaaagtccgacccagatgggactattattggtggagatggtggaaagacatgagagaacggctttggtgaagtaaaagaaccgagaaaaattttatgacttgatgtgctccaaagatgggacagtgcagttggtttatagctatggcctctgggcattgcaagtttcgaggcccttctttttattattattattattttcttttttacagtcctcttcttcatgctttgctttaattttctgtgtacaaattaattaaagatggattctactttc

SEQ ID NO: 7776 - DNA, 1305 bp, Vitis vinifera
atttcctaatacagggaaagcactcggataagcaaaggccacaggcattttgaattcccgaagctttgagcaaagagaaaagcagtgttacgcttacaaaagagaaagctgaagaatacaccacaagaagaaaagcagtaaaaagagagagagagagagagggagctgcagcagcagtgagtgcaacacagagaggagagagaagagaggatcatgtataggttcagcaacacagtgatcggcttcttgaacttgttcactctcttggcgtcgatacccatcatcgggggagggctatggatggcaaggagcagcacaacatgtgaaagctttctgcaaacaccacttctggtggttggttttgtggttttgataatatctcttgcaggcttcattggtgcctgctttaacgttgcatgggcactctggttgtacttggtggtcatgttattcctcattgggaccttactgggcttaaccatatttggcttcgtcgtcaccagccaaggcggcggcgtggaagttcccggtagggtttataaggagtaccagctggagaagtattcttcatggttgaagagcagaatcaaggatccccattactggagcaccatcaggagctgcatattgggttcaaacacttgtgcccagattgcttcttggactcctctcgattatctggagagggacatgactcctattcagtcgggttgttgcaagccaccaacatcatgcaactatgccacggcaacgatgatgacccaagacgcggactgctaccgatggaacaacgccccgaatttgctgtgctacgagtgcgattcgtgcaaggccggggtgctggaacacataagaagagattggcacaagctctcagttctcaacattgtgatgctggtcttgctcattggcatctactcaattggatgctgtgctttcagaaacacgagaagatccgaaaccgattacccatacggcgaaaaccggatgtccaaagtccgacccagatgggatttctactggtggagatggtggtacgacagaaaaaaccagctttactaggcaagaggcagaagtgcttttatctgtttgtttgtatctgtatgttttactgcgtgtggaggatgggcaattgggacatgggcctttctttctttcttgatgtatacactgtaatattcatgcctgctttttctttatttcaaagcataaaacactgacttttccctttggaaatttactactggcttttgactttagtggagtctggagagaggttttgatacacaaagccctcgtgtttcg

SEQ ID NO: 7777 - DNA, 1261 bp, Vitis vinifera
gaaagcactcggataagcaaaggccacaggcattttgaattcccgaagctttgagcaaagagaaaagcagtgttacgcttacaaaagagaaagctgaagaatacaccacaagaagaaaagcagtaaaaagagagagagagagagagggagctgcagcagcagtgagtgcaacacagagaggagagagaagagaggatcatgtataggttcagcaacacagtgatcggcttcttgaacttgttcactctcttggcgtcgatacccatcatcgggggagggctatggatggcaaggagcagcacaacatgtgaaagctttctgcaaacaccacttctggtggttggttttgtggttttgataatatctcttgcaggcttcattggtgcctgctttaacgttgcatgggcactctggttgtacttggtggtcatgttattcctcattgggaccttactgggcttaaccatatttggcttcgtcgtcaccagccaaggcggcggcgtggaagttcccggtagggtttataaggagtaccagctggagaagtattcttcatggttgaagagcagaatcaaggatccccattactggagcaccatcaggagctgcatattgggttcaaacacttgtgcccagattgcttcttggactcctctcgattatctggagagggacatgactcctattcagtcgggttgttgcaagccaccaacatcatgcaactatgccacggcaacgatgatgacccaagacgcggactgctaccgatggaacaacgccccgaatttgctgtgctacgagtgcgattcgtgcaaggccggggtgctggaacacataagaagagattggcacaagctctcagttctcaacattgtgatgctggtcttgctcattggcatctactcaattggatgctgtgctttcagaaacacgagaagatccgaaaccgattacccatacggcgaaaaccggatgtccaaagtccgacccagatgggatttctactggtggagatggtggtacgacagaaaaaaccagctttactaggcaagaggcagaagtgcttttatctgtttgtttgtatctgtatgttttactgcgtgtggaggatgggcaattgggacatgggcctttctttctttcttgatgtatacactgtaatattcatgcctgctttttctttatttcaaagcataaaacactgacttttccctttggaaatttactactggcttttgactttagtggagtctggagagag

SEQ ID NO: 7778 - DNA, 737 bp, Solanum tuberosum
aaaaaaatggggaaagcacgtataataggaattggaatggattattcagcaacaagcaaaatagctctaaaatgggcaattgataatttaattgaagaaggtgatacaattattattattcatgttgtttcttctagagttgaaccaactagtaaacaactctttgaagatactggatcacctttgatacctttggatgaatttaaacagataaatgtgtctaagtattatggattaaatcctgataaagaggttattgatatgcttgagcctgttgccaaactcaaaaaggtgacagttgtgtcaaaggtgtattggggagatgcaagagagaaactttgtgatgctgctgaaagtctcaaacttgattcacttgtaattggaggcaggggtttaggagttcttaaaagggtgttacttggaagtgtgagtaactatgtggtgcaaaatgcaacatgtcctgtcactgttgtgaaaaccagtcctcaaaagtgaaaaaaaaaagacactaaagtttatgtcttattttgtttaaaaaaaaaaagaagagctactttgtatttttactttctttcgtttttgtatagtattttgtttgggatttatttatttgatttcttagggtatgagttggcttttgtttgagagtgtcggatgtgagatgattgtgggactttgttatatttcagtttttcatcttataatatttgttacttccttggttgtcaaaaaaaaaa

SEQ ID NO: 7779 - DNA, 845 bp, Solanum phureja
ttatttttttatataaaaaaatggggaaagcacgtgtaataggaattggaatggattattcagcaacaagcaaaatagctctaaaatgggcaattgataatttaattgaagaaggcgatacaattattattattcatgttgtttcttctaaagttgaaccaactagtaaacaactctttgaagttactggatcacctttgatacctttggatgaatttaaacagattaatgtgtctaagtattatggattaaatcctgataaagaggttattgatatgcttgagcctgttgccaaactcaaaaaggtgacagtggtgtcaaaagtgtattggggagatgcaagagagaaactttgcgatgctgctgaaagtctaaaacttgattcacttgtaattggaggcagaggcttaggagttcttaaaagggtgttacttggaagtgtgagtaactatgtggtgcaaaatgcaacatgtcctgtcactgttgtgaaaaccagtcctcaaaagtgaaaaaaaagacactaaagtttatgtcttattttgttaaaaaaaaagaaaatagagctactttgtatttttactttctttcgtttttgtatagtattttgtttgggattttatttatttgatttcttagggtatgagttggcttttgtttaagagtgttggatgtgagatgattgtgggactttgttatatttcaagtttatcatcttatatatatttgttggcttcttgtttatcatttgtgagacacttgtctttgtcaaaatgctaaatgtttcacttgtgagattgggaagaaaacattgtgaagtttattgtgataaatgtcaatagttaaaa

SEQ ID NO: 7780 - DNA, 728 bp, Nicotiana benthamiana
acagaaaactcagagaaaaagaaacaaagaaagagaaacaaaaaagaagaagaagaagaaaatggcaaaagcacgttcaataggaataggtatggattattcagcaacaagcaaaatagcactaaaatgggcaattgataatttaatagaagaaggtgataaaatcataattattcatgttgtttcttctaaacttgaccctactaataagcagctttttgaagacactggatctcctttaatacctttggatgaatttagagagattaatgtgtctaaatattatggacttgaccctgatagagaggttcttgatatgcttgacactgtttccaagcttaaaaaagtaatagtggtagcaaaagtatattggggagatgcaagggagaagctttgtgatgctgcagaacatctcaagcttgattcacttgtacttggaagcagaggtttaggtgttcttaaaaggatgttacttggaagtgtgagcaaccacttggtgcaaaatgcaacgtgtcctgtcacagttgtgaagtccagccctccaaagtaaaaacaaatcctataaagtttgtttttgttgaaaaacaaaactttttgcttattttttgtataaattttcttgtgtccattttgtactttttacttccttttttgttgttttctgtatatatattttggatttacttatcaggctcattggtatgagttggcttttgtttgatggtgtt

SEQ ID NO: 7781 - DNA, 559 bp, Nicotiana tabacum
  misc_feature (270)..(270): n is a, c, g, or t
ggccattacggccgggggaagaagaaacaagaggaagaagaaaatggcaaaagcacgttcaataggaataggtatagattattcagcaacaagcaaaatagcactgaaatgggcaattgataatttaatagaagaaggtgataaaatcataattattcatgttgtttcttctaaagttgacactactaataagcagctttttgaagacactggatctcctttaatacctttggatgaatttagagagattaatgtgtctaagtattatgnacttaaccctgatagagaggttcttgatatgcttgacactgtttccaagcttaaaaaggtaatagttatggcaaaggtgtattggggagatgcaagggagaagctttgtgatgctgcagaacatctcaagcttgattcacttgtagttggaagcagaggtttaggtgtccttaaaagggtgttacttggaagtgtgagcaaccacgtggtgcaaaatgcaacgtgtcctgtcacagttgtgaaggccagcccatcaaagtaaaaatcctataaagtttgttttattgcg

SEQ ID NO: 7782 - DNA, 561 bp, Petunia hybrida
cggggggagacaaaactcaaaacaagaaaagagaataaattaagatttaaaaatggccggaaaagctcgttcagtaggaatagggatggattactcagaaacaagcaaaatagcactgaaatgggcaattgataatttgatagaagaaggtgatagaatcatcatcatccacgttgtttcttctaaagttgatcctactaacaaacagctctttgaggacactggttcacctttgatacccttagatgaatttagagagattaacgtgtccaagtattatggactagaccctgaccgagaggttcttgatatgcttgacactatttccaagctgaaaaaggtaactgtggtggcaaaggtgtactggggagatgcaagagagaagctttgtggtgctgcagaacatctcaagcttgattctcttgttgttggaagcagaggattaggagtccttaaaagggtgttacttgggagtgtgagcaactacgtggtgcaaaatgcaacgtgtcctgtcacagttgtaaaggccacccctctgaagtatagcctgtcttattttgt

SEQ ID NO: 7783 - DNA, 908 bp, Nicotiana tabacum
ggccattacggccgggggtaaaaaatcagaagaagaacaaaagaaagagaaaaaaataaaataaagaaagaaacaacaataagaagaatgggaaaagcaagattagtaggaattggaatggattattcagcaacaagcaaagcagcattaaaatgggcaattgataatcttatagaagaaggtgatcagattatcattattcatgttgcttctcctaaagctgatcctactaataagcaactctttgaagacactggttcccctttgatacctttagacgaatttagagagattaacgtgtctaagcattatggactaaaccctgataaagaggttcttaatatgcttgacactgtttccaaggttaagaaggtgacagtggtggcaaaggtgtattggggagatgcgagggagaaactttgtgatgctgtggaacatctcaagcttgatactcttgtggttggaagtagaggtttaggagtccttaaaagggtgttacttcgaagtgtgagcaagtacgtggtgcaaaatgcatcttgtcccgttacagttgtgaagggcagttctctctcctgtttgtccggaatctgtcggaaataatttctcttaactttatataagaataaaaataaaatttgtatacgcactattattctcaaactccacttgaaattatattaaatatattattgtgatagtactttaccactgtttgctttttgtgtattttgttgggttgtgaatcacatacttagatattatgtggttttttgtttgagagtggtgaatgagatggttgtggggcaatatcatatttcaagattgtataattttgatgctttctattttcctttattgttgtcaaagcatttgtctttatcaaaggcttaattggaattgcaaaaaag

SEQ ID NO: 7784 - DNA, 814 bp, Solanum tuberosum
atttcttcttcttcatcattccattttgaagtagtcctgacccaattgctctctctatcactattgatttttcaaaaactgtttaaccaaagcaaaatcttggagttggaggtatggaaggaggtggtagatttgttggggtagcagtcgatttctcagcatgcagcaacaaagctctgaaatgggccattgataacattcttcgtaaaggggatcatcttattctcgttactgttcgccctgaaggacactatgaagaaggcgagatgcagctctgggaggctactggttctcctttaattcctttatctgagatatgtgatggtcacacaatgaagaggtatggggttaaccctgaccctgaaacattgcaaatgataacccttgccgctaggcaaatggagattacagtagtcatgaaaattttctggggagatgcccgagagaagttatgtgaagcaattgacaaaactcccttgagctgtctggtcatagggaacagagggcttggaaagatcaagagggctattatgggcagtgtaagcaactatgtggtgaataatgctacgtgccctgttactgttgtgaagaaagcagaagactaatttcacaatgttcagaactccttactgggaaagctgaaaacttatgataaattaattgtctgttttctaagcttggtgtcggatcaaacttctatcttatcgtgaacattgaatatgttgatgtgtgtattgtgtaccgtcatgttgaacctctgtaattcctgtcactatggattgctgcagtaaataaactttttcgaactccttcg

SEQ ID NO: 7785 - DNA, 865 bp, Solanum phureja
actacttgagtacttttcctcttatttcttcttcttcatcattccattttgaagtagtcctgacccaattgctctctctatcactattgatttttcaaaaattgtttaaccaaagcaaaatcttggagttgaaggtatggaaggaggtggtagatttgttggggtagcagtcgatttctcagcatgcagcaacaaagctctgaaatgggccattgataacattcttcgtaaaggggatcatcttattctcgttactgttcgccctgaaggacactatgaagaaggcgagatgcagctctgggaggctactggttctcctttaattcctttatctgagatatgtgatggtcacacaatgaagaggtatggggttaaccctgaccctgaaacattgcaaatgataacccttgccgctaggcaaatggagattacagtagtcatgaaaattttctggggagatgcccgagagaagttatgtgaagcaattgacaaaactcccttgagctgtctggtcatagggaacagaggacttggaaagatcaagagggctattatgggcagtgtaagcaactatgtggtgaataatgctacgtgccctgttactgttgtgaagaaagcagaagactaatttcacaatgttcagaactccttactggcaaagctgaaaacttatgataaattaattgtctgttttctaagcttgatgtctgatcaaacttctatcttatcgtgaacattgaatatgttgatgtgtgtattgtgtaccgtcatgttgaacctctgtaattcctgtcactatggattgctgcagtaaataaactttttcgaactccttcaatctggcttcatcattaagtgcttgcta

SEQ ID NO: 7786 - DNA, 938 bp, Solanum melongena
aatcaacatcgcactacttgattactttttctcttaattcttcattctactttgaaatagtcgtgacccaattgttctctctatcagtaatattcttaaccaaaacaaaatcttaaagggatggaaggaggtggtagatttgtaggggtagcagtggatttctcagcatgcagcaagacagctctgaaatgggccattgataacattcttcgtaaaggggatcaccttattctcgttactgttcgccctgaaggacactatgaagaaggagagatgcagctctgggaggccactggttctcctttaattcctttaaccgagttatgtgatggccacacaatgaaaaggtatggggttaaccctgaccctgaaacactgcaaattataacccttgctgctaggcagatggagataacagtagtcatgaaaattttctggggagatgctcgagacaagttatgtgaagcaattgataaaactcccttgagctgtgtggtcatagggaacagagggcttggaaagctcaagagggctattatgggcagtgtaagcaactatgtggtgaataatgctacgtgtcctgttactgttgtgaagaatgcagatgactaattttacaatgtgcggaacttacaggcaaaactgaaagcttgtgtttacataatcttgtctgttttctaagatcaagcttctatattatcgtgaacattgaacatgttggtttgtgtgttgtgtaccttcatgttgaagctctgtaattcctgtcactatagattgctgcagtaaataaactttttcgaactccttcaatctggcttcattaataaatacttgctatttatgtgtctatcttctaaggcaggctgtattttgttatatgttacaaggattctgcctacatcaacatgaaaaatggaaaatatggttttgatgcaggc

SEQ ID NO: 7787 - DNA, 790 bp, Capsicum annuum
tacttgtctgcttccatcctgaaatagtcgtgatcaagttgctctctccattattgttgttgttgaaagttcttaatcaaagcaaaaatcttaaagagggatggaaggaggtgatagatttgttggggtagcagtagatttctcagcatgcagcaagaaagctttgaaatgggcgattgataacattattcgtaaaggggatacccttattctcgttactgtgcgccctgaaggacactatgaagaaagcgagatgcaactctgggtggccactagttctcctttcattcccttatccgagttatgtgatagccacacaatgaaaaggtatggggttaaccctgaccccgaaacattgcaaatgataagcctcgctgctaggcaaatggagattacagttgtcatgaaaattttctggggggatgctcgtgagaagttatgtgaagcaattgacagaactcccttgagctgtctggtcatagggaacagagggcttggaaagatcaagagggctattatgggaagtgtaagcaattatgtggtgaataatgctacctgtcctgttactgttgtgaagaaggcagaagactaattatacaatgagctgaactcctatacaggcagagctgatttattgtcattgagatctaagcttatgttaaaataatcttatctgttttgtaagcttgattaggatcaagcttgaacatgttgatgtgtgtattatgtaccctcattttgaacgtatgtaattccagtcatgttgtggtaaataaactttttgaactct

SEQ ID NO: 7788 - DNA, 804 bp, Nicotiana tabacum
tattgttcaaagtcttcactagctcattcttacaacgatatatcaatcaagaccgaaaaagaaaaagaaaacgaaaactccaggccatcttcagattgttgaatagagaggatggaaggaggtagatttgtaggggtggcagtggatttctcagcatgcagcaagaaagctctgaaatgggccattgacaacatccttcgtaaaggggatcaccttattctggtcactgttcgtcctgaaggtcactatgaagaaggcgagatgcagctctgggaggccactggttctcctttaattcctttatccgagttttgcgatgcccacacaatgaagaagtatggggttaaccctgacccagaaacattggatatggtaacccttgctgctagacagaaggagataatggtagtcctgaaaatttactggggagatgctcgagagaagttatgtgaagcaattgacaaaactcccttgagctgtctggtcatagggaacagagggcttggaaagctcaagagggctatcatgggcagcgttagcaactatgttgtgaataacgctacgtgtcctgttactgttgtgaagcatgcagatgactaattgcgggtttattttgtcattgaaatgtaagcttatattaaaatcttgtttgttttctaagcttgatgttggatcaagcttctatattaatgtgtactttgaacatgtcgatgctatgtgtgtattatgtaccctcatgttgaacctctgtaattcctatcaccatgagttgctgcagtaaataaacattttggaactcttcaa

SEQ ID NO: 7789 - DNA, 940 bp, Nicotiana benthamiana
gcactaccacctcagttttcttgaatagtcgtgtcccagttgcctttcctattttattgttgcgaagtcttcgttagctcattctaacaaggataaatctaagaccctaaaagaaaaagaaaactcgaggccatcttcagattgttgaatagagaggatggaaggaggtagattcataggggtggcagtggatttctcagcatgcagcaagaaagctctgaaatggtccattgacaacatccttcgtaaaggggatcaccttattctggtcactgttcgtcctgaaggtcactatgaagaaggcgagatgcagctctgggaggccactggttctcctttaattcctttatccgagttttgcgatgcccacacaatgaagaagtatggggttaaccctgacccagaaacattggatatggtaacccttgctgctagacagaaggagataatggtagtgctgaaaatttactggggagatgctcgagagaagttatgtgaagcaatcgacaaaactcccttgagctgtctggtcatagggaacagagggcttggaaagctcaagagggctatcatgggcagcgttagcaactatgttgtgaataacgctacgtgtcctgttactgttgtgaagcatgcagatgactaattgcgggtttattttgtcattgaaatctaagtttatattaaaataatcttgtttgttttctaagcttgatgttggatcaagcatctatatttgtgtgtattttgaacatgtcgatgctgtgtgtgtattatgtaccctcatgttgaacctctgtaattccgatcaccacgagttgctgcagtaaataaacattttggaactcttcaatctggcttcattgtaaagtattgatgtgctatttgtatgcttatgtcttactttataaggtggcgtcaccacataaggtagtattat

SEQ ID NO: 7790 - DNA, 865 bp, Nicotiana benthamiana
ttgaatagttgtgtcccagttgcctttcctattttatattgttccaagttctcattcttacaacgatcaatcaagacccaaaaagaaaaagaaaaagaaaaagaaaaagaaaaagaaaattcgagggcatcttcagattgttgaatagagaggatggaaggaggtagatttgtaggggtggcagtggatttctcagcatgcagcaaaaaagctctgaaatggtccattgacaacatccttcgtaaaggggatcaccttattctggtcactgttcgtcctgaaggtcactatgaagaaggcgagatgcagctctgggaggccactggttctcctttaattcctttatctgagttttgcgatgcccacacaatgaagaagtatggggttaaccctgacccagaaacgttggatatggtgacccttgctgctagacagaaggagataatggtagtcctgaaaatatactggggagatgctcgagagaagttatgtgaagcaattgacaaaactcccttgagctgtctggtcatagggaacagagggcttggaaagctcaagagggctatcatgggcagcgttagcaactatgttgtgaataacgctacgtgtcctgttactgttgtgaagcatgcagatgtctaattgcgggtgtattttgtcattgaaatctaagcttatattaaaataatattgtttgttttctaagcttgatgttggacatgtggatgctatgtgtgtatcatgtaccctcatgttgaacctctgtaattcctatcaccatgagttgctgcagtaaataaacattttggaactcttcaaccagacttcattgtaaagtattgatatgctatttgtatgcttatgt

SEQ ID NO: 7791 - DNA, 907 bp, Nicotiana tabacum
ggccattacggccggggacaacgatcaatcaagacccaaaaagaaaaagaaaaagatacgccatcttcagattgttgaatagagaggatggaaggaggtagatttgtaggggtggcagtggatttctcagcatgcagcaagaaagctctgaaatgggccattgacaacatccttcgtaaaggggatcaccttattctggtcactgttcgccctgaaggtcactatgaagaaggcgagacgcagctctgggaggtcactggttctcctttaattcctttatccgagttatgcgatgcccacacaatgaagaagtatggggttaaccctgacccagaaacattggatatggtaacccttgctgctagacagaaggagataatggtagtcctgaaaatttactggggagatgctcgagagaagttatgtgaagcaattgacaaaactcccttgagctgtctggtcattggaaacagagggcttggaaagctcaagagggccatcatgggcagcgttagcaactatgttgtgaataatgctacatgtcctgttactgttgtgaagcatgcagatgaatagttttgcaatatgcaatgcgggtttattttgtcattgaaatctaagcttatgttaaaataatcttgtttgttttctaagcttgatgttggatcaagcttctatattaatgtgtactttgaacatgtccatgctatgtgtgtattatgtaccctcatgttgaacctctctaattcctatatcaccatgagttgctgctgcagtaaataaacattttggaactcttcaatctggcttcattgtaaagcattgatatgctatttgtatgcttatgtcttgtaacttttataaggtggcatcaccactcaagagagtattatctggaccttcgcgt

SEQ ID NO: 7792 - DNA, 812 bp, Petunia hybrida
attccaagtcttcactcttcttgcaaaagaaagaaacgatcaaccaagagaagtagtacaactcaaagaagaaaagatcacgtacgtctatcttgaaatggaaggagaaagaatggtaggggtggcagtggatttctcagcatgtagcaggaaagcattgaaatgggctattgataatattgttaggaaaggtgatcacctcattcttgttactgttcgtcctgaaggcaattatgaacaaggcgagatgcagctctgggtcgccactggttctccttttattcctctatctgagatatgtgatgcccacacaatggataggtatggggttgcacctgatccggaaactaaggaaatgataaccctcgctactaggcagaaggagattcaagtagtcatgaaaattttctggggagatgctcgagagaagctatgtgaagcaattgataagactcccttgagctgtcttgtcatagggaacagagggcttggaaagctcaagagggcaattatgggaagtgttagcaactatgtagtgaataatgctacatgtcctgttactgttgtgaagaacgcagaagactaatttacagtgcgctgaactcctttattggcagagctggtctattttgtcattgtgatctaacttatgttaaaataatgttgtgtggtttctaagcttgttgttggatcaagctttaatattactgtgaactttgaacatgtctgatgttttgtgtgtatgtaattcctatcactatttgtcgctgcagtaaataaacatttcaaactccttcaaaacaaaccaaaca

SEQ ID NO: 7793 - DNA, 811 bp, Solanum tuberosum
tcattctagttttggttttgaatttgtgagtaatttaaacagtttcgatttccattcaaatttgtcttcaatggctactgctatgggaatgatgggaagtattgggggttgtggagcagcttctgcatctctgtttcgattgaggaactcagcgaagaagaagaccagaaacgacaaaaatggatttagggtttcatgtgtttattcatcttctgctgttgccgatccgtataagaccttgaagattcaacctggtgcatctgaatctgaagttagaaaggcctttagacagcttgctcttaagtatcacccggacgtatgcagaggaaacaattgtggtgttcaatttcaccaaatcaatgaagcttacgatgttgtgatgagtaatttgagaggtgaaacaagagcagagttagagatgattgaggaatatgatgatagtaatgatgaatcaatgagaggaatgtatgaaccagattgggatctatgggaagagtggatgggatgggaaggtgctggcattcgtgattatacatcacatgttaatccttacatatgaatgttaattaatgagttagggatttatcttattggtcgaaaactcaagaatttgaagacccatccatcttctttaaatcaaagatggtttgaggttgatgtacatattcaataggaagtagaggaggttctttttgtacatatttggattccctccttgtttgctctttaccaattgtattcatctctcgttgataaataaaaaatcatatttcttataatataacttgcacaaattggcaactatgttgtt

SEQ ID NO: 7794 - DNA, 833 bp, Solanum phureja
attatattccatttttttcaccattaaaacaatctcattctagttttggttttgaatttgtgagtaatttaaacagtttcgatttccattcaaatttgtcttcaatggctactgctatgggaatgatgggaagtattgggggttgtggagcagcttctgcatctctgtttcgattgaggaactcagcgaagaagaagaccagaaacgacaaaaatggatttagggtttcatgtgtttattcatcttctgctgttgctgatccgtataagaccttgaagattcaacctggtgcatctgaatctgaagttagaaaggcctttagacagcttgctcttaagtatcacccggacgtatgcagaggaaacaattgtggtgttcaatttcaccaaatcaatgaagcttacgatgttgtgatgagtaatttgagaggtgaaacaagagcagagttagagatgattgaggaatatgatgatagtaatgatgaatcaatgagaggaatgtatgaaccagattgggatctatgggaagagtggatgggatgggaaggtgctggcattcgtgattatacatcacatgttaatccttacatatgaatgttaattaatgagttagggattcgaaaactcaagaatttgaagacccatccatcttctttaaatcaaagatggtttgaggttgatgtacatattcaataggatgtagaggaggttctttttgtacatatttggataccctccttgtttgctctttaccaattgtattcatctctcgttgataaataaaaaatcatatttcttataatataacttgcacaaattggcaactatgttgtt

SEQ ID NO: 7795 - DNA, 852 bp, Solanum melongena
atttatttattaaagcagtctcattctcattttgtatttgaacttgtcgcaattaattgattgaattttagatatttttgtgtttgatctaatctacaatggctactgctatgggggtggtggggagtattggaggatgtggagcagcttctgcgtctctgtttcgtttgaggaactcggcgaagaagaaaaccagaaacaacaaaaatggatttagggtttcttgtgtttattcctcttctgctgttgctgatccgtataagaccttgaagattcaacccggtgcgtctgaatctgaagtcagaaaggcctttagacagcttgctcttaagtatcatccagacgtatgcagaggaaacaattgtggtgtccaatttcaccaaatcaatgaagcttatgatgttgtgatgagcaacttgagaggtgaaacacgagcagagttggagatgattaacgatgatgatagtagtaatgatgaatcaatgagaggaatgtatgaaccagattgggatttatgggaagagtggatgggatgggaaggtgctggcattcgtgattatacttctcatgttaatccttatatctgatctttaatttaatgacttgggggttatcttattagttcaaaacccaagaattcgaaatccatccatctccttgaaatcaaagatggtttgaggttttatgtacatatatttagtaggaagtagagggagttcttttgtacatagttggaattccccttcttgtttgttattatcaagtgtaattgatgggatgcatctctcattgataaataaaagattaaatttcttattacaatttgcacggaccggcaactattttgatggc

SEQ ID NO: 7796 - DNA, 877 bp, Capsicum annuum
cttcttaacaacttgttgattgttggtgcttcttaaccagccttaaaaaagtatttaattaagatatttttgtgtaatctatataaaggttgctagattgtgcttgtttttatcattgggtgattagacatataatttcatttttgcttggaatttatctaaaaaaaaatggctagtgctatgggaatgttggggggtattggaggttgtggagcagggtctgcatctctgtttcgattgaggaactcggcgaagaagaagacgaaaaacaacaaaaatggatttagggtttcatgtgtttattcaccatctgctgttgctgatccgtacaagaccttgaggattcaacctggtgcttctgaatctgaagttagaaaggcttttaggaaacttgctcttcagtatcatccggatgtatgcagaggaaacaattgtgatgttcaatttcaccaaatcaatgaagcgtacgatgttgtgatgagcaacttgagaggtgaaacaagagcagagttggagatgattgaggagtatgatgatagtaatgatgattcaatgagaggaatgtatgaaccagattgggatttatgggaagaatggatgggatgggaaggtgctggcatccgtgattatacttcgcacgttaatccttacatctgatcctcacctaatatcttggggattatctttaatcagtcgaaaattcaagattttaagacccacccatctcctttaaaatcaaagatggtttgaggttgttgtaaatattcaagagtgaaccattgtacatatttgggattccccttcttttgtttttgtcaactgtggtgatgtgatgcatctcattgataaatataagattaaatttctttaaagtctt

SEQ ID NO: 7797 - DNA, 961 bp, Nicotiana tabacum
tattcgccctttttcacaagttgttgacgtttttaacgaacatttattcgatattaaatagtctcattcccattttggttcgctgtatttaagccctcttttggatttattgcagttaattgattgacattagatatttttttaatctatttaaagattgctagttcctattgtgggcatatattttaatagttaaatttttggttgggtatagctctctattttttgttcactcaaatcttcaatggctacggcaatgggaatgttgggaggtattgggggttgtggtgcagcctctgcatctttgtttcgtttgaggaacatatcaaagaagaagaccaaaaataacaaaaatggatttagggtttcttgtgtatcctctaccgtggctgatccatacaagacgttaaggattcaacccggtgcctctgaatctgaggtcagaaaggcctttagacagcttgctcttaagtatcacccggacgtatgtagaggaaacaattgtggcgttcaatttcaccaaatcaatgaagcatacgatgttgtgatgagtaatttgaggggtgaaacaagagcagagatggagatatatgaggaatatgatgataataatgatgaatcaatgagaggaatgaatgaaccagattgggacatgtgggaagagtggatgggatgggaaggcgctggcattcgtgactatacttctcatattaatccttacatctgatcttaatgactttggatttggaaatcatctatttgtcgaaaatccaaaattcgaagacccacccatctttgatgaaatcaaggatggttcgaggtttctgtacatataattcaagaagatgtggggagagtacttatgtacatagttggggttctctccttatttgttcttattagctgtgatgatgtgatatgcatctcgttcataaataaagatttttttttaccttaaaaa

SEQ ID NO: 7798 - DNA, 895 bp, Nicotiana benthamiana
tattcctcctttttcacaagttgttgacgtttttaacgaacatttattcgatattttagccctcttttgaatttcttgcagttaatttattgacattagatattttcgtaatctatttaaagattgctagttcctattgtgggcatatattttaatagttaaattttttgttcactcaaatcttcaatggctactgctatgggaatgttgggaggtattgggggttgtggtgcagcctctgcatctttgtttcgtttgaggaacatatcaaagaagaagaccaaaaataacaaaaatggatttagggtttcatgtgtatcatctaccgttgctgatccatacaagacgttaaggattcaacctggtgcctctgaatctgaagtcagaaaggcctttagaaagcttgctcttcagtatcacccggatgtatgcagaggaaacaattgtggcgttcaatttcaccaaatcaatgaagcatacgatgctgtgatgagtaatttgaggggtgaaacaagagcagagatggagatatatgaggaatatgatgataacaatgatgaatccatgagaggaataaatgaaccagattgggacatgtgggaagagtggatgggatgggaaggtgctggcattcgtgactatacttctcatattaatccttacatctgatcttaaggactttggatttggaaatcatttatttgtcgaaaatccaaaattcaaaaaccaacccatctttgatgaaatcaaggatggtttgaggtttctgtacataattcaagaagatatgggaagagttcttatgtgtacatagttgaaattctctccttatttgttcttattaactgtaatgctgtgatatccatctcgttcataactaaagatctttttcctt

SEQ ID NO: 7799 - DNA, 867 bp, Petunia hybrida
gggctgcaggatcggcacgaggctctgttgaacttatttgacattgagatatttacgtaatctatataaagattgctagatttgtgtgtctcatattcataaagttgaacttggttgagtttacattttgtttcttgatttgcaaaaatggcaactgctatgggaatgttgggaagtattggtggatgtggctctgcctctgcatctttgtttcgtttgaggaatatatcaaagaaaaagaccaagaataacaagaatggatttaaggtttcttgtgtttattcatcttctaccgtggctgatccttacaagactttgaggattcaacctggtgcttctgaatctgaagtcagaaaggcttttagacaacttgctcttcagtatcacccggatgtatgcagaggaaacaattgtggtgtccaatttcaccaaatcaatgaagcatacgatgttgtgatgagtaatttgaggggtgaaacacagagtgtagatcaaatggagatttacgaagagtatgatgataatgatgaaatgagaggaatgaacgatccagattgggacctctgggaagagtggatgggatgggaaggtgctggaattcgtgattatacttctcatattaatccttacatctgatctttagtaacctggaaatcatactaattagccgaaattgcaaaacccaaaacccatccatcatcttgaaatcaaggatggtttgaggtttctgtacatattccaaagggagtttccctttgtgcatagtatttgggagactctccttgtttcgttttccattattaaactgtgatgaatgtgatggcctcctccattgaataaataaaagatgaaaaattggtgtattaa

SEQ ID NO: 7800 - DNA, 933 bp, Nicotiana benthamiana
tattagcccttttcacaagttgttgacgtttttaacgaacatttattcgatattaaatagtctcattccattttggttcgctgtattttagccctcttttaaatttattgctgttaattgattgacattggatatttctgtaatctatttaaagattgctagttcctattgtaggcatatatatatattaaaagttgaagctttggttgggtatagctctctgctttttgttcactcaaaattttaatggcttctgctatgggaatgttgggaggtattgggggttgtggtgcagcctctgcatcttattttcgtttgaggaacatatcaaagaagaagaacaaaaataacaaaaatgaagttagggtttcttgcgtatcttctaccgttgctgatccatataagacgttaaggattcaacccggtgcctctgaatctgaggtcagaaaggcctttagaaagcttgctcttcagtatcatccggacgtatgtagaggaaccaattgtggcgttcaatttcaccaaatcaatgaagcatacgatgttgtgatgagtaacttaaggggtgaaacaagagcagaaatggagatatatgaggaatatgatgacagcaatgatgaatcaatgagaggaatgaatgaagcagattgggacacgtgggaagagtggatgggatgggaaggtgctggcattcgtgactatacttctcatattaatccttacatctgatcttaatcactttcatctattagtcggaaatccaaaattcaaaaacccacccatcaaggatggtttgaggtttctgtacataattcaagaagatgtggggagagttcttatgtacatagttgggattctctccttatttgttcttattaattgtgatgacgtgataggcatcttgttcataaataaagacggtctttcttttta

SEQ ID NO: 7801 - DNA, 1783 bp, Solanum phureja
gtgctattgtaggttggtctctaaatgtccattgaattatatcctttatgaaccaagaattagtaaaggtggattcagatggaaagcaagtgcctccaatgaagttcccgttgagaagtggaagcaagatagcattttcattgatagacgcggcagatttagacactttgatcacaaaaaagtttcacggaaaagatgtggttctttaaggggcagaggatggaaatatggatctggttttgttgatggtatattcccagttctaagcccaattgctcagcaaattctaacttttataaagacggaaaaagatccagagaggatttggtcttccttggatactctacgtcccaacaatcacacctgggatgatctgatcaatgtagcagttcaatttcgactcaacaaacaatgggatctgatcatactgatgtgtgaatggatactgtgcaggagttcctttcaggcagatgtgatttgctacaatttgctgatagaagcttatgggcagtgttcacttgttaagaaggcagaatctacttacctggcacttgttgatgctcgatgtgtcccgactgaagatacttatgcaattctcctgaaatcttattccaaatgtgggatgatagaaaaggctgaagctgtcttctctgagatgcggaagaatggccttcctccaagtgctcttgtatataatgcttatattgatgggttaatgaagggaaggaattcacaaaaagcattggcaatcttcgataggatgaagcgtgaaagctgccaaccatctactgatacttatacaatgctgatcaacttatatgggaaggaaaataagtcctacatggcgctaaagatgttcaatgagatgaaaactcagaaatgtaaacctaatatctgtacctacacagctcttgtgaatgcatttgcgagaagtggcctatgtgaaaaggctgaagaagtctttgaagagctacaagaagctgggcttgagcctgacgtttacacctataacgccttgatggaagcttacagtcgtgcaggctatcctcagggtgccgcagagatcttttctctcatgcagcatatgggctgtgaaccagacagagcttcatacaatatcatggtggatgcctatggaagagcaggtcttcatgaagatgcacaaaccgtgtttgatgagatgacgcggctggggatagctcctacgatgaaatcttacatgttactcatatcagcctactcaagaaacagtaacgtgtcaaaatgtgaagaaatagtgaatcagatgcagatatcaggagtgaaactagatacctttcttcttaacagcatgctcaacttgtatggtcgtcttggccagtttgcgaaaatggaagaactcttgactgtcatcgaagctggaccatacatagccgatatcagcacctacaatatcttgatcaatgcatatggacgttcaggatttatcatgaaaatggaagaagttttccaatcacttccagctaagaacctgaagccagatgtggttacatggacttcccgtcttggagcatactccaaaaagaaacagtaccaaagatgcttagaaatcttcgaggaaatgatcgatgaaggttgctatccagatggtggaacagccaaagtgctcctttcgtcttgttcaagtgaagatcagattgaacaagttacaacagtgattagatcaatgcacaagaatgtgaagacagtagagttagtttgaaatgacttgtacagttttcatgaaattgcaatatttgatgtg

SEQ ID NO: 7802 - DNA, 1824 bp, Nicotiana benthamiana
ttttcatctgagctattgtaggttggtctccagatgtccattaaatcatatcctttttgaaccaagaatcagtaaagttggattcagatggaaagcaaaggactccaataatgtccccattgagaagtggaagcaagatagcattttcattgatagacgcggcagatttagacactttgatcacaaaaaagtttccaggaaaagatgtggttctttaaggggtagaggatggaaatatggatctggttttgttgatggtattttcccagtgctaagccctattgctcagcagattctaacttttgtaaagaaggaaacagatccagagaggatttggtcttccttggatactctacgtccaaccaatgacacttgggatgatataataaatgtagcagttcaacttcgaatcaacaaacaatgggatctgatcatactggtgtgtgagtggatactgtgtaggagttcctttcaggctgatgtgatctgctataatttgcttatagaagcttatgggcaaagttcacttgttaagaaggcagaatcaacttatttggcacttcttgaagctcgatgtgtcccgactgaagatacttatgcacttcttctgaaatcttattccaaatgtgggatgctagagaagtctgaagctgtcttctccgagatgcggaagaatgggctacctccaagtgctcttgtatataatgcttatattgacgggttaatgaagggacggaattcacaaaaagcattggtgatcttcgataggatgaagcgagaaagctgccaaccatctacagatacttatacaatgctgatcaacttgtatgggaaggagaataagtcctacatggctctaaaggtgttcaatgagatgaaaactcagaaatgtaagcctaacatctgcacctacacagctcttgtgaatgcatttgcaaggggtggtctatgtgaaaaagcagaagaggtcttcgaagagctacaagaagctgggtttgagcctgatgtttacacctataatgccttgatggaagcttacagtcgtgcaggctatcctcaaggtgctgcagagatcttttctctcatgcagcatatgggctgtgaaccagacagagcctcatataatattatggtggatgcctatggaagagctggtcttcatgaagatgcacaaaccgtatttgatgagatgaagcggctgggaatagctcctacaatgaaatcttacatgttactcatatcagcttactcaagaaacagtaacgtctcaaaatgtgaagaaatcgtaaagcggatgcagaaagaaggggtgaaacttgatacttttcttcttaacaacatgcttaacttgtatggtcgtcttggccagtttacaaaaatggaagaactcttgactgtcatcgaagctggaccttatgtagccgatatcagcacctacaatatcttgatcaatgcatatggacgatcaggatttatcgcaaaaatggaagagattttccattcgcttcctgctaagaacttgaagccagatgtggttacttggacttccagacttggagcatactctaaaaagaaacagtaccaaagatgcttagaaatattcgaggaaatgatcgatgaaggttgctatccagatggtggaacagcaaaagtgctcctttcgtcttgttcgagtgaagatcagattgaacaagttacaactgtaattagatcaatgcacaagaatgtgaagacagtacagttggtttgaaatggctcatttaattttcatcaatgtcttctacaagtgaggatgcctgtgatttaggcaaaattagatgtaaa

SEQ ID NO: 7803 - DNA, 994 bp, Solanum phureja
aagggaaagaatacgaaatgccaacgagttgaatccgacgtggtcaatcgaattaaaaaaaaagcaaacgtggctcattctgattggataatgacaccaatgcccgccgatgacgtggaggaccgccgttctcattcaaatacttgtacatagcttctgcgattccggtaccggcagaagttggcaggaagacggagaaatcgggcaaatggagattaagctgtatacgagatctattattttgattgttgttattgctttcttatctgttttaccagctgcgctctgcatcgaagataaatgttctgcttgttccgccattgctgaggagctagagcatggactattgaaagaaaagccaagaaaccatttagacatgagacatcgcctggattctaaaggtcagcgtgaagggaaacttattgattacagaggcagtgagttgcgagttgttgaactcttagatgacctctgtgaaaagatgcaagattatacactggagaaggtggattcaagcaccaacacgtggatcaaagtaaacaattgggaccttctcaagactaataagcaagaagctcgagcacattcaaaagctatgtcatccttttgtggaaggttactcgagcaaactgaagatgagttggcagagttgataaagaaaggatctgtcaaagttggagatgtaaccaaggtattatgtgaagatctcagcaactattgcaaggggacaagcagctccaataaggcagtagatgatgaagacaaagatacagaccgagaactttgacctgataaatcattttgtttccttggctgattgatgcgggtaaagaaagaagattgtccctattcgtgaaccaggaaagcagatgacttcgatacaagtagaaacagttttttacgtcctcatatttcttctgatatctttacttagccatgtatcagtcatcacatgttgtactcaagattaactaattttatcgatgaacaatat

SEQ ID NO: 7804 - DNA, 1054 bp, Solanum tuberosum
tataagggaaagaatacgaaatgccaacgagttgaatccgacgtggtcaatcgaattaaaaaaaaagcaaacgtggctcattctgattggataatgacaccaatgcccgccgatgacgtggaccgccgttctcattcaaatacttgtacatagcttctgcgattccggtaccggcagaagttggcaggaagacggagaaatcgggcaaatggagattaagctgtatacgagatctattattttgattgttgttattgctttcttatctgttttaccagctgcgctctgcatcgaagataaatgttctgcttgttccgccattgctgaggagctagagcatggactattgaaagtaagataaccatgttgcttcggaaaagccaagaaaccatttagacatgagacatcgcctggattctaaaggtcagcgtgaagggaaacttattgattacagaggcagtgagttgcgagttgttgaactcttagatgacctctgtgaaaagatgcaagattatacactggagaaggtggattcaagcaccaacacgtggatcaaagttaacaattgggaccttctcaagactaataagcaagaagctcgagcacattcaaaagctatgtcatccttttgtggaaggttactcgagcaaactgaagatgagttggcagagttgataaagaaaggatctgtcaaagttggagatgtaaccaaggtattatgtgaagatctcagcaactattgcaaggggacaagctccaataaggcagtagatgatgaagacgaagatacagaccgagaactttgacctgaaatcattttgtttccgtggctggttgatgggggtaaaaaaagaagattgtccctattcgtgaaccaagaaagcagatgagtttgatagaagtagaaacagttttttacgccccttcatatttcttctgatatctttacttaaaaaaacatacatgttcttccctcttttttattggaccatgtatcagccatcgcatgttgtactcaagattaactaattttatcgatgaacaatatatgtct

SEQ ID NO: 7805 - DNA, 1012 bp, Nicotiana benthamiana
atggcaacgagttaaatccgatgtggcaatcaaataagaaaaaggcagacgtggctcatttttattggataatgacaccaaaggtactccgatgacgtggaccgccgttcccattaataacaaatacttctccaccgtagctccttcgattctccggcaccgggaaaaactcacacgaaaaaggagagatcgcaaatggcgattaagccatatatgagatcgattttgattgttgcttttgctttcttatctgttttaccagctactctctgtatcgaagataaatgtgctgcttgtactgccattgctgaggagctggagcatggactcttgaaagaaaaaccacgaaaccatttagacatgagacaccgcctggattctaaaggtcagcgtgaagggaaacttattgattacagagccagtgagctaagagttgttgaactcctagaggacctctgtgaaaagatgcaagattatactctggagaaggtggactcaagcacaaaaacttggattaaagtaaacaattgggaccttctcaagactaataagcaagaagctcgagcacattcaaaagctatatcatccttctgtggaaggttacttgagcaaactgaagatgacttcacagaactgatgaagaaaggatctgtccaagttggagatgtaagcaaggtattatgtgaagatctcagcaactattgcaatgggaaaagtagttccaataagacagtgggtgatgaaaacgaagatgcagatcgagaactttgacctaattaatccttttcttttcctgctggttttgatgggtagagagagaagattgtctctattgtaactcatgcaagcagataacttcaatagaagtagcagaaatttacaccctcctattttcttcgtccgctatctttttgtaatacaacatgcatgttcttccctcctttttgttggaccatgtatcagtcgttgcaagttgtactcaagattaactaactttatcgatgaacaatat

SEQ ID NO: 7806 - DNA, 1601 bp, Solanum phureja
aacaaccattatttaccttccacacctactgtggcgcctctccgcagcatcagccaaaactgcacatgtttttatagggtttttctctacacactgtttgttcaaactaaaaaaaaaatggcttcacttgttcaattccttcctctcttccctttctttttcttgatttctttctctgtttctcatggaccctttttaccaaaagccattattctccctgtaaacaaagatccatctacttttcaatatgttactcaactctacatgggtgctaatcatcttgctcccatcaaattagttgtaaatcttggaggttcatttctatgggctgactgtggcttgacttctgattcttcaagtcaaaaacttgtaccttgtaattcactcaaatgctccatggcaaagcctaatggttgtactaatgacaacaagatctgtggtttgaaatcagaaaacccctttacaagattagctgcaacaggggaattagcagaggatatgtttgctgtggagtttatagatgagttgaaaacaggttcagtagcttcaattcatcaattcttgttttcttgtacatcatctactctgttacaaggacttgctagaggtgctaaaggtatgttagggcttggaaattcaagaattgcattgccatctcagttgtctgatacatttggttttcaaaggaaatttgctatttgtttgtcttcttcaaatggtgctataatttctggtgaaagtccttatttgtcacttttgagtcatgatgtttcaagatccatgctttatacacctctaatttcatctagagatggggttttagaagagtattacataaatgtcaaatccctcaaaattaatggaaataaactatctttgaacacatctttgcttacaatggatggagaaggtcatggagggacaaagattagtacaatttccccttttacaactatgaagacctcaatttacaagacatttgtggaatcttatgaaagatttggtttttccatgggattgactaaggtagaacctatagcaccatttgggctttgctttagcacaaaagtagaggggctaaatgtgccaagtattgatcttgtgttgcaaagtgagatggttaagtggaggatttatgagagtaattcaatggtgaaagtaagtgatgaggtgatgtgtttgggattcttggatggaggggttaaccaaaaggcatcaattgttatagggggtcaccagttggaggataatcttttggagtttaatttgggaacttctatgcttggatttacttcttcattggcaatggtggaaacaagttgttctgacttcatgttcacaaaggattcttcagtttttgatacttgacatgaatccttaaccaaagatagacaattcccctttgtatagttatgttaagaacatgtattggctcttatagatagtcataacttggccaatcttagaatattagaggagtactagtttattgtgagatagtgtttcttgactcactttttgagttgtgagaaagttttgatatgtaagaactgatttttactatgttcttattctaattttcactatgttcctttgctatt

SEQ ID NO: 7807 - DNA, 1597 bp, Solanum tuberosum
tgcacatgtttttatagggtttttctctacacactgtttcttcaaactcaaagaaaatggcttcacttgttcaattccttcctctcttccctttctttttcttgatttctttctctgtttctcatggaccctctttaccaaaagccattattctccctgtaaacaaagatccatctacttctcaatatgttactcaactctacatgggtgctaatcatcttgctcccatcaaattagttgtaaatcttggaggttcatttctatgggctgattgtggcttgacttctgattcttcaagtcaaaaacttgtaccttgtaattcactcaaatgctccatggctaagcctaatggttgtactaatgacaacaagatctgtggtttgaaatcagaaaacccctttacaagattagctgcaacaggggaattagcagaggatatgtttgctgtggagtttatagatgagttgaaaacaggttcagtagcttcaattcatcaattcttgttttcttgtacatcatctactctgttacaaggacttgctagaggtgctaaaggtatgttagggcttggaaattcaagaattgcattgccatctcagttgtctgatacatttggttttcaaaggaaatttgctatttgtttgtcttcttcaaatggtgctataatttctggtgaaagtccttatttgtcacttttgagtcatgatgtttcaagatccatgctttatacacctctgatttcatttagagatggggtttcagaagagtattacataaatgtcaaatccctcaaaattaatggaaagaaactatctttgaacacatctttgcttacaatggatggagaaggtcatggagggacaaagattagtacaatttccccttttacaactatgaagacctcaatttacaagacatttgtggaagcttatgaaagatttggtttttccatgggattgactaaagtagaacctatagcaccatttggggtttgctttagcacaaaagtagaggggctaaatgtgccaagtattgatcttgtgttgcaaagtgagatggttaagtggaggatttatgagagtaattcaatggtgaaagtaagtgatgaagtgatgtgtttgggattcttggatggaggggttaaccaaaaggcatcaattgttatagggggtcaccagttggaggataatcttttggagtttaatttgggaacttctatgcttggatttacttcttcattggcaatggtggaaacaagttgttctgacttcatgttcacaaaggattcttcagtttttgatacttgacatgaatccttaaccaaagatagacaattccccgttgtatagttatgttaagaacatgtattgcctcttatagatagtcataacttggccaatcttagaatatcagaggagtactagtttattgtgagatagtatttcttgactcactttttgagttgtgagaaagttttgatatgtaagaactgatttttactatgttcttattctaattttcactatgttcctttgctattaatttgatgtattgttttgtagtactccatctattctagtaaagataatttatataa

SEQ ID NO: 7808 - DNA, 717 bp, Solanum phureja
agtgagtaataatctctctttctttgccttaattcttaattctttctgagcttaattcaaaattttgaatggagaatttgttgggtcttatgagagttcgtatccacagaggtattaatttggctattagagatgttactaccagcgatccttacgttgttgttaggatgggcaaacagaaattgaagactcgagtggtgaagaagaatctcaatccagaatggaatgaagaattaacactatctattactgaaccaattctcccaatcaatctgcatgtttatgacaaggatatattttctctggacgataagatgggtgatgcagaaattgacatacatccatttatagatgcggtgagaaagcgctacaagaacatccctagtggaaccataatcacaaaaataaagccaagcaggcaaaattgtttgtctgaagagagccccattgtgtgggaaaatgatcaggttgttcaaaatgtgtttattagattgcgaaatgttgagcgtggcgaaatagagctacaattgcagtggattgacattcctggttccaagggtgtgtagctacttgttattatatccatcatgtacagtcagtatcctttcttcatgttgtattagctcttctcccttctttaatctgtaacgcttgtggtccgttttttgtttaaatttctgtttctatgaatattgaagttaccgaatgaactactca

SEQ ID NO: 7809 - DNA, 675 bp, Solanum melongena
tcagctatggagaatttgttaggtcttctgagaattcgtatccgcagaggtattaatttggctattagagatgtcactaccagtgatccttatgtggttgttaggatgggcaaacagaaactgaagactcgagtggtgaagaagaatctcaatccagaatggaatgaagaattaacgctgtctgttactgaaccaattctcccaatcaaactgcaagtttatgacaaggatacattttctctcgatgataaaatgggcgatgcagaagttgacatactcccatttatagatgttgtgagaaagcggttcaaaaacatcccgagtggaaccataatcacaaaaataaagccaagcaggcaaaattccctctctgaagagagctgcattgtctgggaaaatgatcagattgttcaaaatgtgtttgttagactgcgaaatgttgagcgtggtgaaatagagcttcaattgcagtggattgacgttcctggctccaagggtgtgtaggctgtagctaattgtagcaccctgttattctatccatcatgtacagtgagtatccgattagcttcatgttggattagtaagttaatgacgagatgtttgtggtcttttcttgttatatttttatttctatgaatattgaatttacccaatgaactactcagattgtgatac

SEQ ID NO: 7810 - DNA, 722 bp, Nicotiana benthamiana
atagaataatcatctattatctctctttctttggctcaattcattgtattacaccaactccttcattctttctagaaattagaacttcatttttaagtgtcaaatggagaatttattgggtcttctgagaattcatatccacagaggcattaatttggcaattagagatgttactagtagcgatccttatgttgttattaggctgggtagacagaaactgaagactcgagtggtgaagaaaaatgtcaatcctgaatggaatgaagatttaacattatccatcactgaaccaattcaaccaatcaaactgcaagtatatgacaaggatatattttccctagacgataaaatgggagatgcagaacttgacgtatttccatttatagatgctgtaagaaagcgctttaagaacattccgaatggaaccataatcaccaaaataaagccaagcagggaaaattgcttctctgaagaaagctgtgttgtctgggaaaatggtcaggttgttcaaaatgtgtttattagattgagaaatgttgagcgtggtgaaatagagctacaattgcagtggattgatattcctggttctaagggtctgtagatacttataacaccctttattctatccatcatgtacagtaagtttgctttcttgatgtctaattagcttcatcttgtattgtctcccttctttgatatgtaaagttatggtgagatatgtg

SEQ ID NO: 7811 - DNA, 667 bp, Nicotiana tabacum
ggtattaatttggctattagagatgttactagcagcgatccgtatgttgttgttaggctgggtagacagaaactgaagactcgagtggtgaagaagaatgtcaatcctgaatggaatgaagacttaacattatccatcactgaaccaattcaaccaatcaaactgcaagtttatgacaaggatatattttccctagacgataaaatgggagatgcagaacttgacatatttccatttatagatgctgtaagaaagcgcttcgagaacattccgaatggaaccataatcaccaaaataaagccaagcagggaaaattgcttctctgaagaaagctgtattgtctgggaaaatggtcaagttgttcaaaatgtgtttattagattgcgaaatgttgagcgtggtgaaatagagctacaattgcggtggattgatattcctaattccaagggtctgtagttacttgtgacaccctttattctatccaacatgtatagtaagtagtatatgctttcttgatatctggttagctccatcttgtattagtctcccttctttaatctgtattctgtaaagttacagtgagatgtttgtggtattttttgttaagtttctcttttattgaatattaaagttacctaattaatgaattattgatcttcatattctg

SEQ ID NO: 7812 - DNA, 1299 bp, Nicotiana benthamiana
gttgaatcttggcctttctctcgtcccatttctcatcagtatcccattatattctttccaatcgtcacctacctttgtacgcacactcaccttataaacaacactcaaaaaactatcttttctcttctccaccaaaaaaacactcttaatatggcttctttcttcttttcaaccaaattctttctactcctctttttcgtatcagcaattcctatttctttcatcatccacctcgaaacttccgcccccccaacccacgtctatcattaccacagcaccggctggttacgtgagtgtgccaaatgggacgatttaaaccgccggttcattgtcagcttctttgaaggcggtttaggtgtgattccggtcgatgccggctactctccgggtaacgagttacaggaaattccggttgtgaaggacgttgacttgaccggcaatgcgtcgctcggtttagctatagaccgggaaaggaaccgggttttggttgctgtagctgatgtatttggcaatcgctatagcgctttggctgcctatgatttgacgtcgtggaaccggatttttctcaccaaacttagtggtccagaagatgagaaagcatttgcggatgatgtggtggtcgatacagagggaaatgcgtacattacagatgccaaagcaaataagatatggaaggtgggggtgaatggagaacttaaatatacaatcaagaaccccatatttactcctaaagagtggtacaataagctagttggattaaatggaatagcttatcatccaaatggatacttactggtggctcatacattctcgggcaatttgtacaagattgaaatagcaaagcatgacgaagtaaagctagtgaagataaatggtggatcattgaaatttggtgatggcatggaactgttgtcttcgacaaagctagtcgttgctggaaatccgacgaggttagttgagagttctgatgattgggagagttgtagtattgtggggaaggccaaaggggctattcatcgtttaactacagcagcaactgtgaaggaagggactgtttatcttaaccatatgattggtttgggatatcctaggaaaaaacatgttcttgttgaggctgttttttctgcttaattttgccaaccacaaactcaagccatcctttttaatttgtgtgtgacagtaaactttttacgaggtaatttccagctactgattatggacctcaggcaagaactatcaatcttattttgtagaatacaccgtatttattttattacagcatcacttggttgcaacatt

SEQ ID NO: 7813 - DNA, 1308 bp, Nicotiana tabacum
  misc_feature (85)..(85): n is a, c, g, or t
  misc_feature (118)..(118): n is a, c, g, or t
  misc_feature (178)..(178): n is a, c, g, or t
  misc_feature (207)..(207): n is a, c, g, or t
  misc_feature (226)..(226): n is a, c, g, or t
  misc_feature (247)..(247): n is a, c, g, or t
  misc_feature (251)..(251): n is a, c, g, or t
  misc_feature (271)..(271): n is a, c, g, or t
  misc_feature (274)..(274): n is a, c, g, or t
  misc_feature (298)..(298): n is a, c, g, or t
  misc_feature (362)..(362): n is a, c, g, or t
  misc_feature (379)..(379): n is a, c, g, or t
  misc_feature (385)..(385): n is a, c, g, or t
  misc_feature (411)..(411): n is a, c, g, or t
  misc_feature (438)..(438): n is a, c, g, or t
  misc_feature (476)..(476): n is a, c, g, or t
  misc_feature (485)..(485): n is a, c, g, or t
  misc_feature (496)..(496): n is a, c, g, or t
  misc_feature (538)..(538): n is a, c, g, or t
  misc_feature (575)..(575): n is a, c, g, or t
  misc_feature (598)..(598): n is a, c, g, or t
  misc_feature (601)..(601): n is a, c, g, or t
  misc_feature (619)..(619): n is a, c, g, or t
  misc_feature (625)..(625): n is a, c, g, or t
  misc_feature (671)..(671): n is a, c, g, or t
  misc_feature (731)..(731): n is a, c, g, or t
  misc_feature (789)..(789): n is a, c, g, or t
  misc_feature (802)..(802): n is a, c, g, or t
  misc_feature (805)..(805): n is a, c, g, or t
  misc_feature (820)..(820): n is a, c, g, or t
  misc_feature (886)..(886): n is a, c, g, or t
  misc_feature (899)..(899): n is a, c, g, or t
  misc_feature (909)..(909): n is a, c, g, or t
  misc_feature (916)..(916): n is a, c, g, or t
  misc_feature (922)..(922): n is a, c, g, or t
  misc_feature (1171)..(1171): n is a, c, g, or t
tgaatcttggcctttctctcgtctttctcatcagtatccctttatattctttccaatcgtcacctacctctgttctcacactcancttataaacactcaaaataccatctttttctcntctccacaaaaaaacactcttaacatggcttctttcttctgttcaaccaaattctttctnctcctctttttcgtatcagcaattcctantgctttcataatccacctngaaacttccgcccccacaacncacntctatcattaccacagcacnggntggttacgtgagtgtgccaaatgngacgatgtaaaccgccggtttatcgtcagtttctttggaggcggtttaggtgtgattccggtcnatgagaattactccccnggtaangtgctgcaggaaattccggtcgttanggatgttgacttgaccggcaatgcgtngctcggtttaactatagaccgggaaaggaaccgggttntggttgctntagctgatgtntttggcaatcgctatagcgctttggctgcctatgatttgacntcgtggaaccggatttttctcaccaaacttagcggtncagaggatgagaaagcatttgcngangatgtggtggtcgatacngagggnaatgcatacattacagatgccaaagcaaataagatatggaaggtgngcgtgaatggagaacttaaatatacgatcaagaacccaatatttactcctaaagagtggnacaataagctagttggactaaacggaatagtttatcatccaaatggatacttactggnggctcatacattntcnggcaatttgtacaanattgaaatagcaaagggagatgaagtaaagctagtgaagataaatggtggatcattgaaatttggngatggcatggaantgttgtcttngaccaanctagtngttgctggaaatccgacgaggttagttgagagttctgatgattgggagagttgtagtattgtgggaaaggccaaaggggctattcatcgtttaactacagcagcaactgtgaaggaagggactgtttatcttaaccatatgattggtttgggatatcctaggaaaaaacatgttcttgttgaggctgttttttctgcttaattttaccacccacaaacttaagagttacggggttctatctttcctttntaatttttgtgtgagagtaaattttatactaggtaatttccagctactgatttatgtacctcaggcaagaactatcaatcttattttgtagaatgcaccgtatttattttattacagcatcacttagttgcagcgtt

SEQ ID NO: 7814 - DNA, 1250 bp, Nicotiana benthamiana
ctttccaatagtcacctacctttgtacgcatactcaccttataaacaacactcaaaatacgatctttttctcttctccacaaaaaaacactcttaacatggcttctttcttctgttcaaccaaattctttctactcctctttcgtatcagcaattcctactgcttttataatccacctcgaaacttccgcccccacaacccacgtctatcattaccacagcacagggtggttacgtgaatgtgccaaatgggacgatgtaaaccgccggtttatagtcagtttcttcgaaggcggtttaggtgtgattccggtcgatgagaattactccccaggtaatgtgctgtaggaaattccagtcgttaaggatgttgacttgactggcaatgcgtcgctcggtttaactatagaccgggaaaggaaccgggttctggttgcaatagctgatgtgtttggcaatcgctatagcgctttggctgcctatgatttgacgtcgtggaaccggattttcctcaccaaacttagcggtccagaggatgagaaagcatttgcggatgatgtggtggtcgatacagagggaaatgcatacattacagatgccaaagcaaataagatatggaaggtggacgtgaatggaaaacttaaatatacaatcaagaaccccatatttactcctaaagagtggtacaatagattggtggggctaaatggaatagtgtatcatccaaagggatacttactggtggctcatacattctctggcaatttgtacaagattgaaatatcaaaggacgacgaagtaaagctagtgaagataaatggtggatcattgaaatttggtgatggcatggaattgttgtcttcgaccaagctagtggttgctggaaatccgacgaggttagttgagagttgtgatgattgggagagttgtagtattgtggggaaggccaaaggggctattcatcgtttaactacagcagcaactgtgaaacaagggactctttatcttaaccatatgattggtttgggatatcctaggaaaaaacatcttcttgttgaggttgttttttctgcttaattttaccacccacaaatttaaatgaccatcactttaatttgtgtgtgagtataggtgatttccaaattcctgatttatgtacctcggcaagacctgtcaatcttattctagtgtataccctatttattttatttcccatcacctagtgcaacattcggatgtctcacaattgct

SEQ ID NO: 7815 - DNA, 1168 bp, Solanum phureja
ttcttttctctgcgcctttcatggagattattcccactcttccttacgatatcggactcgaatgtcttattcgagttccttattataatttctcatcggttacttccgtcagtagaaactggaagcttcagattgagcttcccgagttttggaggcgaagaagagctactggttccacccgtcaggtaattttaatggcgcaagcccgaattgacccgagattgaaactcgggtcattcaagtactctgctttttcggtttacaagcttacgctttacgaaccggaatcgggttattgggcggaactaccaccggttcctggtatttccgatggattgccgatgttttgtcagctcgtcggagttggattgaatctggtggtgatgggcgggtggaaccctcttacttgggaaccttcaaacgctgtttttgtttttagctttgtgtccgccacgtggcgacgtggagccgacatgcctggttgccggagatcgtttttcggttgtgcgtcggattctgaacggacggtgtacgtcgccggaggtcacgacgaggagaaaaacgcacttaaatcggcgatggcgtatgacgtggcaagggatatgtgggtcccaatgcctgacatggcaagtgaaagagatgaatgtaaatgcactttttttcaagataaattccacgtcatcggcggatatgacacgagcatgcaaggccagttcggtacaagcgctgagtcattcgatccttccacgtggcagtgggaccaagtcaacgaacatttctttgaatctgccacgtgtccaagaacctgcgttgagggtggggacggaaaattgtacttgtgccgggacggtgatgtgctggcactcggaaagtctacgtggcaagctgtggcggcgattccggtggagctccggagcgtagcttttgtgacagcatggaggggtaaaattctgatgactggttctatgggatttaatgaaccccacaatacttatgttcttgatttacagagttataaatggaccaaaatggatactccggcgaacttttccggccacgttcaatccggctgctgcctggagatgtaaaagagtttcttttgagtgtcataagtttgtgttgattgtacagttataattatcagaatagttttgttgcgttgataaaa

SEQ ID NO: 7816 - DNA, 1151 bp, Solanum tuberosum
tggagcttattcccactcttccttacgatatcggactcgaatgtcttattcgagttccttattataatttctcatcggttacttccgtcagtagaaactggaagcttcagattgagcttcccgagttttggaggcgaagaagagctactggttccacccgtcaggtaattttaatggcgcaagcccgaattgacccgagattgaaactcgggtcattcaagtactctgctttttcggtttacaagcttacgctttacgaaccggaatcgggttattgggcggaactaccaccggttcctggtatttccgatgggttgccgatgttttgtcagctcgtcggagttggattgaatctggtggtgatgggcgggtggaaccctcttacttgggaaccttcaaacgctgtttttgtttttagctttgtatccgccacgtggcgacgtggagccgacatgcctggttgccggagatcgtttttcggttgtgcgtcggattctgaacggatggtgtacgtcgccggaggtcacgacgaggagaaaaacgcacttaaatcggcgatggcgtatgacgtggcaagggatatgtgggccccaatgcctgacatggcaagtgaaagagatgaatgtaaatgcactttttttcaagataaattccacgtcatcggcggatatgacacgagcatgcaaggccagttcggtacaagcgctgagtcattcgatccttccacgtggcagtgggaccaagtcaacgaacatttctttgaatctgccacgtgtccaagaacctgcgttgagggtggggacggaaaattgtacttgtgccgggacggtgatgtgctggcactcggaaattctacgtggcaagctgtggcggcgattccggtggagctccggagcgtagcttttgtgacagcatggaggggtaaaattctgatgactggttctatgggatttaatgagccccacaatacttatgttcttgatttacagagttataaatggaccaaaatggatactccggtgagcttttccggccacgttcaatcaggctgctgcctggagatgtaaaagagtttcttttgagtgtcataagtttgtgtggattgtacagttataattatcagaatagttttgttgcgttgataaaaaaaa

SEQ ID NO: 7817 - DNA, 1564 bp, Nicotiana benthamiana
atatgtttcaaaaagaataaacttattattatttttgtagaaattcatttgtcctgatcggaacaattgaagaaaaaaatggtgtctcctttcgcttttcattcaattgttaacatatagtagtaatttttaaatatataaattttaagttttcacagtaacctttatactcctaaaaaattcaaaaaaattgaaacgaaaaaaggtataggttcctcatcccattgtgtatgtccttatgggtccctccactaattctttagtccttttctttgtctttctcttgtgcttgtcatataaaatccagtaacttatgttaatttctctgtctctctaaagacttaaaagcaatggagttaattcccagtattccttacgacataggactagaatgtcttatccgagtcccctaccacaatttctcgtctgttacatccgtctgcaaaaactggaagcaacaaattgaacttcctgagttttggaagctaagaagagctactggcttcacccgccaagtaatcttaatggcccaagcccgaaccgatgacccgaaaataaaaatcgggttatccaagtactccgcttttccagtttacaggttaacgctttatgagcctgattcgggttattgggccgaattaccaccgcttcctggcaactccgatgggctgccgatgttttgccagccagtgggagttgggttgagcttagtggtgattggcggctggaaccctattacttgggagccttcaaacgccgtttttgtttataactttgtgactgccacgtggcgccggggagatgacatgccgggctgccggagatcgttttttggctgtgcgtcggattctgaacggacggtgtacgttgcaggtgggcatgacgaggagaagaacgcgcttaaatctgcgatggcgtatgacgtggcaagtgatgagtgggtcccaatgcctgacatggcaagcgaacgcgatgaatgtaagtgcactttttatcaaggtaaattccacgtcattggcggatatgacacgagcatgcaaggccggttcgggacaactgccgagtcgtttaatacttccatttggcagtgggacccaatcaacgaacatttcttggattctgccacgtgtccgagaacttgtgttgagggtggtgacggtaatttgtacttgtgccgggacggtgatgtgctagcatttcaagattccacgtggcaagttgcggcggcgattccggcggaactccggaacctggcctttgtgacagcgtggcggggtaaaattctgatgactggttctatgggatttaatgagccccacaacacttatattctggatttacagaattacaagtggaccaaaatggatactccggtaaacttctccggccatgttcaatctggctgttgcctcgagatgtaacacttttaaggttttaccactttgtgttgattgtacagtttgaaaattagaaagattttgcatatagtatttcatttgccaactttagtaagtgttaaatttgccactatactacttgaaattgagaaactttgacttccgtt

SEQ ID NO: 7818 - DNA, 1369 bp, Solanum tuberosum
agcggggcagatcattaaatgatttaaatagatatatatttgattcttaaaatgttggtaaaaataaaatcagcaaatattagtgaaaaaaataattaaataggttgagtgactttttgtgcaaagaagtcatagttaagtgacttttgagttgaaaatgaaagttgaatgactttctgtgaaaatagttgatagttgagtaaccatcaaagttattaactcctgaatataacatctcgattattatgatagctaaaaacacgcagaaagtatgggagaattcgaaattaccaaacttctgacattatgcctaacttttctgctgtatttaagatcacaacaagggacataaatgtcatttcacattccccagtccattttcaactacttttcttttctcctccatttttgccccccaatcaaaattcagtatcttctcagaccaatgagcaaagaaggaagaagaagaggagtaagatggagctggacctccgccttcgtcggcgccgccgctgccgcagcaacggtgatggcactctcttcaaagccacgggatcccgattttcatctcatctccatcgatctcacttccttcaagctcaatttccccgtcgtagacgcggaactcatcctcaccgttcacgttactaaccctaacgttacttcaatcaactactcctcaacagaaatgtcgattttctactccggcgaccacctcggttccgctcgtgtcaaagccggatctcagccgccgcgttcctgtcaggtactccgtcttccggcgaggttaagcggactgcaacttgcacatcacggtaaggaattcgtcgccgatgtagcgaagagggagatgttgttggatgctacggtggatatagaaggttttgctaaggtgatgtggtgggaccataaattccgggtgcacgtggatagtcacgtgactgtagacccggtttttcttgacgttattgatcaggaaaataaatcggctttggaggtctttgttaaataacggttcagtccggttcactgtgttgtatcggtttaatttgttcactactaaatatcaagtctatagttgtaattcacttttgattatatattttgtaagatggtttgggcgtgtgaagagatcagatgtatggatgtcgaggttggctacaggttgttttaggagagacagaggtaaaccgaagaaatattaaagagatccaggtgattagaagatgtggaggacacaaattaggaaagaagggtagtaggtcgttgagtcttgagtgtcatattacttgcgaattacgcgcttctttactaatagtttatcttcaatttctattactatatgatattaaggattttatcgcaactt

SEQ ID NO: 7819 - DNA, 1145 bp, Solanum phureja
  misc_feature (249)..(253): n is a, c, g, or t
aattcgaaattaccaaacttctgacattatgcctaacttttctgctgtatttaagatcacaacaagggacataaatgtcatttcacattccccagtccattttcaactacttttcttttgtcctccatttttgccccccaatcaaaattcagtatcttctcaggccaatgagcaaagaaggaagaagaagaggagtaagatggagctggacctccgccttcgtcggcgccgccgctgccgccgcaaagnnnnnggcactctcttcaaagccacgggatcccgattttcatctcatctccatcgatctcacttccttcaagctcaatttccccgtcgtagacgcggaactcatcctcaccgttcacgttactaaccctaacgttacttcaatcaactactcctcaacagaaatgtcgattttctactccggcgaccacctcggttccgctcgtgtcaaagctggatctcagccgccgcgttcctgtcaggtactccgtcttccggcgaggttgagcggactgcaacttgcacatcacggtaaggaattcgtcgccgatgtagcgaagagggagatgttgttggatgctacggtggatatagaaggttttgctaaggtgatgtggtgggaccataaattccgggtgcacgtggatagtcacgtgactgtagacccggtttttcttgacgttattgatcaggaaaataaatcggctttggaggtctttgttaaataacggttcagtccggttcactgtgttgtatcggcttaatttgtattatcactactaaaaatatatttttatcaagtctatagttgcaattcacttttgactatatatttcgtaagatggtttggacgtgtgaagaaatgagatgtacgattgtcgaggttggctacaggttgttataggagagacaaaggtaaaccgaagaaatattgaagagattgaggtgattagaggatgtggaggacacaaattagaaaagaaggatagtaggtcgttgagtcttgagtgtcatattacttgcgaattacgcgcttctttactaatagtttatcttcaatttctattactatatgatattaaggattttatcgcaacttattattattattattattattatatataatgtaattttcg

SEQ ID NO: 7820 - DNA, 674 bp, Solanum melongena
aatcagaattcagacaaatgagtaaacaaggaagaggacgaagatggagctggacctccgccttcgtcggtgccgctaccgccgccctcaccgtagctgcactgtcagtaaagccacgggatccagattttcatctcatctccatcgatctcacttccttcaagctcaatttccccgtcctagacgccgaactcatcctcaccgtccacgtcacgaaccctaacgtcacttccatcaactactcctcaactgaaatgttgattttctactccggcgaccacctcggctctgccagagtcaaagccggttcccagccgccgcggtcctgtgaggtactccgtcttccggcgaggttgagcgggctgcaacttgcacatcacggcaaggaattcgtggccgatgtggcgaaaagggagatgttgctggatgcaacggtggatatagaaggatatgcgaaggtgatgtggtgggaccataagtttcgtgtgcacgtggatagtcacgtgactgtagacccggttttccttgatgttattgatcaggaaaataaatcggctttggaggtttttgttagatgacggttcagtccggtccagtgcaatcagtgttattgtatctgtttaatttgcattattattatcgccaatgtatttcatataaaattattaaattac

SEQ ID NO: 7821 - DNA, 877 bp, Nicotiana benthamiana
gaatttatcaaattctgacatgcttcctagcttttctgctccaatggaccacaaccagggacataaaaagtaatttcacaatcccaagtccaatttcatttcaactgcttttctcttctgtcccaatcaaattcaaaatcaattcagaccaatgagcaaagaaggaagtagaagaagaggcggatggagttggacttccgccctcgtcggtgccgctgctgccggcgtggcgttctcagcactttcgtcgaaaccacgggacccagacttccacctcatttccattgacctcacttccttcaagctcaatttcccagtacttgacgctgaactcatcctcaccgtccacgtcactaaccctaacgtcacttcaattacttactcgtctacagaaatgtcgattttctactccggcgaccacctcggttcggctcgggtgaaagccggatcacagccgccgcgttcctgccaagtcctccggctaccggcgcggctgagcggcgttcaactggctcatcacggcaaggaattcctgtccgacgtggcgaagcgggagatggtgctggacgctacggtggatatagaaggatttgctaaggtgatgtggtgggaccataagttccgcgtgcacgtggatagtcacgtgactgtcgacccgatcttttttgatgtcattgaccaggaaaataagtcggctttggaggtcttcgttaggtaacgtctgaaccggccacccggcgttcaccggtcagctcattgtattttttgagggtttaatattgttactagtatgacttatgtttctcgccccacgtggttaaattatataaagctgtatgcaatctagttaattaagaaaagaaatggtttgctcttt

SEQ ID NO: 7822 - DNA, 766 bp, Nicotiana tabacum
  misc_feature (660)..(660): n is a, c, g, or t
  misc_feature (665)..(666): n is a, c, g, or t
  misc_feature (722)..(722): n is a, c, g, or t
  misc_feature (757)..(757): n is a, c, g, or t
  misc_feature (761)..(761): n is a, c, g, or t
ggaatttatcaaattcttacatgcttcctaacttttctgctccaatggaccacaaccagggacataaaacgtaatttcacaatcccaagtccattttcatttcaactgcttttctcttctgtcccaatcaaattcaaaatcaattcagaccaatgagcaaagaaggaagtagaagaagaggcggatggagttggacttccgccctcgtcggcgccgctgctgccggcatggcggtggcggcactgtcgtcgaagccacgggacccagatttccacctcatctctatcgacctcacttccttcaagctcaatttcccagtactagacgctgaactcatcctcactgtccacgtcacaaaccctaatgtcacttcaattacttactcgtctacagaaatgtcgattttctactccggcgaccgccttggttcggctcgggtgaaagccggatcacagccgccgcgttcctgccaggtcctccggctaccggcgcggctgagcggcgttcaactggctcatcacggcaaggaattcctgtccgacgtggcgaagcgggagatggtactggatgctacggtggatatagaaggatttgctaaggtgatgtggtgggaccataagttccgcgtgcacgtggatagtcacgtgactgtcgacccgnttttnnttgatgttattgaccaggaaaataagtcggctttggaggtcttcgttaggtgacgnctgaaccggccacccggcggttccccggtcagttnattntattt

SEQ ID NO: 7823 - DNA, 685 bp, Nicotiana benthamiana
tcaaattcaaaatcattcagaccaatgagcaaaaaaggaagtagaagaagaggcggatggagctggacttccgccctcgtcggtgccgctgccgccggcatagcgatggcggcactgtcgtcgaagccacgggaaccagatttccacctcatctccatcgacctcacttccttcaagctcaatttcccagtactagacgctgaactcatcctcaccgtccacgtcactaaccctaacgtcacttcgcttacttactcgtctacagaaatgtcgattttctactccggcgaccacctcggttcggctcgggtgaaagccagatcacaggcgccgcgttcctgccaggtccttcggctgccggcgcggctgagcggcgttcaactggctcatcacggtaaggaattcctgtccgatgtggcgaagcggcagatggtgctggatgctactgtggatatagaaggatttgcaaaggtgatgtggtgggaccataagttccgcgtgcacgtggatagtcacgtgactgtcgacccgatttattttgatgtaattgaccaggaaaataagtcggctttggaggtcttcgttaggtgacgtctcaaccggccacccggcggttccccggtcagttcattgtattttgtttacggtaagtgtcaaatatatccttataatattaaaaataggt

SEQ ID NO: 7824 - DNA, 697 bp, Capsicum annuum
caattcagtccaacttttttcagtccaaaatgagtaaaggaggaagaaaaacaacttctggaggactaagatggagctggacctccgccttagtaggcgcagctaccgcggcggccgcggtagctgcactctcctcgaagccaagagatccagatttccatctcatctccatcgacctgacatctttcaagctaaaattcccatcggtggacgcggagttgatcctaaccgtccacgtgacgaatccaaacgtgacctcaatcacctactcgtcgacggagatgtcgatcttctactcgggcgaacacttgggttccgcccgagtaaaagcgggatcgcagaagccgcgatcctgccaagtcctccggttacccgctcggttaaacggaggacaacttgcgcaacgcgggaaacagttcgttgccgatgttgcgaagagggaaatggtactggatgctactgtggatattgaaggatttgctagggtgttatggtgggaccacaagtttcgtgtgcacgtggatagtcacgtgactgttgatccggtttttcttgatgttattgatcaggaaaataaatcggctttggaggtcttcgttagatgacggttcggttcggtttaatttgtagtattgttattgttgttattaatgtatttcatgttaagtggttaatgaattatttaagttttatcgtt

SEQ ID NO: 7825 - DNA, 2347 bp, Solanum phureja
gggagatcctaacaacatccagtccacatggactatacccgccaactccttaaacacacaactccaacacaacagattttcaacaaaatcaataatggagctgcgttgcttgcagtcactcaatatacctccaactggtttagcagagaagccatttttgtgtggacagccaattacattgattcacactagcactaaaagaggcccaaattccaagaaccttaagccccttcgtttcagagctcaaatttctgcaaaaattagctcattggaacctcaaggaactgcaaaagatgtcaaatcaaaagatggaaatcttgtttttgttgctggtgcaaccggtagggttggttctcggactgtaagggagcttctgaaattaggctttaaagttcgagctggagttcgaagtgctcaaagagctcaacctcttgtcaaaagtgttgagcagataaaaattgagaatactacggatggaggagcaaaagctatagagaagcttgaaattgtggaatgcgatttggagaaaagtgatcagattaggcctgcactgggcgatgcatcaattgttatatgttgcattggtgccagtgaaaaggagatctttgatgttactggaccatatcgaattgattacctggccactaagaaccttattgatgcagcaaccgttgcaaaagttgaccactttatcttgctcacatctttgggaacaaacaaggtcggttttcctgcagcaattctcaatttgttttggggagtcctcctttggaaaaggaaagcagaagaggcactgcttgctagtgggcttccttatactattgtgaggcctggaggaatggaacgtcccactgattctttcaaagaaactcacaatattactatttcggaggaagatactttatttggtggtctcgtgtctaaccttcaggtggcagaactaatggcggttatggccaaaaaccgtagcctttcatactgtaaagtggttgaagtagttgcagaaacaacagcaccgttaacccccatggaggaccttcttgcaaaaattccctgccaacgtgttgaggtttccccacccaaggaaactggtgatttacagaaatctgcaactccaagcagtactacgtctgagatccctgatgcctcgctcgagaaaaaacctgctgaaacaaagttgaaagcagcagcaccactctctccatttactgcttatgcagatcttaaaccgcctacatctcctagtccaattcctcccggtggtcgtcaagaaggtacaattggagcagaagatagcaaacccacaaaagaagcctcttctgttgttgattatgcttttgacaaagcagaattgctgactacaaggccttcatctccatatgctgcttatgaagatttaaagccacctacatctcctagtccaaatcctcccggaggtcatcaagaaggtgcaagtggagcagaagatagcgaacccactaaggcagcctcttctgttgttgattctacttttgacaaagcagaattgctgactacaaggcctttgtctccatacattgcttatgaagatttaaagccgcctacatctcctagtccaaatccttccggaggtcgtcaagaaggtgcaagtcgagcggaagatagcgaacccactaaaccagcctcttctgttgttgattctacttttgacaaagcagaattgctgactacaagttatgaagatctaaaaccacctacatcccctagtacaaatcctcccggaggtcgtcaagaaggtgcaagtggagcagaaaatagcaaacccactacggaagcctcttctgtttatttatttacttttgacaaagcagaattgctgactacaaggcctttgtctccatacactgcttatgaagatttaaagccacctacatctccaagtccaagacccagtggtttgaaatcctcagcaaccgtggaagtaacatcaccagttactggaggcaatgatgtggcaatcaatagtgctaccaattctgccaaggaggattcgtcaaaaaattcagctttctgtcattctccctacccagcgtatgaggacttcaagcctccaagttctccaacgccatctttcaataaaatgtgaagggctggaatctagttctgttttgcttcaatagttgtatctcggcaagcctatcgcgtaatgcatcaactcaagcattacagttggagcaatttttgatgatgtctttattttgtttccacttttatttgacttgttgatgctaactcacatactgtcaactgttaactctattagcattcacatgttattgtataaaatgagaccacattttccttgttt

SEQ ID NO: 7826 - DNA, 1846 bp, Nicotiana benthamiana
ttgttgaagtaggtgaagcaaactttaatcttcacaagttcatgcttgtggcgaagagcaactacataaggaaacttatactagagtctaaagaaacagaagtaacgaggataaacttgtctgagatacctggaggaggtcctgagatgtttgaaaaatcagccaagttttgctatggagtcaactttgaaatcacagttcataatgtagctgctcttcgttgtgctgctgaatacttacaaatgactgataaatactgcgataacaatcttgctagcaggacagaagatttccttacccaagttgccttgactagcctttctggcgcacttgtcgtattaaaatcttgtgaaaatcttcttccccttgctgaggaactcaacatcgttcaaagatgtgttgaaatcgccagtgctaagttaaccatattagacataactgtggaggcgaattttccaagcagatcaccaccaaattggtggacggaagagttcaccatattagacataacatttttcgagagaattatcatttcgatgaaaactcggggagcaaaagcgttgacagcagcaagtgctataatcacgtatacagagagatctcttcgtgaccttgtacgtgaccactccggtaatggaaccagattagtcgagccagaggactccgacatcaggatgcatcaacgccaacttctcgagtcaattgtaaaactcttaccttcagacaaagcagcttttcccatcaatttcctatgttgtctccttcgtacagcaattttcttaagagcagctaatagttgcaagaatgaattggagaaaaggatatcagcaattttagaacatgtgactgtagatgatctgctcgtgttgtcttttacttatgatggcgaaagattattcgatctcgagagcgtcaggagaataatttctggatttatggagaaagagaagactgtggcggtttttaatggtggtgatttgggacaacaagtttgttccacggcgatgcagagagttgcaaagactgttgatgcgtatcttggtgaaatagccacttttggggacctcactatagccaaattcaatggaattgctattttggttcctaagggagctaggaaggctgatgatgatctttacagagccgtcgatatctacttaaaggcacatccaaatttggatgaaattgaaagagagaaagtttgcagcgtgatggatacactgaaactttcgtatgaagccagagttcatgcttcacaaaacaaacgtttgccagtgcaaatagtccttcatgctctctacttcgatcaactgaagataaggagtgggggaaatgatactagcaatttacccgaagccatggcaacaaggaatcaattacaagccgatgtttcgcttgtcaaggagaacgaagctctaagaactgaactgttgaagatgaaaatgtacatatcggatagacagaaaacaaatcaagggactacttcagctaaacccagtcttagcagaaagccaaccttcttttcttctgtctccaaaagattgggtaaattgaatccctttaagcatggatcaaaggacacttctatgattgatgatgccactgtagatattactaagcctaggaggagaagattttccatttcctagcttaattatatatttggttttagtttatgttgagtgagaatgattgaatttgtgtaaaggattgattctcttgtttgtttgtttgtttgttctccttttaggattatatccccgtgttctaatgttactataaagtagaaaacacttgttttttcaatactgtgttaattcatgtgattgtatacccaactctgtta

SEQ ID NO: 7827 - DNA, 1952 bp, Amsonia hubrichtii
agcagactctctctcgctatggagaggactggccaatgggttttctctcaagagattccaacagatgttatagttgtagttggtgaagccaacttttctcttcataagttcatgctcgtggcaaaaagcaactacataagaaaaataattctagaatcaaaggaagctgatctaacgaggatagatctgtctgaaatccctggagggcctgagatttttgagaaggcagctaaattctgctatggagtaaactttgagatcacagtacaaaacgtagcggctctgcgctgtgctgctgagtatctccagatgactgataaatactgtgacaataacctcgctggccggacagaggatttccttagacaagtcgccttgaccagcttctctagtgcgttggttgtccttaaatcgtgtgaagatcttcttccccttgccgaagaactcaatatagttccaagatgcgttgatgttgttagctcaaaggcatgtgttgaggcgaactttcctagccgttcgccaccaaattggtggactgaagagctatcaatcttagacataagtttcttcggaaagattattagtacaatgaagtcacggggttctaaatctttaaccgttgctagtgccataatagcatatgctgagaagtccctatgggatcttgtacgtgaccattccggcaacggtgtcaaaacaaatattcttgatgactctgatatcagaatccggcaacgggagcttcttgaatctgttgttactcttttaccttctgaaaaggcagctttccccattaatttcctctgttgtctcctcagagctgctattttcttaggagcagcaagtagttgcaagaacgagcttgaaaaaagaatatcagccatattggagcatgtcacggtagatgaccttttggtgttatctttcacttatgatggtgagaggctgtttgatcttgatagtgtgaggaagattatttccgggtttgtaggaaaaagaaagagtgttggtgtctttaatggaggcgattttagggaagtttgttcaacagctatgctaagagttgccaagactgttgatgcataccttggtgagattgctacttatgcagatcttagcatatctaaattcaatggaattgcaattttggttccaaagggagctcggaaggttgatgatgatctttaccgtgccgtcgatatctaccttaaggctcatccaaatcttgatgagattgagcgagagaaagtatgcagtgtgatggatgctttgaagctatcttacgaagcaagagtacatgcatcacaaaacaaacgtttaccagtacaaatagtccttcacgctctgtattatgatcagttgaaaataagaagtggaacagaagatcagagcatgccaaacgccataaccacaagacatcagttgaaggcagattcatcactggttaaagaaaacgaagaattgcgaacggagttgttgaggatgaagatgtacataacagatatgcagaagagccaggggacatcatccaaaggactaggaaagaagtcaactttcttctcatcaatgtcaaagacactggggaaattgaatcctttcaagcatggatcaaaggatacctcaaacatagatgatgatggagcagtagataccaccaaacctaggaggagaagattctccatttcctagatttatgaactgaatcctttagcttcagatatgtgttatatttctgcaaaggtttgatgcttttacttcagaaacttagttgggtgtgaaaatttacatcatgttcttttgttctttcaaagttgtctgtgttagtatttgttgattgtgtaagaatatttatttgtgaagttgtatagtagttgtgagatggtaacacagaggaaagtttgtaatcacttagatccagacattgatcattgtctccggttctagatgttgct

SEQ ID NO: 7828 - DNA, 2778 bp, Solanum phureja
tttaggactagttgaagagacgcttcattgaaaggttggtacttgaagacaacggtatgtgcaatttttcttctaaactagaggtttgcgcaccaactcaatccgctgccttattcatcattggactttttgaatctggttgatgaggagtgttcggatggactcaaatggtcccccaactaaaaggttggtggaactcaattgtcatagcatacaggatggccagaatggagtaaggggtggaattactggtgatggacagggactttcagaagaagatgagtcaagaattaatgaggacgtcgaaggtgggaatgaaacacacaggaatttggtacaagtgcaggctgttctacaaacacagcagcaacagcccccaggacctttggttaggtgggagcgttttcttcctcttagatccctcaaggttctgctggtggagaatgatgattcaactcgtcatgttgtcagtgcattgctgcgaaactgcagttatgaagttatagctgtgggatatgcccttgaagcgtggaggattctagaagatctaactaaccatgttgatcttgttctgacggaggtggccatgccatatttgtctggggttggtctcttgtcaaagattatgaaccacaaaactctcaagaatgttccagtgattatgatgtctgctaatgactctatgggtatagtctttaagtgtttgtcaaagggcgcagttgactttttagtgaagcctattcgaaagaatgagcttaaaaatctgtggcagcatgtttggaggaaatgccacagttcaagtggaagcggaagtgaaagtggtatacaaactcaaaagtcgacgaaatctaaaagtgttgaaatgtcgggaaacaacactgatagcaatgatgaagctgagaatggaagctttgatctggacgacagggacggaagtgacaatggaagtggcactcagagttcatggtctaaaagggccattgaagtcgacagcccccaacccatgtcaccatggaatgaattggcagatccccctgatagcacttgtgcccaggttatccatacaaggccagaagcacttagtgctacctgggtgcctgcaaatgccaccagaaaatgcctcaatgagaaggatgaactgggaaatgctagaatgggtaaagatttgaacatgggtgtcactaatgttccagagcttgaaggcctatcaggtaaagtaatggatggtttagcagcttctattaaggacaaacatttggagttagatcctaaggataatgagaatatgggtagaaacctaaagctgaacaaggaaactcgggaagatgacctgaaggacaaggatgttggttatatgggtgacataaccaacacatgtacgcctcaagtagaaagtatggccaatgaagttcctaatgatcctttcaagatcacaaacataaaagaaattgccacctatgacagtcaagacatgccttcacttgaacttagtttgaagcaacttcgagatgttggagagaatgggactggtgttcaagagcgaaatatactcaggcattcagatctgtcagcattctctaggcatgtgtataatgctgcttcaactgctaatcaggctccaactggaaacgtgggcagctgttcaccagttaataattgttcagaagttgcaaaagcagaatcaattcataacttgcgatcgaagtcaaacagtacccctaatcagtgctcaaatggaagtagtaacaacaatgacatgggctcctcgacaaataatttcttcagcaaaccaaacacattaactgacaagccaataaacaaacctgcagtcaatgcccatccctgttctgcatttcaaccagtgcaacatggacataattcttctcttcaagctatggttccacgaacacaagatactgcaaaggcagccgtgagccaagcaagagcgatgcaccagaagttccaagttcagcaccaccatcatcactaccatcaccatcaccaccatgtgcttaacttgcagcagcgacaacagctgcttaacaatgatgattcgtctttgcgaaatgatgttgaagctgctccagattgcggaacatctgacatggtaggtactcctgttgaaggaaatgctgctaattatggaagtgcatcaggaagtaacaatggaagcaatgggcaaaatggaagcagtggccaaaatgggagtagcactgctgtagttgctgaaggaacaaatttggttgctgaaaatgaaactggtgaaaaatgtgaaattggcagtgggagtgggagtggaagtgcaagcagaagtggtgatcacttggctcaaagagaggctgctttgattaaattccgacaaaagagaaaggagagatgctttgagaagaaggtccggtaccagagtagaaagagacttgcagaacagaggccacgcatgcgagggcaatttgtgcgtcaagatgcagacaaaagtaaaagcaacaatacaaattcctgacccctaccgtttgaattggatggttgatgtcaaatgagttcaagaagctttagctttgatcgcctaggtagggaggaagcagttcggtaaaacagctaaatttatttagttgaagcattgctgtctagtaataattgcttattggagatcatattaattggggagtcctatgaagacgtatttgttatatagccagtttgaagatatttattttacacttctagatgttgggataccctaataaaattcttcagtatgttgtgctttctggtgtgctt

SEQ ID NO: 7829 - DNA, 3118 bp, Nicotiana benthamiana
tcttttgctttagcctatcgccgtttctcaaccagtaaaagacctccaaaaatccccttaacaaatttatattttttccccataaaaagcaaaccctagaagaagaagaaattcgaagaaaatgagtctacaatagtgggatgaaatattgaatttggactttttacacaaatttgttcgtccttttttttgtgaaccgattgcagtagtagacagtatcagtggaagcttctctttctcgttaatgaggtccataaggacttgttgaagagccatttcattgaaaggttggtacttgaagacaacgttatgtgcaacttttcttccaaactagacgtttttgcaccgactcaatccgctgccttattcatcattggactttttgaatctggttgatgagaggaattcggatggactcaaatggtcccccaactaaagggttggtgggactcaattgtcatagcatacaggatggtcagaatggagtgagggatggaattactggtgaaggacaggggctttcagaggaagatgagtcaaggattaatgaggatgttgaaggtgggaatgaaacacagagggatttggtacatgtacaggctgttctacaaacacagcagcaacagcctcaagggcctttggttagttgggaccgttttcttccaattagatccctcaaggttttgctggtggaaaatgatgattcaactcgtcatgttgttagtgcattgcttcgaaactgcagctatgaagttacagctgttggaaacgcccttgaagcatggaggattctaggagatcttgctaatcatgttgatcttgttctgacggaggtggccatgccgtatttgtcaggcattggccttttgtcaaagattatgaatcacaaaactcgcaagaatgttccggtgattatgatgtctgctaatgactctatgggtatcgtctttaagtgtttgtcaaagggtgcggttgactttttagtgaagcctattcgaaagaatgagctaaaaaatctctggcagcatgtttggaggaaatgccatagttcaagtggaagcggaagtgaaagtggcatacagactcagaagtctacgaaatctaaaagtgttgaaggatcgttgaataacactgacatcaatgatgaagctgagcatgggagctttgatctggatgaccggaacggaagcgacaatggaagtggcacccagagttcgtggtccaaaagggccatagaagttgacagcccccaacccatgtcaccatggaatgaattggccgatccccctgatagcacttgtgcccaggttgtccattcaaggccagaagcacttagtgctacctgggtgcctgcaactgcccccagagagtaccgcaatgagaaggatgaacttggaaatgctagaatgggtaaagatttgaacataggtgtcactagtgttccagagcttgaaggccgatcaggtaaacctatggatgatctagcagctcctacgaaggataaacatttggaattagaccccaagggtagtgaggaaatggtcagaaacctcaagcacaacaaggaaacacgggaagacgacctgaaagacatggatgttggttatatgggtgatcacaccaaaaccggtactcctctagtagaaagtatggccaatgaagttccaaaagatccttcggagatcacaaacatcaaagaaatagccacctatgatagtaaaggcatgccttctcttgaacttagtttgaagcagcttctagatgttggagaaactgggaccagtgtgcaagagcgcaatatactcaggcattcagacctttcagcattctctaggtataatgctcctgcttcaaatgctaatcaggctccaactgggaatgtgggcagctgttcaccagttaataatagctcagaagttgcaaaaacagaatcactgcttaacttgcgatcgaagtcaagaagtacccctaaccagcgctcaaatggaagtagtaacaacaatgacatgggctcctcgacaaataatttctttgtcaaacaagaaacattaactgacaagccaataaccaaacctgcagtcaatgcccatacctgttccgcatttcaaccagtgcaacatggtcataattcttctcttcaacctatggttccaggaaaacaagatgctgcaaaggcagccctggcccaagcaagggcgatgcagcagcaggtccaagttcagcaccaccatcatcactaccatcaccatcaccaccacgtacttgacctgaagcagcaacaacagctgcttgacactgatgattcgtccatgagaaatgctgttggagccgctccaaatttcggaacatctgacatggttggaactgttgaaggaaacgctgctaattatggaagtgcatcaggaagtaacaatggaagcaatggggaaaatggaagcagtggccaaaatggtagcagcactgctctagttgctgaaggaacaaatttggttgctgaaaatgaagcgggtgaaaaatgtgaaattggcagcatgagtggaagtgcaagcagaagtgatcagtcggctcaaagagtggctgctttgattaaattccggcaaaagaggaaggagaggtgctttgagaaaaaggtccggtaccaaagtagaaagagacttgcagaacagaggccgcgtgtgcgagggcaatttgtgcgtcaggatgcagacaaaaataaaagcaatgatgattcctgacccctgccgttatgcttagatggtacatgtgaaaatgagttcgagaagctttagctttgatcgccaaaggtagggaggaagcagtttggttccaaagctaaatttatttagttgaggtattgctgtcttttgaggtattgctgtcttgtaataattgcttattggagatcatattaattggggagtcctatgaagacatctttgttatatagtcggtttgaagatacttatatttggacttgtagatgttgggataccctaataaaatgcttcaatgtgctgtgctttctggcgtgctcaaaactgcttttccaaagtccctcgtgtattgtttgtgtttcattttcatattacttttatccacatctcactttatactcgag

SEQ ID NO: 7830 - DNA, 2792 bp, Solanum lycopersicum
gttggggcttgcttatgaactgaagcaggtaaatatgcataagaggatatgtactaataacagggaaaaaatcttgttctgagacggtatttcttttcgagggaacgtggatatctcttgaggttttttgaaactcaattgtttgagactaaccaaaacttgcagatttttgaatcttttgatccatcctgtcttttttattttcttatcgaatgtattactttggaatattggcagttatagctgtgggatatgcccttgaagcatggaggattttagaagatctaactaaccatgttgatcttgttctgacggaggtggccatgccatttttgtctggtgttggtcttttgtcaaaaattatgaaccacaaaactctcaagaatgtcccagtgattatgatgtctgctaatgactctatgggtatagtctttaagtgtttgtcaaagggcgcagttgactttttagtgaagcctattcgaaagaatgagcttaaaaatctgtggcagcatgtttggaggaaatgccatagttcaagcggaagtggaagtgaaagtggtatacaaactcaaaagtcgacgaaatctaaaagtgttgaaatgtcgggaaacaacactgatagcaatgatgaagctgagaatggaagctttgatctggacgacagggacggaagtgacaatggaagtggcactcagagttcgtggtctaaaagggccattgaagtcgacagcccccaacccatgtcaccatggaatgaattggcagatccccctgatagcacttgtgcccaggttatccattcaagaccagaagcacttagtgctacctgggtgcctgcaaatgccacaagaagatgtctcaatgagaaggatgaactgggaaatgttagaacggttaaagatttgaacatgggcgttgctaatgttccagagctcgaaggcctatcaggtaaagttatggatggtttagcagcttctatgaaggacaaacatttggagttagatcctaaagataatgagaatatgggtagaaacctaaagctgaacaaggaaacacgggaagatgacctgaaggacaaggatgttggttatatgggtgacataaccaacacatgtacgcctcaagtagaaagtactgccaatgaagttccaaatgatccttccaagatcacaaacatcaaagaaattgccacctatgacagtaaagacatgccttcacttgaacttagtttgaagcaacttcgagatgttggagagaatgggactggtgtgcaagagcgaaatatactcaggcattcagatctgtcagcgttctctaggtataatgctgcttcaactgctaatcaggctccaactggaaacgtgggcagctgttcaccagttaataatagttcagaagttgcaaaagcagaatcaattcacaacttgcaatccaagtcgagcagtacccctaatcagcgctcaaatggaagtagtaacaacaatgacatgggctcgtcgacaaataatttcttcatcaaaccagacacattaattgacaaaccaacaaacaaacctgcagtcaatgcccatccctgttctgcatttcaaccagtgcaacatggacatacttcttctcttcaagcaatggttccaggaacacaagatactgcaaaggcagctgtgggccaagcaagagcagtgcaccagaagttccaagttcagcaccaccatcatcactaccatcaccatcaccaccatgtgcttagcttgcagcagcgacaacagctgcttaatgctgatgcttcgtctttgcgaaatgctgttgaaactgctcccgattgtggaacatctgacatggtaggtactcctgttgaaggaaatgctgctaattatggaagtgcatcaggaagtaacaatggaagcaatgggcaaaatggaagcagtggccaaaatgggagcagcactgctgtagttgctgaaggaaccaatttggttgctgaaaatgaaactggtgaaaaatgtgaaattggaagtgggagtggaagtgcaactagaagtggtgatcactcggctcaaagagaggctgctctgattaaattccggcaaaagaggaaggagagatgctttgagaagaaggtccggtaccagagtagaaagagacttgcagaacaaaggccacgcatgcgagggcaatttgtgcgtcaagatgcagacaaaagtaaaagcaacaatacaaattcctgacccctaccgtttgaattggatggttgatgtcaaatgagttcaagaagctttagctttgatcgcctaggtagggaggaagcagttcggtaaaacagctaaatttatttagttgaagcattggtgtctagtaataattacttattggagatgttattaattggggagtcctatgaagacgtctttgttatatagtcagtttgaagatacttattttgcacttctagatgttgggaataccctaataaaattcttcagtatgttgtgctttctggtgtgtgcttaaaactgcttccaaagtctctcatgtaacatttgttgcattttcctactaatatcatccatatctcattttacactccaggaagtttagttctctacagtttacgtctgtcctaaaatttctgaagggatacccagcagaattgtagtataacataagttgtgcggactgtttacttccggtgccacatccatgtcagattctctaaaatacactacttttggaaaatctgatatgcacaccgacattttggaagagtcccgagtcactttgtatagggggtgttt

SEQ ID NO: 7831 - DNA, 763 bp, Solanum phureja
aaagaaagtaaagatttaggcacaaccattcatgtatttggataagactactacactactactcatttacaaagtaacacaaactccatgaacaaaattaattagctcatatggaaactctcatatgccttcaaatcccaaatctctccattacaaactcatttccattgaatcaaaaattcccaatccattttcataaaaaaataaacagaattccaaatctccaacgaaccacatggaaattgaatgccgaagcaaaaggcttcggcaatggaaaacctgaaatttcaaaaaaagggaacagaaggaacaataacgataacgacgagaaaatcccgacggagatatgggaaaggattattggaaggattctgttttacgtcggagctccgttgatcggcggtgtgattttgctgcagattttcgatattataaagcagcagaaattgttggatctgccaatttggttgccatttttgacgacgtttatcacatttggggcttcagcacttggagctgcttatgggactttgtcagccagttgggatccggaaaaacaagggtcgtttattgggctggaagaagcacagaagaattgggttgatatgtgggctgaagatggtgctgatgaagaagaagaaaataggtggatcaattaagaaatgtaaactactgattatttttccttaattgaataggagtaatttaatccagtttttttctgttggttgttgtttattggataagtgattgacagaaaatt

SEQ ID NO: 7832 - DNA, 756 bp, Solanum tuberosum
gaaagatttatgcacaaccattcatgtatttggataagactactacactactattcatttacaaagtaacacaaactccaaaaacaaaattaattagctcatatggcaactctcatatgtcttcaaatcccaaatctctccattacaaactcatttccattgaatcaaaaactcccaatccattttcataaaaaaataaacagaattccaaatctccaacgaacaacatggaaattgaatgccgaagcaaaaagcttcggcaatggaaaacctgaaatttcaaaaaaagggaacagaaggaacaataacgataacgacgagaaaatcccgacggagatatgggaaaggattatcggaaggattctgttttacgtcggagctccgttgatcggcggtgtgattttgctgcagattttcgatattataaagcagcagaaattggtggatctaccaatttggttaccatttttgacgacgtttatcacatttggggcttcagcacttggagctgcttatggaactttgtcagccagttggaatccggagaaacagggctcgtttattgggctagaagaagctcagaagaattgggttgatatgtgggccgaagatggtgctgatgaagaagaagaaaataggtggatcaattaagaatgtaaactaacgactattattccttaattgaataggaataatttaatccagtttttttttttggtgggtgttgtttaatggataagtggttgacagaaaatt

SEQ ID NO: 7833 - DNA, 917 bp, Solanum melongena
aaagcaagtaaagatttaggcacaaccattcatgtatttggataagactactaccattcacttacaaaggaacaacacaaactccatgagaaaaataaccaaaattagttaagctcatatggaaactctcatagctcttcaaaacccttatctctccactacaaatttatttccattgaaccaaaaaatcccaatccattttcataaaaacataaacggagttccaaacctccatcgaaccacatggaaattgaatgccgaagcaaaaggctttggcaatggaagactcgaaacttcaaaaaaagctaacagaaggaacagcaacgacgatgaggacgagaaaattccgacggaagtatgggaaaggattatcggtaggattctgttttacgtcggagctccgttggtcggtggtgtgattttgctgcagatattcgatatcataaagcagcagaaattgttggatctgccgatttggttgccatttttgacgacgtttatcacatttggggcttcagcacttggagctgcttatgggactttgtcagccagttgggatccggagaagcagggctcctttattgggctagaagaagctcagaagaattgggttgatatgtgggctgaagatggtgctaatgatgaagaagaaaataggtggatcaattaattaaaaattgtaaactaatgattattattttcttaattgaataggagtgatttaatcaagggtttttctttttgttggttgttgcttattggtaagtagttgacagaaaataaggggttagttatcatatggttgattaaattcataaatttctcgtcatgacatgttttataatacataatttaggggtcggttttgtttaaaaataagttacgttgagattgtagtataaggattacgaaattgt

SEQ ID NO: 7834 - DNA, 981 bp, Solanum phureja
tgaaccactcaactctcaatttctcaaataactcaatatttcttctctcattcataggaaacaaagtttcagctcactctaaacttaacaatggcttccacaacgtatggtggtggccttttgtgcaaaactagagtttctatctcttcttttcctttgatgcaacccaaaatgagaccagaaataacttactcccagagacatcccagagtcggaacttcctctctcctgaggaatgtatcccacaacatgggcatgaagaaagttccacgtatgatcaccagagctagctcagaaccgagtggcagtagtgatggagctcttggccaggataagacaccatttggatatacgagaaaggatgttctattgatcggagttggagttacacttctaggggttggtttaaagagtggattggagttcttgggatttgaccctttacaagctggaaatgtcgttcaactagtccttgttttgggtctaacagttggatggatctcaacatacatcttccgggtttcaaacaaggaaatgacatatgctcaacaactacgagactacgaaagcaaagtcatggagaaacggttagagagcttaacagaagcagaattacaagtattgcttgagcaggttgaagaagagaagacccgcctgactagtggtgaagaggttaaatagatattgttttccttatgcctacgtaccgttggaccttgttacccatggaaaatggtctggaccataatgaagtctgtacaatagtcaatatatgcttgcctaacatctgatgatcacttccaatttgataaaacaattctggaatgaaaagggttcccctagatggggagttcatgttctgtaaattgtttaggattttatagaaaatacatgatatacgaactattatttatcgcttgtgcatttgttgttaccttttctattcaagcaaaaacataaatgtgataaaacaatgtattg

SEQ ID NO: 7835 - DNA, 1020 bp, Solanum tuberosum
gctttgaaccactcaactctcaatttctcaaataactcaatatttcttctctcattcataggaaacaaagtttcagctcactctaaacttaacaatggcttccacaacgtatggtggtggccttttgtgcaaaagtagagtttcttctttgatgagtatctcttcttttcctttgatgcaacccaaaatgagaccagaaataacttactcccagagacatctcagagttggaacttcctctctcctgaggaatgtatcccacaacatgggcatgaagaaagttccacttatgatcaccagagctagctcagaaccgagtggcagtagcgatggagctcttggccaggataagacaccatttggatatacgagaaaggatgttatattgatcggagttggagttacacttctaggggttggcttaaagagtggattggagttcttgggatttgaccctttacaagctggaaatgtagttcaactagtcctggttttgggtctaacagttggatggatctcaacatacatcttccgggtttcaaacaaggaaatgacatatgctcaacaattacgagactacgaaagcaaagtcatggagaaacggttagagagcttaacagaagcagaattacaagtattgcttgagcaggttgaagaagagaagaccgcctgactagtggtgaagaggtcaaatagatattgttttccttatgcctacgtaccgttggaccttgttatccatggattatggtctagaccatactgaagtctgtacaatagtcaatatatgtttgcctagcatccgatgatcacatcaaacttgataaaacaactctggaatgaaaaaggttccactaggtggggactggggagttcatgttctgtaaattgtttaggattatatagaaaatacatgatatacgaactattatgtatcgcttgtgcattcatttttgccattactattcaagcaagaacataaatgtgataaaacaatgtattgcctgtatattgattgtt

SEQ ID NO: 7836 - DNA, 1037 bp, Capsicum annuum
ttgcagggttgctccactttgagccactcaacttttcaacttctaaaataactcaatatttcttccatcattcgtagcaaaaaatactagtaataatttcagcttattctaaacttaacaatggcttccatagcgtacggtagtggctttttgtgcaaaactagagctttttctttggttggtatctcttcttttcctttgatggagccaggtatgagaccagaaatagcttactcccagagatatctcagagtcggaacttctcctttcctgaggaatgtatcctacaacatgggcatgaagaaagttccacttatgatcaccagagccagctcaaaaccgagtggcagtaatgatggagctcttagccaggataagacaccatttggatatacgagaaaggatgttctgttgatcggacttggagttactcttctagggattggcttaaagagtggattggagtacttgggatttgaccctttacaagctggaaatgtagttcaattagtactggttttgggtctcacagttggatggatctcaacatacatcttccgggtttcaaacaaggaaatgacatatgctcaacaactacgagactatgaaagcaaagtcatggagaaacggttagagagcttaacagaagcagagttacaagtattgcttgagcaggttgaagaagagaagacccgcctgactagtggtgaagaggtcaaatagatattgttttcctcatggcacctcatcccttcttgtctatgttcctttggaccttattatccacggaaaatcgttagaccataaggaattctgtacaatagtcaatatatgtttgcctaacatctgatgatcacatccaatttgataaaatttctggaatgaaaaaagttcccctaggtggggaattagggaattcatgttctgtaaatcgcttaggattttatagaaaatacgtaatatacgaactattattcgttcgtatgtgcattcgttattgccttttctattcaagcaataatatcaatgcctcgtgc

SEQ ID NO: 7837 - DNA, 985 bp, Nicotiana tabacum
  misc_feature (648)..(648): n is a, c, g, or t
  misc_feature (683)..(683): n is a, c, g, or t
catgcggccgctggaaaacatttcagctcaactctccagtagtagaggtaaacttgacaatgggttccacagcgtatactggtgtatataacagccttttatgcaaaactagagcttcttctttgatgggtatttcttcttttccgttgatggaaccaataatgagaccagaaataactaactcccagagacatctcagagtaggaatttccccttccctgaggaatgtatcctacaacatgggcttgaagaaagttccacttataatcaccagagccagctcaaaaccgagtgacagtagcgatgaagctcttggccagaataagacaccatttggctatacgagaaaggatgttatattgattggcgttggagttacccttctagggtatggcttaaagagtggattagagttcttgggatttgaccctttacaagctggaaatgtagttcaattagtcctggttttgggtctaacagttggatggatatcaacatatatcttccgggtttcaaacaaggaaatgacatatgctcaacaattacgagactatgaaagcaaagtcatggagaaaagattagagagcttaacagaagcagagttgcaagtattgcttgagcaggtcgaagaagagaagagtcgtctgnctagtggtaaagaggtcaaatagatacccttggtnttcatgccaaatggtctaaaccataaggaagtctgtacaatagtcaagaatatgcttgcctaacatatgatgaacacaaccaacttgataaaacaattctggaatgaaaaaggtttccctaggtgggagttcctgtttctgtatattgatgattaggattttatagaaatacgaatatccaaactattatttctcgtctgtgcattcattgttacctttctactcaagcaagaacagaagtgtgataaaacaattgttaccttttctattcaagcaagaacaaatgtgtgataaagcgacct

SEQ ID NO: 7838 - DNA, 1061 bp, Nicotiana benthamiana
ttgcgcggctgctccactttgagccactcaagtctcaattctcaatataacttaattggttccctctttcttctctaattcattcataggaaaacatttcagctcaactctccagtagtaaaggtaaacttgacaatgggttccacggcgtatactggtgtatatagcagccttttatgcaaaactagagcttcttcttcgatgggtatatcttctttttcgttgatgggaccaagaattagaccagaaataactaacttccgaagacatctcagagtaggagtttccccttccctgaggaatgtatcctacaacatgggcttgaagaaagttccacttataatgaccagagccagctcaaaaccaagtggcagtagcgatgaagctcttggccagaataagacaccatttggctatacgagaaaggatgttatattgattggagttggagttacccttctagggtatggcttaaagagtggattagagttcttgggatttgaccctttacaagctggaaatgtagttcaattagtcctcgttttgggtctaacagttggatggatatcaacatacatcttccgggtttcaaacaaggaaatgacatatgctcaacagttacgagactatgaaagcaaagtcatggagaaaagattagagagcttaacagaagcagagttgcaagtattgcttgagcaggtcgaagaagagaagagtcgtctggctagtggtaaagaggtcaaatagatacccttggtttccatgccaactggtctaaaccataaggaagtctgtacaatagtcaagaatatgcttgcctaacatatgatgaacacaacctacttgataaaacagttctggaatgaaaaaggtttccctaggtgggagttcctgtttctgtatattgatgattaggattttatagaaatacgtaatattgaaactattatttctcttctgtgcattcattgttaccttttctattcaagcaagaacagaagtatgataaaacaattgttaccttttctattcaagctagaacaaaagtgtgataaagcgac

SEQ ID NO: 7839 - DNA, 2165 bp, Solanum tuberosum
gccttatagcatcttcctactgtcatcctttcacttcacactcactctttttcattcacagatcccaaagtttcaatcttttttcacaaatcttgatccccttttcagttaatgagtgaatttttttgactaatttattatgtagattttgatttttatgtgaaaatatgatgtgggtcgagctcaattttgggtgatgaattggggttttgagatgggtctgaatccgtttgaagaaatggggaaaagggttccgaaaagggtatggcttagatctcaaatgacaatggtattaatgatgggtggaaatcacacttcatccaggttttgtactcgttaatctgtttgattttgttgtttttagacttaaatctcctgtttttagctttttagcttctgtgaaaacttcactttgctgttatagatcttgaaagttttgagctttaaagtttagaaatcttaaaagaaaaaaaaatggatatgaaagttttgaaatggcaatttcttcatggctcattagtgaaacgtttgattctgaaagggttcttgtttgttactgttatgattgttgtgtcatttgttcaaatgacacatatgattcagaaatctgaacctataatgttgaattttggtgtatgccctttgaactttgggtctaatgagtatatgaatgtgaccgggttctttaaacccgtttatggattgaggattccactgtttggggcgtctttgatgaagcgcgacgatgaaaaattgaccaagaatgtgtttaaggagctaatggaaaataatttcttggatttgaatgctaatgcattgtgtgttgggaagaaatcgttgtatgcagctttggtgctgcgagaactgggactcttgagtgctgttggtgttgatgcacacccgtatttctctcttgtatggagaagatttatgtatgagcttgatcatgagaataattctttcgattttgtgttctcaagggatcttgataaggttactgttccagctcttatggtgcttgagattgagcgtgtcttacgtccagggggcactggtgttatgctcgtgggttctagtagtttctacgcgggtaacttgataaaaggcaacttgataaggtctgccaccccagtttcgttgttcttgaagagttctgatgttgtgcacgtatgtggggttggcacgtatactctagtgatgttcaagaaacgatcagagattgttgaatctctcgtgcattctgtgctgcctgctaattgtccttccaatgtgaacaacaagccgtacttgaagcaccttgagccactcatggaaaagaagcttggacagtttgagacacagatctcatacttgcccaagttcatgaacatctcatcaaggaacaaactggtgtatatcaacgttggtgcaggggaatttgtagaatcaactcttgcaagaacattcaagcctcattatccgatccctcaccacttgttcaatgttttcgtcattgatcataacacctccgcactgtctttatatgtgaagaatcctggtattaactttgtgtaccatccaggacttgctgtcgccggagaggctactttgccatttgttgacactgacgaatatttgggtgcaccgctagatcatgaaggattcgacttcattcgttggtttagtgaaacagttgaagacggagactatgtcgtcctcatgatgaatgctagagcagcagagctaaatattctagcagaactattcaaaactggatcaatatgccatgttgatgagctgttccttcgctgctcggctgtagactgcaaaaatgctctttgtggggactgcatgagccttttcaaaactctaaggagaagtggtgtgtttgctcatcaatggtggggagactagagttttgtcaagagtttggtgcattttatgtcgtcttttcttcaacttttgctttattgtctgttgggaataaatagaggggaggttgtaggttgaaagttgatactgtaatcttactttctcccttctggaactgcacttgatgtcttgtgtatgtgtccatgtgtgcatgcgagttgcttgtctgtaagtttctctttaagtttatggaagaaatatgtgttatgtgttttaaaaactatgctttattgtgaaagccactttgtagtttg

SEQ ID NO: 7840 - DNA, 2250 bp, Solanum phureja
atcttccctaacaacaacttcacaatcctctcaccatttgccacgcagtggatagccgacaaagagctttactttcctacagttcagcagcttccttatagcatctttcatcctttcacttcatactcactctttttcattcacagatcccaaagtttcaatcttttttcacaaatcttgatccccttttcagttcttgagtgaatttttttgactaatttatcatgtagattgtgatttttatgtgaaaatatgatgtgggtcgagctcaattttgggtgatgaattggggttttgagatgggtatgaacccgtttgaagaaatggggaaaagggttccgaaaagggtatggcttagatctcaaatgacaatggtattaatggtgggtggaaatcacacttcatccaggttttgtactcgttaatctgtttgattttgttgtttttagacttaaatctcctgtttttagctttttagcttctgtgaaaacttcactttgccgttatagatcttgaaagttttgagctttaaagtttagaaatcttaaaaggaaaaaaaatggatatgaaggttttgaaatggcaatttcttcatgggtcattagtgaaacgtttgattctgaaagggttcttgtttgttactgttatgattgttgtgtcatttgttcaaatgacacatatgattcagaaatctgaacctataatgttgaattttggtgtatgccctttgaactttgggtctaaccagtatatgaatgtgaccgggttctttaaacccgtttatggattggggattccgctgtttggggcgtctttaatgaagcgcgacgatgaaaaattgaccaagaatgtgtttaaggagctaatggaaaagaatttcttggatttgaatgctaatgcattgtgtgttgggaagaaatcgttgtatgcagctttggtgctgcgagaactgggactcttgagtgctgttggtgttgatgcacacccgtatttctctcttatatggagaagatttatgtatgagctcgatcatgataataattctttcgattttgtgttctcgagggatcttgataaggttactgttccagctcttatggtgcttgagattgagcgtgtcttacgtccagggggcactggtgttatgctcgtgggttctagtagtttctacgcgggtaacttgataaaaggcaacttgataaggtctgccaccccagtttcgttgttcttgaagagttctgatgttgtgcacgtatgtggggttggcacgtatactctagtgatgttcaagaaacgatcagagattgttgaatctctcgtgcattctgtgctgcctgctaattgtccttccaatgtgaacaacaagccgtacttgaagcaccttgagccactcatggaaaagaagcttggacagtttgagacacagatctcatacttgcccaagttcatgaacatctcatcaaggaacaaactggtgtatatcaacgttggtgcaggggaatttgtagaatcaactcttgcaagaacattcaagcctcattatccgatccctcaccacttgttcaatgttttcgtcattgatcataacacctccgcactgtctttatatgtgaagaatcctggtattaactttgtgtaccatccaggacttgctgtcgccggagaggctactttgccatttgttgacactgacgaatatttgggtgcaccgctagatcatgaaggatttgacttcattcgttggtttagtgaaacagttaaagacggagactatgtcgtcctcatgatgaatgctagggcagcagagctaaatattctagcagaactattcaaaactggatcaatatgccatgtcgatgagctgttccttcgctgctcggctgtagactgcaaaaatgctctttgtggggactgcatgaaccttttcaaaactctaaggagaagtggtgtgtttgctcatcaatggtggggagactagagttttgtcaagagtttgatgcattttatgtcgtcttttcttcaacttttgctttagtgtctgttgggaataaatagaggggaggttgtaggttgaaagttgatactgtaatcttactttctcccttctggaactgcacttgatgtcttgtgtatgtgtccatgtgtgcatgcgagttgcttgtctgtaagtttctctttaagtttatggaagaaatatgtgttatgtgttttaaaaactatgctttattgtgattgccactttgtagtttg

SEQ ID NO: 7841 - DNA, 2236 bp, Nicotiana benthamiana
taaccgacaaagtgctaaaccgtcgtacaactgggctcgagcttcttccttaataagaccttcctcagtttcttcctttcccattcacactttccactccactcttatcacattcccagatccaaaaaacttcccttttttaaaaaagaaaaccctaatccttttttccagttcttggacaaatttagcacataaaaaattcaatctttataccaagatgtgaagtgggttgagctcaattttggttgatttctgaaatgggtcaaagttggttcgtaccaatgggtaaaagggttccgaaaagggtcttgcttgggtgccaaatgtcaatagtattactggtgggtggaaatcacacttcctccaggttttgtactcgctaatctgtttgattttcttgtttatttggcttatatcttctctttttaatcagtctgattgaaaaaaattagagctttttattagcttctgtgaaaagttcagtttctgttattgatcttgaaaacttggaacaaacttaaagttttgagctttaaactgagaaatctaaaggaaaaatggatatgaaggtgttgaaatggcaaattcttcacgggtcagtagtgaaacgcttgattttaaaagggttcttgtttgtcactgttatgatcgctgtctcgttcattcaaatggggcatttgattcggaactctgagcctatgttattgaattttggtgtatgccccttgaactttggatccagcccgaatatgaatgtgactggggtctttaaacccgtttctggattggcctttccgttttttggggtggctttggtaaaatgcgaagatgaaaatttgagcaagaatgtgtttaaggagctaatggaaaagaatttcttggatttgaatgcaaaagcattgtgtgttggaaagaaatcgtcggctgcagctttggcgctgcgagagctgggactctcgaatgctattggtgttgataggcacccatatttctctcttttatggagaagatttgtatacgagctcgattatgaggataattctttcgactttgtattctcaagagatctcgatagggtctctgttccagctcttttggtgcttgagattgagcgtgtcttacgtccagggggcaccggtgctatgctcgtgagttctagtagtttctactcaggcaacttgataaaaggcaacttgattaggtctgctacaccagtttcctcattcttgaagagttccgatgttgtgcacgtatgtggggttggctcctttactctagtgatgttcaagaaaagatctgagatcgttgaatctctcgagcgttctgtactccctgctaattgtccttccaccacgaacaacaagctgttcttgaaataccttgagccactcgtggagaaaaggtccggacagtttgagacagaaatttcgtacttgcctaagttcatgaatatctcgtcaaggaacaaactggtgtatatcaacattggtgctggggaatttgtagaaacaagtgttgcaagaatgttcaagcctcattatccaatccctcaccactttttcaatgttttcgtcattgatcataacacctctgccctccctttgtatgtgaagaatcctggtattaactttgtgtaccatccgggacttggtggagaggatgcttccccgtttcttgactccgatgaatatttaagtgcaccgctagatcatgaaggatttgactttattccatggttcagtgaaaccgttgaagatggagattacgtggtccttatgatgaatgctagaacagcagaactgaatattttggcagaactattcaaaactggctcaatatgccatgtcgatgaactattccttcgctgctcagctgcggactgcaaaaatgctctttgtggagattgcattagccttttcataactctaagaggaagtggtgtttttgctcatcagtggtggggagactagactttgtcaagagtctggtgtatttatgttgtatttttttcagcttttgctttagtgtctgttgggaataaattgaggagaggtgtaggttgatactatctataatcttcctttctcccctttgtaactgcattttatgtcttatgtatgtgactctgtgtgtgtgtttctgtttgtctgtaaaaccctcttttagcatatggaggaaacatctattatgtttttaaaaaattatgctttgttgtgaatccatgtggttactattt

SEQ ID NO: 7842 - DNA, 1168 bp, Solanum phureja
ttgtgattttgttgacaattacattgaggaatggcttcattgtctggccttagcgaggagcttggggaaatcgaaggacagattttggatatttttcgagctctttcaaatgggtttcagaaattggagaagattaaggattcaaataggcagagcaggcagttggaggagctaacaggaaagatgcgagaatgtaagaggcttatcaaggagtttgacagagaagtaaaggatttggaatataaaagtgatgcagaaaccaccaagatgctgagtgagaaaaaacaatcaatgatcaaagagttgaactcttatgttgctctgaaaaaacaatacgcaagcaatattgagaacaagcgagtagatctttttgagggtcccggtgaagggtttgctgaagagaatggcttgctagcttcaaatatgagcaatcaacagctgatggatcaaggaaataggatgatggatgagacagatgaagccattgagaggtcaaaaaaggtggttcatgaaactgtaaatgttggaactgagactgctgcagcactgaaggctcagactgaacaaatgagccggatagtcaatgagctagactcaatccatttttcaataaagaaggctacacaattggtcaaggaactcggtaggcaggttgcaactgatcgttgtattatggccttgctctttctgattgtgattggggtcatagcaatcattattgtgaagattgtaaacccacataacaaagacatccgggacatccctggattagcccctccagcacccagtcgacgattacttgcttatccttactgaaatctcgaagcctaccatattcacaaggataatacaacctacttcccagcggatttacttggtttttgacttaagaacggagagtgaccgagcacacgagcaaggcaagggatgaaggagaaatgcctggttcagaaagaagagtcttccatcttctctctggtaatgatagttttccattctttgtgatgtttaatgagatagattcatatgatatttgtttgtatgattattatctttaattctagttaaccggaacttttcattgaggaaaatttgaactacgcaaaactttggcactggttgatttgtgcatagaccagtattgtataatagcatcattaatctttat

SEQ ID NO: 7843 - DNA, 1576 bp, Nicotiana benthamiana
tccaaaacgctcaagcatttaaaatcctcaaaatattcagccgaaaaatataaaatattgaaaatgcctgcaaaatcacgagaccagctcatctcttctctgtaataatcaaaatccaaaattttcaaaccctacacctcaactttcatcagatccacagtcagatccgctgattttcctattttttcattccgatttggatccgcattgtgcaataaatcgaatttggaattacgaaaaatttcaaattcgtgaaatttcctattgatcgttgaattttcgaggattttgattgtttttgcaatgttttgatttgttttgagaatcgacattgtttgcgtttattggtagattgtttccaattttgagggatggcttcgttgactggtgttagcgaggagctcggggaaatcgagggacagatttcagatattttccgagctctttcaaatggatttcaaaaattggagaagattaaggattcgaacaggcagagcaggcagttggaggagctaacaggaaagatgaaggaatgtaagaggcttatcaaggagtttgatagagaagtaaaggatttggaatacaaaaatgatgctgacacaaccaagatgctgaatgagaaaaagcaatcaatgatcaaagagttgaactcctatgttgctctaaaaaagcaatacgcaagcaatattgagaacaagcgagtagatctttttgagggtcctggtgaagggtttgctgaagaaaacggcttgctagcttcaaatatgagcaatcaacaactgatggatcaaggaaataggatgatggatgagacagatcaggtcattgagaggtcaaaaaaggtggttcatgaaactgtaaatgttggaacagagactgctgcagcactgaaggcacagactgaacaaatgagccggatagtcaatgagctagactcgatccatttttcgatcaagaaggctacgcagttggtcaaggaactcggtaggcaggttgcgactgatcgttgtattatgggcttgctctttctgattgtggttggggtcatagcaatcattattgtgaagattgtaaacccacataacaaagatatccgggacatccctggattagcccctccagcacccagtcgaagattacttgcttacccttactgaaatctcgaagcaaaccattttcacaaggatattgcattattcacttctcagtgatttacttggtttttgacttaagaacagagagtggccgagcacacaacaaggcaggggttgtaagagaagtagctggttcagtaaaaaagagtctcccaccttctcctttttaatgatatttttccattctttgtgatgttttaatgtgataaattcatatggtattgtttgtatgattattatctgtattctagataactggaccttttccatggagggagggacttttgaactacacaaagctttggaactgattgacttgtgcatacaccagtgttgtataatatcattattaatctttattatatttgtggaacctatgttagttattgttcaattattccacttcccttggttttcctttc

SEQ ID NO: 7844 - DNA, 1260 bp, Nicotiana benthamiana
ttggtatattgtttccaattttgaggaatggcttcgttgactggtgttagcgaggagctcgggctcggggaaatcgagggacagatttcagatattttccgagctctttcaaatggatttcagaagttggagaagattaaggattcgaataggcagagcaggcagttggaggagctaacaggaaagatgaaggaatgtaagaggcttatcaaggagtttgatagagaagtaaaggatttggaatataaaaatgatgctgacataaccaagatgctgaacgagaaaaagcaatcaatgatcaaagagttgaactcttatgttgctctgaaaaagcaatacgcaagcaatatcgagaacaagcgagtagatctttttgagggtcctggtgaagggtttgctgaagaaaatggcttgctagcttcaaatatgagcaatcaacaactgatggatcaaggaaataggatgatggatgagacagatcaagtcattgagaggtcaaaaaaggtggttcatgaaactgtaaatgttggaacagagactgctgcagcactgaaggcacagactgaacaaatgagccggatagtcaatgagctagactcgatccatttttcgatcaagaaggctacacagttggtcaaggaactcggtaggcaggttgcgactgatcgttgtattatgggcttgctctttctgattgtggttggggtcatagcaatcattattgtgaagattgtgaacccacataacaaagatatccgggacatccccggattagcccctccagcacccagtcgaagattacttgcttatccttattgaaatcatgaagcaaaccattttcacaaggatagtgcattatccacttctcagtgcattttcttggtttttgacttaagaacggagagtggccgagcacaaaagcaaggcaagtgttgaaggacaactggacaagtaccaggaagtacctggttcagaaaagaagggtctcccaccttctcctttttaatgatattttccgttctttgtgatgttttagtgtgatagattcatatggtattgtttgtatgattattatctgtattctagataactggaacttctccatggagggaggtacttttgaactacacaaagctttggcactgattgacttgtgcatatactaccagtgttgtataatatcattattaatctttattatgtttgtggaacctatgttagttattgttcaattattccccttcccttgggtttcctttc

SEQ ID NO: 7845 - DNA, 1261 bp, Olea europaea
tcttttcgattagatccgtcattcgtcaacaacattgcttggatcagattcaaatattcaaatcgggcattttctattgcccgaatcgaaatgggtttttaaaatagttgcgagtttttggaagcattgccattttcattaatttgggaaactttatttgttgaaaagaaatttgagcatggattcattatctggggtgagcgaagaacttgcggagatcgagggacagatttctgatatatttcgagctctttcgaatggatttcaaaaattggagaaaatcaaggactccaataggcagagcaggcaattggaagagctagcggccaagatgcgtgaatgtaagaggcttattaaagaatttgacagagaatcaaaggatttagagtataagaatgattcaggcacaaacaagatgctgagtgagaaaaagcaatcaatgattaaagagttgaattcgtatgtggctctcaaaaaacagtacacgagcaatcttgataacaagcgagtaaatctctttgagggtcctggtgaaggatttgcagaagaaaatgtcttgcttgcttccgatatgacaaatcagcaactaatggatcagggaaatcagatgatggatgagactgatcaagcaattgagagatcaaaaaaggttgtccacgagactattgacgttggaacagagactgctacagcactcaaagctcagactgaacaaatgagcaggatagttaatgagctggactccatccatttttcaattaagaaggcttcacagctggtcaaggaaattggtaggcaggttgcaactgatcggtgcattatggctctgcttttccttattgtggtcggtgtcttagccattattatcgtaaagattgtgaacccaaataacaaagacattcgagacataccaggactagctcctccagctcccagtcgaaaactactttggaaccctaagtgaagggtgctacaagcaaatcacaacacgaggttgcccatgacatgcttttctgattgaatagattcttttgcttgtgacgctaccggaggcatctggctttactataaaaatatattttctgaagccatctgtgggattttgaatatggcagctactgaatctgtattgcaatagaatgatttgttttgagtttttattcttctactatgtatcctaaaatgttttcccatttggatgaggaggcagagttgttgtatatgtaatatgcattgttggttatttatgcattagttcttg

SEQ ID NO: 7846 - DNA, 1400 bp, Ipomoea nil
attggtctccttccgtaggtagctctgtgtaatcaattcattcaatcagatccacgaaccatatgactgcattggtcggatctgatcagataacttctaatcgcttctttcaaattagatccattagatcgttgtttctttaaattaaatatttgttaaaatttttggttgtgaggatttgattatccacattgctgaggttttgcttaatctatatactctggaagccataagaagtcaactgaagtaaaaattgaagttcttaggaatggcttcattgtcggcgattagtgaggagctcgcggaaattgaggggcagatttcggatctctttcgagcactctcgaatggatttcagaaattggagaaggttaaggactccaacaggcagagcaggatgttggaggagcttactgagaagatgcgagaatgtaagaggctgattaaagagtttgacagagaagtaaaggatttggagcatagaaatgatgcaaatacaaacaagattctcgctgagaaaaagcaatcgatgatcaaagagctgaactcatatgttgctctgaaaaagcaatatgcagccaaccgtgacaacaagagagtagatctctttgagggtcctagtgaaggttttgctgaggagaatgacttgctagcttcaaatatgactaatcaacagctaatggatcatgggaataggatgatggatgagactgatcaagccattgatagggcacaaaaggtggtgcatgagactgtaaatgttggaactgaaactgcagcagctctgaaagcacagactgaacaaatgagtaggattgttaatgagctggattcaatccacttctctatcaagaaggcttctcaattggtcaaggaaattggttgcaactgatcgttgtattatgggattgctctttcttattgtgatcggtgtcatcgcaatcattattgtgaagattgttaatccccataacaaggacatccgagacatcccaggattagctcctccagctcccagtcgaagattactttcacatcccaactgaaagcttgcaggaaagcattgaaggggcaccgggcacactcgatttcaggcacataggcgtcttattcagagaatgtgtggttagcttgtgacattattggtgaacccacaatagctcaaaaccaggatgcacccgatcatagcttcgactttgttagacattctgatctgccatttttcgagaatgacatcaaacgtttcagacattcttttctatgttttgttgaatagattcgatttggagctgtgtgtattcttttctactgttctacacattatatttagaagttttccattccatcaagggaaaccttaacttatataagacatgaactgatctttgtgtataccctaa

SEQ ID NO: 7847 - DNA, 1195 bp, Plantago ovata
tttgttgttgttgctgatttgcggattcgaatatttattattgttccttcgttctgacaacgatgtcttcattgtccgcggtgagtgaagagctcgccgagatcgaggggcagatttccgatatctttcgagttctctcgaatggattccagaaactggagaagattaaggactccaatcgccagagcaggcagctggaggagcttacggacaagatgcgcgaatgtaagaggcttattaaagagtttgacagagaggtgaaagaccagggctataaaagtgatcctgacacaaccaagatgctgaatgagaaaaaacaatcaatgattaaagagttgaattcatatgttgctctcaagaagcaatatgctagcagtcttgataacaagcgagtagatctctttgagggccctggcgaaggatttcaagaggacaacacactgcttgcttcaaatatgacaaatcagcaactaatggatcagggaaatcatatgatggatgagactgatcaagcaattgacagagcaaaaaaggttgtccatgaaaccatagatgttggaactgagactgctgcagctcttaaagctcagactgaacaaatgagtagaattgtcaatgagttggactcgatccatttttcaatcaagaaggcctcacagctggtcaaggaactgggtaggcagattgcaactgatcgatgcatcatgggcctgcttttccttattgtgattggtgtcatagccatcataattgtgaagatcgttaacccaggcaacagagacattcgggatataccaggattagctcctccagctcctgctcggaagctgctatggactcgtcaatgaggccacatcatatattctgtggtcagagagattatttggttatggttggattactgttgacttgacaaactttgatggaggctctgctataccaaatcaaagtatgcggattacactgtatcactatgtagactaaggtcatctcctatattttttgaaaatggatgaaacccgtgtttgtattctaccacattaaaaccactgacctggagattattcgtttgttcaattcccatgtattttcagatacttttacaattgaaagagaaatatttgtatgtatgtcagaatatcagaaggcagtcttgtaaactctctctcatttgtgcatttgtgaatgattactg

SEQ ID NO: 7848 - DNA, 1236 bp, Olea europaea
ggaacattgtcattttcattgttgttgtcattaatttgggaaattttatttatagaaaataaatatttgaattttgagcatggattcgttacttggggtgaacgaagagctagcggagatcgagggacagatttctgatatctttcgagcactttcaaatggatttcaaaaattggagaagatcaaggactccaataggcagagcaggcagctggaagagctcacagccaagatgcgtgattgtaagaggcttattaaagaatttgacagagaatcaaaggattcagagtataaaaatgattcagacacgaacaagatgctgagtgagaaaaagcaaacaatgattaaagagttgaattcgtatgtggctctcaaaaaacagtacacaagcaatcttgaaaacaagcgagtagatctctttgagggccctggtgaaggatttgcagaagaaaatgtcttgctcgtttccaatatgacaaatcagcagctaatggatcagggaaatcagatgatggatgagactgatcaagcaattgagaggtcaaaaaaggtcgtccacgagactattgatgttggaacagagactgctgcagcactcaaatctcagactgaacaaatgagcaggattgttaatgagctggattccatccatttttcaattaagaaggcttcacagctggtcaaggaaattggtaggcaggttgcaactgatcggtgcattatggccctgcttttcctattgtggttggtgtcatagctattatcattgtaaagctcgtgaatccaaatagcaaagacattcgagatataccaggattagctcctccagctcccagtcgaaaactactttggatccctaattgaagagctacaagcgaatcacaatacgaggtttcacatgacatgatttctgattggatggattctgttacttgttaggctacaagaggcatctggctttaccaaaacctggtgtgtttagatcaactatatattttctgaatccattggacggattttggaatgtggcagctactcaatctgtattaatctaaaatgatcgaactggaaatttgtttcggttcttattctactatatcctaatatgttttctcattggatgaagaagatatgttgtatatgcaatatgcattggcattgttgtttatttattacacataattcttatactctgcatttcttcactctttaaaaattattagctgatgggctgtt

SEQ ID NO: 7849 - DNA, 1296 bp, Centaurea maculosa
gccgatcatcatctgatccatctatggagttttcgatcagatctatgatggattcaacctgcattgctctgatctgatcagtaaacacacgaatctataacttctatttttttttgattttggtgattatttgattcaatctgtttcagtggtaagagattgaagttctggtgaagtttggtgttttgtgatctaaggaggagctaaatcgagaaatttgagaggtgtttttgtgttaaataatgtttgtgatgtgttagagaaaggaagtagggattcggatagatatacttgtttgatttcgagtttttcacggtgttggagagataaatagctatggcgtcttcgatttctgccataagtgaggagcttggagagattgatggacagatagctgatatttttcgagcactatcaaatggatttcaaaagttcgataagattaaagactcaagtcggcagagtaggcagttggaagagctcaccggcaagatgcgggagtgcaagaggcttattaaagagtttgatagagaagtcaaggaattagaacgtacagttgatcctgataccagcaagatactgaacgagaaaaaacaatcaatggtcaaagagttgaactcctatgttgcactgaaaaagcaatatgcaaacaacattgaaaacaaacgagttgagctctttgaaggacctggtgaaggatttgcagaagataatggcttgctagcatcatctatgacaaatcagcaactaatggaccagggtcataacatgatggatgaaactgaccatgctattgaacgctcaaaaaaggttgttcatgacacggtaaatgttggaactgaaactgcagcagcactcaaagcacagactgaacaaatgagtagaatcgttaatgaacttgactcgatccatttttcgatcaagaaggcttctcagttggtgaaggaaattggtaggcaggttgcaactgatcgatgcattatggccttgctcttccttattgtgattggtgtcataacgatcattattgtgaagcttgtgcatccagacaacaaagacattcgggatatccccggattagcccctccagctcctagtcgaaaacttctatggatcccggattaaggatgtcagaagcatacagttaaagctgaaatggatattgctaaacctctaattgcttacgagaaacagaccaagtgatctgatttcgattacttggtgatgatggtctgttagctgattttgtttgagaaagttatgggctttttggatggagagagactgtgtacacaa

SEQ ID NO: 7850 - DNA, 1391 bp, Cirsium arvense
tctctcaacatcttgtggaaatccgatcatcatctgatccatctctggagttttcgatcagatctatgatgtattcgacctgcattgctctgatctgatcaatcaagatacaagtcttataagttcaaattttgatttcgattcaatctgtttccagtgtgaatagattgaagttctggtgcttggtgattgtaacattgtttggatctgagttgaggaagtttggtgttttgtgatttaaagaagatttgaatcgagaaatttgggcggtgtttttgtatttgatgatgtttgtaatgtattagagaaaggaggtagagattcaaatacatacactcgtttgattttgactgtgttggagagataagtatggcgtcttcgatttctgccataagtgaggagcttggggagattgacgggcagatagctgatatttttcgagcactctcaaatggatttcaaaagtttgagaagatcaaagactcaagtcggcagagtaggcagttggaagagctcactggcaagatgcgggaatgcaagaggcttattaaagagtttgatagagaagtcaaggatttagaacatacagttgatcctgataccagcaagatactgaacgagaaaaagcaatcaatggtgaaggagttgaactcctatgttgcactgaaaaagcaatatgcaaacaacattgaaaacaaacgagttgagctctttgaagggcctagtgaaggatttgcggaagataatggtttgctagcatcttctatgacaaatcagcaactaatggaccagggtaatcaaatgatggatgaaactgaccatgctatcgaacgttcaaaaaaggttgtccatgacacggtaaatgttggaactgaaactgctgcagcactcaaagcacagactgaacaaatgagtagaattgttaatgaacttgactcgatccatttttcaatcaagaaagcttctcaattggtgaaggaaattggtaggcaggttgcaactgatcgatgcattatggccttgctcttccttattgtggttggtgtcatatctatcattattgtgaagcttgtgcatccaaacaacaaagacattcgggatatccccggattagcccctccggctcctagtcgaaaacttctatggattctggattaaggacatgaaagttaaagttgaaatggatattggtaaacaagaaacagaccaagtgatctatctggatttggattacttagcagcagattttgtttgagaaagttatggggcctttttggatggagggatatttgccattctatccggttataatatcatgtataagtgtatttgtgtaatcctgtactattattgttttctgaatacacagagtgagaaaccaaattacttta

SEQ ID NO: 7851 - DNA, 1647 bp, Lactuca sativa
ccgaaacttaggccctcggttctaaattactttcggtacaaccttcaatgcatgatgtacaactaaaactttactcaattaacaacaaaatcactcatcacagctcatacttctctctgtctgtctctctttcaacatcgtgtggaaacgttcattatcatctgaagattcatctcaggagttttcgatcagatctgtgatgtatttgacctgcattgctctgatctgacccgttcaaaacacacgtctgtaagttcaaattttgaattggtgattttggttcaatctgcttgaggagattcgagtcctactgcttcgtggttctaacattgttcggatctgacttgaggaagcttggtgttttgtgatttgaccaagatttgaatcgagaaatttgagatgtgtttttgcctttttggcgtttgctgatgtttgtgatatattagagaaaggaggtagaggtacatagtatatacactcgcttgattttgacggagtttgtgagataagtatggcgtcttcgatttcggccataagtgaggagcttggcgagattgacggacaaatagctgatatttttcgagcactttcaaatggatttcaaaagtttgagaagatcaaagactcaagtaggcaaagtaggcagttggaagagctcactggaaagatgcgtgagtgtaaaaggcttattaaagagtttgatagagaagtcaaggatttagaacatacagttggccctgataccagcaagattctgaatgagaaaaagcaatccatggtcaaagagttgaattcctatgttgcactcaaaaaacaatatgcaagcaacattgaaaataaacgagttgatctttttggggggcccgctgaaggatttgaggaggataataatggcttgctagcctcatctatgacaaatcagcaactaatggacaatggtcatcacatgatggatgaaactgaccaagctattgaacgttcaaagaaggttgtccatgaaactgtaaatgttggaaccgagactgcagcagcacttaaagcacagacagaacaaatgagtagaattgtgaatgaacttgactcgatccatttttcaatcaagaaggcttctcaattagtgaaggaaattggtaggcaggttgcaactgatcgatgcattatggctttactcttcctaattgtggttggtgtcatagctatcattattgtgaagattgtggatccaaacaacaaagacattcgggatattccaggattagccccacctgctcctagtcgaaagcttctatggatacctgaataagggcatgagtgtgataaaattaaaagtttgaatggatggctttttggtaaatttctttctaaattacaagaaacagcaggtggtgatctgactacgtatgacctaggaaggggtatttgtgtttgtattgtgttggcagatttttgtttgagaaaaagttatcgggttttggatggagggagactgtatacaaatattcacattttgcttttcttattggcttattattatacaaagactttcttttttgaacacgatgtactttttttttttggtttattgaatgaatgtgtattatatgaaatttaagcatttaataatgtactcttttcactgcccagccg

SEQ ID NO: 7852 - DNA, 1445 bp, Cichorium intybus
tctctctgtctgtctctctctcacatcgtgtggaaacgttcattatcatctgattcatctcaggagtttcgatcagatccatgatgtatttgaactgcattgctctgatctgatccgttcaatcacgcgcctgtaagttcaaattacgaatttgtgattttgatctagcctgcttcaagagattcaagttctactgcttggcggttataacatcgttcggatctgacttgaagaagtttggtgttttgtgatttaacggagatttgaagcgagagatttgggatgtgtttgatgatgtttgtgatatattagagagcggaagtagaggtacatacacttgcttgatttcgacggagtttgtgagataagtatggcgtcttcgatttctgccataagtgaggagcttggcgagattgacggacaaatagctgatatttttcgagcactttcaaatggatttcaaaagtttgagaagatcaaagacccaagtagacagagtaggcagttggaagaactcactggaaagatgagggaatgtaaaaggcttatcaaagagtttgatagagaagtcaaggatttagaacacacaattagtcctgataacagcaagatactgaacgagaaaaaacaatcaatggtcaaagagttgaattcctatgttgccctgaaaaagcaatatgcaagcaacattgaaaacaaacgagttgatctctttggagggcctgctgaaggatttgaggaagataatggcttgctagcctcatctatgacaaatcagcaactaatggacaatggccaccaaatgatggacgaaactgaccaagctattgaacgttcaaagaaggttgtccatgagacagtaaatgttggaactgaaactgcagcagcacttaaagcacagacagaacaaatgagtagaattgttaacgaacttgactcgatccatttttcaatcaagaaggcttctcaattagtgaaggaaattggtaggcaggttgcaactgatcgatgcattatggccttgctattccttattgtggttggtgtcatagcaatcattattgttaagcttgtgcatccagacaacaaggatattcgggatattcccggattagcccctcctgctcctagtagaagacttttatggatccctgattaaagtttaaatggatgccttttgggcttgtgacttgttttgatttttgtttgagaaagttatcggcttttggacggagggagactgtatacaatattcacattttgccatattattgggtttatacaaagacctttgtataactgtaactttagttttgtaccattgttttcaaatacacgagtgacagaccaagttatcaccaaaatttctttgttaatctcgtatttgtattctcgcattaacttggtattttgaaaatcatgattgttataagtgagttatgagt

SEQ ID NO: 7853 - DNA, 1491 bp, Gerbera hybrid cultivar
gtctctctctctctctctctctctctctctctcttgtggaaacgtccttcgtcatcttattcatcgctgggttttcgatcagatctatgacgtattcgacctgcattgctctgatctgatcgtttgaaacacaattctgtacgttcaaattttgaatcggagattttgattcattttgactcattttgattcgatttggaagaagttcaagttcaagttctgcggcttggagatataagattgttccgattggactattggagttgaggaagtttgtgtgttttgtgatttaagaagatttgaatcgaggaatttgggcggtgtttttgtgtttgatgatgtttgagatgtattagcggaaggaagtagagatagagatacatacgcttgtttgaatctgacggagttggagagataagtatggcgtcatcgatttctgctataagcgaggagcttggcgagattgacggacagatagctgatatttttcgagcactttcaaatggatttcaaaagtttgagaagatcaaggactcaagtaggcagagtcggcaattggaagagctcactggcaagatgcgggaatgtaagaggcttattaaagagtttgatagagaagtcaaggatttagaccatacagttgatcctgataccagcaagatacttaacgagaaaaagcaatcaatggtcaaggagttgaattcctatgttgcactgaaaaaacaatatgcaagcaacattgaaaacaagcgagttgatctctttgagggggctgctgaaggatttgcagaagataacggcttactagcctcatctatgacaaatcagcaactaatggaccatggtaatcaaatgatggatgaaactgatcaagttattgaacgttctaaaaaggttgtccatgacacggtaaatgttggaactgagactgcagctgcactcaaagcacagacggatcaaatgagtagaattgttaatgaacttgactcgatccatttttcaatcaagaaggcttctcaattggtgaaggaaattggcaggcaggttgcaactgatcgatgcataatggccttgctcttccttattgtggttggtgtcatagcgatcattattgtcaagcttgtgcatccaaacaacaaagacattcgggatattcctggattagcccctccggctcctagtcgaaaacttctatggatccccaactaacgacgtcaaaaacacacagttatctgattacaagaaacaaactttcagaagcaagcgatttgagtcatgttgacaacatttgaccggccgatatttgtgtttgttttccataaacggattttgtttgagaaagttattgctttttggagagaccgagactgtatacgatgtttacgttttgccattgtatatggttatatactaagaccgcttgtaagcatatttgtagttttcacatcatttttatttgaatacacgggtgacaaactaaattactaccgt

SEQ ID NO: 7854 - DNA, 1426 bp, Tabernaemontana elegans
taatcgaacaaaaattttcgattgcgaatccaagcgattcgatcagatccattggcataacaacctacattttccggatctgatcgccgatttttaatcgaaattgaatccttccgcattttctttgattttttttggggatgaatttggagatgtttggaggtttaggacattggcattgttgaacttcagaggagcggattgaggattttggtttttgttaatttttgtgaagaatttcgggaggaatttgtattttgtagataatttgaaaaagatgtcaacgttatctggaattagcgaggagctagcggagatcgaaggacagatttcggatatttttcgagctctctcaaatggattccagaagttggagaagatcaaggacgcaaatcggcaaagtagacaattggaggagcttactgggaagatgcgtgaatgcaaagggcttattaaagaatttgacagagaattgaaggatttggattacaaaaatgatccagagactaacaagatgttgaatgaacgaaagcaatcaatgatcaaagaattgaactcatatgttgccctgaaaaaacaatatgccagcagtcttgaaaacaagcgagtagaactttttgagggtcctggggaaggatttgcagaagaaaatgtgctgctagcttcatctatgacaaaccaacaactgatggatcatggaaacaagatgatggatgaaacagatcaaattattgaaaggtcaaaaaaagttgtccatgacacagtagatgttggaacagaaactgcagctgctttgaaggcacagactgaacaaatgagtagaattgtgaatgagctggactccatacatttctcaattaagaaggcttcacaattggtcaaggaaattggtaggcaggttgcaactgatcgatgcattatggccttgctcttccttattgtgctgggtgtcatagccatcataattgtgaagattgtgaatccacacaacaaagacattcgggatattcctggattggcacctcctcgcccctactcgaaagttactctggaaacctaattgaagatttgcattatgcgaaaatccagaccaggatttcaaatttttgggattgatggatagtcctagcccgtttttccttttggaggaatctggttctatggaatctgatctgattcatggcttttcaagtgaccttcccaatgatgtgcttgaagtgaacttacagttcccttctagtcagtggcagtaactcaaaaattgttgtggctcagtgtgaaattttttctatgtttatttcttctccgtaattatgtttacaaagattgtttatggtcgagaagagttcaagatattcattcaccaatgctttcttgtacttattgtattttaacataagcagtattaaaaaaacacccaattatt

SEQ ID NO: 7855 - DNA, 1379 bp, Lippia dulcis
ccaagccacgccacaggtccatcggccgtctctccaaaatattcaatcagatccatccaacgctatatgcacattgcatccaatctgcgatttctcgttgtagatgtgattgttcaatccctcccgacgttataccgatcggaataataggttctctaattaattttcgcgccatgttgagcgaagagctcgcggaaatcgagggccagatttcagatatcttccgagctctttcaatggattccaaaaattggagaaaattaaggactccaataggcagagcaggcagctggaggagctcacggacaagatgcgccaatgtaagaggcttattaaagattttgaccgagaggtgaaggactcggactacaaaaatagatcctgacacaaataagatgctcactgagaaaaagcagtcaatgatcaaagagctaaactcatatgttgctctcaagaaacagtatgcaagtaatctagaaaacaagcgagtggatctttttgaaggcacaggtgaaggatttgtagatgagaatgtgctgcttgcttcaaatatgacaaatcagcagttaatggatcatggaaaccatatgatggatgagactgatcaagccattgacagagcacaaaaggttgtccattccaccattgatgttggaactgagactgccgcagctctcaaagctcagactgaacaaatgagcagaattgttaatgagctggactccatccatttctcaatcaaaaaggcctcacagctagtcaaggaaatcggtaggcaggttgcaactgatcggtgtatcatggccctccttttccttattgtggctggtgtcatagctatcattattgtgaagatagtgaatccgcataacaaagatattcgagatattcctgggttagctcctccagcaccacctcgaagactactatggagtaccgattgatgactgcactgaatcacattatatttgatgttataaattatctattgttcaatttgattcgatcaagtttggttggtgatacggagaggcatccgagtgaaccaccatacggttacattatatcagcaagattaactgtatcaatgcggattttctcaagtggcatatccatatattacctacaattacattaagtggaacagggaagtgtttgtatctcattcccatgtatcattatctcaagattattcttcttcatttggacgagtatttggtgtatgcgagatgggctttgcactaagcagtatttgtttattatgtattttctgtgctcccctgtctcttcgacaaaatattcgctctcaaattgtaactcagatagtttgtatggcgatcatgatatgaaagatgcatatgctggaattaaaaaagaaa

SEQ ID NO: 7856 - DNA, 1160 bp, Ocimum basilicum
atcccgccgttgtaatgcggttatttcttccgtcttcatcaacggagtcataactttaacgactactttttgacgctggaaacttgtctttgaagatctctcactcatactccgcttccccactcactgaaaagtatggcgagcgaagagctcgcagagatcgagggccagattcaagatatatttcgagctctttcgaatggattccaaaaattggagaaaattaaggatcccagccgccggagcaggcagctggaggagctcaccgacaagatgcgcgaatgtaagaggcttattaaagattatgaccgagagcagaaggactcagagtacaaacatgaccccagcaccaacaagatgcttactgagaaaaagcaatcaatgataaaggagttgaactcatatgttgctctcaagaaacagtatgcaagtaatcttgaaaacaagcgagtggatctctttgaaggtccaggtgaagggtttgcagaagataatgtgctgcttgcttcaaatatgacaaatcagcagctaatggatcatggaaaccacatgatggatgagactgatcaagcaattgatagagctaaaaaggtagttcatgaaaccgttaatgttggaacagagacagctgcagcactcaaagctcagactgaacaaatgagcagaatcgttaatgagttggactctattcatttttctatcaagaaagcctcccagctagttaaggaaattggtaggcaggttgcaactgaccggtgcatcatgggcctcctcttccttatcgtcgttggtgtcataactatcattatagtaaagatagtgaacccacacaacaaagatataagagatataccgggtttagctcctccagcacccactcggaaacttctgtggattcctaattgaggaatgcacaaacttattactatactaatgttatcaactatctggttttgattggatgaaatttggtcggccaagtagccgacgcctctatcgagttcaccaaaaccaggcttgggcggatcaaattacataaacataatcttgtatccatatcgagttcacacatttccatatatttttgtcttgtaatttctcaagatttaattctttccatttggatgaggaatgttcagtgtatatgcggttggtattct

SEQ ID NO: 7857 - DNA, 1193 bp, Mimulus guttatus
gaagtttgtttgaattaaagttttttttttttttttttttgaagatctttgactcccgattttggtttttgactctctggatcaatggcgagcgaagagctcgcggagatcgaaggccagatttcggatatttttcgtgctctttcgaatggattccaaaaattggagaagattaaagactccagcaggcagagccggcagctggaggagctcacggacaagatgcgtgaatgtaagaggcttattaaggagtttgaccgggagttaaaggactcagactacaaaaatgaccccaacacaaacaagatgcttactgagaaaaagcaatcgatgatcaaagaattgaattcatatgttgctctcaagaaacagtatgcaagtaatcttgaaaacaagcgagttgatctcttcgagggtccaggtgaaggatttgtagaagagaatgtgctacttgcttccgatatgaataatcagcagctaatggatcatggaaatcagatgatggatgaaacggatcaagctattgaccgagcaaaaaaggttgtccatgagactattgatgttgggaccgaaacagctgcagctctcaaagcacagacagaacaaatgagcagaattgttaatgagctggactccattcatttttcaataaagaaggcaacaaagctagtaaaggaaatcggtaggcaggttgcaactgatcggtgtatcatggcgctccttttccttattgttattggtgttgtaactatcattatagtgaagatagtgaacccacaaaacaaagatattcgagatataccaggattagctcctccagctcccgcccggaaattactatggatttctgattgatgatcaactttgatgttattacacattacctggctttggttagtgcactactggaggcaatcggagttaaaccaaagacaaggtttgatcaactaaaattaatcggtacgattatgtgtatccatatcacaattatttttgtcaattggcagctaccatattttttttttatttttttttaatcaaaattaaatggaactgggaatttgtttgtgttaattcccctgtaatttttctaaagattaaattaatttgcatttggatgaggaatatttgatgtatatgcggtttgtattcttctgaatctattggtgtctatgtacttatatattaccatt

SEQ ID NO: 7858 - DNA, 1206 bp, Flaveria ramosissima
ttcgatcagatctataacgcatccgacctgcattgctgcgatctgatcagttcatacacaactcatctgaatcgagaacttctggcggtggttttgtgtttgatgatgtgttggtgagaggaagtggagattgttgttgattggagttggtgaagtatggcgtcttcgatttcggccattagcgaggagcttggcgagattgacggacagattgctgatatttttcgagcactttcaaatggatttcagaaatttgagaagatcaaagatcctagcaggcaaagtaggcagttggaagaactcactggaaagatgcgagaatgtaaaagacttatcaaagagtttgatagagaagtcaaggaactagaaaacacagttgatcctgataccagcaagatgctgaatgagaaaaaacaatcaatggtcaaagagttgaattcatacgttgcactaaaaaaacaatatgcaaccaacattcagaacaagcgtgtcgatctctttggtgggccagctgaaggatttgaggaagataatggcttactagcctcatctatgacaaatcagcaactgatggataatggtcatcaaatgatgaatgaaactgatcaagctattgaacggtcaaaaaaggttgtccacgagacaataaatgtaggaaccgagactgcagcagcacttaaagcacaaacagaacaaatgagtagaatcgttaatgaactcgactcaatccatttttcaatcaagaaggcttctcaattggtgaaggaaattggtaggcaggttgcaactgatagatgcatcatggctttgctcttccttattgtggttggtgttatagcaatagttattgtgaagcttgttcatccagacaacaaagacattcgggatattcccggattagcccctcctgctaaccgaagacttctatggatccctgcttagcgtaatcaagagcataaaattacagtcgaaatggacttattcgaggtatttgattacaaggaaacagactgcaaaacaagtgattatctgacctgccaatatatgttttgtgttagcaggcttttattcgtctttttggatggagagagattgtatacatattcacacgttgccatatattggtgggattttactaggtaagtttattgtttatttgtttacactatcattctacttaagacattgtataagtgttgtgtacca

SEQ ID NO: 7859 - DNA, 1490 bp, Panax ginseng
aagcagtggtatcaacgcagagtacatgggggatatattttatttatttttaaacctcctaaaacccctctcatccttcgtaacgcccccaacctaaacaatccaaacaaaacaacaaaaaagaaaatatgaattcaaaatcaaaaattatgtttcaataatcgcaagatccatctttctctctccttcggttgtgagcaacagtttcgatcagatccatatatttatccacctacattgttcggatctgatcggaaatttgttcacaatcgctgaatcaataaatcaccttttgagatcgacattgctcgaatttcaaattctgtttcgttctgttaattggggagacattgtttggatcggattgatttatttattttttgatttttggatatgaattgggagctgttggagtttgggatataatagatattttgccatttccggtcctggatttgaattttggactttgaaatttattgtggttattaaaaaagtagtagtcattatttgaggttttgtttgattctggagatggcttccttatctgcgataagtgaggagctagcggagctcgatgaacaagttactgatatatttcgagttttatcaaatggatttcaaaagttggagaagattaaagattcaaataggcagagtaggcagttggaggagctcacagataagatgcgtgaatgtaagaggcttatcaaagagtttgatagagaagtgaaggatatggagtatagtaatgacgcaaacaccaacaagatgctgaccgagaaaaaacaatcaatggtgaaggaattaaattcatttgttgctcttaaaaaacaatatgccagcaatcttgaaaacaagcgagctgatctctttgagggacctgacaatggtcctgcagaagataatggcctgctagcttcatcaatgacaaatcaacagttaatgggccacggaaatcaaatgatggacgagacagatcaagccatcgagaggtcaaagaaggtggttcacgacaccgttaatgttggaacagagactgcagcagctctcaaggcacagactgaacaaatgagtaggattgtcaatgaactggattccatcaatttttccatcaagaaggcttctcagctggtcaaggaaattggtaggcaggttgcaactgataggtgtattatggctttgctcttcctcattgtgatcggtgttatagccatcattatcgtaaagcttttgaacccacataacaaagacattcgggacatctctggactagctcctcctgttcctagtcgaaaactgctttggaatatgaattaggagttctacaagcaaaccatggtgtttgataggagttctattagcatatcatatgatgctattggggcaccctctttgatgaaaacgtgatatggtttcagcacacgacgaattcccaagcacatccgattgatctttttcagctacatttcctgaaagatattgctgtt

SEQ ID NO: 7860 - DNA, 1225 bp, Echinacea purpurea
tgaatcgagaaacactgtttgaatccgattatgtgttagagaaactgaggtttaacgattttgattcaatctgttgcagcgttttctggatctgagttgtggaagctttgttttctgatttaacgaagatctgaatcgagaaacactgtttgaactccgatgatgtgttagagaaactgagaaaggaaattgagatacggagttggtgaagttatggcgtcttcgatttcgagcattagcgagcagctcggcgagattgacggacagattgctgatacttttcgagcattatcaaatggatttcaaaagtttgagaagatcaaagacgcaagcaggcagagtaggcagttggaagatctcactggaaagatgcgggaatgtaaaaggcttatcaaagagtttgatagagaagtcaaggagctagaaaacacagttgatcctgataccagcaagatattgaatgagaaaaaacaatcaatggtcaaggagttgaattcatacgtcgcactgaaaaaacaatatgcaacaaacattcagaataaacgtgttgatctctttggtgggcctactgaaggatttgaggaagataatggcttactagcctcatccatgacaaatcagcaactaatggataatggtcaccaaatgatggatgaaactgaccaagctattgaacggtcaaaaaaggttgtccatgagacggtaaatgtgggaaccgagactgcagcagcacttaaagcacaaacagaacaaatgagtagaattgttaatgaacttgattcaatccatttttcaatcaagaaggcttctcaattagtgaaagaaatcggtaggcaggttgcaaccgatcgatgcatcatggctttactcttccttattgtggttggtgttatatccataattattgtgaagcttgttcatccaaacaacaaagacattcgcgatattcctggattagcccctcctgctcctaaccgaagacttttatggcttcctgattaacggaatcaaaaacattcatttacagcctgattggatttactcaagatattcgtgtgagaaagttatcgcctttttggatcgagggagattgtgtacattattcacactttgccattctacctgtaccaaattacaaccttaatatttgttcgatcgtcttgtcatttttactgttgtaccaagtgagcgggtttattcggatgtataaacaaattatgtataa

SEQ ID NO: 7861 - DNA, 1346 bp, Arnica chamissonis
attagttcatacacaagtcgtaagttcaaattttaaattggtgattttgattcaatctgtttcagtttggaacagattcaccttctgtttcatcgtagttgcaacattttccggatctgacttgaggaagtctggtgttttgtgatttaacgaagatctgaatcgagaatttctggcagtgtttttatgtttgatgatgtattagagaaaggaaattgagatacatagacgtgactattattgacggagttggtgaaatatggcgtcttcgatttcggccattagcgaggagcttggcgagattgacggacagatagctgatatttttcgagcactctcaaatggatttcaaaagtttgagaagatcaaagactcaagcaggcagagtaggcagttggaagacctcactggaaaaatgcgggaatgtaaaaggcttatcaaagagtttgatagagaagtcaaggaactagaacacacggttgatcctgataccagcaaaatactgaatgataaaaaacaatcaatggtcaaggagttgaattcatacgttgcactgaaaaaacaatatgcaaccaacattcaaaacaaacgtgttgatctctttggtgggccagctgaaggatttgaggaagacaacggcttactagcctcatctatgacaaatcagcaactaatggataacggtcatcaaatgatggatgaaacggaccaagctattgaacgttcaaataaggttgtccatgagacaataaatgtaggaaccgagactgcagcagcacttaaagcacaaacagaacaaatgagtagaatcgttaatgaacttgattcaatccatttttcaatcaagaaggcttctcaattagtgaaggaaattggtaggcaggttgcaactgaccgatgcatcatggctttactcttccttattgtggttggtgttatagctataatcattgtgaagcttgttcatccgggcaacaaagacattcgggatgttcctggattagcccctcctgctcctaaccgaagacttctatggatccctgattaacagaaccaaaagcataaatttacagtctaaatggatttattcggatttttgtttgagaatgttatcaccttttggggtcgagggagattgtatacaatattcacactttgcgattctacctggtcattccaagacactgtataagtgttgtgtaccattgtgctttgagtacatgagtgagaaaccaaattactaccttcatttctgtttggatgtcttgtcatttgtactgtactgttgtaccaagtgaacaacggttttctgtggatgtataaactaataacgtataaagagagag

SEQ ID NO: 7862 - DNA, 1182 bp, Valeriana officinalis
atcagctcacgttctagtttgttacggttgcatttgttgcgccatttctgagatcggatcagttaagtagtttgggtgcatttttatttggatttgatgcgttcagcattgtagaagaaaagtgctgtttttttagtatgggttcgttatctggtatcagcgaggagcttgctgagatcgacggaaaaatctctgatactttcagagctctatcgaatggatttcaaaaattggaaaaaattaaggactcgaatagaaagagtaggcagttagaggagctcacagataaaatgcgggaatgcaagaggcttatcaaagagtttgaccgggaagttaaggatctggaacataataatgacccagacacaaagaaaatactcaacgagaaaaaacaatctatggtcaaagagctgaattcatatgttgcactaaaaaagcaatatgcaaacaatcttgacaacaagcgggttgatctatttgaggggcctggtgttgaagggtttggggaagagaatgtaatgttagcttcatctatgacaaatcagcagctggtagaccagggaactcatttgatggatgagactgatcaagccattgagagatcaaaaaagaccgtccacgaaactgtaaatgtcggtacggagactgcagcagctttgaagtcgcagacggaacaaatgagtaggatagttaacgagctcgactcgattcatttttcaatcaaaaaggcttctcagctggtcaaggaaatcggcaggcaggttgcaacggaccgctgtattatggctttcctctttctcattgttgttggtgtcattgccatcattatcgtcaagatagtgcacccaaacaacaaagaaattcgggatatccctggattagcccctcctgtacctgcacgaaaacttctatggtatccgaattaactacacacgtggcaccgtttcattggttggagtaaattatctcttttttgcgcggagttgtggttatatcttccatagaaatgtattttgctctcttttgagaactctggtctgtaacatttactacgtatgttttaatgattagaaagaatgtgtagttttgtgtctgcgccattaatttttattcattcatattttttttttcatttggtacacgaacatgattctttgtataatccatgactattttgattca

SEQ ID NO: 7863 - DNA, 1398 bp, Sesamum indicum
tgtaaatcacgagagcgccagctcatagcacagcccaccccagaggcgtctctcggtcaagaactcaaccagatccatccaccaccagacccacattgcttccgtccgcaattctgccgctgttgctgcggttgattgattcctcttgacgtttttccaatcggaatgaaaaagatttcggtttaatctattccggtgataatttgtgagaagagagttttttgaagatctttgaatcgtatttggatttttgactctctggaggaatggcgagcgaggagctggcggagatcgagggccagatttcggatatctttcgagcgctttcgaatggattccaaaagttggagaaaatcaaggaacccaataggcagagcaggcagctggaggagctgactgacaagatgcgtgaatgtaagaggcttattaaagagtttgaccgagagttaaaggagacagactacaaaaatgaccctgatacaagcaagatgctcaatgagaagaagcaatcaatgatcaaagagttgaactcctatgttgctctcaaaaagcagtatgcaagtcaaaacaaacgagtggatgtctttgagggtccaggtgaaggatttgcagaagagaatgtgctgcttgcttcgaatatgtcaaatcagcagctaatggatcatggaaatcggatgatggacgagactgatcaagcaattgacagagcaaaaaaggttgtccttgacaccattgatgttggaacagagactgccgcagctctcaaagctcagactgaacaaatgagtagaatcgttaacgagctggattccatccatttttcgctcaagagggcctcacagcttgtcaaggaaatcggtaggcaggttgcaactgatcggtgcatcatggcccttcttttccttatagtgatgggtgtcatagctatcattatagtaaagatagtgaacccaaataacaaagatattcgagatataccagggttagctcctccagctccagcccggaaattactatggagttctgattgaggagtgctcaatcagatttcatcgaggttacaaattatctggcttttggttggatgaaaattttggttggcacagtactggtggcatccatgttaaccaaagtaaggttttgacagataaaattctatcagcacgatgatctgtagccatcaaacaatgtcatgccacccatgtttgtatcacatcgaaatggatactggggaaactgtgcatttatattgacctatatattttcaaagtttggattcttttccatttggatgaggtgtatttgatgtatatgcggctggtattcttcttctataaggttggttattcatgtatttataaactgactcatatcatatgctatcttggaggaatattc

SEQ ID NO: 7864 - DNA, 1324 bp, Triphysaria pusilla
attttgattcctatttgacgttgcttcggtcggagtaatcattataaaattacttttgtttcgtttcgttgaagacatttgaccaatcggatttggatttttgattctccggcgagatggtgaacgaagagctcgcggagatcgagggccagatttctgatattttcagagctctttcgaatggattccaaaaattggagaaaattaaggactctagccggcagagcaggcagctggaggagctcacggataagatgcgtgaatgtaagaggcttattaaagagtttgaccgagagttaaaggaatcggactacaaaaatgaccctgacacgaacaagatgcttactgagaaaaagcaatcaatgatcaaagagttgaattcatatgttgctcttaagaaacagcatgcaagtaatcttgaaaacaagcgagtggatctctttgagggtcctggcgaaggatttgtagaagagaacggtctgcttgcttcaaatatgtcaaatcagcagctagtggatcatggaaaccagatgatggatgaaactgatcaagcaattaacagagcacaaaaggttgtccatgacaccattgatgttggaactgagaccgccgcagctcttaaatctcagactgagcaaatgagcagaattgttaacgagctggactccattcatttttcaatcaagaaggcatcaaagctagtcaaggaaatcggtaggcaggttgcaactgatcggtgtatcatggccctcctcttcctcattgttattggcgtcgtagctatcattatagtgaagatagtgaacccaaataaccaagatattcgagatataccaggattggctcctccagctcccacccgtaagctactttgggttcctaagtgacgagtatttgtgttcggttcaaactactatgatacaaatacatacctggctggctttgattggatgaagtttggtcgatgaagtattactatctgagggatccgttttgaggtttggccaattattagttagcatgaatatctatctgtctatctatcaatctgtacgcatcccacagcgaccatattttttacatatatttttacaaatattaaatgcaactgggaattgattcttatttgttcccctgtatcttgagattacttaaattcttttccattgcgatgacaagtatttgttgtatagttatactcttaagatccggtctatctgcatattgtggtacttaaaaaaaaaaaaaaaacaaaaaaaaaaaaaaaacaaaaaaaaaaaaaacaaaaaaaaaaaaaacaaaaaaaaaaacaaaaaaacaaaac

SEQ ID NO: 7865 - DNA, 983 bp, Cucumis sativus
attttgtttgtgatttttggctcgcattgggatttgtttgttgacattgattaattggattctgagaattttgggaggtgggagcttaagatcttgaagaatttttgaagattttagcttacttgtaatgtgccttaatatctgagaggacaagaatcgtgtgttttgtttattggaagtttgaatttgaagatggatacattatcttcaatcagcgaggaacttgcagatatcgagggacaaatcaatgatatcttccgagctttgtcaaatggatttcagaagctggagaaaattaaggattcaaataggcggagtagacaattggaagagttgacagataagatgcgagaatgtaagaggcttattaaagattttgacagagaagtcaaagatttagaaggagggaacaacgctaacactaacaaaatgctgagtgagaaaaagcagtctatgatcaaagagttgaactcatatgttgcccttaaaaagcaacatgcaagcactcttgacaacaagcgaatcgatctctttgatggacctggtgaaagttatggggaagaaaatgtgttgctagcttcaaatatgacaaatcaacaattgattgataatggaaacaggatgatggatgaaactgatgaagcaattgagaggtctaaaaaggtagttcaagaaacggtgaatgtaggaacggagacagctgcagctctgaaggcgcagaccgatcaaatgagcaggatcgtgaacgagcttgactccatacatttctcattgaagaaagcatccaaactggtgaaggaattaggaagacaagttgcaactgataagtgtataatggcccttctcttcatcattgttattggtgtcattgccattatcattgtcaagttggtgaatccaaataacaaggacattcgggacattccggggctggcaccacctgttcagagtcgaaaactgctatggaattctggttagaaacc

SEQ ID NO: 7866 - DNA, 1353 bp, Helianthus annuus
caacattttccagatctgagttgagaaagttttgtgattcaccgaggatctgaatcggtgaactatggcggtttcgatttcgagcatcagcgaggagctcggcgagattgacggacagattgctgatatttttcgagcactttcaaatggatttcaaaagtttgagaagatcaaagatgcaagcaggcagagtaggcagttggaagatctcaccgtaaagatgcgtgaatgtaaaaggcttatcaaagagtttgatagagaagtcaaggaactagaacacacagttgatcctgataccagcaagatactgaatgagaaaaaacaatcaatggtcaaggagttgaattcatacgttgcactgaaaaaacaatatgcaaccaacattcaaaataaacgtgttgatctctttggtgggcctgctgaaggatttgaggaggataatggcttacaagcctcatccatgacaaaccagcaactaatggataacggtcatcaaatgatggatgaaactgaccaagctattgaacggtcaaaaaaggttgttcacgagacaataaatgtgggaaccgagactgcagcagcacttaaagcacaaacagaacaaatgagtagaattgttaacgaacttgattcaattcatttttcaatcaagaaggcttctcaattagtgaaggaaattggtaggcaggttgcaactgatcgatgcatcatggctttgctcttccttattgtggttggtgttatatctataattattgtgaagcttgttcatccaaacaacaaagacattcgcgatattcccggattagcccctcctgctcctagccgaagacttttatggatctctgaataacggaatcaaaagcataaatttacagtaaaagtggatttattcagggtaaaactcgttgagtacaaggaaacagactgcaaatcaagcgattatccgtttggttttctgacctatcaatatttgttttctgttagcggttattgtttgagaaagttatcgccttttttggatcgagggagatttgtgtacaatattcactctttgccattctacctggtcatactaagacatttgtacaagtgttgtgtaccaaattacaaccttagtttctgtttggatgtcttgtcgtttgcactcttataccaagtgagcggttttctggggatgtataaacgaatcatgtataagcgagagtgtgtatccactgcctcatttcatctctttgtatgtcttatttttggtatttttaccatttagtttgcattgcagttctttgtatgtcttatagttttgttattatttgtctaccatgccttaaaatagattatcgtttcttgttg

SEQ ID NO: 7867 - DNA, 1340 bp, Triphysaria pusilla
atcacgagagcgccaggtcatagcaaaggcctgtctcttctccaaaaaattcaccagatcccatcccaacttcctccgccactgacgagaacattttgattcctatttgacgttgcttcggtcggagtaatcattattaaaattacttttatttcgtttcgttgaagacatttgaccaatcggatttggatttttgattctccggcgagatggtgaacgaagagctcgcggagatcgagggccagatttctgatattttcagagctctttcgaatggattccaaaaattggagaaaattaaggactctagccggcagagcaggcagctggaggagctcacggataagatgcgtgaatgtaagaggcttattaaagagtttgaccgagagttaaaggaatcggactacaaaaatgaccctgacacgaacaagatgcttactgagaaaaagcaatcaatgatcaaagagttgaatccatatgttgctcttaagaaacagcatgcaagtaatcttgaaaacaagcgagtggatctctttgagggtcctggcgaaggatttgtagaagagaacggtctgcttgcttcaaatatgtcaaatcagcagctagtggatcatggaaaccagatgatggatgaaactgatcaagcaattaacagagcacaaaaggttgtccatgacaccattgatgttggaactgagaccgccgcagctctcaaatctcagactgagcaaatgagcagaattgttaacgagctggactccattcatttttcaatcaagaaggcatcaaagctagtcaaggaaatcggtaggcaggttgcaactgatcggtgtatcatggccctcctcttcctcattgttattggcgtcgtagctatcattatagtgaagatagtgaacccaaataaccaagatattcgagatataccaggattggctcctccagctcccacccgtaagctactttgggttcctaagtgacgagtatttgtgttcggttcaaactactatgatacaaatacatacctggctggctttgattggatgaagtttggtcgatgaagtattactatctgagggatccgttttgaggtttggccaattattagttagcatgaatatctatctgtctatctatcaatctgtacgcatcccacagcgaccatattttttacatatatttttacaaatattaaatgcaactgggaattgattcttatttgttcccctgtatcttgagattacttaaattcttttccattgcgatgacaagtatttgttgtatagttatactcttaagatccggtctatctgcatattgtggtacttaaagctatattt

SEQ ID NO: 7868 - DNA, 1440 bp, Citrullus lanatus
ttcgtttgtgattttcggttcgcattggcatttgttttttgggtttttcgccattgacattgattaaccggagtctgagaatttcgggaggtgggagcttaagatctcgaagaattattgaaaattttcagctatttgtaatcttgtaatgtgccttaatctctgaggaggacaagaatcgttgtattttgtttcttggaggttcgaatttgaagatggattccttatcttcaatcagcgaggaacttgcagatatcgagggacaaatcaatgatatcttccgagctttgtccaatggatttcagaagttggagaagattaaggactctactagacggagtagacaattggaagagttgacagataagatgcgagaatgcaagaggcttattaaagagtttgacagagaagtcaaggatttagaaggaaggaacaactctaacactaacaaaatgctgagtgagaaaaagcagtctatgatcaaagagttgaactcatatgttgcccttaaaaagcaacatgcaagcactcttgacaacaagcgtatcgatctctttgatggacctggtgaaagttatggggaagaaaatgtgttgctagcttcaaatatgacaaatcaacaattgattgataaaggaaacaggatgatggatgagactgatgaagcaattgagaggtcaaaaaaggtagttcaagaaacagtgaatgtgggaacggagacagccgcagctctgaaggcgcagacagagcaaatgagcaggatagtgaacgagcttgactccatacatttctcactgaagaaagcctcaaaacttgtgaaggaattagggagacaagttgcgactgataagtgtataatggccctactcttcatcattgtccttggtgtcattgccattatcattgtcaagctggtgaatccaaataacaaggacattcgggacatcccggggctggcaccgcccgttcagagtcgaaaactgctatggaattccggttagaaacccaagttacaaaaaagaatcatcatccatatctgaaactcacccactcttctgggaatgctctacacaattagctagctatgtgaaattcttctagccttttgtagctttgtgagataataagctctaatgggctgaatgaaggaaggaaagggaaggggtttgctgacttcattcaaacataataggcaaaaggagggggggacagcttagccaggttctttcatatacctatccatattcaaaagtgttactctttactttaaagctacaaattatattcactctcattgtgtcctgtcctgtcctgtctttgagattttattgatttttatgtatggtcctgtcttgtataatgtaatcttaatcactcatatattctatcattttgcatatttgtttgggaattcattatttctaggttaaaatatcattt

SEQ ID NO: 7869 - DNA, 1319 bp, Flaveria ramosissima
attcatctctcaagttttcgatcagatctataacgcatccgacctgcattgctgcgatctgatcagttcatacacaactcatctgaatcgaggacttctggcggtggttttgtgtttgatgatgtgttggtgagaggaagtggagattgttgttgattggagttggtgaagtatggcgtcttcgacttcggccattagcgaggagcttggcgagattgacggacagattgctgatatttttcgagcactttcaaatggatttcagaaatttgagaagatcaaagacccaagcaggcaaagtaggcagttggaagaactcactggaaagatgcgagaatgtaaaagacttatcaaagagtttgatagagaagtcaaggaactagaaaacacagttgatcctgataccagcaagatgctgaatgagaaaaaacaatcaatggtcaaagagttgaattcatacgttgcactaaaaaaacaatatgcaaccaacattcagaacaagcgtgtcgatctctttggtgggccagctgaaggatttgaggaagataatggcttactagcctcatctatgacaaatcagcaactgatggataatggtcatcaaatgatgaatgaaactgatcaagctattgaacggtcaaaaaaggttgtccatgagacaataaatgtaggaaccgagactgcagcagcacttaaagcacaaacagaacaaatgagtagaatcgttaatgaacttgactctatccatttttcaatcaagaaggcttctcaattggtgaaggaaattggtaggcaggttgcaactgatagatgcatcatggctttgctcttccttatcgtggttggtgttatagcaatagttattgtgaagcttgttcatccagacaacaaagacattcgggatattcccggattaggccctcctgctaaccgaagactgttatggatccatgattagcgaaatcaagagcataaaattacagtcgaaatggacttattcgaggtatttgattacaaggaaacagactgcaaaacaagtgattatcaggcttttgtgttagcaggcttttgttcgcctttttggatggagagagattgtatacaatattcacacgttgccatatattggtggattttactaggtaagtttattgtttatttgtttacactttatcgttctacttaagacattgtacaagtgttgtgtaccatgttctttgagtacatgagtgagaaaccaagttacagccttaattctgttgaatatcttgtcatttgtaccaagtgagtggttttctggagatgtataaacgaattac

SEQ ID NO: 7870 - DNA, 1342 bp, Echinacea purpurea
taaaatccttaccatacacctgtcttcttcatctctcaacattcaccttcttcatctcattcatccgtacagtttccgatcagttcccgatcagttcatactctatccaacctgcattgttctcatctgatctgatctcatcagttcatgttttgattcggtgatttaatgattttgattcaatctgttgcagcgttttctggatctgagttgtggaagttttgttttctgatttaacgaagatctgaatcgagaaacactgtttgaactccgatgatgtgttggagaaactgagaaaggagattgagatacggagttggtgaagttatggcgtcttcgatttcgagcattagcgagcagctcggcgagattgacggacagattgctgatacttttcgagcattatcaaatggatttcaaaagtttgagaagatcaaagacgcaagcaggcagagtaggcagttggaagatctcactggaaagttgcgggaatgtaaaaggcttatcaaagagtttgatagagaagtcaaggagctagaaaacacagttgatcctgataccagcaagatattgaatgataaaaaacaatcaatggtcaaggagttgaattcatacgtcgcactgaaaaaacaatatgcaacaaacattcagaataaacgcgttgatctctttggtgggcctactgaaggatttgaggaagataatggcttactagcctcatccatgacaaatcagcaactaatggataatggtcaccaaatgatggatgaaactgaccaagctattgaacggtcaaaaaaggttgtccatgagacagtaaatgtgggaaccgagactgcagcagcacttaaagcacaaacagaacaaatgagtagaattgttaatgaacttgattcaatccatttttcaatcaagaaggcttctcaattagtaaaagaaattggtaggcaggttgcaaccgatcgatgcatcatggctttactcttccttattgtggttggtgttatatccataattattgtgaagcttgttcatccaaacaacaaagacattcgcgatattcctggattagcgcctcctgctcctaaccgaagacttttatggcttcctgattaacggaatcaaaagcattaatttacagcctgagtggattattcaagatattcgcgtgagaaagttatcgcctttttggatcgagggagactgtgtacattattcacactttgccattctacctgtaccaaattacaaccttaatatttgttcgatcgtcttgtcatttttactgttgtaccaagtgagcgggcttattcggatatataaacaaattatgtataagcga

SEQ ID NO: 7871 - DNA, 1081 bp, Ambrosia trifida
tatggcgtcgtcgatttcaacataagcgaggagctcggccagattgacggacagattgctgatatttttcgtagcactttcaaatggatttcaaaagttcgagaagattaaagacccaagcaggcagagtaggcagttggaagatctcactggaaagatgcgggaatgtaaaaggctcatcaaagagtttgatagagaagtcaaggaactagaacagacagttgatcctgataccagcaagatactgaatgagaaaaaacaatcaatggtaaaggagttgaattcatacgttgcactgaaaaaacaatatgcaaccaacattcaaaataaacgtgttgatctctttggtgggcctgctgaaggatttgaggaagataatggcttacaagcttcatctatgacaaatcagcaactgatggataatggccatcatatgatggatgaaactgaccaagctattgaacgatcaaaaaagactgtccatgagacaataaatgtgggaaccgagactgcggcagcactcaaagcccaaacagaacaaatgagtagaattgttaatgaacttgattcaatccatttttcaatcaagaaggcttctcaattagtgaaggaaatcggtaggcaggttgcaactgatcggtgcatcatggcgttgctcttcctcattgtggttggtgttatatctataattattgtgaagcttgttcatcctaacaacaaagacattcgcgatattcctggattagcccctcctgctcctagccgaagactattatggatccctgattaactgaaccagaagcataaatttacagcctaaatggatttattcaggtatttttgtttgagaaagttatcgccatttggatggagggagattgtgtacaatatttcacactttgtgggcattctacctggtcatactatgacattgtacaagtgttgtgtaccaaattacaaccttaatttctgtttggatgtcttgtcattttttactttggtaccaagcgagcagttttctgacgatgtataaacgaatcaagtgtaagagagagcgcatgtccaccatctcatttcattt

SEQ ID NO: 7872 - DNA, 1450 bp, Flaveria ramosissima
ccaaaatcactcgtctaagagattcacagctcatagtcatctgtcttcgattcttcatatctcaacatcgtgtgaaaccctcacaatcttcatcgattcatctctcaagttttcgatcagatctataatgcatccaacctgcattgctgcgatctgatttcttcatacaaaacttatctgaaacttgaacttctggcggtgattttgtgtttgatgatgtgttggtgaaaggaagttgagatacgtaggcgagattgttattgattggagttggtgaagtatggcgtcttcgatttcggccattagcgaggagcttggcgagattgacggacagatagctgatatttttcgtgcgctttcaaatggatttcaaaaatttgagaagattaaagacccaagcaggcaaagtaggcagctggaagaactcactggaaagatgcgggaatgtaaaagacttatcaaagagtttgatagagaagtcaaggaactagaaaacacagttgatcctgataccagcaagatgctgaatgagaaaaaacaatcaatggtcaaggagttgaattcatacgttgcactaaaaaaacaatatgcaaccaacattcagaacaagcgtgtcgatctctttggtgggccagctgaaggatttgaggaagataatggcttactagcctcatctatgacaaatcagcaactgatggataatggtcatcaaatgatgaatgaaactgatcaagctattgaacggtcaaaaaaggttgtccacgagacaataaatgtaggaaccgagactgcagcagcacttaaagcacaaacagaacaaatgagtagaatcgtgaatgaacttgagtcaatccatttctcaatcaagaaggcttctcaattagtgaaggaaatcggtaggcaggttgcaactgatcgatgcatcatggctttgctcttccttattgtggttggtgttatagctgtagttattgtgaagcttgttcatccagagaacaaagacattccggatattcccggattagcccctcctgccaaccgaagactcctatggatccttgattaacggaattaagagcatacagttacagtcgaaatggacttattcaaggtatttgattacaaggaaacagactgcaaaacaagtgattatctgacctgccaatatatgttttgtgttagcagacttttgttcgcctttttggatggagagagattgtatacaatattcacacgttgccatatattggtgggattttactaggtaagtttattgtttatttgtttacactttatcattctacctaagacattgtataagtgttttgtaccattgttctttgagtacatgagtgagaaaccaagttacagccttaatttctgtttggatatcttgtcatttgtaccaagtcagtgggtttctggagatgtataaacgaattacttataa

SEQ ID NO: 7873 - DNA, 1582 bp, Citrus sinensis
acccaaatcatattctgtcaatcacgacaacacattgtttgtttatgctgtttagatcgggcgacattgtaagtcctcgttttggtctccccgatcgatacagccacctacattgtgcggatcgaatccgaatttgaaattgccgattttccattgagactcagcggatctgattttgaatagtagattttcgagttttcatttttttcttttctattctttttttaattaggagcttcattcgttagttttttttggtgatgattaatttggcggtataagctttataaagtttcgagctgcattctgaatttttttttgagagatggatctatcatcgatcagcgacgatttagcggagatcaatggacaaatcactgacattttccgtgctttatcaaatggattccagaaattggagaagatcaaggatgttaataggcagagtaggcagttggaggagcttacggataagatgcgggaatgtaaaaggcttatcaaagagtttgacagagaagttaaggatatagagggtagaaatgatccagaaaccaacaagatgctaagtgagaaaaaacagtcaatggtcaaagagttgaactcatatgtggctctaaaaaagcaacatcaaaccaatcttgaaaacaacaaacgagttgatctctttgacgggccaaacgaagggtttgctgaagacaatgttttgctagcttcatccatgacaaatcaacaactaatggatagtggaaatcgaatgatggatgagactgatcaagccattgagagatcaaaacaggttgttcatgaaactattaacgttggaacagagacagccgcagtgctcaaggctcagaccgaacaaatgagtaggattgttaatgagctagactctatccatttttcaatcaagaaggcttctcaactggtcaaggaaattggtaggcaggttgctactgataagtgcattatggcaatgctcttccttattgtcattggagtcatagccattataatagtgaagcttgtgaacccgaacaacaaagacatccgggatattccaggattagctccacctgcaatggctcgaagattactttcgaatcctagataaattgttacatctgacatctcatgagagttctagggtgatctgcagtctgattgcaactatcattagcatagcttgtgtgccagttggcccttcccagtgttgcagaatgcatctgttgtagaattgttttaattattggtactacgatgaagagatttccaggcttccccaatttgttatcgcagcttattggtagcttcaatcattcgaggagtttatggttatttttccgacatttggtgaaaatcatcctccaatccagggagaaaccgtaccatagtatgtgtatttgagattgtatcggttcatatcctgtataatcacagttgtatcactttcacttgccaatttgttttttgttttgaagatttgttcctttacttttcactttaaacggtcacggacatagtcaatgtcgggtcttggatggaagttgtaatcctagtcgactaatccattttcctcttcctg

SEQ ID NO: 7874 - DNA, 1828 bp, Vitis vinifera
gttttgaaacctgcccgagccaaagctaaaaccaaaacccccccaaaaaccaaaaacaaaaaataaaaataaaaaaatttaaaaatggagaaatatttctctgtaaatcacgagaacctcttcgtacgtatccattctccagatcgccatttccacaagccctaggtttttccatcccaaaatccacattccaaattctcattgttcggatcgatccagattccgtacgttcaattccatttgaatttcgatttggatttttccaatctgatcgaatattcgatgctgtagcattcactttcgcttgaatccgttattgtagggaccagatcggagacgagggagctgtgttattcggtttcgctgccgaggacaattggttgttaaaatcctgtttttggttggagatcgtcagtggatctgcattgcgttgattttggcggtaatttggagattttgatgtttgtgagatattggagatcttgagaggacgtggtgattttcgagagtcattttgcgagatgtcttcgttggctggaatcagcgaggagctggcggagatcgatggacaaattagtgacattttccgcgcgttatctaatgggttccagaagttggagaagatcaaagacacgagtaggcagagcaggcagctggaagagcttacggggaagatgagagagtgtaagaggctcattaaagaatttgatagagaagttaaggatttggagattagaaatgatccagaaaccaacaagatgctgaatgagaaaaagcaatcaatgataaaagagttgaattcgtatgttgctcttaaaaagcaatatgcaaccaatcttgaaaacaagcgaattgatctctttgatgcgcctgctgatgacgttggagaagaaaatgttttgctagcttcatctatgacaaatcaacagctaatggataatggaaatcggatgatggatgagactgatcaagtcattgagagatcaaaaaaggttgttcaagatacagttaatgttggaacagaaactgcagcagctctcaagtcgcagactgaacaaatgagcaggattgttaacgagctagattctatccatttctcaatcaagaaagcttcacagctggtcaaggaaattggtaggcaggttgccactgatcggtgtattatggccttgctcttcattctagtcattggggtcatagccgtcattattgtgaagcttgtgaacccaaataacaaggacattcgggatgttcctggattggccccaccagctctcactcggaaattactttggcatcctaattaaatctggcagtgaatttcctcaagattttatcagacacgatttgattgggtgtaaaattagctgagattttgacgctgttggcatcacttggtatagtgaaaaacccaatctggtttaaaagggtggattctttcgacacaggaaacttgctggagtcgctatatgattaatcagcttttcaaaatgccagtctcttaaactgctgttgtggcttgttcagtagcttcaatcagataaggttttgtatgtgatttgtttattctccacggattacgattaagaaaattgccactatttaggtgagggaattctgagcgtaaatacttgaaaccaagatgttcatactccactgtataatcacaatggtgtgtttatttttattttttagattttgtttttcaccatcatttccatagtgatttgacattatagtgttcatttaattatcacctgaagattgataggttttttgtatctacatttaaaaaaaaaattatttgtgaagtcaagtgacttttgtt

SEQ ID NO: 7875 - DNA, 1585 bp, Vitis vinifera
gctaaaaccaaaacccccccaaaaaccaaaaacaaaaaataaaaataaaaaaatttaaaaatggagaaatatttctctgtaaatcacgagaacctcttcgtacgtatccattctccagatcgccatttccacaagccctaggtttttccatcccaaaatccacattccaaactctcattgttcggatcgatccagattccggaccagatcggagacgagggagctgtgttattcggtttcgctgccgaggacaattggttgttaaaatcctgtttttggttggagatcgtcagtggatctgcattgcgttgattttggcggtaatttggagattttgatgtttgtgagatattggagatcttgagaggacgtggtgattttcgagagtcattttgcgagatgtcttcgttggctggaatcagcgaggagctggcggagatcgatggacaaattagtgacattttccgcgcgttatctaatgggttccagaagttggagaagatcaaagacacgagtaggcagagcaggcagctggaagagcttacggggaagatgagagagtgtaagaggctcattaaagaatttgatagagaagttaaggatttggagattagaaatgatccagaaaccaacaagatgctgaatgagaaaaagcaatcaatgataaaagagttgaattcgtatgttgctcttaaaaagcaatatgcaaccaatcttgaaaacaagcgaattgatctctttgatgcgcctgctgatgacgttggagaagaaaatgttttgctagcttcatctatgacaaatcaacagctaatggataatggaaatcggatgatggatgagactgatcaagtcattgagagatcaaaaaaggttgttcaagatacagttaatgttggaacagaaactgcagcagctctcaagtcgcagactgaacaaatgagcaggattgttaacgagctagattctatccatttctcaatcaagaaagcttcacagctggtcaaggaaattggtaggcaggttgccactgatcggtgtattatggccttgctcttcattctagtcattggggtcatagccgtcattattgtgaagcttgtgaacccaaataacaaggacattcgggatgttcctggattggccccaccagctctcactcggaaattactttggcatcctaattaaatctggcagtgaatttcctcaagattttatcagacacgatttgattgggtgtaaaattagctgagattttgacgctgttggcatcacttggtatagtgaaaaacccaatctggtttaaaagggtggattctttcgacacaggaaacttgctggagtcgctatatgattaatcagcttttcaaaatgccagtctcttaaactgctgttgtggcttgttcagtagcttcaatcagataaggttttgtatgtgatttgtttattctccacggattacgattaagaaaattgccactatttaggtgagggaattctgagcgtaaatacttgaaaccaagatgttcatactccactgtataatcacaatggtgtgtttatttttattttttagattttgtttttc

SEQ ID NO: 7876 - DNA, 1235 bp, Flaveria ramosissima
gattcatctctgaagctttcgatcagatctataatgcatccgacctgcattgctgcgatctgattagttcatccacaagtcatctgaatcgagaacttctggtggtgattttgtgtttgatgatgtgttggtgaaaggaagttgagatacgtaggcgagattgttattgataggagttggtgaagtatggcgtcttcaatttcggccattagcgaggagcttggcgagattgacggacagatagctgatattttcgagcactttcaaatggacttcaaaaatttgagaagatcaaagacgcaaacaggcaaagtaggcagttggaagaactcactggaaagatgcgggaatgtaaaagacttatcaaagagtttgatagagaagtcaaggaactagaaaacacagttgatcctgataccagcaagatgctgaatgagaaaaacaatcaatggtcaaagagttgaattcatacgttgcactaaaaaacaatatgcaaccaacattcagaacaagcgtgttgatctctttggtgggccagctgaaggatttgaagaagataatggcttactagcctcatctatgacaaatcagcaactgatggataatggtcatcaaatgatgaatgaaactgatcaagctattgaacggtcaaaaaaggttgtccacgagacaataaatgtaggaactgagactgcagcagcacttaaagcacaaacagaacaaatgagtagaatcgttaatgaactcgactcaatccatttttcaatcaagaaggcttctcaattggtgaaggaaattggtaggcaggttgcaactgatagatgcatcatggctttgctcttccttattgtggttggtgttatagcaatagttattgtgaagcttgttcatccagacaacaaagacattcgggatattcccggattagcccctcctgctaaccgaagactgttatggatccatgattagcgtaatcaagagcataaaattacagtcgtaatggacttattcgaggtatttgattacaaggaaacagactgcaaaacaagtgattatctgacctgccaatatatgtttgtattagcagacttttgttcacctttttggatggagggagattgtatacaatattcacacgttgccatatattggtgggatattactaggtaagtttattgtttatttgtttactactttatcattctacttaagacattgtataagtgttttgtacc

SEQ ID NO: 7877 - DNA, 1167 bp, Chenopodium quinoa
acaatgtcgtcgttgtcggcgattagcgaggagctcggcgagattgacggacaaatcaatgatatttttcgtgcattatcaaatgggtttcaaaagttggagaagatcaaggattccagtagacagagcaggcaactggaagagctcacggataagatgcgagagtgtaaaaggcttattaaagagtttgatagagaggtgaagaatttggaaagcaggaatgatccaaacaccagcaagacattgaatgagagaaaacagtctatgatcaaggagctgaattcatatgttgctttgaaaaagcaatatgcttccaatcttgaaaataaacgagttgaactatttgatgggcctagcgaaggggtaggagaagaaaatgttttgttagcatccactatgacaaatgagcagctgatggatcgtggaaacacaatgatggatgaaactgatcaagccattgatagaggaaaaaagattgttcacgagacaattaatgtaggaacagaaactgcagaagctcttaaagcccagactgatcaaatgagtaggattgttaatgaactggactccataaatttctcgatcaagaaagcttcgaagctagtcaaggaaatcggtcgacaggttgctactgataaatgtatcatggccttgcttttcctcatagtgcttggagtcatagccatcatcattgcgaagattataaacccacacaacaaagacatccgagatattcctggattagctccaccggctcaatcacgaagactgctttcatttccaaactgaagttcctaccaaagaagatgcttcctaggattcttactttggtcttttgctatcttatgagccgtgtgaaagactttgactgcaccaaggtcttttcggaacccgagtaatttagtcaagaatatgttcatattggcggtactttggcctttgtaatatatttgatttggagccttacttaacaacttgccaagaatatattccagcatacatcaacaaactttcttttgtagggttcagtgtaagtgatgctgtcaaaatattaattattcctgtaatcctatgtttgtattagcgtgaaagtttgtcattttcatatgactaaactgcacgttcacacatgactcgcaacctttgtataatcatacctaaattctt

SEQ ID NO: 7878 - DNA, 1532 bp, Eschscholzia californica
actagttttggtttcctcgtattaagtttatccgattcaacagagttgacctacattgaaccgatttgattcagagtacaggtttccttcttcaattttgtgttaaatcattacatttgagagtgattgacttcatattttagggttatttgatcgatttcaaagttgatctctttcgtaaagattgttaaacgatattgaagtttcttgctcggatttgatgcgtgagatctagtttttttttgttgttgaaatcatcgatgtggatctgagaatagagatttgatgcgggacatagaattttggtagtggaaagggcgtagctttgattctagaaacgaaatacctagaaatctagattggagatggatttatctgatataagtgacgagctagctcatatcgatggacagattagcgatatctttagagctttatctaatgggtttcagaagttggagaagattaaggactcaaataggcaaagccgacaattggaagagctcacgggaaagatgcgcgaatgtaagaggttgattaaggagtttgaccgagaagtaaaggatggggagagtagaaatggtccagatacaaacagaatgctcaatgagaaaaaacagtcaatgatcaaagagttgaactcttatgttgctctcaagaagcaatatgcaagtactcttgacaacaagcgagttgatcttttgatgggcctggtggtggagaagaatttggtgaagaaatgttctgctggcttcaactatgaacaatcagcagctaatagatagtggtaaccggatgatggatgagactgatcaagcaatcgagaggtcaaagaaggttgtgaagacacagttaatgttggagctgagactgcagctgctctcaaggcacagacagaacaaatgagtaggattgtcaatgagttggactcaattcatttctccatcaaaaaggcttccaaactggttaaggaaatcggtaggcaggttgctactgatcggtgtataatggcgttgctttttctagttgttgttggagtcatagccatcattattgtgaagctcgtaaatccaaacaacaaggacattcgtgacattcctggacttgcaccaccagcccaaagtcgaaaacttctttggatcccagacaaagtctagctagcatcagaaggacatttattcaacatatatcgtgtgcacattcaaattacgaacgcatgagatgtggatgttaatcattttcttatctagatgagctacctacccagttttaacctcagattaattcagggctaaaggaaagaaatgagttgaatgtagaatatatttatgaagtcaccgtctgtttttttgctgtgatgcaatttgcgccatactgatgatataattgttcagtttctcttcttcagtcgattcgatgaagcgcgtgtcttcgttgacggtaaattgtgatgttttcttgtgattgtgttttgtgatttaatgtcttggtgtactttagcgagcgagggagcttgtgtttatgcagagtga

SEQ ID NO: 7879 - DNA, 1582 bp, Citrus clementina
acccaaatcatattctgtcaatcacgacaacacattgtttgtttatgctgtttagatcgggcgacattgtaagtcctcgttttggtctccccgatcgatacagccacctacattgtgcggatcgaatccgaatttgaaattgccgattttccattgagactcagcggatctgattttgaatagtagattttcgagttttcatttttttcttttctattctttttttaattaggagcttcattcgttagttttttttggtgatgattaatttggcggtataagctttataaagtttcgagctgcattctgaatttttttttgagagatggatctatcatcgatcagcgacgatttagcggagatcaatggacaaatcactgacattttccgtgctttatcaaatggattccagaaattggagaagatcaaggatgttaataggcagagtaggcagttggaggagcttacggataagatgcgggaatgtaaaaggcttatcaaagagtttgacagagaagttaaggatatagagggtagaaatgatccagaaaccaacaagatgctaagtgagaaaaaacagtcaatggtcaaagagttgaactcatatgtggctctaaaaaagcaacatcaaaccaatcttgaaaacaacaaacgagttgatctctttgacgggccaaacgaagggtttgctgaagacaatgttttgctagcttcatccatgacaaatcaacaactaatggatagtggaaatcgaatgatggatgagactgatcaagccattgagagatcaaaacaggttgttcatgaaactattaacgttggaacagagacagccgcagtgctcaaggctcagaccgaacaaatgagtaggattgttaatgagctagactctatccatttttcaatcaagaaggcttctcaactggtcagggaaattggtaggcaggttgctactgataagtgcattatggcaatgctcttccttattgtcgttggagtcatagccattataatagtgaagcttgtgaacccgaacaacaaagacatccgggatattccaggattagctccacctgcaatggctcgaagattactttcgaatcctagataaattgttacatctgacatctcatgagagttctagggtgatctgcagtctgattgcaactatcattagcatagcttgtgtgccagttggcccttcccagtgttgcagaatgcatctgttgtagaattgttttaattattggtactacgatggagagatttccaggcttccccaatttgttatcgcagcttattggtagcttcaatcattcgaggagtttatggttatttttccgacatttggtgaaaatcatcctccaatccagggagaaaccgtaccatagtatgtgtatttgagattgtatcggttcatatcctgtataatcacagttgtatcactttcacttgccaatttgttttttgttttgaagatttgttcctttacttttcactttaaacggtcacggacatagtcaatgtcgggtcttggatggaagttgtaatcctagtcgactaatccattttcctcttcctg

SEQ ID NO: 7880 - DNA, 1823 bp, Gossypium hirsutum
aagcgaacaacctccctcccaacccaaaacgaccgacgaagccaaaaccttttttttaacaagctagataaataattatattaaaaaaatacaaaattgcctgtaaatcacgagaagacctgtgtatattgtaagctgttttagatcgggaagggagacaatggtgtccaacgtttaaacaaccttaccttcctttttttcattcttaatgaagaagtctttacatcgcaccaaatcaatgtcttaatctcgtaattcttttcttgcctttcatattggttcctttttcaaataccgaagttatttggctttttggatctggaaattaaagattcgcctcaaattctcgctttcgttggctcgacattgtacacatttcgagttttagttacagtaaaccgttcggatcagatctgatccggaagttttgaatctgctgttttggcgatcgactctttgattcgtcattgctgtcaataactagcacaaagaatttaaattttcctttatttgttctctgtgaattcatttaatgcttgaagattgaattaaaatttgagagagaagttagcctgttactactaaggttttaagatggatcctttagctgcggtcagcgaagagctagcggagatcgatggacaagtcgccgacatttttcgagctttatcaaatggattccagaaactggagaagattaaggacgttaataggcagagtaggcaattggaagagcttactgacaagatgcgagagtgtaagaggcttatcaaagagtttgatagggaagtgagggaaacagagcgtagaactgatgcaaacacccacaaaatgctaaacgaaaagaagcagtccatgatcaaggagttgaattcatatgttgcccttaagaagcaacatcaaagcaatcttgagaacaacaaacgagttgatctctttgatgggcctagtgaaggctttggggaagaaaatgtcttgctagcttcatctatgacaaatcaacagctaatggatagtggaaaccatatgatggatgagactgatcaagccattgacagagctaagaaggttgttcaagatactgttgatgttggaacagaaactgctgcagctctcaaggctcagactgaacaaatgagcaggatagttaatgagctggattctatccatttctcaatcaaaaaagcatctaaactggtcaaagaaattggtaggcaggttgctactgataagtgcattatggccttgttatttcttattgtcattggtgtcatagccatcataatcgtgaagctggtgaatccaaacaacaaggacatccgagatattccaggtttagcaccacctgcaatgaacaggcggctactttggactcctaattgaagaatttgaatgaaccaccgatgatatttcaggactatttgcagccacattgaattgaagagttcctactacttataccttggggccggtgggctacccttgttggagaactggtatggtcctgcagttggatttttatgttaggatagttctggtgcatccattaagagtttttcagaacttcccatgtgctaacctgccactagttatcatttcattgaatagcattagcatgatgagatctgtacgattccgttttattgttccagactgaagatattttgtccccatagacgaaagggaatttcatgtactttgagagcgtattggttcctatcatactttgtataatataacgcctgcatgattcttttttttcttctcaattgttccgatactgggacgaacttgtgaggtgagtattggatacggtatattca

SEQ ID NO: 7881 - DNA, 1349 bp, Ambrosia trifida
gaaaaaccaccttcaccttcttcatctacactcttccatccaattcattacgtatcctacctgcattgctcttttctgattcatccaagatctcaatccacaaattctgcagatctttaactgtttatgtttttcagctgttcgaaaaaaaaatactaataaattgagatacatagaccacgtcattattattagtatttattagtgacggagttaggtgaatttatatggcgtcgtcgatttccaacataagcgaggagctcggccagattgacggacagattgctgatatttttcgagcattatcgaatgggtttcaaaagtttgagaagattaaagatccaagcaggcagagtaggcagttggaagatctcactggaaagatgcgggaatgtaaaaggctcatcaaagagtttgatagagaagtcaaggaactagaacacacagttgatcctgataccagcaagatactgaatgagaaaaaacaatcaatggtcaaggagttgaattcatacgttgcactgaaaaaacaatatgcaaccaacattcaaagtaaacgtgttgatctctttggtgggcctgctgaaggatttgaggaagataatggcttacaagcttcatctatgacaaatcagcaactgatggataatggccataatatgatggatgaaactgaccaagctattgaacgatcaaaaaagactgtccatgagacaataaatgtgggaaccgagactgcggcagcacttaaagcccaaacggaacaaatgagtagaattgtaatgaacttgattcaatccatttttcaatcaagaaggcttctcaattagtgaaggaaatcggtaggcaggttgcaactgatcgatgcatcatggcattgctcttcctcattgtggttggtgttatatctataattattgtgaagcttgttcatccaaacaacaaagacattcgcgatattcctggactagcccctcctgctcctagccgaaaacttctatggatccctaattaactgaatcaaaagcatacatttacagcctaaatgaatttattgaggatttgtttgagaaagttatcgccattttggatggagggagattgtgtacaatatagttcacactttgccattctacctggtcatactatggcgttgtacaagtgttgtgtaccaaattacaaccttaatttctgtttggatgtcttgtctattttttactttggtaccaagcgagcagttttctgacgatgtataaacgaatcaagtgtaagcgagagcgcatgtccaccatctcatttcatttctttgtacgtcttatttttgattgtttacttgtggtttctggtga

SEQ ID NO: 7882 - DNA, 1282 bp, Flaveria ramosissima
tcatatctcaacatcgtgtgaaaccctcaccatcttcatcgattcatctctcaagctttcgatcagatctataacgcatccgacctgcattgctgcgatctgatcagttcatacaaaactcatctgaatcgaggacttctggcggtggttttgtgtttcatgatgtgttggtgagaggaagttgagatacgtaggcgagattgttgttgattggagttggtgaagtatggcgtcttcgatttcggccattagcgaggagcttggcgagattgacggacagattgctgatatttttcgagcactttcaaatggatttcagaaatttgagaagatcaaagacccaagcaggcaaagtaggcagttggaagaactcactggaaagatgcgagaatgtaaaagacttatcaaagagtttgatagagaagtcaaggaactagaaaacacagttgatcctgataccagcaagatgctgaatgagaaaaaacaatcaatggtcaaagagttgaattcatacgttgcactaaaaaacaatatgcaaccaacattcagaacaagcgtgttgatctctttggtgggccagctgaaggatttgaagaagataatggcttactagcctcatctatgacaaatcagcaactgatggataatggtcatcaaatgatgaatgaaactgatcaagctattgaacggtcaaaaaaggttagtccatgagacaataaatagtaggaaccgagactgcagcagcacttaaagcacaaacagaccaattgagtagaatcgttaatgaacttgactctatccatttttcaatcaagaaggcttctcaattggtgaaggaaattggtaggcaggttgcaactgatagatgcatcatggctttgctcttccttatcgtggttggtgttatagcaatagttattgtgaagcttgttcatccagacaacaaagacattcgggatattcccggattaggccctcctgctaaccgaagactgttatggatccatgattagcgaaatcaagagcataaaattacagtcgaaatggacttattcgaggtatttgattacaaggaaacagactgcaaaacaagtgattatctgacctgccaatatatgttttgtgttagcaggcttttgttcgcctttttggatggagagagattgtatacaatattcacacgttgccatatattggtgggattttactaggtaagtttattgtttatttgtttactactttatctattctacttaagacattctacaagtgttgtgtacca

SEQ ID NO: 7883 - DNA, 1486 bp, Cannabis sativa
tttattattattatttttttattattagtataataataaataatttgacaacaaaatccagatcgggattggtgtggtggtggtgggagaataatggatccattatcatcgatcagcgaagaacttgcggagatcgaaggccaaatcagcgatattttcagggctttatcaaatgggtttcaaaaattggagaagattaaggattccaacaggcaaagtaggcagctggaggagctcacagagaagatgcgagaatgtaagaggcttattaaagagtttgacagagaagtcaaggatattgaaagtagaaatgatcccaacaccaacaggatgcttagtgagaaaaagcagtctatgattaaggagttgaattcatatgttgccttgaagaaacaatatacagccaatcttgataacaaaaaaattgacctctttgatggaccaacagaaggacatgatgaagaaaatgtcttgctagcctcaaatatgacaaatcaacagcttatggataatggacaccaaatgatgaatgaaacagatcaggccattgagagatcaaagaaggttgttcaagacaccatcaatgttggaactgatacagcagcagctctcaaggctcaaactgaacaaatgagtagggttgttaatgagctggactctatccatttctctatcaagaaagcatctcaactggtcaaggaaattggtaggcaggttgcaactgacaagtgtattatggcattacttttcctaattgttgttggagtcatagccatcattatcgtgaagcttgtaaatccgaacaacaagaccatccgggatatacctggattagcccctcccgcaggccgaaaattactctggtaccttacctagaaagaaaatcgaactacaattcacgcagggttttcgggtaatttgcacctagtttggatgaaggttccgattccacagatattcagagctgattaagtcaggtgatggaactatttctggtagtttttgctttagagagtggctgagatgatgaaatgctagtttctttctactcttgtgtcatgacttggtgagaaggttggaatgggtgagatgtgtaacatcatattcttttgactccccccagattataaatttttatgccctatttaagtgagggagacacttttgattgtctcccttgaagaggtttatattgtttcatatcttgtaaattagcagttgttttatttgttattggtcacttgttttcaaaattattgtgtattgcttctgtcactaccatttatttggaaaatatactttagaaacaaacattcctatttcctagtggagacataataagctttcttgcattgctttgtgttttcttgttcaaatagctcagttcataaagttgggtttatatttgggacccaacacaagtttcaacacttttgattattatttttttatttgagctggttttacatcaactacctgtttttta

SEQ ID NO: 7884 - DNA, 1684 bp, Papaver somniferum
gcaaaaacaaaataattgaaagaatagcttgtccataaattacacgaaccatattatcatccaatcttaaaaaaaaccaaacaacaaactacaaagctccttaaaactttggtctcatcggatctcaaaaacatttttgttcgattaacgttaaactgatttctatcagtcactttttaacaacgattttcatatgttttcttgaaatcgttacgtttcggtgattggcatcagattttgttgcacattctttttgagatctgattgatgtggatcgaagaagaaaactagattctgattcgcttttgtgtaggtacaaggatttgtggttcataaacacttaggattttggataattagggtttctggagctggaattttgaggattctgttcccgatgtgtgaataaattgttgtttgtataaaatttgtagctgtggttatataaggaaattcttgagatggatctatcctccattagcgacgagttagcggagatagacgggcagattagtgatattttcagagcactatcaaatgggttccaaaagctggagaaaatcaaagactcgagtaggcagagtcgacaactggaggagcttacaggcaaaatgagggagtgtaagaggctgattaaagagttcgaccgggaagtgaaggatggtgagcacagctatggtccagacgagaacaaattgcttacagagaaaaaacagtcaatgattaaagagttaaactcctatgtcgctctcaaaaagcaatatgcaagcactcttgacaataagcgagttgatctttttgatgggcctggtggtggagaaggatatggcgaggagaatgttttgttggcctcaaatatgagcaatcaccagctgattgacagtggtaaccggatgatggatgatactgatcaagcaatcgagaggtcaaaaaaagttgttgaagacacagttaatgttggagctgaaactgcagcagctctaaaggcccagacagagcaaatgagtaggatcgttaatgagttagactcgattcatttctcgatcaagaaggcttcacaactggtcaaggaaatcggtaggcaggttgcaactgataaatgtattatggccttcctttttctaattgttattggagtcgtagccattatcattgtcaagattgtgcatccaaataacaaagacattcgagatattcccggtcttggtccaccagtccaaagccgaaaacttctttggcttccggacaatgtttattacagcaagtgagaagttgacagagcatatattttgaggagcttattagtaaaatgatgcatgagaggtggatggtttacgttcgtttctgattgataaagccattgcagcagctcaaaatgagaagattctgagtgagaggactcaataagttgaacatacgtaaagaatcttccggaagtgatattttgccagggattgcataatgttcatttatatctgtgttaattcttttggttaatgatgaagttttacgacgtgtattgtgttggccatctttcttctttgtgatgaatatttctgattcttagtcatttggtctccccttgtgggtgtaagggagacctaaaaacacgtacttaaaacagtttaccttacgttacgatataacacttactggtgtacattcatttaaaaaaaaaaaaaaa

SEQ ID NO: 7885 - DNA, 1731 bp, Ricinus communis
cccccttccaaaaaaactccacaatgaagaaacttctttttttttttttctttccttaactaaaaagaaaaaatcgaacattgtctgtttatcacgatgaaccattgctgttggtatttaatataaacattttttttttgtttttctatataaaaaattcttaaatagatcgggagacattgtaaatccttcgattctggtctcctcgatcagcaatatttcaatcacctcagaacctgcattgcacggatctaattaagcatttttaatccgtatccattgtatataaaaaaatttgggatttaattcaaatccctcgcattttggggtaaaaatgcaaatcgatgtaacattcggtgtatgaattctctacctgtccggattcagatcgtggaatctgcattttatgttgttctagatcgcgttgttttgacctacatttatcgttgaatagaattggttcgtgctcggttatatttttagatatttagcgattaaattataaagatggatcccatatcagcagtaagcgaagaactaggtcagatcgatggccagatagctgacattttccgagctttatcaaatgggtttcagaagttggagaagattaaggatgttaataggcagagtcggcaattggaagagcttactgggaagatgaaggattgtaagaggcttatcaaagattttgacagagaagtgaaggatttggagaatagaaatgacccaaacacaaacagaatgctgaatgaaaaaaagcaatcaatgattaaagagctgaattcatatgttgctcttaaaaagcaatatgcagccaatttagaaaacaacaagagagttgatctttttgatgggcctggtgaagagttaaatgaagaaaatgtgttgctagcttcatctatgacaaaccagcagttaatggataatggaaatcagatgatggacgagacagatcaagcaattgagaggggtaaaaagattgttcaagagaccatcaacgtaggaacagacactgcagcagctcttaaggctcagactgaacaaatgagtagaattgttaatgagcttgactctatccatttttcaatcaagaaagcttctcaactggtcaaggaaattggtaggcaggttgcaactgacaaatgcatcatggcgatgctgttccttattgtcgcaggggtcatagctatcattattgtgaagcttgtgaacccaaacaacaaagacattcgggatattccaggattagcccctccagctcagaatcgcagattactttggcatcctaataaagaaagtagctataacggggctgccttgtgagcacgtcagggtaatttacaatccaagaaaacttgacagtgtgatgctagttgcaggatctagcatttcagtaccagtttggtgcttttctgaaaagcttcctcaaatacttgtctcgagatttattgttgtagttcattgaatagcttaatttggaagaagacttcacggctatcccaaaacgaaagtgcttaggaattacctaatttatctattggttcatagcatgcataattacccttgtatgtttttcttttcttttcttttccttcagcttcataacatgtttgatattttttattttttttattttttgtttgagattcattcattcagcttacttacatttggatgtgcgtttgtggagctaaattttaatgaactaagtacaggagttttgcttct

SEQ ID NO: 7886 - DNA, 1816 bp, Populus trichocarpa
ctggaattaagaagccaacaacaacaataacaataaaaattcatccaacaaaaacaaaatactaaaaaaacaacgccaaaacagaacattaacgaggagacattttcatacttgcataattgatttagtttatttttttttcatctttaagatcgagagaaactgtaaaaccttggatcttggtccttgatcgattccataacctacattgtacggatcggatcaggatttcaaatcgttgaatttctttgtttttttttgtgaattcaaaattcgtaacccaaattattcagttaccaattgcaatcttaggcatttgtgtgaagagattcaattgaatttttggtactatttgtattctctacgagatgcattagtaaatttaataggatttgattagttttcgagctcattttgagcttgattgtttgaattctttttttatttatatgtgcattgaggattattgaattataggcagagatggatcctttatcgtcgatcagtgaagagctagcagagatcaatggacagatcgccgatatttttcgagctttatcaaatgggttccagaaattggagaagattaaggatgtcaatagacagagtaggcagctggaagaacttacggggaagctgcgggagtgtaagaggcttatcaaagagtttgacagagaaatgaaggatatggagagtagaaatgatccagacaccaacaaaatgctgaatgagaaaaagcagtcaatgatcaaagagttgaattcatatgttgctcttaaaaaacaatatgcgaccaatcttgaaaacaacaagagagttgatctctttgatgggcccaatgaagagttacatgatgacaatgtgttgctagcttcgtctatgacaaaccaacagctagtggatcatggaaatcagatgatggatgagactgatcaggcaattgagaggggaaaaaaggttgttcaagacaccatcaatgttggaacagaaactgcagcagctcttaaggctcagactgaacaaatgagtaggattgttaatgagctcgactctatccatttctcaatcaagaaagcttcgcaattggtgaaggaaattggtaggcaggttgcaactgacaagtgcattatggcattactcttccttattgttgttggagtcatagcaatcattattgtgaagctcgtgaacccaagcaacaaggacattcgggatattccaggattagccccgcctgcaccgtctcgcagattactttggattcctaatcaagaaacaagctagaaatgggattgtcaggatctactgcaatccaatcattttggatactgttggcagcaaccagtactacagaattgacctggtggagtgtactcaatgtgttttccggcttaaataccaatcttctgagagaaatttattgaattgcttcaattggaagatttctgcacaactatctttcaacagagtgaaagtaagattatccgcatgcgagagcaacttattttgtatttgagattgtaatggttcacggatctgtataatcaccctcgtatgattgtagtttcataaattgttttatttttttatttttattttttaaatggggtttcattgaaatcagtgtggcgcccgtctctcccagagtgtttgaatttttagaacctgttgctttcctcagccgtcacccatggaggaacgagggaatcctaaattcgatgagacagcacgtctatattccctgaaagagtggagacaatgcgaggcatgatcacattgaaatttgaactcggaggagtccctttctcagtgtttc

SEQ ID NO: 7887 - DNA, 1763 bp, Prunus mume
taaaaacgcgttttcttggcgggccacagggtccgaccctaagtttcctaacgacgaaatgagcgttttaaacggccaataatgttgtcgtagattttaaacgcccctctccccccatcacaaaaagagaaaagaaaaaaaaacaaacaaagaaaaaatccaaaatataaaaaatttgtctctgtaaatcacgaggagggaagcccctgtattattatttttataaatttataaagaagagtttttcagatcggggacccttcgattttggtctcctcgatcgccatcgcaacctacattgcctcggatctgatcgcggatttcgatttttttattgtccgatttattggtttgattaatttggaaggcgatttgagatttgattctttgcattttgcttcggttgagcttcgaagccgattggatttgattggggaacttcccagaatctgagttttgtgatgatctgaaggatttgatttgattgttgtttattggagagatggatccgttatctgcaatcagcgaagagctggcggagatcgacggccaaatcactgacattttccgtgcattatcaaatgggtttcagaagctggagaagattaaggactcgaataggcaaagtaggcagcttgaagagctcactgacaagatgcgagactgtaagaggcttatcaaggaatttgacagagaagtcaagaatattgagagagtaaatgacccagacaccagtagaatgctgaatgagaaaaagcagacaatgatcaaagagttgaattcatatgtggctctgaaaaagcaatatgcgtcgaaccttgaaaacaagaaaattgatctctttgatgggccagccgaggaatatggggaacagaatgtcttgctagcctcgtctatgacaaatcaacaactaattgataatggaaaccaaatgatggatgagacagatcaagcgattgagagatcaaaaaaggtcgttcatgagaccatcaatgttggaacagagacagcagcagcactcaaagctcaaactgaacaaatgagtaggattgtcaacgagctggactcaatccatttctcaatcaagaaagctactaagctggtcaaggaaattggtaggcaggttgcaactgataggtgtattatgggattacttgtcctggtggtcattggagtcatagccatcattattgtgaagctcgtccatccaaacaacaaggacattcgagatattcctggattagcccctcccgcaatgacccgaaaattactgtggaatcctaattaaagagagctcaaaatgaaccatgtcatgagattgccaagatggtttgcatcatgcccaaatggacgttagctttttatctcgtgatgctgttctcagccctgttttacaaaacagatatggaactatttcccagtaagttttgctttggaaaccggctgtcgtttaggaaagctaggctcactactgttgttgtgccttggtaattggcttcagttgcatgagatatgcgtgatcaatttttcttccctgaccgtaaaagttatccctatttaagtgagggaaatctactttgaatatgtattttaggctgtattggttcgtataccctgtataatcacagcttgattttgtagtcacttttactaaaagttctgtttggaagttactcgttgatgtaccaaaattaatatttgaaatgaatttgggtcttctgtggattgaatcagtgtagctcagaagttgatctcatgtttta

SEQ ID NO: 7888 - DNA, 1249 bp, Prunus persica
gatttgattgttgtttattggagagatggatccgttatctgcaatcagcgaagagctggcggagatcgacggccaaatcactgacattttccgtgcattatcaaatgggtttcagaagctggagaagattaaggactcgaataggcaaagtaggcagcttgaagagctcactgacaagatgcgagactgtaagaggcttatcaaggaatttgacagagaagtcaagaatattgagagagtaaatgacccagacaccagtagaatgctgaatgagaaaaagcagacaatgatcaaagagttgaattcatatgtggctctgaaaaagcagtatgcgtcgaaccttgaaaacaagaaaattgatctctttgatgggccggccgaggaatatggggaacagaatgtcttgctagcctcgtctatgacaaatcaacaactaattgataatggaaaccaaatgatggatgagacagatcaagcgattgagagatcaaaaaaggtcgttcatgagaccataaatgttggaacagagacagcagcagctctcaaagctcaaactgaacaaatgagtaggattgtcaacgagctggactcaatccatttctcaatcaagaaagctactaagctggtcaaggaaattggtaggcaggttgcaactgataggtgtattatgggattacttgtcctggttgtcattggagtcatagccatcattattgtgaagctcgtccatccaaacaacaaggacattcgagatattcctggattagcccctcccgcaatgacccgaaaattactgtggaatcctaattaaagagagctcaaaatgaaccatgtcatgagattgccaagatggtttgcatcatgcccaaatggacattagctttttatctcgtgatgctgttctcagccctgttttacaaaacagatatggaactatttcccagtaagttttgctttggaaaccagctgtcgtttaggaaagctaggctcactactgttgttctgccttggtatttggcttcagttgcatgagatatgtgtgatcaatttttcttccctgatcgtaaaagttatccctatttaagtgagggaaatccactttgaatatgtattttaggctgtattggttcgtataccctgtataatcacagcttgattttgtagtcacttttactaaaagttctgtttggaaattactcgttgatgtaccgaaattaatatttgaaatgaatttgggtcttctgtggat

SEQ ID NO: 7889 - DNA, 1434 bp, Papaver somniferum
gattttcatatgttttttgaaatcgttacatttcggtgattggcatcagattttgttgtatattctttttgagatctgattgatgtggatccgggaagaaaactagattctgattcgcttttgtgtaagtacaaggatttctggttcataaacactttaggattttggataattagggtttctcgagctggaattttgaggattctgttcccgacgtgtgaataaattgttttgtataaaatttgtagctgtggttatataaagaaactcttgagatggatctatcctcaattagcgacgagttagcggagatagacggacagattagtgatattttcagagcactatcaaatgggttccaaaagctggagaaaatcaaagactcgagtaggcagagtcggcaactggaggagcttacaggcaaaatgcgggagtgtaagaggctgattaaagagttcgaccgggaagtgaaggatggtgagcacagctatggtccagacgagaacaaattgcttacggagaaaaagcagtcaatgattaaagagttaaactcttacgtcgctctcaagaagcaatatgcaagcactcttgacaacaagcgagttgatctttttgatgggcctggtggtggagaagaatatggcgaggagaatgttttgttggcctcaaatatgagcaatcaacagctgattgacagtggtcaccggatgatggatgatactgatcaagcaattgagaggtcaaaaaaggttgttgaagacaccgttaatgttggagctgaaactgcagcagctctaaaggcacagacagagcaaatgagtaggattgttaatgagttagactcgattcatttctcgatcaagaaggcttcacaactggtcaaggaaatcggtaggcaggttgcaactgacaatgtattatggccttcctttttctaattgttattggagtcgtagccattatcattgtcaagattgtgcatccaaataataaagacattcgagatattcccggtcttggtccaccggtccaaagccgaaaacttctttggcttccggacaatgtttattacagcaagtgagatgttgacagagcatatattttgaggagcttattagtaaaaagatgcatgagaggtggatggtctacatttgtctctgattgataaagcattgcatcagctcaaatgcgaagattccgagtgagaggactcaatcagttgaacatacgtaaagaatctttcggaagtgatattttgccagggattgcataacgttcatttatatctgtgttaattcttatggttaatgatgaagttttacgacgtgtattgtgttggccatcttcttttttgtgatgaatatttccgattcttagtcatttggtctccccttgtgagtgtaagggagacctaaaaacacgtacttgaaacag

SEQ ID NO: 7890 - DNA, 1880 bp, Gossypium raimondii
aaattattgcgaagatttttaaagaaaaattctccctccgaaccagcggacaacctccctcccaacccaaaacgaccaacgaagccaaaaccttttttttaaacaacttagataaataattatattaaaaaaaatacaaaattgcctgtaaatcacgagaagacctgtgtatattgtaagctgttttagatcgggaagggaggcaatggtgtccaacgtttaaacaaccttaccttcctttttttcattcgtaatgaagaagtcttcacaccgcaccaaatcaatgtcttaatctcgtaattcctttcttgcctttcgaattggttcctttttcaaataccgaagtttttttggctttttggatctggaaattaaagattcgcctcaaattttcgctttcgctggctcgacattgtacacatttcgaattttagttacagtaaaccgtgcggatctgatctgatccggaagttctgaatctgctgttttggcgatcgactctttgattcgtcattgctgtcaataagtagcacaaaggatttaaattttcctttatttgttctctgtgaattcatttaatgcttgaagattgaattaaaatttgagagagaagttagcctgttacctctaaggttttaagatggatcctttagctgcggtcagcgaagagctagcggagatcgacggacaagtcgccgacatttttcgagctttatcaaatggattccagaaactggagaagattaaggacgttaataggcagagtaggcaattggaagagcttactgacaagatgcgagagtgtaagaggctcatcaaagagtttgatagggaagtgaaggaaacagagcgtagaactgatgcaaacacccacaaaatgctaaacgaaaagaagcagtcaatggtcaaggagttgaattcatatgttgcccttaagaagcaacatcaaagcaatcttgagaacaacaaacgagttgatctctttgatgggcctagtgaaggctttggggaagaaaatgtcttgctagcttcatctatgacaaatcaacagctaatagatagaggaaaccatatgatgaatgagactgatcaagccattgacagggctaagaaggtcgttcaagatactgttgatgttggaacagaaactgctgcagctctcaaggctcagactgaacaaatgagcaggatagttaatgagctggattctatccatttctcaatcaagaaagcatctaaactggtcaaagaaattggtaggcaggttgctactgataagtgcattatggccttgttgtttcttattgtcattggtgtcatagccatcataatcgtgaagctggtgaatccaaacaacaaggacattcgagatattccaggtttagcaccacctgcaatgaacaggcggctactttggactcctaattgaagaatttgaatgaaccacctgatgatatttcaggacaatttgcagccaccatgaattgaagagtccctactacttatacctcggggcccggtgggctacccttgttggagaactggtatggtcctgcagttggatttttatgttaggatagttctggtgcatccattaagagtttttcagagcttcccatgtgctaacctgccactagttatcttttcattgaatagcattagcatgatgagatctgtacgattccgttttattgttccagactgaagatattttgtccccatagacgaaagggaatatcatgtactttgagagtgtattggttcctatcatactttgtataatataacacctgcatgattcttttttttttctttctcaattgttccgatactaggacggacttgtgaggtgagtcttggatacggtatattcaaaacag

SEQ ID NO: 7891 - DNA, 1989 bp, Gossypium raimondii
tatcacgcagtaagaaaacacgagtggcggccccactgcttagtccctaatttccggtttaaacgcctaaattattgcgaagatttttaaagaaaaattctccctccgaaccagcggacaacctccctcccaacccaaaacgaccaacgaagccaaaaccttttttttaaacaacttagataaataattatattaaaaaaaatacaaaattgcctgtaaatcacgagaagacctgtgtatattgtaagctgttttagatcgggaagggaggcaatggtgtccaacgtttaaacaaccttaccttcctttttttcattcgtaatgaagaagtcttcacaccgcaccaaatcaatgtcttaatctcgtaattcctttcttgcctttcgaattggttcctttttcaaataccgaagtttttttggctttttggatctggaaattaaagattcgcctcaaattttcgctttcgttggctcgacattgtacacatttcgaattttagttacagtaaaccgtgcggatctgatctgatccggaagttctgaatctgctgttttggcgatcgactctttgattcgtcattgctgtcaataagtagcacaaaggatttaaattttcctttatttgttctctgtgaattcatttaatgcttgaagattgaattaaaatttgagagagaagttagcctgttacctctaaggttttaagatggatcctttagctgcggtcagcgaagagctagcggagatcgacggacaagtcgccgacatttttcgagctttatcaaatggattccagaaactggagaagattaaggacgttaataggcagagtaggcaattggaagagcttactgacaagatgcgagagtgtaagaggctcatcaaagagtttgatagggaagtgaaggaaacagagcgtagaactgatgcaaacacccacaaaatgctaaacgaaaagaagcagtcaatggtcaaggagttgaattcatatgttgcccttaagaagcaacatcaaagcaatcttgagaacaacaaacgagttgatctctttgatgggcctagtgaaggctttggggaagaaaatgtcttgctagcttcatctatgacaaatcaacagctaatagatagaggaaaccatatgatgaatgagactgatcaagccattgacagggctaagaaggtcgttcaagatactgttgatgttggaacagaaactgctgcagctctcaaggctcagactgaacaaatgagcaggatagttaatgagctggattctatccatttctcaatcaagaaagcatctaaactggtcaaagaaattggtaggcaggttgctactgataagtgcattatggccttgttgtttcttattgtcattggtgtcatagccatcataatcgtgaagctggtgaatccaaacaacaaggacattcgagatattccaggtttagcaccacctgcaatgaacaggcggctactttggactcctaattgaagaatttgaatgaaccacctgatgatatttcaggacaatttgcagccaccatgaattgaagagtccctactacttatacctcggggcccggtgggctacccttgttggagaactggtatggtcctgcagttggatttttatgttaggatagttctggtgcatccattaagagtttttcagaacttcccatgtgctaacctgccactagttatcatttcattgaatagcattagcatgatgagatctgtacgattccgttttattgttccagactgaagatattttgtccccatagacgaaagggaatatcatgtactttgagagtgtattggttcctatcatactttgtataatataacacctgcatgattcttttttttttctttctcaattgttccgatactaggacggacttgtgaggtgagtcttggatacggtatattcaaaacaggtatgctcaaatttttaactttttcttttatatattttaag

SEQ ID NO: 7892 - DNA, 1280 bp, Ambrosia trifida
atctcagtaattcgatcagatctatcatccatccatctcacattgctcggtttctccgatctaaccagtgatctgtataataataatatttagttcgacatgacgtcatccgtgtcgaccataagcgaagagctcggcgagatcgacggacagatagctgatattttcgtagcactctcaaatagggtttcaaaagtttagtagaaggttaaagactcaagcaggcagagtaggcagttggaagactcactgcaagatgcgggaatgtaagaggcttatcaaagagtttgatagagaagtcaaggagttagaacatacagttgatcctgctaccagcaagattctgaacgagaaaaagcaatcgatggttaaagagttgaattcgtacgtagcactgaaaaagcaatatgcaacaaacattcaaaacaaacgtgttgatctatttggaggtcctgccgaaggatttgaggaagataatggcttgctagcatcatcaatgacaaatcagcaacttatggataatggtcatcagatgatggatgaaactgaccaggttattgaacgttcaaacaaggttgtccatgagacaataaatgtgggaaccgagactgcagcagcgcttaaagcacaaacagaacaaatgagtagaattgtcaatgaacttgactcgatccatttctcaatcaagaaggcttctcaattagtgaaggaaattggtaggcaggtcgcaactgatcgatgcattatggctttgctcttccttattgtagttggcgttatagctatcattatcgtgaagcttgtccatccagacaacaaagatatccgggatattccaggactaggccctcctgctgctaagcgaagacttctatggacccctcaataaatgcataacttaacggtctaggacacttttaggattaaactttattcgactacaaggaaacagactgcaaaaactagtgagctgacttgagtgctcggccatagtctagtgtggtgactagcagtatttgttttcggttgggagagtttgtttgagaaagttattgcctttcagatggatggagactgcacacaatcaaatattattcacactttctccattgtatctaaaacattgtaccagtgttgtgttacttgtgtatcatagttcctttgagtgagaaaccatattacgaccttaatttgtgtttttggatgtctgacattgaagcaagggttttcttgggatgtatagacaaattatgtataagcgaattcgtatcaaaaaagaa

SEQ ID NO: 7893 - DNA, 1761 bp, Gossypium hirsutum
cagcggacaacctccctcccaacccaaaacgaccaacgaagccaaaaccttttttttaaacaacttagataaataattatattaaaaaaaatacaaaattgcctgtaaatcacgagaagacctgtgtatattgtaagctgttttagatcgggaagggaggcaatggtgtccaacgtttaaacaaccttaccttccttttttttcattcgtaatgaagtcttcacaccgcaccaaatcaatgtcttaatctcgtaattcctttcttgcctttcgacttggttcctttttcaaataccgaagttttttttggctttttggatctggaaattaaagattcgcctcaaattttcgctttcgttggctcgacattgtacacatttcgaattttagttacagtaaaccgtgcggatctgatctgatccggaagttctgaatctgctgttttggcgatcgactctttgattcgtcattgctgtcaataagtagcacaaaggatttaaaatttcctttatttgttctctgtgaattcatttaatgcttgaagattgaattaaaatttgagagagaagttggcctgttacctctaaggttttaagatggatcctttagctgcggtcagcgaagagctagcggagatcgacggacaagtcgccgacatttttcgagctttatcaaatggattccagaaactggagaagattaaggacgttaataggcagagtaggcaattggaagagcttactgacaagatgcgagagtgtaagaggctcatcaaagagtttgatagggaagtgaaggaaacagagcgtagaactgatgcaaacacccacaaaatgctaaacgaaaagaagcagtcaatggtcaaggagttgaattcatatgttgcccttaagaagcaacatcaaagcaatcttgagaacaacaaacgagttgatatctttgatgggcctagtgaaggctttggggaagaaaatgtcttgctagcttcatctatgacaaatcaacagctaatagatagaggaaaccatatgatgaatgagactgatcaagccattgacagggctaagaaggtcgttcaagatactgttgatgttggaacagaaactgctgcagctctcaaggctcagactgaacaaatgagcaggatagttaatgagctggattctatccatttctcaatcaagaaagcatctaaactggtcaaagaaattggtaggcaggttgctactgataagtgcattatggccttgttgtttcttattgtcattggtgtcatagccatcataatcgtgaagctggtgaatccaaacaacaaggacattcgagatattccaggtttagcaccacctgcaatgaacaggcggctactttggactcctaattgaagaatttgaatgaaccacctgatgatatttcgggactatttgcagccaccatgaattgaagagtccctactacttatacctcggggcccggtgggctacccttgttggagaactggtatggtcctgcagttggatttttatgttaggatagttctggtgcatccattaagagtttttcagaacttcccatgtgctaacctgccactagttatcatttcattgaatagcattagcatgatgagatctgtacgattccgttttattgttccagactgaagatattttgtccccatagacgaaagggaatttcatgtactttgagagcgtattggttcctatcatactttgtataatatcacgcctgcatgattctttt

SEQ ID NO: 7894 - DNA, 1734 bp, Theobroma cacao
aagctctttccagatcgggaggcaccattatcaaacgttaaaagaacctcccctttctgtcttcgccaatccattccagaaataaaaaagggctccacattgtacggaattggatttcaaatggcgtaatttctttctttccttttcatttgatccgcatttgaaatccgttttgagatctcacgcatttctttgggaaagttcgagagttgttttgctttttggatcgggaattcaagattcgcctcttgttttcttttggaggaaaatttaagagtcattggctccgcattgttcctatttggatttctatttgaagattcgattttcagttcttgtaaatcgtacggatctgatccggtccggattttgaatcttctggtatggtgttttggcgatcgtgtctttgaatcgtcattcctgtcaataaacagctaaaaaaaacaaatttctcctttatttattctctgggaattcatttaatgcgtgaagactgaactaaagacagaagatagctggttacattgaaggttgaaagatggatcctttggctgcggtcagcgaagagctagctgagatcgacggacaaatcgccgacatttttcgagctttatcaaatggattccagaaactggagaaggttaaggatgttaataggcagagtaggcaattggaagagcttactgacaagatgcgggagtgtaaaaggctcatcaaagagtttgatagagaagtgaaggaaatggagagtagaattgatccaaacaccaacagaatgctgaatgaaaagaagcagtcaatgatcaaggagttgaattcatatgttgcacttaaaaagcaacatcaaagcaatcttgagaacaacaaacgagttgatctctttgatgggcctaacgaaggttttggagaagaaaatgtcttgctagcttcatctatgacaaatcaacagctaatggataggggaaaccagatgatggatgaaactgatcaagccattgacagggccaagaaggttgttcaagacacagttgatgttggaacagagactgctgcagctctcaaggctcagactgaacaaatgggcaggatagttaatgagctggattctatccatttctcaatcaagaaagcttctaagttggtcaaagaaattggtaggcaggttgctactgataagtgcataatggcattgttgtttcttatcgtcgctggtgtcatagccatcataatcgtgaagcttgtgaatccaaacaacaaggacatccgggatattccaggattagcaccacctgcaatgaaccggcggttactctggactcctaatcgaagactttagaatgaacgacctgatgatgttgtcaggattgtttgcagccacatttgatttgaagaatcatcatagagctatatccctggtggctaccatcgttgaagaactgatatggttgtggagttgatttaattttatgatagttttggtgaattggtaaaagagtttggcaggatttcccatgtgctagcggcactgtcaatgttatgattcattgaatagcattagcgtgacgagatctgtatgactacatcattcttccctgaccaaagaatttgtccctatatatagacgagagggaaggtaatgaatttgagagtgtattggttcatttcataccctgtataatataatacttgcataattctttgcttcatttactccataatttgttctgaatattc

SEQ ID NO: 7895 - DNA, 2044 bp, Theobroma cacao
agctctttccagatcgggaggcaccattatcaaacgttaaaagagcctcccctttctgtcttcgccaatccattccagaaataaaaaagggctccacattgtacggaattggatttcaaatggcgtaatttctttctttccttttcatttgatccgcatttgaaatccgttttgagatctcacgcatttctttgggaaagttcgagagttgttttgctttttggatcgggaattcaagattcgcctcttgttttcttttggaggaaaatttaagagtcattggctccgcattgttcctatttggatttctatttgaagattcgattttcagttcttgtaaatcgtacggatctgatccggtccggattttgaatcttctggtatggtgttttggcgatcgtgtctttgaatcgtcattcctgtcaataaacagctaaaaaaaacaaatttctcctttatttattctctgggaattcatttaatgcgtgaagactgaactaaagacagaagatagctggttacattgaaggttgaaagatggatcctttggctgcggtcagcgaagagctagctgagatcgacggacaaatcgccgacatttttcgagctttatcaaatggattccagaaactggagaaggttaaggatgttaataggcagagtaggcaattggaagagcttactgacaagatgcgggagtgtaaaaggctcatcaaagagtttgatagagaagtgaaggaaatggagagtagaattgatccaaacaccaacagaatgctgaatgaaaagaagcagtcaatgatcaaggagttgaattcatatgttgcacttaaaaagcaacatcaaagcaatcttgagaacaacaaacgagttgatctctttgatgggcctaacgaaggttttggagaagaaaatgtcttgctagcttcatctatgacaaatcaacagctaatggataggggaaaccagatgatggatgaaactgatcaagccattgacagggccaagaaggttgttcaagacacagttgatgttggaacagagactgctgcagctctcaaggctcagactgaacaaatgggcaggatagttaatgagctggattctatccatttctcaatcaagaaagcttctaagttggtcaaagaaattggtaggcaggttgctactgataagtgcataatggcattgttgtttcttatcgtcgctggtgtcatagccatcataatcgtgaagcttgtgaatccaaacaacaaggacatccgggatattccaggattagcaccacctgcaatgaaccggcggttactctggactcctaatcgaagactttagaatgaacgacctgatgatgttgtcaggattgtttgcagccacatttgatttgaagaatcatcatagagctatatccctggtggctaccatcgttgaagaactgatatggttgtggagttgatttaattttatgatagttttggtgaattggtaaaagagtttggcaggatttcccatgtgctagcggcactgtcaatgttatgattcattgaatagcattagcgtgacgagatctgtatgactacatcattcttccctgaccaaagaatttgtccctatatatagacgagagggaaggtaatgaatttgagagtgtattggttcatttcataccctgtataatataatacttgcataattctttgcttcatttactccataatttgttctgaatattcgaagtactgttttatttcaacaattgagtttgagtcttgacgatcttctgagcttagacatatcaaaaccatgtcctaattcaggcctctgctttttcttctgagctttgtaaatattcaagtcatggaaattgttttcatggctaatatttgcaacgctagggagtatgtcgactcataatagtttcattaaaagttgaagcaatttggtttcggtcatgaacggattcacaggtgatggaagtcctcaccatttattgaaaaattacatttattacaactgaataaaagagtaaattacataacactct

SEQ ID NO: 7896 - DNA, 1673 bp, Eucalyptus grandis
gcctccgccgactctccccggggccgcattctccggctttgaggcgcgcgcgattcgtccgcccggcgatggtctgtccgcgacgcggggaccgccgcatttcccgagcacgcggtgtccgccggtggccggcctgctgatcggcgtctcttctttctccccgcgggataccgtttctcgaggtcctgacgagtgttcgctagagttttctccgagcgagaggaagttcttcgtcgcgagattcggcgtcgggagtttggaatatcgtcagcggctcgccttcggggtttcctctcggcgtcctcgagaatggacgacctgtctgcgatcagcgaggagctggcggagctggacgggcagatctccgacatcctccgagctctagcaaatggattccagaaacttgataagatcaaggatgccaaccggcagagtagacaattggaagagcttaccgataaaatgcgtgagtgtaagaggctcattaaggagtttgacagagaaataaaggatcttgagggtagaaatgatgcagaaaccagcagaatgctgaatgagaaaaagcagtcaatgataaaagagcttaattcatttgtcgccctaaaaaagagatacacaacaaatctagaaaacaaacgagttgatctctttgatgggcccagtgaaggaattggtgaagataatggtttgctcgcttcatccatgacaaatcaacagctaatggaccatggaaaccagatgatggatgagacagatcaagccattgagaggtccaagaagactgtccaagataccgtcaatgtcggaacagacactgcagcagctcttaaggctcagactgagcaaatgagcaggattgtaaatgaactggattcaattcatttttcaatcaagaaagcatctcagctggtcaaggaaattggtaggcaggttgcaactgacaaatgtattatggcgtttctcgtcctcatagtcattggcgttatagccatcataattgtgaaaattgtacacccaaataacaaggacatccgtgatattccggggttggcacctcctgctcctactcggaaactactttgggaccgaaaggaagatagatggtaaccgtcatgtggtagatctcgtcatccacccagttgtttgatggctgtggcgctgcaggcttcccttccccgtcccgtctgctgaattcacgagcaatttctctcgagtatttcacttggattctctcggcttttcaggctatattcttttcattagttttgctccccaaaaagaattgagagatctactcaggtgatggatatctgtgctcgtaatttttcagacactcctcacctcaggataggagtcaccgggttgcattcatctttatttgtgatgtgtatttgaacaaaatggtccagagagtttgctgcttgctttcctgtctttcttcccagtatattaattatcaggatgtaactatgcgttcgcgtttccgaaatggccaatttacaattagatcacattatttccctgatgtactttgggactgctctctccattgatgaatttcatcaaaagaataacaaaagcccccgaagcattactttcgttgggcatatcgttctgctggcgcagacaattggcgaatgaatgcaattactacatctcccgtgtttaaataa

SEQ ID NO: 7897 - DNA, 1411 bp, Solanum phureja
cctctttatatcccttccatttccttaacattttttctaactatccctaaagcaacttcacttgctctctcctacttctttcttggcaactttcccttcataaatccatttatacacacacaaaaatttcccttttatcctcaaattaattactacctattttgtcatcattgaagtttcccaaaatggagaaagttaaaagtatggagaaaaagaaattgatcaatgagttaacacaagggaaggaatttgttaaccaattgaaaaatcagattattggtccattagcttctcctgaagaatgtgatttactaattgggaaaatattgtctacacttgagaaatcattatcaattctcaatttgaaggctcttcttcttgaaggtggaattaataatactaacaattcttcatcttcatgttcatcaatttcatttcttgctagtaataataatattagtcccaagagtgaagtttttgattcttcaagggatcaattggacaaaaatatggtctccaagaaaagaaagaaaacacaacaatggattaatcaaacaagcatttctgtaaatgggcttgaaggtccatgtgaagatggatttagttggagaaagtatggccaaaaagatattttaggggctaatcatccaagggcttattataggtgtactcataggaacacacagggatgtttggcaacaaaacaagtccaaaaatcagatggaaattcaacaatttttgaagtcacatataaaggaaggcacagttgtaaagttgcgcaatcagaaatattttcacttaataaccaaaaacgccagaaatgcaacaaaaaacaaaaagaagaaatggtaatattcaactctgcatcaccaaaccataacgttgaaaacttaaacattataacagcaaaagaagaagaagttttcacgccctttccattccctcctgcaccactacacatcgaaaatgtcgaagaaaataaattctttccagattcctcagaattacccttgtacttgtcattgttgacatcccaaaatgatgaatttggaatggaacacatgattctacagagctcagattcagatcttactgaattgatatcgactccgacttcgatttcaaattcatcgtttggtggagaagggatggattatgaacatgaaatcacatttgacattgaagaattcttcatttaatttgaaatttagagcattccttgcaaagtttgtaatagcagcaagtatgttttatgcaataatttttgcttttttagcctaattgatcctaagctaaagtcaattgactgatgttttagagaaatagttgtagtaaaaattgtaacgtcgatgaattcatgtttgtaattacaagctttggctattgaaattcaagttgcatttcaattttt

SEQ ID NO: 7898 - DNA, 1503 bp, Solanum tuberosum
gataaacttacaaaacaacgtatatacagacaaaatcacataatacgccctcgccggaatcttattttcactgtcaccggccgttataactttttttttccagttcggaggtcaaataattaaactccgatctgaagaagtagttattctaactgcttctatttaatctgaaaacgggaaaaacccctgaactgggtaaggtggatttcgtgatgggattttgtatttgtcctttggaaactcctgctagattactgtggagtactagtttcttccgccacaagcttatgctcttctaaaactttgtcaactctctttttcatacacatcccctgctaaaaaaagaactctgttctggagtttattttctcttttctgtttcgccggaaacatataaataatcttctgtgggtaaataggcgatcttccagatcattgaaaatatgggatctgggcatatatttttcgacccgtcgtcgtgtcacggcaacatgctgttccttggcaacggagatcctgttttccgaggaccaagatcgacgatgatgaagatggaggactcctcgaagaggcgacccttctttagctcaccggaggatctatatgacgaggaatactacgatgagcagtcaccggagaagaagcgccgtctcactcctgagcaggtgcacttgttggagaagagctttgagacagagaacaagctggagcccgaacgcaagacccagctggccaaaaagctggggctgcagcccaggcaggtggctgtatggttccaaaaccgccgtgccaggtggaagaccaagcagctcgagagggattatgatcagctcaaatcctcttatgactctcttctctctgattttgactccattcgcaaagataacgataagctcaaatctgaggttgtttcattgatggaaaagttgcaggggaaagtggttggaggagcaggggtaagtgaaaaatctgatgtcttggaggtagatgctatgacagcgacccttcaagtgaaggtgaaggctgaggaccggttgagcagtggcagtggtgggagcgcggtggtagatgagcatagtccacagctggtggacagtggggactcatattttcacactgatcatgaggagtatccagggcctggaggatgcaatgttcctccacccatggatggtttacaatcagaggaagatgatggtagtgatgatggcagttgccatggctacttctctaacgtctttgtgacagaggagcagcaccatgaagaaggagaagagcctattggatggttctggtcttaattgaattttagaatattgtattacagttttttttatctacgcgcgcgctttgtatgatgaaataagtgttgtaattcgaacttccaatttaaacatctataaatatgcttttgcatcttttattctcttgatttatttctgattcttgatgtttcttcatatatttcacatctagtatttaaataaactacatgttccaatt

SEQ ID NO: 7899 - DNA, 1525 bp, Solanum phureja
cctctgtcaactttagtcgcaaaataaacttacaaaacaacgtatatacagacaaaatcacataatacgccctcgccggaatcttattttcactgtcaccggccgttataactttttttttccagttcggaggtcaaataattaaactccgatctgaagaagtagttattctaactgcttctatttaatctgaaaacgggaaaaacccctgagctgggtaaggtggatttcgtgatgggattttgtatttgtcctttggaaactcctgctagattactgtggagtactagtttcttccgccacaagcttatgctcttctaaaactttgtcaactctctttttcatacacatcccctgctaaaaaaagaactctgttctggagtttattttctcttttctgtttcgccggaaacatataaataatcttctgtgggtaaataggcgatcttccagatcattgaaaatatgggatctgggcatatatttttcgacccgtcgtcgtgtcacggcaacatgctgttccttggcaacggagatcctgttttccgaggaccaagatcgacgatgatgaagatggaggactcctcgaagaggcgacccttctttagctcaccggaggatctatatgacgaggattactacgatgagcagtcaccggagaagaagcgccgtctcactcctgagcaggtgcacttgttggagaagagctttgagacagagaacaagctggagcccgaacgcaagacccagctggccaaaaagctggggctgcagcccaggcaggtggctgtatggttccaaaaccgccgtgccaggtggaagaccaagcagctcgagagggattatgatcagctcaaatcctcttatgactctcttctctctgattttgactccattcgcaaagataacgataagctcaaatctgaggttgtttcattaatggaaaagttgcaggggaaagtggttggaggagcaggggtaagtgaaaaatctgatgtcttggaggtagatgctatgacagcgacccttcaagtgaaggtgaaggctgaggaccggttgagcagtggcagtggtgggagcgctgtggtagatgagcatagtccacagctggtggacagtggggactcatattttcacactgatcatgaggagtatccagggcctggaggatgcaatgttcctccacacatggatggtttacaatcagaggaagatgatggtagtgatgatggcagttgccatggctacttctctaacgtctttgtgacagaggtgcagcaccatgaagaaggagaagagcctattggatggttctggtcttaattgaattttagaataatgtattgcagtttttcttatctacgcgcgcgctttgtatgatgaaataagtgttgtaattcgaacttccaatttaaacatctataaatatgcttttgcatcttgtattctcttgatttatttctgattcttgatgtttcttcatatatttcacatctagtatttaaataaactacatgttctaatt

SEQ ID NO: 7900 - DNA, 1447 bp, Nicotiana benthamiana
agtcgcaaaataaacttataataatttcatacagacaaaacaacacgtagcgtagattaatttcctcatcagccgtcgccggaatctcgttttcacggtgaccggccatcaaccttgtattgattttccctttttctttttctttcagctcggaggtcatctaattatcctccgatctgaagtagttatacatatagctgcttcttcttattctgagaacaacagaaccccttagctgggtaaagtggagttcgtgatgggattttgtatctgtcctttggaaactcctgctagattgctgtggagtactagtttcttccgccacaagctcatgctcttttgaaacttggtcaactctcttttccaatatatatacatatccctgctaaaattaaagaaactctgctctagagtttttcttttctgtgtgtaaatataatttctacggcgatcatccagatcattgaaaatatgggatctgggcatatatttttcgacccttcttgtcacggcaacatgttgttccttgggaattcagatcctgttttccgaggaccaagatcgatgatgaagatggaggactcctcaaagaggcgacctttctttagctcgccggaggagctatatgacgaggaatattacgacgagcagtcgccggagaagaaacgccgtctcactcccgagcaggtgcacttgctggagaagagctttgagacggagaacaagctgggagccagagcgtaagactcagctagccaagaagcttggcctgcagcccaggcaggtggccgtgtggttccaaaaccgccgtgcccggtggaagactaagacgctcgaaagggattatgatcagctcaaatcctcttatgactctcttctctctgattttgactccatgcgcaaagataatgagaagctcaaagctgaggtggtttcattgatggagaagttgcagggtaaagtggttggtggagcagggataacaaatgaaaaatgtgaggttttggaggtagatgcgctgacccttcaagtgaaggtgaaggcggaggacaggctgagcagcggcagcggcggaagtgcggtggtagatgaacacagtccacagctggtggacagtggggactcctattttcacactggtcatattgaagaatatccaataggggctggaggatgtattaatattcctccacctatggatagtttgcagtcagaggaggatgatggtagtgatgatggcggcggccatggctacttctctaatgtctttgtggcggcagaggagcagcagcatgaagaaggagagcctattggatggttctggtcttaaataattaaagggattttagaatgtcttatttacagtatttcttatttgcgcttgtacgatgaataagtggtttaattcgtacgtgtaattcaaacatctattactatatgcttttgc

SEQ ID NO: 7901 - DNA, 1533 bp, Capsicum annuum
attataaaaacaaaaccgcataatattcccttaccggaatctcatttcaccatcaccggccgtttaaactttcacttattgattttccttttttttttttttttcagcttggaggtcatataattaacctccgatctgaagaagtagttaattttaactgcttctaatttttcaaagaaagaaagaactcctgctgaatttcgtgatgggattttgtatttgtcctttggaaactccagctagattgctgtggagtactagtttctttcgccataagcttatgcttttctaaaacttagtcaactctctttttcatacacattcctaataaaaaagaaaagaactctgttgtggagttttttttttagcttttctgtttcgccggacacatactaataataatattcggtgtgtaaatataatttctacggcgatcttttccagatcaatattattggaagtatgggatctggtcatatatttttcgacccgtcgtcatgtcacggcaacatgttgttccttggcaacggagatcctcttttccgaggaccaagatcgtcgatgctgaagatggaggactcctcgaagaggcgacccttctttagctcgccggaggaactatatgacgaggaatattacgatgagcagtcgccggagaagaagcgccgtctcagtcctgagcaggtgcacttgttggagaagagctttgaggcagagaacaagctggagcctgagcgcaagacccagctagcccagaagctggggctgcagcccaggcaggtggctgtatggttccaaaaccgccgtgccaggtggaagaccaagcagctcgagagggattatgatcagctcaaatcctcttatgactctcttctatctgattttgactccattcgcaaagacaacgatcagctcaagtctgagattgtttcattgatggagaagttgcaggggaaagtggttggaggatcggtggtaaatgaaaaatcggaggcattggaggtagatgccttgacgacccttcaagtgaaggtgaagactgaggaccggctaagcagtggcagtggtgggagcgcggtggtagatgagcatagtccacagctggtggacagtggggactcatattttcacagtactattgatcatgaggagtatccagggcctggaggatgcaatattcctccacctgtggatggtttacagtcagaagaagatgatggtagtgatgatggcagctgccatggctacttctctaacgccttcgtggcatcagaggagcaccaccatgaagaaggagaagagcctcttggatggttctggtcttaattgagttttagaatattgtatttcagttttttcgtatctacgcgctctttgtatgatgaaataagtgttgtaagtcctacttataattcaaacgtctattaatatgcttttgtatcttttattctcttgatttaattctggttcgtgatgtttcttcatatatttcacatctagtacttaaacaacgttccaacgtgcttcatgctt

SEQ ID NO: 7902 - DNA, 976 bp, Nicotiana tabacum
  misc_feature (248)..(248): n is a, c, g, or t
  misc_feature (250)..(250): n is a, c, g, or t
  misc_feature (318)..(318): n is a, c, g, or t
  misc_feature (345)..(345): n is a, c, g, or t
gaaaatatgggatctgggcatatatttttcgaaccgtcttgtcacggcaacatgttgttccttgggaattcagatcctgttttccgaggaccaagatcgatgatgaagatggaggactcctcaaagaggcgacctttctttagctcgccggaggaactatatgacgaggaatattacgacgagcagtcgccggagaagaagcgccgtctcactcccgagcaggtgcacttgctggagaagagctttgngncggagaacaagctggagccagagcgtaagactcagctagccaagaagcttggcctgcagcccaggcangtggctgtgtggttccaaaaccgccgngcccggtggaagaccaagacgctcgaaagggattatgatcagctcaaatcctcttatgactctcttctctctgattttgactccattcgcaaagataatgagaagctcaaagctgaggtggtttcattgatggagaagttgcaggggaaagtggttggtgaagcaggggtaataaatgaaaaatgtgaggttttggaggtagatgcgctgacccttcaagtgaaggtgaaggcggaggacaggctgagcagtggcagcggcggaagtgcggtggtagatgagcacagtccacagctggtggacagtggggactcctattttcacactggtcatatggaagagtatccactaggggctggaggatgtaataatattcctccgcctatggatggtttgcagtcggaggaagatgatggtagtgatgacggcggcggccatggctacttctgtaacgtctttgtggcggcagaggagcagcaacatgaagaaggagagcctattgggtggttctggtcttgaataattaaagggattttagaatgtattattactgtttttcttatctacccgcgcttttgtatgatgaataagtggtgtaattcgaacgtataattcaaacctctattatatg

SEQ ID NO: 7903 - DNA, 1435 bp, Nicotiana benthamiana
agtcgcaaaataaactcacaacaccacaaacagacaaaacaacaccctcatcagccctcgcagggatctcgttttcacggtgaccggccgttcaaccttcttctactgaattgtttcagctctgaggtcttataattaacctccgatctgaagaagtagttatatatatagctgcttcttttttattctgagaacgaaagaatccctgaactgggtaaagtggagttcgtgatgggattttgtatctgtcctttggaaactcctgctagattgctgtggagtactagtttcttccgccacaagctcatgctcttttgaaacttagtcaactctcttttttttatacacatccctgctaaaattaaagaaactctgctctagagtttttcttttctgtgtgtaaatatattttctacggcgatcatccagatcattaaaaatatgggatctgggcatatatttttcgacccgtcttgtcacggcaacatgttgttccttgggaattcagatcctgttttccgaggatcttcgatgatgaagatggagaactcctcaaagaagcgacctttctttagctcgccggaggaactatatgacgaggaatattacgacgagcagtcgccggagaagaaacgccgtctcactcccgagcaggtgcacttgctggagaagagctttgagacggagaacaagctggagccagagcgtaagactcagctagccaagaagcttggcctgcagcccaggcaggtggctgtgtggttccaaaaccgccgtgcccggtggaagaccaagacgcttgaaagagattatgatcagctcaaatcctcttatgactctcttctctctgattttgactccatgcgcaaagataatgagaagctcaaagctgaggtggtttcattgatggagaagttgcaggggaaagtggttggtgaaggaggggtaacaagtgaaaaatgtgaggttttggaggtagacgctatgacccttcaagtgaaggtgaaggcggaggacaggctgagcagtggcagcggcggaagcgcggtggtagatgaacacagtccacagctggtggacagtggggactcctattttcacactggtcatattgaagagtatccaataggggctggaggatgcaataatattcctccacctatggatggtttgcagtcagaggaggatgatggtagtgatgatggcggcggccgtggctacttctctaatgtctttgtggcggcagaggagcagcaacatgaagaaggagagcctattggatggttctggtcttaaataattaaagggattttagaatgtattattactttttttcttatctaccagcgcttttgtacgatgaataagtgttgtaattcgaacgtataattcaaacatctattatatgtatgcttttgcatcttttattctcttg

SEQ ID NO: 7904 - DNA, 1312 bp, Petunia hybrida
gcgggaggcgcaaaataatttttctaacataacatacatacaaaacacactagttctagccggaatcttgattttacggtcaccggccgtgcattatttttctgtcagctcggaggtcatataattaacctccgatctgatatagctacgttttctttatatatactgagaacgaattatacacccgagctgggtaaattggataacgtgatgggattttgtatttgtcctttggaaactccagctagattactgtggagtacgagtttctttcgccacaagctcatgctcttttgataccttagtcaacttcctttttactctacaacatacaaaaacaaagctcttgtttagagttttttttttctgtttccctcgaaattacgtatacacataaatatataaacttctgtgtatctacggtgattttgcaaatcattgaaagaatggaatctggacgtattttctttgatccatcatgcaacggcaacatgttgtttcttggtcatggagattctattttccgaggagcaagatcgatgatgaagatggaggactcctcaaagaggcgacccttctttacctcgccggaggatttatatgacgaggaatattacgacgagcagtcgccggagaagaaacgccgtctcactcctgaacaggtgcacctattggagaagagttttgagacggagaacaagctggagccagatcgcaagagtcagctagccaagaaactaggcctgcagccaaggcaggtggctgtgtggttccaaaaccgccgtgcacggtggaagactaaacagcttgaaagggattatgatcatctcaaatcctcttatgactctcttctctctgattttgactccattaccaaagacaatgacaagctcaaagctgaggtagcttcattgttggagaagttgcaggggaaagtggttggatcaggagcagggacaagtgaaaaatctgagggtttggaggtagatgctgcaatgacccttcaagtgaaggctgaggacaggctgagcagtggcagcggtggtagcgcggtggttgatgagcatagtccacagctagtggacagtggggactcatatattcacactggtcatgaagagtatgcaggggttggaggatacaatattcctccaccagtggatggtttaaattcggaggaagacgatggtagtgatgatggtagttgtcatggctacttctctaatgtctttgtggctgcagaggaacatcatcatcatgaagaagaaggagagcctcttggttggttctggtcttaaaattaagttagact

SEQ ID NO: 7905 - DNA, 1965 bp, Solanum phureja
atcttgtttggaacacagtcaagtttctgctttcttgttttcatcgacatcaaccttttccttcttcaaatctaccgcacacccacttcgtcattcattctcatttctctgtcagagtagcaattgttcttggcaggaagacaggaattggattacattgatcaggaaatggattctgcagccatgactagtgtttgtggcaaatctgctctttgctctactcccggtttatttttggggagaacgagcggtattaggagctcgcagtgtagctttatagctggaaataggataaactttccaaggcagacagctcaagcacacagagttcgtactaattctcgcaagggtcatggtgctcttactgtgacatgtcgcgccgagaaaattctggtggcaaatagaggagagattgctgtccgcgtgatccgaactgcccatgagatgggaattccttgtgttgcggtttattcgaccattgataaagatgccttacatgtgaagctagctgatgaatctgtttgcattggagaagcaccaagtaatcagtcgtatttagtgatcccaaatgtcttgtctgctgctatcagtcgcggatgtacaatgttgcatcctggatatggtttcctttctgagaatgcaagttttgttgagatgtgcagagaacatggaatcaactttattgggccaaatccagacagtataagagtcatgggtgacaaagccactgctagagatacaatgaagaatgctggtgttccaactgtaccaggaagtgacggactattgcagagcactgaagaaggtgtaaggctcgctgaggagattggttacccagtgatgattaaggcaacagctggtggtggtggacgtggaatgcgtcttgctaaagagcctagtgagttcgtaaaattattgcagcaagctaagagtgaagcagcagctgcatttggaaatgatggcgtttatctggagaagtacatcgtaaatcctaggcacattgaatttcaggttttggcggacaagtatggtaatgttgtacactttggagagcgtgattgcagtattcagagaagaaaccagaagttgctggaggaagcaccgtcccctgcattgacatcagatctgaggaaagccatgggtgatgcagctgttgcagcagcagcatccataggatacattggtgttggtaccatagagttcctattggatgagagagggtccttttacttcatggaaatgaacactcgtattcaggtagagcatccagtgacagaaatgatatcctctgttgatctgatagaggaacagatccgtgtcgctatgggagaaaagctccgatacaaacaggaggatattgtgcttagaggacactcaattgaatgccgtataaacgcagaagatgctttcaaaaacttcagacccggcccagggagaatcacttcatatttaccagctggaggtccatttacgcgtatggatagccatgtttatcctgactatgtggttccacctagctacgattccctgctaggaaagctcattgtatgggctccaacacgtgagagggctattgagcgcatgaaaagagcacttaatgacaccattatcactggagttcctaccacaatagaatatcataaactcatccttgatatcgaggactttaagaatgggaacgttgatactgctttcattccaaagcatgaggaagaattagctccgcctcagcaaattgttccagcagcaaccaaggagctgatcaatgccaatgcttaattattcttctatttagttttagttttcttctttgattttcttgcttcatcagtgaatatagtgaaagaacattactcccattggatcttgaagttaatgcagttttggatacaactttcatctcctttatctttagcttgttgtatttaaagatacgcaagactgaatgaaattattctcttttta

SEQ ID NO: 7906 - DNA, 1802 bp, Capsicum annuum
ggcacgaggaaagacagccaacaagttcttgacaggaagacaggaattggattacactgatcaggaaatggattctgcagccatgactagcgtttgtggaaaatctgctctttgctctactcctggtttatttttggggagaacgactggtattaggagctcgcagtgtagctttatggccggaaataggataaactttccaaggcagagagctcaagcatatagagttagtactaaatctagcaaacgtggtggtgctcttactacaacatgtcgtgccgagaagattctagtggcaaatagaggagagattgctgttcgtgtgattcgaactgcccatgagatgggaattccttgtgttgcggtttattcaaccatagacaaagatgccttacatgtgaagctagctgatgaatctgtttgcattggagaagcacctagcaatcaatcgtatttagtgatcccaaatgtcttgtcggctgctatcagtcgcggatgtacaatgttgcatcctggatatggttttctttccgagaatgcagtttttgttgagatgtgcagagaacatggaatcaattttattgggccgaatcctgacagtataagagtcatgggtgataaatccactgccagagatacaatgaagaatgctggtgttccaactgtgcccggaagtgacggactattacagagcactgaagaaggtgtgagactcgccgaggagattggttatccagtgatgattaaggcaacagctggtggcggtgggcggggaatgcgtcttgctaaagaacctggggagtttgtaaaattattacagcaagctaagagtgaagcagcagcggcattcggaaatgatggcgtttatctggagaagtacatcataaatccaaggcacattgaatttcaggttttggcagacaagtatggtaatgttgtacactttggagagcgtgattgcagtattcagagaagaaaccagaagttgttggaagaagcaccctctccggcattgacgccagagctgaggaaagccatgggtgatgcagccgttgctgcagcagcatccataggttacgttggtgttggtaccatagagttcctattggacgagagagggtccttttacttcatggaaatgaacactcgtattcaggtagagcatccagtgacagaaatgatatcatctgttgatttgatcgaggaacaaatccgcgtggctatgggagaaaagctccaatacaagcaggaggatattgtgcttagaggacattcaatcgaatgtcgtataaacgcagaggatgctttcaaaaatttcagacctggtccagggagaatcacttcatatttaccagctggaggtccatttacgcgtatggatagccacgtttaccctgactatgtggttccacctagctacgattccctgctaggaaagctcattgtatggggtcccacacgcgagaaggctattgagcgcatgaaaagagcactaagtgacaccattattactggagttcctaccacaatagaatatcataaactcatccttgatatcgaggactttaagaacgggaaagttgatactgcttttattcctaagcacgaggatgaattagctccgcctcagcaaattgttccagcagcaaccaaggagctgatcaatgccaatgcttaattattctttggtcttttgcttcttcagagaatgtgtagttttggactcttcaagattgtatttaaagatacattagactgaattaaatttctctctcaaaattgccttattatgtactctcctc

SEQ ID NO: 7907 - DNA, 1882 bp, Nicotiana tabacum
ctagctccgccctctctctttctctctgtcaaagtaaatagttcttggcaggaatacaggaattagattacattgatcaggaaaatggactcggcagccctgactagcgtttgtggcaaatctgctcttcgcttcactccgggtttatttctggggagaacgaatggtattaggagctcgcagtgtagctttatggcaggaaaccggataaactttccgcggcagagagctcaagcatatagagttagtactaaatctagcacacgtggtggtgctcttgctgcaacatgtcgcgccgagaagattctggtggcaaatcgaggagaaattgctgttcgtgtgattcgaactgcccatgagatgggaattccttgtgttgctgtttattcgaccatagacaaagatgccttacatgtgaagctagctgatgaatctgtttgcattggtgaagcaccaagcaatcaatcgtatttagtgatcccaaatgtcttatctgctgctatcagtcgtggatgtacaatgttgcatcctggatatggtttccttgctgagaatgcagtttttgttgagatgtgcagagaacatggaatcaactttattgggccaaatccagacagtattagagtcatgggtgacaaatccactgccagagatacaatgaagaatgctggtgttccaactgtgccaggaagtgatggactattacagagcactgaagaaggtgtaaggcttgctgaggagattggttaccctgtgatgattaaggcaacagctggtggtggtggacgtggaatgcgtcttgctaaagaacctgatgagtttgtaaaattattacagcaagctaaaagtgaagcagctgctgcatttggaaatgatggcgtttatctggagaagtacgtccaaaatcctaggcacattgaatttcaggttttggcggacaagtatggtaatgttgtacactttggagagcgtgattgcagtattcagagaaggaaccagaagttgctggaggaagcaccttcccctgcattaacaccagagctaaggaacgccatgggtgacgcagctgttgcggcagcagcatccataggttacattggtgttggtaccgtggagttcctattggatgagagagggtccttttacttcatggaaatgaacactcgtattcaggtagagcatccagtgacagaaatgatatcctctgttgatctgatagaggaacagatccgtgtggctatgggagaaaagctccgatacaaacaggaggatattgtgcttagaggacattcaattgaatgccgtataaatgcagaagatgctttcaaaaatttcagacccggaccagggagaatcactgcctatttaccagctggaggtccatttgtgcgtatggatagccacgtttatcctgactatgtggttccacctagctacgattccctgctaggaaagctcatcgtatgggctccaacacgcgagagggctattgaacgcatgaaaagagcacttaatgacaccataattactggagttcctaccacaatagaatatcataagctcatcctcgatattgaggactttaagaatggaaagtttgatactgcttttattccaaagcatgaagaagaattagctccgccccagcaaatggttccagcagctaccaaggagatggtcaatgctagtgcttaattcttcctcttttttttttgttttttttctttgatatttttcctttaccatagtcagcgaatagtgaaagcagattgcttccattagatcttgaggtgactgtagttctggatataatattcatctctttgatcttagcttgaatgtatttttagataccctagactgaatgaaattctttttttgg

SEQ ID NO: 7908 - DNA, 2035 bp, Amsonia hubrichtii
ggagtattcaatcttttcacaaaacatagtcacttcagagagcctcgttttcatcgacacccaccttcttcccttccttcaaatcttccccaactccccctattctcttctgcttttctctctctttctctagcatttgatcaaatcctcaaacccacattgtaaagttgctgcatagagcctttcaattgggttgatcaaagatggatgctgcagctatgacctctgtttgcagtaaatcactctactcgactcctggtttattcatggggacaacaagagggattaagagctcgcagtgtagctttatggtgggaaataaggtgcagttcccccgacagcaggcaaaagcatcccgtgttagtcgtaagtctggcaatcgtgggggagctcttgctgcgacatgtcgtgatgaaaagattctcattgcaaacagaggagagattgcagttcgtgttattagaacagctcatgaaatgggaattccttgtgttgctgtttactcaacaatagataaggatgcacttcatgtgaaacttgcagatgaatcagtttgcattggtgaagcaccaagtagtcaatcgtacttggtgatcccaaatgtcttatctgctgctgttagccggggatgtacaatgcttcatccaggatacggtttccttgctgagaatgcagtttttgttgagatgtgcagagagcacgggatcaactttatcggaccaaaccctgacagtattagagtcatgggtgacaaatcaacagccagagatacaatgaagaatgctggtgttccaactgttccaggaagcgatggattgctacagagtactgaagaaggagtaaggctggctgaagagattggttaccctgtcatgatcaaggcaacagctggtggtgggggacgtggaatgcgtcttgctaaagagcctgaagaatttgtgaagttgttacagcaagctaaaagtgaggctgctgctgcatttggaaatgatggtgtttatctggagaaatacatccagaaccccaggcatattgagtttcaggttctggcggacaagtatggaaatgttgtacacttcggagagcgtgattgcagtattcagaggagaaaccagaaattgctggaagaagcaccctctcctgcattaacaccggagttgcggaaggccatgggtgatgcagcagttgcagcagcagcatctataggttacataggtgttggtactgtagaatttcttttggatgaaaggggttccttttactttatggagatgaatacccgtattcaggtagagcatccagttaccgaaatgatttcctctgttgacctgattgaagaacaaatacgtgtggctatgggagagaaactccgatacaagcaggaagatattgtgctgagaggacattcaattgaatgccgtattaatgcagaagatgctttcaaaaacttccgacctggaccagggagaataactgcatatttgccagctggaggtccattcgtaagaatggatagtcatgtttatcccgactatgtggttccaccaagctatgattctctgcttgggaagcttatcgtatgggctccaacaagagaacgggcaatcgaacgcatgaaaagggctcttaatgacaccatcattacaggggtaccaacaacaatagactaccacaaacttatcctggatgtcgaggatttcaaaaatggaaaagttgatactgcttttattcccaagcatgaaaaggaattagctgctccccaaccaattgtacctgctacaacagagaaagagttggccaaagctgctgcctaagttggtttctcatcagccagagtgcgagctagattccttggggttcatttcattcaagcacccgtattcattcttttgcccccttcatacttcttacatgtagtggaattgattatgactgaattaggaacatttttgcttttggcttccagatgtaataaataatgttcaattggcctgttttgtattacaaaataccaattttctgtttggttcttgga

SEQ ID NO: 7909 - DNA, 2062 bp, Sesamum indicum
tttcaatctgctcaaagtctcaaactccctcgttttcatcgaccctcctctcttcaaatcttctctacccactctctacctctctatttctccctgttctatctctttctcgctagcaataaggctaatccccgatcaagattacttttttagagacatttctgaggaggatttcttgatctgaagatggactctgccaccatgaacttttgcagcaaatctgtctgctcgcctcctggtttattcatggggaggacaacaggaatcaggagctcccagtgcagctttatggcaggaagtagagttaacttcccccgacagcgagtccaggcttctcgagttggtcataaatctggcaaacgtgggggagctcttgctgctacatgccgcgacgataaaattctggttgctaacagaggagagattgctgttcgtgtgattcggactgcccatgagatggggatcccttgtgttgcagtttactcgacaatagataaagatgctcttcatgtaaagctggctgatgaatccgtttgcattggggaagcaccaagcaatcaatcttatttggtgatcccaaatgtcttatctgctgccatcagccgtggatgtaccatgctgcatcctggatatggtttcctttctgagaatgctgtttttgttgagatgtgcagagaacacggaatcaactttattggaccaaatcctgagagcatcaggatcatgggtgacaagtcaactgctagggatacaatgaagaatgctggagttccgactgttcctggaagtgatggattgttaaagagtactgaagaagcagtgagacttgcggatgagattggttatcctgtcatgatcaaggcaacagctggtggaggaggacgtggaatgcgccttgctaaagaacctgatgagtttgtgaagttgttgcagcaagctaaaactgaggctgcagctgcatttggtaatgatggagtttacctagagaagtttatccagaatccaaggcatattgaatttcaggttttggctgacaaatatggtaatgttgtgcactttggggaacgtgattgtagtattcagaggagaaaccagaagttgctagaagaagcaccttctcccgcattaacaccagagttgcggaaagccatgggtgatgcagcagtagcagcggcagcatccataggttacataggtgttggtacaatcgaattccttttggatgaaagaggatcattttactttatggagatgaacactaggatccaggtggagcatccagttacagaaatgatatcatcggttgacctaattgaggaacagattcgtgtggctaggggagagaaacttcgctacacacaggaagatattgtactgagaggtcattcaattgaatgccgtatcaatgcagaagatgctttcaaaaacttcagacctggaccaggaaggataactgcgtacctgcctgctggaggtccatttgtgcgaatggatagccatgtttatccagattatgtggttccacctagctacgattccctgcttggaaagcttattgtctggggtccaaccagagaaagggcaatcgaacgcatgaagagggctcttaatgataccatcatcactggggttcctacaacaattgattaccataagcttattcttgatattgaggacttcaaaaatggaaaggtggatacagcttttattccaaaacacgaagaagagctcgcagcgcctcaaccaactcaacccgcaaccacacagaaacagctgattagcacttcagcttgagatactctcaacggcgtccctggaagcaaagctctctctttgatttctccaattcggtatcgtctccccaactacatattgtctttgtcagtcaactactaacatttttggtcacatgtattcacatgtacgaatggacgccataatttattttttcctcaattttatcatatcaaacgagcgtcgaatgtaagtgatggattcaaccaactgtttgttcagtctttcttggtataaaagttcatcatcagcagttcataaatggcgg

SEQ ID NO: 7910 - DNA, 1694 bp, Vinca minor
gtttcttagagaatttgaattgggttgatcaaagatggatgctgcaactatgacctctgcttgcagtaaacccctctgctccactcctggtttattcatgggatcaacaagagggattaggagctcgcagtgtagctttatagcaggaagtaaggtgcagttccctcgacagcatgcaaaagcatcccgagttggtactaaatctggcaaacgaggaggagctcttgctgctacatgtcgtagtgaaaaaatcctcatcgctaacaggggagagattgcagtccgtgtgattagaactgctcatgaaatgggaattccttgtattgctgtgtattcaacaattgacaaggatgcacttcatgtgaaacttgcagatgaatcggtttgcattggcgaagcaccaagtaatcagtcgtacttagtgatcccaaatgttttatctgctgctgttagtcgtggatgtacaatgcttcatcctgggtatggttttcttgctgagaatgcagtttttgttgagatgtgcagagagcatggaatcaactttattggaccaaaccctggcagtattagagtgatgggtgacaaatcaacagccagagatacaatgaagaatgcgggtgttccgactgttccaggaagcgatggattgctacagagtactgaagaagcagtaaggctggctgaagggattggttatcctgtaatgatcaaggcaacagctggtgggtcggggacgtcggatgcgccttgctaaagagcctgaagaattcgtaaagttgttacagcaagctaagagtgaggctgccgcagcatttggaaatgatggtgtttatctggagaaatacatccagaatcccaggcatattgagttccaggttctggcagataagtatggaaatgttgtacactttggagagcgtgattgcagtattcagagaaggaaccagaaattgctggaagaagcaccatctcctgccttaacaccagagttgcggaaggccatgggtgatgcagcagttgcagcagcagcatctataggttacataggtgttggtactgtagaattccttttggatgaaagaggatccttctactttatggagatgaatacccgtattcaggtagagcatccagtcactgaaatgatttcctctgttgatctgatcgaagaacaaattcgtgtggctatgggagagaaactccgatacaagcaggaagatattgtgcttagaggacattcaattgaatgccgtatcaatgcagaagatgctttcaaaaacttccgacctgggccagggagaataactgcatacttgccagctggaggtccatttgtaagaatggatagccatgtttatcctgattatgttgttccaccaagctatgattctctgcttggcaaacttattgtatgggctccaacaagagagcgggcaatcgaacgcatgaaaagggctcttaatgacaccattattacaggggttccaacgacaatagactaccacaaactcatcttggatgttgaggatttcaaagatggaaaagtagatactgcttttattcccaagcatgagaaggaattagccgctccgcaggcaattgttccggttacaaaggaggcagagttggctaaggctgctgcctaatctggccctatccattcttttgctctttatacatgtagtgtaatttat

SEQ ID NO: 7911 - DNA, 1998 bp, Theobroma cacao
ctcgtttccatcgacatcttcctccatatctttctacgtctccattcccacaactgtcactctctctctttttctctctacattgtctaattcttgttcacatcaagcttggcattttttgcaatggcaatggatgcttcaatgacgatgtgcaaatctgttaactcacctcctggcttattcttggggagaagtagaggtattaggagttcccagtgtagctttatggtgggaagcaggatcaactttcctaggcagaaagctcaggcaacccaagttagatgtaaatctaataagcttggaggagctcttggtgctacatgccgtgctgagaaaattctggtggcaaatagaggagaaatagctgttcgtgtaatccgtacagctcatgagatgggaataccctgtgttgctgtctactcaacaatagataaggatgcactccatgtgaagttggctgatgaatcagtttgcataggcgaagcaccaagtagtcagtcgtatttattgattccaaatgtcttatctgctgcaattagccgtaactgtaccatgcttcatcctggatatggtttccttgctgagaatgcagtgtttgtagaaatgtgcagagaccaccgaatcaactttattgggcctaatcctgacagtatccgtgttatgggtgacaaatcgactgctcgagaaacaatgaagaatgcaggtgttcctactgttccaggaagtgatggattgttacagagtacagaggaagcaatcaagcttgcccatgagattggctttcctgtgatgatcaaggccacagctggtggtggagggcgtggaatgcgtcttgctaaagagcctgatgagtttgtgaagttactgcagcaagccaaaagtgaagctgcagctgcattcgggaatgatggagtttatttggagaagtacattcaaaatccaaggcatattgagttccaggttctcgcggataaatatggtaatgttgttcactttggtgagcgcgactgcagcatccagagacgtaatcaaaaacttctagaagaggctccttctccagcattgacaccagagctgcggaaggcaatgggtgatgcagcagttgctgcagcagcatctattgggtacattggtgtaggaactgttgaattccttttggatgaaagaggttccttctacttcatggaaatgaacactagaatccaggtcgagcatcctgtaactgaaatgatttcctctgctgacttgattgaagaacaaattcgtgtagctatgggagaaaaacttcactacaaacaggaagatatcgtgctcagagggcattcaattgaatgtcgtatcaatgctgaagatgcatttaaagggttcagacctggaccaggaagaataacatcatacttgccatctggaggcccatttgtgagaatggatagccatgtttattctgattatgtagttcctccgagctatgattcactactcggaaagcttattgtatgggctcctacaagggaaaaagcaattgagcgcatgaaaagggctcttgatgacactgtaattacaggggttcctacaaccattgaataccataaactcatccttgatattgaggacttcagaaatggaaaggttgacactgctttcattcctaaacatgaagaagagttagcagcgccccagaaaatggtactagcaaccccgaccaaagaattgactagtgcaaccgcttagaagggttagtattctgcacatttttttatttggtttaagccgtcgagctgtcaacttggcattcattcaacggcctttttttcgttgaacagactgcatttagtttgaacttctgtaatgttgctattgctagtgcgttccatatgagaacttgtatgaaattttgacaatcatcagggtttctttcattccacagtcgaattgaattgtttgcttaatgatgtagaattttggtatgcttattgccctcaaactcttagaaatggc

SEQ ID NO: 7912 - DNA, 2120 bp, Mimulus guttatus
tctctacagtaacacactcccaaacccaactcactcaaaactgacaaacaactctccctcgttttcatcgacaccccccttcttcaaatcttcccccacccactctctctctcctctctctacattctctctctctcccctctatctctccgcagaagaacctcatcgatcaggatttcaattcaacactcattttcgaggtgggtttaattgatctgaaaatggactccgctaccatgacttttcgcagcaactctattcgctcaactcctggtttattcatggggagaacatctggaattaggagctcccagtgcagcttcattgcaggaaatagagttaacttcccccgacaaagggttcaggcttctcgagttggtcgcaaatctggcaagcatgggggagctcttactgttacatgtcgtgatgataaaattctggtggctaacagaggagagattgctgttcgtgtgattcgtactgcccatgagatggggatcccttgtgttgcggtttactcaacaatagataaagatgcgctccatgttaaactcgctgatgaatctgtctgcattggagaagcaccaagcagtcaatcttacttggtgattccgaatgtcttatctgctgccatcagccgtgggtgtactatgctgcatcctggatatggtttcctttctgagaatgctgtttttgttgagatgtgcagagagcatggaatcaactttattggaccaaatcctgacagcattagagtcatgggtgacaaatctactgctagggatacaatgaagaatgctggagttccaactgtccctggaagtgatggattgctacagagtaacgaagaaggaattaggcttgcgaatgagattggttaccctgtcatgatcaaggccaccgccggtggaggaggacgtggaatgcgccttgctaaagaacctgatgagtttgtaaagttgttgcagcaagctaagagtgaggctgcagctgcatttggtaatgatggtgtttacctggagaagtatatccagaacccaaggcatattgaatttcaggttttggccgacaaatttgggaatgtcgtgcactttggagagcgtgattgtagtattcagagaagaaaccagaagttgctagaagaagcaccttctcctgcattaacaccggagttgcgaaaagccatgggtgatgcagcagtagcagcggcagcctccataggttacataggtgttggtacagtcgagtttcttttggatgaaagaggttccttttacttcatggagatgaacactaggatccaggtggagcatccagttacagaaatgatatcctcagttgacctaattgaggaacagattcgtgtggctagaggagagaaacttcgttacgcacaggaagatattgtgctcagtgggcattcgattgaatgccgtattaatgcagaagatgctttcaaaaacttcagacctggaccaggaagaataactgcttacttgccagctggaggtccatttgtgcgaatggatagccatgtttatccagattatgtagttccaccaagttatgattcactacttggaaagcttattgtctgggctccaactagagaaagagcaatccagcgcatgaagagggctcttaatgaaaccaccattacaggtgttccaacaacaattgaataccataaacttatccttgaaattgaggacttcaaaaacggaaaggtggatacagcttttatcccaaaacatgaacaagaacttgctgcgcccctgccaagtcaacccttgacatctcagatagaactggtcaacgcatcttcttgaggagcaaaagtaagctttctctttgagttctcaacctggataaatcggtttccaacaaagatagttacttattcgatagatgcgcgcttttttttttttttacatgtattcaaatgtatgaacggacgcggtattttaatttattttttccggtctttttattgtcataaattagcctcagttgtaagtgacggattcattcaacccatctgttttcgtgtttgtcgaatctttcttggtatcgaaaaatcatcattcaagtagttattttaactagtaattatttgacta

SEQ ID NO: 7913 - DNA, 2111 bp, Tabernaemontana elegans
tcttcacaaaacacacactcatttcagagagcctcgttttcatcgacacccacttattcacttccttcaaatcttccccaacctcccccattctctgctgctctctctcacactttctctctctgggcatttgatcaaatcctcaagcccacattgtaaaggatttgctgcatagagcattcaattgtgttgatcaaagatggatgctgcagctatgacttcggtttgcagtaaatccctctgctcgactcctggtttattcatgaggacaacaagagggattaggagctcgcagtgtagctttatggtaggaaaaaaggtgcagtaccctcaacagcatgcaaaagcatcccgggttagtcataaatctggcaaacgtgggggagctcttgctgctacatgtcgtgatgaaaaaattctcatcgcaaacagaggagagattgcagttcgtgttattagaacagctcatgaaatgggaattccttgcgttgctgtttactcaacaatcgataaggatgcacttcatgtgaaacttgctgatgaatcagtttgcattggtgaagcaccaagtagtcaatcgtacttagtgatcccaaatgtcctatctgctgccgttagccgcagatgtacaatgcttcatcctggatatggtttccttgctgaaaatgcagtttttgtcgagatgtgcagagagcatgggatcaattttattggaccaaaccctgacagtattagagtcatgggtgacaaatcaacagccagagaaacaatgaagaatgctggtgttcccacagttccgggaagcgatggattactgcagagtactgaagaagcaaaaaagttggctgaagagattggttaccctgtaatgatcaaggcaacagctggtggtgggggacgtggaatgcgacttgccaaagagcctgaggaatttgtaaagttgttacagcaagctaagagtgaggctgctgctgcatttggaaatgatggtgtttatctggagaaatacatccagaatcccaggcatattgagtttcaggttctggcggacaagtatggaaatgttgtacactttggagagcgtgattgcagtattcagagaagaaaccagaaattgctggaagaagcaccctctcctgcattaacacctgagttgcggaaggccatgggtgatgcagcagttgcagcagcagcatctataggttacatcggtgttggtactgtagaattccttttggatgaaaggggttccttttactttatggagatgaatactcgtattcaggtagagcatccagtgacagaaatgatttcctctgttgacctgattgaagaacaaattcgtgtggctatgggagagaaactccgatacaagcaggacgatattgtcctccaaggacattcaattgaatgccgtattaatgcagaagatgctttcaaaaacttccgacctggcccagggagggtaactgcatacttgccagctggaggtccattcgtaagaatggatagccatgtttatcccgactatgtggttccaccaagctatgattctctgcttggcaagcttattgtatgggctccaacaagagaacgggcaattgaacgcatgaaaagggctcttaatgacaccatcattactggggtaccaacaacaatagactaccacaaacttatcctggatattgaggatttcaaaaatggaaaagttgatactgcctttatccccaagcatgaaaaggaattagctgctccccagccaattgtaccggttacaactgataaagagttgaccaaagctgctgcctaagttggtttctcatcagccagacaacctatatttcctgggggttcatttcatctgagcatccgtattcattcttttgctctcgtcacagttcttacatgtcttgtaattgtttatgactgaattttaggaaaatttttgtgttcctctttgcacatgtaatgacataaatgagagttcaatcatcgcattttgtatttcaaaatactattttttgtttggttcttggaagaacttgagctagatgaggagaatgacttttaatctttccaagtgattgttagatcgttatgagagttgaatt

SEQ ID NO: 7914 - DNA, 1692 bp, Vinca minor
gggttgatcaaagatggatgctgcaactatgacaactgcttgtagtaaatccctctgttcgactcctcctggtttattcgtggggtcgacaagaggcattaggagctcgcagtgtagctttatggcaggagctaaggtgcagttcccgcgacagcaagcaaaagcatcccgagttagtcctaaatctggaaaacgtggaggagctcttgccgctacatgtcgtagtgaaaaaatcctcattgctaacagaggagagattgcagttcgtgttattagaacagctcatgaaatgggaattccttgcgttgctgtttactcgacaattgataaggacgcacttcatgtgaaacttgcagatgagtcggtttgcattggtgaagcaccaagtaatcagtcgtacttagttatcccaaatgtcttatctgctgctgttagtcgcggatgtacaatgcttcatcctggatatggtttccttgctgagaatgcagttttcgtcgagatgtgcagagagcatggaatcaactttattggaccaaaccctgacagtattagagtcatgggtgacaaatcaacagccagagatacaatgaagaatgctggtgttccgactgttccaggaagcgctggattgctacagagtactgaagaagcagtaaagctggctgaagagattggttatcctgttatgatcaaggcaactgctggtggtgggggacgtggaatgcgccttgctaatgagcctggagaattcgtaaagttgttacagcaagctaagagtgaggctgccgcagcatttggaaatgatggtgtctatctggagaaatacatccaaaatcccaggcatattgagttccaggttttggcagataagtacggaaatgttgtacactttggagagcgtgactgcagtattcagagaaggaaccaaaaattgctggaagaagcaccctctcctgcattaacaccagagttgcggaaggccatgggtgatgcagcagttgcagcagcagcatctataggttacataggtgttggtactgtagaattccttttggatgaaaggggatccttctactttatggagatgaatacccgtattcaggtagagcatccagtaacagaaatgatttcctctgttgatctgatcgaagaacaaattcgtgtggctatgggagagaaactccggtacaagcaggaagatattgtgctgagaggacattcaatcgaatgccgtatcaatgcagaagatgctttcaaaaacttccgacctggaccagggagaataacagcctacttgccggctggaggtccatttgtaagaatggatagccatgtgtatcctgattatgttgttccaccaagctatgattctctgcttggcaagcttattgtatgggctcccacaagagagcgggcaattcaacgcatgaaaagggctcttgatgacaccatcatcacaggggtaccaaccacgatagactaccacaaactcatcttggaagttgaggatttcaaaaatgggaaagtagatactgcttttattcccaagcacgagaaggaattagctgctccgcaggcgattgttccggttacaaaagagagagacttgactgaagttgctgctgcctaatttgatttctcatcagccagagcaagagccaaatttcctggggtttcatcaaagcaccaccc

SEQ ID NO: 7915 - DNA, 2507 bp, Gossypium raimondii
tgggcatgagtcgagctgtttttcctttttccggcccaatccaaatagagctaagtgggtgctgacaattgtgagatacaaacgtggaatgaaaacattggaggaatggacccaacagtagagatagaaccatagggaaaggtctatgactgctaatagatggagccgggcttatatgcctgatgagtgataaccccaaccatttaggcggagcattcaataaatcacttgcctcgtttccatcgacaacttctccatatctctctcttctctctatttccccatctccctgtctcactacattgctctgattcttgttcacgtcaagcttggcattttctgtttttctcaatggcaatggatgcttcactgactatgtgcaaatcggtcacatcacctcctggcttattcttggggagaagtagagttattaggagttcccagtgtacctttatggtgggaagcaggatcaactttcctaggcagaaagctcagtcaacccaagttaaatgtaaatctagcaggtgtggaggagctcttggtgctaaatgccgtgctgagaaaattttggtggcaaatagaggagaaattgctgttcgtgttatccgaacagctcatgagatgggaataccatgtgttgctgtttactctacaattgataaggatgcacttcatgtgaagctggctgatgaatcagtttgcataggcgaagcaccaagcagtcaatcgtatttattgattccaaatgtcctatctgctgcaattagccgtaactgtactatgcttcatcctgggtatggtttcctttctgagaatgcggtttttgtagaaatgtgcagagatcacaggatcaactttattgggcctaaccctgacagtattcgtgttatgggtgacaaatcaactgcacgagaaacaatgaagaacgcgggtgttcctactgttccgggaagtgatggattgttacagagtacagaggaagcaatcaagcttgcccatgagattggctttcctgtgatgatcaaggccacagcaggtggtggagggcgtggaatgcgtcttgctaaagagcctgatgagtttgtgaagttactgcagcaagccaaaagtgaagctgcagctgcatttggaaatgatggagtttatttggagaagtacatccaaaatccaaggcacattgagttccaggttcttgcggataaatatggtaatgttgttcactttggtgagcgagactgcagcatccagagacgtaatcaaaaacttcttgaagaggctccttctccagcattgacaccagagttgcggaaggccatgggtgatgcagcagtagctgcagcagcatctattggttacattggtgtaggaactgttgagttcctattggatgaaagaggttccttctacttcatggaaatgaacactagaattcaggtggagcatcctgtaactgaaatgatttcctctgttgacttgattgaagaacaaattcgtgtagctatgggagaaaaactgcgctacaaacaggaagatattgtgctcagagggcattccattgaatgtcgtatcaatgcagaagatgcatttaaagggttcagacccggaccagggagaataacatcgtacttgccatctggaggcccatttgttcgaatggatagccatgtttattctgattatgtagttcctccaagctatgattcattacttggaaagcttatcgtatgggctccaacaagggaaaaagcaattgagcgcatgaaaagggctcttgatgacactgtaattacaggggttcctacaacaattgaataccataaactcatccttgatattgaggacttcagaaacggaaaagttgacactgctttcattccaaaacatgaagaagagttggcagcaccacagaaaatggtagtagcaagcccagccaaagaattaacaagtgcaactgcttagatcaaagatggtttatttgcaacttgtgtaatgattcatgcactgagaaaattgtttgaaattttgataatccactctttcgtttcagtgttgtaatgtttgcataatggtgagtagaaatcgttgatatgcagacattcgtcttgcagttaaaaactatcagaattaatgactaaagttggaaactttagtttctcttttccctgtttgtgatgattcagtagtcgtgactatcctgtttgtcatccgccaacaaatggcagtacggaaaataaaatatattactttaatagaaaatgcggttaacaaaaaagaaatgaaatgagttggattgattcaatatgaaaatataccttttctattatgcatgtaaatcagcactcccaagtaagtagctaaaaattcaaaacatgcacttctcatacacgcacaagaggcttttttcgttttgagaaaacatgatgatgttatatatatattcttttttagttaattattttcaacatgaaatttatggagataaaagaaatttaaaataagaaaaagta

SEQ ID NO: 7916 - DNA, 2059 bp, Gossypium hirsutum
taacccaaccatttaggcgagcattcaataaaacacttgcctcgtttccatcgacaacttctccatatctctctcttctctctatttccccatctccctgtctcactacattgctctgattcttgttcacgtctagcttggcattttctgtttttctcaatggcaatggatgcttcactgactatgtgcaagtcggtcacatcacctcctggcttattcttggggagaagtagagttattaggagttcccagtgtacctttatggtgggaagcaggatcaactttcctcggcagaaagctcagtcaacccaagttagatgtaaatctagcaggtgtggaggagctcttggtgctaaatgccgtgctgagaaaattttggtggcaaatagaggagaaattgctgttcgtgtaatccgaacagctcatgagatgggaataccatgtgttgctgtctactctacaattgataaggatgcacttcatgtgaagctggctgatgaatcagtttgcataggcgaagcaccaagcagtcaatcgtatttattgattccaaatgtcctatctgctgcaattagccgtaactgtactatgcttcatcctgggtatggtttcctttctgagaatgcggtttttgtagaaatgtgcagagatcacaggatcaactttattgggcctaaccctgacagtattcgtgttatgggtgacaaatcaactgcacgagaaacaatgaagaacgcgggtgttcctactgttccgggaagtgatggattgttacagagtacagaggaagcaatcaagcttgcccatgagattggctttcctgtgatgatcaaggccacagcaggtggtggaggacgtggaatgcgtctttctaaagagcctgatgagtttgtgaagttactgcagcaagccaaaagtgaagctgcagctgcatttggaaatgatggagtttatttggagaagtacatccaaaatccaaggcacattgagttccaggttcttgcggataaatatggtaatgttgttcactttggtgagcgagactgcagcatccagagacgtaatcaaaaacttcttgaagaggctccttctccagcattgacaccagagttgcggaaggccatgggtgatgcagcagtagctgcagcagcatctattggttacattggtgtaggaactgttgagttcctattggatgaaagaggttccttctacttcatggaaatgaacactagaattcaggtggagcatcctgtaactgaaatgatttcctctgttgacttgattgaagaacaaattcgtgtagctatgggagaaaaactgcgctacaaacaggaagatattgtgctcagagggcattccattgaatgtcgtatcaatgcagaagatgcatttaaagggttcagacccggaccagggagaataacatcgtacttgccatctggaggcccatttgttcgaatggatagccatgtttattctgattatgtagttcctccaagctatgattcattacttggaaagcttatcgtatgggctccaacaagggaaaaagcaattgagcgcatgaaaagggctcttgatgacactgtaattacaggggttcctacaacaattgaataccataaactcatccttgatattgaggacttcagaaacggaaaagttgacactgctttcattccaaaacatgaagaagagttggcagcaccacagaaaatggtagtagcaagcccagccaaagaattaacaagtgcaactgcttagatcaaagatggtttatttgcaacttgtgtaatgattcatgcactgagaaaattgtttgaaattttgataatccactctttcgtttcagtgttgtaatgtttgcataatggtgagtagaaatcgttgatatgcagacattcgtcttgcagttaaaaactatcagaattaatgactaaagttggaaactttagtttctcttttccctgtttgtgatgattcagtagtcgtgactatcctgtttgtcatccgccaacatatggcagtacggaaaataaaatatattactttaata

SEQ ID NO: 7917 - DNA, 1854 bp, Olea europaea
acggaggacgatttgattggattagtctgaaaatggattctgcagccatgactttttgcaataaatctataagctcaactcccggtttattcatggggaggactatacaaattcaaagctcccagtgtagctttgtcgtaggaagtaaggttaactaccctcgacagagagttcaggcttctcgtgttggtagatctagcaaacgtggaggctctcttgctgctacatgtgctaatgataaaatcctagtggctaacagaggtgagattgctgttcgtgtgattcggacagctcatgagatggggatcccttgtgttgctgtttactcaaccatagataaagatgctcttcacgtgaaattggctgacgaatctgtttgtattggagaagcgccaagcagtcaatcgtatttattgattccaaatgtattatccgctgccatcagtcgtggatgtactatgctacatcctggatatggtttccttgctgagaatgcagtttttgtagagatgtgcagagaacatggtatcaactttattgggccaaatcccgacagcattagggtcatgggtgacaaatcaactgccagagatacaatgaaaaatgctggagttccaactgtcccaggaagtgatggcttattacagagtactgaagaagcagttagactagctgaggagattggttttcctgtcatgatcaaggcaactgctggtggtggaggacgtggaatgcggcttgctaaagtgccaaatgagtttgtgaagttattgcagcaagccaagagcgaggctgcagccgcgtttggtaatgatggtgtttacctggaaaagtacatccaaaatccaaggcatattgaattccaggttttggcagacaagtttggtaatgttgtgcactttggagagcgtgattgcagtatccagagaagaaaccagaagttactggaagaagcgccttctcctgcattaacaccagagttgcggaaagcaatgggtgatgcagcagttgcagcggcagcatcgataggttacataggtgttggtactgttgagttccttctggacgaaagagggtccttttactttatggagatgaacactaggattcaggttgaacatccggttacggaaatgatttcctctgttgatctaattgaagaacagatccgtgtggctaggggagagaaacttcggtacaagcaggaagatatcgtccttcgtggacattcaattgaatgccgcatcaatgccgaagatgctttcaaaaatttcagacctggaccaggaagaataacagcatatttgccatctggaggtccatttgtgcgaatggatagccatgtttatccagattacgtggttccacccagctatgattccctacttggaaagcttattgtttgggctccaacaagagagagggcaattgaacgcatgaagagggctcttgatgacaccatcataacgggggttccaacaacaattgattaccataagcttatccttgaagttgaggacttcaaaaatggaaatgttgatactgcttttataccaaagcatgaagaagaattagccccgcctcagcaagatgaattggcatctgctaagaaagagttggcaaaggcttctacctaaaagttttcttttcagaagtggaggcaaagttcccgagttctagaattggtcctaaatatataattgtttgtttgatgccagcacatttttattcgaatctattatatttaactgtaacgaataaaaatgttttatactttccctgtttattgtgaaatgagattaaaaccaaggggcatcgtttttagcaaaaaacagggaaagtataaaacatttt

SEQ ID NO: 7918 - DNA, 1781 bp, Nicotiana benthamiana
gggtttatttctggggagaacaaatggtattaggagctcgcagtgtagctttatggcaggaaaccggataaactttccgcggcagagagctcaagcatatagagttagtactaaatctagcaaatgtggcggtgctcttgctgcaacatgtcgcgccgagaagattctggtggcaaatcgaggagagattgctgttcgtgtgattcgaactgcccatgagatgggaattccttgtgttgctgtttattcgaccatagacaaagatgccttacatgtgaagctagctgatgaatctgtttgcattggtgaagcaccaagcaatcaatcgtatttagtgatcccaaatgtcttatctgctgctatcagtcgtggatgtacaatgttgcatcctggatatggtttcctttctgagaatgcagtttttgttgagatgtgcagagaacatggaatcaactttattggcccaaatccagacagtataagagtcatgggtgacaaatccactgccagagatacaatgaagaatgctggtgttccaactgtgccaggaagtgatggactattacagagcactgaagaaggtgtaaggcttgctgaggagattggttaccctgtgatgattaaggcaacagctggtggtggtggacgtggaatgcgtcttgctaaagaacctgacgagtttgtaaaattattacagcaagctaaaagtgaagcagctgctgcatttggaaatgatggcgtttatctggagaagtacgtccaaaatcctaggcacattgaatttcaggttttggcggacaagtatggtaatgttgtacactttggagagcgtgattgcagtattcagagaaggaaccagaagttgctggaggaagcaccttcccctgcattgacaccagaactaaggaacgccatgggtgacgcagctgttgcggctgcagcatccataggttacattggtgttggtaccatggaattcctattggatgagagagggtccttttacttcatggaaatgaacactcgtattcaggtagagcatccagtgacagaaatgatatcctctgttgatctgatagaggaacagatccgcgtggctatgggagaaaagctccgatacaagcaggaggatattgtgcttagaggacattcaattgaatgccgtataaatgcagaagatgctttcaaaaatttcagacccggcccagggagaatcactgcatatttgccagctggaggtccatttgtgcgtatggatagccacgtttatcctgactatgtggttccacctagctacgattccctgctaggaaagctcattgtatgggctccaacgcgcgagagggctattgaacgcatgaaaagagcacttaatgacaccataattactggagttcctactacaatagaatatcataagctcatcctcgatatcgaggactttaagaatggaaaagttgatactgcttttattccaaagcatgaagaagaattagctccgccccagcaaattgttccagcagctaccaaggagatggtcaatgccagtgcttaattattcctctttttttttttttgttttttttttctttgattattttttctttacccttgtcggtgaatagtgaaagcagattgctcccattggatcttgaggtgactgcagttctggatataacattcatctctttgatcttagcttgaatgtatttttagatacacaagactgaatgaaattcttttttttgctatatgatgctcaattgaatctgtgttaaatg

SEQ ID NO: 7919 - DNA, 2142 bp, Populus trichocarpa
caacccaaacccaattaggcggagcattcaatctctcacactctctgactctcttcgcatttcctcgtttctatcgacaagacagcaacacaaaccaaagtcccaacaaatctcttccttccatcacttctatcttaaataccctctccttctccttctcttcgtgctttctttgcttctaaaataacccatcatttcttcttcaaggctttttgggttccaaaatggaggctacgttgcctgtttgcaaatctgttacctctactcctggtttattcatggggaaaactagtggaatcaggagttctcaatgcagctttatgatgggaaataaggttaactttcctagacaaagagctcagactgcccacgttcactgtgctaagaatggaggagctcttggggttacatgtcgcgcggaaaaaattctggtagcaaacagaggagagattgctgttcgtgttattcgaactgcacatgagatggggataccatgtgtagctgtttactccaccatagataaggatgcacttcatgtgaaattggctgacgaatcagtttgcatcggtgaagcacccagcagtcagtcgtacttagtgatcccaaatgttttatctgctgctataagtcgtagatgtacaatgctgcatcctggatatggcttccttgctgaaaatgctgtatttgtggaaatgtgcagagaacatggaataaactttattgggcctaatcctgacagtataagggtcatgggtgacaaatcaactgctagagaaacaatgaagaaggcaggggttccaactgtaccaggaagtgatggcttattacagagtactgaggaaggagtaaggctcgccaacgagattggttatcctgtgatgatcaaggcaacggcaggtggtggaggacgtggaatgcggctcgccaaagaacctgatgagtttgtaaagttgctacagcaagctaaaagtgaggctgctgctgcatttggaaatgatggagtttatttggagaagtatgttcaaaatcccagacacattgaattccaggttcttgcagacaaattcggtaatgttgttcattttggtgagcgagactgcagtattcagagacgaaaccaaaagctgttggaagaagcaccatctccagctttgactcctgagttacggaaggccatgggtgatgcagcagtttcagccgcagcatccatagggtacattggtgttggaacagttgagttccttttggatgaaaggggttccttctacttcatggaaatgaacactcgaatccaggtggagcatccggtgactgaaatgatttcttctgttgatttgattgaggaacaaattcgtgtagccatgggagagaaacttcgatacaaacaggaagatattgttcttagaggacattcaattgaatgccgtatcaatgcagaagatgcttttaagggattccgacctgggcctgggagaataacagcatatttgccatctggaggcccgtttgttagaatggatagccatgtttatcctgattatgttgttcctccaagctatgattccctacttggaaagcttattgtctgggctccaacaagagaaaaggcaattgagcgaatgaaaagggctcttgatgacactattattactggagttccgacgactatagattaccacaaacttatccttgaaattgaggacttcaaaaatggaaatgttgataccgctttcattccgaagcatgaaaaggagttagcagcgccacaacaaatcataccagccaaacagttgaccaattcagccgcataaatagatcacttctcaaatcgcaaccatcttcagctaattttcaagcacagttaagaggccaggttcttatgcgaatctgctggaagctttcgttttcctttcctttagaacttgtaaatttcaacgtgccagacacgggagaattattcatgaaattttgatgtatgctgtatgtgttccttttagttggggatgaaaatggggtaaagttcatcttgctcatacaatacttggatggtgatgtttttagtcaagactgattcgaaatttgttgaaatgaagggagaaatttactctatcatgctcttgccccaccagattatcacattct

SEQ ID NO: 7920 - DNA, 2254 bp, Gossypium raimondii
ggcccaatccaaacagagctaagtgggtgctgacaattgtgagatgcaaacgtggaatgaaaacattggaggaatggacccaaccgtagagatagaaccgtagggaaaggtctatgactgctgggcttatatgcctgatgagtgataaccccaaccatttaggcggagcattcaataaatcacttgcctcggttccatcgacaacttctctatatctctctcttctctctatttccccatctccctgtctcactacattgctctgattcttgttcacgtcaagcttggcattttctgtttttctcaatggcaatggatgcttcactgactatgtgcaaatcggtcacatcacctcctggcttattcttggggagaagtagagttattaggagttcccagtgtacctttatggtgggaagcaggatcaactttcctaggcagaaagctcagtcaacccaagttaaatgtaaatctagcaggtgtggaggagctcttggtgctaaatgccgtgctgagaaaattttggtggcaaatagaggagaaattgctgttcgtgttatccgaacagctcatgagatgggaataccatgtgttgctgtttactctacaattgataaggatgcacttcatgtgaagctggctgatgaatcagtttgcataggcgaagcaccaagcagtcaatcgtatttattgattccaaatgtcctatctgctgcaattagccgtaactgtactatgcttcatcctgggtatggtttccttgctgagaatgcggtttttgtagaaatgtgcagagatcacaggatcaactttattgggcctaaccctgacagtattcgtgttatgggtgacaaatcaactgcacgagaaacaatgaagaacgcgggtgttcctactgttccgggaagtgatggattgttacagagtacagaggaagcaatcaagcttgcccatgagattggctttcctgtgatgatcaaggccacagcaggtggtggagggcgtggaatgcgtcttgctaaagagcctgatgagtttgtgaagttactgcagcaagccaaaagtgaagctgcagctgcatttggaaatgatggagtttatttggagaagtacatccaaaatccaaggcacattgagttccaggttcttgcggataaatatggtaatgttgttcactttggtgagcgagactgcagcatccagagacgtaatcaaaaacttcttgaagaggctccttctccagcattgacaccagagttgcggaaggccatgggtgatgcagcagtagctgcagcagcatctattggttacattggtgtaggaactgttgagttcctattggatgaaagaggttccttctacttcatggaaatgaacactagaatccaggtggagcatcctgtaactgaaatgatttcctctgttgacttgattgaagaacaaattcgtgtagctatgggggaaaaactgcgctacaaacaggaagatattgtgctcagagggcattccattgaatgtcgtatcaatgcagaagatgcatttaaagggttcagacccggaccagggagaataacatcgtacttgccatctggaggcccatttgttcgaatggatagccatgtttattctgattatgtagttcctccaagctatgattcattacttggaaagcttattgtatgggctccaacaagggaaaaagcaattgagcgcatgaaaagggctcttgatgacactgtaattacaggggttcctacaacaattgaataccataaactcatccttgatattgaggacttcagaaacggaaaagttgacactgctttcattccaaaacatgaagaagagttggcagcaccacagaaaatgttagtagcaagcccaaccaaagaattaacaagtgcaactgcttagatcaaagatggtttatttgcaacttgtgtaatgattcatgcactgagaaaattgtttgaaattttgataatccactctttcatttcagtgttgtaatgtttgcataatggtgagtagaaaccgttgatacgcatacattcgtcttgcggttaaaaactatcagaattaatgactaaatttggaaactttagtttctcttttccctgtttgtgatgattcagtagtcgtgactatcctgtttgtcatccgccaacaaatggcagtacggaaaataaaatatattactttaatagaaaatgcggttaacaaaaaagaaatgaaatgagttggattgattcaa

SEQ ID NO: 7921 - DNA, 2184 bp, Panax ginseng
gtattcaatcccatatctccctcgttttcatcgacaccttttctctacttcttcacaacaaccctgctttctgtccccaattcgctttcaacttcgatcaaagtgtaacagtagatatactgcagaagaagcatttgatctgaaaatggactccgcggccatgactttttgtaccaaatctgtttactctcctccgagtttattcacggggagcgcttgtgggattaaaagctcccagtgtagttttatgataggaagtaaagtgacattccccaggcaaaaagttcaggcttataaagttagtcgtaaatctgggaaacgagggggtgctctcagtgctacttgtcgtgacgataaaattctggtggcaaacagaggagagattgctgtccgcgtgatacgaactgctcatgagatgggtataccttgtgttgctgtttactcaaccatcgataaggatgcacttcatgtgaaattggccgatgaatcagtttgcattggtgaagcaccaagcagtcaatcgtatttagtggtcccaaatgtcctatccgctgctattagccgtgggtgtacaatgctgcatcctggatatggtttcctttccgagaatgcattgtttgttgaaatgtgcagagagcatggaatcaactttattgggccaaatcctgacagtattcgtgtcatgggtgacaaatcaactgccagggacacaatgaagaatgctggtgttccaactgtaccaggaagtgatggattggtacagagcactgaggaagctattagagttgctgatgagattggctaccctgtgatgattaaggcgacagctggtggtggaggccgtggaatgcgtcttgctaaagagcctgaggagtttgtgaagttattacaggcagctaagagtgaggctgcagctgcatttggaaatgatggggtttatttagaaaagtacatccagaatccaaggcacattgaattccaggttcttgcagacaagtttggtaatgttgttcactttggagagcgtgattgcagtattcagagaaggaatcagaagttgctggaagaagcaccatcccctgccttaacctccgagctgcggaaagccatgggtgatgcagcagttgcagccgcagcatctataggttacattggggttggtactgtcgagttccttttggatgaaagagggtccttttacttcatggaaatgaacactaggatccaggtggagcatcctgtgacagaaatgatttcttctgttgacctgattgaagaacaaatccgtgttgctaggggagagaaactacgttacaaacaggaagatattgtgcttagaggacactcaattgaatgccgtattaacgcagaagatgctttcaaaaatttcagacctgggccagggagaataacatcatacttgccatctggaggtccatttgtgagaatggatagccatgtttatccggattacgttgttccaccgagctatgattccctacttggaaagcttattgtatgggctccgacaagagagagggcaattgcacgcatgaaaagggctcttgatgacaccatcattactggtgttccaacaacaatcgaataccataaacttatccttgaggttgaggatttcaaaaatggaaaggtcgacactgcttttattcctaagcatgaacatgaattggcagcgccccagaagattgtaccagcaacacctgctaaagagcttgcgaacactgcagcctagagggaaaacaagacatcttgggtaggtggagctgatattttttaacagggtggtggtggtttggtctaattgtattagtttggtctcggctgattttgttcttcatagttgttagaataaaatcccttctttttgctgtcaaatgatgcttatcgcatagatttggatctgaattggatattgtttttgtggttggtcttagaagagcttaactgtactattgaagcatgactaaaacgaatgagaaattcttcatggaatattttaacgggaagcggttagtatgaagtttattttggggtaagttgatcaattgactaatagaatactgacacgcaggcgaggttgtatgcgtatcagtattttattgatcaattaactaatttatcaaaaaaataacttcatattaactggatccattttaactaaaa

SEQ ID NO: 7922 - DNA, 2099 bp, Panax ginseng
aagcagtggtatcaacgcagagtacgcggggggtccatttcggcggagtattcaatcccatatctccctcgttttcatcgacaccttttctctacttcttcacaacaacccttctttctgtccccaatttgctttcaacttcgatcaaagtgtaacagtagatatactgcagaagaagaagcatttgatctgaaaatggactccgcggccatgactttttgtaccaaatctgtttactctcctccgagtttattcacggggagcgcttgtgggattaaaagctcccagtgtagttttatgataggaagtaaagtgacattccccaggcaaaaagctcaggcttataaagttagtcgtaaatctgggaaacgagggggtgctctcagtgctacttgtcgtgacgataaaattctggtggcaaacagaggagagattgctgtccgcgtgatacgaactgctcatgagatgggtataccttgtgttgctgtttactcaaccatcgataaggatgcacttcatgtgaaattagccgatgaatcagtttgcattggtgaagcaccaagcagtcaatcgtatttagtggtcccaaatgtcctatctgctgctattagccgtgggtgtacaatgctgcatcctggatatggtttcctttccgagaatgcattgtttgttgaaatgtgcagagagcatggaatcaactttattgggccaaatcctgacagtattcgtgtcatgggtgacaaatcaactgccagggacacaatgaagaatgctggtgttccaactgtaccaggaagtgatggattggtacagagcactgaggaagctattagagttgctgatgagattggctaccctgtgatgattaaggcgacagctggtggtggaggccgtggaatgcgtcttgctaaagagcctgaggagtttgtgaagttattacaggcagctaagagtgaggctgcagctgcatttggaaatgatggggtttatctagaaaagtacatccagaatccaaggcacattgaattccaggttcttgcagacaagtttggtaatgttgttcactttggagagcgtgattgcagtattcagagaaggaatcagaagttgctggaagaagcaccatcccctgccttaacctccgagctgcggaaagccatgggtgatgcagcagttgcagccgcagcatctataggttacattggggttggtactgtcgagttccttttggatgaaagagggtccttttacttcatggaaatgaacactaggatccaggtggagcatcctgtgacagaaatgatttcttctgttgacctgattgaagaacaaatccgtgttgctaggggagagaaactacgttacaaacaggaagatattgtgcttagaggacactcaattgaatgccgtattaacgcagaagatgctttcaaaaatttcagacctgggccagggagaataacagcatacttgccatctggaggtccatttgtgagaatggatagccatgtttatccggattacgttgttccaccgagctatgattccctacttggaaagcttattgtatgggctccgacaagagagagggcaattgcacgcatgaaaagggctcttgatgacaccatcattactggtgttccaacaacaatcgaataccataaacttatccttgaggttgaggatttcaaaaatggaaaggtcgacactgcttttattcctaagcatgaacatgagttggctgcgccccagaagattgtaccagcaacacctgctaaagagcttgcgaacactgcagcgtagagggaaaacaagacatcttgggtaggccgagctgattttttgaacagggggtggtggtttgagctaatggacagtttttggtctaaatgtattagtttggtctgggctggttttgatcttcatagttgttagaataaaatcccttctttttgctgtcaaatgatgcttatcgcatagaattggatattgtttatgtggttggtcttagaaattacatactataagagtagctttttgtttcttcaactgtaatattgaagcatgactaaaacgaatgagaaattcttcatggaaca

SEQ ID NO: 7923 - DNA, 2024 bp, Gossypium hirsutum
ggcttatatgcctgatgagtgacaaccccaaccatttaggcggagcattcaataaatcacttgcctcgtttccatcgacaacttctctatatctctctcttctctctatttccccatctccctgtctcactacattgctctgattcttgttcacgtcaagcttggtagcactgaagctttggcttaaatgggtatttgctattgtaggcattttctgtttttctcaatggcaatggatgcttcactgactatgtgcaaatcggtcacatcacctcctggcttattcttggggagaagtagagttattaggagttcccagtgtacctttatggtgggaagcaggatcaactttcctaggcagaaagctcagtcaacccaagttaaatgtaaatctagcaggtgtggagtagctcttggtgctaaatgccgtgctgagaaaattttggtggcaaatagaggagaaattgctgttcgtgttatccgaacagctcatgagatgggaataccatgtgttgctgtttactctacaattgataaggatgcacttcatgtgaagctggctgatgaatcagtttgcataggcgaagcaccaagcagtcaatcgtatttattgattccaaatgtcctatctgctgcaattagccgtaactgtactatgcttcatcctgggtatggtttccttgctgagaatgcggtttttgtagaaatgtgcagagatcacaggatcaactttattgggcctaaccctgacagtattcgtgttatgggtgacaaatcaactgcacgagaaacaatgaagaacgcgggtgttcctactgttccgggaagtgatggattgttacagagtacagaggaagcaatcaagcttgcccatgagattggctttcctgtgatgatcaaggccacagccggtggtggagggcgtggaatgcgtcttgctaaagagcctgatgagtttgtgaagttactgcagcaagccaaaagtgaagctgcagctgcatttggaaatgatggagtttatttggagaagtacatccaaaatccaaggcacattgagttccaggttcttgcggataaatatggtaatgttgttcactttggtgagcgagactgcagcatccagagacgtaatcaaaaacttcttgaagaggctccttctccagcattgacaccagagttgcggaaggccatgggtgatgcagcagtagctgcagcagcatctattggttacattggtgtaggaactgttgagttcctattggatgaaagaggttccttctacttcatggaaatgaacactagaatccaggtggagcatcctgtaactgaaatgatttcctctgttgacttgattgaagaacaaattcgtgtagctatgggggaaaaactgcgctacaaacaggaagatattgtgctcagagggcattccattgaatgtcgtatcaatgcagaagatgcatttaaagggttcagacccggaccagggagaataacatcgtacttgccatctggaggcccatttgttcgaatggatagccatgtttattctgattatgtagttcctccaagctatgattcattacttggaaagcttattgtatgggctccaacaagggaaaaagcaattgagcgcatgaaaagggctcttgatgacactgtaattacaggggttcctacaacaattgaataccataaactcatccttgatattgaggacttcagaaacggaaaagttgacactgctttcattccaaaacatgaagaagagttggcagcaccacagaaaatgttagtagcaagcccaaccaaagaattaacaagtgcaactgcttagatcaaagatggtttatttgcaacttgtgtaatgattcatgcactgagaaaattgtttgaaattttgataatccactctttcatttcagtgttgtaatgtttgcataatggtgagtagaaaccgttgatacgcatacattcgtcttgcggttaaaaactatcagaattaatgactaaatttggaaatttta

SEQ ID NO: 7924 - DNA, 2001 bp, Helianthus annuus
cttccttacttgtatttccttgctcactctctctctatctctctctctccctctagcgctcaactgctccgcctaatttcttcacaatttggcttcctctcagctaatttcaacgtttggtattcgatatggattccgccgccgtgacattttgcagtaaacctatcacatctcctccgggtgtattcatcgggaggtctagtggaattaagagttcccagtgtaacttcttagtgggaaataagttgaactttcccaagcaaagatttcaggcttcccaaaaggctcatagatcagcgaaacgtgagggagcacttggtgtcacttgccgtgcagaaaaaattctggtggcaaacagaggggaaattgcagtgcgcgtgattcgaactgcccatgagctagggatcccctgtgttgcagtgtactctactatagataaggatgcacttcatgtgaaactggctgatgaatcagtttgtataggggaagctcctagtaatcagtcgtacttgttgatacctaatgtcctctctgctgctatcagtcgtggatgtacaatgttgcatcctggttatggtttccttgctgagaatgctgtttttgttgagatgtgcagagagcatggaatcaacttcattgggccaaatcctgacagcattcgtgttatgggggacaaagcaactgcacgagataccatgaagaatgctggtgttccaactgtaccaggaagtgatggtctattacagagcactgaagaaggcatcaggctcgctgacgagattggcttccctgtgatgattaaggctacagcaggtggtggaggtcgtggaatgcgtcttgcaaaagaacgtgacgagtttgtaaagttgttgcagcaagctaagagtgaggctgcagctgcatttggaaatgatggtgtatatttggagaaatgcattctaaatccaaggcacattgagttccaggttcttgcagacaaatatggaaatgttgttcactttggggagcgtgactgcagcatccagagaaggaaccagaagcttctagaagaagcaccctcaccagcattaaccccagaactgagaaaagccatgggtgatgcagcagttgcggcggcagcatcaattggctacattggtgttggtactatagagtttcttttggatgaaagaggtgacttttacttcatggaaatgaacactagaatccaggtagagcatcctgtgacagaaatgatatcgtcggttgacttgatagaggagcagattcgggtagctatgggtgagaaactccgttacacgcaggatgacatcgtgctcagaggacactcgattgaatgccgtattaacgcggaagacgctttcaaaaatttcagacctggaccagggagaataacatcttacttgccatctggaggtccatttgtgagaatggatagccacgtatataccgattatgttgttccaccaagctatgattctctacttggaaagcttattgtatgggccccaacaagagaaaaggcgattgaacgcatgaaaagggctcttgatgataccatcatcacaggggttccaaccacaatcgagtaccacaagctaatcctcgacatcgaagatttcaaaaacggaaaagttgacactgctttcattccaaagcatgaggacgaattagccgagccacagaaaccgagtacttcaaatgctgctaaagaagtggcaaaggctgtagcttaaggagtgtttgtacttttgtatgcaacaaaatgttacattttttgtttggtcaagtctttgatcccccaaatgtcttgagctaactttctttcaggctgtggcatccttttaactttttgagacatattcattgcttgctaaatgttgattataaatccttgagccaaatttgtaagcctagatgattggtttccttgtgcaatctgccgcgtacacactcacactcggagaattaggtgctcgggttcgggttttacacacagat

SEQ ID NO: 7925 - DNA, 2137 bp, Helianthus annuus
gggcggagaattcaatctgcaaccatcatagatttcatcgacacccctctttcttccttccttacttgtatttccttgctcactctctctctacctctctctctccctctagcgctcaactgctccgcctaatttcttcacaatttggcttcctctcagctaatttcaacgtttggtattcgatatggattccgccgccgtgacattttgcagtaaacctatcacatctcctccgggtgtattcatcgggaggtctagtggaattaagagttcccagtgtaacttcttagtgggaaataagttgaactttcccaagcaaagatttcaggcttcccaaaaggctcatagatcagcgaaacgtgagggagcacttggtgtcacttgccgtgcagaaaaaattctggtggcaaacagaggggaaattgcagtgcgtgtgattcgaactgcccatgagctagggatcccctgtgttgcagtgtactctactatagataaggatgcacttcatgtgaaactggctgatgaatcagtttgtataggggaagctcctagtaatcagtcgtacttgttgatacctaatgtcctctctgctgctatcagtcgtggatgtacaatgttgcatcctggttatggtttccttgctgagaatgctgtttttgttgagatgtgcagagagcatggaatcaacttcattgggccaaatcctgacagcattcgtgttatgggggacaaagcaactgcacgagataccatgaagaatgctggtgttccaactgtaccaggaagtgatggtctattacagagcactgaagaaggcatcaggctcgctgacgagattggcttccctgtgatgattaaggctacagcaggtggtggaggtcgtggaatgcgtcttgcaaaagaacgtgatgagtttgtaaagttgttgcagcaagctaagagtgaggctgcagctgcatttggaaatgatggtgtatatttggagaaatgcattctaaatccaaggcacattgagttccaggttcttgcagacaaatatggaaatgttgttcactttggggagcgtgactgcagcatccagagaaggaaccagaagcttctagaagaagcaccctcaccagcattaaccccagaactgagaaaagccatgggtgatgcagcagttgcggcggcagcatcaattggctacattggtgttggtactatagagtttcttttggatgaaagaggtgacttttacttcatggaaatgaacactagaatccaggtagagcatcctgtgacagaaatgatatcgtcggttgacttgatagaggagcaaattcgggtagctatgggtgagaaactccgttacacgcaggatgacatcgtgctcagaggacactcgattgaatgccgtattaacgcggaagacgctttcaaaaatttcagacctggaccagggagaataacatcttacttgccatctggaggtccatttgtgagaatggatagccacgtatataccgattatgttgttccaccaagctatgattctctacttggaaagcttattgtatgggccccaacaagagaaaaggcaattgaacgcatgaaaagggctcttgatgataccatcatcacaggggttccaaccacaatcgagtaccacaagctaatcctcgacatcgaagatttcaaaaacggaaaagttgacactgctttcattccaaagcatgaggacgaattagccgagccacagaaaccgagtacttcaaatgctgctaaagaagtggcaaaggctgtagcttaaggagtgtttgtacttttgtatgcaacaaaatgttacattttttgtttggtcaagtctttgatcccccaaatgtcttgagctaactttctttcaggctgtggcatccttttaactttttgagacatattcattgcttgctaaatgttgattataaatccttgagccaaatttgtaagcctagatgattggtttccttgtgcaatctgccgcgtacacactcacgctcggagaattaggtgctcgggttcaggttttacacacagatttgagtgtctgggttcggtttacacacgcatttaagtgtatgggttcggttttacacacatcgtagggggctggtttggt

SEQ ID NO: 7926 - DNA, 2812 bp, Gossypium raimondii
tagaaccgcagaggaagtaaccgtagggaaaagtcaagcagagggaggtgtgggctgatgtccccaaccattttaggcggagaaatcgatcaagtaccgacagtaactctaagcctcgtttccatcgacttcttctccatatctccattcccttaacactcactctctctttcactacacctcattctctcattcttcttcagctcatattctttggcatttgtcgctatggcattggattcttccatgactatgtgcaaatccgtcacctcaacccctggcttattcttgcggagaaatacaagtagtaggagtttccaatgtacctttaaggtgggaagcaggatcaactttcctaggcagaaagctcaggtaacccaagttagatgtaaatccagtaaacgtggaggagccctcggtgccacatgccgtgctgagaaaatcctggtggcaaatagaggagaaatcgctgttcgggtaatccgaactgctcatgagatgggaataccttgtgttgctgtttactcaaccatagataaggatgcacttcatgtaaaattggctgatgaatcagtttgcataggggaagcaccaagcagtcaatcgtatttattgataccaaatgtcctatctgctgcacttagccgtaattgtactatgcttcatccgggatatggtttccttgctgaaaatgcagtttttgtggaaatgtgcagagatcacagaatcaactttattgggcctaatcctgacagtattcgtgttatgggtgacaaatcaactgcccgagaaacaatgaagaatgcaggtgttcctactgttcctggaagtgatggtttgttacagagtacagaggaagcaatcaagctagcacatgagattggctttcctgtgatgatcaaggccacagctggtggtggagggcgtggaatgcgtcttgctaaagaacctgatgagtttgtgaagttactacagcaagccaaaagtgaagctgctgctgcatttggaaatgatggagtttatttggagaagtacatacaaaatcctaggcacattgagttccaggttcttgcagataaatatggtaatgttgttcactttggtgagcgcgattgcagtatccagaggcgtaatcaaaaacttttagaagaagcgccttctccagcattgactccagagttgcggaaggccatgggtgatgcagcagttgctgcggcagcatctattggttacattggtgtaggaactgttgagtttcttttagatgaaagaggttccttctatttcatggaaatgaacactagaatccaggtggagcatcctgtaacagagatgatttcctctgttgacttgattgaagaacaaattcgtgtagctatgggagaaaaacttcactacaaacaggaagatattgtgctcagagggcattcaattgaatgtcgtatcaatgcagaagatgcatttaaagggttcagacctgggccagggagaataacatcatacttgccatctggaggcccatttgttcgaatggatagccatgtttatcctgattacgtagttcctccaagctatgattcattacttggaaagcttatcgtatgggctccaacaagggaaaaagcaattgagcgcatgaaaagggctcttgatgacactgtaattacaggggttcctacaaccattgaataccataaactcatccttgatattgaggacttcagaaatggaaaggttgacactgctttcattccaaaacatgaagaagagttggccgcgccacagaaaatggtattagcaactgctgccaaagaattgactagtgcgagtgcgaccgcttagaaggtttagtattcttcttcttgttcaacttcttcagcatactggtataagtcatatagcagtcagcttgttggaaatgttggtaggtgataaatcattcatattcattggtgattcgtggacatggggttcatcaagatcctgttgttcagctgacattctaatacatcgtttattttccttgtgttttttcaaccgtgatgtgttattcttgaaacgcaattaataattttcttcatagtggttggaatatacatccccaaaacccggaatttgatatattagtcatttaagtttcaagattttatggatacatttttcaaaatgaagaggaattatatttttacaagctatcattgggatatattaaaatgactacaaaaactatactaagattttcctttcctacatacgataagatttaaagcttggtgaaataagttctctttcagaatggacaaggaagtatcatctatctatttgtccttagagatgctgaaactgaaacggaaagcctccaaaattctgccaagttgcccatctcctttatttgtttgtttattcattaagtatgatgcagtggtagaagttatgcagcggcgacctcggaaaataacacgtgtggggaagactgggagcaatcaagcgcacatatttgtttgtgatcatcacttctaatttgcttgtcacggcaatccgcgctgcaaaatccttcctcccctctgcccaatccaaccagatattttattcatggcagaaaatcaacaccccagaagctttatgtcatcaccattattatatgtcaaaaaatatctcaagcaattggggttataaattctcatttaagtgctatgtgggtcaaataaatatccgactgacatgtaggcctcagtctccaaatatttacacttctccttgagtccaactacaactaccaaaaaggttttccatctagaagactcaacagaga

SEQ ID NO: 7927 - DNA, 1846 bp, Panax ginseng
tggaactgagctaacgcctaacaagcaccagctacattaagcataagcggtccatttcggcggagtattcaatcccatatctccctcgttttcatcgacaccttttctctacttcttcacaaatcacaacaaccctgctttctgtccccaattcgctttcaacttcgatcaaagtttaacagtagatatactgcagaagaagaagcatttgatctgaaaatggactccgcggccatgactttttgtaccaaatctgtttactatcctccaagtttattcgcggggagcgcttgtgggattaaaagctcccagtgtagttttatgataggaagtaaagtgaaattccccaggcaaaaagctcaggcttataaagttagtcgtaaatctgggaaacgagggggtgctctcagtgctacttgtcgtgacgataaaattctggtggcaaacagaggagagattgctgtccgcgtgatacgaactgctcatgagatgggtataccttgtgttgctgtttactcaaccatcgataaggatgcacttcatgtgaaattggccgatgaatcagtttgcattggtgaagcaccaagcagtcaatcgtatttagtggtcccaaatgtcctatccgctgctattagccgtgggtgtacaatgctgcatcctggatatggtttcctttccgagaatgcattgtttgttgaaatgtgcagagagcatggaatcaactttattgggccaaatcctgacagtattcgtgtcatgggtgacaaatcaactgccagggacacaatgaagaatgctggtgttccaactgtaccaggaagtgatggattggtacagagcactgaggaagctattagagttgctgatgagattggctaccctgtgatgattaaggcgacagctggtggtggaggccgtggaatgcgtcttgctaaagagcctgaggagtttgtgaagttattacaggcagctaagagtgaggctgcagctgcatttggaaatgatggggtttatctagaaaagtacatccagaatccaaggcacattgaattccaggttcttgcagacaagtttggtaatgttgttcactttggagagcgtgattgcagtattcagagaaggaatcagaagttgctggaagaagcaccatcccctgccttaacctccgagctgcggaaagccatgggtgatgcagcagttgcagccgcagcatctataggttacattggggttggtactgtcgagttccttttggatgaaagagggtccttttacttcatggaaatgaacactaggatccaggtggagcatcctgtgacagaaatgatttcttctgttgacctgattgaagaacaaatccgtgttgctaggggagagaaactacgttacaaacaggaagatattgtgcttagaggacactcaattgaatgccgtattaacgcagaagatgctttcaaaaatttcagacctgggccagggagaataacagcatacttgccatctggaggtccatttgtgagaatggatagccatgtttatccggattacgttgttccaccgagctatgattccctacttggaaagcttattgtatgggctccgacaagagagagggcaattgcacgcatgaaaagggctcttgatgacaccatcattactggtgttccaacaacaatcgaataccataaacttatccttgaggttgaggatttcaaaaatggaaaggtcgacactgcttttattcctaagcatgaacatgagttggctgcgccccagaagattgtaccagcaacacctgctaaagagcttgcgaacactgcagcgtagagggaaaacaagacatctt

SEQ ID NO: 7928 - DNA, 1602 bp, Manihot esculenta
atggaggccacattgccagtgtgcaaatctgttgttacttcaacaactcctggcttattcatggggagaactggaggaattgggagttcccaatgtagctttatggtcggaagtaggataaattttccaagacaaagagttcgagctgcccaagttagccgtaaagctaaaaaaaatggtgcaggtgctcttggggcaacatgccgtgctgataaaattttgattgcaaatagaggagaaattgctgttcgtgttatccgaactgcacacgagatgggtataccttgtgttgctgtttactcaaccatagacaaggatgcacttcatgtgaaattggctgatgaatcagtttgcataggtgaagcaccaagcagtcagtcgtacttgttgattccaaatgttttatcggctgctataagccgtggatgtacaatgttgcaccctggttatggtttccttgctgagaatgcagtatttgttgaaatgtgtagagaacatgggatcaactttattgggcctaatcctgacagtatccgagtcatgggtgacaaatcaactgccagagaaacaatgaagaatgcaggtgttccaacggtaccagggagtcaggggttgctacagagtacagaggaagcagtgaagcttgctaatgagattggatatcctgtgatgatcaaggcaacagcaggtggtggaggacgtggaatgcgccttgctaaagaacctgatgagtttgtgaagttgttacagcaagctaagagcgaggcagctgcagcatttggaaatgatggagtttatttggagaagtacattcaaaatccacggcatattgagttccaggttctggctgataaatatggaaatgttgtccactttggtgagcgtgactgcagcatccagagacgtaatcaaaagctgctcgaagaggccccttctcctgcattgaccgctgagttgcggaaagctatgggtgatgctgctgttgcagcagcagcatctatagggtatattggtgttggaacagttgagttccttttggatgaaagaggttccttctacttcatggaaatgaacactcgaatccaggttgaacatccagtaactgaaatgatttcctctgttgatttgattgaggaacaaattcgtgtagccatgggagaaaagctccgttatacacaggaaaatattgtgctcagaggacattcaattgaatgccgtatcaatgcggaagatgcttttaagggattccgacctgggccaggaagaataacagcatatttgccatctggaggcccgtttgtcagaatggatagccatgtttatcctgattatgtggttcctccaagctatgattccctactgggaaagcttatcgtgtgggccccaactagagaaaaggcaattgaacgcatgaaaagagcactggaggacactattattacaggtgtccctacaaccatcgattaccataaacttatccttgacattgaggactttagaaatggcaaggttgacactgctttcattcctaagcatgagcaggaactagcagcgccgcagaatattgtaccggtgaaggaattggccaatgcaactgcatag

SEQ ID NO: 7929 - DNA, 2059 bp, Gossypium hirsutum
tatctctctcttctctctatttccccatctccctgtctcactacattgctctgattcttgttcacgtcaagcttggcattttctgtttttctcaatggcaatggatgcttcactgactatgtgcaaatcggtcacatcacctcctggcttattcttggggagaagtagagttattaggagttcccagtgtacctttatggtgggaagcaggatcaactttcctaggcagaaagctcagtcaacccaagttaaatgtaaatctagcaggtgtggagtagctcttggtgctaaatgccgtgctgagaaaattttggtggcaaatagaggagaaattgctgttcgtgttatccgaacagctcatgagatgggaataccatgtgttgctgtttactctacaattgataaggatgcacttcatgtgaagctggctgatgaatcagtttgcataggcgaagcaccaagcagtcaatcgtatttattgattccaaatgtcctatctgctgcaattagccgtaactgtactatgcttcatcctgggtatggtttccttgctgagaatgcggtttttgtagaaatgtgcagagatcacaggatcaactttattgggcctaaccctgacagtattcgtgttatgggtgacaaatcaactgcacgagaaacaatgaagaacgcgggtgttcctactgttccgggaagtgatggattgttacagagtacagaggaagcaatcaagcttgcccatgagattggctttcctgtgatgatcaaggccacagccggtggtggagggcgtggaatgcgtcttgctaaagagcctgatgagtttgtgaagttactgcagcaagccaaaagtgaagctgcagctgcatttggaaatgatggagtttatttggagaagtacatccaaaatccaaggcacattgagttccaggttcttgcggataaatatggtaatgttgttcactttggtgagcgagactgcagcatccagagacgtaatcaaaaacttcttgaagaggctccttctccagcattgacaccagagttgcggaaggccatgggtgatgcagcagtagctgcagcagcatctattggttacattggtgtaggaactgttgagttcctattggatgaaagaggttccttctacttcatggaaatgaacactagaatccaggtggagcatcctgtaactgaaatgatttcctctgttgacttgattgaagaacaaattcgtgtagctatgggggaaaaactgcgctacaaacaggaagatattgtgctcagagggcattccattgaatgtcgtatcaatgcagaagatgcatttaaagggttcagacccggaccagggagaataacatcgtacttgccatctggaggcccatttgttcgaatggatagccatgtttattctgattatgtagttcctccaagctatgattcattacttggaaagcttattgtatgggctccaacaagggaaaaagcaattgagcgcatgaaaagggctcttgatgacactgtaattacaggggttcctacaacaattgaataccataaactcatccttgatattgaggacttcagaaacggaatagttgacactgctttcattccaaaacatgaagaagagttggcagcaccacagaaaatgttagtagcaagcccaaccaaagaattaacaagtgcaactgcttagatcaaagatggtttatttgcaacttgtgtaatgattcatgcactgagaaaattgtttgaaattttgataatccactctttgatttcagtgttgtaatgtttgcataatggtgagtagaaaccgttgatacgcatacattcgtcttgcggttaaaaactatcagaattaatgactaaatttggaaattttagtttctctgttccctgtttgcgatgattcagtagtcgtgaccgtgctgtttgtcatcaaccaacatatggcaataccgaaaataaaataaatgtaatagaaaatgcatttctttcttaaacaaaaaagaaataaaaggagtttgattaatccaacaaaaaaacaaac

SEQ ID NO: 7930 - DNA, 1843 bp, Prunus persica
cgacaaactcaactcttgatatcttccctcggaccttcccaccttcttcttctcattgctctcactctttttctctccctttctgctttctcgctccacagctcttggggtcccctaacactttccttcttcttcattcattcattctgatcctgttctgagacaattgagaaaggtctctttgttttcaaaatggatgccacaatgcccatttgcaagattgtcactccaactcctggcttattttttgggagaactagagagatccagagttcccaatgcagctttatggtgggaaataaagtcaactttttaaggcagagagctcggggtgctcaagttactttcaaatccaggaagcatgggggagctctccatgctacatgtcgtgctgaaaaaattctggtggcaaataggggagaaattgctgttcgtattattcgaactgcccatgaaatgggaataccttgtgtggctgtttactcaacaatagacaaggacgcacttcatgtgaaattggctgatgaatcagtttgtattggtgaagcagcaagcagtcagtcgtacttagttgttccaaatgttttatctgctgctatcagtcggaaatgtacaatgctgcatccaggatacggtttccttgctgagaatgcatcatttgttgaaatgtgcagagaacacggaatcaactttattgggcctaagcccgacagcatccgtgttatgggtgataaagcgactgccagagacacaatgaagacagcaggtgttccaactgtaccaggaagtgatggattactacagagcacagaggaaggaatcaggcttgcagatgagattggttttcctgttatgatcaaggcaacggcaggaggtggaggacgtggcatgcgtcttgctaaagaacctgaagagtttgtgaagttgttacagcaagcaaagagtgaggctgcagctgcttttggaaatgatggagtttacttggaaaagtacatccaaaatcctagacacattgaatttcaggttcttgcagataaatatggtaatgttgttcactttggagagcgggattgcagtatccagagaaggaaccaaaagctgctggaagaagcaccctcccctgcattgaccccagagttgcgtaaagctatgggtgatgcagcagttgccgcagcagcatcgattggttacattggtgttggaaccgttgaattccttttggatgaaagaggttccttttacttcatggaaatgaacactcgtattcaggttgagcatcctgtgacagagatgatttcctctgttgacttgattgaagaacaaattcgtgtagctatgggagaaaaacttcgatacacacaggatgagatagtgctcagaggacattcaattgaatgtcgtatcaatgcagaagatgcttttaaaggattccgacctgggccaggaagaataactgcctacttaccatctggaggtccctttgttagaatggatagccatgtttatcctgattatgtggttcctccaaactatgactcccttcttggaaagcttattgtttgggcaccaacaagagaaaaggcaattgaacgaatgaagagggctcttgatgacactattataacaggagttcccacaaccattgaatatcataaacttatccttgatatagaggatttcaaaaatggcaaggttgatactgcttttattccaaagcacgaagaggagctcgcagcgccccaacatttggtgcctgcagcccctgccaaagaactagctggtgcatctgcttagatggatggagctcgagttgctaccgtctggtcaagacacccactacatt

SEQ ID NO: 7931 - DNA, 3210 bp, Gossypium hirsutum
acagtactctaagcctcgtttccatcacttcttctccatatcaatctctctatttttctccattcccttaacactcactctctctttcacttcacctcattctctcattcttcttcacctcatattctttggcatttgtcgctatggcattggattcttccatgactatgtgcaaatccgtcacctcaacccctggcttattcttgcggagaaatacaagtagtaggagtttccaatgtacctttaaggtgggaaccaggatcaactttcctaggcagaaagctcaggtaacccaagttagatgtaaatccagtaaacgtggaggagccctcggtgccacatgccgtgctgagaaaatcctggtggcaaatagaggagaaatcgctgttcgggtaatccgaactgctcatgagatgggaataccttgtgttgctgtttactcaaccatagataaggatgcacttcatgtaaaattggctgatgaatcagtttgcataggggaagcaccaagcagtcaatcgtatttattgataccaaatgtcctatctgctgcacttagcctgaattgtactatgcttcatccgggatatggtttccttgctgaaaatgcagtttttgtggaaatgtgcagagatcacagaatcaactttattgggcctgatcctgacagtattcgtgttatgggtgacaaatcaactgcccgagaaacaatgaagaatgcaggtgttcctactgttcctggaagtgatggtttgttacagagtacagaggaagcaatcaagctagcacatgagattggctttcctgtgatgatcaaggccacagctggtggtggagggcgtggaatgcgtcttgctaaagaacctgatgagtttgtgaagttactacagcaagccaaaagtgaagctgctgccgcatttggaaatgatggagtttatttggagaagtacatacaaaatcccaggcacattgagttccaggttctcgcagataaatatggtaatgttgttcactttggtgagcgcgattgcagtatccagaggcgtaatcaaaaacttttagaagaagcgccttctccagcattgactccagagttgcggaaggccatgggtgatgcagcagttgctgcggcagcatctattggttacattggtgtaggaactgttgagtttcttttagatgaaagaggttccttctatttcatggaaatgaacactagaatccaggtggagcatcctgtaacagagatgatttcctctgttgacttgattgaagaacaaattcgtgtagctatgggagaaaaacttcgctacaaacaggaagatattgtgctcagagggcattcaattgaatgtcgtatcaatgcagaagatgcatttaaagggttcagacctgggccagggagaataacatcatatttgccatctggaggcccatttgttcgaatggatagccatgtttatcctgattacgtagttcctccaagctatgattcattacttggaaagcttatcgtatgggctccaacaagggaaaaagcaattgagcgcatgaaaagggctcttgatgacactgtaattacaggggttcctacaactattgaataccataaactcatccttgatattgaggacttcagaaatggaaaggttgacactgctttcattccaaaacatgaagaagagttggccgcgccacagaaaatggtattagcaactgctgccaaagaattgactagtgcgagtgcgaccgcttagaagggttagtattcttcttgtttaacttcttcagcatactggtataagtcatatagcagtcagcttgttggaaatgttggtaggtgataaatcattcatattcattggtgattcgtggacatggggttcatcaagatcctgttgttcagctgacattctaatacatcgtttattttccttgtgttttttcaaccgtgatgtgttattcttgaaacgcaattaataattttcttcatagtggttggaatatacatccctaaaacccggaatttgatatattattaattgaagtttcaagattttatggatacatttttcaaaatgaagaggaattatatttttacaagctatcattgggatatattaaaatgagtacaaaaactatactaagattttcctttcctacatacgataagatttaaagcttggtgaaataagttctctttcagaatggaaaaggaaatatcatctatctatttgtccttagagatgctgaaactgaaacgtaaagcctccaaaattctgccaagttgcccattctcctttatttgtttgtttattcattaagtatgatgcagtggtagtagttatgcagcggcgacctcggaaaataacacgtgtggggcaggctgggagcaatcaagcgcacatatttgtttgtgatcatcacttctaatttgcttgtcacggcaatccgcgctgcaaaatccttcctcccctctgtacatgaaaatatccaaaccatgtagttccttcttgcaaagatgacaagaagtcaaaaagccatcactccaaaattccctcttgaactgacccatattgtttttcctaggcgaaggagcagcagtaaacccactgcaattcttgttgtcatctccaaaaccgaactgattcttgatcaaattatcgccaaaatgagaaattacaaaagtgtcgttgtcagataattcatcaaacttctcggagttaaagccacctccgaaactgggagctgctttaacagatgagactataggtatgggggtggatcttggggatggagcaaaacaaatagattggtgtgtatgggttgaatcagtcatagctgctactatgcctagcccaactacaccatattgaaagttgcttgggggtttagtggggtttagacagaaaaaagagtgcgataaagaggtgaagaggttgagattgatggcgggtctcttttttccacaaaaattatgcatgttataggagaattacagcccctaagattgttgggaggggattaaattcatggggtttgttggaccctaatccccccaagaggagagaaacgaaaagtagtgaatcagaagttaagagactgggttctgaagagaaagagagagaagagaggatggcttggcgttgttgtttcaatcagcgctccttgttctgtttatctccctttctctacactcttcttccctcc

SEQ ID NO: 7932 - DNA, 1970 bp, Echinacea purpurea
cggagaattcaatctgcacccatcatagatttcatcgacacccctctttcttctttacttgtatcactcaactgctccgcctactttcttcgacaatttagcttcctctcacttcaatttcgaatatggattcagctgccgtgacattttgcagtaaaccaatcacttctcctccgggtttattcatcgggaggtctagtggaattaagagttcccagtgtaacttcttagctggaaataagttaagctttcctaagcaaagatttcaggcttcccaaaaggctcatagatcagcgaaacgtgatggagcacttggtgtcacttgtcgtcaagaaaaaattctggtggcaaacagaggggaaattgcagtgcgtgtgattcgaactgctcatgagttagggatcccctgtgttgcagtgtactctaccatagacaaggatgcacttcatgtgaaactggctgatgaatcagtttgcataggtgaagctcctagtaatcaatcgtacttgctgatacctaatgtcctctctgctgccatcagtcgtggatgtacaatgttgcatcctggttacggttttcttgctgagaatgctgtttttgttgagatgtgcagagagcatggaatcaacttcattgggccaaatcctgacagcattcgtgttatgggggacaaagcaactgcaagagataccatgaagaatgctggtgttccaactgtacccggaagtgatggtctattacagagcactgaagaaggcatcaggcttgctgacgagattggcttccctgtgatgattaaggctacagcaggtggtggaggtcgtggaatgcgtcttgcaaaagaacgtgaggagtttgtaaagttgttgcagcaagctaaaagtgaggctgcagctgcatttggaaatgatggtgtatatttggagaaatgcattctaaatccaaggcacattgagttccaggttcttgcagacaaatatggaaatgttgttcactttggagagcgtgactgcagcatccagagaaggaaccagaagcttctagaagaagcaccctcaccagcattaaccccagaactgagaaaagccatgggtgatgcagcagttgctgcagcagcatcaatcggctacattggtgttggtactatagagtttcttttggatgaaagaggtgatttttacttcatggaaatgaacactagaatccaggtagagcatcctgtgacggaaatgatatcatcagttgacttgatagaggagcagattcgggtagctatgggtgagaaactccgttacacacaggatgacatcgtgctcagaggacactcgattgaatgccgtattaatgcggaagatgctttcaaaaatttcagacctggaccagggagaataacatcttacttgccatctggaggtccgtttgtgagaatggatagccacgtatataccgattatgttgttccaccaagctatgattctctactcggaaagcttattgtatgggccccaacaagagaaaaggcaattgaacgcatgaaaagggctcttgatgatactatcatcacaggggttccaacgacaatcgagtaccacaagctaattctcgacgtcgaagatttcaaaaacggaaaagttgacactgctttcattccaaagcatgaagacgaattagccgagccacataaatcgagtacaacaaatgctgctaaagaaatcgcaaaggctgtagcttaacgagtgtatggacctatacgcaacaaaatgtattttttgtgtcttaagtcttcgatccccccaaatgtcttgagctaactttatttcaggctgtggcatctgtttaattttttgagagatctatggacaatacattcatcgtttgctaaatgttgattataaatccttgagccaaaatttgtaaacctggatgattttgtttccttgtgcaatctggcgatacacgcacacgcgagc

SEQ ID NO: 7933 - DNA, 2043 bp, Echinacea purpurea
cggccgggggagattttgggcggagaattcaatctacacccatcatagatttcatcgacacccctctttcttctttacttgtatcactcaactgctccgcctactttcttcgacaatttagcttcctctcacttcaattttcgaatatggattcagctgccgtgacattttgcagtaaaccaatcacttctcctccgggtttattcatcgggaggtctagtggaattaagagttcccagtgtaacttcttagctggaaataagttaagctttcctaagcaaagatttcaggcttcccaaaaggctcatagatcagcaaaacgtgacggagcccttggtgtcacttgtcgccaagaaaaaattctggtggcaaacagaggggaaattgcagtgcgtgtgattcgaactgctcatgagttagggatcccctgtgttgcagtgtactctaccatagacaaggatgcacttcatgtgaaactggctgatgaatcagtttgcataggcgaagctcctagtaatcaatcgtacttgctgatacctaatgtcctctctgctgccatcagtcgtggatgtacaatgttgcatcctggttacggttttcttgctgagaatgctgtttttgttgagatgtgcagagagcatggaatcaacttcattgggccaaatcctgacagcattcgtgttatgggggacaaagcaactgcaagagataccatgaagaatgctggtgttccaactgtacccggaagtgatggtctattacagagcactgaagaaggcatcaggcttgctgacgagattggcttccctgtgatgattaaggctacagcaggtggtggaggtcgtggaatgcgtcttgcaaaagaacgtgaggagtttgtaaagttgttgcagcaagctaaaagtgaggctgcagctgcatttggaaatgatggtgtatatttggagaaatgcattctaaatccaaggcacattgagttccaggttcttgcagacaaatacggaaatgttgttcactttggagagcgtgactgcagcatccagagaaggaaccagaagcttctagaagaagcaccctcaccagcattaaccccagaactgagaaaagccatgggtgatgcagcagttgctgcagcagcatcaattggctacattggtgttggtactatagagtttcttttggatgaaagaggtgatttttacttcatggaaatgaacactagaatccaggtagagcatcctgtgacggaaatgatatcatcggttgacttgatagaggagcagattcgggtagctatgggtgagaaactccgttacacacaggatgacatcgtgctcagaggacactcgattgaatgtcgtattaacgcggaagatgctttcaaaaatttcagacctggaccagggagaataacatcttacttgccatctggaggtccgtttgtgagaatggatagccacgtatataccgattatgttgttccaccaagctatgattctctacttggaaagcttattgtatgggccccaacaagagaaaaggcaattgaacgcatgaaaagggctcttgatgatactatcatcacaggggttccaacgacaatcgagtaccacaagctaattcttgacgtcgaagatttcaaaaacggaaaagttgacactgctttcattccaaagcatgaagacgaattagccgagccacataaatcgagtacaacaaatgctgctaaagaaatcgcaaaggctgtagcttaacgagtgtatggacctatacgcaacaaaatgtattttttgtgtcttaagtcttcgatcccccaatctaactttatttcaggctttggcatctgtttaattttttgagagatatatggacaatacattcatcgtttgctaaatgttgattataaatccttgagccaaaatttgtaaacctggatgattttgtttccttgtgcaatctggcgacacacgcacacgcgcgcacagattaatatatgggtgtttgggtttgggttttacacacagatttaggagtctgggttcg

SEQ ID NO: 7934 - DNA, 2518 bp, Panax ginseng
aagcagtggtatcaacgcagagtacgcggggggtccatttcggcggagtattcaatcccatatctccctcgttttcatcgacaccttttctctacttcttcacaaatcacaacaaccctgctttctgtccccaattcgctttcaacttcgatcaaagtttaacagtagatatactgcagaagaagaagcatttgatctgaaaatggactccgcggccatgactttttgtaccaaatctgtttactatcctccaagtttattcgcggggagcgcttgtgggattaaaagctcccagtgtagttttatgataggaagtaaagtgaaattccccaggcaaaaagctcaggcttataaagttagtcgtaaatctgggaaacgagggggtgctctcagtgctacttgtcgtgacgataaaattctggtggcaaacagaggagagattgctgtccgcgtgatacgaactgctcatgagatgggtataccttgtgttgctgtttactcaaccatcgataaggatgcacttcatgtgaaattggccgatgaatcagtttgcattggtgaagcaccaagcagtcaatcgtatttagtggtcccaaatgtcctatccgctgctattagccgtgggtgtacaatgctgcatcctggatatggtttcctttccgagaatgcattgtttgttgaaatgtgcagagagcatggaatcaactttattgggccaaatcctgacagtattcgtgtcatgggtgacaaatcaactgccagggacacaatgaagaatgctggtgttccaactgtaccaggaagtgatggattggtacagagcactgaggaagctattagagttgctgatgagattggctaccctgtgatgattaaggcgacagctggtggtggaggccgtggaatgcgtcttgctaaagagcctgaggagtttgtgaagttattacaggcagctaagagtgaggctgcagctgcatttggaaatgatggggtttatctagaaaagtacatccagaatccaaggcacattgaattccaggttcttgcagacaagtttggtaatgttgttcactttggagagcgtgattgcagtattcagagaaggaatcagaagttgctggaagaagcaccatcccctgccttaacctccgagctgcggaaagccatgggtgatgcagcagttgcagccgcagcatctataggttacattggggttggtactgtcgagttccttttggatgaaagagggtccttttacttcatggaaatgaacactaggatccaggtggagcatcctgtgacagaaatgatttcttctgttgacctgattgaagaacaaatccgtgttgctaggggagagaaactacgttacaaacaggaagatattgtgcttagaggacactcaattgaatgccgtattaacgcagaagatgctttcaaaaatttcagacctgggccagggagaataacagcatacttgccatctggaggtccatttgtgagaatggatagccatgtttatccggattacgttgttccaccgagctatgattccctacttggaaagcttattgtatgggctccgacaagagagagggcaattgcacgcatgaaaagggctcttgatgacaccatcattactggtgttccaacaacaatcgaataccataaacttatccttgaggttgaggatttcaaaaatggaaaggtcgacactgcttttattcctaagcatgaacatgagttggaagcgccccagaagattgtaccagcaacacctgctaaagagcttgcgaacactgcagcctagagggaaaacaagacatcttgggtaggtggagctgatattttttaacagggtggtggtggtttggtctaaatgtattagtttggtctcggctgattttgttcttcatagttgttagaataaaatcccttctttttgctgtcaaatgatgcttatcgcatagatttggatctgaattggatattgtttttgtggttggtcttagaagagcttaactgtactattgaagcatgactaaaacgaatgagaaattcttcatggaatattttaacgggaaatggttagtatgaagtttattttgggataagttgatcagttgactaatagaatactaacacgcaggcgaggttgtatgcgtatcagtattttattggtcaattaactaatttatacaaaaaaataactttcatattaaccggattctttaaactaattacaaacaaaagtttctgttcacttgtgaccacgatttcttctattcgagacaaaagagaagccaaatgtaatttgaacttaaaaaaataaaaaaaaaaaaaaaaaaaaaacaaaaaaaaaaaaaaaaacaaaaaaaaaaaaaaaacaaaaaaaaaaaaaaacaaaaaaaaaaaaaacaaaaaaaaaaaacaaaaaaaagaaaaagaaaagaaaagaaagaaagaaagaaagaagaagaagaagaagacacacacacacacacacacacaacacaca

SEQ ID NO: 7935 - DNA, 3153 bp, Gossypium hirsutum
gtaaccgtagggaaaagtcaagcagaggcaggtgtgggctgatgtccccaaccattttaggcggagaaatcgatcaagtaccgacagtaactctaagcctcgtttccatcgacttcttctccatatctccattcccttaacactcactctctctttcactacacctcattctctcattcttcttcagctcatattctttggcatttgtcgctatggcattggattcttccatgactatgtgcaaatccgtcacctcaccccctggcttattcttgcggagaaatacaagtagtaggagtttccaatgtacctttaaggtgggaagcaggatcaactttcctaggcagaaagctcaggtaacccaagttagatgtaaatccagtaaacgtggaggagccctgggtgccacatgccgtgctgagaaaatcctggtggcaaatagaggagaaatcgctgttcgggtaatccgaactgctcatgagatgggaataccttgtgttgctgtttactcaaccatagataaggatgcacttcatgtaaaattggctgatgaatcagtttgcataggggaagcaccaagcagtcaatcgtatttattgataccaaatgtcctatctgctgcacttagccgtaattgtactatgcttcatccgggatatggtttccttgctgaaaatgcagtttttgtggaaatgtgcagagatcacagaatcaactttattgggcctaatcctgacagtattcgtgttatgggtgacaaatcaactgcccgagaaacaatgaagaatgcaggtgttcctactgttcctggaagtgatggtttgttacagagtacagaggaagcaatcaagctagcacatgagattggctttcctgtgatgatcaaggccacagctggtggtggagggcgtggaatgcgtcttgctaaagaacctgatgagtttgtgaagttactacagcaagccaaaagtgaagctgctgctgcatttggaaatgatggagtttatttggagaagtacatacaaaatcctaggcacattgagttccaggttcttgcagataaatatggtaatgttgttcactttggtgagcgcgattgcagtatccagaggcgtaatcaaaaacttttagaagaagcgccttctccagcattgactccagagttgcggaaagccatgggtgatgcagcagttgctgcggcagcgtctattggttacattggtgtaggaactgttgagtttcttttagatgaaagaggttccttctatttcatggaaatgaacactagaatccaggtggagcatcctgtaacagagatgatttcctttgttgacttgattgaagaacaaattcgtgtagctatgggagaaaaacttcactacaaacaggaagatattgtgctcagagggcattcaattgaatgccgtatcaatgcagaagatgcatttaaagggttcagacctgggccagggagaataacatcatacttgccatctggaggcccatttgttcgaatggacagccatgtttatcctgattacgtagttcctccaagctatgattcattacttggaaagcttatcgtatgggctccaacaagggaaaaagcaattgagcgcatgaaaagggctcttgatgacactgtaattacaggggttcctacaaccattgaataccataaactcatccttgatattgaggacttcagaaatggaaaggttgacactgctttcattccaaaacatgaagaagagttggccgcgccacagaaaatggtattagcaactgctgccaaagaattgactagtgcgagtgcgaccgcttagaaggtttagtattcttcttcttgttctacttcttcagcatactggtataagccatgtagcagtcagcttgttggaaatgttagtaggtgataagtcattcatattcattggtgattcgtggacatggggttcatcaagatcctgttgttcagctgacattctaatacatcgtttattatccttgtgttttttcaactgtcatgtgttattcttgaaacgcaattaataattttcttcatagtggttggaatatacatccccaaaacccggaatttgatatattagtcatttaagtttcaagattttatggatacatttttcaaaatgaagaggaattatatttttacaagctatcattgggatatattaaaatgactacaaaaactatactaagattttcctttcctacatacgataagatttaaagcttggtgaaataagttctctttcagaatggacaaggaagtatcatctatctatttgtccttagagatgctgaaactgaaacggaaagcctccaaaattctgccaagttgcccatctcctttatttgtttgtttattcattaagtatgatgcagtggtagaagttatgcagcggcgacctcggaaaataacacgtgtggggaagactgggagcaatcaagcgcacatatttgtttgtgatcatcacttctaatttgcttgtcacggcaatccgcgctgcaaaatccttcctcccctctgtacatgaaaatatccaaaccatgtagttccttcttgcaaagatgacaagaagtcaaaaagccatcactccaaaactccctcttgaactgacccatattttttttcctaggcgaaggagcagcagtaaacccactgcaattcttgttgtcatctccaaaaccgaactgattcttgatcaaattatcgctaaaatgagaaattacactagtgtcgttgtcagataattcatcaaacttctccaagttaaagccacctccgaaactgggagctgctttaacagatgagactataggtatgggggtggatcttggggatggagcaaagcaaatagattggtgtgtatgggttgaatcagtcatagctgctactatgcctagcccaaccacaccatattgaaagttgcttgggggttttgtggggtttagacagaaaaaagagtgagataaagacgtgaagaggttgagattgatggcgggtctcttttttccataaaaattatgcatgttgtaggagaattacagcccctaagattgttgggaggggattaaattcatggggttgttggaccctaattcccccaagaggagagaaacgaaagtagt

SEQ ID NO: 7936 - DNA, 1926 bp, Ambrosia trifida
atcgacacccccctctttcttccttacttgtattccgttgctctcacactctcttttcgctcaactgctctgcctaatttcttcacaatttatcttcctctctcttaatttcaacgtttgatatggattccgccgccatgacattttgcagtaaaccaatcacatctcctccgggtttgttcattgggaggtctagtggaattaagagttcccagtgtaacttcttagttggaaataagttgagctttcctacgcaaagagttcaggcttcccaaaaggctcatagatcagggaaacgcgagggagcacttggtgtcacttgccgtgcagaaaaaattctggtggcaaacagaggggaaattgctgtgcgtgtgattcgaactgctcatgagctagggatcccctgtgttgcggtgtactctactatagacaaggatgcacttcatgtgaaactggcggatgaatcagtttgcataggggaagctcctagtaatcaatcgtacttgctgatacctaatgtcctctctgctgccatcagtcgtggatgtacaatgttgcatcctggttatggtttccttgctgagaatgctgttttcgttgagatgtgcagagagcatggaataaacttcattgggccaaatcctgacagcattcgtgttatgggggacaaagcaactgcacgagataccatgaagaatgctggtgttccaactgtaccaggaagtgatggtctattacagagcactgaagaaggcatcaggctcgctgacgagattggcttccctgtgatgattaaggctacagcaggcggtggaggtcgtggaatgcgtcttgcaaaagaacgtgatgagtttgtaaagttgttgcagcaagctcagagtgaggctgcagctgcatttggaaatgatggtgtatatttggagaaatgcattataaatccaaggcacattgagttccaggttcttgcagacaaatatggaaatgttgttcactttggggagcgtgactgcagcatccagagaaggaaccagaagcttctagaagaagcaccctcaccagcattaaccccagaactgagaaaagccatgggtgatgcagctgttgctgcagcggcatcaattggctacattggtgttggtactatagagttcttttggatgaaagaggtgattttattttatggaaatgaacactagaatccaggtagagcatcctgtgacggaaatgatatcgtcagttgacttgatagaggagcagattcgggtagctatgggtgagaaactccgttacacacaggatgacatcgtgctcagaggacactcaattgaatgccgtattaacgcggaagatgctttcaaaaatttcagaccaggaccagggagaataacatcttacttgccatctggaggtccgtttgtgagaatggatagccacgtatatacagattatgttgttccaccaagctatgattctctacttggaaagcttattgtatgggccccaacaagagaaaaggcaattgaacgcatgaaaagggctcttgatgatactatcatcacaggggttccaacgacaatcgagtaccacaagttaattctcgacatcgaagattttaaaaacggaaaagttgacactgctttcattccaaagcatgaggacgaattagccgagccgcataaattgagtacttcaaatgctgccatggaaatcgcaaaggctgtagcttaaagagtgtttggacctgtatgcatttaaatgttagaatttttgtttctcaagtctttgatcccccaaatgtcttgagctaactttatttcaggctgtgtcatctgttttaactttttgagagatccatgaataatatattcattgtttgctaaatgttgattataaatccttgtcccaaatttgtaagcctaaatgatt

SEQ ID NO: 7937 - DNA, 1889 bp, Flaveria ramosissima
gcaaccatcatagatttctatcgacacccctcctttcttctattacttgtatttcgttgctcttaacaacactctcgctcaactgctccgcctaatttcttcaaaattcttcatcctctcaatcaatttcaacggttgatataggatatggattccgccgctgtgacattttgcagtaagccgattacgtctcctccgggtttattcgtcgggaggtctagtggaattaagagttcccagtgtaacttcttggtgggaaataagttgagctttcctaagcaaagatttcaggcctctcaaaaggctcatagatcagtgaaacgtgagggagctcttggtgtcacctgccgtgctgaaaaaattctggtggcaaacagaggggaaattgcagtgcgtgtgattcgaactgctcatgagctagggatcccatgtgttgctgtgtactctactatagataaggatgcacttcatgtgaaactggctgatgaatcagtttgtattggggaagctcctagtagtcaatcgtacttgctgatacccaatgtcctctctgctgctatcagtcgtggatgtacaatgttgcatcctggttatggtttccttgctgagaatgctgtttttgttgagatgtgtagagagcatggaatcaacttcattgggccaaatcctgacagcattcgtgttatgggggacaaatcaactgcacgagataccatgaagaatgctggtgttccaactgtaccaggaagtgatggtctattacagagcactgaagaaggcatcaggctggctgatgagattggcttccctgtgatgattaaggctacagcaggtggtggaggccgtggaatgcgtcttgcaaaagaacgtgacgagtttgtaaagttgttacagcaagctaaaagtgaggctgcagctgcatttggaaatgatggtgtatatttggagaaatacattcaaaatccaaggcacattgagttccaggttcttgcagacaaatatggaaatgttgttcactttggggagcgtgactgcagcattcagagaaggaaccagaagcttctagaagaagcaccctcacccgcattaaccccagaactcagaaaagccatgggtgatgcagcagttgccgcagcagcgtcaattggctacattggtgtcggtaccgtagagtttcttttggatgaaagaggtgaattttacttcatggaaatgaacactagaatccaggtagagcatcctgtgacggaaatgatatcctcagttgacttgatagaggaacagattcgggtagctatgggtgaaaaactccgttacacacaggatgaaatcgtgctcagaggacactcgattgaatgccgtattaatgcggaagatgctttcaaaaacttcagacctggaccagggagaataacatcttacttgccatctggaggtccatttgtgagaatggatagccacgtatacactgattatgttgttccaccaagctatgattctctacttggaaagcttattgtatgggctccaacaagagaaaaggcaattgaacgcatgaaaagggctcttgatgataccatcatcacaggagttccaacaacaattgagtaccacaagctaattcttgacgtcgaagatttcaaaaacgggaaagtcgacactgcttttattccaaagcacgaggacgaattagctgagccacagaaattgagtacatcaaatgctgctaaagaagtcgcaaaggctgtagcttaaagagtgtttagccctcgttttctgtatgcaacaaaatgttaccttttgtttatcaagtctttgatgctaccaaatgtcttgatataacattcagcctgtggcatccgtttgattttttgagagttccatggacg

SEQ ID NO: 7938 - DNA, 2154 bp, Prunus mume
atttgggcggaggtttcaatcggtaactcccctcgtttccatcgacaaactcaactcttgatatcttccctcggaccttgccaccttcttcttcacattgttcacactctttttctctccctttctgctttctcgctccacagctcttggggtccccaaacactttccttcttcttcattcattcattctgatcctgttctgagacaattgagaaaggtctctttgttttcaaaatggatgccacaatgcccatttgcaagattgtcactccaactcctggcttattttttgggagaactagagagatccagagttcccaatgcagctttatggtgggaaataaagtcaactttttaaggcagagagcttggggtgctcaagttactttcaaatccaggaagcatgggggagctctccatgctacatgtgctgaaaaaattctggtggcaaatagaggagaaattgctgttcgcattattcgaactgcccatgaaatgggaataccttgtgtggctgtttactcaacaatagacaaggacgcactgcatgtgaaattggctgatgaatcggtttgtattggtgaagcagcaagcagtcaatcgtacttagttgttccaaatgttttatctgctgctatcagtcggaaatgtacaatgctgcatccaggatacggtttccttgctgagaatgcatcatttgttgaaatgtgcagagaacacggaatcaactttattgggcctaagccggacagcatccgtgttatgggtgataaagcgactgccagagacacaatgaagacagcaggtgttccaactgtaccaggaagtgatggattactacagagcacagaggaaggaatcaggcttgcagatgagattggttttcctgttatgatcaaggcaacggcaggaggtggaggacgtggcatgcgtcttgctaaagaacctgaagagtttgtgaagttgctacagcaagcaaagagtgaggctgcagctgcttttggaaatgatggagtttacttggaaaagtacatccaaaatcctagacacattgaatttcaggttcttgcagataaatatggtaatgttgttcactttggagagcgggattgcagtatccagagaaggaaccaaaagctgctggaagaagcaccctcccctgcattgaccccagagttgcgtaaagctatgggtgatgcagcagttgccgcagcagcatcgattggttacattggtgttggaaccgttgaattccttttggatgaaagaggttccttttacttcatggaaatgaacactcgtattcaggttgagcatcctgtgacagagatgatttcctctgttgacttgattgaagaacaaattcgtgtagctatgggagaaaaacttcgatacacacaggatgagatagtgctcagaggacattcaattgaatgtcgtatcaatgcagaagatgcttttaaagggttccgacctgggccaggaagaataaccgcctacttaccatctggaggtccctttgttagaatggatagccatgtttatcctgattatgtggttcctccaaactacgactcccttcttggaaagcttattgtttgggcaccaacaagagaaaaggcaattgagcgaatgaggagggctcttgatgacactattataacaggggttcccacaaccattgaatatcataaacttatccttgatgtagaggatttcaaaaatggcaaggttgatactgcttttattccgaagcatgaagaggagctcgcagcgccccaacatttggtgcctgcagcccctgccaaagaactagctggtgcatctgcttagatggatggagctcgagttgctaccgtctggtcaagtcacccactacatttaaaaagcggcaaatcattcacttttttgtattttagttatttaatttgtgttaatgttgttacttttatagcactagtaacattgacatgccttgcatttcatgtgagaattccctttggaattttgatatgttctgtttcaactgggtgtactgtgtacaaacctgtattgctccctatatatgtagaaatgatgatgaggatttgcaaactatccatattaataagcaaagatgcttccttcattgttaggctcaatcctaaaatacca

SEQ ID NO: 7939 - DNA, 1923 bp, Flaveria ramosissima
gggaagcatcatagatttcatcgacatcctcttcttcattacttgtatttcgttgctcttcacacactctcgctcaactgctccgcctaatttcctcaaaattcttcatcctctcgatcaatttcaacggttgatataggatatggattccgccgccgtgacattttgcagtaagccgattacgtctcctccgggtttattcattgggaggtctagcggaattaagagttcccaatgtaacttcttgacgggaaataagttgagctttcctaagcaaagatttcaggcttcacaaaaggcccatagatcagtgaaacgtgagggagctcttggtgtgacttgccgtgctgaaaaaattctggtggcaaacagaggggaaattgcagtgcgtgtgattcgaactgctcatgagctagggatcccctgtgttgcagtgtactctactatagataaggatgcacttcatgtgaaactggctgatgaatcagtttgcataggggaagctcctagcagtcaatcgtacttgctgatacccaatgtcctctctgctgctatcagtcgtggatgtacaatgttgcatcctggttatggtttccttgctgagaatgctgtttttgttgagatgtgcagagagcatggaatcaacttcattgggccaaatcctgacagcatacgtgttatggggacaaatcaactgcacgagacaccatgaagaatgctggtgttccaactgtaccaggaagtgatggtctattacagagcactgaagaaggcatcaggctggctgatgagattggcttccctgtgatgattaaggctacagcaggtggtggaggccgtggaatgcgtcttgcaaaagaacgtgacgagtttgtaaagttgttacagcaagctaagagtgaggctgcagctgcatttggaaatgatggtgtatatttggagaaatacattcaaaatccaaggcacattgagttccaggttcttgcagacaaatatggaaatgttgttcactttggggaacgtgactgcagcattcagagaaggaaccaaaagcttctagaagaagctccctcaccagcattaaccccagaactgagaaaagccatgggtgatgcagcagttgctgcagcagcatcaattggctacattggtgttggtactgtagagtttcttttggatgaaagaggtgaattttacttcatggaaatgaacactagaatccaggtagagcatcctgtgacagaaatgatatcctcagtcgacttgatagaggaacagattcgggtagctatgggtgagaaactccgttacacacaggatgaaatcgtgctcagaggacactcgattgaatgtcgtattaatgcggaagatgctttcaaaaatttcagacctggaccagggagaataacatcttacttgccatctggaggtccatttgtaagaatggatagccatgtatacacggattatgttgttccaccaagctatgattctctactcggaaagcttattgtatgggctccaacaagagaaaaggcaattgaacgcatgaagagggctcttgatgatactatcatcacaggggttccaaccacgatcgagtaccacaagctaattcttgacatcgaggatttcaaaaacgggaaagttgacactgctttcattccaaagcacgaggacgaattagctgagccacagaaattgagtacatcaaatgctgctaaagaagtcgcaaaggctgtagcttaaagtgtgtttggccctcatttttctgtatgaaacaaaatgttactttttgtttatcaagtctttgatcctaccaaatgtcttgagatgactttcagcctgtggtatccgtttaattttttgagagttccatggacgataaaatgattatttgttaaaagtttgattattaaatac

SEQ ID NO: 7940 - DNA, 2031 bp, Vitis vinifera
atgagatttattattataatatatttgcaagcaaatatagaggcggagcattcaatctcccactctcctcgttcttatcgacgctttcttcttcaaatctcaacccccctttctctctctctatctgcatttcttctctcaaaccttccattgttctctgcatttccattgggttttggttcggagatggagacgaccatgaatgtttgcaaatctgtaatctcgcctccaggtttatttgtggggacacctcaaggaatcaggagttctcaatgtagttttatggtgggaaagaaggtgaactttcctaggcaagtagctcaggttgcacgagttcgcagtaagtctaagaaacatgggggagctctaggtgctacatgtcgtaatgacaaaatcctggtggcaaacagaggagaaattgctgtgcgtgtgattcgaacagctcatgagatggggataccttgtgttgcagtttactcaaccatagacagggatgcgcttcatgtaaaattggctgatgaatcagtttgcataggtgaagcaccaagcagtcaatcgtatttattgatcccaaatgttctatcagctgcaataagtcatggatgtacaatgcttcaccctggatatgggttccttgctgaaaatgcaacttttgttgaaatgtgcagagagcatggaatcaactttattggacctaatcctgacagtattcgtgttatgggtgacaaatcaactgctagagacacaatgaagaatgccggagttcctactgtaccaggaagtgaaggattgttaaagagcacagaagaaggtatcaagcttgccaatgagattggctatcctgtgatgatcaaggcaacagctggtggtggaggacgtggaatgcgccttgctaaagaacctgatgagtttgtgaaattgttacagcaagcaaagagtgaagctgcagctgcatttggaaatgatggagtttatctggaaaaatacattcaaaatccaaggcacattgagttccaggttcttgcagataagtttggaaatgtggtccactttggagagcgtgattgcagcattcagagaaggaaccagaagctcttggaagaagcaccgtctcctgcattgacctcagagttgcggaaagccatgggtgatgcagcagttgcagcagcagcatccataggttatattggtgttggaacggttgagttccttttggatgaaagaggttccttttactttatggaaatgaatactaggatccaggttgagcatcctgtgacagaaatgatttcgtctgttgacttgattgaggaacaaattcgtgtagctatgggagagaaacttcactacaaacaggaagacattgtgcttagaggtcattcaattgaatgccgtattaatgctgaggatgcttttaaaaacttcagacctgggccagggagaataacagcatacttgccggctggaggcccatttgtgagaatggatagccatgtttatcctgattatgtggttcccccaagctatgattcccttcttggaaagcttattgtatgggctccaacaagggagagggcaattgaacgcatgaaaagggctcttaatgatactgttattacaggggttcctacaaccattgattaccataaacttatacttgatattgaggacttcagaaatggcaaggttgatacagcctttattcctaagcatgaggaggagttagcagcgcccctagcaattgtgaatgcgacagtagcttgaatttataggcgggatctgtcgtagttgaagcagagtcatgttggaattggtagaacgtttacaacaggaaacattgttgctttcacggtctcattttttcctttagaataagaagcttttgtttatttagtacagtgaattgtaagaggatgtttgttttatgtttggggaaaaagaaaattggtgtgttgttgaaatgaaaatgattttgacgaggttagccgtgctgccacccagcctttgcgtatgctcaatcttatgcattct

SEQ ID NO: 7941 - DNA, 2358 bp, Vitis vinifera
aattaggtggtttgcaagtgaaccaccacaacgctgacgcgtcaatatctaattggagagctgagaaagcaagcagcaggttacctccaaggcaacaaggcttcttaacttgtatacaagttgcaagcaaatatagaggcggagcattcaatctcccactctcctcgttcttatcgacgctttcttcttcaaatctcaacccccctttctctctctctatctgcatttcttctctcaaaccttccattgttctctgcatttccattgggttttggttcggagatggagacgaccatgaatgtttgcaaatctgtaatctcgcctccaggtttatttgtggggacacctcaaggaatcaggagttctcaatgtagttttatggtgggaaagaaggtgaactttcctaggcaagtagctcaggttgcacgagttcgcagtaagtctaagaaacatgggggagctctaggtgctacatgtcgtaatgacaaaatcctggtggcaaacagaggagaaattgctgtgcgtgtgattcgaacagctcatgagatggggataccttgtgttgcagtttactcaaccatagacagggatgcgcttcatgtaaaattggctgatgaatcagtttgcataggtgaagcaccaagcagtcaatcgtatttattgatcccaaatgttctatcagctgcaataagtcatggatgtacaatgcttcaccctggatatgggttccttgctgaaaatgcaacttttgttgaaatgtgcagagagcatggaatcaactttattggacctaatcctgacagtattcgtgttatgggtgacaaatcaactgctagagacacaatgaagaatgccggagttcctactgtaccaggaagtgaaggattgttaaagagcacagaagaaggtatcaagcttgccaatgagattggctatcctgtgatgatcaaggcaacagctggtggtggaggacgtggaatgcgccttgctaaagaacctgatgagtttgtgaaattgttacagcaagcaaagagtgaagctgcagctgcatttggaaatgatggagtttatctggaaaaatacattcaaaatccaaggcacattgagttccaggttcttgcagataagtttggaaatgtggtccactttggagagcgtgattgcagcattcagagaaggaaccagaagctcttggaagaagcaccgtctcctgcattgacctcagagttgcggaaagccatgggtgatgcagcagttgcagcagcagcatccataggttatattggtgttggaacggttgagttccttttggatgaaagaggttccttttactttatggaaatgaatactaggatccaggttgagcatcctgtgacagaaatgatttcgtctgttgacttgattgaggaacaaattcgtgtagctatgggagagaaacttcactacaaacaggaagacattgtgcttagaggtcattcaattgaatgccgtattaatgctgaggatgcttttaaaaacttcagacctgggccagggagaataacagcatacttgccggctggaggcccatttgtgagaatggatagccatgtttatcctgattatgtggttcccccaagctatgattcccttcttggaaagcttattgtatgggctccaacaagggagagggcaattgaacgcatgaaaagggctcttaatgatactgttattacaggggttcctacaaccattgattaccataaacttatacttgatattgaggacttcagaaatggcaaggttgatacagcctttattcctaagcatgaggaggagttagcagcgcccctagcaattgtgaatgcgacagtagcttgaatttataggcgggatctgtcgtagttgaagcagagtcatgttggaattggtagaacgtttacaacaggaaacattgttgctttcacggtctcattttttcctttagaataagaagcttttgtttatttagtacagtgaattgtaagaggatgtttgttttatgtttggggaaaaagaaaattggtgtgttgttgaaatgaaaatgattttgacgaggttagccgtgctgccacccagcctttgcgtatgctcaatcttatgcattctgacatattaagcctaaccatttcttctttggctgggttggatctcaggaacaaaccacacaccacactttttgcaattcactatttacaaaattaggcttttcatgtttggtgggttgtgtaaatgggtcaatctaaacacaacatacatgaataataattaagttaaaaacatgaatctgaataccatctaattattaattattaaagaagtaacatgtcttaaatgggg

SEQ ID NO: 7942 - DNA, 1777 bp, Camellia sinensis
acctctgtctctctgtctctctctctctctctctctctaactttgatcagaatttctcattgaagggaatctgatttggaaatggattccgccttaactttttgcaaatctgtccactcacctcctggtttatttgtggggagatctagaggaattcagagcccccaatgtagcgttatggtgggaagtagggtgaactttccacggcagagtgtccgggttgctcaaattagtcgtaaatctgagaaacgaggaggagccctttgtgctacttgtcgtgatgaaaaaattttggtgataaatagaggagaaattgccgttcgtattattcgaactgctcatgagatgggaataccttgtgttgcagtttactcaaccatagacaaggatgcacttcatgtaaaactggccgatgaatcagtatgcataggtgaagcaccaagtagtcaatcgtacttagtgatcccaaatgtcctgtcggctgcgatcagtcgtgggtgtacaatgctgcatcctggatatggtttccttgctgagaatgcagtttttgttgaaatgtgcagagagcatggaatcaacttcattgggccaaatcctgacagtatacgtgtgatggttgacaaagcaacggccagggagacaatgaagaatgctggtgttccaactgtaccaggcagtgaggggttgttgcagaatacagaagaagctgttaggctttctgaggagattggctttcctgtgatgatcaaggcaacagctggtggtggaggacgtggaatgcgtcttgctaaagaacctgatgagtttgtgaagttgttacagcaagccaagagtgaggctgcagctgcatttggcaatgatggtgtttatttggagaagtacatccaaaatccaaggcatattgagttccaggttcttgcagacaagtttggtaatgtagttcactttggagagcgtgattgcagtattcagagaaggaatcagaagctgctggaagaagcaccctcacctgcattaacgccagagttgcggaaagccatgggtgatgcagcagttgcagcagcagcgtcaataggatacatcggtgttggtactgttgagttccttttggatgaaagaggttcgttttatttcatggaaatgaatactcgaatccaggttgagcatcctgtgacggaaatgatttcctctgttgacctgattgaagaacagatccgtgtagctatgggagaaaaacttcgttacaaacaggaagatattgtgcttagaggacattcaattgaatgtcgcattaatgctgaagatgcttttaaaaatttcagacctgggccagggagaataacagcgtacttgccatctggaggtccatttgtgagaatggatagtcatgtctatcctgattacgtggttccaccaagctatgattccctacttggaaagcttattgtatgggctccaacaagagagagagctattgaacgcatgaaaagggctcttaatgacactataattataggagttccaacaacaattgactaccacaaacttatcctagacgttgaggacttcaaaaatggaaaagttgatactgcttttattccgaagcatgaacaagaattagctgcgccccagaaaatggtaccagcaactcctgctaaagagctgaccaaggctactgcttaaaagggatctcttattcaagattggagcaggttcttttattaggtttatcagagcctagcgataggtttgagcaagaagattgctagtgtggtcc

SEQ ID NO: 7943 - DNA, 1986 bp, Citrullus lanatus
aattaggtgtgggcggagcttcctatcaaagcctctctcgttttcatcgccactattttcctctttcctacaaatctcaactcctcctctctcccatttcttcgcttccgtttctgtttccttttcatttcactcgctttccctttccatctcaaccatggacgccgcaatgcctctctgcaaatctgctcgcgctccctctctcactggtttatttgctgggactactaatggattgaggagctctcaatgtaccttcatgggtgcaaagaaagtcagttttcctagacagagagctactggagtgcaatatagtcgtaaatcgtggaagaatgggagaggtcttcaagttatgtgccgtgcggataaaattttggtggctaatagaggagaaattgcggttcgtattataagaactgctcatgaattgggaattccttgtgtggctgtgtactcaaccattgacaaggacgcactccacgtaaaattggctgatgaatctgtgtgcattggtgaagcaccaagcagccaatcgtacttagtgatcccaaatgtcctctctgctgccatcagtcggggatgtacaatgctgcatcctggatatggcttccttgctgagaatgcagtatttgttgaaatgtgcagagaacatggaatcaattttattggacctaatcctgacagcatccgagttatgggtgacaaatcaactgccagagatactatgaaaaaagcaggtgtaccaactgttccaggaagtgatggtcttttacagagcaccgaagaagcaatcaaacttgcacaggaaattggctatcctgttatgatcaaggcaacagcaggtggtggaggacgtggcatgagacttgctaaagagcctgatgaatttgtgaagttgttgcagcaagccaagagtgaggctgcagctgcatttgggaatgacggtgtttatcttgaaaagtatgtccaaaatccaaggcatattgagtttcaggttcttgcagataagtatggaaatgttgttcattttggagagcgtgattgcagcattcagagacggaaccaaaagcttctagaggaggcaccatctcctgccttaacccccgagttaaggaaggctatgggtgatgcagcagttgccgctgctgcctctataggttacattggggttgggacgattgagttcttgttggatgaaagaggctccttctacttcatggaaatgaacactcggatccaggtcgagcatcctgtgacggaaatgatatcctctgttgacttgattgaggaacaaattcgtgtagctatgggagaaaaacttcggttcaaacaggaagatattgtactcagaggacactcaattgaatgccgtatcaatgcagaggatgcctttaaagggttccgccctggaccaggaagaattacagcatacttaccgtcaggaggaccatttgttaggatggatagccatgtgtatactgattatgtagtgcctccaagctatgattctcttcttggaaagcttattgtttgggctccaacaagagagaaggcaattgagcgaatgaaaagggctcttgacgatactattattacaggggttcctacaaccattgaataccacaagctaattcttgatgtagaggatttcaagaatggcaaggtggatactgcgtttattcctaaacacgaacaggaattagctgcgcctcagaaaatggtggtagccaaagatctagccaacgcagttgcttaaaaaaggattcttctcagctcagtttagttcagctttatttatgcttagaaagcttctttttttcttttggccacattttggtgttagtagcacgagttccaccatttttttctttaaatctttcctcgtccctgctgtatgtgagcttttttgtttgttttttggtactagaaaaagatacttcgttttaacatagtatttataaaatacacccataccatgtctattct

SEQ ID NO: 7944 - DNA, 2053 bp, Panax ginseng
aagcagtggtatcaacgcagagtacatggggaagcaccagctacattaagcattagcggtccatttcggcggagtattcaatcccatatctccctcgttttcatcgacaccttttctctacttcttcacaaatcacaacaaccctgctttctgtccccaattcgctttcaacttcgatcaaagtttaacagtagatatactgcagaagaagaagcatttgatctgaaaatggactccgcggccatgactttttgtaccaaatctgtttactatcctccgagtttattcgcggggagcgcttgtgggattaaaagctcccagtgtagttttatgataggaagtaaagtgaaattccccaggcaaaaagctcaggcttataaagttagtcgtaaatctgggaaacgagggggtgctctcagtgctacttgtcgtgacgataaaattctggtggcaaacagaggagagattgctgtccgcgtgatacgaactgctcatgagatgggtataccttgtgttgctgtttactcaaccatcgataaggatgcacttcatgtgaaattggccgatgaatcagtttgcattggtgaagcaccaagcagtcaatcgtatttagtggtcccaaatgtcctatccgctgctattagccgtgggtgtacaatgctgcatcctggatatggtttcctttccgagaatgcattgtttgttgaaatgtgcagagagcatggaatcaactttattgggccaaatcctgacagtattcgtgtcatgggtgacaaatcaactgccagggacacaatgaagaatgctggtgttccaactgtaccaggaagtgatggattggtacagagcactgaggaagctattagagttgctgatgagattggctaccctgtgatgattaaggcgacagctggtggtggaggccgtggaatgcgtcttgctaaagagcctgaggagtttgtgaagttattacaggcagctaagagtgaggctgcagctgcatttggaaatgatggggtttatttagaaaagtacatccagaatccaaggcacattgaattccaggttcttgcagacaagtttggtaatgttgttcactttggagagcgtgattgcagtattcagagaaggaatcagaagttgctggaagaagcaccatcccctgccttaacctccgagctgcggaaagccatgggtgatgcagcagttgcagccgcagcatctataggttacattggggttggtactgtcgagttccttttggatgaaagagggtccttttacttcatggaaatgaacactaggatccaggtggagcatcctgtgacagaaatgatttcttctgttgacctgattgaagaacaaatccgtgttgctaggggagagaaactacgttacaaacaggaagatattgtgcttagaggacactcaattgaatgccgtattaacgcagaagatgctttcaaaaatttcagacctgggccagggagaataacagcatacttgccatctggaggtccatttgtgagaatggatagccatgtttatccggattacgttgttccaccgagctatgattccctacttggaaagcttattgtatgggctccgacaagagagagggcaattgcacgcatgaaaagggctcttgatgacaccatcattactggtgttccaacaacaatcgaataccataaacttatccttgaggttgaggatttcaaaaatggaaaggtcgacactgcttttattcctaagcatgaacatgagttggctgcgccccagaagattgtaccagcaacacctgcttaagagcttgcgaacactgcagcctagagggaaaacaagacatcttgggtaggtcgagctgattttttgaacagggggtggtggtgacagtttttggtctaaatgtattagtttggtctcggctggttttgatcttcatagttgttagaataaaatccttctttttgctgtcaaatgatgcttatcgcatagaattggatattgtttgtggttggtcttagaaattacatactataagagtagc

SEQ ID NO: 7945 - DNA, 1918 bp, Cichorium intybus
gggggatttgggcggagaattcaatctgcgaccgtcatagattttatcgacacccctctttcttcattagttgtacttcattgttctcacactctctcgctcaactgctgcgcctaattcttgaaaagttgcctgcctctcgataatttcggacgtttggtataagacatggattccgccgccatgacattttgcagtaaaccaatcacctctcctccgggtttattcatcgggaggtctagtggaatcaagagctcccagtgtagcttcttggtgggaaacaaggtcaactttcctagacagagagttcaagcatctcaaaaggctcgtaaatcagggaaacatgaaggagcacttggtgccacttgtcgtgctgaaaagattctgatagcaaacagaggtgaaatcgcggtgcgagtgattcgaaccgctcatgaaatggggattccctgtgttgcagtgtactcaactatcgataaggatgcacttcacgtgaaactagctgatgaatcagtttgcataggggaagctcctagtagtcaatcgtacttgttgatacccaatgttctgtctgcagctatcagtcatggatgtacaatgttgcatcctggttatggtttccttgctgaaaatgctgtttttgttgagatgtgcagagggcatggaattaatttcattggtccaaatcctgacagtattcgagtcatgggagacaaagcaactgctagagataccatgaagaatgctggcgttccatgtgtacctggaggtgaaggtctattacagagcacagaggaaggcatcaagcttgctgatgagattggctaccctgtgatgattaaggctacagcaggtggtggtggtcgtggaatgcgtcttgcaaaagagcgtgatgagtttgtgaaattgttgcagcaagcccagagtgaggctgcagctgcatttggaaatgatggtgtttatttagagaaatacatccaaaacccaaggcacattgagttccaggttcttgcagataaatatggaaatgttgttcactttggagagcgtgactgcagtattcagagaaggaaccagaagttgcttgaagaagcaccttcacctgcattaaccccagagcttagaaaagccatgggcgatgcagcagttgctgcagcagcatcaattggatacattggtgttggtactgtagagtttcttttggatgaaagaggttcattttacttcatggaaatgaacactagaatccaggtcgagcatccagtgaccgaaatgatatcttcggttgacttgatagaggaacaaatccgtgttgctatgggcgaaaagctccgttacacacaggaggatattgttcttagaggccactcgattgaatgccgtatcaatgctgaagatgctttcaaaaatttcagacccggaccagggagaattacatcttatttgccatctggaggtccatttgtgagaatggatagtcatgtctataccgattacgttgttccaccaagctatgattctctacttggaaagcttatcgtatgggccccaacaagagaaaaggcaattgaacgcatgaagagggctcttaatgacactattatcacaggggttccaacgacaatcgagtaccacaagctaatccttgagatcgaagacttcaaaaacggaatagtggatactgcttttattccaaagcacgaggaagaattagctgagccacagccacagccacagccacgcaagttgattacctcaacttctactaaagaagtctcaaatgctgtagcttaaagagtgatatgttccgtatttttctgtatgaaaaaatgttacttatttttgtcagaaataactttcaagctgtggtatccctttgattttttgagattgaatgagtttaatcgacaatttatcg

SEQ ID NO: 7946 - DNA, 1747 bp, Flaveria ramosissima
aaccttcacacactctcgctcaactgctccgcctaatttcctcaaaattcttcatcctctcgatcaatttcaacggttgatataggatatggattccgccgccgtgacattttgcagtaagccgattacgtctactccgggtttattcgttgggaggactagtggaattaagagttcccagtgtaacttcttggtgggaagtaagttgagctttcctaagcaaagatttcaggcctctcaaaaggctcatagatcagttacacgtgagggagctcttggtgtcacctgccgtgctgaaaaaattctggtggcaaacagaggggaaattgcagtgcgtgtgattcgaactgctcatgagctagggatcccctgtgttgctgtgtactctactatagataaggacgcacttcatgtgaaactggctgatgaatcagtttgtattggggaagctcctagtagtcaatcgtacttgctgatacccaatgtcctctctgctgctatcagtcgtggatgtacaatgttgcatcctggttatggtttccttgctgagaatgctgtttttgttgagatgtgcagagagcatggaatcaacttcattgggccaaatcctgacagcattcgtgttatgggggacaaatcaactgcacgagataccatgaagaatgctggtgttccaactgtaccaggaagtgatggtctattacagagcactgaagaaggcatcaggctggctgatgagattggcttccctgtgatgattaaggctacagcaggtggtggtggccgtggaatgcgtcttgcaaaagaacgggacgagtttgtaaagttgttgcagcaagctaaaagtgaggctgcagctgcatttggaaatgatggtgtatatttggagaaatacattcaaaatccaaggcacattgagttccaggttcttgcagacaaatatggaaatgttgttcactttggggagcgtgactgcagcattcagagaagaaaccagaagcttctagaagaagcaccctcaccagcattaaccccagaactgagaaaagccatgggtgatgcagcagttgccgcagcagcatcaattggctacattggtgttggtactgtagagtttcttttggatgaaagaggtgaattttacttcatggaaatgaacactagaatccaggtggagcatcctgtgacggaaatgatatcctcagttgacttgatagaggaacaaattcgggtagctatgggtgagaaactccgttacacacaggatgaaatcgtgctcagaggacactctattgaatgccgtattaatgcggaagatgctttcaaaaatttcagacctggaccagggaaaataacatcttacttgccatctggaggtccatttgtaagaatggatagccacgtatacaccgattatgttgttccaccaagttatgattctctacttggaaagcttattgtatgggctccaacaagagaaaaggcaattgaacgcatgaaaagggctcttgatgataccatcatcacaggggttccaacaacaatcgagtaccacaagctaattcttgacatcgaagatttcaaaaacgggaaagtcgacactgctttcattccaaagcacgaggacgaactagccgagccacagaaattgagtacatcaaatgctaaagaagtcgcaaagactgtagcttaaagagtgtttgaccctcacttttctgtatgcaaaaaatgttactttttgtttatc

SEQ ID NO: 7947 - DNA, 2131 bp, Quercus alba
attttggatcagaacacgtccattgttgttcccattccagaggcattttctccttttgctctggaaacaatggatgccacactgcctttttgcaaatctgtcacctcaactcctggtttatttgtggggacgagtagaggaatcagagctgcttcccaatgtagctttatggtgggaaatagtagagtgaactttccaaggcaaagagctgagtgtgcacaagttggaagttacaaagctaagaagcgtggaggagctctccatgctacatgtcgtgctgagaaaattctgattgcgaatagaggagagattgccgttcgggtcattagaactgctcatgagatggggataccttgtgtggctgtttactcaaccattgacaaggatgcactccatgtgaaattggctgatgaatcggtttgcattggtgaagcaccaagcaatcagtcgtatttattaattcaaaatgttctatccgctgctatcagccgtaagtgtacaatgctgcatcctggatatggcttccttgctgagaatgcagtatttgttgaaatgtgcagagaacatcgaatcaactttatcgggcctaatcctgacagtatccgtgttatgggtgacaagtcaactgctagagaaacaatgaagaaagcaggtgttccaactgtaccaggaagtgatggattgttgcagagtacggaagaagcaatcaagcttgccaatgagattggatatcctgttatgatcaaggcaacagctggtggtggtggccgtggcatgcgtctagctaaagaacctgaggaatttgtgaagttgctacagcaagccaagagtgaggcagcagctgcatttggaaatgatggagtttatttggagaagtacattcaaaatccaaggcacattgagttccaggttcttgcagataaatttggtaatgtcgtccactttggagagcgtgattgcagcatccagagacggaatcaaaagctgctggaagaagcaccctctcctgcattgaccccagagttgcggaaagccatgggtgatgcagcggttgcagcagcagcatctataggatacattggtgttggaacggttgagttccttttggatgaaagaggttccttctactttatggaaatgaacactcgtatccaggttgagcatcctgtgacagaaatgatctcctctgtggacttgattgaggaacaaattcgtgtagctatgggagaaaaactccggtacaaacaggaagatattgtgctcagaggacactcaattgaatgccgtatcaatgcagaagatgcctttaaaggattccgacctggaccagggagaataacagcatatttgccatctggaggtccatttgttagaatggatagccatgtttatcctgactatgtggttcctccgagctatgattcccttcttggaaagcttattgtatgggctccaactagagaaaaggcaattgagcgcatgaaaagagctcttgatgacactattattacaggggttccaacgaccattgaataccataaacttatacttgaagtggaggatttcaaaaatggcaaagttgatactgcttttatcccgaagcacgagcaggaattagcagcgccccagaacctggtgccaacaacttcaggcaaagaactagctggcacagctgcttagatggattgtttgctctggtatttcagtcttttctcagttccagttctaacaaatcaaaatggttgcttgctattggtattggtggaaggaggaaataccgagtgttgtcatgatgatgcaaaagcctaatgctagatgttgaattttttccattgagcatcctgagtgcaaaggtccttgttttttgggatctaatgcaccttttctgacaggaaaagcatgtaaacttggtgtgcttcttgccagctttggctataactaggcttgtatcctccaatgtttagcttcataccaaatttaattattaacgttttgtttttgagaatgaaaggaaattataaaggtagcaacactttatagagccgcattagtgttcaataatatgagcaaatattcaatacacctcgacttgtctttttggcacatgatatgaggctatgagttaaaacct

SEQ ID NO: 7948 - DNA, 2103 bp, Malus domestica
cttacttatgagtgttttaagtacaccttcacggcatcggaacaccgccaccgcagtggctgtgtagtagccgtgcaatctaactagctctcctccgtcagccgtcctccactcctcttcctcccttcaccgcccagctcggcccacactcctccttcttcttcattggcaatttggcattgtcaacagcaacaacagtaacctaaactcattgtaaggtcgctttgtttcgaaaatggacgccacaatgcccatctgcaagactgtcacgccaactccgggcttattttttgggagaactagagagatccgcagttctcaatgtagctttatggtgggaaataaagtcaactttttaaggcagagagttcagggtgctcaagttagtgttaaatccagaaagcatgggggagctcttcatgctacatgtcatgctgaaaaaattctggtggcaaatagaggggaaattgctgttcgcgttattcgaacagcccatgagatgggaataccttgtgtggctgtttactcaacaatagacaaggatgcacttcatgtgaaattggctgacgaatcagtttgtattggtgaagcagcaagcagtcaatcgtacttagttgttccaaatgttttatctgctgccatcagtcggaaatgtacaatgttgcatccaggatatggtttcctttctgagaatgcatcatttgttgaaatgtgcaaagaacatggaatcaattttattgggcctaagcccgagagcatccgtgttatgggtgataaatcgactgccagagacacaatgaagaaagcaggtgtcccaactgtacctggaagtgatggattactacagagcacagaggaaggaatcaggcttgcagatgagattggttttcctgtaatgatcaaggccacagcaggaggtggaggacgtggcatgcgtcttgctaaagaacctgaggagtttgtgaagttgttgcagcaagcaaagagtgaggctgcagctgcttttggaaatgatggagtttatttggaaaagtacatccaaaatcctagacacattgagtttcaggttcttgcagataaatatggtaatgttattcactttggagagcgggattgcagcatccagagaaggaaccaaaagcttctggaagaagcaccttcccctgcattgaccccagaactgcggaaagctatgggtgatgcagcagttgcagcagcagcatcaattggctacattggtgttggaaccgttgaattccttttggacgaaagaggttccttttacttcatggaaatgaacactcggattcaggttgagcatcctgtgacagaaatgatttcctctgttgacttgattgaagaacaaattcatgtggctatgggtgaaaaactccgatacacacaggaagatatagtgctcagaggacattcaattgaatgccgtatcaatgcagaagatgcttttaaaggattccgacctgggccaggaagaataacagcctacttaccatctggaggtccctttgttcgaatggatagccatgtttatcctgattatgtggttcctccaaactatgattcccttcttggaaagcttattgtttgggcaccaacaagagaaaaggcgattgagcgaatgaagagggctcttgacgacactgttataacgggggttcccacaaccattgaataccataaacttatccttgacatagaggatttcaaaaatggcaaggttgatactgcttttattccaaagcatgaagaggagctacaagcgccccaacatttggtgcccgcggccgccgccaagaactagctggtgcatctgcttacatggatggctctctaattgccaccatctggtctagtcgaccacatttaaacggcaaatctttcgcttttttgtacgagttatataattccgtgtctttttatacttattagaactaataacattattcgcatgccttgcatttgagtatttcatttgaaattttgacatgttacatgcgtttcagttgggtgtacaaacttgtattgctcaccctatgtgtatttgcatactatttatatttagcaagatccttgtttcataattta

SEQ ID NO: 7949 - DNA, 1883 bp, Euonymus alatus
aaccatacgggcggagcattcaatccctcagttccctcgttttcatcgaagcttttttcttgctcttcgttcgtttctcttcataaacaccatcaacacacacaatcttcctccatctctctatctctctccccgtctatcaaaatttggatcaacgtttctgtctttgttcgtgttaaacagagcttccttttcctacattgacaatggaggtctccatgactatgactacatgcaaatctgtcacttctcctcctggtctttttattgggagagctagaggaatcaagagttctcaaagtagctttttagtgggaagcaatgtaaacttccccagactaagagcccaggctgcgcaagttacttgtaaatctaagaagaatggtggagctcttaggactgtatgtcgtgctgataaaattttggtggcaaataggggagaaattgctgttcgtattattcgaactgcgcatgagatggggataccttgtgttgctgtttactcgacaatagacaaggacgcacttcatgtgaaattggctgatgaatcagtttgcataggggaagcgccaagcagtcaatcgtatttagtaatcccgaatgttctatctgctgctgtcagccgtagatgtaccatgttgcatcctggatacggtttcctggctgaaaatgctgtttttgttgaaatgtgcaaagaacatggaattaactttattggaccaaatcctgacagcatccgtgtcatgggtgacaaatcaactgcaagagacacgatgaaaaatgcaggtgttccaactgttccaggaagtgatggattgttacagaacacagaggaaggaatcagactagccaatgagattggttttcctgtgatgatcaaggcaacggctggtggtggaggtcgtggaatgcgtcttgctaaagaacctgacgagtttgtgaaatttctacagcaagctaagagtgaggctgctgctgcatttggcaatgatggagtgtatttggagaagtatatacaaaatccaaggcacattgaattccaggttcttgctgataaatatggtaatgttgttcactttggtgagcgtgactgcagtatccagaggcgtaaccaaaagttgctggaagaggcaccctctcctgcactgacaccagagttgcggaaagccatgggtgatgcagcagttgcagcggcagcatctattggctacattggtgttggaacagtcgaattccttttggatgagaggggctccttttacttcatggaaatgaacactcgaatccaggttgaacatcctgtgacagaaatgattttctctgttgatttgattgaggaacaaattcgagttgccatgggtgagaagctccgctacaagcaggaagatatttctctcagaggacactccatcgaatgtcgtattaatgcggaagatgctttcaaaggatttcgaccagggccagggagaataacctcatacttgccctctggtggtccatttgttagaatggatagccatgtttatcctgattacgtggttcctccaaattatgattctcttcttggaaagcttattgtatgggctccaacaagagagaaggcaattgagcgcatgaaaagagctcttgacgacactatcatcactggggttcctacaaccattgattatcataaacttattcttgacattgaggacttcagaaatgggaaggtcgatactgctttcattccaaaacatgagcaggagttggcagcgccccagacactcgtgccagtgaaagaattgtcaaatgcatctgcttagatatcacttctgaagagtcggatgatagccgctgaaaaggccgtagtttttcctcctcctgagaatatgttattgcct

SEQ ID NO: 7950 - DNA, 2196 bp, Populus trichocarpa
ccaaactcaaccaggcggagctttcgatctcacacactctcttacactcttcgtctttcctcgtttctatcgacaagacagcaatccaaactaaagtcccaacaaatatcttccttccttcacttctgtcttaaatactctctctctttctctctttctccctgtgctttctttgtttctgaaacaatccatcatttcttgttcaaggcctttcgggttccaaaatggaggcaacattgcctgtttgcaaatctgttacatctactcctggtttattcatgaagagaaatagtggaatcaggaattctcaatgcagctttatggtgggaactaaggttaactttcctagacaaagaactcaggctacccaagctaatcactgtgctaagaagaatggaggagctcttggggttacatgtcgcgcagaaaaaattctggtagcaaacagaggagagattgctgttcgtgttattcgaactgcgcatgagttggggattccatgtgttgctgtttactcaaccatagataaggatgcacttcatgtgaaattggctgatgagtcggtttgcataggtgaagcacccagcaaccaatcgtacttagtgatccaaaatgttttatctgctgctatcagtcgtggatgcacaatgctgcatcctggatatggtttccttgctgaaaatgctgtttttgtggaaatgtgcagagaacatggaataaactttattgggcctaatcctgacagcatacgagtcatgggtgacaaatcaactgctagagaaacaatgaagaaggcaaatgttccaactgtaccaggaagtgatggcttgttacagagtaccgaggaagcagtaaagcttgccagtgagattggttatcctgtgatgatcaaggcaacggcaggtggtggaggacgtggaatgcggcttgccaaagaacctgatgagtttgtaaagctgctacagcaagctaaaagtgaggctgctgcggcatttggaaatgatggagtttatttggagaagtatgttcaaaatccaagacacattgagttccaggttcttgcagacaaattcggtaatgttgttcactttggtgagagagattgcagcattcagagacgtaaccaaaagctgttggaagaagcaccatctcctgctttgactcctgagttacgaaaggctatgggtgatgcagcagttgcagctgcagcatccatagggtacattggtgttggaacggttgagttccttttggatgaaaggggttccttctacttcatggaaatgaacactcgaatccaggtggaacatccagtaactgaaatgatttcttctgtcgatttgattgaggaacaaattcgtgtagccatgggagagaaacttcaatacaaacaggaagatattgttcttaggggacattcaattgagtgccgtatcaatgcagaagatgcttttaagggattccgaccggggccagggagaataacagcatatttgccatctggaggtccgtttgttagaatggatagccacgtttatcctgattatgtggttcctccaagctatgattccctacttggaaagcttattgtctgggctccaacgagagaaaaggcaattgagcgaatgaaaagggctcttgatgacactattattactggagtcccaacaacaatagattaccacaagcttatccttgacattgaggacttcaagaacggaaatgttgatactgctttcatacccaagcatgaacaggagttagcagcgcctcaacaaattatactagccaattcagcttcataaatagatcacttctcaaattacaaccttgttcagctaattttcgagcgcggttacagaggccagagttttcctgcaaatctgccggaagctttcatttcatttgtggtgtttggatgcattccctttgttttagaacttgtagatttcgtgagaatttgtcgcgaaattttgatgtattttgtatgttttccttttagtttgggttgaaatggtttaaaactcatccatgcttgcataatcctggaagtacgtatttagttcagagttcagacatgcgaaattgttcaaatgaagggagatatttagctcaataattatcttggcccacaaattaatcatattttaaaattcttagtagttacattcatagacgtagaacttggattgccca

SEQ ID NO: 7951 - DNA, 1862 bp, Helianthus annuus
gcagttattagatttctcgacactctctgccttctttatacaccttcgtagctctctctccatcaaccactccgcctaatttcttcaaaatttggcaacctaccaatacatttcgacgttagatatacgatatggattcagccgctgttacattttgcagtaaaccagtaacctctcctccgggtttattcgtcgggaggtctagtggaattaagagctctcagtgtaacttcttggtgggaaacaagttgaactttccaaagcaaagagttcagtcttctcagaaggctcgtagctcagggaaacatgagggagcacttaatgttacttgccgtgcggaaaaaattctggtggcgaacagaggggaaattgcggtgcgtgtgattcgaacggctcatgagctagggatcccctgtgttgcagtgtactccactatagataaagatgcacttcatgtgaaactcgctgatgaagcggtttgcataggagaagcacctagcagccaatcgtacttgctgatacccaatgttctgtctgctgccatcagtcgtggatgtacaatgttgcatcctggttacggtttccttgcggagaatgcggtttttgttgagatgtgtagagagcacgggatcaacttcattgggccaaatcctgacagcattcgtgttatgggggacaaatcaacggctcgagataccatgaagaacgctggtgttccaaccgtaccaggaagtgatggactattacagagcactgaagaaggcatcaagttagctgacgagataggcttccctgtgatgattaaggctacagcaggtggaggaggtcgtggaatgcgtcttgcaaaagaacgtgatgagtttgtgaagttgttgcagcaagctcagagtgaggctgcagctgcatttggaaacgacggtgtatatttagagaagtatattcaaaatcctagacacattgagttccaggttcttgctgacaaatttgggaacgttgttcactttggtgagcgtgactgcagtattcagagaaggaatcaaaagttgctagaagaagcaccgtcacctgcattaacaccagagctgaggaaagccatgggtgatgcagccgttgctgccgcagcatcaatcggctacatcggtgtcggtactgtcgaatttcttttggatgaaagaggtgaattttacttcatggaaatgaacactagaattcaggtggagcacccagtgacggaaatgatatcgtctgttgatttgatagaggagcagattcgcgtagctatgggtgagaaactccgttacacacaggatgaaatcgtgcttagaggacactcgattgaatgccgtataaatgcggaagatgctttcaagaatttcagacctggaccagggagaataacgtcttacttgccgtctggaggtccatttgtgagaatggatagccacgtgtatactgattacgttgttccaccaagctacgattctcttcttggaaagcttattgtatgggccccaacaagagaaaaagcaattgaacgcatgaaaagggctcttgatgatactatcatcacaggtgttccaacgacaatcgattaccacaagctaatccttgacatcgaggacttcaaaaacggaaaagtcgacactgcattcattccaaagcacgaggaagaattagccgagccacagaaactgataacaccaaatggtgctaaagacgttgcaaaggctgtagcttaaaggagtagtttgtttggtcatttttgtgtattaaaaatgttacattgcaagtcatttgatctgccaaatgtcttttgagataacttttaatttgaggcatccgtttaatattttgagacttcc

SEQ ID NO: 7952 - DNA, 2059 bp, Panax ginseng
attcaatcccatatctccctcgttttcatcgacaccttttctctacttcttcacaaatcacaacaaccctgctttctgtccccaattcgctttcaacttcgatcaaagtttaacagtagatatactgcagaagaagaagcatttgatctgaaaatggactccgcggccatgacttcttgtaccaaatctgtttactatcctccaagtttattcgcggggagcgcttgtgggattaaaagctcccagtgtagttttatgataggaagtaaagtgaaattctccaggcaaaaagctcaggcttataaagttagtcgtaaatctgggaaacgagggggtgctctcagtgctacttgtcgtgacgataaaattctggtggcaaacagaggagagattgctgtccgcgtgatacgaactgctcatgagatgggtataccttgtgttgctgtttactcaaccatcgataaggatgcacttcatgtgaaattggccgatgaatcagtttgcattggtgaagcaccaagcagtcaatcgtatttagtggtcccaaatgtcctatccgctgctattagccgtgggtgtacaatgctgcatcctggatatggtttcctttccgagaatgcattgtttgttgaaatgtgcagagagcatggaatcaactttattgggccaaatcctgacagtattcgtgtcatgggtgacaaatcaactgccagggacacaatgaagaatgctggtgttccaactgtaccaggaagtgatggattggtacagagcactgaggaagctattagagttgctgatgagattggctaccctgtgatgattaaggcgacagctggtggtggaggccgtggaatgcgtcttgctaaagagcctgaggagtttgtgaagttattacaggcagctaagagtgaggctgcagctgcatttggaaatgatggggtttatctagaaaagtacatccagaatccaaggcacatggaattccgagtctgcagacaagtttggtaatgttgttcactttggagagcgtgattgcagtattcagagaaggaatcagaagttgctggaagaagcaccatcccctgccttaacctccgagctgcggaaagccatgggtgatgcagcagttgcagccgcagcatctataggttacattggggttggtactgtcgagttcctttggatgaaagagggtccttttacttcatggaaatgaacactaggatccaggtggagcatcctgtgacagaaatgatttcttctgttgacctgattgaagaacaaatccgtgttgctaggggagagaaactacgttacaaacaggaagatattgtgcttagaggacactcaattgaatgccgtattaacgcagaagatgctttcaaaaatttcagacctgggccagggagaataacagcatacttgccatctggaggtccatttgtgagaatggatagccatgtttatccggattacgttgttccaccgagctatgattccctacttggaaagcttattgtatgggctccgacaagagagagggcaattgcacgcatgaaaagggctcttgatgacaccatcattactggtgttccaacaacaatcgaataccataaacttatccttgaggttgaggatttcaaaaatggaaaggtcgacactgcttttattcctaagcatgaacatgagttggctgcgccccagaagattgtaccagcaacacctgcttaagagcttgcgaacactgcagcctagagggaaaacaagacatcttgggtaggccgagctgattttttgaacagggggtggtggtgacagtttttggtctaaatgtattagtttggtctcggctggttttgatcttcatagttgttagaataaaatcccttctttttgctgtcaaatgatgcttatcgcatagaattggatattgtttgtggttggtcttagaaattacatactataagagtagctttttgtttcttcaactgtaatattgaagcatgactaaaacgaatggaacattttaacgtattcaaacaaaagtatctgttca

SEQ ID NO: 7953 - DNA, 2037 bp, Tripterygium wilfordii
ccaaccattcaggcggaggattcaatcaagcctccctcacttccctcgttttcatcgaagcttttccttgctcttcgtttctcttcataaacaccatcaacacacacaatccaactccacctctctctctctctccccgtctctcaagatttggatcgaagtttctgtcttagttcgtcttttaacagagcttccctcttcctacattgacaatggaggcctccatgactatgactacatgcaaatctatcacttctcctccggatctttttattgggagaactagaggaatcaagagttcccaatgtagctttttggccggaagcaatgtaaacttgccaagacaaagagctcagactgcgcaagttagtcgtaagtctaagaagaatggtggagctcttagtgctgtatgtcgtgctgataaaattctggtggcaaatagaggagaaattgctgttcgtgttattcgaactgcgcatgagatggggataccttgtgttgctgtttactcgacaatcgacaaggatgcacttcatgtgaaattggctgatgaatcagtttgcataggagaagcaccaagcagtcaatcgtatttagtaatcccaaatgttctatctgctgctgtcagccgtggatgtaccatgttgcatcctggatacggtttcctggctgaaaatgctgtttttgttgaaatgtgcaaagagcatggaattaactttattggaccaaatcctgacagcatccgtgttatgggtgacaaatcaactgcaagagaaacaatgaaaaatgcaggtgttccaactgttccaggaagtgatggattgttacagagcacagaggaaggaatcagactagccaacaatattggttttcctgtgatgatcaaggcaacagctggtggtggaggtcgtggaatgcgtcttgctaaagaacctgacgagtttgtgaagttgctacagcaagctaagagtgaggctgctgctgcatttggcaatgatggagtgtatttggagaagtacatccaaaatccgaggcacattgaattccaggttcttgctgataaatatggtaatgttgtccactttggtgagcgtgactgcagtatccagagacgtaaccaaaagtttgctggaagaggcaccctctcctgcattgacaccagagttgcggaaagccatgggtgatgcggcagttgcggcagcagcatctattggatacattggtgtcggaacagttgaattccttttggatgagaggggttccttttactttatggaaatgaacactcgaatccaggttgaacatcctgtgacagaaatgatttcctctgtcgatttgattgaggaacaaattcgagttgcaatgggtgagaaactccgctacaagcaggaagatattaccctcagaggacactccatcgaatgtcgtattaacgcggaagatgctttcaaaggatttcgaccagggccagggagaataacctcgtacttgccctctggtggtccatttgttagaatggatagccatgtttatcctgattacgtggttcctccaagctatgattctcttcttggaaagcttattgtatgggctccaacaagagagaaggcaattgagcgcatgaaaagagctcttgacgacactatcatcacaggggttcctacaaccattgattatcataaacttattctcgacattgaggacttcagaaatgggaaggttgatactgctttcattccaaagcatgagcaggagttggcagcgccccagaaactggtgccggtgaaagaattgggaaatggaactgcttagatatcacttctgaagagtcggatgctgaaaaggccagagttctttttttctgcgaatctgttgttggcttttatttacatcaatcactctctccatggttcactcccaatgtattgacatgctttagaatatttctgtttcatgcacatttggattgcctaaaaattttgtggattgccagtatttcgtttttctgaaaaccataaacagtataatccaagccta

SEQ ID NO: 7954 - DNA, 1877 bp, Cirsium arvense
gctctcacactctatcgctcaactgctacgtcctaattttcttagaaatttttggccttccttccctccctcacttattgccgacgtttgatataagacatggattccgccgccatgacattttgcagtagtaaccaatctcttctcctccgggtttattcattgggaggtctagtggtatcaagagctcccagtgtaacttcttagtgggaagtaaggtgagctttcctaggcagagagttcaggcttctcagaaagttcgtagatcagggaagcgtgaggcagcaggaggacttggtgttacttgccgtgctgaaaaaatactggtggcaaacagaggtgaaattgccgttcgagtgattcgaactgctcatgagctaggaattccttgtgttgcagtgtactccaccatagataaggatgcacttcatgtgaaactggctgatgaatcagtttgcataggggaagctcctagtagtcaatcgtacttgctgatacccaatgtcctgtctgctgctatcagtcgtggatgtacaatgctgcatcctggttatggtttccttgctgagaatgctgtttttgttgagatgtgcagagagcatggaatcaacttcatagggccaaatcctgacagtattcgtgttatgggggacaaagcaactgccagagataccatgaagactgctggtgttccaactgtaccaggaagtgaaggactattacagagcaccgaagaaggcatcaagctcgccgatgagattggctttcctgtcatgatcaaggctacagcaggtggtggaggtcgtggaatgcgtcttgcaaaagagcgtgacgagtttgtgaagttgttgcagcaagctaagagtgaggctgcagctgcatttggaaatgatggtgtttatttggagaagtacattcaaaatccaaggcacattgaattccaggttcttgcagataaattcggaaatgtcgttcactttggagaacgtgactgcagtattcagagaaggaaccaaaaattgcttgaagaagcaccatcgcctgcattaaccccagagctgcggaaagccatgggtgatgcagcagttgctgcagcagcatcaattggctacattggtgttggtactgtagagtttcttttggatgaaagaggttcattctacttcatggaaatgaacactagaatccaggtagagcatcctgtgaccgaaatgatatcttcagttgacttgatagaggagcagatccgggtagctatgggtgaaaaactccggtatacacaggatgagatcgtgcttagaggacactcaattgaatgccgtatcaatgcagaagatgctttcaaaaacttcagacctggaccagggagaataacatcttacttgccatctgggggtccgtttgtgagaatggatagccatgtatataccgattacgttgttccaccaagctatgattctcttcttggaaagcttatcgtatgggccccaacaagagaaaaggcaatcgaacgcatgaaaagggctctaaacgatactattatcacaggggttccaactacaatcgagtaccacaagctaattcttgacattgaagacttcaaaaacggaaaagttgatactgctttcattccaaagcacgaggaggaattagccgagccacagaaattgattgctttaaatgctgctgctaaagaagtggccaagtctgtagcttaaataaagagtggttggtttgttccatttttctgtatgcaaaaatgtgttactttttgtctcttaggtaagtttcaagctgtctgtctgtggcgtctgtttgattttttttgagactgaattgagtttcattgacaattcatcgaattattccaatcacat

SEQ ID NO: 7955 - DNA, 2153 bp, Triphysaria pusilla
atttctttcttgttttcatcgacgctcatcccttttcttcaaatctcccaactatttcacctgccatttatctatctcactctcttattgtcaacacgaaatctatctatacaagccccgaactagattgcaatttaagttccattttctaaggtatttgttcttttagcagatccaactctctgtgttcaccgcgattccgttttaattgatctgaaaatggactctgcaactatgacattttgcagtaacccttgtgttcgctcacctccgggtttattcatggggagcacaacaggaattagaagctcccagtgcagcttttttatggctggaagagttaactttcctcagcaaaggcttcaggcttcttctagagttggtcgtaaatctggtaaacgtggaggagctcttggagctacatgccttgatgataagattctggtggctaacagaggagaaatcgctgttcgtgtgattcggactgcacatgagatggggataccttgtgttgctgtttactcgacgatcgataaagaagctcttcatgtcaaactggctgatgagtctgtttgcattggtgaagcaccaagtagtcaatcttacttggtgattccaaatgtgttatctgctgccatcagccgtggatgtactatgctgcatcctggatatggtttcctttccgagaatgctgtttttgttgagatgtgcagagagcatggaatcaactttattggaccaaatcctaatagtattagggtcatgggtgacaagtcaactgctagggatacaatgaagaatgctggagttccaactgtccctggaagtgacggattggtgcagactactgatgaagcagtgaagattgctgagcagattggttatccagttatgatcaaggcaacagccggtggaggaggacgcggaatgcgccttgctaaaacacctgatgagtttgtaaagttgttgcagcaagcgaagagtgaggctgcagctgcgtttggtaatgatggtgtttaccttgagaagtatatccagaatccaaggcatattgaatttcaggttttggctgacaagtttggcaatgttgtgcactttggggagcgtgactgtagtattcagagaagaaaccagaagttgctagaagaagcaccttctcctgcattaacagcagaattgcgaaaagccatgggtgatgcagcagtagcagcagctgcatctattggttacatcggtgttggaacagtcgagttccttttggatgaaagaggctccttttacttcatggagatgaacactaggatccaggtggaacatccagttacagaaatgatatcctctgtggaccttattgaagaacagatttgcgtggctatgggtgagaagcttcgttatgctcaggaagatattgtgctcagtggacattcaattgaatgccgtataaatgccgaagatgctttcaaaaacttcagacctggaccaggaagaataactgcataccttcccgctggaggcccattcgtgcgaatggatagccatgtatatccggattatgtggtcccacctagctacgattccctgcttggaaagcttattgtctgggctccaacaagagaaagggcaattgcacgcatgaagagggctcttaatgataccatcattacaggggttccaacaacaattgaataccataagcttatccttgaaattgaggactttaaaaatggaaaagtggatacagcttttattccgaaacacgaacaagagcttgctgagcctgtatcaaacgaacttgtaaaggcccacaaagagccggtcaatgcttctgcttgagctattctcatctcgttagtcttcaccggaagcagcaatctttcggttcgggctcttagattttaccttagttgtgatgagatagatatatatagttgttcgttatttaatagccgcgcacatttccgatcacatgaactcgactatttattcattttccgactttttattcgtcaaaacgagcttcagatatatgtgagtgaatgtgtggattcaaccaactctctttgtcccatctttcttggcataaatttcatcagcagcagttattaaataaatacaatagattttggcatgacaataaaataaaaaaaaaaaaa

SEQ ID NO: 7956 - DNA, 2075 bp, Eucalyptus grandis
tctctctctctctctctctctctctctttccaggggtttccaggcgccgccgcgttcgaacatggaggccacattgccaatgtgcagcaaatccgtcgccgcctccactccgggtctagttttcagaagggcagacagtatccagagttctcaatgtagctttttggtcgggagcagggtgaacttccctaaacaaagatgtcgtgctgttaaagtcggtcatgcttctaagaggcgtgggggagctcttaatgctacttgccgtgctgataagatcttggtagcaaatagaggtgaaattgcggtccgcgttattcgaacagctcatgagatgggtattccctgtgtggccgtttactcaacaattgacaaggatgcgcttcacgtgaaattagccgacgaatcagtttgtatcggtgaagcaccaagtagccaatcgtacttagtgatcccgaatgttctatctgctgccatcagccgtggctgcactatgcttcatcctggatatggtttcctttctgaaaatgcagtatttgttgagatgtgcaaagagcacggcattaactttataggacctaatcctgagagcatccgagtgatgggtgataaatcaactgctagagaaacaatgaaaaatgctggtgttcccaccgttccgggaagtgatgggttgttgcagagcacagaggaaggagtccggcttgctcaagagattggttatcccgtgatgattaaggcaacagcaggtggtggaggacgtggaatgcgtcttgctaaagagcctgatgagtttgtaaagttgttacagcaagctaagagtgaggctggggctgcatttggcaatgatggagtttatctggaaaagtgtattctgaatccaaggcacattgagttccaggttctagctgataaatatggcaatgttgttcactttggggagcgtgattgcagcatccagaggcggaatcaaaagcttttggaagaagcaccttccccagcattgaccccagagttgcgaaaagccatgggtgatgcagctgttgcagcagcagcatctattgggtacattggtgttgggacaatcgagttccttttggatgaaagaggatccttctacttcatggaaatgaacactagaatccaggttgagcatccagtaacagaaatgatttcttctgtcgatctgatcgaggagcaaattcgcgtggcaatgggagagaagctccgctacaaacaggaagatattgttctcagaggacattcaatagaatgccgtatcaatgctgaagatgcatttaaaggattccggcctggaccagggagaataacagcatacttgccttctggaggtccttttgttcgaatggatagccatgtatatccagattatgtggttcctccaagctatgattccttgcttgggaagcttatagtatggggtcctacaagggaaaaagcaattgagcgtatgaagagggccctcaatgacactatcataacaggagttcccacaaccattgactaccacaaacttatccttgacattgaggatttcagaaatggcaaggtggatactgcctttattcctaagcatgaggatgagctaagggagcctcagaaaatggtgttggcagcacccgcgaaggaattaactggtgctacggtctagatggatcgttttactcgaagtcactagcatccacaatgttcatagatggaagtatgtcgtcctcaaacggggagctgaaaatcattaatatacactggcgcggcgggtttatctgtttttgttggaataagtcaagagttgttggatgagttataggtctttgtttcgtgtacgttagatggcatgggaactcgttaattcactgaagctatttatggggctgcttcttttattgttctgaactttaaatgcacatttatatttaccttcttccccagttatatttcagatttgcctaattggtttcgccacgagattaagtgaattagcgtcatgttcctgtgattacctactgtgcctatgttgcatgtcatgaatgtatggtaatatgatcatattattcttt

SEQ ID NO: 7957 - DNA, 1751 bp, Arnica chamissonis
cgacgttagatataagatatggattccgccgccgtcacattttgcagtaaaccgatatcctctcctccgggtttattcgtcgggaggtctagtggaattaagagctctcggtgtaacttcttggtgggaagtaaggtgagctttcctaagcaaagagtgcaggcttctcaaaaggctcatagttcagggaaacgtgagggagcacttggtgttacttgtcgtgctgaaaaaattctggtggcaaacagaggagaaattgcagtgcgtgtgattcgaactgctcatgagctagggatcccatgtgttgcagtgtactccactattgataaggatgcacttcatgtgaaactggctgatgaatcagtttgcagtaggggaagctcctagtagtcaatcgtacttgctgatacccaatgttctgtctgctgccatcagtcgtggatgtacaatgttgcatcctggttatggtttcctttctgagaatgctgtttttgttgagatgtgcagagagcatgggatcaacttcattggcccaaatcctgacagcattcgtgttatgggggacaaatcaactgcccgagataccatgaagaatgctggtgttccaactgtaccaggaagtgatgggcttttacaaagcactgaagaaggcattaggttagctgacgagattggcttccctgtcatgattaaggctacagcaggtggtggaggtcgtggaatgcgtcttgcaaaagaacgtgacgagtttgtgaagttgctgcagcaagctaagagtgaggctgcagctgcatttggaaatgatggtgtatatttagagaagtacattcaaaatcctagacacatcgagttccaggttcttgctgacaaatatggaaatgttgttcactttggtgagcgtgactgcagtattcagagaaggaaccaaaaattgctagaagaagcaccctcacctgcattaacccccgagctgaggaaagccatgggtgatgcagcagttgctgcagcagcatcaattggctacgttggtgttggtactgtcgaatttcttttggatgaaagaggcgacttttacttcatggaaatgaacactagaatccaggtagagcatccagtgacagaaatgatatcatcggttgatttaatagaggagcagattcgggtagctatgggcgagaaacttcgttacacacaggacgaaatcgtgcttagaggacactcaattgaatgccgtattaatgcagaagatgctttcaaaaatttcagacctggaccagggagaataacagcttacttgccatctggaggtccatttgtgagaatggatagccacgtgtatactgattacgttgttccaccaagctacgattctctacttggaaagcttattgtatgggccccaacaagagaaaaagcaattgaacgcatgaaaagggctcttaatgatactatcatcacaggggttccgacaacgatcgagtaccacaagctaatccttgaaatcgaggacttcaaaaacggaaaagtcgacaccgctttcattccaaagcacgaggatgaattagccgagccacagaaattgattgctgctaaagaagttgcaaaggctgctgcagcttaaagagtggtttgtttgataatttttctgtattaaaaatgttacattttaagtcctttgatttataaaatgttacgttttaactcttatatcttaatccaagtctagatgattttgtaaagaactgtaaaac

SEQ ID NO: 7958 - DNA, 2411 bp, Citrus clementina
gagcattcaatcagtgagtcccctcgtttccatcgccaactgccccttcaaaatctcaaactaaaatctcacaagtctcattgtgctggtggctttcttgcttggattcagatcctacctctacgcacgcaatggacgcctccatgaccatgtccaaatctgtcaccaccacttctcccggattgtttgttgggaggggcaaggggattttgagaagttcgcaatgtagctttatggtggggagcaggacggtgaactttccgaggcaagtagtggctggagttggcggtaagttaaagaggcgttgcagtggcggcggagctctcaaagtgacgtgtcgtcaggagaaaatcctagtggccaatagaggagagattgctgtgagggttatcaggacggctcatgaaatggggataccttgtgttgctgtttactccaccatcgataaggatgcccttcatgttaaattggcggatgaatccgtttgcattggtgaagctcctagtagccaatcgtatttattgattccaaacgtactgtctgctgctattagccgaggatgtacaatgttgcatcctggatatggattccttgctgagaatgctgtttttgttgaaatgtgcagagaacacggaattaactttattggtcccaatcctgacagcatccgcattatgggcgacaagtcaactgctagggaaacaatgaagaatgcaggtgttcctactgtcccgggtagtgatggattgttacagagcacagaagaagcagtcaagctagccgatgagctaggatttcctgtgatgatcaaggcaactgccggtggtggaggacgtggaatgcgtcttgctaaagaacctggtgaatttgttaagttgcttcagcaagctaagagtgaagctgccgctgcatttggaaatgatggagtttatttggaaaaatacgttcaaaatccaagacatattgaattccaggttcttgctgataaatatggcaatgttgtccactttggtgaacgtgactgcagcatccagagacgtaaccaaaagcttttggaagaagctccgtctcctgcattgacccctgaactgcggaaagccatgggtgatgcagctgttgcagcagcagcatccattggttacattggtgtcggaacggttgagtttcttttggatgaaagaggttccttctacttcatggaaatgaacactcgtatccaggttgagcatcctgtgacagaaatgatttcctctgttgacttgattgaggaacaaatttatgttgcaatgggaggaaaactccgctacaaacaggaagatattgtgctccaaggacattcaattgaatgccgtatcaatgcagaagatccttttaaaaacttccgacctgggccagggagaataacagcatacttgccagctggtggcccatttgtcagaatggatagccatgtttatcctgattatgtggttcctccaagctatgattctcttcttggaaagcttattgtatgggctccaactagagaaaaggcaattgagcgcatgaaaagggctcttaatgacactattatcacaggtgttcctacaaccatcgaataccataaacttatccttgatgttgaggacttcaaaaatgggaaggttgacactgcgttcattccaaaacatgaacaggagttgcaagcaccccagaagattgttttggcaacaactccaaatgaaatggctggtgcaactgcttagatgagtctcttctggaattgcaaccacttaacagctttggtcagtcaaagtcaaaggccatgactcttcctcattacacttactggtaccattaaccacattgggtgttgtcatttttctaggaatactgtaaaatagtatattcggtgcataaactcttagtgatttactgattttgatggtggtgatgagtgttgtcttaattttatggagccgaaagatgtaattaggggttagaaagatgtgataaataaccagagcttagaaactgtgataaataaccagagcttagaaactgggtagtgggtttttcagtaattttctttttttttttcacaaaaataattgtattgttaaataaacttctgtggttttttaagtggcaatcagtttgaatgttgataattgggtggttgcttaaattgttgccgtggtacccttcaactgttgcaaggtaactggatccttgttattaatgtttggagaaagtcttagtaaaatgatttcgacaggaccatagttctctcgaaatcataatatatgtaagtggtcaaatttttaaaataaatgtaacaagattttattgatcaggcgagtggatgatttggtacgccatctcgctaaagatttttattttttaatatttgaataggctgatttcaatca

SEQ ID NO: 7959 - DNA, 2411 bp, Citrus sinensis
gagcattcaatcagtgagtcccctcgtttccatcgccaactgccccttcaaaatctcaaactaaaatctcacaagtctcattgtgctggtggctttcttgcttggattcagatcctacctctacgcacgcaatggacgcctccatgaccatgtccaaatctgtcaccaccacttctcccggattgtttgttgggaggggcaaggggattttgagaagttcgcaatgtagctttatggtggggagcaggacggtgaactttccgaggcaagtagtggctggagttggcggtaagttaaagaggcgttgtggcggtggcggagctctcaaagtgacgtgtcgtcaggagaaaatcctagtggccaatagaggagagattgccgtgagggttatcaggacggctcatgaaatggggataccttgtgttgctgtttactccaccatcgataaggatgcccttcatgttaaattggcggatgaatccgtttgcattggtgaagctcctagcagccaatcgtatttattgattccaaacgtactgtctgctgctattagccgaggatgtacaatgttgcatcctggatatggattccttgctgagaatgctgtttttgttgaaatgtgcagagaacacggaattaactttattggtcccaatcctgacagcatccgcattatgggcgacaagtcaactgctagggaaacaatgaagaatgcaggtgttcctactgtcccgggtagtgatggattgttacagagcacagaagaagcagtcaagctagccgatgagctaggatttcctgtgatgatcaaggcaactgccggtggtggaggacgtggaatgcgtcttgctaaagaacctgatgaatttgttaagttgcttcagcaagctaagagtgaagctgccgctgcatttggaaatgatggagtttatttggaaaaatacgttcaaaatccaagacatattgaattccaggttcttgctgataaatatggcaatgttgtccactttggtgaacgtgactgcagcatccagagacgtaaccaaaagcttttggaagaagctccatctcctgcattgacccctgaactgcggaaagccatgggtgatgcagctgttgcagcagcagcatccattggttacattggtgtcggaacggttgagtttcttttggatgaaagaggttccttctacttcatggaaatgaacactcgtatccaggttgagcatcctgtgacagaaatgatttcctctgttgacttgattgaggaacaaattcatgttgcaatgggaggaaaactccgctacaaacaggaagatattgtgctccaaggacattcaattgaatgccgtatcaatgcagaagatccttttaaaaacttccgacctgggccagggagaataacagcatacttgccagctggtggcccatttgtcagaatggatagccatgtttatcctgattatgtggttcctccaagctatgattctcttcttggaaagcttattgtatgggctccaactagagaaaaggcaattgagcgcatgaaaagggctcttaatgacactattatcacaggtgttcctacaaccatcgaataccataaacttatccttgatgttgaggacttcaaaaatgggaaggttgacactgcgttcattccaaaacatgaacaggagttgcaagcaccccagaagattgttttggcaacaactccaaatgaaatggctggtgcaactgcttagatgagtctcttctggaattgcaaccacttaacagctttggtcagtcaaagtcaaaggccatgactcttcctcattacacttactggtaccattaaccacattgggtgttgtcatttttctaggaatactgtaaaatagtatattcggtgcataaactcttagtgatttactgattttgatggtggtgatgagtgttgtcttaattttatggagccgaaagatgtaattaggggttagaaagatgtgataaataaccagagcttagaaactgtgataaataaccagagcttagaaactgggtagtgggtttttcagtaattttctttttttttttcacaaaaataattgtattgttaaataaacttctgtggttttttaagtggcaatcagtttgaatgttgataattgggtggttgcttaaattgttgccgtggtacccttcaactgttgcaaggtaactggatccttgttattaatgtttggagaaagtcttagtaaaatgatttcgacaggaccatagttctctcgaaatcataatatatgtaagtggtcaaatttttaaaataaatgtaacaagattttattgatcaggcgagtggatgatttggtacgccatctcgctaaagatttttattttttaatatttgaataggctgatttcaatca

SEQ ID NO: 7960 - DNA, 1868 bp, Centaurea maculosa
tcatagattttatcgacctctttcttcttctttaacttcattgctatcacactctcttcgttcaactgctacgcctagatattgccgacgttttgatatcagaaatggattccgccgccttgacattttgcagtagtaaaccgatatcttctcctccgggtttagtcattgggaggtctagtggaatcaagagctcccagtgtaacttcttggtcggaagtaaggtgagctttcctaggcagagagttcaggcttctcaaagagttcgtagatcggcaaaacgtgagggagcacttggtgttacttgtcgtgctgaaaaaattctggtggcaaacagaggtgaaattgcagtgcgagtgattcgaactgctcatgaactcgggattccttgtgttgccgtatactccaccatagataaggatgcgcttcatgtgaaactggctgatgaatcagtttgcataggggaagctcctagtagtcaatcgtacttgctgatacccaatgtcctgtctgctgccatcagtcgtggatgtacaatgttgcatcccggttatggtttccttgctgagaatgctgtttttgttgagatgtgcagagagcatggaatcaacttcatcgggccaaatcctgacagtattcgtgttatgggggacaaagcaactgccagagataccatgaagactgctggtgttccaactgtaccaggaagtgatggactgttacagagcaccgaagaaggcatcaaactcgccgatgagattggctttcctgtgatgatcaaggctacagcaggtggtggaggccgtggaatgcgtctcgcaaaagagcgtgacgagtttgtaaagttgttgcagcaagctcagagtgaggctgcagctgcatttggaaatgatggtgtttatttggagaagtacattcaaaacccaaggcacattgaattccaggttctcgcagataaattcggaaatgttgttcacttcggagagcgtgactgcagtattcagagaaggaaccaaaagttgcttgaagaagcaccctcgcctgcattaaccccagagctacggaaagccatgggtgatgcagccgttgctgcagcagcatcaattggctacattggtgttggtactgtagagtttcttttggatgaaagaggttcattctacttcatggaaatgaacactagaatccaggtagagcatcccgtgactgagatgatatcttcagttgacttgatagaggagcagatcagggttgctatgggtgagaaactccggtacactcaggatgagatcgtgcttagaggacactcaattgaatgccgtattaatgcagaagatgctttcaaaaacttcagacctggaccagggagaataacatcttacttgccatctggaggtccgttcgtgagaatggatagccatgtatataccgattacgttgttccaccaagttatgattctcttcttggaaagcttatcgtatgggccccaacaagagaaaaggcaattgaacgcatgaaaagggctcttaacgataccattatcacaggagttccaactacaatcgagtaccacaagctaattctcgacattgaagacttcaaaaacggaaacgttgatactgctttcattccaaagcacgaggaggaattagccgagccccagaagttgattgcttcaaataacgctgctgctgcggctgctgctaaagaagtcgccaagtctgtagcttaaataaaagagtggttggttggtttgttccaattttctgtatgcaaaaacgtttactttttgtgtattagatgagttctaagctgtctgtttgattttttgagattgaattgacaattcatcggattattccaatca

SEQ ID NO: 7961 - DNA, 2061 bp, Fragaria vesca
gagtgacaggcatttgggcggagcattcaatctctcactcccctcgttttcatcgacgactctacactcttactctcttcggaccttcccaccttctctttctccttcttattctctttctacttcgccattttgggctcattctgatctcgccattagtctctgtttgctttggagaaatggatgccaccatgcccatttgcaagactgtttctccaactccggggttattttttggaaaaactggagagatcaggagttcccaatgtagcttcatggtgggaaataaagttagctttttgaggcagagagctcagggtgctcaaattagttatagatcaaggaagcatgcgggaactctccatgctacatgtcgtgctgataaaatcctggtggcaaatagaggagaaattgcagttcgtgttattcgaacggcgcatgagatgggcataccctgtgtggctgtctactcaacaatagacaaggatgcgcttcatgtcaaattggctgatgagtcggtttgtattggtgaagcagcaagcaatcaatcgtaccttgtagttccaaatgttttatctgctgccatcagtcgtaaatgtacaatgcttcatcctggatatggtttcctatctgagaatgcatcttttgttgaaatgtgcaaagaacatggaatcaactttattggtcctaagcctgaaagtatccgtattatgggtgataaatccactgcaagagaaacaatgaagcaagcaggtgttccaactgtacccggaagtgatggattactaaagagcacagaggaaggaatgaagcttgctgatgagattggttatcctgtaatgatcaaggcaacagcaggtggtggaggacgtggcatgcgtcttgctaaagagcctgaggagtttgtaaagttgttacaggcagcaaagagcgaggctgcagctgcttttggaaatgatggagtttatttggaaaagtatgtcgtaaatcctagacacattgaatttcaggttcttgcagataagtacggtaatgttgttcactttggagaacgtgattgcagcatccagagaaggaaccaaaagcttctagaagaagcaccctctcctgcattaactccagaactgcggaaagccatgggtgatgccgcagttgctgccgcagcatctattggttacattggtgttggaaccgttgagttccttctggacgaaagaggttccttttacttcatggaaatgaacactaggattcaggttgagcatcctgtgacagaaatgatttcctctgttgacttgattgaagaacaaattcgtgttgctatgggagaaaaactcagaatgactcaggatgatatcgttctccgaggacattcaattgaatgtcgtatcaatgcagaagacgcttttaaaggattccgacctgggccaggtagaataacagcttacttacccgctggaggtccatttgttagaatggatagtcatgtttatcctgattatgtggttcctccaaactatgattcccttcttggaaagcttattgtgtgggcaccaacaagagaaaaggcaattgatcggatgaaaagagctcttaacgacactattataacaggggttccaacaactattgaatatcataagctcatcctggagatagaggatttcaaaaatgggaaggttgataccgcttttattcccaagcatgaagaggagctagcagcgccccaacaagtgttgcctgcatccccaccgaaagaactagctagtgcaagtgcatagatggatgactcgggaactgctgctccttgttctagttgaccacattccaaaagcggcaaaatcgttcacttttttgtacgttagtgtgtaattggtgcccttgttattaacatttgtaaaattcacatgccttgcattatggaattccatttaaaattttgatatgttcctatagtaaaaactagtgttgctcaccatatattttaaaggaataataagggttctgtaaactcattcatgccattatgctaggcaagttgctttctttcattatcgggtt

SEQ ID NO: 7962 - DNA, 1762 bp, Eschscholzia californica
ctccccctctctctctaccgaagatccggcgacaagggctaaaatttgagtatggacgcctcaactttctgcaagtctgtttgctctcctactgttcctggtttatttgcgacacaaactagacaaataaggagctcacaatgtagctttatggttggaagtggggcaatctttcctaaacagaaagctcaaatgattcatctaagccaaaagaccaagaaacgtgtaggagcactaagtgtgacatgccggggagataagattcttgtagcaaacagaggtgaaattgcagttcgtgtaatacgaactgctcatgagatgggcataccttgtgtggcagtgtattcaaccatagataaagatgctcttcacgtgaagcttgctgatgaggctgtttgcattggtgaagcacctagcaaccaatcgtacttggtgatccctaatgttttatctgctgctataagccgtggatgtaccatgctgcatcctggatacggttttcttgctgagaatgctgtttttgttgaaatgtgcagagagcacggaatcaacttcattggacctaatcctgacagcattcgtgttatgggtgataaatctactgctagagagacaatgaagaaagctggtgttccaactgttcccggaagtgacggattattacagagcacagaggaaggtatcagattagctcatgaaattggatatcctgtgatgatcaaggcaactgctggtgggggtggacgtggaatgcgtctcgccaaagaacccgaggagttcgtcaaattgttacagcaagcaaagagtgaagctggtgcagcatttggaaacgatggagtttatttggagaagtacgttcaaaacccaaggcacattgagttccaggttctagctgatatgtttggtaacgttgttcactttggggaacgtgattgcagcattcagcgaaggaatcaaaagctactagaagaagctccgtctcctgcattgactccagaactgagaaaagccatgggtgatgctgcagttgcagcagccgcctctattggttacattggagttggaacagttgagttccttctggatgaaagaggttcattctacttcatggaaatgaatactaggatccaggtcgagcatcctgtgactgaaatgatttcttctgtcgatctgattgaggaacaaatccgtgtggcaatgggagaaaaactccgttacaaacaggaagatatcgtacttagaggacattctattgagtgtcgaatcaatgcagaagatgcttttaaaggattccgacctggaccagggagaataacagcatacctcccatcaggagggccatttgtgagaatggacagtcatgtttatcctgattatgtggttcctccaagctatgattccctacttggaaagcttattgtttgggctccaactcgggagagagccatcgaacgtatgaaaagggctcttaatgacactattattacaggtgttcctacaaccattgaataccataaacttatattggagatcgaggacttcaaaaatggcaacgtcgatactgcgttcatacccaagcatgaagaagagctagctgagccacagaaaatggtgccatctccatcactaaaagaattagtcaatacttctaactaggctggctgtcattacttcaatctttgaagggggatgtgaccttcaattttgtatgctcagctttacaagtgaggtgtgttaggttaaataatctactatactattc

SEQ ID NO: 7963 - DNA, 1843 bp, Jatropha curcas
atggaagccacattgcctatctgcaaacccaaatctgctgttatttcaacaactccaggtttattgactgggagaagtagcggaattgggagttctcaatgtagttttatggtgggaagtaaagttaactttcccagacaaagaattagggctgggcgagttagccataaagcaggtaagagcagcaatggaggtgctattggggttaaatgtcgtgctgataagattttgattgcaaatagaggagaaattgctgttcgtattattagaactgctcatgaattggggattccatgtgttgctgtttactcaactattgataaggatgctcttcatgttaaattggctgatgaatctgtttgcattggtgaagcaccaagcagtcagtcctacttgttgattccaaatgttctgtcggctgctatcagtcgtggatgtacaatgtttcatcctggctatggcttccttgctgagaatgcggtttttgttgaaatgtgtagagaacatggaatcaactttattgggcctaatcctgacagtatccgagtcatgggtgacaaatcaactgccagagaaacaatgaagaatgccggtgttccaactgtaccaggaagtgatgggttgctacagaatacagaggaagcagtcaagctggcccatgaaattggttttcctgtgatgatcaaggcaacagcaggtggtggaggacgtggaatgcgtctagctaaagagcctgatgagtttgtgaagttgctccagcaagctaagagtgaggctgctgcagcatttggaaatgacggagtttatttggagaagtacattcaaaatccaaggcatatcgagttccaggttcttgcagataaatatggtaatgttgtccattttggtgagcgtgactgcagtatccagagacgtaatcaaaagctgctggaagaggcaccctctcctgcattgacccctgaattacggaaagctatgggcgatgcagcagttgctgcagcagcatccatagggtatattggtgttggaacggttgagttccttttggacgaaaggggttccttctacttcatggaaatgaacactagaatccaggttgaacatcctgttactgaaatgatttcctcagttgatttgattgaggaacaaattcgtgtagccatgggagaaaagcttcgctacaaacaggaagatattgtgcttagaggacattcaattgaatgccgtatcaatgcagaagatgcttttaagggattccgacctggaccaggaagaataacagcatacttgccatctggaggcccatttgttagaatggatagccatgtttatcctgattatgtggttcctccaagttatgattctttactgggaaagcttattgtgtgggctccaacccgagaaaaggcaattgaacgcatgaaaagagcactagacgacactattattacaggagttcctacaacaatagactaccataaacttattcttgagattgaggatttcaaaaatggcaaggttgacactgctttcattccaaagcatgagcaggagttagcagcgccacagaagattgtaccagtcaaagaattggcaagtacaacggcataggtagataatacattccttcccaaagggcaatagtttgttctggtcattgcaatcactaatgaaaaaccatagcttttggcgtaattatgtctgtaggtttcatctttccactttgaattttcattgccttaaatttgtagaagtgagttgatgaaattttgttgtatgtgctcctttaattggctggtgacattttgcttacaaggctggaaataatgattgattatttcag

SEQ ID NO: 7964 - DNA, 2057 bp, Tragopogon dubius
tcgggatagccaaaaccaaagaaagtccgatttcgggcggagaattcaatctgcaaccatcatagatttcatcgacacccctctttcttctttacttgtacttcatttctctcacactctcgctcagctgctacgcctaattcttgaaattcttcccttcctttcgataatttcggacgtttgatacaagacatggattccgccgccatgacattttgcagtaaaccaatcacttcccctccgggtttattcattgggaggtctagtggaatcaagagctcccagtgcaccttcttggtgggaaacaaggtgaactttcctaggcagagagttcaggcttctcaaaaggcacgcaaatcaagcaaacatgaaggagcacttactgttacttgcagtggtgacaaaatcctagtggcaaacagaggtgaaattgcagtgagagtgattcgaactgctcatgagctagggatcccttgtgttgcagtgtactccactatcgataaagacgcacttcatgtcaaattagccgatgaagcagtttgcataggtgaagctcctagtagtcaatcgtatttgctgatacccaatgtcctctctgctgctattagccgtggatgtacaatgttgcaccctggttatggtttcctttctgaaaatgctatgtttgttgagatgtgtagagagcatggaatcaacttcattggcccaaatcctgacagtattcgtgtgatgggggacaaagcaactgcaagagaaacaatgaagaaagctggggttccaactgtacctggaagtgaaggactattatcgagcacagaggaaggcatcaagcttgcagacgagattggcttccctgttatgattaaggcgacagctggcggtggaggtcgtggaatgcgtcttgcaaaagagcgtgacgagtttgtaaagttgttgcagcaagctcaaagtgaggctgcagctgcatttggaaacgatggtgtttatttagaaaaatacatccaaaacccaagacacattgagttccaagttcttgctgataaatatggaaacgttgttcactttggagaacgtgactgcagtattcagagaaggaaccagaagcttctagaagaagcaccatcacctgcattgaccccagagttgaggaaagccatgggtgatgcagcagttgcagcagcagcatcaattgggtacattggtgttggtactgttgagtttcttttagatgaaagaggtgctttttacttcatggaaatgaacactagaatccaggtcgagcatccagtgactgaaatgatatcttcggttgacttaatagaggagcaaatccgtgttgccatgggtgaaaaacttcgttatacacaggaggatattgtgcttagaggacactcgattgaatgtcgtatcaatgcagaagatgctttcaaaaatttcagaccaggacccggaagaataactgcttacttgccatctggtggtccatttgtaagaatggatagtcatgtatataccgattatgttgttcccccaagctatgattctctacttggaaagcttattgtgtgggccccaacaagagaaaaggcaatcgagcgcatgaaaagagctcttaatgatactattatcacaggtgttccaacgacaatcgagtaccacaagctaattcttgaaattgaagacttcaaaaacggaaatgtcgatactgctttcattccaaagcacgaggaggaattagccgagccacatgaattgatgatacggtcaagttctggtagagaaatcgaggaggctgtggcttaaagaaggtgatatattcgggtatttctgtatgcaaaaatgttacttttttgtggtctttttggattacccaaatgtcttgaaataacttgagttgtgtggtatccgtttgattttttttcgagactgaatgagttctattgacaatttatttatcgaattcataaccagttagattacagattaataatttttattcagtttgacagtagatgaatagctgtatgtgtgttttaaattacaaaaacatatatctg

SEQ ID NO: 7965 - DNA, 1962 bp, Valeriana officinalis
cggttcaatctaataactccctcgttttcatcgacgatttccccctcttcttcttcttcttctccatcaccatcttttcttatttctcgccaactgtttctctctgttgatcaccattactactccaattcaatctaactacaaacttatctgaaaatcgtgcattccggttcttgatactaaaatggatgccgcaatgacattttgcagcaaacctgtctgctcaccaactccaaacaagaagttattatcgggaagagctagcacaattagcagttcccaatgtagctttatggtgggaaatagggtgcagtttcctaggcaaagagctcaagctcttcaatttagccgtaaatcagtaaaaagtgggagagctgttacaattacatgccgtgctgaaaagattttggtggcaaacagaggcgaaattgccgttcgtgtgattagaactgctcatgagatgggaatcccatgtgtggcagtttactcaaccatagataagatgcacttcacgtcaaactggctgatgattcggtttgtataggtgaagctgcaagcagtcaatcgtatttagtggtggcgaatgtgctatctgctgcgatcagtcgtggatgcacaatgctgcatcctggatatggtttcttggctgaaaacgcaggttttgttgaaatgtgcagagagcatggaatcaacttcatcgggccaaatccagatagcatacgtgttatgggcgacaaagcaactgccagggaaacgatgaagaatgcaggtgttccaactgtacctggaagtgacggcttattacagagcacagaagaaggtataaaactcgcagatgagattggatttccagtgatgatcaaggcaactgctggtggtggtgggcgtggaatgcgtcttgctaaagagagggacgagtttgttaagctactacaggcagccaagagtgaggctgcagctgcatttggaaatgatggtgtctatctggaaaagtatgttcagaatccaaggcacattgagtttcaggttcttgcagacaagtatggtaacgttattcattttggcgagcgtgactgcagtatccagagacgaaatcaaaagttgttggaagaagcaccatctccggcactaaccccggagttgaggaaagccatgggcgacgcagctgttgcagcagcagcgtccatcggctacgtcggtgttggtaccgttgagttccttttggatgaaagaggttcattttacttcatggaaatgaatactaggatccaggtagagcatcccgtgacagaaatgatatcctcagtggatctgattgaagaacaaatccgtgtagctatgggagaaaaactccggcacacacaggaagatatagttcttagaggacattccattgaatgccgtatcaatgcagaagatgcttttaaaaacttcagacccggcccagggagaatcacatcgtacttgccgtctggaggtccatttgtgagaatggacagtcatatataccctgattatgtggtaccaccgagctatgattccttactcggaaagcttatcgtatgggctccaacaagagaaagggcaattgcacgcatgaaaagagctcttagtgacactgtcattacaggggttccaacaacaatcgaataccataaacttatccttgacatcgaggacttcaaaaacgggaatgtcgacactgcctttatccctaagcatgaagatgaattagctgagccccagaaagaactcgcggtggctacagcctagagtgaaggtcatttatattacgatcgcggcctcagtttcagcatcaaatattttagtttggtctatacacaattttcttccccaatatgttttaatttaattgtatgtatgcttaagttaatcagttcgagttgcagaaagagatggatcacacataactaacaattcggatgacattgttgagttaca

SEQ ID NO: 7966 - DNA, 1735 bp, Ambrosia trifida
cagtaaaccaatcacatctcctccgggtttgttcattgggaggtctagtggaattaagagttcccagtgtaacttcttagttggaaataagttgagctttcctaagcaaagagttcaggcttcccaaaaggcttgtagatcagggaaacgcgagggagcacttggtgtcacttgccgtgcagaaaaaattctggtggcaaacagaggggaaattgctgtgcgtgtaattcgaactgctcatgagctagggatcccctgtgttgcggtgtactctactatagacaaggatgcacttcatgtgaaactggcggatgaatcagtttgcattggggaagctcctagtaatcaatcgtacttgctgatacctaatgtcctctctgctgccatcagtcgtggatgtacaatgttgcatcctggttatggtttccttgctgagaatgctgttttcgttgagatgtgcagagagcatggaataaacttcattgggccaaatcctgacagcattcgtgttatgggggacaaagcaactgctcgagataccatgaagaatgctggtgttccaactgtaccaggaagtgatggtctattacagagcactgaagagggcatcaggctcgctgacgagattggcttccctgtgatgattaaggctacagcaggcggtggaggtcgtggaatgcgtcttgcaaaagaacgtgatgagtttgtaaagttgttgcagcaagctcaaagtgaggctgcagctgcatttggaaatgatggtgtatatttggagaaatgcattataaatccaaggcacattgagttccaggttcttgcagacaaatatggaaatgttgttcactttggggagcgtgactgcagcatccagagaaggaaccagaagcttctagaagaagcaccctcaccagcattaaccccagaactgagaaaagccatgggtgatgcagctgttgctgcagcagcatcaattggctacattggtgttggtactatagagtttcttttggatgaaagaggtgatttttactttatggaaatgaacactagaatccaggtggagcatcctgtgacggaaatgatatcgtcagttgacttgatagaggagcagattcgggtagctatgggtgagaaactccgttacacacaggatgacatcgtgctcagaggacactcaattgaatgccgtattaacgcggaagatgctttcaaaaatttcagaccaggaccagggagaataacatcttacttgccatctggaggtccgtttgtgagaatggatagccatgtatatacagattatgttgttccaccaagctatgattctctacttggaaagcttattgtatgggccccaacaagagaaaaggcaattgaacgcatgaaaagggctcttgatgatactatcatcacaggggttccaacgacaatcgagtaccacaagttaattctcgacatcgaagattttaaaaacggaaaagttgacactgctttcattccaaagcatgaggacgaattagccgagccacataaatcgagtacttcaaatgctgccaaggaagtcgcaaaggctctagcttaaagagtgtttggtcctgtatgcatttaaatgttagaatttttgtttctcaagtctttgatccctcaaatgtcttgagctaactttatttcaggctgtgtcatctgttttaactttttgagagatccatgaataatatattcattgtttgctaaa

SEQ ID NO: 7967 - DNA, 1945 bp, Centaurea maculosa
  misc_feature (100)..(100): n is a, c, g, or t
  misc_feature (941)..(941): n is a, c, g, or t
  misc_feature (1016)..(1016): n is a, c, g, or t
  misc_feature (1274)..(1274): n is a, c, g, or t
  misc_feature (1314)..(1314): n is a, c, g, or t
  misc_feature (1319)..(1319): n is a, c, g, or t
  misc_feature (1340)..(1340): n is a, c, g, or t
  misc_feature (1766)..(1766): n is a, c, g, or t
  misc_feature (1781)..(1781): n is a, c, g, or t
  misc_feature (1806)..(1806): n is a, c, g, or t
cggggatttgatgtctgcaagtagttaaaacaaaaaaggctccgatttcgggcggagtattcaatgtgcataggttttatccctctttctcctttaactncttcacactctcttagctcaactgctacgcctaattccttagaatttttgagcgttttttgatatcagaaatggattccgccgccttgacattttgcagtagtaaaccgatatcatctcctccgggtttagtcatttggaggtctagtggaatcaagagctcccagtgtaacttcttggttggaagtaaggtgagctttcctaggcagagagttcaggcttctcaaagagtccgtagatcggggaaacgtgagggagcacttgctgttacttgtcgtgctgaaaaaattctggtggcaaacagaggtgaaattgcggtgcgagtgattcgaactgctcatgaactcgggattccttgtgttgcagtgtactccaccatagataaggatgcacttcatgtgaaactggctgatgaatcagtttgcataggggaagctcctagtagtcaatcgtacttgctgatacccaatgtcctgtctgctgctatcagtcgtggatgtacaatgttgcatcccggttatggtttccttgctgagaatgctgtttttgttgagatgtgcagagagcatggaatcaacttcatcgggccaaatcctgacagtattcgtgttatgggggacaaagcaactgctagagataccatgaagactgctggtgttccaactgtaccaggaagtgatggactgttacagagtaccgaagaaggcatcaggctcgccgatgagattggctttcctgtgatgatcaaggctacagcaggtggtggaggccgtggaatgcgtcttgcaaaagagcgtgacgagtttgtgaagttgttgcagcaagctaagagtgaggctgcngctgcatttggaaatgatggtgtttatttggagaagtacattcaaaacccaaggcacattgaattccaggttctngcagataaattcggaaatgttgttcactttggagagcgtgactgcagtattcagagaaggaaccaaaagttgcttgaagaagcaccctcgcctgcattaaccccagagctacggaaagccatgggtgatgcagccgttgctgcagcagcatcaattggctacattggtgttggtactgtagagtttcttttggacgaaagaggttcattctacttcatggaaatgaacactagaatccaggtagagcatcccgtgacngaaatgatatcttcagttgacttgatagaggagcagatcngggtngctatgggtgagaaactccgntacacacaggatgagatcgtgcttagaggacactcaattgaatgccgtattaatgcagaagatgctttcaaaaacttcagacctggaccagggagaataacatcttacttgccatctggaggtccgttcgtgagaatggatagccatgtatataccgattacgttgttccaccaagttatgattctcttcttggaaagcttatcgtatgggccccaacaagagaaaaggcaatcgaacgcatgaaaagggctcttaacgataccattatcacaggagttccaactacaatcgagtaccacaagctaattctcgacattgaagacttcaaaaacggaaaagttgatactgctttcatcccaaagcacgaggaggaattagccgagccccagaagttgattgcttcaaataacgctgctgcggctgcngctgctaaagaaatngccaagtctgtagcttaaataaagngtggttggtttgttcaaattttctgtatgcaaaaaaacgttactttttgtgtattagatgagttctaagctgtctgtttgatttttttagattgaattgacaattcatcgggattatattccaatccaaaaaaaaaaaa

SEQ ID NO: 7968 - DNA, 1894 bp, Cirsium arvense
cggagtattcaatctgcaaccatcatagattttatcgacacctctttcttcttctttaacttcattgctatcacactctcttcgttcaactgctacgcctagatattgccgacgttttgatatcagaaatggattccgccgccttgacattttgcagtagtaaaccgatatcttctcctccgggtttagtcattgggaggtctagtggaatcaagagctcccagtgtaacttcttggtcggaagtaaggtcagctttcctaggcagagagttcaggcttctcaaagagttcgtagatcggcgaaacgtgagggagcacttgctgttacttgtcgtgctgaaaaaattctggtggcaaacagaggtgaaattgcggtgcgagtgattcgaactgctcatgaactcgggattccttgtgttgccgtgtactccaccatagataaggatgcgcttcatgtgaaactggctgatgaatcagtttgcataggggaagctcctagtagtcaatcgtacttgctgatacccaatgtcctgtctgctgccatcagtcgtggatgtacaatgttgcatcccggttatggtttccttgctgagaatgctgtttttgttgagatgtgcagagagcatggaatcaacttcatcgggccaaatcctgacagtattcgtgttatgggggacaaagcaactgccagagataccatgaagactgctggtgttccaactgtaccaggaagtgaaggactgttacagagcaccgaagaaggcatcaaactcgccgatgagattggctttcctgtgatgatcaaggctacagcaggtggtggaggccgtggaatgcgtctcgcaaaagagcgtgacgagtttgtaaagttgttgcagcaagctcagagtgaggctgcagctgcatttggaaatgatggtgtttatttggagaagtacattcaaaacccaaggcacattgaattccaggttctcgcagataaattcggaaatgttgttcacttcggagagcgtgactgcagtattcagagaaggaaccaaaagttgcttgaagaagcaccctcgcctgcattaaccccagagctacggaaagccatgggtgatgcagccgttgctgcagcagcatcaattggctacattggtgttggtactgtagagtttcttttggatgaaagaggttcattctacttcatggaaatgaacactagaatccaggtagagcatcccgtgactgagatgatatcttcagttgacttgatagaggagcagatcagggttgctatgggtgagaaactccggtacactcaggatgagatcgtgcttagaggacactcaattgaatgccgtattaatgcagaagatgctttcaaaaacttcagacctggaccagggagaataacatcttacttgccatctggaggtccgttcgtgagaatggatagccatgtatataccgattacgttgttccaccaagttatgattctcttcttggaaagcttatcgtatgggccccaacaagagaaaaggcaattgaacgcatgaaaagggctcttaacgataccattatcacaggagttccaactacaatcgagtaccacaagctaattctcgacattgaagacttcaaaaacggaaacgttgatactgctttcattccaaagcacgaggaggaattagccgagccccagaagttgattgcttcaaataacgctgctgctgcggctgctgctaaagaagtcgccaagtctgtagcttaaataaaagagtggttggttggtttgttccaattttctgtatgcaaaaaacgtttaactttttgttgtattagatgagttctaagctgtctgtttgtattttttgtagattgaattgacaattcatcggattattccaa

SEQ ID NO: 7969 - DNA, 1595 bp, Arnica chamissonis
aaatttggattcctctcaattatttccgacgtttgatataagatatggattccgccgccgtgacattttgcagtaaaccaatcacatctcctccgggcttattcattgggaggtctagtggaattaagagttcccagtgtaacttcttggtgggaaataagttgagctttcctaagcaaagatttcaggcttttcaaagggctcatagatcagggaaacgtgagggagcacttgctgtcacttgccgtgctgaaaaaattctggttgcaaacagaggggaaattgcagtgcgggtgattcgaactgctcatgagctagggatcccctgtgttgcagtgtactctactatagataaggatgcacttcatgtgaaactggctgatgaatcagtttgcataggggaagctcctagtaatcaatcgtacttgctgatacccaatgtcctctctgctgctatcagtcgtggatgtacaatgttgcatcctggttatggattccttgctgagaatgctgtttttgttgagatgtgcagagagcatggaatcaacttcattgggccaaatcctgacagcattcgtgttatgggggacaaagcaactgcacgagataccatgaagaatgctggtgttccaactgtaccaggaagtgatggtctattacagagcactgaagaaggcatcaggctcgctgacgagattggcttccctgtgatgattaaggctacagcaggtggtggaggtcgtggaatgcgtcttgcaaaagaacgtgacgagtttgtaaagttgttgcagcaagctaagagtgaggctgcagctgcatttggaaatgatggtgtatatttggagaaatatattcaaaatccaaggcacattgagttccaggttcttgcagacaaatttggaaatgttgttcattttggggagcgtgactgcagcattcagagaaggaaccagaagcttctagaagaagcaccctcaccagcattaaccccagaactgagaaaagccatgggtgatgcagcagttgctgcagcagcatcaattggctacattggtgttggtactgtagagtttcttttggatgaaagaggtgaattttacttcatggaaatgaacactagaatccaggtagagcatcctgtgacggaaatgatatcatcggttgacttgatagaggagcaaattcgggtagctatgggtgagaaactccgttacacacaggatgaaatcgtgctcagagggcactcgattgaatgccgtattaatgcggaagatgctttcaaaaatttcagacctggaccagggagaataacatcttacttgccatcgggaggtccatttgtgagaatggatagccacgtgtataccgattatgttgttccaccaagctatgattctctacttggaaagcttattgtatgggccccaacaagagaaaaggcaattgaacgcatgaaaagggctcttaatgatactatcattacaggggttccaacgacaatcgagtaccacaagctaattcttgacatcgaagatttcaaagccgggaatgttgacactgctttcattccaaagcacgaggatgaattagccgag

SEQ ID NO: 7970 - DNA, 1968 bp, Eutrema parvulum
cttcttcttcttcctggtttgcatggttgattagatttgactgtttctttcctctgtaattcaggatctgcttcccttatccagcaatggacgcctcaatgattactaactgcaaatccgttgcctcccttccctctttattcctggggaggtcgggaggtagtattaggagttcccaatgtaatgtgatgggaaaatcggttagcttcccgaggcaaaaaacccagactttgaaggttagccggaacgtgaagagaagtggtggtggtggtgcgcttgctgctacttgcagcagcggggataagattctcgtggctaatagaggtgaaattgctgtccgtgttatccgaactgctcatgagatggggattccttgtgttgctgtttactcaaccatagacaaggatgcactgcatgtgaaattggctgacgaagcagtttgtattggtgaagctccaagcaaccagtcgtatttgttgataccgaatgttctgtcagctgcaattagccgaggatgtacaatgctccatcctggatatggattccttgcagagaacgctctttttgtagagatgtgcagagaccacaggatcaattttattggaccaaatcctgatagcatccgtgtcatgggtgacaaatcaactgctagggagacaatgaaaaatgcaggtgtcccaactgtaccagggagtgatggactattgcagagcacagaagaaggagtcaggctcgccaatgagattgggtaccctgtaatgatcaaggcaacagctggtggtggtggacgtggaatgcggcttgctaatgaaccatcagagtttgtgaaactgttgcagcaagcaaagagcgaggccgctgctgcttttggaaatgatggagtttatctggagaagtacgtgcaaaatccccggcatattgagttccagattcttgcagataaatttggtaatgttgttcactttggcgagcgtgactgcagcatccagagacgtaaccaaaagttgctggaagaagcaccttctcctgcactgacccctgagttgcgaaaagccatgggtgatgcagcggttgcagcagcagcgtcgattggttacattggtgttggtaccgtggaatttcttttggatgaaagaggttccttctatttcatggaaatgaacactagaatccaggtggagcatcctgtgacggagatgatttactccgttgatttgattgaagaacagattcgtgttgcaatgggagagaaactgcgttataaacaggaggaaattgtgcttagaggacactcgattgaatgtcgtatcaatgcagaagacccatttaaaggattcagacctggacctggaagaataacatcatatctgccatctggaggtccttttgttaggatggatagccatgtatatcccgactacgttgttcctccaagctatgattctcttcttggaaagcttatcgtatgggctccaactagggaaagggcaattgagcggatgaaacgtgcacttaatgacactattattacaggggttcccaccaccattgagtaccacaaacttatccttgatgttgaggatttcaagaacggaaaagttgatacagctttcatccccaagcatgaagaggaattagcagagcctcaggaaattgtcccagtgaaagatttgacaaatgtagctgcttagaatacatcagctcttacatgaaacagtgattttcggaacacaggggaatcaatgatgacaatacccgcaaaatcctcttacctggtgtcttcgtcttcttgagatgttatgcaacagcgcttcgcatgatttcggcaataattgtgttttcttgtgttgagtttatggtatttacaattcgttctaagggaattgttgatttagttcagaagtgtgagcactttatttcaacctccgagaccatttaagtatttctggaagaaaattttatataact

SEQ ID NO: 7971 - DNA, 1972 bp, Triphysaria pusilla
atagactgaatggttgcatatcgaacacgtttttggctgatgacaagaatatatcggttgacataaaatcgactcagacgatttctttttaattgatctgaaaatggactctgcaaccatgacattttgcagtaacccttatgttcgctcacctacgggtttatttatggggagcacagcaggaattaggagctcccagtgcagtttttttatggctggaagagttaactttcctcggcaaaggattcaggcttctaaagttggccgtaaatctggccaacgtggaggagctcttggtgctacatgccatgatgataaaatattggtggctaacagaggagagattgctgttcgagttattcggactgcccatgagatgggaatcccttgtgttgctgtttactcgacgatcgatagagatgctcttcatgtcaaactagctgatgagtctgtttgcattggtgaagcaccaagcaatcaatcttacctggtgattccaaatgtgttatctgctgccatcagccgtggatgtactatgctgcatcctggatatggtttcctttctgagaatgctgttttcgttgagatgtgcagagagcatggaatcaactttattggaccaaatcctaatagcattagagtcatgggtgacaagtcaactgctagggatacaatgaagaatgctggagttccaactgtccctggaagtgacggactgttacagactactgatgaagcagtgaagattgctgatcagattggttatcctgttatgatcaaggcaacagccggtgggggaggacgtggaatgcgccttgctaaaacgcctgatgagtttgtgaagttgttgcagcaagcgaagagtgaggctgcagctgcatttggtaatgatggtgtttaccttgagaagtatatccagaatccaaggcatattgagtttcaggttttggctgacaaatttggtaatgttgtgcactttggggagcgtgattgtagtattcagagaagaaaccagaagttactagaagaagcaccttcgcctgcattaactgaagagttgcgaaaagccatgggtgatgcagcagtagcagcagctgcatctattggttacattggtgttggaacagtcgagttccttttggatgaaagaggctccttttacttcatggagatgaacactaggatccaggtggagcatccggttacagaaatgatatcctccgtcgaccttattgaagaacagattcgtgtggctaggggagaaaaacttcgttacgttcaggaagatattgtgctcaaaggacattcaattgaatgccgtattaacgcagaagatgctttcaaaaacttcagacctggaccaggaagaataactgcgtacttgccagcaggaggtccattcgtgcgaatggatagccatgtctatcccgattatgtggtcccacctagttatgactctctgcttggaaagcttattgtctgggctccaacaagagaaagggcaattcaacgcatgaagagggctcttaatgaaactaccattacaggtgttccaacaacaattgaataccataagcttatccttgatattgaggactttaaaaatggtaaagtggatacagcttttattccgaaacacgaacaagagcttgctgcgcctgtgtcaaacgaactcgcaatggtcccaaaagagccagttaatgcttcttcttctgcttgagttaatctcatattgcatcaccggaagcaaacactcggtttgggctcttggattttgttttagtttgtgatgagatatatgtagttgcttattattatttgatagccgcgcacattcttgatctcgactatttgttttgttgcgagcttcagatatatgtgaaagtgagggattcaaccaactctttgtccaatctttcttggcataaagttgttaaccaggctcagttcttaaatgcagcagcagttttca

SEQ ID NO: 7972 - DNA, 2175 bp, Triphysaria pusilla
gttgtagagctaatcactctccatttctttcttgttttcatcgacgctcatcccttttcttcaaatctcccaactatttcacctgccatttatctatctcactctcttattgtcaacacgaaatctatctatacaagccccgaactagattgcaatttaagttccattttctaagatatttgttccgctagcagatccaattctctgtgttcaccgcgattccgttttaattgatctgaaaattgactctgcaactatgacattttgcagtaacccttgtgttcgctcacctccgggtttattcatggggagcacaacaggaattagaagctcccagtgcagcttttttatggctggaagagttaactttcctcagcaaaggcttcaggcttcttctagagttggtcgtaaatctggtaaacgtggaggagctcttggagctacatgccttgatgataagattctggtggctaacagaggagaaatcgctgttcgtgtgattcggactgcacatgagatggggataccttgtgttgctgtttactcgacgatcgataaagaagctcttcatgtcaaactggctgatgagtctgtttgcattggtgaagcaccaagcagtcaatcttacttggtgattccaaatgtgttatctgctgccatcagccgtggatgtactatgctgcatcctggatatggtttcctttccgagaatgctgtttttgttgagatgtgcagagagcatggaatcaactttattggaccaaatcctaatagtattagggtcatgggtgacaagtcaactgctagggatacaatgaagaatgctggagttccaactgtccctggaagtgacggattggtgcagactactgatgaagcagtgaagattgctgagcagattggttatccagttatgatcaaggcaacagccggtggaggaggacgcggaatgcgccttgctaaaacacctgatgagtttgtaaagttgttgcagcaagcgaagagtgaggctgcagctgcgtttggtaatgatggtgtttaccttgagaagtatatccagaatccaaggcatattgaatttcaggttttggctgacaagtttggcaatgttgtgcactttggggagcgtgactgtagtattcagagaagaaaccagaagttgctagaagaagcaccttctcctgcattaacagcagaattgcgaaaagccatgggtgatgcagcagtagcagcagctgcatctattggttacatcggtgttggaacagtcgagttccttttggatgaaagaggctccttttacttcatggagatgaacactaggatccaggtggaacatccagttacagaaatgatatcctctgtggaccttattgaagaacagatttgcgtggctatgggtgagaagcttcgttatgctcaggaagatattgtgctcagtggacattcaattgaatgccgtataaatgccgaagatgctttcaaaaacttcagacctggaccaggaagaataactgcataccttcccgctggaggcccattcgtgcgaatggatagccatgtatatccggattatgtggtcccacctagctacgattccctgcttggaaagcttattgtctgggctccaacaagagaaagggcaattgcacgcatgaagagggctcttaatgataccatcattacaggggttccaacaacaattgaataccataagcttatccttgaaattgaggactttaaaaatggaaaagtggatacagcttttattccgaaacacgaacaagagcttgctgagcctgtatcaaacgaacttgtaaaggcccacaaagagccggtcaatgcttctgcttgagctattctcatctcgttagtcttcaccggaagcagcaatctttcggttcgggctcttagattttaccttagttgtgatgagatagatatatatagttgttcgttatttaatagccgcgcacatttccgatcacatgaactcgactatttattcattttccgactttttattcgtcaaaacgagcttcagatatatgtgagtgaatgtgtggattcaaccaactctctttgtcccatctttcttggcataaatttcatcagcagcagttattaaataaatacaatagattttggcatgacaataaaataaaaaaaaaaaaa

SEQ ID NO: 7973 - DNA, 2324 bp, Theobroma cacao
gtttccatcgacatcttcctccatatctttctacgtctccattcccacaactgtcactctctctctttttctctctacattgtctaattcttgttcacatcaagcttggcattttttgcaatggcaatggatgcttcaatgacgatgtgcaaatctgttaactcacctcctggcttattcttggggagaagtagaggtattaggagttcccagtgtagctttatggtgggaagcaggatcaactttcctaggcagaaagctcaggcaacccaagttagatgtaaatctaataagcttggaggagctcttggtgctacatgccgtgctgagaaaattctggtggcaaatagaggagaaatagctgttcgtgtaatccgtacagctcatgagatgggaataccctgtgttgctgtctactcaacaatagataaggatgcactccatgtgaagttggctgatgaatcagtttgcataggcgaagcaccaagtagtcagtcgtatttattgattccaaatgtcttatctgctgcaattagccgtaactgtaccatgcttcatcctggatatggtttccttgctgagaatgcagtgtttgtagaaatgtgcagagaccaccgaatcaactttattgggcctaatgacttaattgaaattgattactgcaaatatgagatatctgttctgaatgaattctggcttttgctttggcagcctgacagtatccgtgttatgggtgacaaatcgactgctcgagaaacaatgaagaatgcaggtgttcctactgttccaggaagtgatggattgttacagagtacagaggaagcaatcaagcttgcccatgagattggctttcctgtgatgatcaaggccacagctggtggtggagggcgtggaatgcgtcttgctaaagagcctgatgagtttgtgaagttactgcagcaagccaaaagtgaagctgcagctgcattcgggaatgatggagtttatttggagaagtacattcaaaatccaaggcatattgagttccaggttctcgcggataaatatggtaatgttgttcactttggtgagcgcgactgcagcatccagagacgtaatcaaaaacttctagaagaggctccttctccagcattgacaccagagctgcggaaggcaatgggtgatgcagcagttgctgcagcagcatctattgggtacattggtgtaggaactgttgaattccttttggatgaaagaggttccttctacttcatggaaatgaacactagaatccaggtcgagcatcctgtaactgaaatgatttcctctgctgacttgattgaagaacaaattcgtgtagctatgggagaaaaacttcactacaaacaggaagatatcgtgctcagagggcattcaattgaatgtcgtatcaatgctgaagatgcatttaaagggttcagacctggaccaggaagaataacatcatacttgccatctggaggcccatttgtgagaatggatagccatgtttattctgattatgtagttcctccgagctatgattcactactcggaaagcttattgtatgggctcctacaagggaaaaagcaattgagcgcatgaaaagggctcttgatgacactgtaattacaggggttcctacaaccattgaataccataaactcatccttgatattgaggacttcagaaatggaaaggttgacactgctttcattcctaaacatgaagaagagttagcagcgccccagaaaatggtactagcaaccccgaccaaagaattgactagtgcaaccgcttagaagggttagtattctgcacatttttttatttggtttaagccgtcgagctgtcaacttggcattcattcaacggcctttttttcgttgaacagactgcatttagtttgaacttctgtaatgttgctattgctagtgcgttccatatgagaacttgtatgaaattttgacaatcatcagggtttctttcattccacagtcgaattgaattgtttgcataatgatgtagaattttggtatgcttattgccctcaaactcttagaaatggctatagtttgaaatgagttttctttgtttgattctggtggtatggtaagccattcattcagccaagaaactatactaatgcaatgtatttcgccagacattccattcattcatgaaagttgaaaatttttaagaggttgagttttctcaacaaagagaagaaaaaaagaagtaaactgtactcatatgcttggctcaatggtatttacctgagggattctcctttcactcttttgccaaatatatagaaaattaaggg

SEQ ID NO: 7974 - DNA, 1767 bp, Prunus persica
aggtcgctttgttttcaaaatggatgccataatgcccatttgcaagactgtaactccaagtcctggcttattttttgggaaaactagagagatacggagttccaaatgtagctttatggtgggaaataaagtcaactttttaaggcagagagctcagggtgctcaagttagtttcaaatccaggaagcatgggggagctctccatgctacatgtcgagctgaaaaaattctggtggcaaatagaggagaaattgctgttcgcattattcgaactgcccatgagatgggaataccttgtgtggctgtttactcaacaatagacaaggacgcacttcatgtgaaattggctgatgaatcagtttgtattggtgaagcagcaagcagtcagtcgtacttggttgttccaaatgttttatctgctgctatcagtcggaaatgtacaatgctgcatcccggatatggtttcctggctgagaatgcatcatttgttgaaatgtgcagagaacacggaatcaactttattgggcctaagcctgacagcatccgtgttatgggtgataaatcgactgccagagacacaatgaagaaagcaggtgttccaactgtaccaggaagtgatggattactagagagcacagaagaaggaatcaggcttgccgatgagattggctttcctgttatgatcaaggcaacagcaggaggcggaggacgtggcatgcgtcttgctaaagaacctgaagagtttgtgaagttgttacagcaagcaaagagtgaggctgcagctgcttttggaaatgatggagtttatttggaaaagtacatccaaaatcctagacacattgaatttcaggttcttgcagataaatatggtaatgttgttcactttggagagcgggattgcagtatccagagaaggaaccaaaagctgctggaagaagcaccctcccccgcattgaccccagaattgcgtaaagctatgggtgatgcagcagttgctgcagcagcatcaattggttacattggtgttggaaccgttgaattccttttggatgaaagaggcaccttttacttcatggaaatgaacacacgtattcaggttgagcatcctgtgacagagatgatttcctctgttgacttgattgaagaacaaattcgtgtagctatgggagaaaaacttcgatactcacaggatgagatagtgctcagaggacactcaattgaatgtcgtatcaatgcagaagatgcttttaaaggattccgacctgggccaggaagaataactgcctacttaccatctggaggtccctttgttagaatggatagccatgtttatcctgattatgtggttcctccaaactatgattcccttcttggaaagcttattgtttgggcaccaacaagagaaaaggcaattgaacgaatgaagagggctcttgacgacactattataacaggggttcccacaaccattgaatatcataaacttatccttgatatagaggatttcaaaaatgggaaggttgataccgcttttattccaaagcacgaagaggagctcgccgcgccccaacatttggtgctaaagaactagctgctgcatctgcttgaagtgctaccatcttctctagtcgaccacattagagaagctgcaaatcattcacttttttttttctttttcttttttgtattttagttgtttaatttgtgttcttgtttatttttatagcactaggaacattgacatgcctagtatatgagaattccatt

SEQ ID NO: 7975 - DNA, 1924 bp, Eutrema halophilum
actcactctttctccctcgtttgcatcgaaacctttctcggtttctcctccatcggatctgcttctcttattcaacaatggacgcatacatgattaccaattgcaaatcctttgcctcccctccctctttattcctggggaggtcgggaggaattagaagttcccagtgtaatgccatgatgggaaaaatggttagcttccctaggcaaagaactcagactttgaaagttacccgaaaggtgaagaggagtggtggtggtgcgcttgctgctacgtgtagtggggacaaaattcttgtggctaatagaggtgaaatagctgtccgtatcatccgaaccgcacatgaaatggggattccttgtgttgctgtttactcaactatagacaaggatgcactgcatgtgaaattggctgatgaagcggtttgtattggtgaagctcccagcaaccagtcgtacttgctgataccgaatgttctgtcagctgcaattagccgaggatgtacaatgcttcatcctggatatggattccttgcggagaacgctctttttgtagagatgtgcagggaccacaggatcaattttattggaccaaatcctgatagcatccgtgtcatgggtgataaagcaactgctagagagacgatgaaaaatgcaggtgtcccaactgtaccaggaagtgatggactattgcagagcacagaggaaggagtcaggctcgccaatgagattggttttcctgtaatgatcaaggcaacagctggtggtggtggacgtggaatgcggcttgccaatgaaccgtcagagtttgttaaactgttgcagcaagcgaagagtgaggctgctgctgcttttggaaatgatggatgttatctggagaagtatgtgcaaaatccccggcatattgagttccagattcttgcagataaatttggtaatgttgttcactttggcgagcgtgactgcagcatccagagacgtaaccaaaagttgctggaagaagcaccttctcctgcactgacccctgagttgcgtaaagccatgggtgatgcagcagttgctgcagcagcgtcgattgggtacattggtgttggtactgtggaatttcttttggatgagagaggttccttctatttcatggaaatgaatactagaatccaggtggagcatcctgtgacggagatgatttactccgttgatttgattgaagaacaggttcgtgttgcaatgggagagaaactgcgttataagcaggaagatattgtgcttagaggacactcgattgaatgtcgtatcaatgcagaagacccatttaaagggtttagacctggccctggaagaataacatcgtatctcccatctggaggtcctttcgttagaatggatagccatgtatatcccgactatgttgttcctccaagctatgattctcttcttggaaagcttattgtatgggctccgacaagggaaaaggcaatcgagcgaatgaagcgtgcacttaatgacactattattacaggggttcccaccaccattgaataccacaaacttatccttgatgttgaggatttcaagaacggaaaagttgatacagctttcatcgtgaagcatgaggaggaattagcagagcctatggaaattgtctcggtgaaagatttgacaaatgtagctgcttagaattcatcagctcttagatgaaacggtgattttcagaatcagagaaatcaattctgccaatgcccacaaagtccttttatttggtgtcttcgtcttcttgtgatgtctatgtaacagcacttcgcagagtttggcaataattgtgttctgttaagagtctggtattgacagtacattttaaggtactttgtgtgaaattctgatgaattgtcgaattagttcgaagataactctcagcattgcatttc

SEQ ID NO: 7976 - DNA, 1925 bp, Eutrema halophilum
actcactctttctccctcgtttgcatcgaaacctttctcggtttctcctccatcggatctgcttctcttattcaacaatggacgcatacatgattaccaattgcaaatcctttgcctcccctccctctttattcctggggaggtcgggaggaattagaagttcccagtgtaatgccatgatgggaaaaatggttagcttccctaggcaaagaactcagactttgaaagttacccgaaaggtgaagaggagtggtggtggtgcgcttgctgctacgtgtagtggggacaaaattcttgtggctaatagaggtgaaatagctgtccgtatcatccgaaccgcacatgaaatggggattccttgtgttgctgtttactcaactatagacaaggatgcactgcatgtgaaattggctgatgaagcggtttgtattggtgaagctcccagcaaccagtcgtacttgctgataccgaatgttctgtcagctgcaattagccgaggatgtacaatgcttcatcctggatatggattccttgcggagaacgctctttttgtagagatgtgcagggaccacaggatcaattttattggaccaaatcctgatagcatccgtgtcatgggtgataaagcaactgctagagagacgatgaaaaatgcaggtgtcccaactgtaccaggaagtgatggactattgcagagcacagaggaaggagtcaggctcgccaatgagattggttttcctgtaatgatcaaggcaacagctggtggtggtggacgtggaatgcggcttgccaatgaaccgtcagagtttgttaaactgttgcagcaagcgaagagtgaggctgctgctgcttttggaaatgatggatgttatctggagaagtatgtgcaaaatccccggcatattgagttccagattcttgcagataaatttggtaatgttgttcactttggcgagcgtgactgcagcatccagagacgtaaccaaaagttgctggaagaagcaccttctcctgcactgacccctgagttgcgtaaagccatgggtgatgcagcagttgctgcagcagcgtcgattgggtacattggtgttggtactgtggaatttcttttggatgagagaggttccttctatttcatggaaatgaatactagaatccaggtggagcatcctgtgacggagatgatttactccgttgatttgattgaagaacaggttcgtgttgcaatgggagagaaactgcgttataagcaggaagatattgtgcttagaggacactcgattgaatgtcgtatcaatgcagaagacccatttaaagggtttagacctggccctggaagaataacatcgtatctcccatctggaggtcctttcgttagaatggatagccatgtatatcccgactatgttgttcctccaagctatgattctcttcttggaaagcttattgtatgggctccgacaagggaaaaggcaatcgagcgaatgaagcgtgcacttaatgacactattattacaggggttcccaccaccattgaataccacaaacttatccttgatgttgaggatttcaagaacggaaaagttgatacagctttcatcgtgaagcatgaggaggaattagcagagcctatggaaattgtctcggtgaaagatttgacaaatgtagctgcttagaattcatcagctcttagatgaaacggtgattttcagaatcagagaaatcaattctgccaatgcccacaaagtccttttatttggtgtcttcgtcttcttgtgatgtctatgtaacagcacttcgcagagtttggcaataattgtgttctgttaagagtctggtattgacagtacattttaaggtactttgtgtgaaattctgatgaattgtcgaattagttcgaagataactctcagcattgcatttca

SEQ ID NO: 7977 - DNA, 2662 bp, Ricinus communis
gattggaaatggaaagaaaaccgtagagagagagtgaagcagaaagcaggtgagcttttgccaactaaatcaggcggagaattcaatctcctcgtttctatcggacccaaccccccaccttctccattcttaaaaacacccatctttctctacattcacagcattcctcattctcattctctcttttccttctcctttggatctcaacaatggaggccgcattgcctgtccacaaatctattctcactactccaaaatctcctggtttgtttatgaggagaaatggcagtattagaggaattaaagggagttctcaatgcagttttatggttggaaccaagcttaactttcaaagacaaaagctttttattcagtctgctgccaaagttacccataaggaaggtggtggtggtggtgctgctcttagggtctcgtgtcgagctgagaaaatattgatagcaaatagaggagaaattgcggtccgtgtaattagaactgctcatgaattgggaataccttgtgttgctgtttattctactattgataaggatgctcttcatgttaaattagctgatgagtctgtctgcattggtgaagcaccgagcagtcagtcctacttgttgattccaaatgttttatccgctgctatcagtcgcgggtgtacaatgttgcaccccggatatggctttcttgctgaaaatgcagtttttgttgaaatgtgcaaagaacatgggatcaactttattggcccaaaccctgacagtatccgagtaatgggtgacaaatcaactgccagggaaactatgaagaatgcaggtgttccgactgtacctgggagtgaaggtctgctacagagcacagaagaagcagtgaagcttgcccatgagattggctttcctgtgatgatcaaggcgacagcaggtggtggaggccgtggaatgcgtcttgctaaagagcccggcgagtttgtaaagttgctacagcaagctaagagtgaggctgctgcagcatttggaaatgatggagtgtatttggagaaatacattcagaatccaaggcacattgaattccaggttcttgcagataaatatggtaatgttgttcacttcggtgaacgtgactgcagcatccagaggcgtaatcagaagctgctcgaagaggcaccctctcctgcattgactcctgaattgcggaaagctatgggtgatgctgcagttgcagcagcagcatcaataggatatattggtgttgggacagttgagttccttttggatgaaagaggttccttctacttcatggaaatgaacactcgaatccaggttgagcatcctgttacagaaatgatatcctctgttgacttgattgaggagcaaattcgtgtagccatgggagaaaagctccggtacagacaggaagatattgtgcttagaggacattcaattgaatgccgtatcaatgcagaagatgcttttaagggattccgacctgggccagggagaataacagcatacttaccatctggaggcccatttgttagaatggatagccatgtctaccctgattatgtggttcctccaagttatgattccctactgggaaagcttatcgtgtgggctccaacaagagaaaaggcaatcgaacgcatgaaaagagcactggatgacacaattattacaggagttcctacgacgatagaataccataaacttatcctcgacattgaggacttcaaaaatgggaaggttgacactgctttcattccaaagcatgagcaggaattacaggcgccacagaagattgtaccggtcaaagaactggccagcgcaaccgcatagactgatcactgcgaagggcaaaaaagaaaaacaaaatgttcaacccatttcagtcacatttgaaaggtcagagttctcaatgtacatgcagagatgggctctcgattaccactctttaagtgcattccccttttcttatggaaggttgtagaatttgattgcgctaggcatgttagaagtcttcattcctgaaattttgatgttgccctttcaattggttggaattgttgtttctaattgatgttgcctgcaagctagagcttagatttatgtgaatttggaatataaagcatatggattgcctcaatgcaaaaatctatagaaattgaacctgaaagactgatgtcttctattactggaaatgctacattctaatgggaatataaggttcattttggctcctgtattttgcagccaggctcaatttgatccttttttaaaaatgcaacggctcctggtgcaatagcaagcaccaatttgacttggggagtggcgatttagtggcagtgggtggcaaggttgctttgtgagtaaacaaatataaaaaaaagctttctccgggtctaatgagaaagcattcgttcacgtcaggcaatgtaattgttgacgtagttgcttgtacttttcttttttttcgagattgggttggtgtggattttatggtacatctaaaaattattttggagccgatttagcataaaattttgattttttttctttttcaaatcaccccgttcgagaaagatagcaactgagtgactctgtaaaagagagtgaagtgctaaaagaataataaatgaataactatggctgatattcattaataa

SEQ ID NO: 7978 - DNA, 2286 bp, Quercus alba
tgcacatttgtattaataggtaatacgaagtactaaccaaaatcaagtccacgcacagttggagagtttcccaaccactttggcggagctcgcaacttgccacttcccttgtttttatcgaacacctcctcactcttttacccttcaaaaacctcttccaactctcacacttctttcttgaactctgtctctctaaattttggatcagaacatctccattatcattgttcccattccaaagaggcattttctccttctgtactgacaaaaatggatgccacactgccattttgtaaatctgtcacctcacctcctggcttatttgtggggagaagtagaggaatcagagcttctcaatgtagctttattgtgggaactagtagagtgaactttcctaggcaaagagtcgagggtgcacaagttggtggttataaatctaagaagcgtggaggagctctcaatgctacatgtcgtgctgagaaaattctgattgcaaatagaggagagattgccgttcgggtcattagaactgctcatgagatggggataccttgtgtggctgtttactcaaccattgacaaggatgcactccatgtgaaattggcagatgaatcaatttgcattggtgaagcgccaagcaatcagtcgtatttattaattccaaatgttctatctgctgctatcagccataagtgtacaatgctgcatcctggatatggtttcctagctgagaatgcagtatttgttgaaatgtgcaaagaacatcgaatcaacttcattgggcctaaccctgacagtatccgtgttatgggtgacaagtcaactgctagagaaacaatgaagaaggcaggtgttccaactgtaccaggaagtgatggattattacagagcacagaagaagcaatcaggcttgccaatgagattggatatcctgttatgatcaaggcaacagcaggtggtggtggccgtggcatgcgtctagctaaagaacctgatgagtttgtgaagatgctacagcaagccaaaagtgaggcagcagctgcatttggaaatgatggagtttatttggagaagtacattcaaaatcctaggcacattgagttccaggttcttgcagataaatatggtaatgtcgtccactttggagagcgtgattgcagcatccagagacggaatcaaaagctgctggaagaagcaccctctcctgcgttgaccccagagttgaggaaagcaatgggtgacgcagcggttgcagcagcagcatctataggttacattggtgttggaacagttgagttccttttggacgaaagaggttccttctactttatggaaatgaacactcggatccaggttgagcatcctgtgacagaaatgatttcctctgtggacttgattgaggaacaaattcttgtagctatgggagaaaaactccggtataaacaggaagatattgtgctcagaggacattcaattgaatgccgtatcaatgcagaagatgcctttaaaggattccgacctgggccagggagaataacagcatatttgccatctggaggtccatttgttagaatggatagccatgtttatcctgactatgtggttcctccaagctatgattcccttctaggaaagcttattgtatgggctccaacaagagaaaaggcaattgagcgcatgaaaagagctcttgatgacactattattacaggggttccaacaaccattgaataccataaacttatacttgatgtggaggatttcaaaaatggcaaagttgatactgcctttatcccaaagcatgagcaggaattagcagcgccccataacctggcaaagatctagctggcacagtttctttagatggatctcttgctctggtatttcaacctttttcagttcccagttctaacaaatcaaaatggttgcttgccattgattgtggcggaaggaggaaataccgagtgctgtcatgatgctgcagaagcctattgatagatgttgaattttttccattaagcatccttaagtgcaatgatcctgttctttttggggtatgatgcaccctttctgatggggaaaagcatgtaagcttggtgggtctcttgctagctttggctataacttggcatgtattttctgatgttcagcatcataccaaattcaattattaaccttttttttttttttgaggatgagaagaaattatgaaggtagtaacactttatagagtcacattattgttcaatataatataacaaatattgaatacattactgaacaaaa

SEQ ID NO: 7979 - DNA, 2023 bp, Brassica rapa
cattacaaaacacgggcgatccgattcaatcacttgtcccctcgttaacatcgaaacatttctcctcagagacaagaaggatctccgtttctttatccagcaaatggacgcctcaatgattactaattgcaaatccactgcctcccttccctctttgttcctggggaggtcgggaggtagcattagaagttcccagtgtaatgtcatgatggggaaagccattaccttcccgagccaaaagactcagactttgaaggttagccggaagaacgtgaataggaggtgtggtggtggtgcgcttggtgctacttgcagtactggggataagattcttgtggctaacagaggtgaaattgctgtccgtgtgatccgaactgctcatgaaatggggattccttgtgttgctgtttactcaaccattgacaaggatgcattgcatgtcaaattggctgatgaggctgtttgtattggtgaagctcctagcaaccagtcgtatttggtgataccgaatgttctgtcagctgcaattagccgaggatgcacaatgcttcatcctggatatggattcctttcagagaacgctctttttgttgagatgtgcagagagcacaggatcaactttattggaccaaatcctgatagcatccgtgtcatgggtgacaaatcaactgccagggagacgatgaagaatgctggtgtcccaactgtaccagggagtgatggactattaaagagcacagaagaaggagtcaagctcgccaatgagattgggtttcctgtgatgatcaaggcaacagctggtggtggtggacgtggaatgcgtctcgctaatgaaccgtcagagtttgtgaaactgctgcaggcagcaaagagtgaggccgcggctgcttttggaaatgatggagtttatctggagaagtacgtccaaaatccccgccatattgagttccagattcttgcagataaatttggaaatgttgttcacttcggcgagcgtgactgcagcatccagagacggaaccaaaagttgctggaagaagcaccttcccctgcactgacccctgagttgcgaaaagccatgggtgatgcagctgttgcagcagcagcgtccattgggtacgttggtgttggtaccgtggagttccttttggatgagagaggttccttctatttcatggaaatgaatactagaatccaggtggagcatcctgtgacagagatgatttactccgttgatttgattgaagaacagattcgtgttgctatgggagagaaactgcgttatacacaggatgagattgtgcttagaggacactctattgaatgtcgtatcaatgcagaggacccatttaaaggattcagacctggacccggaagaataacatcatatctgccatctggaggtccctttgtcagaatggatagtcatgtgtatcccgactatgttgttcctccaagctatgactctcttcttggaaagcttattgtatgggctccaacgagggaaagggcaattgagcggatgaaacgtgcacttaatgacactattattacaggggttcccaccaccattgagtaccacaaacttatccttgaagttgaggatttcaagaacggaaaagttgacactgcattcatccccaagcatgaagaggaattagcagagcctcatgaaattgtgctagtgaaagatttgacaaatgcagctgcttagagaactcatcagctcttgcatgaaaccagtaattttcagaacaagggggaatcaattatgccaatgcccgcaaagtcttcatccacttggcatgatctcagcgataattgtgttgttttttctttagagtttatggtattcacaatacgttccaagggaattgtcgatttagtgtgaggatctgtgagaacttcattttcagaccatttaagtatttcaagatgaaatgttttatgactaggctttaaatgtgagacttgatattcagtgtgtttgcctatttatccttagattttgtttcttgccatg

SEQ ID NO: 7980 - DNA, 1922 bp, Brassica napus
ctcctcagaggcaagaaggatctgcgtctcttatccagcaaatggacgcctcaatgattactaattgcaaatccactgcctcccttccctctttgttcctggggaggtcgggaggtagcattagaagttcccagtgtaatgtcatgatggggaaagccattaccttcccgagccaaaagactcagactttgaaggttagccggaagaacgtgaataggaggtgtggtggtggtgcgcttggtgctacttgcagtactggggataagattcttgtggctaacagaggtgaaattgctgtccgtgtgatccgaactgctcatgaaatggggattccttgtgttgctgtttactcaaccattgacaaggatgcattgcatgtcaaattggctgatgaggctgtttgtattggtgaagctcctagcaaccagtcgtatttggtgataccgaatgttctgtcagctgcaattagccgaggatgcacaatgcttcatcctggatatggattcctttcagagaacgctctttttgttgagatgtgcagagagcacaggatcaactttattggaccaaatcctgatagcatccgtgtcatgggtgacaaatcaactgccagggagacgatgaagaatgcaggtgtcccaactgtaccagggagtgatggactattaaagagcacagaagaaggagtcaagctcgccaatgagattgggtttcctgtgatgatcaaggcaacagctggtggtggtggacgtggaatgcgtctcgctaatgaaccgtcagagtttgtgaaactgctgcaggcagcaaagagtgaggccgcggctgcttttggaaatgatggagtttatctggagaagtacgtccaaaatccccgccatattgagttccagattcttgcagataaatttggaaatgttgttcacttcggcgagcgtgactgcagcatccagagacggaaccaaaagttgctggaagaagcaccttcccctgcactgacccctgagttgcgaaaagccatgggtgatgcagctgttgcagcagcagcgtccattgggtacgttggtgttggtaccgtggagttccttttggatgagagaggttccttctatttcatggaaatgaatactagaatccaggtggagcatcctgtgacagagatgatttactccgttgatttgattgaagaacagattcgtgttgctatgggagagaaactgcgttatacacaggatgagattgtgcttagaggacactctattgaatgtcgtatcaatgcagaggacccatttaaaggattcagacctggacccggaagaataacatcatatctgccatctggaggtccctttgtcagaatggatagtcatgtgtatcccgactatgttgttcctccaagctatgactctcttcttggaaagcttattgtatgggctccaacgagggaaagggcaattgagcggatgaaacgtgcacttaatgacactattattacaggggttcccaccaccattgagtaccacaaacttatccttgaagttgaggatttcaagaacggaaaagttgacactgcattcatccccaagcatgaagaggaattagcagagcctcatgaaattgtgctagtgaaagatttgacaaatgcagctgcttagagaactcatcagctcttgcatgaaaccagtaattttcagaacaagggggaatcaattatgccaatgcccgcaaagtcttcatccacttggcatgatctcagcgataattgtgttgtttttctttagagtttatggtattcacaatacgttccaagggaattgtcgatttagtgtgaggatctgtgagaacttcattttcagaccattcaagtatttcaagatgaaatgttttatgactaggctttaaatgtgagacttgatattcagtgt

SEQ ID NO: 7981 - DNA, 1985 bp, Arachis hypogaea
atcgacaatcgccattcggcattcgctaacccttcaaaaagcaaatcatagacagattcagttacaattaggatacaaaacacacataatggagagtagaataatggctgcgctcaactccgttacctctcctcatctgccttctcattccccgggtctgtacgcggtggagaacagcatcaagagctcccaatgcagcttctcagcggggagcaagaaggtgagttttccgaggcaaaggtgcagtcacgtgacgaagaccagggcggcacgtgatggtggtgctggtggtgctctcggtgccacgtgtcaggcggagaagatcctggtggcgaacagaggcgagatcgcggtgcgagtcatcagaaccgctcatgagatgggaattccgtgcgtggctgtgtactcgaccattgataaggacgcgcttcatgtcaagctcgctgatgatgctgtttgcatcggtgaagcgcctagcagtcaatcgtacttattgattccaaatgttctatctgctgctattagccgaagatgcacaatgttgcatcctgggtatggtttccttgctgaaaatgcagtgtttgttgagatgtgcagagagcatggaatcaattttattgggccaaatcccgacagtattcgggttatgggtgacaaatcaactgccagagatacaatgaagaaagcaggtgttcctacggttccgggaagtgatggattgttacagaccacagaggaagctatcaggctggcaaatgagattggtttccctgtaatgatcaaggcaacagctggaggtggagggcgtggcatgcgccttgctaaagaacctgatgaatttgtaaagttattacagcaagctaagagtgaagctgctgctgcatttggtaatgatggagtttatttggaaaagtatgtccaaaacccaaggcacattgagttccaggttcttgctgataaatatggtaatgtagttcactttggagaacgtgattgcagcatccagaggcgtaatcagaaactgttggaagaagcaccttctcctgcattgaccccagagttgcgtaaggcaatgggtgatgcagcagttgctgcagctgcatctataggttacataggtgttggaacggttgagttcctcttggatgaaagaggttctttttacttcatggagatgaacactcgtatccaggttgagcatccggtgacagaaatgatttcttctgttgatttgatagaagagcaaattcgtgtagctatgggggaaaaacttcgatacaaacaggaggatattgtgctcagaggacattctattgaatgccgtatcaatgcagaggatgctttcaagggttttagaccagggccaggtagaataacagcatacttgccatctggtggtccatttgttagaatggacagccatgtttatcctgattatgtggttcctccaagctatgactcccttcttggaaagcttattgtttgggctccaacaagagaaaaggcaattgaacgtatgaaaagggcacttgatgacacaattatcacaggggttcctactacaattgattaccataaacttatccttgacatagaggatttcaaaaatggcaaagttgatactgcttttattccaaagcatgaagaggagttggcaatgcctcctgtgaagatggtactggccaaagaattcgctggtgtaaatgcatgatggatatgatatgacatttgggatatcatcaagaatggctggccttgttttaatcactctctccgtgcatttatgtgaaaattttaatgaaaattttgataattaacttggcactattgtctttgttcttgatacattgtaaaaaccaaacttcatgtttggttctattgctaatatcaaatactggtgctagaaagtgcgagtacccctttgcaattcttcaagattcatagttgtattgtgactgatgaaatattctaaatttttgttttcc

SEQ ID NO: 7982 - DNA, 1936 bp, Artemisia annua
acatctcctcctcacttcacatttccgcatttcatttcactcttggctcaactgctacacctaattccttgttaaaaataggcacattcacattcaaatttttatataaggagctatggattcagctgctgtcatgaactgcagtaagccgatttcgacctcggtttcctcctctcttccgggtttatttatcgggaggtctagtggacttaagagctcacagtgtaacttcttggctggaagtaaggtgagctttcctaagcaacgagttcaagcttctcaaaaggctcgtagctcagcgaaacaagcaggagcacttggtgttacttgccgtgctgaaaaaattctggtggcaaacagaggagaaattgcagtgcgagtgattagaactgctcatgagttaggaatcccctgcgttgcagtgtactccactatcgataaggatgcccttcatgtgaaactggctgatgagtcggtttgcatcggagaagctcctagtaatcaatcgtacttgttgatacccaatgtcctgtctgctgccatcagtcgtggatgtacaatgttgcatcctggttatggtttccttgctgagaatgctgtttttgttgagatgtgtagagagcatggaattaacttcatcgggccaaaccctgacagcattcgtgttatgggggacaaagcaactgcccgagagaccatgaagaatgctggtgttccaactgtaccaggaagcgagggtcttttatcgagcacagaagaaggaatcaaacttgctgacgagattggcttcccagtgatgattaaggctacagcaggtggggaatgcgtcttgcaaaagaacgtgatgagtttgtgaagttgttgcagcaagctcagagcgaggctgcagctgcatttgggaatgatggtgtgtatttggagaaggccattctaaatccaaggcacattgagttccaggttcttgcagacaaatatggaaatgttgttcatttcggggaacgtgactgcagtattcagagaagaaaccaaaagttgcttgaagaagcaccatcacctgcattaaccccagagctgaggaaagccatgggtgatgcagcagttgctgcagcagcatcaattggctacattggtgttggtactgtagagtttcttttggacgaaagaggtggattctacttcatggaaatgaacactagaatccaggttgagcatcctgtgaccgaaatgatatcttccgtcgacttgatagaggagcagattcgggtagcaatgggtgagaagctacgttacacacaggatgaaattgtgcttagaggacattcaattgaatgccgtatcaacgcggaagatgctttcaaaaatttcagacctggaccagggagaattacttcttacttgccatctggaggtccattcgtgagaatggatagtcacgtatataccgattacgttgttccaccaagctatgattctctacttggaaagcttattgtatgggccccaaccagagaaaaggctattgaacgcatgaaaagggctcttaatgacactatcattacaggtgttccaacgacgatcgaataccacaagctaatccttgacatcgaagactttaaaaatggaaaagttgatactgccttcattcctaagcacgaggaggaattagctgagccacaggcacataaaatgattacaacaaatggtgctaaagaagtcgcaaaatctgtagcttaaagagtggatcggccacatttttctgtatgcaaaaatgttactttttttgtcttgtagtcttttgatcccccaaacatcttgatataactctcgaactgtggcatccatttgattttttgagtcttattgagtgttacattaacaatccatcgaatatttgctaagatgttgattattaatccttagccacaaattgtaactc

SEQ ID NO: 7983 - DNA, 1984 bp, Triphysaria pusilla
tttctttcttgttttcatcgacgctcatcccttttcttcaaatctcccaactatttcacctgccatttatctatctcactctcttattgtcaacacgaaatctatctatacaagccccgaactagattgcaatttaagttccattttctaaggcgattccgttttaattgatctgaaaattgactctgcaactatgacattttgcagtaacccttgtgttcgctcacctccgggtttattcatggggagcacaacaggaattagaagctcccagtgcagcttttttatggctggaagagttaactttcctcagcaaaggcttcaggcttcttctagagttggtcgtaaatctggtaaacgtggaggagctcttggagctacatgccttgatgataagattctggtggctaacagaggagaaatcgctgttcgtgtgattcggactgcacatgagatggggataccttgtgttgctgtttactcgacgatcgataaagaagctcttcatgtcaaactggctgatgagtctgtttgcattggtgaagcaccaagcagtcaatcttacttggtgattccaaatgtgttatctgctgccatcagccgtggatgtactatgctgcatcctggatatggtttcctttccgagaatgctgtttttgttgagatgtgcagagagcatggaatcaactttattggaccaaatcctaatagtattagggtcatgggtgacaagtcaactgctagggatacaatgaagaatgctggagttccaactgtccctggaagtgacggattgttacagactactgacgaagcagtgaagattgctgatcagattggttatcctgttatgatcaaggcaacagccggtgggggaggacgtggaatgcgccttgctaaaacgcctgatgagtttgtgaagttgttgcagcaagcgaagagtgaggctgcagctgcatttggtaatgatggtgtttaccttgagaagtatatccagaatccaaggcatattgagtttcaggttttggctgacaaatttggtaatgttgtgcactttggggagcgtgattgtagtattcagagaagaaaccagaagttactagaagaagcaccttcgcctgcattaactgaagatttgcgaaaagccatgggtgatgcagcagtagcagcagctgcatctattggttacattggtgttggaacagtcgagttccttttggatgaaagaggctccttttacttcatggagatgaacactaggatccaggtggagcatccggttacagaaatgatatcctccgtcgaccttattgaagaacagattcgtgtggctaggggagaaaaacttcgttacgttcaggaagatattgtgctcaaaggacattcaattgaatgccgtattaacgcagaagatgcttttaaaaatttcagacctggaccaggaagaataactgcgtacttgccagcaggaggtccattcgtgcgaatggatagccatgtctatcccgattatgtggtcccacctagttatgactctctgcttggaaagcttattgtctgggctccaacaagagaaagggcaattcaacgcatgaagagggctcttaatgaaactaccattacaggtgttccaacaacaattgaataccataagcttatccttgatattgaggactttaaaaatggtaaagtggatacagcttttattccgaaacacgaacaagagcttgctgcgcctgtgtcaaacgaactcgcaatggtcccaaaagagccagttaatgcttcttcttctgcttgagttaatctcatattgcatcaccggaagcaaacactcggtttgggctcttggattttgttttagtttgtgatgagatatatatagttgcttattattatttgatagccgcgcacattcttgatctcgactatttgttttgttgcgagcttcagatatatgtgaaagtgagggattcaaccaactctt

SEQ ID NO: 7984 - DNA, 2138 bp, Brassica rapa
aaataaatttgacttttctgtgtgtttcagttagattcagttcagtctctcactcaatctcccctagtttacatcgaaacacttctcctgggagagaaaaacaaagaaagattctgcttcctctgtaaaccaggatctgcgtgcaatggacgcctcaatgattactaatcccaaatccattgtctcccttccctctttgttcatggggaggtcgggaggtagtattagaagttcccaatgtaatgtcactatgggacaaacggttagcttcccgaggcaaaagactctgactttaaaagttagccggaacgtgaagagaaaaagtggtggtggtgcgtttgctgctacttgtagcagtggggataagattcttgtggctaacagaggtgaaatcgctgtccgtgttatccgaacagctcacgaaatggggatcccttgtgttgctgtttactcaactatagacaaggatgcacttcatgtgaagttggctgatgaagctgtttgtattggtgaagctcctagcaaccagtcgtatttgttgataccgaatgttctgtcagctgcgattagcagaggatgtacaatgctccatcctggatatggattccttgcggagaacgctctttttgtagagatgtgtagagaacacaggatcaatttcattggaccaaatcctgatagcatccgtgtcatgggtgacaaatcaactgctagggagacaatgaaaaatgctggtgtccctactgtaccagggagtgatggattattgcagagcacagaggaaggagtcaggctcgccaatgagattgggtaccctgtaatgatcaaggcaacagcaggtggtggtggacgtggaatgcgtcttgccaatgaaccgtcagagtttgtgaaactgttgcagcaagcaaagagtgaggccgctgctgcttttggaaatgatggagtttatctggagaagtacgtgcaaaatccccgtcatattgagttccagattcttgccgataaatttggtaacgttgttcactttggcgagcgtgactgcagcatccagaggcgtaaccaaaagttgctggaagaagcaccttctcctgcactgacccctgagctgcgaaaagccatgggtgatgcagcagtggcagcagcagcgtccattggttacattggtgttggtacagtggagtttcttctggatgagagaggttccttctatttcatggaaatgaacactagaatccaggtggagcaccctgtgacggagatgatttactcagttgatttgattgaagaacagatccgtgttgcaatgggagagaaactgcgttatacacaggatgagattgtgcttagaggacattcgattgagtgtcgtatcaatgcagaagacccatttaaaggattcagacctggacctggaagaataacatcgtatctgccatctggaggtccttttgttaggatggatagccatgtgtatccggactatgttgttcctccaagctatgattctcttcttggaaagcttattgtatgggctccaacgagggaaagggcgatcgagcggatgaagcgtgcactcaatgacactattattacaggggttcccaccaccattgagtaccacaagcttatccttgaagttgaggatttcaaaaacggaaaagttgatacagctttcatccccaagcatgaagaggaattagcagagcctgatgaaattgtcccagtgaaagatttgacaaatgtagctgcttagaatccatcagctcttacatgaagcagtgatatttggaacaacaggggattcagttatgccaatatgtccgcaaagttttcttacctgattctggtgtcttcgccttttgtgatgttatgcaatagcaacttcacacatggtttcgaaaatagttgtgttttttttttccggttgagtttatggtatttacagtacttcatttcagacctgagaccatttttaagtatttcttgactgcaatagttgagtttatttatgttattagcaagtccgaactttaaatcatttataaacacaatgtccttgtggtgttatgcaagacagagtcatcttgtaagtttaggtatgatgattatagataaaaataaaatataatttgctgata

SEQ ID NO: 7985 - DNA, 2007 bp, Brassica napus
aaacatttctcctcagagacaagaaggatctcagtctcttatccagcaaatggacgcctcaatgattactaattgcaaatccactgcctcccttccctctttgttcctggggagatcgggaggtagtcttagaagctcccagtgtaatgtcatgatggggaaaaccattaccttcccgagccaaaagactcagactttgaaggttagccggaagaacgtgaataggaggtgtggtggtggtgcgcttggtgctacctgcagtggggataagattcttgtggctaacagaggtgaaattgctgtccgtgtgatccgaactgctcatgagatggggattccttgtgttgctgtttactcaaccatcgacaaggatgcattgcatgtcaaattggctgacgaggctgtttgtattggtgaagctcctagcaaccagtcgtatttggtgataccgaatgttctgtcagctgcaatcagccgaggatgcacaatgcttcatcctggatatggattcctttcagagaacgctctttttgttgagatgtgcagagagcacaggatcaactttattggaccaaatcctgatagcatccgtgtcatgggtgacaaatcaactgccagggagacgatgaagaatgcaggtgtcccaactgtaccagggagtgatggactattaaagagcacagaagaaggagtcaagctcgccaatgagattgggttccctgtgatgatcaaggcaacagctggtggtggtggacgtggaatgcgtcttgctaatgaaccgtcagagtttgtgaaactgctgcaggcagcaaagagtgaggccgcggctgcttttggaaatgatggagtttatctggagaagtacgtccaaaatccccgccatattgagttccagattcttgcagataaatttggaaatgttgtgcacttcggcgagcgtgactgcagcatccagagacggaaccaaaagttgctggaagaagcaccttctcctgcactgacccctgagttgcgaaaagccatgggtgatgcagctgttgcagcagcagcgtcgattggctacgttggtgttggtaccgtggagttccttttggatgagagaggttccttctatttcatggagatgaacactagaatccaggtggagcatcctgtgacagagatgatttactctgttgatttgattgaagaacagattcgtgttgcaatgggagagaaactgcgttatacacaggatgagattgtgctaagaggacactctattgaatgccgtatcaatgcagaggacccattcaaaggattcagacctggacctggaagaataacagcatatctgccatctggaggtccttttgttagaatggatagtcatgtgtatcccgactatgttgttcctccaagctatgactctcttcttggaaagcttattgtatgggctccaacgagggaaagggcaattgagcggatgaaacgtgcacttaatgacactattattacaggggttcccaccaccattgagtaccacaaacttatccttgaagttgaggatttcaagaacggaaaagttgacactgctttcatccccaagcatgaggaggaattagcagagcctcatgaaattgtgctagtgaaagatttgacaaacgcagctgcttagaatccatcagctcttaagatgaaacagtaattttcagaacacgggggaatcgtttatgccaatgcccgcaaagtcttcatccacttggcatgatctcagcgataattatgttgtttttctttagagttcatggtattcacaatacgttctaagggaattgtcgatttggtgcgaggatctatgagaacttcattttcagactataagatgtgatgttttataactgtggaggtttcggtagactataatcagtgtgttacctgtttatcctttagaattttctgcttgacatttctctcttccttctttagattcttatggtatttttctctctggagtatctctaggga

SEQ ID NO: 7986 - DNA, 1822 bp, Brassica napus
catcgaaacacttctcctgggagagaaaaacaaagaaggatctgcgtgcaatggacgcctcaatgattactaatcccaaatccattgtctcccttccctctttgttcatggggaggtcgggaggtagtattagaagttcccaatgtaatgtcactatgggacaaacggttagcttcccgaggcaaaagactctgactttaaaagttagccggaacgtgaagagaaaaagtggtggtggtgcgtttgctgctacttgtagcagtggggataagattcttgtggctaacagaggtgaaatcgctgtccgtgttatccgaacagctcacgaaatggggatcccttgtgttgctgtttactcaactatagacaaggatgcacttcatgtgaagttggctgatgaagctgtttgtattggtgaagctcctagcaaccagtcgtatttgttgataccgaatgttctgtcagctgcgattagcagaggatgtacaatgctccatcctggatatggattccttgcggagaacgctctttttgtagagatgtgtagagaacacaggatcaatttcattggaccaaatcctgatagcatccgtgtcatgggtgacaaatcaactgctagggagacaatgaaaaatgctggtgtccctactgtaccagggagtgatggattattgcagagcacagaggaaggagtcaggctcgccaatgagattgggtaccctgtaatgatcaaggcaacagcaggtggtggtggacgtggaatgcgtcttgccaatgaaccgtcagagtttgtgaaactgttgcagcaagcaaagagtgaggccgctgctgcttttggaaatgatggagtttatctggagaagtacgtgcaaaatccccgtcatattgagttccagattcttgccgataaatttggtaacgttgttcactttggcgagcgtgactgcagcatccagaggcgtaaccaaaagttgctggaagaagcaccttctcctgcactgacccctgagctgcgaaaagccatgggtgatgcagcagtggcagcagcagcgtccattggttacattggtgttggtacagtggagtttcttctggatgagagaggttccttctatttcatggaaatgaacactagaatccaggtggagcaccctgtgacggagatgatttactcagttgatttgattgaagaacagatccgtgttgcaatgggagagaaactgcgttatacacaggatgagattgtgcttagaggacattcgattgagtgtcgtatcaatgcagaagacccatttaaaggattcagacctggacctggaagaataacatcgtatctgccatctggaggtccttttgttaggatggatagccatgtgtatccggactatgttgttcctccaagctatgattctcttcttggaaagcttattgtatgggctccaacgagggaaagggcgatcgagcggatgaagcgtgcactcaatgacactattattacaggggttcccaccaccattgagtaccacaagcttatccttgaagttgaggatttcaaaaacggaaaagttgatacagctttcatccccaagcatgaagaggaattagcagagcctgatgaaattgtcccagtgaaagatttgacaaatgtagctgcttagaatccatcagctcttacatgaagcagtgatatttggaacaacaggggattcagttatgccaatatgtccgcaaagttttcttacctgattctggtgtcttcgccttttgtgatgttatgcaatagcaacttcacacatggtttcgaaaatagttgtgttttttt

SEQ ID NO: 7987 - DNA, 1686 bp, Centaurea maculosa
attttgcagtagtaaaccgatatcatctcctccgggtttagtcatttggaggtctagtggaatcaagagctcccagtgtaacttcttggttggaagtaaggtgagctttcctaggcagagagttcaggcttctcaaagagtccgtagatcggggaaacgtgagggagcacttgctgttacttgtcgtgctgaaaaaattctggtggcaaacagaggtgaaattgcggtgcgagtgattcgaactgctcatgaactcgggattccttgtgttgcagtgtactccaccatagataaggatgcacttcatgtgaaactggctgatgaatcagtttgcataggggaagctcctagtagtcaatcgtacttgctgatacccaatgtcctgtctgctgctatcagtcgtggatgtacaatgttgcatcccggttatggtttccttgctgagaatgctgtttttgttgagatgtgcagagagcatggaatcaacttcattgggccaaatcctgatagtattcgtgttatgggggacaaagcaactgccagagataccatgaagactgctggtgttccaactgtaccaggaagtgatggactattacagagcactgaagaaggcatcaggcttgccgatgagattggctttcctgtgatgatcaaggctacagcaggtggtggaggccgtggaatgcgtcttgcaaaagagcgtgacgagtttgtgaagttgttgcagcaagctaagagtgaggccgcagctgcatttggaaacgatggtgtttatttggagaagtacattcaaaatccaaggcacattgaattccaggttctcgcagataaattcggaaatgttgttcactttggagagcgtgactgcagtattcagagaaggaaccaaaagttgcttgaagaagcaccctcgcctgcattaaccccagagctacgtaaagccatgggtgatgcagccgttgctgcagcagcatcaattggctacattggtgttggtactgtagagtttcttttggacgaaagaggttcattctacttcatggaaatgaacactagaatccaggtagagcatcccgtgaccgaaatgatatcttcagttgacttgatagaggagcaaatccgggtggctatgggtgagaaactccgatacacacaggatgagatcgtgcttagaggacactcaattgaatgccgtattaatgcagaagatgctttcaaaaacttcagacctggaccagggagaataacgtcttacttgccatctggaggtccattcgtgagaatggatagccatgtatataccgattacgttgttccaccaagttatgattctcttcttggaaagcttatcgtatgggccccaacaagagaaaaggcaatcgaacgcatgaaaagggctcttaacgataccattatcacaggagttccaacgacaatcgagtaccacaagctaattcttgacattgaagacttcaaaaacggaaaagttgatactgctttcatcccaaagcacgaggaggaattagccgagccccagaagttgattgcttcaaataatgctgccgctgctgctgctgctaaagaagccgccaagtctgtagcttaaataaagagtggtggttggtttgttccaattttctgtatgcaaaaaacgttacttgttgtgtattagatgagttctaa

SEQ ID NO: 7988 - DNA, 2151 bp, Glycine max
gccacgtagcagtccaaattgtccgagtaccttccaactagatttagatttaggcggagctttcaatttcgcacctccctcgtttccatcgacatccgcatcaaaagaccttctctttctcttgccatcatttcattccccatacgctccatccatcaccctttctttcattctgttgggaaatggaagtcacactttcagcgtgcaagtccattagctcgccttctgttcccgtcgcagctttatttgcggggaaagcaggaactaagagttcgcaatgcagttttttagctggagcaaacaaagtgaggtttcctaggcaagtcggtcaagttagccacgttcgcaaacagcgccaaacgcgtcactgtggtgctctccacgcgacttgcagcggtgacaagatcctgatcgcgaatagaggcgagattgcggttcgcgttattcgaaccgctcatgaattggggattccgtgtgtggctgtgtactccaccattgataaggacgcccttcatgtcaaactggctgatgaagctgtatgcatcggcgaagcgccgagtagccagtcgtacttgctgatcccgaatgttctgtcggctgctattagccgcagatgcacgatgttgcatcctggctatggttttcttgcggagaatgctgtgtttgttgaaatgtgcagggaacatggaatcaactttattgggcccaaccctgacagtattcgggttatgggtgacaaagcaactgccagagagacaatgaagaaagcaggtgttcccaccgttccaggaagtgatggccttttacagagcacagaagaagctattaggctggcaaatgagattggtttccctgtgatgatcaaggcaacagctggtggtggaggacgtggcatgcgtcttgctaaagaacctgatgagtttgtgaagttgttacagcaagctaagagtgaggcagctgctgcatttggcaatgacggggtttatttggagaagtacattcaaaacccaaggcacattgagttccaggttcttgcagataaatatggtaatgttgttcactttggagaacgtgattgcagcattcagaggcgtaatcagaaactgcttgaagaagcaccatctcctgccctgacccctgagttgcgaaaggcaatgggagatgcagcagttgctgctgctgcatctattggttacataggtgttggaacgattgagtttcttttggatgaaagaggttccttttactttatggagatgaacacacgtatccaggttgagcatcctgtgacagaaatgatttcctcaacagatttgatagaagagcaaattcgtgtagctatgggagaaaaacttcgatacaaacaggaggatattgtcctcagaggacattctattgaatgccgtatcaatgcagaagatgcttttaagggatttagaccagggccaggtagaattacagcatacttgccatctggaggtccatttgttagaatggatagccatgtttatcctgattatgtggttcctccaagctatgactcccttcttggaaagctgattgtatgggctccaacaagagaaaaagcaattgaacgcatgaaaagggcacttgatgacactattatcacaggagttcctactacaattgattatcataaacttatccttgacatagaggatttcagaaatggaaaggttgatactgcttttattccaaaacacgaggaagagttggcaatgcctccgcagaagatggtactcgctaacagggtgaacgaactagctggttcaactgcctgatgaatatgattgtgtgatgtcagaattgctttttgtaatcgccgtgttgtcagtgcctcgaagtgaatgttttaatgaaattttgataattagtctcgtacattccttttcttcacataattatattgtaaaatcaattaattcatgtttgatttcatcccaaatattattgcaaggaattaagaataggtccttgcatttttttcggaagtcatagttgtcacaatggttggtttagaggatcttgtattaagagctcgatgctagatacagtaataaaaacttaaccttatcctaatagactgggtttgttatatggatcaattggcgtcgctagatacttagaata

SEQ ID NO: 7989 - DNA, 2089 bp, Glycine max
ctagatttagatttaggcggagttttcaatttcgcacctccctcgtttccatcgacatccgcatcaaaagaccttctctttctcttgccatcatttcattccccatacgctccatccatcaccctttctttcattctgttgggaaatggaagtcacactttcagcgtgcaagtccattagctcgccttctgttcccgtcgcagctttatttgcggggaaagcaggaactaagagttcgcaatgcagttttttagctggagcaaacaaagtgaggtttcctaggcaagtcggtcaagttagccacgttcgcaaacagcgccaaacgcgtcactgtggtgctctccacgcgacttgcagcggtgacaagatcctgatcgcgaatagaggcgagattgcggttcgcgttattcgaaccgctcatgaattggggattccgtgtgtggctgtgtactccaccattgataaggacgcccttcatgtcaaactggctgatgaagctgtatgcatcggcgaagcgccgagtagccagtcgtacttgctgatcccgaatgttctgtcggctgctattagccgcagatgcacgatgttgcatcctggctatggttttcttgcggagaatgctgtgtttgttgaaatgtgcagggaacatggaatcaactttattgggcccaaccctgacagtattcgggttatgggtgacaaagcaactgccagagagacaatgaagaaagcaggtgttcccaccgttccaggaagtgatggccttttacagagcacagaagaagctattaggctggcaaatgagattggtttccctgtgatgatcaaggcaacagctggtggtggaggacgtggcatgcgtcttgctaaagaacctgatgagtttgtgaagttgttacagcaagctaagagtgaggcagctgctgcatttggcaatgacggggtttatttggagaagtacattcaaaacccaaggcacattgagttccaggttcttgcagataaatatggtaatgttgttcactttggagaacgtgattgcagcattcagaggcgtaatcagaaactgcttgaagaagcaccatctcctgccctgacccctgagttgcgaaaggcaatgggagatgcagcagttgctgctgctgcatctattggttacataggtgttggaacgattgagtttcttttggatgaaagaggttccttttactttatggagatgaacacacgtatccaggttgagcatcctgtgacagaaatgatttcctcaacagatttgatagaagagcaaattcgtgtagctatgggagaaaaacttcgatacaaacaggaggatattgtcctcagaggacattctattgaatgccgtatcaatgcagaagatgcttttaagggatttagaccagggccaggtagaattacagcatacttgccatctggaggtccatttgttagaatggatagccatgtttatcctgattatgtggttcctccaagctatgactcccttcttggaaagctgattgtatgggctccaacaagagaaaaagcaattgaacgcatgaaaagggcacttgatgacactattatcacaggagttcctactacaattgattatcataaacttatccttgacatagaggatttcagaaatggaaaggttgatactgcttttattccaaaacacgaggaagagttggcaatgcctccgcagaagatggtactcgctaacagggtgaacgaactagctggttcaactgcctgatgaatatgattgtgtgatgtcagaattgctttttgtaatcgccgtgttgtcagtgcctcgaagtgaatgttttaatgaaattttgataattagtctcgtacattccttttcttcacataattatattgtaaaatcaattaattcatgtttgatttcatcccaaatattattgcaaggaattaagaataggtccttgcatttttttcggaagtcatagttgtcacaatggttggtttagaggatcttgtattaagagctcgatgctagatacagtaataaaaacttaaccttatcctaatagactgggtttgttatatggatcaa

SEQ ID NO: 7990 - DNA, 2300 bp, Chenopodium quinoa
caacttcacctccctcttcgaatctgcaactccaacttcaactacttcaattactacaaactttctcattgaatttgcgaactcaaatttcacattgaagagatctctcattgttcttcttcattgacatattctcttgtggtatttgatcggtgaatatggatgcatttttggtttgcaaatctgtaactgcgccatctactactaaacctggcttatggatgaaccagaccaaaggattcagcagtgctccatctaacttggcgatagggagccgggttaattttcctgggcagtcagttcaggttcttaagataaatcgtaaagctagaaagtgtggtggagctcttgcagcaacttgtcgcagtgaaaaaattttggtagctaatagaggtgagattgcagtccgtgtgatccgaactgctcatgagatgggcattccttgtgttgcagtctactcaaccatagacaaggatgcactccatgtgaaaatcgctgatgaatctgtttgcattggtgaagctccaagtaatcaatcatatttggtgatccccaatgttctatctgctgctgtaagtcgtggatgcagtatgttgcatcctgggtatggatttcttgcggaaaacgctgtttttgttgagatgtgtagagaacatggaataaattttattggaccaaatccagatagcatccgtgtcatgtgtgacaagtcgactgctagagaaaccatgaagaaggctggtgttccaactgttcctggaagtgatggattgttacagagcacagatgaagcgataaagcttgctcatgaaattggtttccctgttatgattaaggcaactgcaggaggtggaggccgtgggatgcgtcttgctaaggagccggatgaattcgtgaagttgctgcagcaagctaagagtgaggctgcagctgcatttggaaatgatggagtatatttggagaagtatgtacaaaatccaaggcatattgaattccaggttcttgcagataaatatggaaatgttattcactttggagagcgtgattgcagtattcagaggagaaaccagaagctacttgaagaagcaccttctcctgcattgactctggagttaaggaaagccatgggtgatgctgctgttgctgcagcagcatctataggttacattggtgtaggaacagtggaattccttttggacgaaagaggttctttctacttcatggaaatgaacacccgaatccaggttgagcatccagtgacagaaatgatatcgtcagttgacttgattgaagaacaaattcgagtggctatgggagagaaactccgctacaaacaggaagatatagtgctaagtggacattcaattgaatgccgaatcaacgcagaagatgcattcaaaggattccgtcctggacctggaaaaataaccagttacttgcctgctggaggaccgtttgtgaggatggatagccatgtttatcctggttatgttgttccaccaagttatgactctctacttggcaagctgattgtctgggctccaactcgagagaaagcaattgcacgtatgaagagggctctcgatgatactattattacaggggtccccacaactattgaataccataaactaattcttgatattgaggattttaaaaatggaaaagtagatactgctttcatccccaagcatgaacaggaattggcggagcctcaaaagattgtttctgcaactcctgccaaagaactgactggtgcaactgcctaaatactgtttcggttaggcactgatctagcgctttacctccattgaatcacctcttctttttcgcaatgaatgatcttctccaaacaaggcaacaaaaagaggcagcaaattcagctggaagaacttgggcatttaactcaatatagtaccctccttcctaggtccctgaaaaaatagaaaagactatattgtatggataactacaaattatttataaaaagtttgcgacattattagctcatcactagtatgttttctttttatatgggagattgattatggattctaaatgaagatgaaggttcgatgagcacttggagttgatgaaaaatttgcgtctgaaggtctcagtgctgtctgagtttaatcaattatttagttttaatcttcatgggattttgcatgtcgagtgctgtatttttgcattacacaatatgtacttaatttttttagatgtaacactttcctaatctgaaagttaagaaatagcggcaatgtttttaattgcgaagatctgaagttttaccctta

SEQ ID NO: 7991 - DNA, 2138 bp, Aquilegia formosa
tcttgttttcatcgacaccttttcaataaatttcattcacttctcttcttctcattgttgtttctctttaaacaaatttttcctcaattttatttttcttcaaggattaagacctttttcttcgagaatggattccatgactgtctgcaaatcagtttcttctcctaatgtacctggtttatgtgtgggacaaagtagaggaataaggagctcacagtgtagctttatgttaggaagcggagttatgtttcctagacagagtattcaatctgctcgtgttacccacaaatctaaaaaacgtgggggagcacttgctgccacttgccgttatgataaaattcttgtggctaatagaggtgaaattgcggtacgtattatacgaactgctcatgagatggggataccatgtgttgcagtctactcaaccatagataaggatgcacttcacgtgaagcttgcagatgaggcagtttgcataggtgaagcacccagtaatcagtcgtacttggtgatgccaaatgttttatctgctgctcttagtcgcaaatgtactatgctgcatcctggatatggcttcctcgccgagaatgcaacttttgttgaaatgtgcagagagcatcgaatcaacttcattggacccaatcctgacagtatccgtactatgggtgacaaagctactgcaagagatactatgaagaaagctggtgttccaactgtaccaggaagtgagggattattacagaccacagaggaagctatcaggctcgctgatgagattggttatcctgtgatgatcaaggcaaccgctggtggcggtggacgtggaatgcgtcttgcgaaagaaccagaggagtttgtaaagttgctacagcaagcgaaaagtgaggctgcagctgcattcggaaatgatggagtttatttggaaaaatacattcaaaacccaaggcacattgagttccaggttcttgcagataggtataataatgcaattcattttggggagcgtgattgcagcattcagagacgtaatcaaaagctgctagaagaagctccgtctccagcattaaccccagaattaaggaaggccatgggtgatgcagcggttgctgcagcaacgtctataggctacattggtgtaggaactgttgaattccttttggatgaaaggggcgccttttatttcatggagatgaacactcggatccaggtggagcaccctgttaccgaaatgatatcttctgtcgatttgattgaggaacaaatccgtgttgctagaggagagaagcttcggtacacgcaggatgatattgttctcagagggcattcaattgaatgtcgtataaatgcagaagatgcattcaaaggattccgaccaggaccagggaggataacagcatacttgccgtctggaggcccatttgtaagaatggatagccatatttatcctgattatgtggttcccccgagctatgactctctacttgggaagctcattgtttgggctccaacaagagaaagagcaattgagcgcatgaaacgggctcttagtgacactattattacaggggttcctacaactattgaatatcataaacttatcttggaaattgaggacttcaaaaatggcaacgttgataccgcatttatacccaagcatgaaaaggaattggctgagccacagaaaatagtcctatcaacacctgcaaaagagctgacttccgcgactgcctgaaaagatcctctgtgttgtacgtgaatctgtgaagttcacatctagatgcgaatgagggttgatctttgtgtagaggcaacaattttccttgtgatgtgtcaatatgttgttgagttaatttatattcacaattttcattttctacacatctatgggagtttctcaacatgtattaggtagaaggtttgtaggacatgcaagaaatttacagtacaagaaaaactcctctttgtagtacgggctatatttacgtgaatgaataataagttttatgatgtcgaagtatgtatgatgatgatggtgttgatggtattcgaacttttgaaagcgtggaagtgtttgaaactcttgaagtaagttatcctggactaataagcgtcacaatgtgtgttatgaactaaatata

SEQ ID NO: 7992 - DNA, 2090 bp, Plantago ovata
gacagaatagtcctactgagctaactacactcgtctccctcgttttcatcgtcaccaagcttcttcaaaatctcctcctcctaccccttcctaacccccttgattgattaattgattatttcatttctctctctatctgcctcaaccactcagagcgagagagagagacagagagcagaagattgcttctagcttgatttgggaatatggactctgctactatgagtttctgcagtagatctgctgtctcctcgccgcacccgggtttactcatggggaggagagcaggaatcatgagcagctcccagtgtagctttatggtaggaaggaagattaacttccctagacagagtgcccaagtctctaaaatgaatgctaaatctggaaaacctggccgagctctttccgttacgtgcaaagccgaaaaaatcctggtggctaaccgaggagagattgctgttcgtgtcatcagaactgcacacgagatgggaatcccttgtgtggctgtttattcaacaattgataaagatgctcttcatgtgaagctggctgatgaagctatttgcatcggtgaagcaccaagcaatgaatcgtatttggtgagtttaaacgtcctagcagccgcaacaacctatggatgtactatgttgcatcctggatatggtttcctttctgagaatgcccgttttgttgaaatgtgccgagaacattcaattaacttcattggacctaatcctgatagcattagggtcatgggtgataaatctacagctagagatacaatgaaaaatgctggagttccaactgtccctggaagtgatgggttattgccgaatactgaagaagcaatccgagttgcgaacgagattggctatcctgtcatgatcaaggcaacggctggtggtggaggacgtggaatgcgtctagctaaagagcctgaggagtttgtgaaattgttacagcaagctcagagtgaggctgcagctgcttttggtaatgacggtgtttatcttgagaagtatatccagaatccaaggcacatcgagtttcaggtgttggctgataaatatggtaacgttgtgcactttggggagcgtgattgcagtattcagaggagaaaccaaaagttattagaagaggcaccttctcctgcattgacatcggaattgcggaaagccatgggtgatgcagcagtagctgcagcagcatctataggctatgtaggtgttggtacagtagagttccttttggatgagagagggtcattttacttcatggagatgaacactagaattcaggtggagcatcctgttaccgaaatgatatcctccgttgacttaattgaagaacagatccgtgtggctatgggagagaaacttcgctacacgcaggatgatattgttcttaaagggcactcaattgaatgccgtattaatgcagaagatgctttcaagaatttcagacctggaccagggagaataacaacttacttgccagcgggaggtccatttgttcgaatggatagccatgtgtatcaagattatgtagttccaccaagctatgattccctgctcggaaagcttattgtttgggctccaacaagagaccgggcaattgaacgcatgaaaagggctctcagtgacaccattatcacaggggttcctacaacaattgagtaccacaagctcatccttgatattgaggacttcaaaaatggaaaggtggatactgcttttattccgaaacacgaagaagagcttgctgcgcccgtggaaatggaaaagtaaccggaaaccaccctgaaacagttgcgtctacttgggtagcatcttgttctggttgctggaaagttggatcaatagtgaaatattgtttgagccttgtccgattttggcctgatgaatcaaatcaaatgtacgagcgagtggagtttcatttttattatagttttcgattacaaaatagttgacggcatagaccatagactcaaacaattgtttgtttgtattggtataaaagaaattcttagcactctctaccgaacctttactcttgttttcttccctaatgaatgaaaatgttctctttac

SEQ ID NO: 7993 - DNA, 1917 bp, Silene vulgaris
aacaaacatctacattacacatctggtggacatggactcccttatggtttgcaaaactgtcactgctcctcctactcctggtttatggatgaaccagaacaaggggttgaagaaaggaccaagtagcttactagttggtagccgggttattttcctaggcaaacagctggtgtgattaagatcaatcgcacctccagaaaggctggaggtgcacttgctgtaacttgccaggctgaaaagattttggtcgcaaacagaggtgagattgcagtgcgcgtcattcgaactgcgcatgagatgggtattccctgtgttgctgtttactcaactatagataaggatgctcttcatgtcaaaattgctgatgaagctgtctgcattggtgaagctccaagcaatcaatcgtacttggtgatccccaatgttctatcagctgctgttagccgtggatgcactatgctgcaccctggatatggattcctctctgagaatgctgcctttgttgagatgtgtaaagaacatggaataaattttattggaccaaacccagacagcatccgtgtcatgggagataaatctacggcaagagataccatgaaaaaggctggtgttcccactgtacctggaagcgatggattgttgcagagcacagatgaagccattaagcttgctcatgaaattggtttcccagtcatgattaaggcaactgctggagggggaggccgtggaatgcgtcttgctaaagaacccgatgaatttgtaaagctgctccagcaagctaaaagtgaagctgcagctgcatttgggaatgatggagtgtatctggagaagtacatacaaaatccaagacatatagaatttcaggtccttgcagataagtttgggaacgttgtgcactttggggagcgtgattgcagtatccagagaaggaaccagaagctgcttgaagaagcaccatctcctgcgttgactccagaattaaggaaagccatgggtgatgctgctgttgctgcagctgcctcaataggctatattggagttggaacagtggagttccttctagatgagagaggcacattttacttcatggagatgaatacaaggattcaggtggagcatcctgtgacagaaatgatatcctcaactgatttgatcgaggaacagattcgtgtagctatgggggaaaaactccgctacaagcaggaggatatagtgcttaaaggacactcaattgaatgccgaatcaatgcagaagatgccttcaagggatttagaccagggcctggaaaaattaccacctacttgccttctgggggaccatttgtaaggatggatagccacgtttatcctggctatgttgttccaccaagttatgactctcttcttggcaagctgattgtttgggctccaactcgagaaaaggccattgctcgtatgaagagggcccttgaagatacaatcattacaggtgtgccaacaactattgaataccataaacttattcttgaagtcgaggacttcaaaaatgggaaagtcgacactgctttcattcccaaacatgaacaagagcttgcggagcctcagcatgttgttcgtgcaactccaggcaaagaattggctggcgcaacggcgtagatacttgtatggtttggcatctagccttctgtaagatgtagctaagcaggataaccttgattgaactatttatcctcattcagtgaacctgcacccaggacgtaggttgttgagggcaaaaatgttggtggattgccttcgatgctggagattgagtagtcttttttcctcttttaattaagggagaagtatttttttatgctttcttagttttttccattcatttacaaaattatagattcttttgtaattgattgtttgaagtattttttgttttttttt

SEQ ID NO: 7994 - DNA, 1989 bp, Arabidopsis lyrata
ggaggattcaatatctcacagttccactctcaacatttcaatctctctctctctctcaacagattagatctgtttcgatactcacgaggtttcctctcacttccttccattgttaaaccaggatttgcctcctcctgcatttggaaatggacgcttctatgattaccaattccaaatccattacttctccaccctctttagtcttggggaagacaggaggagttattagaagttctctatgtaacttgatgatgccaagtaaggttaactttcctagacaaagaactcaaactttaaaggttagccagaagaagatcaagagagctactagtggtggtgctcttggtgctacatgcagtggtgataagattcttgttgctaatagaggtgaaatcgcagttcgtgttatccgaactgctcatgaaatggggattccttgtgttgctgtctattcaactattgataaggatgccctccatgtcaaattagctgatgaagctgtttgcattggtgaagctcccagtaaccagtcgtacttggtaattccaaatgttctgtctgctgctatcagtcgcggttgtacaatgcttcatcctggatacggtttcctttcggagaacgctctctttgttgaaatgtgcagagaccatgggatcaattttattggaccaaatcctgatagcatccgtgttatgggggacaaagcaactgcaagagagacaatgaaaaatgcaggggttccaactgtaccagggagtgatgggctattgcagagcacagaagaagcagtcagggtcgccaatgagattggtttccctgttatgatcaaggcaacagccggtggtggtggacgtggaatgcgtcttgctaaggaaccgggagagtttgtaaaactgttacagcaagctaagagtgaggctgctgctgcttttggaaatgatggatgttatctggagaagtttgtacagaaccctagacatattgagttccaggtgctggcagataaatttggaaatgttgttcactttggtgagcgtgactgcagcatccagaggcgtaaccaaaagcttcttgaagaagcaccttctccagcattgaccgctgaattgcgaaaagccatgggtgatgcagcagtcgcagcagcagcatccattgggtacattggtgttggtactgtggaatttcttttagatgagagaggttccttctacttcatggaaatgaacactaggatccaggtggagcatcctgtgacagagatgatttactctgttgatttgatagaggagcagattcgtgttgcaatgggagagaaacttcgttacaaacaggaagatatcgttctcagagggcactcaattgaatgtcgtatcaacgcagaagatccatttaaaggattcagacctggacctggtagaataacatcatacctgccatctggaggtcctttcgttagaatggacagccatgtttattccgactatgttgtgcctccaagctatgattctcttcttgggaagcttattgtgtgggctccaacgagggaaaaagcaattgaaaggatgaagcgtgcgcttaatgacactataattacaggggttccaacgactatcaattaccacaaacttatccttgatgttgaggatttcaaaaatggaaaagttgatacagctttcattgtcaagcatgaagaggagctagctgagcctcacgaaattgtggcagtgaaagatttgacaaacgcagcggtttagaacgatacatcagctctgaaagaccacccaattattgcaatcttcgtctccttttgtgttgtcattggtacaaactttggttacgataagagtgctcttttagagtctgtggttttatcactttatgtgatgttcttcttgtgtcatacagaagatgaaacacttttgtttgtagtctctatgtcaacattatccaataattttcatatatagtagattatatgaacaaggccta

SEQ ID NO: 7995 - DNA, 2092 bp, Arabidopsis lyrata
  misc_feature (1869)..(1869): n is a, c, g, or t
  misc_feature (1998)..(1998): n is a, c, g, or t
  misc_feature (2004)..(2004): n is a, c, g, or t
  misc_feature (2041)..(2041): n is a, c, g, or t
cgttccgcgtttggagttggcacagaatccaccaaattaaaccattcaggcggaggattcaatatctcacagttccactctcaacatttcaatctctctctctctctctctcttagatctgtttcgatactcacgaggtttcctctcacttccttccattgttaaaccaggatttgcctcctcctgcatttggaaatggacgcttctatgattaccaattccaaatccattacttctccaccctctttagtcttggggaagacaggaggagttattagaagttctctatgtaacttgatgatgccaagtaaggttaactttcctagacaaagaactcaaactttaaaggttagccagaagaagatcaagagagctactagtggtggtgctcttggtgctacatgcagtggtgataagattcttgttgctaatagaggtgaaatcgcagttcgtgttatccgaactgctcatgaaatggggattccttgtgttgctgtctattcaactattgataaggatgccctccatgtcaaattagctgatgaagctgtttgcattggtgaagctcccagtaaccagtcgtacttggtaattccaaatgttctgtctgctgctatcagtcgcggttgtacaatgcttcatcctggatacggtttcctttcggagaacgctctctttgttgaaatgtgcagagaccatgggatcaattttattggaccaaatcctgatagcatccgtgttatgggggacaaagcaactgcaagagagacaatgaaaaatgcaggggttccaactgtaccagggagtgatgggctattgcagagcacagaagaagcagtcagggtcgccaatgagattggtttccctgttatgatcaaggcaacagccggtggtggtggacgtggaatgcgtcttgctaaggaaccgggagagtttgtaaaactgttacagcaagctaagagtgaggctgctgctgcttttggaaatgatggatgttatctggagaagtttgtacagaaccctagacatattgagttccaggtgctggcagataaatttggaaatgttgttcactttggtgagcgtgactgcagcatccagaggcgtaaccaaaagcttcttgaagaagcaccttctccagcattgaccgctgaattgcgaaaagccatgggtgatgcagcagtcgcagcagcagcatccattgggtacattggtgttggtactgtggaatttcttttagatgagagaggttccttctacttcatggaaatgaacactaggatccaggtggagcatcctgtgacagagatgatttactctgttgatttgatagaggagcagattcgtgttgcaatgggagagaaacttcgttacaaacaggaagatatcgttctcagagggcactcaattgaatgtcgtatcaacgcagaagatccatttaaaggattcagacctggacctggtagaataacatcatacctgccatctggaggtcctttcgttagaatggacagccatgtttattccgactatgttgtgcctccaagctatgattctcttcttgggaagcttattgtgtgggctccaacgagggaaaaagcaattgaaaggatgaagcgtgcgcttaatgacactataattacaggggttccaacgactatcaattaccacaaacttatccttgatgttgaggatttcaaaaatggaaaagttgatacagctttcattgtcaagcatgaagaggagctagctgagcctcacgaaattgtggcagtgaaagatttgacaaacgcagcggtttagagttcatcagctcttacatgaaccagtaattttcagaacacggggggaatcaactatgtcaatttncgcatgatttcagctataactgttttgtttttctttaaaggaattgtcgatttagtgcgaggatctgtgagaacttcattttcagaccattcaagtattttcaagatgaaatgttttttttttaactanggaggnttcagtaggctttaaatgtgagacttgatattcagtntgttgcctatttatccttagaatcttcttgacatttaggtatgtctttctt

SEQ ID NO: 7996 - DNA, 1832 bp, Brassica juncea
aaatccactgcctcccttccctcattgttccttgggaggtcgggaggtagtattagaagttcccaatgtaatgtcactatgggacaaacggttagcttcccgaggcaaaagactctgactttaaaagttagccggaacgtgaagagaaaaagtggtggtggtgcgtttgctgctacttgtagcagtggggataagattcttgtggctaacagaggtgaaattgctgtccgtgttatccgaactgctcacgaaatggggattccttgtgttgctgtttactccactatagacaaggatgcacttcatgtcaagttggctgacgaagctgtttgtattggtgaagctcctagcaaccaatcgtatttgttgataccgaatgttctgtcagctgcaattagccgaggatgtacaatgcttcatcctggatatggattcctttcagagaacgctctttttgttgagatgtgcagagagcacaggatcaactttattggaccaaatcctgacagcatccgtgttatgggtgacaaatcaactgccagagagacgatgaagaatgcaggtgtcccaactgtaccagggagtgatggactattaaagagcacagaagaaggagtcaggctcgccaatgagattgggtaccctgtaatgatcaaggcaacagcaggtggtggtggacgtggaatgcgtcttgctaatgaaccgtcagagtttgtgaaactgctgcagcaagcaaagagcgaggccgctgctgcttttggaaatgatggagtttatctggagaagtacgtgcaaaatccccggcatattgagttccagattcttgcagataaatttggaaatgttgttcacttcggcgagcgtgactgcagcatccagagacgtaaccaaaagttgctggaagaagcaccttctcctgcactgacccctgagttgcgaaaagccatgggtgatgcagctgttgcagcagcagcgtcgattggttacgttggtgttggtaccgtggagttccttttggatgagagaggttccttctatttcatggaaatgaatactagaatccaggtggagcatcctgtgacagagatgatttactccgttgatttgattgaagaacagattcgtgttgcaatgggagagaagctgcgttatacacaagatgagattgtgcttagaggacactctattgaatgtcgtatcaatgcagaggacccattcaaaggattcagacctggacctggaagaataacatcgtatctgccatctggaggtccttttgttaggatggatagccatgtgtatcccgactatgttgttcctccaagctatgattctcttcttggaaagcttattgtatgggctccaacgagggaaagggcaattgagcggatgaaacgtgcacttaatgacactattattacaggagttcccaccaccattgagtaccacaaacttatccttgaagttgaggatttcaagaatggaaaagttgacactgcattcatacccaagcatgaagaggaattagcagagcctcatgaaattgtcctagtgaaagatttgacaaatgcagctgcttagagtgcatcagctctttaattgccagaacacaggaatcaattatgccaatgcccgcaaagtcttcatccacttggcatgatctcagcgataattgtgttgttttttctttagagtttatggtattcacaatacgttctaagggaattgttgatttagtgcgaggatctatgagaacttcattttcagaccattcaagtatttcaagatgaaatgttttataactaggctttaaatgtgagacttgatattca

SEQ ID NO: 7997 - DNA, 1804 bp, Eutrema parvulum
tctttattcctggggaggtcgggaggaattagaagttcccagtgtaatgccatgatgggaaaaatggttagcttccctaggcaaagaactcagactttgaaagttacccgaaaggtgaagaggagtggtggtggtgcgcttgctgctacgtgtagtggggacaaaattcttgtggctaatagaggtgaaatagctgtccgtatcatccgaaccgcacatgaaatggggattccttgtgttgctgtttactcaactatagacaaggatgcactgcatgtgaaattggctgatgaagcggtttgtattggtgaagctcccagcaaccagtcgtacttgctgataccgaatgttctgtcagctgcaattagccgaggatgtacaatgcttcatcctggatatggattccttgcggagaacgctctttttgtagagatgtgcagggaccacaggatcaattttattggaccaaatcctgatagcatccgtgtcatgggtgacaaatcaactgctagggagacaatgaaaaatgcaggtgtcccaactgtaccagggagtgatggactattgcagagcacagaagaaggagtcaggctcgccaatgagattgggtaccctgtaatgatcaaggcaacagctggtggtggtggacgtggaatgcggcttgctaatgaaccatcagagtttgtgaaactgttgcagcaagcaaagagcgaggccgctgctgcttttggaaatgatggagtttatctggagaagtacgtgcaaaatccccggcatattgagttccagattcttgcagataaatttggtaatgttgttcactttggcgagcgtgactgcagcatccagagacgtaaccaaaagttgctggaagaagcaccttctcctgcactgacccctgagttgcgaaaagccatgggtgatgcagcggttgcagcagcagcgtcgattggttacattggtgttggtaccgtggaatttcttttggatgaaagaggttccttctatttcatggaaatgaacactagaatccaggtggagcatcctgtgacggagatgatttactccgttgatttgattgaagaacagattcgtgttgcaatgggagagaaactgcgttataaacaggaggaaattgtgcttagaggacactcgattgaatgtcgtatcaatgcagaagacccatttaaaggattcagacctggacctggaagaataacatcatatctgccatctggaggtccttttgttaggatggatagccatgtatatcccgactacgttgttcctccaagctatgattctcttcttggaaagcttatcgtatgggctccaactagggaaagggcaattgagcggatgaaacgtgcacttaatgacactattattacaggggttcccaccaccattgaataccacaaacttatccttgatgttgaggatttcaagaacggaaaagttgatacagctttcatcgcgaagcatgaggaggaattagcagagcctatggaaattgtctcggtgaaagatttgacaaatgtagctgcttagaattcatcagctcttagatgaaacggtgattttcagaatcagagaaatcaattctgccaatgcccacaaagtccttttatttggtgtcttcgtcttcttgtgatgtctatgtaacagcacttcgcagagtttggcaataattgtgttctgttaagagtctggtattgacagtacattttaaggtacttgttgatttagttcagaagtgtgagcactttatttcaacctccgagaccatttaagtatttctgga

SEQ ID NO: 7998 - DNA, 2256 bp, Arachis hypogaea
gcccaactgtgatgggcccagttgtgcaagtgcaagtgcaggtgcagggtgcaccctcactcactccagattctcgccatctaacatccaaccaaaccaactaagccatctctccgactgtacgcattagatttaggcggagctttctatctgctaccctcctcctccacatcgtttccatcgccgttcttcttctcataaaaagccaccctttgtccctacccttatattcgcattttcattaacatactcattctcacaggaaatggaggccacaatggcagcctgcaactctcttagctcgccttctgttcccatcccaggcttgtatgcgggaacaagtagaggaatcaagaattcacaatgcagtttcttaggtgcaactaaggtgaattttcccagccaaacaatgtccagaacttgtcaactcaatcacaaacataaaacacgttctggggcactccatgctacctgccagggtgacaagatcctggtagctaacagaggcgaaatcgcagttcgtgttattcgcactgctcatgaattgggaataccctgtgtggctgtgtactcaaccatagacaaggatgcacttcatgtcaaattggctgatgaatccgtttgcattggcgaagcgccaagcagccaatcgtacttattgatcccaaatgtactgtctgctgctattagccgtagatgcacaatgttgcatcccggatatggttttcttgctgagaatgcagtgtttgttgaaatgtgtagagaacatggaatcaattttattggacctaatcctgacagtattcgggttatgggtgacaaatcaactgccagagacacaatgaagaatgcaggggttcctactgttccaggaagtgatgggcttttacagagcactgaagaagctatcaggctagcaaatgagattggtttccctgttatgatcaaggcaacagcaggtggcggtggacgtggtatgcgacttgctaaagaacctggagagtttgtgaagttgttacagcaagctaagagtgaggctgctgccgcctttggtaatgatggagtttatttggagaagtacattcaaaatcctaggcacattgagttccaggttcttgcagataaatatggtaatgttgttcactttggagaacgtgattgcagcatccagaggcgtaatcagaaactgttggaagaagcaccatctcctgctttgaccccagagctgcggaaggcaatgggagatgcagcagttgcagcagctgcatctatcggttacataggtgttggaacagttgaattcctcttggatgaaaggggctccttttacttcatggagatgaatactcgtatccaggttgaacatccggtgacagaaatgatatcttctgttgatttgattgaagagcaaattcgtgtggctatgggagcgaagcttcgttacaaacaggaggatattattctgagaggacattctattgaatgccgtatcaatgcagaagatgcttttaagggatttagaccagggccaggtagaattacagcatacttaccatcaggaggcccatttgtcagaatggatagtcatgtttatcctgattatgtagttcctccaagctatgactcccttcttggaaagttgattgtgtgggctccaacaagagaaaaagcaattgaacgcatgaaaagggcacttgatgacaccatcatcacaggtgtgcctacaacaattgaatatcataaactcatccttgacatagaggatttcagaaatggcaaggttgacactgctttcattccaaagcatgaagaggagttgaccatgccacctcagaagatggtacctgctattaacaaggcaaaagaatttgttggagcaactgtatgatggatataactccctgatgccaccccttttaagaatacgtttttgaaagcctatgcagtgctagtccttcgttcttgtggacgtttcggtgaaattttgataatcagtctggcgtagttccttttgttcacattactttattgtaaaattcatcttttcgtgttttattatatcccaaatatttattagtgcaaggaatcggagtacctcgtaataattcaaaatcatagttgtccttttagccttagagaatctttgtccccaaccttgtttgtaattcttgtattaagaactccgctgtagtcctatcctattgtaaacttcaaagttaggagggtttgttgcatgaatcagtctacacttttttt

SEQ ID NO: 7999 - DNA, 1794 bp, Tropaeolum majus
gagttcccagtgtagctttgttgtgggaaataaggtcagcttccctaggcaaagagctcaggctgctaaagttagtcggaaaactgcaaacaacaatggagctttaagtgttacatgtcgtgctgataaaattcttgtggcaaatagaggagaaattgcggttcgtatcattaggacagctcatgagatggggataccctgtgttgctgtttactcgaccatagacaaagatgcacttcatgttaaattggctgatgaatcagtttgcattggcgaagcaccaagtagtcaatcgtatttgctgataccaaatgttctgtctgctgctattagccgtgggtgcaccatgctgcatcctggatatggtttccttgcagagaatgctgcatttgttgaaatgtgcagagaacatgggatcaacttcattggccccaaccctgacagcattcgtgtcatgggtgacaaagcaaccgctagagagacgatgaagaatgcaggtgttccaactgtccctggaagccaaggattgttgcagagcacagaagaagcaatcaaacttgccaatgaaattggctatcctgttatgataaaggcaacagcaggtggtggaggacgtggaatgcgtcttgcaaaagaacctgatgagtttgtgaagttactacagcaagctaaaagtgaggctgcggcagcatttggaaatgatggagtttatttggaaaagtatattcaaaatcccaggcacattgagtttcaggttctagcagataaatatggtaatgttgttcattttggtgagcgtgactgcagcatccagagacgtaaccaaaaactgctggaagaagcaccttctcctgcactaactcccgagttgcggaaagccatgggtgatgcagcagttgcagcagctgcatctattggttatattggtgttggaacggtagagttccttttggatgaaagaggttccttctacttcatggagatgaacacacggatccaggttgagcatcccgtgacagaaatgatttcctctgttgacttgattgaagaacaaattagtgttgccatgggaaaaaaactgcagtacaaacaggaggatattgtgctcaagggacattcaattgaatgccgtatcaatgctgaagacgcattcaaaaatttccgacccgggccaggaagaataacggcgtacttgccatctggaggcccatttgtgagaatggatagccatgtttatccggattatgtcgttcctcctagctatgattccctacttggaaagcttatcgtatgggctccaacaagggagaaggctattcaacgaatgaaaagggcccttgacgacacaataattacaggggttcctacaaccatcgagtaccataaacttatccttgacattgaggacttcaaaaatggaaaggttgatactgctttcattccaaagcatgaacaggagttagcagcgcctagtagtatcgtagctgcatcctcggcataagaacggaataccattacgtagctgctaacatggatgatcgatatcccgagattgttcttttcacctttagggcctccatagcaatcgatctaccattgtttctatgttgcctttttttcttttcttctctcgtttatttcatcattctagtgtgagaactaagaaattttgatagtttattttatttattttggtggtacaacttgtatatgtatactattctatgtatactatttctgatcttattaatttatttcccgtattgtggtattattcgatcaaaaaaaaaaaaa

SEQ ID NO: 8000 - DNA, 1978 bp, Raphanus sativus
  misc_feature (404)..(404): n is a, c, g, or t
  misc_feature (431)..(431): n is a, c, g, or t
  misc_feature (458)..(458): n is a, c, g, or t
  misc_feature (596)..(596): n is a, c, g, or t
  misc_feature (704)..(704): n is a, c, g, or t
  misc_feature (752)..(753): n is a, c, g, or t
  misc_feature (783)..(783): n is a, c, g, or t
  misc_feature (796)..(797): n is a, c, g, or t
  misc_feature (821)..(821): n is a, c, g, or t
  misc_feature (840)..(840): n is a, c, g, or t
  misc_feature (854)..(854): n is a, c, g, or t
  misc_feature (879)..(879): n is a, c, g, or t
  misc_feature (885)..(886): n is a, c, g, or t
  misc_feature (905)..(905): n is a, c, g, or t
  misc_feature (1427)..(1427): n is a, c, g, or t
  misc_feature (1803)..(1803): n is a, c, g, or t
  misc_feature (1814)..(1814): n is a, c, g, or t
  misc_feature (1829)..(1829): n is a, c, g, or t
  misc_feature (1843)..(1843): n is a, c, g, or t
  misc_feature (1854)..(1855): n is a, c, g, or t
  misc_feature (1887)..(1888): n is a, c, g, or t
  misc_feature (1902)..(1902): n is a, c, g, or t
  misc_feature (1938)..(1938): n is a, c, g, or t
  misc_feature (1950)..(1950): n is a, c, g, or t
  misc_feature (1952)..(1952): n is a, c, g, or t
  misc_feature (1956)..(1956): n is a, c, g, or t
  misc_feature (1959)..(1959): n is a, c, g, or t
  misc_feature (1966)..(1966): n is a, c, g, or t
tttttgagttttcaattaaaattcagttcaatctctctcactcaagttcttcacatagttaacatcgaaacacatttctcctcagagagacaagaaggatctgcgttcttttatccagcaaatggacgcctcaatgattactaattgcaaatccaccgcgtcctcccttccctctttgttcctggggaggtcgggaggtagcattagaagttcccagtgtaatgtcatgatgggacaaacggttagcttcccgaggcaaaagactctgactttgaaggttagccggaacgtgaagaggaggagtaggtggtggtggtgcgcttgctgctacttgcagcagtggggataagattcttgtggctaacagaggtgaaattgctgtccgtgtgatccgaactgctcangaaatggggatcccttgtgttgctgtntactcaactatagacaaggatgcactncatgtgaagttggctgacgaagctgtttgtattggtgaagctcctagcaaccagtcgtatttgttgataccgaatgttctgtcagctgcgattagcagaggatgtacaatgcttcatcctggttatgggttccttgcngagaacgctctttttgttgagatgtgcagagaacacaggatcaactttattggaccaaatcctgatagtatccgtgtcatgggtgacaaatcaactgccagggagacnatgaaaaatgcaggtgtcccaactgtaccagggagtgatggactattnnagagcacagaagaaggagtcaggctcgccnatgagattgggtnncctgtaatgatcaaggcaacagcnggtggtggtggacgtggantgcgtcttgctaangaaccctcagagtttgtgaaactgntgcagnnagcaaagagtgaggccgcngcggcttttggaaatgatggagtttatctggagaagtacgtgcaaaatccccggcatattgagttccagatccttgcagataaatttggtaatgttgttcactttggcgagcgtgactgcagcatccagagacgtaaccaaaagttgctggaagaagcaccttctcctgcactgacccctgagttgcgaaaagccatgggcgatgcagcagttgcggcagcagcgtccattggttacatcggtgttggtactgtggaatttcttttggatgagagaggttccttctatttcatggaaatgaacactagaatccaggtggagcaccctgtgacggagatgatttactcggttgatttgattgaagaacagattcgtgttgcaatgggagagaaactgcgttatacacaggatgagattgtgcttagaggacactcgattgaatgtcgtatcaatgcagaagacccatttaaaggattcagacctggacctggaagaataacatcgtatctgccatctggaggnccttttgttaggatggatagccatgtatatcccgactatgttgttcccccaagctatgattctcttcttggaaagcttattgtatgggctccaacgagggaaagggcaatcgagcggatgaagcgtgcacttaatgacactattattacaggggttcccaccaccattgagtaccacaagcttatccttgaagttgaggatttcaaaaacggaaaagttgatacagctttcatccccaagcatgaagaggaattagcagagcctcatgaaattgtcccagtgaaagatttgacaaatgtagctgcttaagctttcatcagctcttttcatgaaacacatggggaatcaattatgccaatgcccgcaaagtcttcgntcttactcttncctggtgtcttcgtntttttgtgatgttnttatgcaacannacttcatttcagacctacgagaccattttaannatttctagactgcnatagttgagtttatttttatttttttgttattagcnaagatgaatcanantccnaanttgaaancattataaacac

SEQ ID NO: 8001 - DNA, 2309 bp, Glycine max
tgtgaaacgtatttaaccattaatgttgcatatacaaattgatattgctacgagaattttaaagaaggggatgaactagatttatatttaggcggagctttcaatttggcacctccctcgtttacatcgacacccgcatcaaaagtcactccattcccatcagaacacaaaacacagcatttcccttagcgtaggtaaagccatagtatccatcactcactctttcgcaagcattctttctgtttatatatttcactcaccaatgccttcattgtgttaggaaatggaagtcacactttcagcctgcaagtccgttagctcgccttctgttcccgtcgcaggtttgtttgcggggaatggaggaattaagagctcgcaatgcagtttcttagcgggagcgagcaaagtgaggtttcctaggcaagtaggtcaagttagccaccttcgcaaacagcgccaaacgcgtcactgcggtgctctccacgcgacttgcagcggtgacaagatcctgatcgcgaacagaggcgagattgccgtccgcgttattcgaaccgctcatgaattggggattccttgtgtggctgtgtactccaccatcgacaaggacgcgcttcatgtcaaattggctgatgaagccgtttgcatcggggaagcgccgagtagccagtcctacttgctgatcccgaatgttctgtcagctgctattagccgcagatgcaccatgttgcatcctggctatggttttcttgcggagaatgcagtgtttgttgaaatgtgcagagaacatggaatcaactttattgggcctaaccctgacagtattcgggttatgggtgacaaagcaactgccagagagacaatgaagaaagcaggtgttcccaccgttccgggaagtgatggccttttacagagcacagaagaagctatcagactggcaaatgagattggtttccctgtgatgatcaaggcaacagctggtggtggaggacgtggcatgcgtcttgctaaagaacctgctgagtttgtgaagtttttacagcaagctaagagtgaggcagctgctgcatttggcaatgatggggtttatttggagaagtacattcaaaacccaaggcacattgagttccaggttcttgcagataaatatggtaatgttgttcactttggagaacgtgattgcagcattcagaggcgcaaccagaaactgcttgaagaagcaccatctcctgccctgacccctgagttgcgaaaggcaatgggagatgcagcagttgcagctgctgcatctattggttacataggtgttggaacggttgagttccttttggatgaaagaggttccttttactttatggagatgaacactcgtatccaggttgagcatccggtgacagaaatgatttcctcaacggatttgatagaagagcaaattcgtgtagctatgggagaaaaacttcgatacaaacaggaggatattgtcctcagaggacattctattgaatgccgtatcaatgcagaagatgcttttaagggatttagaccagggccaggtagaattactgcatacttgccatccggaggtccatttgttagaatggatagccatgtttatcctgattatgtggttcctccaagctatgattcccttcttggaaagctgattgtatgggctccaactagagaaaaagcaattgaacgcatgaaaagggcacttgatgatactattatcacaggagttcctactacaattgattatcataaacttatccttgacatagaggatttcagaaatggcaaggttgatactgcttttattccaaaacacgaggaagagttggcaatgccaccgcagaagatggtactcgctaacagggtgaatgaactagctggttcaactgcctgatgaatatgattgtgtgatgccagaattgctttgttgtaatcaccgtgtcgttagtgccttgaagtcaatgttttattgaaattttgataattagtctcgtacattcctatttcttcacataattatattgtaatatcaattaatttcatcccaaatattagtgcaaggaataaggaataactccttgcatttttcttccaaagttagttgtctaaacggtttagaggatctttgtcccaaggcttgtttgtaattcttgtattaagagctcgttgctagatacactaataaaaacttaaccttatcctaacagcctgggtttattattatatggatcaattggcgtccaattggcgtcgctagatgcttagaataatttttgtttagattatcttttttctattac

SEQ ID NO: 8002 - DNA, 2197 bp, Glycine max
ctagatttatatttaggcggagctttcaatttggcacctccctcgtttacatcgacacccgcatcaaaagtcactccattcccatcagaacacaaaacacagcatttcccttagcgtaggtaaagccatagtatccatcactcactctttcgcaagcattctttctgtttatatatttcactcaccaatgccttcattgtgttaggaaatggaagtcacactttcagcctgcaagtccgttagctcgccttctgttcccgtcgcaggtttgtttgcggggaatggaggaattaagagctcgcaatgcagtttcttagcgggagcgagcaaagtgaggtttcctaggcaagtaggtcaagttagccaccttcgcaaacagcgccaaacgcgtcactgcggtgctctccacgcgacttgcagcggtgacaagatcctgatcgcgaacagaggcgagattgccgtccgcgttattcgaaccgctcatgaattggggattccttgtgtggctgtgtactccaccatcgacaaggacgcgcttcatgtcaaattggctgatgaagccgtttgcatcggggaagcgccgagtagccagtcctacttgctgatcccgaatgttctgtcagctgctattagccgcagatgcaccatgttgcatcctggctatggttttcttgcggagaatgcagtgtttgttgaaatgtgcagagaacatggaatcaactttattgggcctaaccctgacagtattcgggttatgggtgacaaagcaactgccagagagacaatgaagaaagcaggtgttcccaccgttccgggaagtgatggccttttacagagcacagaagaagctatcagactggcaaatgagattggtttccctgtgatgatcaaggcaacagctggtggtggaggacgtggcatgcgtcttgctaaagaacctgctgagtttgtgaagtttttacagcaagctaagagtgaggcagctgctgcatttggcaatgatggggtttatttggagaagtacattcaaaacccaaggcacattgagttccaggttcttgcagataaatatggtaatgttgttcactttggagaacgtgattgcagcattcagaggcgcaaccagaaactgcttgaagaagcaccatctcctgccctgacccctgagttgcgaaaggcaatgggagatgcagcagttgcagctgctgcatctattggttacataggtgttggaacggttgagttccttttggatgaaagaggttccttttactttatggagatgaacactcgtatccaggttgagcatccggtgacagaaatgatttcctcaacggatttgatagaagagcaaattcgtgtagctatgggagaaaaacttcgatacaaacaggaggatattgtcctcagaggacattctattgaatgccgtatcaatgcagaagatgcttttaagggatttagaccagggccaggtagaattactgcatacttgccatccggaggtccatttgttagaatggatagccatgtttatcctgattatgtggttcctccaagctatgattcccttcttggaaagctgattgtatgggctccaactagagaaaaagcaattgaacgcatgaaaagggcacttgatgatactattatcacaggagttcctactacaattgattatcataaacttatccttgacatagaggatttcagaaatggcaaggttgatactgcttttattccaaaacacgaggaagagttggcaatgccaccgcagaagatggtactcgctaacagggtgaatgaactagctggttcaactgcctgatgaatatgattgtgtgatgccagaattgctttgttgtaatcaccgtgtcgttagtgccttgaagtcaatgttttattgaaattttgataattagtctcgtacattcctatttcttcacataattatattgtaatatcaattaatttcatcccaaatattagtgcaaggaataaggaataactccttgcatttttcttccaaagttagttgtctaaacggtttagaggatctttgtcccaaggcttgtttgtaattcttgtattaagagctcgttgctagatacactaataaaaacttaaccttatcctaacagcctgggtttattattatatggatcaattggcgtccaattggcgtcgctagatgctt

SEQ ID NO: 8003 - DNA, 2025 bp, Arabidopsis thaliana
cgtgtttgcgtttagagttggcacaaaatccaccaaatcaaaccagtcgggcggaggattcaatatctcagagtttcactctcaacatttcattctctctctctctctcaacaattagatctgtttcgataatcacgaggtttccctcacttcctttccattgctaaaccaggatttgcctcctgcatttggaaatggacgcttctatgattaccaattccaaatccattacttctccaccctctttagccttagggaagtcaggaggaggaggagttatcagaagttcactatgtaacttaatgatgccaagcaaagttaacttccctagacaaagaactcaaactctaaaggttagccagaagaaactcaagagagctactagtggtggtcttggtgttacatgcagtggtggtgataagattctcgtagcgaatcgaggtgaaattgcagttcgtgttatcagaactgctcatgaaatggggattccttgtgttgctgtgtattctactatagataaagatgctcttcatgttaaattagctgatgaagctgtttgtattggtgaagctcctagtaaccagtcgtatttggtgattccgaatgttctgtctgcggctattagccgtggatgtacaatgcttcatcctggatatggttttctttcggagaacgctctctttgttgaaatgtgtagagaccatgggatcaattttattggacctaatcctgatagcatccgtgttatgggagacaaagcgactgcaagagagacaatgaaaaatgcaggggttcccactgtaccagggagtgatgggctattgcagagtacagaagaagctgtcagggtcgccaatgagattggtttccctgtaatgatcaaggcaacagctggtggtggtggacgtggaatgcgtcttgctaaggaaccgggagagtttgtaaaactgttgcagcaagctaagagcgaggctgctgctgcttttgggaatgatggatgttatctggagaagttcgtacaaaaccctagacatattgagttccaggtgctggcagataaatttggaaatgttgttcactttggtgagcgtgactgcagcatccagaggcgtaaccaaaagcttctggaagaagcaccttctccagcattgaccgctgaattgcgaaaagccatgggtgatgcagcagtcgcagcagcagcatccattgggtacattggtgttggtactgtggagtttcttttagatgagagaggttccttctacttcatggaaatgaacactaggatccaggtggagcatcctgtgacagagatgatttactctgttgatttgatagaggagcagattcgtgttgcaatgggagagaaacttcgttacaaacaggaagatattgtgctcagagggcactcaattgaatgtcgtatcaatgcagaagatccatttaaaggattcagacctggacctggcagaataacatcatacctgccatctggaggtcctttcgttagaatggacagccatgtctattccgactatgttgtgcctccaagctatgattctcttcttgggaagcttattgtgtgggctccaacgagggaaaaagcaattgaacggatgaagcgggcgcttaatgacactatcattacaggggttccaacgactatcaattaccacaaacttatccttgatgttgaggatttcaaaaatggaaaagttgatacagctttcatcgtcaagcatgaagaggagctagctgagcctcaagaaattgtggcagtgaaagatctgacaaacgcaacggtttagaatgatacatcagctctgaaagaccacccaattattgcaatcttcgtctccttttgtgtgttcattggtacaaacttcggtaacgataagactgttttactagagtctgtggttttatcaatgttcttcttgtatcataaacaagaggaaacacttttgtttgtagtctctatgtcaagatttttcaataattttcatatatagtagagattatatg

SEQ ID NO: 8004 - DNA, 1973 bp, Arabidopsis thaliana
ggaggattcaatatctcagagtttcactctcaacatttcattctctctctctctctcaacaattagatctgtttcgataatcacgaggtttccctcacttcctttccattgctaaaccaggatttgcctcctgcatttggaaatggacgcttctatgattaccaattccaaatccattacttctccaccctctttagccttagggaagtcaggaggaggaggagttatcagaagttcactatgtaacttaatgatgccaagcaaagttaacttccctagacaaagaactcaaactctaaaggttagccagaagaaactcaagagagctactagtggtggtcttggtgttacatgcagtggtggtgataagattctcgtagcgaatcgaggtgaaattgcagttcgtgttatcagaactgctcatgaaatggggattccttgtgttgctgtgtattctactatagataaagatgctcttcatgttaaattagctgatgaagctgtttgtattggtgaagctcctagtaaccagtcgtatttggtgattccgaatgttctgtctgcggctattagccgtggatgtacaatgcttcatcctggatatggttttctttcggagaacgctctctttgttgaaatgtgtagagaccatgggatcaattttattggacctaatcctgatagcatccgtgttatgggagacaaagcgactgcaagagagacaatgaaaaatgcaggggttcccactgtaccagggagtgatgggctattgcagagtacagaagaagctgtcagggtcgccaatgagattggtttccctgtaatgatcaaggcaacagctggtggtggtggacgtggaatgcgtcttgctaaggaaccgggagagtttgtaaaactgttgcagcaagctaagagcgaggctgctgctgcttttgggaatgatggatgttatctggagaagttcgtacaaaaccctagacatattgagttccaggtgctggcagataaatttggaaatgttgttcactttggtgagcgtgactgcagcatccagaggcgtaaccaaaagcttctggaagaagcaccttctccagcattgaccgctgaattgcgaaaagccatgggtgatgcagcagtcgcagcagcagcatccattgggtacattggtgttggtactgtggagtttcttttagatgagagaggttccttctacttcatggaaatgaacactaggatccaggtggagcatcctgtgacagagatgatttactctgttgatttgatagaggagcagattcgtgttgcaatgggagagaaacttcgttacaaacaggaagatattgtgctcagagggcactcaattgaatgtcgtatcaatgcagaagatccatttaaaggattcagacctggacctggcagaataacatcatacctgccatctggaggtcctttcgttagaatggacagccatgtctattccgactatgttgtgcctccaagctatgattctcttcttgggaagcttattgtgtgggctccaacgagggaaaaagcaattgaacggatgaagcgggcgcttaatgacactatcattacaggggttccaacgactatcaattaccacaaacttatccttgatgttgaggatttcaaaaatggaaaagttgatacagctttcatcgtcaagcatgaagaggagctagctgagcctcaagaaattgtggcagtgaaagatctgacaaacgcaacggtttagaatgatacatcagctctgaaagaccacccaattattgcaatcttcgtctccttttgtgtgttcattggtacaaacttcggtaacgataagactgttttactagagtctgtggttttatcaatgttcttcttgtatcataaacaagaggaaacacttttgtttgtagtctctatgtcaagatttttcaataattttcatatatagtagagattatatg

SEQ ID NO: 8005 - DNA, 2331 bp, Cajanus cajan
aacccaagcaagtgtggtgggccacgtagcgcagtccatttatgtgaaggaagatgataaaggttgaacgaagggctgcgatgtaagaagatgaacacccactctcagcttccaactgccaaagtccaactaaaacaaaccatttagatttaggcggagctttcaatttggcactccctcgtttccatcgacatccacatcaaaaactcactcccatcacaacacaacacgcaaatcacactctcttctctcgccaacaccgctcccatcggtaagtaggaaatggaagccacactttcagcctgcaactccctcacctcgtcgtccgttcccctcgtgggtttatttgcggggaaaggagggattaagagctctcaatgcagtttcctagcgggaacgaaccgagtgaggttccccaggcaagtaggtcaggttagtcgatttcacaaacaacgccaaacgcgtcactgcggcgcgctccacgccacttgtaacggtaacaagatcctcatcgcgaatagaggcgagattgcggttcgcgtcattcgaaccgctcatgagttggggattccctgtgtggctgtgtactccaccattgataaggacgcgcttcatgtcaaattagctgatgaagccgtttgcatcggcgaagcgccgagtagccagtcatacttgctgatcccgaatgttctttcggctgcaattagccgcagatgcacgatgttgcatcctggctatggttttctggcggagaatgcagtgtttgttgaaatgtgcacggaacatggaatcaactttattgggcctaaccctgacagtattcgggttatgggtgacaaatcaactgcaagggagacaatgaagaaagcaggtgttcccactgttccgggaagtgaaggccttttgcagaccactgaagaagctatcaggctggcaaatgagattggtttccctgtgatgatcaaggcaacagctggtggtgggggacgtggcatgcgtcttgctaaagaacctgatgagtttgtgaagttgttacagcaagctaagagtgaagcagctgctgcatttggaaatgatggggtatatttggagaagtacattcaaaacccaaggcacattgagttccaggttcttgcagataaatatggtaatgttgttcactttggagaacgtgattgcagcattcagaggcgtaatcaaaaactgcttgaagaagcaccatctcctgcactgacccctgagttgcgaaaggcaatgggagatgcagcagtggcagctgctgcatctattggttacataggtgttggaacggttgaattccttttggatgaaaggggttccttttacttcatggagatgaacactcgtatccaggttgagcatcctgtgacagaaatgatttcctcaactgatttgatagaagagcaaattcgtgttgctatgggagaaaaacttcgatacaaacaggaggatattgtgctcagaggacattctattgaatgccgtatcaatgcagaagatgcttttaagggatttagaccagggccaggtagaataacagcatacttgccatctggaggtccatttgtcagaatggatagtcatgtttatcctgattatgtggttcctccaagctacgactctcttcttggaaagctgattgtatgggctccaacaagagaaaaagcaattgaacgcatgaaaagggcacttgatgacacgattatcacaggagttcctactacaattgattatcataaacttatcctcgacatagaggatttcagaaatggcaatgttgatactgcttttattcctaaacatgaggaagagttggcaatgccgccacagaagatggtactctctaacacggtgaaagaactggctggctcaattgcctgatggatatgatatgatatgattttctgatgccataattgcttggttgtaatcaccatgtcgacagtccctcgaagtggaagcgaaattttaatgaaattttgataattagtctctttacatgattatattataaaattaattatgttttgctttcgtcccaaatattagtgcaggaattgggaatagctgcttcttgcatttcttttcaagtcgtggtagtcacaattgttattagaggatctgtcccaaggcttgtttgtaattcttgtattaagagctcgatgctagatacagtaataaggacttaatcttatcctaactggttgggtttgttatacggatcaattggcgtcgctagatatttaaaatagtttttgtttagacttcctttttctatgatccatatttattacttgcatttaacgtgaa

SEQ ID NO: 8006 - DNA, 2144 bp, Aristolochia fimbriata
acactgcattgcctccaattttctcggcggagtcttcaaagttcaatctgctccgtccctcgggctcatcgactcccgacttttccccgttgcttctttagatttaacgatcacttcccctgcattctcaactaactctcatctaccttcgctgttgccggaaagctcaaacattgcgctcgcgtttccggcatggatgccatgattgtctgcaaatcggtctgcgcgcctcgttgcaccagtaacaggggtttgtttgccgggcaagccagaggaattaggagctcgcaatgtagctttatggttgggaaaggtgggccatttccacatcaaagagctgttcaacttagcaagaagcccaagaaaaagggaggagcactgagtgcaacttgtcgggatgaaaagattctagtggcaaatagaggggaaattgctgttagagtgatccgaactgcccatgagatgggaatcccatgcgttgcagtgtattcaacaatagatcgggatgcactccatgttcgactagctgacgaggctgtatgcattggggaagcacctagtagccaatcgtatttgttcattccaaatgtcctgtctgctgctgtaagtcataattgcacaatgctgcatcctggatacggttttcttgctgagaatgcctcttttgttgatatatgcagagcgcatggaatcaatttcattggtcccaatccagatagcatacgtgttatgggtgacaaagctactgctagggaaacaatgaaaaaagctggtgttcccactgttcctggaagtgacgggttgttgcagtccacagaggaggcagtgaagcttgcgcatgagattggtttccctgtgatgatcaaggcaactgctggtggtggtggacgtgggatgcgtctagctaatgaacctgatgaatttgtaaagttactgcagcaagccaagagtgaagcccaatctgcattcgggaatgatggagtttatttggaaaagtatattcaaaatcctaggcatattgaattccaggttcttgcagataagtatggaaatgttgttcactttggagagcgtgattgcagcattcagagaaggaaccaaaagcttctggaagaagctccttctcctgcacttactcctgaactgcggaaagccatgggggatgcagctgttgctgctgcggcatcaataggatatattggtgttggaacggtggaatttctactggatgaaaggggttctttctacttcatggaaatgaacaccagaatccaggtggagcatcctgtcactgaaatgatctcctcaactgacttgattgaggaacaaattcgtgtggcacttggagaaaagcttgagtacaatcaggaagatattgtacttaggggacattctattgaatgccgtattaatgcagaagatgcttttaagaactttcgacctggacctggaaaaataacagcttacttaccttctggtgggccatttgtgagaatggatagtcatgtctaccctgattatgtcgtcccacccagctatgactccttgttgggaaagctaattgtttgggctccgaccagagaaaaggcaattgagcgtatgaaaagagctctggatgatacagttataacaggaattcctaccactatcgactaccataagcttatcctcaacattgaggacttcagaaatggtaaggttgacacagcattcattccaaagcatgagaaggagttagctgggccccaaagtctggttctggcgaaatctgagaaggagctggccagcacagcagcataaacggaatgagatgcctggacccgatcacacccatgttttcctccagaattgagctgtgacagttttgagcagaggaacagtcatttgaatatttttttggtagattaatcctcaactatttgccttgtagctcttgcccttatttgtaaaattatcggaaaaccctggtagttatgaaaaattgtgttagaacgtcgtacgtttgagctctgtcagtttttattgtgataatcaatgttgttaatcaatgaattctgactgaggcatgccatcagttcatattggataattttcaaagattgtctggactagagaataaaatcgtagcctttgagttactttct

SEQ ID NO: 8007 - DNA, 1639 bp, Cucumis sativus
atttctctctttccttcaaatctcaactccccctttctctcatttcttcgtttcccttcctctttcctttttacacctttccatctcaaacatggatgccgcaatgcctctctgcaaatctgctcgcgctccctctctcactggcttatttgctgggactaccaatagattcaggagctctcaatgtaccttcatgggtgcaaataaactcagttttcctagtcagagagctagtggaataaaatatactcgtaaatcgttgaagaatgggaagggccttcaagttgtgtgccgtgccgagaaaattttggtgtctaatagaggagaaattgcggttcgtattataagaactgctcatgaattgggaattccttgtgtggctgtgtactcaaccgttgacaaggacgcactccacgtaaaattagctgatgaatctgtgtgcattggcgaagcaccaagcagcctatcgtacttactgattccaaatgtcctctctgctgccgtgagtcggggatgtacaatgctgcatcctggttatggcttccttgctgagaatgcatcatttgttcaaatgtgcagagaacatggaatcaattttattggacctaatcctgacagcattcgagttatgggtgataaatcaactgccagagatactatgaaaaaagcaggtgtaccaactgttccaggaagtgatggccttttacagagcactgaagaagccatcaaacttgcacaggaaattggctatcccgttatgatcaaggcaacagcaggtggtggaggacgtggcatgaggcttgctaaagagcctgatgaattcgtgaagttgttgcagcaagccaagagtgaggctgcagctgcatttgggaatgatggtgtttatcttgaaaagtatgtccaaaatccaaggcatattgagtttcaggttcttgctgataagtatggaaatgttgttcattttggagagcgtgattgcagcattcagagacggaaccaaaagcttctagaggaggcaccatctcctgccttaacacctgagttaaggaaagctatgggcgatgcagcagttgcagctgctgcctctataggttacattggggttgggacagttgagttcctgttggatgaaagaggctccttctacttcatggaaatgaacactcggatccaggtcgagcatcccgtgacagaaatggtattttctgttgacttgattgaagagcaaattcgtgtagccatgggagaaaaacttcggtacaaacaggaagatattgtacttagaggacactcgatcgaatgccgcatcaatgcagaagatgcctttaaagggttccgacctggaccaggaagaattacagcttacttaccgtcaggaggaccatttgttaggatggatagccatgtttatactaattatgtagtgcctccaaactatgattctcttcttggaaagcttattgtttgggctccaacaagagaaaaggcaattgagcgtatgaaaagggctcttgatgatactattattacaggggttcctacaaccattgaataccacaagctaattcttgatgtagaggatttcaagaatggtaaggtggatactgcgtttattcctaaacatgaagaggaattagct

SEQ ID NO: 8008 - DNA, 1769 bp, Cleome spinosa
aattgcaaatccatcgcttcgcctccctttctattcttggggaggacgggaggtattaaaagttctcagtgtaacttcactttgggaagaagagttagcttccccagtcaaagatctcagactgttaaggttagtcggaaagctaagaaggcaggaggtggggctctggctgctacatgcagtggtgataaaattctagtagcgaatagaggtgaaattgcagtccgtgtaatccgaactgcccatgagatggggattccttgtgtagctgtctattcaaccatagacaaggatgcccttcatgtgaaactggctgatgaagcagtttgcatcggtgaagctcccagcagccaatcgtacctgttgataccaaatgttctgtctgctgctattagccgtggatgtacaatgcttcatccgggatatggtttcctttcggagaatgctctctttgttgaaatgtgcagagagcatgggatcaattttattggacccaaccctgatagcatccgtgtcatgggtgacaaatcaactgccagggagacaatgaagaatgctggtgttccaactgtaccaggaagtgatggattattacagagcactgaagaagcaataagggttgccaatgagattgggttccctgtaatgatcaaggcaacagctggtggtgggggacgtggaatgcgtctcgctaaggagccagaggagtttgtaaagttgctacagcaagctaagactgaggccgctgctgcttttggcaatgatggagtttatctggagaagtttgtccagaatcccagacacatcgagttccaggttcttgccgataaatatggcaacgttgtgcattttggtgagcgtgactgcagtatccagagacgtaaccaaaagcttttggaagaagcaccttctcctgcattgagcgctgagttgcggaaagccatgggtgatgcagcagttgctgcagcagcatctattgggtacataggtgttggtaccgtggaatttcttctggacgagagaggttccttctatttcatggaaatgaacactcggattcaggttgagcaccctgtgacggaaatgatttactctgttgatttgattgaggagcaaattcgtgttgctatgggagagaaacttcgttacaaacaggaagatattgtgctcagaggacactcaattgaatgccgtattaacgcagaagacccgtttaaaggattcagacctggccctggcagaataacagcatacttaccatctggaggtcctttcgttagaatggacagccatgtttatcccgactatgttgttcctccaagctatgattcccttcttggaaagctcattgtgtgggggccgacaagagaaaaggctattgagcggatgaaacgtgcactagacgacactattattacaggggttcccaccacaatcgattaccacaaacttatccttgacgttgaggatttcagaaacggaaaagttgatacggctttcattgtgaagcacgaagaggagctagccgctcctcaggatatcgtagcagtgacaaactcagctgctgcttagaagcaaatgacgggaaatgccgtttttttggttgtcttttttgtgtttctgtgtcagtattttggagagtcttggaataaaaataggatgtttctgttttttttttttttacattctctttgggaactctaactggttttgtgttttggtgagtctctgatgtatttgcgataacatgaccatttttatgctttttt

SEQ ID NO: 8009 - DNA, 2964 bp, Cicer arietinum
tatattttgatcacatgatcgaacctagactctttatgattgaataaacgaagggctgagatcgaaaggaagtaagggcaaggttgctcacctttgaacagccaaaatccattattacactattacagttctagatttagatttaggcggagctttcaagtcacttactataacacctccctcgtttccatcgacacccatccaactacatcttctcttcaaaaccccccactccattccatttcattccattccattgcattgttccttccttctctcaattcattcaccaatattccattgataaaaatggaagcaacaatgtcggcgtgcaagtctcttacctcaccttccaccgttcccgtcacaggtttatttgcggtgagaggaggaggaatcaagagttcgcattcacagtgcagtttcttaacgggaactaacaaggtgaagtttccgaggcaaactactcaaccttgtaaacaccgtcaaacgcgtcattgtggtgctcttcgtgcgacttgtcgtgcagataagattctgatcgcgaatagaggtgaaattgcggttcgtattattcgtactgctcatgaattggggattccgtgtgtcgctgtttattccaccgttgataaggatgctcttcatgttaaattggctgatgaatctgtttgcattggtgaagctcctagtagtcaatcgtatttactgattccaaatgttctggctgctgcaattagccgacaatgcacaatgttgcatcctggatatggttttcttgctgagaatgcagtgtttgttgacatgtgtagagaacatggaatcaattttattgggcctaatcctgatagtattcgggttatgggtgataaagcaactgccagagagaccatgaagaaagcaaacgttcctactgttccaggaagtgatgggcttttgcagaccactgaagaagctatcagggtggcacacgaaattggtttccctgtgatgatcaaggcaaccgcaggtggtggaggtcgtggtatgcgtcttgctaaagaacctgaagagtttgtgaagttattacagcaagctaagagcgaggcagctgctgcatttggaaatgatggggtttatttggagaagtacattcaaaacccaaggcacattgagttccaggttcttgcagataaatatggtaatgttgttcactttggagaacgtgattgcagtatccagaggcgtaaccagaaactgcttgaagaagcaccatctcctgcattgaccccagagttacggaaggcaatgggagatgcagcagttgctgcagccgcatctattggttacataggtgttggaacggttgagttccttttggatgaaaggggttctttttacttcatggagatgaacactcgtatccaggttgaacatcctgtgacagaaatgatttcctctgttgatttgatagaagagcaaattcgtgtagctatgggagaaaagcttcgatacactcaggaggatattgtgctcagaggacattctattgaatgccgtatcaatgcagaagatgcttttaagggatttagaccagggccaggtagaattacagcatacttgccctctggaggtccatttgtcagaatggatagtcacatttacccggattatgttgttcctccaagctatgattctcttcttggaaagctgattgtatgggctccgactagggaaaaagcaattgaacgcatgaaaagggcactcgatgacactattatcacaggagttccaacaacaattgattatcataaacttatccttgacatagaggatttcaaaaatggcaaggttgatactgctttcattccaaagcatgaggaagagttggctgtgcccccgcagcagaagatggtattagttaacaaggtgacaaaactaactggctcgacagcctgatggacatgactatgtgatgccacccatatgaagaatttgctttgttgtaatcaacgtggtcggtgcatgcttgtgaaagttctaatgaaattttgatgattggtgtcccacaattctctgttcaataattatattgttaaatgaattaattaattttatgtttgtttattgtcccaaatattagtgcaaggttatgggattttacaatggttattattttagaggatctgtctcatttcatgtttgtaattcttgtaataagaacacaattttagatagagtaataaactagaccttatcgtagcaagttgggtttgagacacgcttctattagttttaaatctagtttttttgtgtacaatttttaaatagttttaacgatttttctgtttccgtatgtcttctgtacttttttaagactgttttaatacatttcatatttattacttgttttcaacctaaagtgggatattatatgtacccatattctctttgagtgtcgtaagcaattgagatgataaaatattttagggaatgaaaattaagggaagattaatttacaaggatatagtgtccacatgttaaatcggaagatattcaaacaattttaattcaagcacacttgatgctacttttgacattttaacgtatgtcaattatttttgtcattttcatttatttgttcattctgcttaaaaatagcaagttctgtccgaaagattgaccattagcatgtgcaggaagatgagttagtttcatgttttaatgaagttttaagcaactagtacccagtcgtgaatgacaaaaattgataaatacaattgaacagttacagttatagttacaattacattcgtgcctgtagtaatgtcaattgcaaattaacctaaaacttgactttgatgtggatgcctgttgcaatgttacgtcattatgcagctttggtgctgctgcatcttgaaacacattttatgcatcacagtgttgacaggaaaaaatagaagaatttacatttttcccactgattat

SEQ ID NO: 8010 - DNA, 1706 bp, Vaccinium corymbosum
aaccaacttgtctttgaagggcatttgattgggaaatggactccgccatgaccttttgcaaatctgtccacgcacctcctggtttatttgtggggagagctaatggaattcagagcccacgatgtagctttaacgtgggaagtagggtgaactttctagggaagagtacccggagtattcaagttagccgtaaattccagaaacgaggtggaccacttcgtgctaagtgccttggtgataaaattctggtggcaaatagaggagaaattgctgttcgtgtgattcgaactgctcacgagatgggaataccctgtgttgcagtttactcaaccatagataaggatgcactgcacgtgaaactggctgatgaatcagtttgcataggtgaagcaccaagcaatcaatcgtatttggtggtcccaaatgtcctttctgctgctaccagtcgtggttgtaccatgttgcatcctggatatggcttcctttctgagaatgcagtttttgttgcaatgtgtagggagcatggaatcaactttattggtccaaatcctgacagtatacgtgtcatgggtgataaatcaacagccagggacacaatgaagaatgctggtgttccaactgtaccaggcagcgatggactgttggagagcacagaagaagccattagagttgcgaacgagattggttttccggtgatgatcaaggcaacagcaggtggaggaggacgtggaatgcgtcttgcaaaagaacctgaggagttcgtgaagttgttgcaggcagctaaggctgaggctgcagctgcatttggaaatgatggtgtttatttggagaagtacatccaaaatccaaggcacattgagtttcaggttcttgcagacaagtacggtaatgtagttcactttggagagcgtgattgcagtattcagagaaggaatcagaagcttctggaagaggcaccctcacctgcattaaccccagagttgcgtaaagccatgggtgatgcagcagttgcagcagcagcatctataggatatatcggtgttggtactgttggtaggttccttctggatgagacaggtcctttattcatggaaatgaacactcggatccaggttgagcatccctgtgacggagatgatttcctctgttgacctgtattgaagaacagatccgggtagcaaggggagaaaaaacttcgctacaaacaggaagatattgtgctgagaggaccattcaattgaaatgccgtattaatgctgaagatgctttttaagaatttcagacctgggccaggtagaataacagcatacttgccgtcaggaggtccatttgtgagaatggatagtcatgtctatcctgattacgtggttccaccaagctatgattccctactgggaaagcttattgtatgggctccaacaagagagagagcaatagcacgcatgaaaagggctctcaatgacactgtaattactggagttccgacaacaattgaataccataaacttatccttgaggttgaggacttcaaaaatggaaaagttgatactgcttttattccaaagcatgaagatgagttagccccgcccaaacagatggtaaaggttgatgcctgaatggatctcttcttctgcaatcggagttgatttttcttcagctgattgtagcctcacaatggatttgagcatgaagcttgccactgtggt

SEQ ID NO: 8011 - DNA, 1902 bp, Brassica napus
atggacgcttcaatgattactaatcctaaatccattgtctcccttccctctttgttcatggggaggtcgggaggtagcattagaagttcccaatgtaatgtcacgatgggacaagcggttagcttcccgagccaaaaaccaaacttgaagttagcggacgtgaagagaaggagtggtggtggtggtgcgttgctgctacttgcagcagtgggataagattcttgtggctaacagaggtgaaatcgctgtccgtgttatccgaactgctcacgaaatggggatcccttgtgttgctgtttaactccactatagacaaagatgcactccatgtgaagttggctgatgaagctgtttgtattggtgaagctccagcaaccagtcgtatttgtttgataccgaatgttctgtcagctgcgattagcagaggatgtacgatgctccatcctggatatggattccttgcggagaacgctctttttgtagagatgtgtagagaacacaggatcaacttcattggaccaaatcctgatagtatccgtgtcatgggtgacaaatcaactgccagggagacaatgaaaaatgcaggtgttcctactgtaccagggagtgatggattattgcagagcacagaagaaggagtcaggcttgccaatgagattggataccctgtaatgatcaaggcaacagcaggtggtggtggacgtggaatgcgtcttgctaatgaaccttcagagtttgtgaaactgttgcagcaagcaaagagtgaggccgctgctgcttttggaaatgatggagtttatctggagaagtacgttcaaaatccccgtcatattgagttccagattcttgcagataaatttggtaatgttgttcactttggcgagcgtgactgcagcatccagagacgtaaccaaaagttgctggaagaagcaccttctcccgcactgacccctgagctgcgtaaagccatgggtgatgcagcagtggcagcagcagcgtccattggttacattggtgttggtaccgtggagtttcttttggatgagagaggttccttctatttcatggaaatgaacactagaatccaggtggagcaccctgtgacggagatgatttactccgttgatttgattgaagaacagattcgtgttgcaatgggagagaaactgcgttatacacaggatgagattgtgcttaggggacattctattgaatgtcgtatcaatgcagaagacccatttaaaggattcagacctggacctggaaggataacatcgtatctgccatctggaggtccttttgttaggatggatagccatgtatatccagactatgtcgttcctccaagctatgattctcttcttggaaagcttattgtatgggctccaacgagggaaagggcgatcgagcggatgaagcgtgcacttaatgacactattattacaggggttcccaccaccattgagtaccacaagcttatccttgaagttgaggatttcaaaaacggaaaagttgatacagctttcatccccaagcatgaagaggaattagcagagcctcatgaaattgtaccagtgaaagatttgacaaatgtagctgcttagagttcatcagttcttacatgaaaaacacatggggaatcaattatggcaatgcccgcaaagtcctcttacctgggtgtcttcctcgtcttgtgatgttatgcaacagagcttcacatggtttcggctatagttgtgttttttttcgttgatggtatttacagtacttcattccagaactacaagaccatttcaagtattttctaagttctttttgttattagtttaaatgaaccaaactccaaacatgaaatcattatgaacacaatgtccttcttttggtattatgcaatacagagtc

SEQ ID NO: 8012 - DNA, 2077 bp, Lotus japonicus
cagcaccctcgtttgcatcgacacccccttcccccactcttcaaaaccaacacccaactcaaccaacccaaatccattctccattctccattcttgcttcaagcatagcaacaaatggaggccaccatgtccgcctgcaaatcaatcacctcctcttccgttcccgtcacaggtttattcgcgggaagacgaggagtgaagagttccacccaatgcagcttcttagctgaaaccaacaaggtcaaattcccgaggcaagctgctcagttcaacaagcagcaccaccagactcgccgccactgcggccctctccgcgtgacttgcggtggcggcagcggcgagaagatcctcattgctaacagaggcgagatcgccgtccgtgtcattcgtaccgcccatgaattggggattccgtgtgtggctgtgtactccaccattgacaaggacgcgcttcatgtcaagctggctgatgaagccgtttgcattggtgaagcacccagtagccaatcctatttgctgatcccgaatgttctagctgctgctattagccgcaaatgcacaatgttgcatcccggttatggtttccttgctgagaatgcagtgtttgttgagatgtgtagggaacatggaatcaattttattgggcctaatcctgacagtattcgggttatgggtgacaaagcaactgccagagaaacaatgaagaaagcaaatgttcctactgttccaggaagtgaggggcttttacagagtacagaagaagctatcagacttgcacatgagattggtttccctgtgatgatcaaggcaacagctggtggtggaggacgtggcatgcgtcttgctaaagaacctgaggagtttgtgaagttgttacagcaagctaagagtgaggcagctgctgcatttggcaacgatggagtttatttggagaagtacattcagaacccaaggcacattgagttccaggttcttgccgataaatttggtaatgttgttcactttggtgagcgtgattgcagtatccagaggcgtaatcagaaacttcttgaagaagcaccatctcctgcattgacccccgagttgcgaaaggcaatgggagacgcagcagttcaagctgctgcatcaattggttacataggagttggaacggttgagttccttttggatgaaaggggttcattttacttcatggagatgaacacacgtatccaggttgaacatcctgtgacagaaatgatttcctctactgatttgatagaagagcaaattcgtgtagctatgggtgaaaaactacgatacaaacaggaggacattgttctcagaggacattctattgaatgccgtatcaatgcagaagatgcttttaaggggtttagaccagggccaggtagaataacagcatacttgccatctggaggtccatttgtcagaatggatagccatgtttatcctgattatgtagttcctccaagctatgactcccttcttggaaagctgattgtatgggcaccaacaagagaaaaagcaattgagcgcatgaaacgggcacttgatgacactatcatcacaggagttcctacaacaattgattatcataaacttatccttgacattgaggatttcaaaaatggcaaggttgatactgcttttattccaaaacacgaggaggagttggcggtgccgccgccgcaaaagagggtactttctaacacgacgaaagagctaaatggcgcaactgcctgatgaatatgactctgatgccaccctatttaaaaattgcatttgtaatcactatgtcgtctgtgtgtgcatgtgaaagttctcaggaaattttgataattagtctccctcaattctctttgttcaataatcatattgtaaaatcaattaatttaatgttcaatttcatcccgaatatcagtgcaagcctgcaatgatatggctcactttgcattttctttcaggttgtagttgtcacaatggtttcttagaggatgtgtctgcggtcttgtttgtaattgtatttaagaactctattttagatacagcaataaaaattaaaccttatcctagt

SEQ ID NO: 8013 - DNA, 1814 bp, Brassica juncea
aaccaactcattattgttatcgtctcaattacgcttcgttcatatacttttctttgcctttctagagagttcgttcaatcatctttgctgtaagagatggcgggtcggggaaaacaactcggatctggcgcggcgaagaaggcctcaatgattactaattgcaaatccactgcctcccttccctctttgttcctggggaggtcgggaggtagtattagaagttcccagtgtaatgtcatgatggggaaaaccattagcttcccgagccaaaagactcagactttgaaggttagccggaagaacgtgaataggaggtgtggtggtggtgcgcttggtgctacttgcagtactggggataagattcttgtggctaacagaggtgaaatcgctgtccgtgttatccgaacagctcacgaaatggggatcccttgtgttgctgtttactcaactatagacaaggatgcactccatgtcaagttggctgatgaagctgtttgtattggtgaagctcctagcaaccagtcgtatttgttgataccgaatgttctgtcagctgcgattagcagaggatgtacaatgctccatcctggatatggattccttgcggagaacgctctttttgtagagatgtgtagagaacacaggatcaatttcattggaccaaatcctgatagcatccgtgtcatgggtgacaaatcaactgctagggagacaatgaaaaatgctggtgtccctactgtaccagggagtgatggattattgcagagcacagaggaaggagtcaggctcgccaatgagattgggtaccctgtaatgatcaaggcaacagcaggtggtggtggacgtggaatgcgtcttgctaatgaaccgtcagagtttgtaaaactgttgcagcaagccaagagtgaggccgctgctgcttttggaaatgatggagtttatctggagaagtacgtgcaaaatccccgacatattgagttccagattcttgcagataaatttggaaatgttgttcactttggcgagcgtgactgcagcatccagagacgtaaccaaaagttgctggaagaagcaccttctcctgcactgacccctgagctgcgaaaagccatgggtgatgcagcagttgcagcagcagcgtccattggttacatcggtgttggtactgtggaatttcttttggatgagagaggctccttctatttcatggaaatgaacactagaatccaggtggagcaccctgtgacggagatgatttactccgttgatttgattgaagaacagatccgtgttgcaatgggagagaaactgcgttatacacaggatgagattgtgcttagaggacattcgatcgaatgtcgtatcaatgcagaggacccatttaaaggattcagacctggacctggaagaataacatcatatctgccatctggaggtccttttgttagaatggatagtcatgtatatcccgactatgttgttcctccaagctatgattctcttcttggaaagcttattgtatgggctccaacgagggaaagggcaattgagcggatgaaacgtgcactcaatgacactattattacaggggttcccactaccattgagtaccacaaacttatccttgaagttgaggatttcaaaaacggaaaagttgatacagctttcatccccaagcatgaagaggaattagcagagcctcatgaaattgtcctagtgaaagatttgacaaatgcagctgcttagaactcatcagctcttgcatgaaaccagtaattttcagaacaagggggaatcaattatgccaatgcccg

SEQ ID NO: 8014 - DNA, 2240 bp, Medicago truncatula
gcgaggtccattattacagcacagcagtatcattgttgttagatttagatttggacggagctttcaactaagcatagcatagacacagtcacaccctcaacctcgtttccatcgacaccaatatactaactaaatcacacttcaaaaaccctattccaacacattttcattttcattttcctattggtattggtagaaacaattatggaggcaacaatgtccgcagcctgcaattctctcacctcaccatccaccgtcacaggtttatttgcgacgagaggaggaggattgaacaagaattcacattctcagtgcactttcttgaccggaacaaacaagctgaagtttccgaggcaaactactcaaccttgtaaacaacgccaaacgcgtcattgcggtgctcttcgtgcaacttgtcgtcttgagaagatattggttgccaatcgaggcgagattgctgttcgtgttattcgtactgctcatgaattggggattccttgtgttgctgtttattccaccattgataaagatgctcttcatgttaaattggctgatgaatctgtttgtattggtgaagctcccagtagccaatcgtatttagtgattccaaatgttctggctgctgctaccagccgccaatgtacaatgttgcatcctggatatggttttcttgcagagaatgctgtttttgttgaaatgtgtagagatcatggagtcaattttattggacctaaccctgacagtattcgggttatgggtgacaaagcaactgcaagagaaacaatgaagaaagcaaatgttcctactgttccaggaagtgaggggcttttgcagaccactgaagaagctatcagactggcacacgagattggtttccctgtgatgatcaaggcaaccgcaggtggtggaggacgtggcatgcgtcttgctaaagaacctaaagagtttgtgaagttattacagcaagctaagagtgaggcagctgctgcatttggaaatgatggggtttatttggagaagtacattcaaaacccaaggcacattgaattccaggttcttgcagataaatatggtaatgttgttcactttggagaacgtgattgcagtatccagaggcgtaatcagaaactgctcgaagaagcaccgtctcctgcattgaccccagagttacggaaggcaatgggagatgcagcagttcaggctgccgcatctatcggttacataggtgttggaacggttgagttccttttggatgaaaggggttctttttacttcatggagatgaacactcgtatccaggttgaacatcccgtgacagaaatgatttcctcagttgatttgatagaagagcaaattcgtgtagctatgggagaaaagcttcgatacaaacaggaggatattgtactcagaggacattccattgaatgccgtatcaatgcagaagatgctttcaagggatttagaccagggccaggtagaattacagcatacttgccgtctggtggtccatttgtcaggatggatagccatatttatcctgattatgttgttcctccaagctatgactctcttcttggaaagctgattgtatgggctccgactagagaaaaagcaattgaacgcatgaaaagggcactcgatgacactattatcacaggagttcctacaacaattgattatcataaacttatccttgacatagaggatttcaaaaatggcaaggttgatactgcttttattccaaagcacgaggaggagttggctgtgcccccacaacagaagatggtattagttaacaaggtggtgacagaaccagctggctcgactgcctgatggatatcatgactatgtgatgacgccctataaagaatttgcactgttgtaatcaatatgttgtccgtgtgtgcttgagaaagttctaatgaaattttgataattagtctcccataattatccgtccaataattattttgtaaaatggttaattaatttcatgtttaatttatcaccccgaatattagtgctaggttatgggatttcaccatgattttagatgattgttgtctcatttcatgttttgtaattcttatattaagaacacacttttagatagagtaataaactgcatcatatctagcaagttgaatttcaggcatgtttcaatttgtgtcactagactattataaatctagctttttgtgaaattttaaatatattttaatgatcttttgtcgttgtaa

SEQ ID NO: 8015 - DNA, 2404 bp, Medicago truncatula
ttcaacccctttatttataaaaatattacaataagcttagatttgattttaatgaaaaagcagttggattggattgtataaatcaagaaatatatttacgttttgatcataggatccaaagaataaacggctgagattaaaaggaaataagggctaagttgccgagaggcgaggtccattattacagcacagcagtatcattgttgttagatttagatttggacggagctttcaactaagcatagcatagacacagtcacaccctcaacctcgtttccatcgacaccaatatactaactaaatcacacttcaaaaaccctattccaacacattttcattttcattttcctattggtattgaaacaattatggaggcaacaatgtccgcagcctgcaattctctcacctcaccatccaccgtcacaggtttatttgcgacgagaggaggaggattgaacaagaattcacattctcagtgcactttcttgaccggaacaaacaagctgaagtttccgaggcaaactactcaaccttgtaaacaacgccaaacgcgtcattgcggtgctcttcgtgcaacttgtcgtcttgagaagatattggttgccaatcgaggcgagattgctgttcgtgttattcgtactgctcatgaattggggattccttgtgttgctgtttattccaccattgataaagatgctcttcatgttaaattggctgatgaatctgtttgtattggtgaagctcccagtagccaatcgtatttagtgattccaaatgttctggctgctgctaccagccgccaatgtacaatgttgcatcctggatatggttttcttgcagagaatgctgtttttgttgaaatgtgtagagatcatggagtcaattttattggacctaaccctgacagtattcgggttatgggtgacaaagcaactgcaagagaaacaatgaagaaagcaaatgttcctactgttccaggaagtgaggggcttttgcagaccactgaagaagctatcagactggcacacgagattggtttccctgtgatgatcaaggcaaccgcaggtggtggaggacgtggcatgcgtcttgctaaagaacctaaagagtttgtgaagttattacagcaagctaagagtgaggcagctgctgcatttggaaatgatggggtttatttggagaagtacattcaaaacccaaggcacattgaattccaggttcttgcagataaatatggtaatgttgttcactttggagaacgtgattgcagtatccagaggcgtaatcagaaactgctcgaagaagcaccgtctcctgcattgaccccagagttacggaaggcaatgggagatgcagcagttcaggctgccgcatctatcggttacataggtgttggaacggttgagttccttttggatgaaaggggttctttttacttcatggagatgaacactcgtatccaggttgaacatcccgtgacagaaatgatttcctcagttgatttgatagaagagcaaattcgtgtagctatgggagaaaagcttcgatacaaacaggaggatattgtactcagaggacattccattgaatgccgtatcaatgcagaagatgctttcaagggatttagaccagggccaggtagaattacagcatacttgccgtctggtggtccatttgtcaggatggatagccatatttatcctgattatgttgttcctccaagctatgactctcttcttggaaagctgattgtatgggctccgactagagaaaaagcaattgaacgcatgaaaagggcactcgatgacactattatcacaggagttcctacaacaattgattatcataaacttatccttgacatagaggatttcaaaaatggcaaggttgatactgcttttattccaaagcacgaggaggagttggctgtgcccccacaacagaagatggtattagttaacaaggtggtgacagaaccagctggctcgactgcctgatggatatcatgactatgtgatgacgccctataaagaatttgcactgttgtaatcaatatgttgtccgtgtgtgcttgagaaagttctaatgaaattttgataattagtctcccataattatccgtccaataattattttgtaaaatggttaattaatttcatgtttaatttatcaccccgaatattagtgctaggttatgggatttcaccatgattttagatgattgttgtctcatttcatgttttgtaattcttatattaagaacacacttttagatagagtaataaactgcatcatatctagcaagttgaatttcaggcatgtttcaatttgtgtcactagactattataaatctagctttttgtgaaattttaaatatattttaatgatcttttgtcgttgtaa

SEQ ID NO: 8016 - DNA, 2458 bp, Elaeis guineensis
cctcctcttcgcttctcctaatttaactctcaacccctcccctcggaacccatctcttctcctcccctctaatccttcgatacctctcctcctcatccccgacggctacccttctttccagatccgcccatctctcccaccatttcgcggatttgatagctggagtatcttctttctctatccgaaccgagatcggtattaatttttttcgttctgtttgaggatttgatccgaagatgaactccatgatcacttgcaagtcggcctgctcgcctcttgggttagtcatcggaccagccagaggaattaggagctctcaatgtacctttatggtgggaaatgctccaaactttcacaagataagctttccgaggcaaagagctgcttgtgcaaaccggaaatcaaaaaggagcggaggagctctgcatgcaacttgccatgatgagaggattcttgtggcaaatagaggggaaattgcagtcagggtgattcgaactgcacatgagatggggattccctgtgttgctgtgcactccacaatagatgaggatgctcttcatgtgcgactcgcagatgaggcagtgtgcattggtgaagcaccaagcagtcaatcgtacttgttcattccaaatgttttatctgctgctgttagccgggggtgcactatgttgcatcctgggtatggtttcctagctgagaatgctggctttgttgatatatgcaaagagcatggaatcaactttattgggccaaatcctgacagcattcgagtcatgggcgataaatctacagccagagaaacaatgaagaaggcaggcgtcccgactgtacctggaagtgatggattgttacagtccactgaagaggctgtcaagcttgcacatgaaattggtttcccagtgatgattaaggcaactgctggtggtggagggcgtggaatgcgtctagctcatgaacctgaagagtttgtaaagttactccagcaagctaagagtgaggcggcagcagcatttggaaatgatggggtttacctggagaaatacatccagaatccaaggcacattgagttccaggttcttgcagacaagtatggtaatgttgttcattttggtgagcgtgattgcagtatacagagaaggaatcagaagctcctagaagaagctccatcccctgcattgacgcctgagctacggaaagctatgggtgatgcagctgtagctgctgctgcatctataggttacattggtgttggaactgtggaatttctcttggatgaaagaggtaccttctacttcatggagatgaacaccaggattcaggtagagcaccctgtcactgaaatgatttcttcaaccgacttgattgaagaacaaattcgagttgctcttggagagaggctgacatacaagcaggaagacattgttctgagaggacattcaattgaatgccggattaatgcagaagatgccttcaaaggatttcgtccagggcctggaaagattacatcatacttgccatctggaggtccatttgtgagaatggatagtcatgtttatccaggctatgtggttcccccaagctatgactccttgttaggaaagcttattgtgtgggcaccaaccagggaaaaagcgattgaacggatgaaaagagctcttgatgacacgataataacaggaattcctacaaccattgaataccataagctaattcttgatatcgaggattttagaaatggaaaggtagatactgccttcataccgaagcatgagaaggatttggctgcaccccagaaactagtgctgttgacattggagaaagagcttgccgggttgggtgcctaaacattatattatgtgcttcagttccttgcagtccctatggcatttcaatctatacatcattcattgcttaccagctgaagattttgacttgagaataactgtagcctaggccaatctctctctctctctctctctctctctctctctctctcacatttaattaccttaaatatttctttcagtttgtctaggcagtaaaacatgactggaaattgtatgaatgagaagcatagcttctgcttggaaacaatttgggatgtaggtatatttgggtatggagacatattttgaactcagctgttattgttatttatggacttcatgttctttccaatagttcaatgcaatgtgcttttctcaagttttgccggccatagaattaaatttgtagtatgattattgtaagtcatgacctaactgaatgttatgtggtttagagatgtgtggctcaatcttgaagcccaatatatcgtagtttcaattctaatgttaatggctaaagcttccatcggaagcattggagatgatgtttaacttttgctcaattatttatttaagtctcatttgcattgctgcatcagccttcgtgacagtgacaagtggaatgttttcaa

SEQ ID NO: 8017 - DNA, 1820 bp, Euonymus alatus
ttttgttgggaagcaatgtaaacttccctagacaaagatttcagacagcgcaagttagatgtaaatctaagaagaatggtggagctcttagtactgcatgtcgcgctgagaaaattctggtggcaaatagaggagaaattgctgttcgtattattcgaactgcacatgagatggggataccttgtgttgctgtttactcgacaatagacaaggacgcacttcatgtgaaattggctgatgaatcagtttgcataggggaagcgccaagcaatcaatcgtatttagtaatcccgaatgttctatctgctgctgtcagccgtagatgtaccatgttgcatcctggatatggtttcctggctgaaaatgctgtttttgttgaaatgtgcaaagaacatggaattaactttattggaccaaatcctgacagcatccgtgtcatgggtgacaaatcaactgcaagagacacgatgaaaaatgcaggtgttccaactgttccaggaagtgatggattgttacagaacacagaggaagcaatcagagtatccaatgagattggttttcctgtgatgatcaaggcaacggctggtggtggaggtcgtggaatgcgtcttgctaaagaacctgacgagtttgtgaaatttctacagcaagcaaagagtgaggctgctgctgcatttggcaatgatggagtgtatttggagaagtatatacaaaatccaaggcacattgaattccaggttcttgctgataaatatggtaatgttgttcactttggtgagcgtgactgcagtatccagaggcgtaaccaaaagttgctggaagaggcaccctctcctgcactgacaccagagttgcggaaagccatgggtgatgcagcagttgcagcggcagcatctattggatacattggtgttggaacagtcgaattccttttggatgagaggggctccttttacttcatggaaatgaacactcgaatccaggttgaacatcctgtgacagaaatgattttctctgttgatttgattgaggaacaaattcgagtggccatgggtgagaagctccgctacaagcaggaagatatttctctcagaggacactccatcgaatgtcgtattaatgcggaagatgctttcaaaggatttcgaccagggccagggagaataacctcatacttgccctctggtggtccatttgttagaatggatagccatgtttatcctgattacgtggttcctccaaattatgattctcttcttggaaagcttattgtatgggctccaacaagagagaaggcaattgagcgcatgaaaagagctcttgacgacactatcatcacaggggttcctacaaccattgattatcataaacttattcttgacattgaggacttcagaaatgggaaggtcgatactgctttcattccaaaacatgagcaggagttggcagcgccccagacactggtgccagtgaaagaattgtcaaatgcatctgcttagatatcacttctgaagagtctgatgatagccgctgaaaaggccggagtttttcctcctcctgagaatctgttattgcctttttttacctcagtaaatctatcccatagttcactcccaatgtactgacatgctttagaatatttctatgtcatgcacaagaaataagtgcgggaaattgaatgttttcctttatttatcagacaaaaaacatattacaagcaacaaactcttccgttcgcgatcgtttaactagcatcccttgccgagtaccaccgaactatgcatgacattccttatagccaagcaccaccaaagtataat

SEQ ID NO: 8018 - DNA, 1675 bp, Euphorbia peplus
aatgtagttttatgctgggaaccaaacttaactttccaagccacaaacttcaggcttcccaacttactcataaatcaaacaagaatgggggtgctcttggtgctacatgccgctctgagaaaatattgattgcaaatagaggagaaattgctgttcgtgttattagaacagctcacgaattggggattccttgtgtggctgtttactcgactattgataaggatgcacttcatgttaaattggctgatgaatctgtttgtattggtgaagcaccaagcagtcagtcgtacttgttgattccaaatgttttatccgctgctattagtcgtggatgtacaatgttgcaccctggctatggatttcttgctgagaatgcagtatttgttgaaatgtgtagagaacatggaatcaactttattgggcctaatcctgacagtatcagagtcatgggagacaaagcaactgctagggaaacaatgaagaatgcaggtgttcctactgtacccgggagcgaaggattgctgcagagtacagaggaagcagtgaagcttgctcatgagattggttttcctgttatgatcaaggcaacagcaggcggtggaggccgtggaatgcgccttgctaaagaaccagaggagtttgtgaagttgctgcagcaagctaaaagtgaagcagcagcagcatttggaaatgatggtgtttatttagagaaatacatccagaatccaagacacattgagttccaggttcttgctgataaattcggtaatgttgttcactttggtgagcgtgattgcagtatccagagacgtaatcaaaagttgcttgaagaagcaccctctcctgcattgacccctgaactgcgaaaagctatgggtgatgctgctgttgcagctgctgcgtctattggatatatcggtgttggaacagttgagttcctcttggatgagagaggttctttttacttcatggaaatgaacactagaatccaggttgagcatcctgtgactgaaatgatttcctctgttgacttgattgaggaacaaattcgtgtagccatgggagaaaaactccgctacaaacaggaagatattgtgctgagaggacattcaattgaatgccgtatcaatgctgaggatgcttttaagggcttccgacccgggccagggagaataacagcatacttgccatctggaggcccatttgttagaatggatagccacgtttatcctgattatgtcgtccctccaagctatgactccctccttggaaagcttattgtatgggcaccaactagggaaaaggcaattgaacgcatgaaaagagcattgaatgacactattattacaggcgttcctacaacaatagattatcataaacttatcctcgaaattgaggacttcaaaaacggcaaagttgacacagctttcattccaaagcacgaacaagagttacaggcgccacaaaagatcgtaccagctggtgcaagcgcgtaggcttcaaaggcagaaatatgttcatctcagtcacctagaaaagccgcattttgtgcacattcattcgctttgttccggaaattgtataattgcacattgatagaattttgttgtatgatcaatcgtttctttgctggttagcgatatactcggatattacttggaataacagcctctaa

SEQ ID NO: 8019 - DNA, 2338 bp, Prunus mume
gtggcagaatatcattggacagcgtcatcaacactttgaagacagatttctctccatttgggcggagcttttcaagcagcaactcccctcgttttcatggacaactcaactcttgatatctcccctcggaccttcccaccttcttcttctcactgctcactctcattatctctccctttctgctttctcgctcctcagctcttcgggtcccaaaagccttcccttttctgttcacattcaacccttgttcttcattaattcattcattcattttgatcttgttctgagacaattgagtaaggtcgctttgttttcaaaatggatgccataatgcccatttgcaagactgtaactccaactcctggcttattttttgggagaactagagagatacggagttcccaatgtagctttatggtgggaaataaagtcaactttttaaggcagagagctcagggtgctcaagttagtttcaaatccaggaagcatgggggagctctccatgctacatgtcgagctgaaaaaattctggtggcaaatagaggagaaattgctgttcgcgttattcgaactgcccatgagatgggaataccttgtgtggctgtttactcaacaatagacaaggaagcacttcatgtgaaattggctgatgaatcagtttgtattggtgaagcagcaagcagtcagtcgtacttggttgttccaaatgttttatctgctgctatcagtcggaaatgtacaatgctgcatcccggatatggtttcctggctgagaatgcatcatttgttgaaatgtgcagagaacacggaatcaactttattgggcctaagcctgacagcatccgtgttatgggtgataaatcgacagccagagacacaatgaagaaagcaggtgttccaactgtaccaggaagtgatggattactaaagagcacagaggaaggaatcaggcttgccgatgagattggctttcctgttatgatcaagcaggaggcggaggacgtggcatgcgtcttgctaaagaacctgaagagtttgtgaagttgttgcagcaagcaaagagtgaggctgcagctgcttttggaaatgatggagtttatttggaaaagtacatccaaaatcctagacatattgaatttcaggttcttgctgataaatatggtaatgttgttcactttggagagcgggattgcagtatccagagaaggaaccaaaagctgctggaagaagcaccctcccccgcattaaccccagaattgcgtaaagctatgggtgatgcggcagttgccgcagcagcatcaattggttacattggtgttggaaccgttgaattccttttggatgaaagaggctccttttacttcatggaaatgaacacacgtattcaggttgagcatcctgtgacagagatgatttcctctgttgacttgattgaagaacaaattcgtgtagctatgggagaaaaacttcgatacacacaggtaattagtaattaattgtggtaggacatatatgacccttcctgttcaatgtctgatggaggttgctccactacaggatgagatagtgctcagaggacactcaattgaatgtcgtatcaatgcagaagatgcttttaaaggattccgacctgggccaggaagaataactgcctacttaccatctggaggtccctttgttagaatggatagccatgtttatcctgattatgtggttcctccaaactatgattcccttcttggaaagcttattgtttgggcaccaacaagagaaaaagcaattgatcgaatgaagagggctcttgacgacactattataacaggggttcccacaaccattgaatatcataaacttatccttgatatagaggatttcaaaaatgggaaggttgataccgcttttattccaaagcatgaagaggagctcgccgcgccccaacatttggtgccaaagaactagctgctgcatctgcttgaagtgcaaccatctgctctagtcgtccacgttagaaaagctgcaaatccttcactttttttattttttatttttattattatttttaatagcactgggaacattgacatgccttgcatatgagaattccatttgaaattttgatatgttccgtttcaattgggtgttcaaacttgttttgcgcaccatatatgtagaaatgatgagggtcttgcaaactatccatattaagcaaggatgcttccttcattgttaggtttaatctaaaaataccattttgacgcttcacccgttatagtaaatagaacttaaaaaaacatttttgtgaactaaaaactcaaatgaaatgcattccacaaaataa

SEQ ID NO: 8020 - DNA, 1977 bp, Fagopyrum esculentum
ctcgtgcacccggtttagttgtggggcacactgcaaaatttcactcacctaaatgcacgcttcttgggagcagggtgaaatttcctgctcagaaagcatgtgctgttcatgttggaggaaaatctaagaaacgtggaggagctcttgctgctacttgtctgggtgacaagattttggtagcaaatagaggagaaattgcagttcgtgtgatccgtactgctcatgagctaggaattccatgtgttgcagtgtactcaaccatagacaaggaggccctccatgtgaagcttgctgatgaagcagtttgcattggtgaagcaccaagtaaccaatcgtatttagtaataccaaatgttttatcagctgcagttacccgtaaatgtacaatgttgcatcctggatatggtttccttgctgaaaatgcaacctttgttgagatgtgtagagagcatggcataaacttcataggacccaatcctgaaagtatccgtgtcatgggtgataaagcaactgccagagaaacaatgaaaaatgctggtgtgccaactgttcctggaagtgaaggtttattacagagcactgaagaagctgtgaagctttctcatgaaattggctttcctgtaatgattaaggcaactgcaggtggtggtggacgtggaatgcgtcttgctaaagagccagatgaatttgtgaagttgttgcagcaagctaagagtgaggctgctgctgcatttggcaatgatggagtttatttggagaaatacattcaaaatccaagacatatagagttccaggtccttgctgataagtatggtaacgtggttcactttggtgagcgtgactgcagtattcagagaagaaatcagaagcttcttgaagaggctccctctcctgcattgaccccagagttgcgtaaagccatgggtgatgcagctgtggctgctgctgcatccattgggtacattggtgttggaactgtagaattcttgttggatgaaagaggttcattttacttcatggagatgaacactagaatccaggttgagcatcctgtcacagagatgatatattctgtggacttgattgaggaacaaatccgtgtagctatgggagagaagctccgctacaaacaggaagatatagtccttaaaggacactcaattgaatgccgaatcaatgcagaagatgcgtttaagggattccgtcctggacctggaaaagttacagcttacttaccatctggggggccatttgtgagaatggatagccatgtttatcctggatatgtagtacctccaagctatgattcattgctgggcaagctaattgtatgggctcctactagggagaaagctatcgctcgcatgaaaagggctcttgaggataccataattactggagttccaacaacaatcgattaccacaaacttatccttgatattgaggatttcaaggacgggatagttgacaccgcgttcatccccaagcacgaggaggagttggctgcgccccagaagcctgttctagcaattgccaaagatctagctggaacttctgcttaaattcgtccgaggaaatagctcaacgcgtggaatctacgaacgcaaggagttgcgtcggagaaccctttaagttccgtgcttatgttgttcaccatttcgtattatagaatagaagctatagttttttaatcatgagtctatgaaggtgcttagagctctatttattacaacattggagaatctggtggagatttttttgttattaacttataattcaatcattgcctagagtgagttttaagattagggaagcaaacattgtatcttgtatgtcactctttttcatgtgtgttttcttaaactttgtaagagagactgactagttggatatattgtttcactttttgctcattcggttgtaagaaaatgttgtctttttcgaaaatttaggacccatctaaatatttttgtatgt

SEQ ID NO: 8021 - DNA, 1976 bp, Amborella trichopoda
atgttctgtttgcttttattttgtggaaacaaggatttgttcaaaagtggggcaagaggaatcataagttcaagatgcagctttctgggtgggaaccttgtaacatttcttagaccgacagctaccgtaactagcaaattcaagaaatgtgggggagcattaaatgctacatgtcgagatgagaaaatcctcgtggccaataggggtgaaattgcagtgcgtgttatccgcactgcccacgagatgggtattccatgcgttgctgtttactcgacaatagaccaggatgcacttcatgtcaggcttgcagatgaggcagtttgcattggggaagcaccaagtaaccaatcgtatctgttcattccaaatgttctatctgctgctgttagccgtgattgcacgatgttgcatcctggatacggtttcctctctgaaaatgcaacttttgttgatatctgtagagaccatggtatcaatttcattggacccaatccagatagcatccgtgttatgggtgacaaagctactgctagggaaacaatgaagaaagctggtgttccaaccgttccaggaagtgatggattgctacagacaacagaggaggctgtcaggcttgctcatgagattggttttcctgttatgataaaggcaactgctggtggtggaggacgtggaatgcgtctggctaatgaaccagatgaatttgtgaagttgttgcagcaagccaagagtgaggctgctgccgcatttggaaatgatggtgtttatttagaaaaatacattaaaaatccccgtcacattgagtttcaggttctggcagataagcatggcaatgttgtccattttggtgaacgagattgcagcattcagcgaaggaatcagaaacttttagaggaagctccctccccagcattgaccccagaacttagaaaagctatgggtgatgctgctgtggcagctgctgcatctataggttatataggtgttggaacggttgagttcctcttggatgaaaggggttcgttttactttatggaaatgaacaccaggatacaggtggaacatccagtcacagaaatgatctcttctacggatttgatcgaggaacaaattcgtgtagcacttggagagaagcttcaatataaacaggaagatattgtacttagagggcattctatcgagtgccgtatcaatgcagaggatgcgttcaaaggattccgacctgggcctggaaggataacagcatacttgccatcaggagggccatttgttagaatggacagtcatatttatccagattacgtggttcctcctagctatgattcacttcttggaaagctcattgtttgggccccgacccgagagaaagcaattgaacgtatgaagagggctcttgcggacactgttataacaggaattccaacaaccattgattaccataaactcatccttgagattgaggatttcaaggatggaaaaatcgacacggcattcattccaaagcatgaaaaggatttggcagcgccacaacaactcgtccccttcaccttcccagcaaaagaaatggctggggtcaatgcttgacctggaaaatttgcagcaaatttgagagtttgaagtagtcgaggatgcttcagggcagcaatttttgatgcaaaaataatctttttaagcacatgatttgtgatggattcgttctctatcactcgctagagtaattattttcaagttttagatttcttttcccctggttcagtacatgttgtgatgttcaaagggtgaaaagctttgggtaacatgtgttggatgcaggccttatttgtgaactcttgcttcattgtaagttaaattatgaggtgggaattttcatggatccaaatattgtgcttgagagagacaatgaaagagaatcaaattctacaccagttcaatttctgttgaatcaaatggattacaggcattgaagtagcagaaaa

SEQ ID NO: 8022 - DNA, 2173 bp, Phaseolus vulgaris
gaggatgaacaccctcaccttccaactgccaaagtccaactaaaccagcatttgcatttagatttagatttaggcggagctttcaatttggcgcctccctcgtttccatcgccatccacatcaaaattcactcccatcacaacgcaacacaaatcatacactctcttacaatcacaccattgccatcatctcaaataggaaatggaagtcacactctccgcctgcaagtccgttacctcgccttctcttcccgtcgcaggcttatctgcgaggaagggagggattaagagttcgcaatgcagtttcttagcaggaacgaacagagtgaagtttcctaggcaagtaggtcaagttagtcacgtccgcaaacagcgccaaacgcgtcactgtggtgctctccacgcgacttgtagcggcgataagatccttatcgcgaacagaggcgagattgcggttcgagtgattcgaaccgcccgtgaattggggattccttgcgtggctgtgtactccaccattgataaggactcgcttcatgtcaaattggctgatgaagctgtttgcattggcgaagctccgagtaaccaatcgtacttgctgattccgaatgttctgtctgctgctcttagccgcaattgcacgatgttgcatcctggctatggttttcttgcggagaatgctcggtttgttgaaatgtgctgcggtcatagaatcaactttatcgggcctaaacctgatagtattcgggttatgggtgacaaagcaactgccagagaaacaatgaagaaagcaggtgttcccactgttccaggaagcgagggtcttttacagagcacagaggaagctatcaggctggcaaaagagattggtttccctgtgatgatcaaggcaacagctggtggtggaggacgtggcatgcgtcttgctaaagaacctgatgaatttgtgaagttgttgcagcaagctaagagtgaagccgccgctgcatttggcaatgatggtgtttatctggagaagtacattcaaaacccaaggcacattgagttccaggttcttgccgataaacatggtaacatcgttcactttggagaacgtgattgcagcatccagaggcgtaatcagaagctgctagaagaagcaccatctcctgccctgacccctgagttgcgaaaggcaatgggagatgcagcagttgcagctgctgcatctattggttacataggtgttggaacagtggagttccttttggatgaaaggggttccttttacttcatggagatgaacactcgtatccaggttgagcatcctgtgacagaaatgatttcctcaacagatttgatagaagagcaaattcgtgttgctatgggagaaaaacttagatttaaacaggaggatattgtgctcagaggacattctattgaatgtcgtatcaatgctgaagatgcttttaagggatttagaccagggccaggtagaattacagcatacttgccatctggaggtccatttgtcagaatggatagccatgtttatcctgattatgttgttcctccaagctatgactcccttcttggaaagctgattgtttgggctccaaatagagaaaaagccattgaacgcatgaaaagggctcttgatgacacagttatcacaggagttcctacaacaattgattatcataaacttatccttgacatagaggatttcagaaatggcaaagttgacaccgcttttattccaaaacacgaggaagagttgtcaatgccgccgccaccgaagatagtaccgagctaaccggttgaaggagctagttgcctgaaggataatggttttgtgatgctgcttagttgtagtctccttgtcgtcagcgcttggaagttaaaagttttaatgaaattttgataattagtctcgtatattcctatttcttcacataattttatcgtaaaatcagttaatgttatttgatttcatcccaaatattagtgcaagaaatttggcgtctctccttgctttttagtcgtagttgttacattggttactaaaggatcttttgaaggcttgttgtaagtcttgtattaagagctcgtgttaaatacagtaataaaacctttaaattattctaaccggcttgaattgttatatggatcaattggtgttgctatatatttaaaca

SEQ ID NO: 8023 - DNA, 2266 bp, Phaseolus vulgaris
gaaacaggcttgaaagagcccaattgcggtgggccacgtagcagtccacttttgtggagtgataaaaaggataaatgaagggttgtgatggaagaggatgaacaccctcaccttccaactgccaaagtccaactaaaccagcatttgcatttagatttagatttaggcggagctttcaatttggcgcctccctcgtttccatcgccatccacatcaaaattcactcccatcacaacgcaacacaaatcatacactctcttacaatcacaccattgccatcatctcaaataggaaatggaagtcacactctccgcctgcaagtccgttacctcgccttctcttcccgtcgcaggcttatctgcgaggaagggagggattaagagttcgcaatgcagtttcttagcaggaacgaacagagtgaagtttcctaggcaagtaggtcaagttagtcacgtccgcaaacagcgccaaacgcgtcactgtggtgctctccacgcgacttgtagcggcgataagatccttatcgcgaacagaggcgagattgcggttcgagtgattcgaaccgcccgtgaattggggattccttgcgtggctgtgtactccaccattgataaggactcgcttcatgtcaaattggctgatgaagctgtttgcattggcgaagctccgagtaaccaatcgtacttgctgattccgaatgttctgtctgctgctcttagccgcaattgcacgatgttgcatcctggctatggttttcttgcggagaatgctcggtttgttgaaatgtgctgcggtcatagaatcaactttatcgggcctaaacctgatagtattcgggttatgggtgacaaagcaactgccagagaaacaatgaagaaagcaggtgttcccactgttccaggaagcgagggtcttttacagagcacagaggaagctatcaggctggcaaaagagattggtttccctgtgatgatcaaggcaacagctggtggtggaggacgtggcatgcgtcttgctaaagaacctgatgaatttgtgaagttgttgcagcaagctaagagtgaagccgccgctgcatttggcaatgatggtgtttatctggagaagtacattcaaaacccaaggcacattgagttccaggttcttgccgataaacatggtaacatcgttcactttggagaacgtgattgcagcatccagaggcgtaatcagaagctgctagaagaagcaccatctcctgccctgacccctgagttgcgaaaggcaatgggagatgcagcagttgcagctgctgcatctattggttacataggtgttggaacagtggagttccttttggatgaaaggggttccttttacttcatggagatgaacactcgtatccaggttgagcatcctgtgacagaaatgatttcctcaacagatttgatagaagagcaaattcgtgttgctatgggagaaaaacttagatttaaacaggaggatattgtgctcagaggacattctattgaatgtcgtatcaatgctgaagatgcttttaagggatttagaccagggccaggtagaattacagcatacttgccatctggaggtccatttgtcagaatggatagccatgtttatcctgattatgttgttcctccaagctatgactcccttcttggaaagctgattgtttgggctccaaatagagaaaaagccattgaacgcatgaaaagggctcttgatgacacagttatcacaggagttcctacaacaattgattatcataaacttatccttgacatagaggatttcagaaatggcaaagttgacaccgcttttattccaaaacacgaggaagagttgtcaatgccgccgccaccgaagatagtaccgagctaaccggttgaaggagctagttgcctgaaggataatggttttgtgatgctgcttagttgtagtctccttgtcgtcagcgcttggaagttaaaagttttaatgaaattttgataattagtctcgtatattcctatttcttcacataattttatcgtaaaatcagttaatgttatttgatttcatcccaaatattagtgcaagaaatttggcgtctctccttgctttttagtcgtagttgttacattggttactaaaggatcttttgaaggcttgttgtaagtcttgtattaagagctcgtgttaaatacagtaataaaacctttaaattattctaaccggcttgaattgttatatggatcaattggtgttgctatatatttaaaca

SEQ ID NO: 8024 - DNA, 1868 bp, Panax ginseng
accttttatttacttattcaccctccctcccctctcgtactcattttctttctcctccctttatttatcttgacattcgatctaggcgcatcagtttgatttgtattcttcaaaagtttctggcggcatttgatccgaaaatggactctgcggccataactttttgtagcaaacctgtgtattcctcccctccaaatttattcatggggagcacttgtggaattaaaagctcccagtgtatttttatggtgggaaataaagtgaaattccctaggcaaagagctcaggcttctcaagttaatcgtaaatctgggaaacgtgggggtgctcttagtgctacatgccgtgacgataaaattctggtggcaaacagaggagagattgctgtccgtgtgatacgtactgctcatgagatgggtataccttgtgttgctgtttactcaaccatcgataaggatgcacttcatgtgaaactggctgatgaatcagtttgcatcggtgaagcaccaagcagtcaatcgtatttagtggtcccaaatgttttatctgctgctattagtcgtggatgtacaatgctgcatcctggatacggtttcctatctgaaaatgcagttttcgttgaaatgtgcagagaacatggaatcaattttattgggccaaatcctgacagtattcgtgtcatgggtgacaaatcaactgccagggaaacaatgaagaatgctggtgttccgactgtaccaggaagcgatggattgttacaaatacaatttttgatctacatattaccaaaaatgaacttgcaacatctttaatcaacatcaaatttgatattgccaaattttaattttgttaataattgtcataatagagcactgaagaagctgtcaggcttgctgatgagattggctaccctgtgatgattaaggcgacagcaggtgggggaggccgtggaatgcgtcttgctaaagagcctgaggagtttgtgaagttactacaagctgctaagagtgaggctgcagctgcatttggcaatggtggcgtttatcttgaaaagtacatccagaatccaaggcacattgaattccaggttcttgcagacaaatttggcaatgttattcactttggagagcgtgattgcagtattcagagaaggaaccagaagttgctggaagaagcaccatcccctgcattaacctctgagttgcgaaaagccatgggtgatgcagcagttgcagccgcagcatctataggttacattggtgttggtacagtcgagttccttttagatgaaagagggtccttttacttcatggaaatgaacactaggatccaggtggagcatcctgtgacagaaatgatttcttctgttgacctgattgaagaacaaatccgtgttgctaaggcagagaaactacgttacaaacaggaagatattgtgcttagaggacactcaattgaatgccgtattaatgcagaagatgctttcaaaaatttcagacctgggccagggagaataacagcatacttgccagctggaggtccatttgtgagaatggatagccatgtttatccggattacgtggttccaccaagctatgattctctacttggaaagctgattgtatgggctccgacaagagagagggcaattgaacgcatgaaaagagctcttggtgacactattattaccggcgttccaacaacaatcgaataccataaacttatccttgaggtcgaggacttcaaaaatggaaaagttgatactgcttttattccgaagcatgaacatgagttggctgcgccccagaagatagtatcagctactcctgctaaagagcttgccaacactgcagcctgaagggaaaaag

SEQ ID NO: 8025 - DNA, 1779 bp, Musa acuminata
atgcggagtcgggaaggactcaacgaaccccctccgcatcacctcgatctcaacgaccttccctcgccgcatcacgctatctctctgctgctccactccgatcccatcgccttctcttccccaaatcctctcccgtccttcatcctctgttttcagggtttcgggttgatcatggattccatttccgtctgcaagccagcattcaaaactcctggtttgttattgagacctgctggagggataaaaggcttgcagtgcagctttattgtaggatattctccaaacttctgcaaagtatgtactcccaaaaaaatgactaaccgtatgacttggagatcaaaaaatcatggcggagctcttaatatgacttgccagaataggaagattcttgtggcaaatagaggagaaattgcagttagggtgatccgaactgcacatgaaatgggaataccttgtgtagctgtgcactctacaatagatcgggatgctcttcatgtgcagcttgcagatgaggcagtctgcattggtgaagcaccaagcagtcagtcgtacttgttcattccaaatgttttatctgctgctgttagtcgtaaatgtaccatgttgcatcctggttatggcttcctagctgagaatgctggttttgttgacatatgcaaagagcatggaataaattttattgggcccaatcctgacagcattcgagtaatgggtgataaatctacagctagggaaacaatgaagaaagcaggtgtccctaccgtacctggaagcgatggactcttgcagtcaacagaggaggcagtgaagcttgcccatgaaattggctttcctatcatgatcaaggcaactgctggtggtggagggcgtggaatgcgtctagctaaagaacctgaagagtttgtgaagttgctacagcaagctaagagtgaggcagcagctgcatttggaaatgatggggtttatttggagaagtgtatccagaatccaaggcacatcgagtttcaggttcttgcagacaaatttggaaatgttgtgcattttggagagcgtgattgcagcattcagagaagaaatcagaagcttctcgaggaagctccttcacctgctctgacaccagaactacggaaagctatgggtgatgcagctgtagcagctgcttcgtctataggttacattggtgttggaactgttgaatttctcttggatgaaggaggttctttctacttcatggagatgaacaccaggattcaggtagaacatcctgtcacggaaatgatttcttcaactgatttgatcgaggaacaaattcgagtggctcttggagagaggctgacgtacaaacaggaagatattgttcttaggggacattcaattgagtgtcgcattaatgcagaagatgctttcaaaggatttcgtcctgggcctgggaaaataacctcatacttgccatctggaggtccctttgtgagaatggatagtcatgtttacccaggctatgtggttcctccaagctatgactctctacttggaaagcttatcgtttgggcaccaaccagagagaaagcaatagaaagaatgaaaagagccctgaatgacactgttatcacaggggttcctaccacaattgagtaccataagctaattcttgacgtcgaggacttcagaaacggaaaggtggacactgcattcatacccaagcatgagaatgagttggctgcaccccataaaatgatcctgtctgcatccgaaaaggagctttctctattgagcaattaa

SEQ ID NO: 8026 - DNA, 2054 bp, Papaver somniferum
agaagaaaatggcgacgattttacaaggaattggaaccacaacttcattatcttccacttctttggattccaagagatttgagtcttcatcaggaaaggttttgggaggtatcagatctgattcaagagacatttcttttggatcatctaataataacaaagctcgtaaattagtagctactaatgcacttacaagtttaaagagctcacaatgtagcttcatggttggaagtggggcgattcctagtcagaaagtacaagccagtcatttaagccgaaagtcaagaagacgtgcaggagcattgagtgtgacatgtcgcggtgaaaagattcttgtggcaaatagaggtgaaattgctgttcgtgtcattcgaactgctcatgaaatgggcataccatgtgttgcagtttattcaacgatagacaaagatgcactgcatgtcaagcttgcagacgaggctgtttgcattggagaagcacctagtaaccaatcgtatttggtgatcccaaatgttctctctgcagctataagccgtggatgtaccatgctgcatcctggatatggattccttgctgagaatgctgtttttgtggaaatgtgcagagaacacggaatcaactttattggacctaatccggacagcattcgtgttatgggtgacaaatctactgccagagaaacaatgaagaaagctggtgttccaactgtgcctggaagtgatggattgttacagagcacagaggagggaatcagacttgctcatgaaattggttttcctgtgatgatcaaggcaactgctggtggtggtggacgtggtatgcgtctcgcaaaagaacccgaggagtttgtcaagttattacagcaagcaaaaagtgaagctggtgcagcatttggaaatgatggagtttatttggagaagtatgttcaaaatccaagacacatagagttccaggttcttgcggatatgttcggtaacgtcgttcacttcggggagcgtgattgcagcattcagcgaaggaatcaaaagctgttagaagaagccccatcaccggcgttgaccccagagcttagaaaagccatgggtgacgcagcagttgcagctgctgcttctataggttacattggtgttggaactgttgaattcttgttggacgaaagaggtgatttctacttcatggaaatgaacactagaatccaggtggagcatcccgtgacagaaatgatttcttctgttgatttgattgaggaacaaatccgtgtggccatgggagagaaactccgttacacacaggaagagattgtactcagaggacattcaatagaatgccgtattaatgctgaagatgcatttaaaggattcagaccaggacctggaaggataacagcatacttgccatctggagggccattcgtgagaatggatagccatgtctatcctgattatgtggttcccccgagctatgactccttactcggaaagcttattgtttgggctccaactagggagagggccattgaacgtatgaagagggctctcaatgacactattattacaggggttcctacaaccatcgaatatcacaaactaatattggagattgaggactttaaaaatggcaaagttgataccgcattcataccaaagcatgaagaagagttagccgctccacaacaaaaaatggtgctatcaatgcagccaaaagagccagtgaacacaacttcctagagaaatatttgccgatcccaacttgattgtcacctacatatttggcggccacagttttccccgtgagatttctccttggtttcatgaaagagttaaattatgtctgtcccctcatttgttcttggtgtgttaagtacctctcttctttatttttgttagtttgttgttattatattttaggagatgtaatttaagaacaataagcagtattggtatttactccagatatttcattgcaaacaatttgatttgaagtctagcaaaagatgaagaccctcctaattagtatttcgtctattctaagttaaaccgtcttgtacataaagt

SEQ ID NO: 8027 - DNA, 1823 bp, Brassica napus
gtgtaatgtcacgatgggagaaacggttagcttcccgagacaaaagactctgactttaaaagttagccggaacgtgaagagaaggagtggtggtggtgcgtttgctgctacttgtagcagtggggataagattcttgtggctaacagaggtgaaatcgctgtccgtgttatccgaactgctcacgaaatggggatcccttgtgttgctgtttactccactatagacaaggatgcacttcatgtgaagttggctgacgaagctgtttgtattggtgaagctccaagcaaccagtcgtatttgttgataccgaatgttctgtcagctgcgattagcagaggatgtacaatgctccatcctggatatggattccttgcggagaacgctctttttgtagagatgtgtagagaacacaggatcaatttcattggaccaaatcctgatagtatccgtgtcatgggtgacaaatcaactgccagggagacaatgaaaaatgctggtgtcccaactgttccagggagtgatggattattgcagagcacagaagaaggagtcaggctcgccaatgagattgggtaccctgtaatgatcaaggcaacagcaggtggtggtggacgtggaatgcgtctagctaatgaaccttcagagtttgtgaaactgttgcagcaagcaaagagtgaggccgctgctgcttttggaaatgatggagtttatctggagaagtacgttcaaaatccccggcatattgagttccagattcttgcagataaatttggcaatgttgttcactttggcgagcgtgactgcagcatccagagacgtaaccaaaagttgctggaagaagcgccttctcccgcactgacccctgagctgcgaaaagccatgggtgatgcagcagttgcagcagcagcgtccattggttacattggtgttggtaccgtggagtttcttttggacgagagaggctccttctatttcatggaaatgaacactagaatccaggtggagcacccggtgacggagatgatttactcagttgatttgattgaagagcagattcgtgttgcaatgggagagaaactgcgttatacacaggatgagattgtgcttagagggcactcgattgaatgtcgtatcaatgcagaagacccatttaaagggttcagacctggacctggaagaataacatcgtatctgccatctggaggtccttttgttaggatggatagccatgtgtatccggactatgttgttcctccaagctatgattctcttcttggaaagcttattgtatgggctccaacgagggaaagggcgatcgagcggatgaaacgtgcacttaatgacactattattacaggggttcccaccaccattgagtaccacaagcttatccttgaagttgaggatttcaaaaacggaaaagttgatacagctttcatccccaagcatgaagaggaattagcagagcctcatgaaattgtaccagtgaaagatttgacaaatgtagctgcttagagttcatcagctcttacatgaaaaacacatgggaatcaattatggcaatgcccgcaaagtcctcttacctggtgtcttcctcgtcttgtgatgttatgcaacagagcttcacatggtttcggctatagttgtgtttttttcgttgatggtatttacagtacttcattcctgacctacaagaccatttcatgtattttctagagtgtcacaattgagttctttttgttattagtttaaatgaaccaaactccaaacatgaaatcattatgaacacaatgtccttcttttggtattatgcaatacagag

SEQ ID NO: 8028 - DNA, 1996 bp, Elaeis guineensis
atcagacctaccagaggaattaggagctctcaatgcagctttatggtgggaaatgatccaaagttttgcaagataagctttccaaggaaagaactgcttgtgcgatccggaaatccaaaaaaaatggaggagcactgaatgcaacttgctatgatgagaagattcttgtggcaaatagaggggaaattgcagtccgtgtgattcgaactgcacatgagatggggattccctgtgttgctgtgcactctacaatagatcaggatgctcttcatgtgcggcttgcagatgaggcagtgtgcattggtgaagcaccaagcagtcaatcgtatttatttattccaaatgttttatcagctgctgttagccgggggtgcactatgttgcatcctggatatggtttccttgccgagaatgctggctttgttgatatatgcaaagagcatggaatcaactttattgggcccaatcctgacagcattcgagtcatgggtgataaatctacagccagagaaactatgaagaaagcaggcgtcccaactgtacctggaagtgatggactgttacagtccaccgaggaggctgtcaagcttgcacatgaaattggtttccctgtgatgatcaaggcgactgccggtggtggagggcgtggaatgcgtctggcttacgaacctgaacagtttgtaaagttgctccagcaagcgaaaagtgaggcagctgcagcatttggaaatgatggggtttacctggagaaatacatccagaatccaaggcacattgagttccaggttcttgcagacaagtatggaaatgttgttcattttggggagcgtgattgcagtattcagagaaggaatcagaagctcctagaagaagctccatcacctgcattgacccctgaactacgcaaagctatgggtgatgctgctgtagcagctgctgcatctataggctacattggtgttggaactgtggaatttctcttggatgaaagaggttccttctacttcatggaaatgaacaccaggatccaggtagagcacccagtcactgaaatgatttcttcaactgatttgattgaagaacaaattcgagttgctcttggagagagactgacatacaagcaggaagacattgttcttaggggacattcaattgagtgccgtattaatgcagaggatgccttcaaaggatttcgaccggggccaggaaagatcacatcatacttgccatctggaggtccatttgtgagaatggatagtcatgtttatccaggctatgtggttcctccaagctatgactccttgctaggaaagcttattgtgtgggctccaaccagggagaaagcaatagagcggatgaaaagagctcttgatgacaccataataacaggaattccgacaaccattgaataccataagctaattcttgatattgaggacttcagaaatggaaaagtagatactgccttcatacccaagcatgagaaggatttgacagcaccccataaactagtcttgtcaacatcggagaaagagcttgctggcgtgggtgcctaaactttatatcatgtgctgcagtcaccatggcatgtcaatctctacaacattcgttgcttatcaacggaagactttgacttgagaataaccatagcctgcaccaatctctctctcatctgattacctggaatatttctttcagtttgtctaggcactaggcagcgaagcttatgactggaaattgtattgagtgagaagcatagcttctgtttggaaacgacttaggatgtacgtatagctgggggtggatgtgcacatttaagtctgagcaattattgatatttataggctctgttctttcccagtttaatgggctgtgcttttttcaagttttactggctctggaattcagtcaggacccgagaactgaatgttatgtggttcagagttgaagctcaatttcgaatcccagcaggttgatgtttcaaaaaaaaaaaaaa

SEQ ID NO: 8029 - DNA, 2063 bp, Phalaenopsis aphrodite
ccaaccggcaccattctctcccattttgtttcctcattcacgaaaccccaccaaggatcaggctttctcctcaatcctcagattatttattcgaagatggactcaatggtcatgttcaagtctattagctcgatgcagaagacaatgtttcttaggacaacccaaggaaataggagttcacaatgcaactttatggttggaaatcttccaaattttcagaaaatatttttgcccaggcagagggctgcctgtaaaactcaaagatttaaaaattctggtggtgctcttcgtgcaacatgccatgatgagaaaatccttgtggcaaatagaggcgagatcgcagttcgcgtcattaggactgctcatgagatgggaataccatgtgtagctgtgcactctacaatagataaggacgctcttcatgtgaggctagcagatgaggcagtgtgtatcggggaagctccaagtagtcaatcgtacttgttcatcccaaatgttctctctgctgctgttagccatagatgcactatgctacatcctggctatggttttttggctgagaatgctggctttgttgatatatgtagagaacatggaatcaactttattggccctaatcctgacagtattcgagttatgggtgacaaatctactgcccgagaaacaatgaagaaagcaggtgtcccaactgttcctggaagtgaaggactgctgcagtccactgaagaagctatcaagcttgcccatgaaatcggttttcctgtcatgatcaaggcaactgctggtggtggagggaggggaatgcgactagcacttgagcctggtgaatttgtgaaattactacagcaagcgaagagtgaggcagcagctgcatttggaaatgatggtgtgtatctggaaaagtatattcagaatccaaggcacattgagtttcaggttcttgctgacaagtatggaaatgttgttcattttggagagcgtgattgcagtattcagagaagaaaccagaaactattagaagaagccccttctccggctttgacccaagaactacggaaagctatgggtgatgctgcggtggcagcggctgcatcaatcggctatattggtgttggaactgtggaatttcttttggacgagagaggttccttctactttatggaaatgaacacgaggatccaggtcgagcaccctgttacagaaatgatttcctcaaccgatttgattgaggaacaaattcgtgtagctctcggagagaggctgtcttttgaacaggaggatattattctcagaggacattcaatcgagtgtcgcatcaatgcagaggatccctttaaaggatttcgtccagggccagggagaatcacagcctaccttccatctggtggtccatttgtgagaatggatagtcacatttatccagattatgtcgtgcctcctagctatgactccctacttggaaagcttattgtttgggccccaaccagggataaagccatcgaacgaatgaaacgagctctaaatgacacggtcatcactggtgtcccgactacaattgagtaccacaagctcattcttgatgttgaggactttaaaaatgggaaggtggatacagcattcatacccaagcatgagaacgaattgaccgagcctcagaagatggtgctagctaacccaaggaaggaggttgttggtgtgaactaatcggatctcacgaattgcacccccacgtattttttaatcttattcaaaccttactattgattattatgataagaaacattttttgacatgaggataacctttggccagtttactttgtttcctttttcttgtattttaatttacatagtagttagtataagataacttaactatgtatattatgataagaaacaaaagtaaatagcgtaagttaagtctccatgtcacgttacttttgtttctttttctttgttatttatttatttaatactaactcctactacgtctcttattgttattagttacgatagataagtcgggtgggcggaggacacgacacggaggttagggagccgccc

SEQ ID NO: 8030 - DNA, 1466 bp, Chenopodium quinoa
agaaagtgtggtggagctcttgctgcaacttgtcgcagtgaaaaaattttggtagctaatagaggtgagattgcagtccgtgtgatccgaactgctcacgagatgggcattccatgtgttgcagtctactcaaccatagacaaggatgcactccatgtgaaaatcgctgatgaatctgtttgcattggtgaagctccaagtaatcaatcatatttggtgatccccaatgttctatctgctgctgtaagccgtggatgcagtatgttgcatcctgggtatggatttctgctgagaatgctgtttttgttgagatgtgtagagaacatggaataaattttattggaccaaatccagatagcatccgtgtcatgggtgacaagtcaactgctagagaaaccatgaagaaggctggtgttccaactgttccaggaagtgatggattgttacagagcacagatgaagcgataaaacttgctcatgaaattggtttccctgttatgattaaggcaactgcaggaggtggaggccgtgggatgcgtcttgctaaggagccggatgaattcgtgaagttgctgcagcaagctaagagtgaggctgcagctgcttttggaaatgatggagtatatttggagaagtatgtacaaaatccaaggcatatagaatttcaggttcttgcagataaatatggaaatgttattcactttggagagcgtgattgcagtattcagaggagaaaccagaagctacttgaagaagcaccttctcctgcattgactctggagttaaggaaagccatgggtgatgctgctgttgctgcagcagcatctataggttacattggtgtaggaacagtggaattccttttggacgaaagaggttctttctacttcatggaaatgaacacccgaatccaggttgagcatccagtgacagaaatgatatcgtcagttgacttgattgaagaacaaattcgagtggctatgggagagaaactccgctacaaacaggaagatatagtgctaagtggacattcaattgaatgccgaatcaacgcagaagatgcattcaaaggattccgtcctggacctggaaaaataaccagttacttgcctgctggaggaccgtttgtgaggatggatagccatgtttatcctggttatgttgttccaccaagttatgactctctacttggcaagctgattgtctgggctccaactcgagagaaagcaattgcacgtatgaagagggctctcgatgatacaattattacaggggtccccacaactattgaataccataaactaattcttgatattgaggattttaaaaatggaaatgtagataccgctttcattcccaagcatgaacaggaattggcggagccccaaaagattgttcctgcaactcctgccaaagaactgactggtgcaactgcctaaatactgtttcggttaggcactgatcta

SEQ ID NO: 8031 - DNA, 1989 bp, Panax ginseng
gggggtgctctcagtgctacttgtcgtgacgataaaattctggtggcaaacagaggagagattgctgtccgcgtgatacgaactgctcatgagatgggtataccttgtgttgctgtttactcaaccatcgataaggatgcacttcatgtgaaattagccgatgaatcagtttgcattggtgaagcaccaagcagtcaatcgtatttagtggtcccaaatgtcctatctgctgctattagccgtgggtgtacaatgctgcatcctggatatggtttcctttccgagaatgcattgtttgttgaaatgtgcagagagcatggaatcaactttattgggccaaatcctgacagtattcgtgtcatgggtgacaaatcaactgccagggacacaatgaagaatgctggtgttccaactgtaccaggaagtgatggattggtacagagcactgaggaagctattagagttgctgatgagattggctaccctgtgatgattaaggcgacagctggtggtggaggccgtggaatgcgtcttgctaaagagcctgaggagtttgtgaagttattacaggcagctaagagtgaggctgcagctgcatttggaaatgatggggtttatctagaaaagtacatccagaatccaaggcacattgaattccaggttcttgcagacaagtttggtaatgttgttcactttggagagcgtgattgcagtattcagagaaggaatcagaagttgctggaagaagcaccatcccctgccttaacctccgagctgcggaaagccatgggtgatgcagcagttgcagccgcagcatctataggttacattggggttggtactgtcgagttccttttggatgaaagagggtccttttacttcatggaaatgaacactaggatccaggtggagcatcctgtgacagaaatgatttcttctgttgacctgattgaagaacaaatccgtgttgctaggggagagaaactacgttacaaacaggaagatattgtgcttagaggacactcaattgaatgccgtattaacgcagaagatgctttcaaaaatttcagacctgggccagggagaataacagcatacttgccatctggaggtccatttgtgagaatggatagccatgtttatccggattacgttgttccaccgagctatgattccctacttggaaagcttattgtatgggctccgacaagagagagggcaattgcacgcatgaaaagggctcttgatgacaccatcattactggtgttccaacaacaatcgaataccataaacttatccttgaggttgaggatttcaaaaatggaaaggtcgacactgcttttattcctaagcatgaacatgagttggaagcgccccagaagattgtatcagcaacacctgctaaagagcttgcgaacactgcagcctagagggaaaacaagacatcttgggtaggtggagctgatattttttaacagggtggtggtggtttggtctaaatgtattagtttggtctcggctgattttgttcttcatagttgttagaataaaatcccttctttttgctgtcaaatgatgcttatcgcatagatttggatctgaattggatattgtttttgtggttggtcttagaagagcttaactgtactattgaagcatgactaaaacgaatgagaaattcttcatggaatattttaacgggaaatggttagtatgaagtttattttgggataagttgatcagttgactaatagaatactaacacgcaggcgaggttgtatgcgtatcagtattttattggtcaattaactaatttatcaaaaaaataactttcatattaaccggattcttttaaactaattcaaacaaaagtttctgttcacttgtgaccacgatttcttctattcgagacaaaagagaagccaaatgtaatttgcttaaagcaatggacagttttctgtccacggtgggtccaacgtctataaaag

SEQ ID NO: 8032 - DNA, 1718 bp, Musa acuminata
cacctttgcctcttccccaactggcgttataactctcgcctccctctctccgatcgcatctctttctcttcctcgaatcctcacccggccgtcattctcttcttcagggtttcctgacgatcatggacctcactgtcgtcttcaagcctgcgttgtcgcctcccgggttgtttcccagacatgctggaggaatgaaaagctcacaatgtagctttagtgtgggatattctccagtcttccataaagtgtgttcttccaggcaaatgactgctcatacaaacaggaggttaaaatataatggaggggctcttaatgcaacttgccagggtgggaagattcttgtggcaaatagaggagaaattgcagtcagggtgatccgaactgcacatgaaatgggaataccatgtgttgctgtgcactctacaatagatcgggatgctcttcacgtgcggctcgcagatgaggcagtatgcattggtgaagcaccaagcagtcaatcgtacttgttcattccaaatgttttatctgctgctgtcagtcatcgatgtaccatgttacatcctggttatggattcctagctgagaatgctggttttgtcgacatatgcagagagcataggatcaactttattggcccaaatcctgacagcatccgagtaatgggcgataaatctacagctagggaaacaatgaagaaagcaggtgttcctaccgtacctggaagcgatggactattgcagtcaacagaggaggctgtgaagcttgctcatgaaattggctttcctgtcatgatcaaggcaactgctggtggtgggggacggggaatgcgtctagcaaaagaacctgaagagtttgtcaagttgctactgcaagctaagagtgaggcagcagcggcatttggaaatgatggggtttatttggaaaagtatatccagaatccaaggcatattgagtttcaggttcttgcagacaaatatggtaatgttgtccattttggagagcgtgattgcagcattcagaggagaaatcaaaagcttctcgaggaagctccatcacctgctttgtccccagaactacggaaagctatgggtgatgctgctgtagcagctgctgcatctataggttacattggcgttggaactgttgaatttctattggatgaaagaggttctttctacttcatggagatgaacaccaggattcaggtagaacatcctgtcacagaaatgatttcttcaactgacttgattgaggaacaaattcgagtggctctcggagagaggctgacctacaaacaggaagatattgttcttagagggcattcaatcgagtgccgcattaatgcagaagatgccttcaaaggttttcgtcctgggcctgggagaatcacttcatacttgccatctggaggtccatttgtgagaatggatagtcacatttacccgggctatgtggttcctccaagctatgattccctacttggaaagcttattgtttgggcaccaacaagggagaaggcaatagaaagaatgaaaagggcgctgaatgacactattatcacaggagttcctaccactattgagtaccataagttaattctgaatgttgaggacttcagaaatggaaaggtggacacggcttttatacctaagcatgagaacgagttggctgcaccccagaaaatgatcctgtctaccgcagccgcaatgagcaactaa

SEQ ID NO: 8033 - DNA, 2214 bp, Centaurea maculosa
atcggcgaaacgtgagggagcacttgctgttacttgtcgtgctgaaaaaattctggtggcaaacagaggtgaaattgcggtgcgagtgattcgaactgctcatgaactcgggattccttgtgttgcggtgtactccaccatagataaggatgcacttcatgtgaaactggctgatgaatcagtttgcataggggaagctcctagtagtcaatcgtacttgctgatacccaatgtcctgtctgctgccatcagtcgtggatgtacaatgttgcatcccggttatggtttccttgctgagaatgctgtttttgttgagatgtgcagagagcatggaatcaacttcatcgggccaaatcctgacagtattcgtgttatgggggacaaagcaactgctagagataccatgaagactgctggtgttccaactgtaccaggaagtgatggactgttacagagtaccgaagaaggcatcaggctcgccgatgagattggctttcctgtgatgatcaaggctacagcaggtggtggaggccgtggaatgcgtcttgcaaaagagcgtgacgagtttgtgaagttgttgcagcaagctaagagtgaggctgctgctgcatttggaaatgatggtgttatttggagaagtacattcaaaacccaaggcacattgaattccaggttcttgcagataaattcggaaatgttgttcactttggagagcgtgactgcagtattcagagaaggaaccaaaagttgcttgaagaagcaccctcgcctgcattaaccccagagctacggaaagccatgggtgatgcagccgttgctgcagcagcatcaatcggctacattggtgttggtactgtagagtttcttttggacgaaagaggttcattctacttcatggaaatgaacactagaatccaggtagagcatcccgtgactgaaatgatatcttcagttgacttgatagaggagcagatccgggtggctatgggtgagaagctccgatacacacaggatgagatcgtgcttagaggacactcaattgaatgccgtattaatgcagaagatgctttcaaaaacttcagacctggaccagggagaataacatcttacttgccatctggaggtccgttcgtgagaatggatagccatgtatataccgattacgttgttccaccaagttatgattctcttcttggaaagcttatcgtatgggccccaacaagagaaaaggcaatcgaacgcatgaaaagggctcttaacgataccattatcacaggagttccaactacaatcgagtaccacaagctaattctcgacattgaagacttcaaaaatggaaaagttgatactgctttcattccaaagcacgaggaggaattagccgagccccagaagttgattgcttcaaataacgctgctgcggctgctgctgctaaagaaatcgccaagtctgtagcttaaataaagagtggttggtttgttcaaattttctgtatgcaaaaaaacgttactttttgtgtattagatgagttctaagctgtctgtttgatttttttagattgaattgacaattcatcgggattatattccaatcacataatgttcacatcaaaaaagaaaaaaggagttaatgagatagatgatatcactattacaatggtgacaaaagatctcaaaagatacttgatcatagtatcaaactggtggactattattccacatattcccttaccacactccgcgtgaagtagtctctctcctccattttctctctctcttttctcttatataactcattaataatctcaaaaccatcatatatatcctcatttctctctcatatatattctctcaacatcattcatcaaatcaaactgtattagtttaattaatactttcttcacatatgagtcaagcaaccatggctgatgatgatgattctatggcggctatggacctcgaaatgcagcttctgccgtcatccgccgccgcccataaccaccacgacggtggtggtggtgaagtagcagcagcttccacaacaacacaattaatgcacaaggtcatacgagtcatccaatccaccatcatcttcactgatcatcttctttctagggtttcttcatctaaaacccttgataacaccagcaccactgatgatcagcaaactgggaaggagatgcaacgttgggtatgcaacttataaaccttaga

SEQ ID NO: 8034 - DNA, 2127 bp, Trifolium pratense
  misc_feature (2082)..(2082): n is a, c, g, or t
gtttgttagatttagatttcgacggagcctccaatataggctttgccattgtcactcactccctcgtttccatcgacacacaccaatattccaactaactaatacactctcttcaaaaacaaaactgcattcattcattgcattctctctcaattcacatcaatggaggcaacaatgtcagcagcttgcaaatctctcgcctcaccatccaccgttcccgtcacaggtttatttacggccagaggaggattgaaatcatcgaattcgcattctcggtgtagttttttgacgggaaacaataaggtgaagtttccgaggcaaattactcaacattcatctaaacaacaacaccgtcgtcgagcacttcattcctatgctcttcctgtaacttgtcgtgctgaaaagattctcattgccaatagaggcgaaattgctgttcgtgttattcgtactgctcatgaattagggattccttgtgttgctgtttattcaaccattgataaagatgctcttcatgttaaattggctgatgaagctgtttgcatcggcgaagctcccagtagccaatcgtatttagtgattccgaatattttggctgctgcttctggtcgcaattgcacaatgttgcatcctggatatggttttctagctgagaatgctgtctttgttgaaatgtgtagagaacatggaatcaattttattggcccaaatcctgacagtattcgggttatgggtgacaaagcaactgctagagaaacaatgaagaaagcaaatgttcctactgttcccggaagtgagggactattgcagagcactgaagaagctatcaggctggcacatgagattggtttccctgtgatgatcaaggcaaccgcaggtggtggaggacgtggcatgcgtcttgctaaagaacctgaggagtttgtgaagttattacagcaagctaagagtgaggcagctgctgcatttggaaatgatggggtttatttggagaagtacattcaaaacccaaggcacattgaattccaggttcttgcagataaatatggtaatgttgttcacttcggagaacgtgattgcagtatccagaggcgtaatcagaaactacttgaagaagcaccgtctcctgcattgaccccagagttacggaaggcaatgggagatgcagcagttcaggctgccgcatctatcggttacataggtgttggaacggttgagttccttttggatgaaaggggttctttttacttcatggagatgaacactcgtatccaggttgaacatcccgtgacagaaatgatttcctccgttgatttgatagaagagcaaattcgtgtagctttgggagaaaagctccgatacaaacaggaggatattgtgctcagaggacattctattgaatgccgtatcaatgcagaagatgcttttaagggatttagaccagggccaggtagaattacagcatacttgccatctggaggtccatttgtcagaatggatagccatatttatcctgattacgttgttcctccaagctatgattctcttcttggaaagctgattgtatgggctccaactagagaaaaagcaattgagcgcatgaaaagggcacttgatgacactattatcacaggagttcctacaacaattgattatcataaacttatccttgacatagaggatttcaaaactggcaaggttgatactgcttttattccaaagcacgaggaagaattggctgtgcccccaccgccgaagatggtattagttaacaaggtgacagaaccagaaccagaacgagaaccagttgccttgcctgcctgatggatatgactacgtggtgccgcccctataaagaatttgcattgttgtaatcaatatgtagtctgtgcgtgcttgtgaaagttctaatgaaattttgattagtctcccacaataaactgttcaataattatattttaaaatgaattaattaatttcatgtttaatttatcgtcccaaatgttagtgctaggttatggggtttcacaatgttttatttgaggaaccgtctcattttgtgtttgtaattcttgtattaanaacacaattttagataagagtaataaactaagcccagcaagttga

SEQ ID NO: 8035 - DNA, 2272 bp, Trigonella foenum-graecum
gaatttagttagatttgataaatgaagtgagtattgaatgagacgatgaaaacaagatgagtagtattttggattgaatgaaggggtgagattaaaggatttagggttgctagctaagttgatgttacaagtacagaaaacagtattgttgttagatttagatttaggcggaggtttcaagtaccacatcacaccaccgtcctcgtttccatcgacagactcaccaatatactaactaactttacactcttcaaaaaccaaccccattttcattcttccttcttctctcaacaatacaatggaggcaacaatgtcagcatcgtcgtgcaaatctctcacctctccatccatcggtttatttgcggcggcaaaaggaggaggaggaggaggattgaagctgaattcgcattctcagtgtacgtttttaacgggaacaaacaaggtcaagtttccgaggcaaactactcaaccttgtaaacaacgccaaacgcgtcattgcggtgctcttcgtgcaacttgtcgtgctgagaagattttggttgccaaccgaggcgaaattgctgttcgtgttattcgtactgctcatgaattggggattccctgtgttgctgtttattccaccattgataaagatgctcttcatgttaaattggctgatgaagctgtttgtattggtgaagctcctagtagccaatcgtatttactgattccaaatgttctggctgctgctacaagccgaaaatgcacaatgttgcatcctggatatggttttcttgctgagaatgctgtgtttgttgacatgtgcaaagaacatcgaatcaattttattgggcctaatcctgacagtattcggattatgggtgacaaagcaactgccagagacacaatgaagaaagcaaatgttcctactgttccaggaagtgaggggcttttgcagaccactgaagaagctatcaggttggcacacgagattggattccctgtgatgatcaaggcaaccgcaggtggtggaggacgtggcatgcgtcttgctaaagaacctgaagagtttgtgaagttattacagcaagctaagagtgaggcagctgctgcatttggaaatgatggagtttatttggagaagtacattcaaaatccaaggcacattgaattccaggttcttgcagataaatatggcaatgttgttcactttggagaacgtgattgcagtatccagaggcgtaatcagaaactgcttgaagaagcaccgtctcctgcattgaccccagagttacggaaggcaatgggagatgcagcagttcaggctgctgcatctatcggttacataggtgttggaacggttgagtttcttttggatgaaaggggttctttttacttcatggagatgaacactcgtattcaggttgaacatcctgtgacagaaatgatttcgtctgttgatttgatagaagagcaaattcgtgtagctatgggagaaaagcttcgatacaaacaggaggatattgtgctcagaggtcattctattgaatgccgtatcaatgcagaagatgcttttaagggatttagaccagggccaggtagaattacagcatacttgccttctgggggtccttttgtcagaatggatagccatatttatcctgattatgttgttcctccaagctatgattctcttcttgggaagctgattgtatgggctccgactagagaaaaagcaattgaacgcatgaaaagagcgctcgatgacactattatcacaggagttcctacaacaattgattatcataaacttatccttgacatagaggatttcaaaaatggcaaggttgatactgcttttattccaaagcacgaggaagagttggctgtgcccccacaacagaagatggtattagttaacaaggtggtgacagaaccagaacctgaacctgaatctgaaccagaaccagctgccacgactgcctgatggatatgactatgtgatgccacccctataaaaaaaattgcattgttgtaatcaatgtgtagtccgtgcgtgcttgtgaaagttctaatgaaattttgattattagtctcccataattatctgttcaataattattttgcaaaaggaattaattaatgtcatgtttaacttataaacccaaatattagtgctaggttatgggatttcacaatgattttttagaggatctttgtttcatttcatgtttgtaattcttgtattaagaacacaattttagatagagtaataaactaaaccttatcctag

SEQ ID NO: 8036 - DNA, 1937 bp, Zostera marina
ttctagatccgatcgattcgttctgggcttcgcccgtcgttctgcaaagacgattgttctttcgagttcgcgaggttgaaggttgaagatggacgccatgattgcctgcaaagctgccccgacttctgcttctcctggtctatttgtggcatctacaagagggataaggagctcgcaatgtagcttcatgattggtggaagagcgggaagctttccaaatgttctccttacaagcaaatgcttaacgcgtgtgagtcggaaatctaagagatatggaggtgctctaggtgcaacatgcagagatgaaaagattcttgtggcaaatagaggtgaaattgctgtacgtgttataagaactgctcatgaaatggggataccatgtgttgcagtgcattctacaatagacagggatgcacttcatgtacagcttgcagatgaggcagtttgcatcggtgaagctcaaagcagccaatcgtatctatcaattccaaatatcttgtctgcagctatcagtcatgaatgcaccatgctgcatccaggttatggcttcctatctgaaaatgcttcttttgtggacatgtgtagagaacaggggatcaactttattggccctgatgctgatagtatacgtgctatgggtgacaagtcaacagccagagaaacaatgaagaaagcaggagttcctacagttcctggaagtgatgggttattgcaatctacggaagaagctgtcaaggttgccgatgagattggctatcccgtaatgatcaaggctactgctggtggtggaggtcgtggaatgcgtttggcaaaagaacccgaagaatttattagattgttacagcaagctaagagtgaagcagctgctgcttttggaaacgatggtgtttacttggagaaattcattcagaatcccaggcatattgaattccaggttcttgcagataagtatggtaatgttgtgcactttggtgaaagagattgcagtattcagaggaggaatcaaaagctattagaggaagctccatctcctgtattgactactgaactaagagaagctatgggtaatgcagccattgcagctgctgcatcaataggatatattggtgttgggactatagaatttctactagatgaaagaggttctttctattttatggaaatgaataccagaattcaggtggaacaccctgtgactgaaatgatatcgtctgctgatttaattgaggaacaaattaatgtggcacttggcaagcgaatcaactataaacaggaagatattgtgctcagaggacattcaattgaatgtcgtataaatgctgaagatgccttcaaaggatttcgtccagggcctgggagaataacatcttacttgcctgctggtggtccttttgttagaatggacagtcatgtttatacagattatgttgttccaccaaattatgattccctactgggaaagcttattgtttgggccccaacaagagaaaaagcaatcgagcgaatgaagagagctctaaatgacactgttattacaggaattcctacaaccatcgaataccataaacttattctcgaaattgaggacttccaaaatggcatagtagatacagcattcattcaaaagcatgaagaagaattagccgagcctcacaattttgttttgacatcctatttaaattaagagttttcaacacaatagacgacgattgacgagtccaaggcagctgagaagatagatcagaattcagatggaaaataattttttctaatttatggtggtatctgaatcagatttactagtatttatgagattagtatgaacaataatttttagttttgaaataaaagacagaatgatttattactatttttgtggtacttgaaatgtaataatttctcttttaatttaagcaattgaactgtgatcgttaacg

SEQ ID NO: 8037 - DNA, 911 bp, Solanum phureja
aacttgttaactattgttgttctgaaaattaatagagtatgatgatttttactaccccttatttctctttccctcccatttccatttccatttccaataaatccccaaaccctaaacttattcctgctggcattaattatgttattcgttgctcaacttcaactcctggattaccagttacaacagaaagacttaggaatgatactcctttgaccggtggagcatatgattttgaaaaagccactacttctctaactaaaaaagtgctagattcacccaagaaagttactattgtacgccatggtctcagctcttggaatgaagaaagtagagttcagggaagctcaaacttatctatactttctgaaaaaggaacaatgcaagcagaaagatgcaagatggccttgtctgatatgcactttgaccaatgtttctctagtccgatatcacgtgccaagacgacagctgaaatcatatggaaaggaaaggaagagcctctggtttttcttgattccctgaaggaggcccatctattttttcttgaaggcatgaaaaatgaggatgctaagcgcatatatccaaaggagtatacaacttggagagaagatccatctaatttttgtgtagatggtgtatatcctcttcaaaaactgtggggaagagcacatgaagcatgggaagaaattttattgacaccgggagagaactttttggttgtgacacacaaatctattttacgagcattgatctgcacagctcttggactaggaccagaacggtttcgttcagtggatataaataatggaggattatgtgtattcaaattcaacaaagaaggagaagccatgcttcaatcgctgaacatgacagcacatatgtatactgatcacgtctaccactattaaaatcgg

SEQ ID NO: 8038 - DNA, 1206 bp, Nicotiana tabacum
  misc_feature (184)..(184): n is a, c, g, or t
  misc_feature (810)..(810): n is a, c, g, or t
gaaattcatgggcaaacaaagctggaaacaatcttgaaatagcaaaaacagaactcctaagtactacactgaattaacactttaagaagatgagttctggaactattcttattaccccttatttctctttcccttccatttccaattctaataaatttccacgccctaaacttcattctagctngaacataaactatagtattcgctgctcaacttcaagtcccgagttaccagttactacaacagagagatttaggtatgatactcctttgactggtggagcatttgattttgaaaaagccacaacttctctaactagaaaagcattggcttgtccaaagaaagttactcttgtaaggcatggtctcagctcttggaatgaagaaggtagagttcagggaagctcaaacttatctatactttctgaaaaaggagcaatgcaagcagaaaggtgcaagatggccttgtctgatatgcactttgaccaatgtttctctagtccaatatcacgcgccaagacgaccgctgaaatcatatggcaagaaaaagaagagcctctggtttttcttgattccctgaaggaggcccatctgtattttcttgaaggcatgaaaaatgaggatgccaagcgcatatatccaaaggagtatacaacttggagagaagatccgtctaatttttgcgtagacggtgtataccctcttcagaaactgtggggaagagcatatgaagcatgggaagaaattttattgacaccgggagagaactttttggttgtgacgcacaaatctattttacgagcattgatcngcacagctcttggactagggccagaaaggtttcgttccgtggatataaataatggaggattatgtgtattcaaattcaacaaacaaggagaagccatgcttcattccctgaacatgacagcacatatgtacacagaccacatctaccactactaaatcaacggccataagggctcaaaagaaggacaattaagattacaatcaccagtgcaacaacagagaaccgcatcaaaccagaacagttgtctgtgactctgtgtagtatgtgagttacgaatcattgaactcttaaaataaaatttttgttagaatagcattataggttaagaacagcaacaatttgtaacatgttcgaattggaaatgcagagttcattatttcttcagcggccgcatga

SEQ ID NO: 8039 - DNA, 1011 bp, Nicotiana benthamiana
caagtttcattttcagctcttctcttttgtagaagcccctcgaaattcatggacaaacaaaactggaaacaatcttgaaatagtaaagacagaactcctaattactacactgaacactttaagaagatgagttctggaactattcttattaccccttatttctctttcccttccatttccaattctaataaatttccacgccctaaacttcattccagctccagcataaactatactattcgctgctcaacttcaagtcccgagttaccagttactacaacagagagatttaggtatgatactcctttgactggtggagcatttgattttgacaaagccacaacttctctaactagaaaagcattggcttgtccaaagaaagttacaattgtaaggcatggtctcagctcttggaatgaagaaggtagagttcagggaagctcaaacttatctatactttctgaaaaaggagcaatgcaagcagaaaggtgcaagatggccttgtctgatttgcattttgaccaatgtttctctagtccaatatcacgcgccaagacgactgctgaaatcatatggcaaggaaaagaagagcctctagtttttcttgattccctgaaggaggcccatctatattttcttgaaggcttgagaaatgaggatgctaagcgcatatatccaaaggagtatactacttggagagaagatccgtctaatttttgtgtagacggtgtataccctcttcagaaactgtggggaagagcatatgaagcatgggaagaaattttattgacaccaggagagaactttttggttgtgacgcacaaatctattttacgagcattgatctgcacacctcttggactaggaccagaaaggtttcgttcagtagatataaataatggaggattatgtgtaatcaaattcaacaaacaaggagaagccatgcttcattccctgaacatgacagcacatatgtacactgaccatatctaccactactaaaatatcaac

SEQ ID NO: 8040 - DNA, 1603 bp, Solanum phureja
cgaaaatagtgtgaagaatttgtctatatatacagaaaagcagcagttacttatactgcacttgtgaccttacaatagtagtgctctcaaagaggttgagctttgttgcaagtaaacaatggaggcagtacgtgaacaatacaacagagccaaaccctttcttgcagtcatttttctccaatttgggctagcaggcatggatatcctcaccaaagtggccttgaacgaaggaatgagtaattatgtatttgttgtgtaccgccatgcagttgccactttggttattgctccttttgcaataattctagacaagaaagtaagaccaaagatgacgccctcaatatttgctaagttggtacttcttagcttactggagcctgtcatcgaccagaatctctactctattggcctgaaatacacaacagcaacttttgcagctgcaatgtgcaacattcttcctgccattacttttataatggcctggatattcaggcttgagaaggtgaagcttacaagcatccgcagccaagccaaactagttgggactgttgccacagtggcaggagccatgatcatgaccctggtacgaggcccaatagttgaactattttggacagcaggaaatgccggtcatgactctcaaagtggtgggttaaatctaagccatgctatcaaaggttccatcatgataacaattgggtgcttcagttgggctgcattcatgattttgcaggcaatcacactgcggacttatcctgctgagctctcgctcactgcttggatatgcttgttgggaacaactgagggagccatagttgcaatggtaatggagagaggaaaacctgcagtgtgggccataaactgggactctaaatttcttgcagctgtatacagcggaatattctgttcaggactcgcgtattatatccaaggagtcataatgaaagacaggggccctgttttcgtcacagctttcaatccattaagcatggttattgtagctatattgagtacaatcattctacgtgaacaactgaacctgggaagggtactgggtgctgttgtgattgttgttggcctttacattgtcctatggggtaaaagtaaggatcacaaatctccatcaatcgatgaacaagcaataccaacacatgaaaccaaaattgacaaggaaactttaagtcagccagttgtccacatcaattcatcgagaggaacaactgctcccgaagatgaaaccatataatgattttctatttgaggttttatcttccaaattccaaaaggaggtctggctatagagcagcctcttcatctaagaaatgagctcctcttcagctgcatcttgaattagtaattattagttaaagatggtttacagcgtgtggccaaatttaagccagttaaaccaccattttaggaaacttctttctgaactatagaatgactaaactatgttaagcctataggccttttcttttggtttttaatcgatattaaaccatgtataataaattatagtaacaacaataatcatgcccagacatgtagataagttggttcttgaacttcagatctacaatactgaagttctatctggaaa

SEQ ID NO: 8041 - DNA, 1543 bp, Solanum tuberosum
cgaaaatagtgtgaagaatttgtctatatatacagaaaagcagcagttacttatactgcacttgtgaccttacaatagtagtgctctcaaagaggttgagctttgttgcaagtaaacaatggaggcagtacgtgaacaatacaacagagccaaaccctttcttgcagtcatttttctccaatttgggctagcaggcatggatatcctcaccaaagtggccttgaacgaaggaatgagtaactatgtatttgttgtgtaccgccatgcagttgccactttggttattgctccttttgcaataattctagacaagaaagtaagaccaaagatgacgccctcaatatttgctaagttggtacttcttagcttactggagcctgtcatcgaccagaatctctactctattggcctgaaatacacaacagcaacttttgcagctgcaatgtgcaacattcttcctgccattacttttataatggcctggatattcaggcttgagaaggtgaagcttacaagcatccgcagccaagccaaactagttgggactgttgccacagtggcaggagccatgatcatgaccctggtacgaggcccaatagttgaactattttggacagcaggaaaggccggtcatgactctcaaagtggtgggttaaatctaagccatgctatcaaaggttccatcatgataacaattgggtgcttcagttgggctgcattcatgattttgcaggcaatcacactgcggacttatcccgctgagctctcgctcactgcttggatatgcttgttgggaacaactgagggagccatagtcgcaatggtaatggagagaggaaaacctgcagtgtgggccataaactgggactcaaagtttcttgcagctgtatatagtggaatattctgttcaggactcgcgtattatatccaaggagtcataatgaaagacaggggccctgttttcgtcacagctttcaatcctttaagcatggttattgtagctatattgagtacaatcattttacgtgaacaactgaacctgggaagggtactaggtgctgttgtgattgttgttggcctttacattgtcctatggggtaaaagtaaggatcacaaatctccatcaatcgatgaacaagcaataccaacacatgaaatgacacatgaaaccaaaattgacaaggaaactttaagtcagacagttgtccacatcaattcatcgagaggaacaactgctaccgaagatgaaaccatataatgattttctatttgaggctttatcttccaaattccaaaaggaggtctggctatagagcagcctcttcatctaagaaatgagctcctcttcagctgcatcttgaattagtaattattagttaaagatggtttacagcgtgtggccaaatttaagccagttaaaccaccatttttggaaacttctttctgaactatagaatgactaaactatgttaagcctataggccttttcttttggtttttaatcgatattaaaccatgtataataaattatagtaacaaccat

SEQ ID NO: 8042 - DNA, 1358 bp, Solanum melongena
cacttgtgactttataatagtagtgctctgaaagagattgagctttgttacaagtaaacaatggaggcagtatgtgaactatacaacaaagcaaaaccctttcttgctgtcatttttcttcaatttgggctagcaggcatggatatcctcaccaaagtggctttgaatgaaggaatgagtaactatgtatttgttgtgtaccgccatgcagttgccactctggttattgctccttttgcaatatttctagacaagaaagtacgaccaaagatgacgctctcaatatttgctaagttggtacttcttagcatactagaacccgtcatcgaccagaatctctactctattggcctgaagtacacaacagcgacttttgcagctgcaatgtgcaacattcttcctgccattacttttatcatggcctggatattcaggcttgagaaggtgaagcttacaagcatccgcagccaggccaaaatagttgggactgttgccacagtggcaggagccatgatcatgacactagtacgaggcccaatagttgaattattttggacaactggaaatgccggtcatgaatctcaaagtggtgggttaaatctaagccatgctatcaaaggttccatcatgataacaattgggtgcttcagttgggctgcattcatgattttgcaggcaatcacactgcggacttatcccgctgaactctcgctcactgcttggatatgcttcttgggaacagctgagggagctatagtagcaatggtaatggagagaggaaaaactgcagtgtgggccataaactgggattccaagtttcttgcagctgtatacagtggaatattctgttcaggactcgcatattacatccaaggagtaataatgaaagacaggggccctgttttcgtcacagctttcaatccattaagcatggttattgtagctatattgagtacactcattctacgtgaacaactgaatctgggaagggtactaggtgctattgtgattgttgtcggcctttacattgtcctgtggggtaaaagcaaggatcacaaaactccatcaattgatgaacaagcaataccaacacaagaaatgacacatgaaaccaaaattgacagggaaaatttaagtcagacagttgtctacatcaatccatcgagcggaaaaactgctaaagaagatgaaagcatgtaatgattttctatttgaggctttatcttccaaattccaaaaggaggtctgactataaagcagcctcttcatctaagaaatgagctcctttttagctgcatcttgatttagtaattattagttaaagatggtttatatataaagatgagtttatttctggt

SEQ ID NO: 8043 - DNA, 1560 bp, Nicotiana benthamiana
tgcacacttgtgaccttacaatagaagtgctctcaaagaggttgagtttgtgcaaataaacaatgaaggcagtaagtgaactattcattagatcaaaaccctttattgctgtcatatttcttcactttgcaaggcatggatatcctcaccaaaatggcattgaatgaagggatgagcaactatgtatttgttgtgtaccgccatgcagtagccactctcgctatttctccttttgcaataattctagacaagaaaataagaccaaagatgactctctcaatattcactaagttggtacttcttagcatactggagccagtcatcgaccagaatctctactctattggcctgaaatacacaacagcaacttttgcagctgcaatgtgcaacatacttcccgccattacttttataatggcctggatattcaggcttgagagggtgaagcttacaagcattcgcagccaagccaaaataattgggactgtcgccacagttgcaggagccatgatcatgacgctggtacgaggtccagtcattgaactattttggacaaacggaaattccagtcatgaatctcaaagtggtgggttaaatctaagccatgctatcaaaggttccctcatgataacaattgggtgcttcagttgggcagcattcatgattttgcaggcaatcacactgcggacctaccctgcagagctctcactcactgcttggatatgcttgttgggaacagctgagggagctatagtagcgacggtaatggaaagaggaaaagctgcagtgtgggccataaaatgggacactaagtttcttgcagctgtatacagtggaatattctgttcaggactcgcctattacatccaaggagtcataatgaaagataggggccctgttttcgtcacagctttcaatccattaagcatggttattgtagctatactgagttcattcattctacgtgaacaaatgaacctgggaagggtacttggtgctgttgtgatcgttttaggcctttacattgtcctatggggtaaaagcaaggatcaaaaatctccatcagctaatgaacaagcaataccaacacaggaaacgacacatgaaaacaaaattgacaaggaaaatttaagccagacaattatccacatcagtccatcaagaggaacaactgttaccaaagatgaaagaatataatgatcttctcgtcggggctatatcttccaaattcaaaggaagtcgggctacagagcaacctctttatctaagaaatgagctcctcttcaccttcatctaagaattaatagttattagttaaagatggtttatgtatgaagaggagtttctttctgctttaaggcaaggaaaaagaatctcaagtcatgtgcccaaaatttggggcagttcacaaccattttttgcaaacttctgtcagtactatagaatgaccaaactatgttaagccaataggctttttcttatggtttgttaaacagatattaagcatgtataataacagcaataatcatgcccagatatgaaaataaggcggatcctgaa

SEQ ID NO: 8044 - DNA, 1194 bp, Nicotiana benthamiana
tgcacacttgtgaccttacaatagaagagctctcaaagaggtttagtttgtgcaaataaacaatgaaggcagtaagtgaactattcattagatcaaaaccctttattgctgtcatatttcttcactttgcaaggcatggatatcctcaccaaaatggcattgaatgaagggatgagcaactatgtatttgttgtgtaccgccacgcagtagccactctcgctattgctccttttgcaataattctagacaagaaaataagaccaaagatgactctctcaatattcactaagttggtacttcttagcatactagagccagtcatcgaccagaatctctactctattggcctgaaatacacaacagcaacttttgcagctgcaatgtgcaacatacttcccgccattacttttataatggcctggatattcaggcttgagagggtgaagcttacaagcattcgcagccaagccaaaataattgggactgtcgccacagttgcaggagccatgatcatgacgctggtacgaggtccagtcattgaactattttgggcaaaaggaaattccagtcatgaatctcaaagtggtgggttaaatctaagccatgctatcaaaggttccctcatgataacaattggatgcttcagttgggcagcattcatgattttgcaggcaatcacactgcggacctaccctgcagagctctcactcactgcttggatatgcttgttgggaacagctgagggagctatagtagcgatggtaatggagagaggaaaagctgcagtgtgggccataaaatgggacaccaagtttcttgcagctgtatacagtggaatattctgttcaggactcgcatattacatccaaggagtcataatgaaagataggggccctgtttttgtcacagctttcaatccattaagcatggttattgtagctatactgagttcattcattctacgtgaacaaatgaacctgggaagggcacttggtgctgttgtgatcgttttaggcctttacattgtcctgtggggaaaaagcaaggatcaaaaatctccatcagccgatgaacaagcaataccaacacaggaaactacacatgaaaacaaaattgacaaggaaaatttaagtatccacatcagtccatcaagaggaccaactgttaccaaagaagaaagaataaaatgattt

SEQ ID NO: 8045 - DNA, 1475 bp, Solanum tuberosum
gtctcttaataaaaaccctacctaattagttacattttgcttcttcttcaactgacatttcttcaatcattttccgcccccattcaccgccgcccctcaccggaaaaatgaactctccggcactttctctccgtcacaaccatttcctcaatggcggctccgctctggcatccggcattcgtctaccacgctcaatctcttcccctttccgtgtccgtatgtctctccaggaaaacggcccatccgtcgccgtcgtcggcgttactggcgccgtcggtcaagagtttctctccgttctatctgaccgtaacttcccttaccgttctattaaactccttgcaagcaaaagatcagctggaaaatcgatgaagtttgaggaacgagattatactgttgaagaactcactgaggatagttttgatggtatagatattgcattgtttagtgctggtggttcgattagtaagaaatttggacctttggctgctcaaaagggaacaattgtggtggataatagctccgcttttcgaatggatgagaatgtgcctcttgtgattccagaagtgaatcctgaagctatggcacatgtcaagcttggttctggaaagggagcacttattgcgaatccgaattgctctactattatttgcttgatggctgttactcctctccatcgtcgtgctaaagtcaaacgcatggttgttagtacatatcaggcagctagtggtgccggtgctgctgcaatggaagagctggtgcagcagactcgtgaggtcctggagggaaaagaaccaacctgcaatatctttaaccagcagtatgcttttaatcttttctcacataatgcacctattcaacccaatggatataatgaagaggaaatgaagctggtcaaagaaacaagaaaaatatggagtgacaaggatgtcaaggttactgcaacatgtatacgtgttcctgttatgcgtgcacatgctgagagcgtgaatcttcaatttgagaatcccctcgatgagaatactgcaagggatattcttaaaaatgcaccaggtatagttgtagtcgatgaccgtgcaagtaatagattcccaaccccacttgaagtttccaataaagacgatgttgcagttgggagagtacgacgtgatgtttcccaagatggagattatgggctggacatctttgtttgtggtgatcaaatacgcaagggagccgcccttaatgctgtccagattgcagaaatgctgttgtagatttgcgatatagcacccctaaaggttctaattttggctcaaatatgagagacagagaaccttaaaggtagtcgcgtattcctccagcattacattttgcttggtgagatttgggaatcctcatttacattagttgagttcgttctagtttgaagagagattttgcttcaaactcttgtttctgtgaaacttctgttattatttataataatcttattgttg

SEQ ID NO: 8046 - DNA, 2443 bp, Solanum phureja
agccacaccgcttcttctgttcaactccattacttcattggtcttctccctcatgtttcggccattaatatctacttctttgatttgacacaatcttttgagttttctaactttttctctgtgtctttcttcccccaaaacattgaactttatacttttcagaaaaaaaaaatcagagtgaaatttttcttctccttccacaaaaaccactttttaagttgggaaaaaaacctgaaaaatggacagaaatcaagaaattgcattgacccaaatgaggaaatcagttgaaaagcttggatcttccactgaaagttatggtgagaagacattaatgaggttcttgattgcgagatcaatggacccagagaaagctgcaaagatgttttgtcagtggaaaaaatggagggctgagatggttccacttggttacatctctgattctgaagttgcaaatgaattagcagctgaaaaactttatttgcagggattgtccaagagtggacaccctattgtgatagtcaaagttaacaagcattttccttccaaagatcaagttcaattcaagaaattcgtcattcatctactagacaaaacaattgcaagttcattcaaaggtagggaaataggaaatgagaaacttattgcaattcttgatctcaagaatattacctatagcaatgttgatactcgtggattgataactggttttcagtttttacaggcatactaccctgagcgcttagctacttgttaccttttacacatgccacaattctttgtcaccatatggcgatttatttgtcgcttccttgaaaaggcaactcaagagaagatgaggattgttacaagtgaagaagaaaaggaagagttcatccgagaggtcggtgaagatgtcttaccggaggagtatggagggcgcgctaaacttgtacttatgcaggatgttgctttacaatttttgcttcttcttcaactgacatttcttcaatcattttccgccgccattcaccgccgcccttcaccggaaaaatgaactctccggcactttctctccgtcacaaccatttcctcaatggcggctccgctctggcatccggcattcgtctaccacgctcaatctcttcttcttccacctcctcttcccctttccgtgtccgtatgtctctccaggaaaacggcccatccgttgccgtcgtcggagttactggcgccgtcggtcaagagtttctctccgttctatctgaccgtaacttcccttaccgttctattaaactccttgcaagcaaaagatcagctggaaaatcgatgaagtttgaggaacgagattatactgttgaagaactcactgaggatagttttgatggtatagatattgcattgtttagtgctggtggttcgattagtaagaaatttggacctttggctgctcaaaagggaacaattgtggtggataatagctccgcttttcgaatggatgagaatgtgcctcttgtgattccagaagtgaatcctgaagctatggcacatgtcaagcttggttctggaaagggagcacttattgctaatccgaattgctctactattatttgcttgatggctgttactcctctccatcgtcgtgctaaagtcaaacgcatggttgttagtacatatcaggcagctagtggtgccggtgctgctgcaatggaagagctggtgcagcaaactcgtgaggtcctggagggaaaagaaccaacctgcaatatctttaaccagcagtatgcttttaatcttttctcacataatgcacctattcaacccaatggatataatgaagaggaaatgaagctggtcaaagaaacaagaaaaatatggagtgacaaggatgtcaaggttactgcaacatgtatacgtgttcctgttatgcgtgcacatgctgagagcgtgaatcttcaatttgagaatcccctcgatgagaatactgcaagggatattcttaaaaatgcaccaggtatagttgtagtcgatgaccgtgcaagtaatagattcccaaccccacttgaagtttccaataaagatgatgttgcagttgggagagtacgacgtgatgtttcccaagatggagattatgggctggacatctttgtttgtggtgatcaaatacgcaagggagccgcccttaatgctgtccagattgcagaaatgctgttgtagatttgcgatatagcacccctaaaggttctaattttggctcaaatatgagagacagagaaccttaaaggtagtcgcgtattcctccagcattacattttgcttggtgtgatttgggaatcctcatttacattagtcgagttcgttctagtttgaagagagattttgcttcaaactcttgtttctgtgaaacttttgttattatttataataatcttgttgttgagctggtgagtctttcatattttaattt

SEQ ID NO: 8047 - DNA, 1423 bp, Solanum melongena
aattttacatttgctttctttaactatatttcttctctcatccgccgccgtctcttgaccaaaaaatgaactctccggcgctctctctccgtcacaaccagttcctcaatggcggcaccgctctggcatccggaattggtttatcacgttacatctgttcctccacctcctcccctttcagggtccgaatgtctcttcaggaaaccggtccatccgtcgccgtcgtcggcgttactggcgccgtaggtcaagagtttctctccgttctatctgaccgtaactttccttaccgttctcttaaactccttgcaagcaaaagatcagctggaaaatggatgaaatttgaagagagagattatactgttgaggaactcactgaggatagttttgatgcaatagatattgcattgtttagtgctggtggttcgattagtaagaaatttggacctttggctgctcaaaaggggactattgttgtagataatagctcggcttttcgaatggatgagaatgtgcctcttgtgattccggaagtgaatcctgaagctatggcacatgtgaagcttggttctgggaaaggagcacttattgctaatccaaattgttctactattatttgcttaatggctgttactcctctccatcgtcgtgctaaggtcaaacgcatggttgttagtacatatcaggcagctagtggtgccggtgctgctgcaatggaagagctagtgcagcagactcgtgaggtcctggagggcaaagaaccaacctgcaatatctttaaccagcagtatgcttttaatcttttctcacataatgcacctattcaatccaatggatataatgaggaggaaatgaagctggtcaaagaaacaagaaaaatatggagtgacaacgatgtcaaggttactgctacatgtatacgtgttcctgttatgcgtgcacatgctgagagcgtgaatcttcaatttgagaatcccctcgatgagaatactgcaagggaaattcttaaaaatgcaccaggtatagttgtagtcgatgaccgtgcaagtaatagattcccaaccccacttgaagtttccaataaagacgatgttgcagttgggagagtacgtcgtgatgtttcccaagatggagattatgggctggacatctttgtttgtggtgatcaaatacgcaagggagccgcccttaatgctgtccagattgcagaaatgctgttgtagattcgcgatatagcaccccctaaggttctaattttggctcaaatatgagagacagagaacctgaaaggtagtcgcgtatcctccagcatttacattttgcttggtgggatttgggaatcctcatttacattagttgagtttgttctagtttgaggagagattttgctttaaacttttgtgaattataataattttgttgg

SEQ ID NO: 8048 - DNA, 1485 bp, Nicotiana benthamiana
ggcgcctcaggtaagggcttcacttgccttaacgttgagccgcccttgagtccgccgccgcttcccgcaaaaatgaacactccagcactttctgtccgccacaaccatttcctctaccgcggcggcaccaccattccacgaccacgctccatcaccacctccacctcgcctttccgcgtccgcatgtctctccaagagaacggcccatccgtcgccgtcgtcggcgtcaccggagcggtcggtcaagagtttctctccgttctctccgaccgcgacttcccttaccgttcgatgaaactcctcgcaagcaaaagatcagctggtaaatcaatgaaattcgaagacagagattatacagttgaagagctcacggaggatagttttgtagggatagatatagcattgttcagtgctggcggttctattagtaagaaatttggaccgttagcggcgcaaaaggggactatagttgtggataatagctcggcgtttcgaatgtatgagaacgtgcctctcgtgatacccgaagtgaatcctgaagcaatggcgcatgtgaagctaggttctggaaaaggagcgcttattgctaatcccaattgctctactattatttgcttgatggctgttactcctcttcatcgttgtgctaaggtcaaacgcatggttgttagtacatatcaggcagctagtggtgctggggctgctgcaatggaagagctagttcagcagactcgtgaggtcctggagggcaaagaacctacttgcaatatctttaatcagcagtatgcctttaatcttttctcacataatgcacctgttcaaccaaatggatataacgaagaggaaatgaagctggtcaaagaaacaagaaaaatatggaatgacatggatgtcaaggttactgcaacatgtatacgtgtccctgttatgcgtgcacatgctgagagcgtgaatcttcaatttgagaagccccttgatgaggatactgcaagggatatccttaaaaatgctccaggtataattatcattgatgatcgtgctagtaatcgatttccaaccccacttgaagtttccaataaggatgatgttgcagttgggagagtacgccgtgatgtttcccaagatggagattatgggctggacatctttgtttgtggtgatcaaatacgcaagggagccgcccttaatgccgtccagattgcagagatgctgttgtagttttgcgatatagcttcataaaaaaaaagcttttgtgtacatcacccgaaggttctatttttgcttgaatgtgagagacgtagaacctgaagaaagatagaggtggtcgtgttttcctctaacatttacattttgctcattggggttttggcaatcttcattctagtttgaggagaaattttgcttcagactcgtttctggaaacttttgttatttatcataatcggttaagggtcaaatatatccttgtactattaaaaataggcc

SEQ ID NO: 8049 - DNA, 1344 bp, Ipomoea nil
ggccattcttatttcctccctttctccttaaaccctcccgccgccgtcgcctccgacaatgaagctctcaactctttctcttcgccaccaccaattcctccccggcaccgccgccatccccactccccgttccatttcctcctccgcctccgcctcccgcgtccgcatgtcgcttcgtgaggacgccccctcagtcgccatcgtcggcgtcaccggcgccgtgggccaggagtttctctccgtcctctccgaccgcgacttcccgtaccgctccctcaagctcctcgccagcaagcgctccgcggggaggggcctcgccttcgaaggcaagcagtacaccgtcgaagagctcaccgaggaaagctttgaaggcgtcgacattgctctgttcagcgccggcgggtctattagtaagaaatttggcccgatagcggctcggaaggggaccattgtggtggataacagctctgcttttaggatggacgatggcgtgccgctagtgatcccggaggttaatccagacgccatggcgcatattaaggtcgggtctgggaagggagcgatcattgccaatcccaattgctccaccattatttgcttaatggccgccacgccgcttcatctccgggctaaggttaaacgtatggtcgttagcacataccaggctgccagtggggctggtgctgcagccatggaagagcttgttttgcagactcgtgaggtcttagaagggaaagaaccaacctgtaacatctttaagcagcagtatgctttcaacctattctcacataatgcatctattcaatcaaatggttacaatgaagaggagatgaaattggtaaaagagactaggaaaatatggaacgacaaggatgttaaagtgacggcaacgtgcatacgagttccagttatgcgtgctcatgccgagagtgtgaatcttcaatttgagaaacccctcgatgaggagacggctaaggatattctcaagaatgcaccgggcatagtagtcgttgatgatcgagctgcaaacagatttcccaccccactcgaagtttccaacaaagacgacgttgcagttgggaggatacgacgtgacatttcccaagatggggactacgggttggacatctttgtctgtggtgatcaaatacgcaagggagctgcccttaacgctgttcagattgcagagaagctgctataggttgaatacacacagccaaaagaaaattttaccatctcacttgaatgcccataaaagggcagatttattggaacagtttttattttttgcctgtggagttatgaatgttgtccatgttgcagagtagatttttgttgaaagtt

SEQ ID NO: 8050 - DNA, 1573 bp, Chenopodium quinoa
taaaatccaacataatcccgttttcttccatttcatcacatcattttccctttgaaagccctaaacacttcctccacttccactttctctctcctaaacccccaccaccttccgccgccattctcacaatgtccgccgccatgaacctcgccgccggcaaagtccacactcccttcctctccgggaccaccaccactacctcaaccacctccgtccgccgcaccctcctccctctcccccgcaccagcaccccatcctcctccgccatccgcatgtccctccgcgacgacggcccctccctcgccgtcgtcggcgtcaccggcgccgtcggccaagaattcctctccgtcctctccgatcgcgacttcccttaccgctccctcaaactcctcgccagcaaacgctccgccggcaaggagatgaccttcgaaggccgaacttatatcgtcgaagagctcgatgaagatagctttgatgggattgacattgctctgttcagtgctggtggttccattagtaagcagtttggacctttggctgttgaaaagggtaccattgttgttgataatagctccgcttttcgaatggttgatgatgttcctcttgttattcctgaagttaaccctcaagctatggctcatattaagcttggttctggaaagggtgctttgattgctaatcctaattgttctactattatttgtttaatggctgctactcctcttcatcgccgtgccaaggttactcgcatggttgttagtacataccaggctgctagtggtgctggtgctgctgcgatggaagagcttgagctgcaaactcgtgaggttttggaaggcaagcctccaacttgcaacatctttagtcagcagtatgcttttaatttgttctcccacaatgcaccaattctttcaaatggatacaatgaagaggagatgaaattagtaaaggaaaccaggaaaatttgggatgatattactgtaagggttactgctacatgtattagggtccctgttatgcgtgcacatgccgagagtgtaaaccttcaatttgagaccccccttgacgaggacacagcaagagagattttagagagcgctcctggcgtggtggtaatagatgatcgtgcatcaaatcactttcccacccccttggaagtttccaacaaggacgctgttgctgttggcaggataaggcgtgatgtctctctagatggagataatgggttggacatttttgtatgtggtgaccaaatacgcaagggagcagcacttaatgctgtccagattgccgagatgctgttatagacttgtagatttgtttctatttctgattttgttttttcatatttttttctctttgtgctggggtatatttggtgcccccaattttctgagaaaattttgcaattagcaacctgtattatgctgatctttacaactgattggattacttggcttattgaggtgaaataagacgtctcttgtgtatgactatctattcttttttaccccaagtatcaggtaacatctcataccgggtaatcggtttcccaaattctagtatattgaaa

SEQ ID NO: 8051 - DNA, 1328 bp, Orobanche aegyptiaca
ccgatatgaaactccaaacactctccctccgccaccacctcaccacatccttccttcacaacggtgccaccagcctctccgtctcccgttcgacgcgcgttaccaatgccccattcactgtccgcatgtctctcagagaagacggcccctccgtcgccgtcgttggagtcacaggcgccgtcggccaggagttcctctccgtcctctccgaccgtgatttcccctaccgatctctcaagctgctcgcctccaaacgatccgccgggaaaaaagtgacgtatgagaatcgtgactacaccgtcgaggaattgacggaagacagcttcgatgctgttgacattgccttattcagtgccggcgggagtataagtaagaagtttgggcctatagccgttgacaagggcactattgtagtggacaatagctcagcgtttaggatggacgatgggattccactcgtgattccggaagtgaatcctgaggcgatggaggggattaagcttaagggtggaaaggggcgcttattgcaaatccaaattgctcgactattatatgcctcatggctgtcaccccattgcatcgtcaggcaaaagtatcacgaatggttgtcagtacataccaggcagctagtggtgcaggtgctgcagcaatggaagaacttgaacagcagactcgtgaggtgctggaaggaaaacagcctacttgtaacatttttaagcaacagtatgcctttaacttgttctcacataatgcacctgttctttccaatggatacaacgaagaggagatgaaattggttaaagagacacggaagatatggaataataatactgtcaaggttactgccacctgtataagagtacctgtgatgcgtgctcacgctgaaagcgtgaatcttcaattcgagacacctttagatgaggacacggcaagagagatactcagaaatgcccctggtgtagtggttatcgacgaccgtgcagccaattacttccctacccccttggaggtttctaataaagatgatgtggccgttggaagaatacgaagagatgtttctcaggatgggagctacgggttggacatttttgtttgtggcgatcaaatacgcaaaggtgctgctcttaatgccgtccagattgctgagatgttgctctagatttaaaactttgataaattatttaatcatggtgatatgcgtgatatcaattttgatgtcttgttgtttcctcaaatgaggatgactttttttatgtgttctcaataaaataaagatgtttcctcaaatgaggatgactaatataaatgatgttcctttatgtaattct

SEQ ID NO: 8052 - DNA, 1639 bp, Cicer arietinum
ctattacttcgttccttgtctctcactgccccactttacaacacactctctctctctctctctctctctaaaacaaagtataaaccctttctctctctaaaatctctgattccaatggcttcactctctctcctacgccaaaacagcttcttctccgccaccctctcgagccaacccaaaccgaaatatgcatctccaggaagagtccgaatgtcactccaagaaaacgcaccaacaatcgccgtcgtcggagtcaccggcgccgtcggccaagaatttctctccgtcctatccgaccgagacttcccatacagctccatcaaaatgctggcttcaaaacgctccgccggccgccgcctaacattcgaagacaaggagtacgtcgtggaggagctgacggcggagagtttcgacggcgtcgacattgctctgttcagcgccggagggtcaatcagcaaggagtttggtcctattgctgtggaaagaggagcaatcgttgttgataatagctctgcttttcgaatggatgagaatgttccgttggtgattcctgaagtgaaccctgaagctatggctaatatcaaagttggaatgggaaaaggggctctcattgctaaccctaattgttccaccattatttgtttaatggctgctacacctcttcatcgacgtgccaaggtgttgcgtatggttgttagtacctatcaagctgctagtggtgctggtgctgctgcaatggaagagcttgtgttgcaaactcgtgaggtattggaaggaaaaccgccaacttgtaaaatatttaaccgacagtatgcttttaatctgttctcacacaatgcacctgttctttcaaatggatataacgaagaagaaatgaaattggtcaaggagactagaaaaatttggaatgacaaggacgttaaagttacggctacatgtatacgagttcctgtcatgcgcgctcatgccgagagtgtgaatcttcaattcgagacaccacttgatgaggacactgcaagggatattttgaagaatgctccgggcgtagtggttattgacgaccgcgaatccaataactttcctactccattggaagtgtcaaataaggatgatgttgcggttggcaggattcgccgtgacctgtctcaggatgggaatcaagggttggatatttttgtatgcggggatcaaattcgcaagggagctgcacttaacgcaatccagattgccgagatgttgctatgagttctgatatgtcacggttttggtttctcagaattaagttgttttgaatatgctagatggaagctgtcattctttgtttttgtaagatttatagctctttagctagtcaaaaagacttatttacaggatgtggtaatacactatagcttgaacaatttttttccatggccttaattgcacactttgtgtagtcagctcctttcataataacaagcattggttatgccattgggcattactccttgaacttaggagtgtgaatatatgaactaaggaaatggattccctgtagttaaatagtaactgcatggtaatcttgatcatccaatttggatcaataatttataatgttttttatttactttaaatttgaaccattcaaattcaatctaat

SEQ ID NO: 8053 - DNA, 1611 bp, Vitis vinifera
aaaaaaatgaggaaaaagaaacactcttagcaaagaaagaaagaacggcggaaagcgaaaacaggaaggaaaatcacaacgccgccttccctagcttttcaaggtttgaacctcagccgcctctttctctcttaaaccctaaccaaacctcattttttcagattctccaggctgctgcactctttatctctttacattagtgtcaaaaatgaaggcaccagctctcgcccaccatcaccacctcctctctgcaactcgcattcctaggaccaacctcagaccccgtaccgccacccccacttccaccatccgcatgtccctccaagaaaatgccccctcccttgctgtagtaggcgttaccggcgccgtcggtcaggagttcctctccgtcctgtccgaccgcggcttcccatatcgatccatcaaaatgctggcctccaagcgctccgccggcaaacacctcactttcgaggacaacgactacgttattgaggaactcaccgctgatagcttcgacggcatcgacatcgctctctttagcgccggaggctccatcagtaaacagtttggtccgattgcggttgatcggggctccattgttgttgataacagttcggcatttaggatggatgagaacgtgccgcttgttattccagaagtgaatccggatgcaatgaagcatattaagctcgggagtggaaagggggcgcttattgccaaccccaattgttctactattatatgccttatggctgccacgccccttcatcggtgcgccaaggtagtacgcatggttgtcagcacatatcaggcagctagtggtgctggtgctgctgcaatggaggagcttgaactgcaaactcgtgaggtcttggagggaaaacaaccaacttgtaaaattttcaagcaacagtatgcttttaatctcttttcacacaatgcacctgttcttccaaatgggtacaatgaagaggaaatgaaattagtaaaagagacaaggaaaatctggaatgacatgaatgttaaagtgactgccacatgcatacgggtccctgttatgcgtgcgcatgctgagagtgttaatctccagtttgagaatccccttgatgaggataaagcaagggatatcctgaagaacgctcctggtgtggtggttattgatgagcggccatccaataactttcctaccccattagaggtatcaaacaaagatgatgttgcagtaggcaggatacgccgtgatgtttctcaggatggaaattttgggctggacatctttgtctgtggtgatcaaatacgcaagggggctgcacttaatgccatccagattgccgagatgttgctgtagttcacttttgattcttgcagggagttttgttttatgaatttatttatgtgggagatgaagcaacgttgagcaatagattctattgatcctcaatgcagatattcagatgtgacatgaaacaaattttaggagttcttgtagtattgtgctgaattgtggttggatgttttccacttaaaaagttgtgcacaagttatgctaatataattctgcactagtaataaattaattttgtttcatgaactgcctgagtcttttcagtg

SEQ ID NO: 8054 - DNA, 1513 bp, Vitis vinifera
atcacaacgccgccttccctagcttttcaaggtttgaacctcagccgcctctttctctcttaaaccctaaccaaacctcattttttcagattctccaggctgctgcactctttatctctttacattagtgtcaaaaatgaaggcaccagctctcgcccaccatcaccacctcctctctgcaactcgcattcctaggaccaacctcagaccccgtaccgccacccccacttccacaatccgcatgtccctccaagaaaatgccccctcccttgctgtagtaggcgttaccggcgccgtcggtcaggagttcctctccgtcctgtccgaccgcggcttcccatatcgatccatcaaaatgctggcctccaagcgctccgccggcaaacacctcactttcgaggacaacgactacgttattgaggaactcaccgctgatagcttcgacggcatcgacatcgctctctttagcgccggaggctccatcagtaaacagtttggtccgattgcggttgatcggggctccattgttgttgataacagttcggcatttaggatggatgagaacgtgccgcttgttattccagaagtgaatccggatgcaatgaagcatattaagctcgggagtggaaagggggcgcttattgccaaccccaattgttctactattatatgccttatggctgccacgccccttcatcggtgcgccaaggtagtacgcatggttgtcagcacatatcaggcagctagtggtgctggtgctgctgcaatggaggagcttgaactgcaaactcgtgaggtcttggagggaaaacaaccaacttgtaaaattttcaagcaacagtatgcttttaatctcttttcacacaatgcacctgttcttccaaatgggtacaatgaagaggaaatgaaattagtaaaagagacaaggaaaatctggaatgacatgaatgttaaagtgactgccacatgcatacgggtccctgttatgcgtgcgcatgctgagagtgttaatctccagtttgagaatccccttgatgaggataaagcaagggatatcctgaagaacgctcctggtgtggtggttattgatgagcggccatccaataactttcctaccccattagaggtatcaaacaaagatgatgttgcagtaggcaggatacgccgtgatgtttctcaggatggaaattttgggctggacatctttgtctgtggtgatcaaatacgcaagggggctgcacttaatgccatccagattgccgagatgttgctgtagttcacttttgattcttgcagggagttttgttttatgaatttatttatgtgggagatgaagcaacgttgagcaatagattctattgatcctcaatgcagatattcagatgtgacatgaaacaaattttaggagttcttgtagtattgtgctgaattgtggttggatgttttccacttaaaaagttgtgcacaagttatgctaatataattctgcactagtaataaattaattttgttt

SEQ ID NO: 8055 - DNA, 2281 bp, Arabidopsis lyrata
tcttcctgtggcttctgggtctctgtcaacatcaaagctctttacttttccaactgacattatcgtgcgtctgtacggaccacaaaggctctctctttatttctttctgtgagttttgaggatctgagagccaaagatcatggaggaaagccaagaacttgccttgacccagttgagaaaatcggtcgagaaactctcttcctccactgagggatatgaaaaaccgacattgatgaggttcctggtggcaagatcaatggacccagacaaggcagcaaagatgtttgtagattggcaaaagtggagagcctccatgattcctccaactggattcatccctgagtcagaagtgaaggatgaattggaattcagaaaggtctgtcttcagggtccaaccaaatccggacaccctttggtgcttgtcataacctctaagcattttgcttctaaggatccagctaacttcaagaagttcgttgtttatgtgctagacaaaacaatcgcaagtggaaacaatggcaaagaaattggaggtgagaaattagtagccgttattgatctggcaaacattacatataagaatcttgatgctcgtggattgatcactggctttcaattcttacaatcttactacccggaacgccttgcaaaatgctacatcttgcatatgcccggattcttcgtgaccgtttggaaattcgtctgccgttttttagagaaagcaactcaggaaaagattgtgatagtaacggacggagaagaactgaaaaaattcgaggaggagatcggagcagaagctttaccggaagagtacggtggccgagctaagctcacagcaatccaagatgttcttcttcctcagtctgctccagtaactctaacaaacaataattcccaaactttttctatcagccgcctccaaaatctctctatctctcacttcttcttcctcacgacggcgacaatggcgacgttcactcatcaaactccacaaacccatttcctctctcgccttcctctcagagctacacccagacacttctccgcaagagtcaaaatgtctctccaagaatctgcgccttctctcgccgtcgttggcgttaccggagccgtcggacaagaattcctctccgtgttatccgatcgagacttcccttatagctccgtcaagatgcttgcatcgaaacgctccgcagggaaacgtgttgccttcgatggccgtgaatacacggtggaggagctcacggcggagagcttcgacggcgtagacattgctttgttcagtgctggtggatccataagcaaggagtttggtcctctcgcggcggagaaaggaaccattgttgttgataatagctcggcttttagaatggttgatggagttccgcttgtgattccggaagtgaatccagaagcaatgaaagggattaaagttggaatgggcaaaggggctttgattgcaaaccctaattgctccaccattatctgtttgatggctgtgactcctcttcatcgtcacgcaaaggtgaagagaatggtggtaagtacatatcaagcagctagtggtgctggtgctgcagctatggaagagcttgttcagcagactcgtgaggttttagagggtaaacctccgacttgtaacatcttcgggcagcagtatgcatttaacttattttcgcataatgcccctattcttgacaatggttacaatgaagaggaaatgaaacttgtgaaggagacaaggaagatctggaatgacacagaagtaaaagtaacagctacgtgtatacgtgttccagttatgcgtgctcatgcagagagtgtgaatcttcagtttgagaatcctcttgatgagaacacagcaagggagatactgaagaaagcacctggagtttatataatagacgaccgtgcttcaaatactttccctactccactagatgtctctaacaaagacgatgtagcggttggtaggataaggcgagacgtgtctcaagatggcgatttcgggctggacatattcgtttgcggagaccaaatacggaaaggagctgctctgaatgctgttcagattgcagagatgcttctctgaatttgaagcctccctctcactttgcttgttatgaaattcttgacaaagagagatcactgtattatcagatttgagacaagaatttgtctcatttttctatttgaccaattttgttactttcttcattcactcatccccacgcttgaacctattggcaatttgccggttcgaatctgtaccgacttggtt

SEQ ID NO: 8056 - DNA, 2369 bp, Arabidopsis lyrata
ttctatccacttaccgtagaaacaagtgccaaatactttgtcttcctgtggcttctgggtctctgtcaacatcaaagctctttacttttccaactgacattatcgtgcgtctgtacggaccacaaaggctctctctttatttctttctgtgagttttgaggatctgagagccaaagatcatggaggaaagccaagaacttgccttgacccagttgagaaaatcggtcgagaaactctcttcctccactgagtttgtatcttttggccgtttcatgagtttcactgtcaatgtctcgttagaaaatgagaaaaagatctgtcatttgatttttatgagctacactaaaatctcatccatggtttttttttttgtggttgtttcctctgaaaagggatatgaaaaaccgacattgatgaggttcctggtggcaagatcaatggacccagacaaggcagcaaagatgtttgtagattggcaaaagtggagagcctccatgattcctccaactggattcatccctgagtcagaagtgaaggatgaattggaattcagaaaggtctgtcttcagggtccaaccaaatccggacaccctttggtgcttgtcataacctctaagcattttgcttctaaggatccagctaacttcaagaagttcgttgtttatgtgctagacaaaacaatcgcaagtggaaacaatggcaaagaaattggaggtgagaaattagtagccgttattgatctggcaaacattacatataagaatcttgatgctcgtggattgatcactggctttcaattcttacaatcttactacccggaacgccttgcaaaatgctacatcttgcatatgcccggattcttcgtgaccgtttggaaattcgtctgccgttttttagagaaagcaactcaggaaaagattgtgatagtaacggacggagaagaactgaaaaaattcgaggaggagatcggagcagaagctttaccggaagagtacggtggccgagctaagctcacagcaatccaagatgttcttcttcctcagtctgctccagtaactctaacaaacaataattcccaaactttttctatcagccgcctccaaaatctctctatctctcacttcttcttcctcacgacggcgacaatggcgacgttcactcatcaaactccacaaacccatttcctctctcgccttcctctcagagctacacccagacacttctccgcaagagtcaaaatgtctctccaagaatctgcgccttctctcgccgtcgttggcgttaccggagccgtcggacaagaattcctctccgtgttatccgatcgagacttcccttatagctccgtcaagatgcttgcatcgaaacgctccgcagggaaacgtgttgccttcgatggccgtgaatacacggtggaggagctcacggcggagagcttcgacggcgtagacattgctttgttcagtgctggtggatccataagcaaggagtttggtcctctcgcggcggagaaaggaaccattgttgttgataatagctcggcttttagaatggttgatggagttccgcttgtgattccggaagtgaatccagaagcaatgaaagggattaaagttggaatgggcaaaggggctttgattgcaaaccctaattgctccaccattatctgtttgatggctgtgactcctcttcatcgtcacgcaaaggtgaagagaatggtggtaagtacatatcaagcagctagtggtgctggtgctgcagctatggaagagcttgttcagcagactcgtgaggttttagagggtaaacctccgacttgtaacatcttcgggcagcagtatgcatttaacttattttcgcataatgcccctattcttgacaatggttacaatgaagaggaaatgaaacttgtgaaggagacaaggaagatctggaatgacacagaagtaaaagtaacagctacgtgtatacgtgttccagttatgcgtgctcatgcagagagtgtgaatcttcagtttgagaatcctcttgatgagaacacagcaagggagatactgaagaaagcacctggagtttatataatagacgaccgtgcttcaaatactttccctactccactagatgtctctaacaaagacgatgtagcggttggtaggataaggcgagacgtgtctcaagatggcgatttcgggctggacatattcgtttgcggagaccaaatacggaaaggagctgctctgaatgctgttcagattgcagagatgcttctctgaatttgaagcctccctctcactttgcttgttatgaaattcttgacaaagagagatcactgtattatcagatttgagacaagaatttgtctcattttt

SEQ ID NO: 8057 - DNA, 1511 bp, Vigna unguiculata
ataacaacatacatcttctcaccctaaaacctcacccacacccacgcaaactctgttatggcttcactctccgtttcgcgccacagccacctcttatcgggcctccttccggcccggtccaagcccacctcggggcctaccagggtcagaatgtccctccgcgatgacggtccctccatcgccgtcgtcggcgtcaccggcgcagtcggccaggagttcctctctgtcctctccgaccgcgacttcccctaccgctccatcaaaatgttggcatcgcagcgctccgccggccgccgcatcacctttgaggacagggactacgtcgtggaggagctcacggcggatagtttcgacggcgtcgacatcgcactgttcagcgctggtgggtccatcagcaagaagtttggtcctgctgcggtggaccgggggacagtggttgtggacaatagctcagcctttcggatggacgagaaggtgccgctggttatccccgaagtgaaccccgaagcgatgcagcacatcaaagctggaactggaaaaggcgctctcattgcgaaccctaattgctctaccattatttgcttgatggctgccacgcctcttcatcgacgagctaaggtgttacgaatggttgtcagtacctatcaggctgccagtggtgctggtgctgctgcaatggaagagctcgagctgcaaactcgtgaggtgttggaaggaaaaccacccacttgtaaaatatttaatcgacagtatgcttttaacttattctcgcataatgcatctgttctttcaaatggatacaacgaagaagaaatgaaaatggttaaggagacaaggaaaatctggaatgacaaggaagttaaagtaactgctacatgcatacgagttcctgtcatgcgtgctcatgccgagagtgtgaatcttcaatttgaaaatccacttgatgagaacactgcaagagatattctgaagaatgctccaggtgtagtggtcattgatgatcgtgagtccaatcattttcccactccattggaagtgtcgaataaggatgatgttgctgttggtaggattcgccaggacctgtctcaagatgggaatcaagggttggacatttttgtatgtggggatcaaattcgcaaaggagctgcacttaacgcgatccagattgctgagatgttgctttgagttctacgtcgtcaaggatgtggtacttaaagataatgcttctttagaaacagttttgtatctggtagttttatgaggtttattagtttcttttgagatttaactagtccaaggatattttcaacaatgtgggagtgggagtactttagctggaaacaatttttcgaaggtcttagctggaaacaaccatagattatgacaaaggagaatcatctaatgttttgatcttttgaataaagaatttgatgaccagttttattttgtctttatttctcacttagaaaaacacccactgcctgcctcctaatcaaaatatgcaattccag

SEQ ID NO: 8058 - DNA, 1759 bp, Eucalyptus grandis
gtctaagtacccgtcagccagaatactataaaaacaggggagaaaaggatctgcacaaccctgcattgctctgcgcacgctcgccctcccaacctccaaaacccaaaacctcttccctctccgccgccgcgccgccgccgccgccggagacctgtcctaccgtcgaagcgagacccgaccacccaacccatttcccttcattcctccccccttgagtaaagaaggaaccttgcgagatctctgaatctcagaagctactttctacttgggcgcacatccgcaatggccgcgctgactcgcatcacccacaaagcccacctcccgttccccgccgccacggccgccggcggcggcaggaggccgcgcgccgccaggatccgcatgtccctccaggagaacggcccctccctcgccgtcgtcggcgtcaccggcgccgtcggccaggagttcctctccgtcctctccgaccgcgacttcccctaccgctccatcaagatgctcgcctccaagcgctccgcgggcaagcgaatgaccttcgaggaccgggactacgtcgtcgaggagctcacagctgacagctttgagggcgttgacatcgctctgttcagcgctggcgggtcgataagcaaggagttggggcccatcgccgtcgagaaggggacgatcgtggtggacaacagctcggccttcaggatggtcgagggcgtgcctttggtcatacccgaggtgaatcctgaagccatggagggtgttaggctcgggacgggaaagggggctctcattgcgaaccccaattgctcgaccatcatttgcttgatggctgccacaccgctgcatcgacgcgccaaggtggttcgcatggttgttagcacttatcaagcagcaagtggtgctggagctgctgcaatggaagagcttgagcttcagactcgtgaggttcttgaagggaagccaccaacttgtaatatctttaagttacagtatgccttcaatttgttctctcacaatgctcctgttctctcgaatgggtacaatgaagaggaaatgaaactagtgaaggaaactagaaaaatctggaatgacacaaatgtcaaagtgactgctacttgcatacgagttcctgtcatgcgcgctcacgctgagagcgttaatctccagtttgagaatccactagatgaggagactgcgaaggatatactcaagaatgctcctggtgttgtggttatcgatgatagggcagccaatcacttccctacaccattggaggtgtcaaataaggatgatgtagcggttgggaggatacgtcgtgatgtttcacaagatgggaattatggattggatatctttgtctgcggtgatcaaatacgcaagggagcagcactcaatgctgttcaaattgctgagatgctcttataatttggaatttcttcatgatagcgaggctttagatcttagcttttccagtactcaggtggagatttttccttgtgatatgtcaccgttgtaagagtgctgttcattcttagtttggagtagaataagctggagtaggagtttgattttgcccagcacgaacagataggctcattagatcatatttaaaaactccctttgggattttttgctatgactggcctgattgtttatttggaatttgtttaccttgagttcgaaaagctgtattttgtcattcacatgtcggctgcattctcctaacgagcacctcgttcttgataatcaacaaccttcttgttccttc

SEQ ID NO: 8059 - DNA, 1646 bp, Citrus clementina
agaggatattgcggtagccaacaatttaactacaattcacttgcatacatacattaagattacgttacaaataactccgattcagaccccacagacgatctttgaagcaaccaaaaaccccatatctgtttccaactatcaaactcaaaacctcactagccgccatccgccgccgcagcaaacatggcgactttctcgtcacatcaaacacagacccacttcatatccaaactgcccgccaacaaacccagaaccaaacccatgttcacaagagtccgaatgtcctaccaagaatcggcaccctccgtggcggtcgtcggcgtgactggcgccgtcggccaagagttcctctccgtcctctccgatcgcgacttcccttaccgttcgatcaaaatgctggcctccaagcgttctgctgggaagcaactcagcttccaagacaaagcgtacacggtcgaagagctaacggaggatagctttgatggcgttgatatcgcgctgtttagtgctggtgggtcgatcagtaagaagtttgggcctattgctgtcgagaaagggagcattgttgtggataatagctcggcttttaggatggtggagaatgtgccgcttgtgattcctgaagtgaatcctgaagccatgagtgggattaaagttggaatggggaaaggtgctttgattgctaatcctaattgttctactatcatttgcttgatggctgccacgcctctccatcgccgtgctaaggttacacgtatggtggtaagtacatatcaggctgctagtggtgctggtgctgctgcaatggaagaacttgagctgcaaactcgtgaggtgctggaaggaaaacctccaacttgtaaaatcttttcacaacagtatgctttcaatttgttctcacacaatgcacctgttcttgaaaatgggtacaatgaagaagagatgaaaatggtaaaagagacaagaaaaatctggaatgacaaggatgttagagtgactgccacatgcatacgagttcctgtcatgcgtgcacatgctgagagtgtgaatcttcaatttgagaagccccttgatgaggacacagcaagggatattctgaagaatgcacctggggtagttgtcattgatgatcgggcgtccaatcactttcccacaccattggaggtatcaaacaaagatgacgttgcagttggcaggatccgccgtgatgtttctcaggatgggaatcatgggttggatatttttgtctgtggtgatcaagttcgcaaaggagctgcactcaatgctgttcaaattgccgagatgctgctatagttgacctttgggtttcagttttgagggttcatcttatagatttactacacttcatgtggtaagctgtagcgattgtgattgtgattgtgagtaatttatcaagtccagtctttagatgcggatatctactcttgcagttgaggtttgagattaagaagtttcacctgtttttgtactgtaaacattagtcttagtagtaagctgtttaatttcattttttacccccctaaatgtcctctgaattattccatctgcaattttgccggcatttgtcacttttggaacagtattaagtaaatatatcattatcaaataaatttatatttttttta

SEQ ID NO: 8060 - DNA, 1594 bp, Citrus sinensis
gatattgcggcagccaacaatttaactacaattcacttgcatacacacattaagattacgttacaaataactccgattcagaccccacagacgatctttgaagcaaccaaaaaccccatttctgtttccaactatcaaactcaaaacctcactagccgccatccgccgccgcagcaaacatggcgactttctcgtcacatcaaacacagacccacttcatatccaaactgcccgccaacaaacccagaaccaaacccatgttcacaagagtccgaatgtcctaccaagaatcggcaccctccgtggcggtcgtcggcgtgactggcgccgtcggccaagagttcctctccgtcctctccgatcgcgacttcccttaccgttcgatcaaaatgctggcctccaagcgttctgctgggaagcaactcagcttccaagacaaagcgtacacggtcgaagagctaacggaggatagctttgatggcgttgatatcgcgctgtttagtgctggtgggtcgatcagtaagaagtttgggcctattgctgtcgaaaaagggagcattgttgtggataatagctcggcttttaggatggtggagaatgtgccgcttgtgattcctgaagtgaatcctgaagccatgagtgggattaaagttggaatggggaaaggtgcattgattgctaatcctaattgttctactatcatttgcttgatggctgccacgcctctccatcgccgtgctaaggttacacgtatggtggtaagtacatatcaggctgctagtggtgctggtgctgctgcaatggaagaacttgagctgcaaactcgtgaggtgctggaaggaaaacctccaacttgtaaaatcttttcacaacagtatgctttcaatttgttctcacacaatgcacctgttcttgaaaatgggtacaatgaagaagagatgaaaatggtaaaagagacaagaaaaatctggaatgacaaggatgttagagtgactgccacatgcatacgagttcctgtcatgcgtgcacatgctgagagtgtgaatcttcaatttgagaagcctcttgatgaggacacagcaagggatattctgaagaatgcacctggggtagttgtcattgatgatcgggcgtccaatcactttcccacaccattggaggtatcaaacaaagatgacgttgcagttggcaggatccgccgtgatgtttctcaggatgggaatcatgggttggatatttttgtctgtggtgatcaagttcgcaaaggagctgcactcaatgctgttcaaattgccgagatgctgctatagttgacctttgggtttcagttttgagggttcatcttatagatttactacacttcatgtggtaagctgtagtgattgtgattgtgattgtgagtaatttatcaagtccagtctttagatgcggatatctactcttgcagttgaggtttgagattaagaagtttcacctgtttttgtactgtaaacgttagtcttagtagtaagctgtttaatttcattttttttcccccctaaatgtcctctgaattattccatctgcaattttgccggcatttgtcacttttgga

SEQ ID NO: 8061 - DNA, 1670 bp, Panax ginseng
aagagagttgcctgtattctgttcgtctcaaaaaccctaccaaccaaacaagcgccccctcttctctctcaattattttaaaaacttcaaacttgagctgctctgcaacatccgccgcctactgcaactcaaaaaactccaattctctctctaaaacacttatcaaacactttcttcaataatgaattcccccaccctcgctcaccaccaattccttcacggcggcggcggcgccaccttctctctcctccatcctaaaccagctttttccaccacctcctctcccttcaccgtctgcatgtcactccgggaagacgctccgtccttggccgtagtgggcgtaaccggcgccgtaggccaagaattcctctccgtcctctccgaccgcgccttcccttaccgttccatcaaaatgctcgcttccaagagatccgccggtaaaaaattcatctttgaagacaatgattatgtcgtggaagagctgacccccgattccttctccggcgttgatattgctctgttcagcgctggcggctccattagcaagcagttgggtcctatcgcggcggattgcggaactattgtagtggataatagctctgcgtttcgtatggatgagaacgttcctcttgtgattccagaagtgaatccggatgcaatgtcgggtataaagtggggatccgggaagggggctataattgcaaaccctaattgttccactataatatgtttgatggcagccacgcctcttcatcgaagagccaaggtagtacgcatggttgttagcacataccaggcggctagtggtgctggtgctgctgcaatggaggagcttgagcagcagactcgtgaggtcctcgaaggaaaacaaccaacttgtaaaatcttcaagcggcagtatgcctttaatcttttctcacacaatgcacctgttctttcaaatgggtacaatgaggaggaaatgaaattagtaaaagagaccaggaaaatctggaatgacactagtgtcaaagtgacagccacttgtatacgtgttcctgtgatgcgtgcacatgctgagagtgtgaaccttcaatttgagaagccccttgatgaggacacagctagggatattctgaaaaatgctcctggagtggtggttattgatgaccgggcatccaatcactttcctacaccattagaagtttcaaacaaagataatgtagcagttggcagaatacgcagggatgtgtcccaagatggagactatgggttagacatctttgtttgtggtgatcaaatacgcaagggagctgctctaaatgctgtccagattgcagagatgttgctatagttcagtttctgtactaatgccctcgtgttagaatagttattaacccttggagttgaagaaatgaccatctttgcaacataaacagttaggtatactaatatttggttgcattgatctttttcaagggcttggcttttttataattattttttaaaattttagttttgttacaatcttgagagttctgaataattaaccctttttgagtgttaacatctaatgagtggtgtgtggaagttggtgtctctcaaaatatgtatcaagtcattgcaaatcagtaaccattgcaaggccttcttgtactacctttaagatcaataataattttaaggacaaa

SEQ ID NO: 8062 - DNA, 1463 bp, Arnica chamissonis
aaacatgcaatctccggccgtcgctcaccgccacttcttcgatggcgccgccgccgcttcttcctcctcccccctcctccgtctcaaacctactccttctgtatccagccccttttcagttcgtatgtcactacgtgaggacgcaccatcgattgctgtcgtcggcgtcaccggcgccgtcggccaggaatttctatcagtcctctccgatcgttcgttcccctacagatccataaaaatgctcgctagcaaacgctccgccggaaagaaatacacattcgaagataacgaatacgtcgtcgaggagctaaccgctgacagcttcagagacgttgacattgctttgttcagcgccggtggttctattagcaaggaattcggacctatagctgcgagttttgggaccgttgtggtggataacagctctgcttttcgtatggatgatggagttccgttggtgattccggaagttaatccggatgcgatgtcgcatattaacttggggacggggaaaggtgctttgattgctaaccctaattgctctaccatcatttgtttgatggctgctactcctcttcatcgacgtgcaaaggtattgcgtatggtggttagcacataccaggcagctagtggtgctggtgctgcagctatggaagagcttgaactgcagactcgtgaggtgcttgaagggaaacggccaacttgtaatatcttcaaacaacagtatgcttttaatctattctcacataatgcaccagttctcccaaatggatataatgaggaggaaatgaaattagtaaaagagaccaggaaaatctggaatgacaagggcgtcaaagtgaccgccacatgtatacgggttccagttatgcgggcccatgccgagagtgtgaacctacaatttgcaagcccgcttgatgagaacgaagcaagggacattttgaagaaagctcctggtgtagttgttattgatgatcgggctagcaatcactttcctactcctttggaagtttcaaacaaagatgacgtggctgttggcaggatccgtcaagacgagtctcaagatggaaattatggattggatatctttgtttgtggcgaccaaatacgcaagggggctgctcttaatgctgtccagattgcagagatgttgctgtaacaaagatgtttgtttcatttatccagttgcaggtaagctaagatgaaagaaccaaagaagatgttgaatttagctgttgaagacgacacacattcttacgattaccagtaaccatgcatgtgtaaatgaactttatcacatttttgatgatggaattggctaggttaacgaattaggctgcgagttatgttgtgagtttgaggtaaagacttggttcaaaaggatcttgatgtcacaataagattgtagaagcgtcttttaatattggtgtggatcattagtttgtcttcaagatttagaattt

SEQ ID NO: 8063 - DNA, 1659 bp, Glycine max
gtaaaatctgtgtaagacaagtttttctgaaagcaacaaatagaaaaagaggttgggacatggaatagaaattggattctggcctcctccctctgttttaaaatccatcagcagccgccaactctctcaataaaacctgctttctatttttctcaacctaaaatcccatccaccaaccttatgatgatgtcttcactctctgtttcgcgccacaaccacctcttctcgggccctctcccggcccggcccaagcccaagcccagcttttcctcttccaggatccgaatgtccctccaagaaaacggcccctccatcgccgtcgtgggcgtcaccggcgccgtcggccaggagttcctctccgtcctctccgaccgcgacttcccctacagctccatcaaaatgctcgcgtccaagcgctccgctgggcgccgcatcacctttgaggacagggactacgtcgtggaggagctgacggcggagagcttcgatggcgtcgacatcgcgctcttcagcgccggcggctccattagcaagtacttcggccccatcgccgtcgatcggggaacggtggtcgtcgacaacagctccgcgtttcggatggacgagaatgtcccattggtaattcccgaagtgaacccggaagcaatgcaaaacatcaaagccggaactggaaagggcgcactcattgctaaccctaattgctccaccattatatgcttgatggctgctacccctcttcatcgacgtgccaaggtgttacgtatggttgttagtacctatcaggctgctagtggtgcgggtgctgctgcaatggaagagcttcagctgcaaactcgtgaggtgttggaaggaaaaccgcccacttgtaaaatatttaaccgacagtatgcttttaatctattctcgcataatgcgtctgttctttcaaatggatataatgaagaagaaatgaaaatggtcaaggagaccaggaaaatctggaataataaggacgttaaagtaactgccacatgcatacgagttcctgtcatgcgagctcatgctgagagtgtgaatcttcaatttgaaacaccccttgatgaggacactgcaagagatattctgaagaatgctccaggtgtagtggttattgatgatcgtgaatccaatcattttcctactccattggaagtttcaaacaaggatgatgttgctgttggtaggattcgccaggacctatctcaggatgggaaccaagggttggacatctttgtatgtggggatcaaattcgcaagggagctgcacttaacgcaatccagattgctgagatgttgctatgagatctggtttttaaaggatgtggtacttgaagactatgcttcttttgaaacagttttgtatcttctagttgtatgaggttattcatttcttttgtgagaaagtacgaggatcttttcaacgatgtggtagcacactaactggaaacagtttttttaaggttttgtgcttaatttctgtaatccttatcaccgggaataacaataattggttatggcaaaggagaatcacctaatgtttcatcttttgaataaagaatttgttcaccagttttctatgatgttactttatttttcacttagaaagacaccacctgccacctaatcaaaacttgcaaatcc

SEQ ID NO: 8064 - DNA, 1619 bp, Glycine max
aggtaaaatctgtgtaagacaagtttttctgaaagcaacaaatagaaaaagaggttgggacatggaatagaaattggattctggcctcctccctctgttttaaaatccatcagcagccgccaactctctcaataaaacctgctttctatttttctcaacctaaaatcccatccaccaaccttatgatgatgtcttcactctctgtttcgcgccacaaccacctcttctcgggccctctcccggcccggcccaagcccaagcccagcttttcctcttccaggatccgaatgtccctccaagaaaacggcccctccatcgccgtcgtgggcgtcaccggcgccgtcggccaggagttcctctccgtcctctccgaccgcgacttcccctacagctccatcaaaatgctcgcgtccaagcgctccgctgggcgccgcatcacctttgaggacagggactacgtcgtggaggagctgacggcggagagcttcgatggcgtcgacatcgcgctcttcagcgccggcggctccattagcaagtacttcggccccatcgccgtcgatcggggaacggtggtcgtcgacaacagctccgcgtttcggatggacgagaatgtcccattggtaattcccgaagtgaacccggaagcaatgcaaaacatcaaagccggaactggaaagggcgcactcattgctaaccctaattgctccaccattatatgcttgatggctgctacccctcttcatcgacgtgccaaggtgttacgtatggttgttagtacctatcaggctgctagtggtgcgggtgctgctgcaatggaagagcttcagctgcaaactcgtgaggtgttggaaggaaaaccgcccacttgtaaaatatttaaccgacagtatgcttttaatctattctcgcataatgcgtctgttctttcaaatggatataatgaagaagaaatgaaaatggtcaaggagaccaggaaaatctggaataataaggacgttaaagtaactgccacatgcatacgagttcctgtcatgcgagctcatgctgagagtgtgaatcttcaatttgaaacaccccttgatgaggacactgcaagagatattctgaagaatgctccaggtgtagtggttattgatgatcgtgaatccaatcattttcctactccattggaagtttcaaacaaggatgatgttgctgttggtaggattcgccaggacctatctcaggatgggaaccaagggttggacatctttgtatgtggggatcaaattcgcaagggagctgcacttaacgcaatccagattgctgagatgttgctatgagatctggtttttaaaggatgtggtacttgaagactatgcttcttttgaaacagttttgtatcttctagttgtatgaggttattcatttcttttgtgagaaagtacgaggatcttttcaacgatgtggtagcacactaactggaaacagtttttttaaggttttgtgcttaatttctgtaatccttatcaccgggaataacaataattggttatggcaaaggagaatcacctaatgtttcatcttttgaataaagaatttgttcaccagttttctatgatgttactttatttttcact

SEQ ID NO: 8065 - DNA, 1931 bp, Panax ginseng
aagcagtggtatcaacgcagagtacatgggggcctgtattctgttcatctcaaaaaccctaccaaccaaaccaccgcccctcttctctctcaattattttaaaaacttcaaacttgagctgctctgcaacatccgccgcctactgcaactcaaaaaactccatttctctctctaaaacacttatcaaacactttcctcaataatgaattcccccgccctagcccaccaccaattccttcacggcggcggcggcgccaccttctctctcctccatcccaaaccatattttcccaccaccaccacctcctctcccttcaccgtctccatgtcactcagggaagacgctccgtcattggccgtagtgggcgtaaccggcgccgtaggccaagaattcctctccgtcctctctgaccgctccttcccttaccgttccatcaaaatgctcgcttccaagcgatccgccggtaaaaaattcatctttgaagacaatgattatgtcgtggaagagctgactcccgattccttctccggcgttgatattgccctgttcagcgctggcggctccattagtaagcagttgggtcctatcgcggcggattgcggaactattgtagtggataacagctctgcgtttcgtatggatgagaacgttcctcttgtgattccagaagtgaatccggatgcaatgtcgggtataaagtggggatccgggaagggggctataattgcaaaccctaattgttccactataatatgtttgatggccgccacacctcttcatcgaagagccaaggtagtacgcatggttgttagcacataccaggcggctagtggtgctggtgctgctgcaatggaggagcttgagcagcagactcgtgaggtcctcgaaggaaaacaaccaacttgtaaaatcttcaagcggcagtatgcctttaatcttttctcacacaatgcacctgttctttcgaatgggtacaatgaggaggaaatgaaattagtaaaagagaccaggaaaatctggaatgacactagtgtcaaagtgacagccacttgtatacgtgttcctgtgatgcgtgcacatgctgagagtgtgaaccttcaatttgagaagccccttgatgaggacacagctagggatattctgaaaaatgctcctggagtggtggttattgatgaccgggcatccaatcactttcctacaccattagaagtttcaaacaaagataatgtagcagttggcagaatacgcagggatgtgtcccaagatggagactatgggttggacatctttgtttgtggtgatcaaatacgtaagggagctgctctaaatgctgtccagattgcagagatgttgctatagttcggtttctgtactaatgcccttatgttagaatagttattaacccttggagttgaagaaatgaccatctttgcaacataaacagttaggcatactaatatttggttgcaatgatcattttcaagggcttgactttttttataattaatttttttaaaattttagttttgttacaatcttgagagttctgaataattatccctttttgagtgttatgttgcatggaacatctaatgagtgatgtgtggaagttggtgtctctcaaaatatgtataaagtcattgcaaatcagtaacccatttggtattacctttcctttaagatacaattaattttaatgttaccatgcactagtggctagtacttctaaaagaaaaaaaaaacaaaaaaaaaaaaaaaaaaaaaaagaaaaaaaaaaaaaaaaaaagaaaaaaaaaaaaaaaaagaaaaaaaaaaaaataaaaaaaaaaaagaaaaaaaaaaaaacaaaaaaaaagtaaaaaaaaacaaaaaaagaaaaagtaaaacgaaaacgtaaagaaacgtaagaaacgaacgtaagaagacaaag

SEQ ID NO: 8066 - DNA, 1905 bp, Glycine max
tgttggagttccttcttcgaagtcggaaaccactagtgtaaagacacaacaaccataatttcggatttgttaatattataaggcttgtatatgcatagagagtaagcttttaataatccgttggaagtgaacgagacactgattgaagaacaaagtagatatgcagatgtaccttgcccacatgttattaataacaatgaggctgatacgatgggaaaggataaaacttatgtccctaggccaagtttattgggaagaaatttaacgatgcaatcctaattttttatttttgttacctgattccactcttttttagatactagttatttcataattaaaatgtatataatttaatgctctaagtctaagtcgttgtttttgaaaccaacaagtagaaaaaaaggttgggacatggaattggaagacaagttggagtgtggtggtctgttttaaaatccaacacttaatctctctcttcgcagcctaaaatcccaatggcttcactctctgttttgcgccacaaccacctcttctcgggccccctcccggcccgccccaagcccacctcctcctcctcctccaggatccgaatgtccctccgcgagaacggcccctccatcgccgtcgtgggcgtcaccggcgccgtcggccaggagttcctctccgtcctctccgaccgcgacttcccctaccgctccattcatatgctggcttccaagcgctccgctggccgccgcatcaccttcgaggacagggactacgtcgtccaggagctcacgccggagagcttcgacggtgtcgacatcgcgctcttcagcgccggcggctccatcagcaagcacttcggccccatcgccgtcaatcgtggaacggtcgtggtcgacaacagctccgcgtttcggatggacgagaaggtgcctttggtaattcccgaagtgaaccccgaagcaatgcaaaacatcaaagccggaacgggaaagggcgcactcattgctaaccctaattgctccaccattatatgcttgatggctgctacccctcttcatcgacgtgccaaggtgttacgtatggttgttagtacctatcaggctgcgagtggtgctggtgctgctgcaatggaagagcttgagctgcaaactcgtgaggtgttggaaggaaaaccacccacttgtaaaatatttaaccgacagtatgcttttaatctattctcacataatgcgtctgttctttcaaatggatataatgaagaagaaatgaaaatggtcaaggagaccaggaaaatctggaatgacaaggatgttaaagtaactgccacatgcatacgagttcccatcatgcgagctcatgctgagagtgtgaatcttcaatttgaaagaccccttgatgaggacactgcaagagatattctgaaaaatgctccaggtgtagtggttattgatgatcgtgaatccaatcattttcctactccactggaagtgtcaaacaaggatgatgttgctgttggtaggattcggcaggacctgtctcaggatgggaatcaagggttggacatctttgtatgtggggatcaaattcgcaagggagctgcacttaacgcaatccagattgctgagatgttgctatgagttctggtttttcaaggatctggtacttaaagattatgcttcttttgaaacagttttgtatgtgctagttgtatgtggttattcatttcttttgtgatgtttaactagtccaagtatcttttcaacgatgtggtagcacactagctggaaacagtttttttaaggtcttggtgcgtaatatctgcaatccttttcaccgggaataacaagcactggttatggcaaaggagagtaacctaatgtttaatcttttgaataaagaatttgttgagcagtttta

SEQ ID NO: 8067 - DNA, 1463 bp, Arabidopsis thaliana
gcttttttctatcagccgcctccaaaatctctctatctctctgtctctcacttcttcttcctcacggcggcgacaatggcgacgttcactcatcaaaccccacaaacccatttcctctctcgccttcctctcagagctaaacctagacacttctccgcaagagtcaaaatgtctctccaagaatctgcgccttcactcgccgtcgttggcgttaccggagccgtcggacaagaattcctctccgtcttatccgatcgagacttcccttatagctccatcaagatgcttgcatcgaaacgctccgcagggaagcgtgttgccttcgatggccatgaatacacggtggaggagctcacggcggatagcttcaacggtgtagacatagctttgttcagtgctggtggatccataagcaaagagtttggtcctctggcggcggagaaaggaaccattgttgttgataatagctcggcttttagaatggttgatggagttccgcttgtgattcctgaagtgaatccagaagcaatgaaagggatcaaagttggaatgggcaaaggggctttgattgcaaaccctaattgctccaccattatctgtttgatggctgttacgcctcttcatcatcacgcaaaggtgaagagaatggtggttagtacatatcaagcagctagtggtgctggtgctgcagctatggaagagcttgttcagcagactcgtgaggttttagagggtaaacctccgacttgtaacatcttcgggcagcagtatgcatttaacttgttttcacataatgctcctattcttgacaacggttacaacgaagaggaaatgaaacttgtgaaggagacaaggaagatctggaatgacacagaagtaaaagtaacagcaacgtgtatacgtgttccagttatgcgtgctcatgcagagagtgtgaatcttcagtttgagaatcctcttgatgagaacacagcaagggagatactgaagaaagcacctggagtttatataatagatgaccgtgcttcaaatactttccctactccactcgatgtctctaacaaagacgatgtagcggttggtaggataaggcgagacgtgtctcaagatggcaatttcgggctggacatattcgtttgtggagaccaaatacgcaaaggagctgctctgaatgctgttcagatcgctgagatgcttctctgaatttgaacccgctctcactttgcttcttatgaaattcttgacaaagagatcactgtattattagatttgagccaagaatttgtctcattttttgttctgtgagttttctattttgaccaattttgttactttgattcataaagttgtctcttaaatctgaactcatcatgcacacgcttgaacctcttggcaattttccggttcgaatctgtaccgacttggttgatctcaccgaagacaaccgggctccacaattattt

SEQ ID NO: 8068 - DNA, 1422 bp, Phaseolus vulgaris
tccttagttacttaccactcatcacagccgccaaataacaaccctaccaacgccaccaccgtcatggcttcactctccgtttcgcgccacagccacctcttatcgggcttccttccggcccggcccaagcccacctcggggcccaccagggtccgaatgtccctccgcgatgacggccccgccatcgccgtcgtcggcgtcaccggcgccgttggccaggagttcctctccgtcctctccgaccgcgacttcccctaccgttccatcaaaatgctggcctcgcagcgctccgccggccgccgcatcgtcttcgaggacatggactacgtcgtggaggagctcacggcggatagcttcgacggcgtcgacatcgcgctcttcagcgccggcggctccatcagcaagaagttcggccccgccgcggtggatcggggtacggtggtggtagacaatagctccgcgtttcggatggacgagaaggtgccgctggttattcccgaagtgaaccccgaagcgatgcaacacatcaaagccggaacgggaaaaggcgctctcattgcgaaccctaattgctccaccattatttgcttgatggccgctacccctcttcatcgacgagctaaggtgttacgaatggttgtgagtacctatcaggctgcgagtggtgctggtgctgctgcaatggaagagctcgagctgcaaactcgtgaggtgttggaaggaaaaccacccacttgtaaaatatttaatcgacagtatgcttttaacatattctcgcataatgcacctgttctttcaaatggatataacgaagaagaaatgaaaatggttaaggagacaaggaaaatatggaatgacaaggatgttaaagtaactgccacatgcatacgagttcctgtcatgcgggctcatgctgagagtgtgaatcttcaatttgaaaatccacttgatgagaacactgcaagagatatcctgaagaatgctccaggtgtggtggttattgatgatcgtgaggccaatagttttcctactccattggaagtgtcaaataaggatgatgttgctgttggtaggattcggcaggacctgtctcaggatgggaatcaagggttggacatatttatatgtggggatcaaattcgcaagggagctgcacttaacgcaatccagattgctgagatgttgctttgacttctacttcgtcaaacagttttgtatctgctagttttatgagcttattaatttctttttcgagatttaactagtccaaggatatttcaacaatgtagctggaaacaaatttcttaaggtcttcgtgcgtaatttatgtaatccttttcaggcaacaagcatgggttatgacaatcatctaatgtttgatcttttgaataaagaatttgatgaccagttttatttagtgtt

SEQ ID NO: 8069 - DNA, 1444 bp, Phaseolus vulgaris
cacaacacttagttgagtgtgttccttagttacttaccactcatcacagccgccaaataacaaccctaccaacgccaccaccgtcatggcttcactctccgtttcgcgccacagccacctcttatcgggcttccttccggcccggcccaagcccacctcggggcccaccagggtccgaatgtccctccgcgatgacggccccgccatcgccgtcgtcggcgtcaccggcgccgttggccaggagttcctctccgtcctctccgaccgcgacttcccctaccgttccatcaaaatgctggcctcgcagcgctccgccggccgccgcatcgtcttcgaggacatggactacgtcgtggaggagctcacggcggatagcttcgacggcgtcgacatcgcgctcttcagcgccggcggctccatcagcaagaagttcggccccgccgcggtggatcggggtacggtggtggtagacaatagctccgcgtttcggatggacgagaaggtgccgctggttattcccgaagtgaaccccgaagcgatgcaacacatcaaagccggaacgggaaaaggcgctctcattgcgaaccctaattgctccaccattatttgcttgatggccgctacccctcttcatcgacgagctaaggtgttacgaatggttgtgagtacctatcaggctgcgagtggtgctggtgctgctgcaatggaagagctcgagctgcaaactcgtgaggtgttggaaggaaaaccacccacttgtaaaatatttaatcgacagtatgcttttaacatattctcgcataatgcacctgttctttcaaatggatataacgaagaagaaatgaaaatggttaaggagacaaggaaaatatggaatgacaaggatgttaaagtaactgccacatgcatacgagttcctgtcatgcgggctcatgctgagagtgtgaatcttcaatttgaaaatccacttgatgagaacactgcaagagatatcctgaagaatgctccaggtgtggtggttattgatgatcgtgaggccaatagttttcctactccattggaagtgtcaaataaggatgatgttgctgttggtaggattcggcaggacctgtctcaggatgggaatcaagggttggacatatttatatgtggggatcaaattcgcaagggagctgcacttaacgcaatccagattgctgagatgttgctttgacttctacttcgtcaaacagttttgtatctgctagttttatgagcttattaatttctttttcgagatttaactagtccaaggatatttcaacaatgtagctggaaacaaatttcttaaggtcttcgtgcgtaatttatgtaatccttttcaggcaacaagcatgggttatgacaatcatctaatgtttgatcttttgaataaagaatttgatgaccagttttatttagtgtt

SEQ ID NO: 8070 - DNA, 1405 bp, Lippia dulcis
ctttcacttttgctgaccgccgccgctggtactctattctgaattctcaaccctacgcacaccaaccgccgcccattcgccgccgccgggcagaatgaagctgccgacactctcctcccaccaccaccaccaccaccttgccaatccgttcctccacaagccgaccgcctgcgcggtttcccgctcaactcgcgtgtctaatggccgcttcgccgttcgaatgtcgctcaaggaggatgggccctccgtcgccatcgtcggagtgaccggcgccgtcggtcaggagtttctctccgttctctccgatcgagacttcccttaccgatctctcaaactacttgcctccaaacgctcctctggaaagacgctcaattatgaagaccggagctacaccgtcgaggaattgacggagaacagcttcgatgatgttgacattgctctgttcagcgccggggggagtataagcaagaaatttgggcctattgccgtggaaaagggtaccatcgttgtggataatagctccgcgtttaggatggacgaagggattccgcttgtgataccggaggtgaatcctgaggcgatggaaggtattaagatcaagagcgggaagggggcgcttattgcaaatccaaattgctccaccattatttgcctcatggccgccaccccattgcatcgccgtgccaaggtgacgcgtatggttgtcagtacataccaggcggctagtggcgccggtgctgcagcaatggcagagctcgaattgcagactcgtgaggttctggaagggaaagagcctacttgtgaaatcttcaagcagcagtatgcctttaacttgttctcacataatgcgccgatcgtttcaaatggatacaatgaagaggagatgaaattagttaaagagacaagaaagatttggagtgataagaatgttaaagttactgcaacctgtataagagtacctgttatgcgtgcacatgccgagagcgttaatcttcaatttgagacacctttagatgaggacacagcaagggagattcttaaaaacgccccaggtgtagtggttatcgatgaccgctcggccaaccgcttcccgaccccattacaagtctctaataaagatgacgttgccgttggaagaatacgccaagatgtttcccagggcgggaactacgggttggatatcttcgtttgtggagatcaaatacgcaaaggcgctgctcttaatgctatccagattgctgagatgttgctatagatttgaaggcctgaggtattatttatggttaggtatgttggttgatatcagttttggattttcctttgaatgcggagtagtttcacctttggagggaccaaacctcacatattctgtagcttgttgccttatatttttacttctaatcca

SEQ ID NO: 8071 - DNA, 1550 bp, Cajanus cajan
aaagttaaaaccctttctttctgtctgtggttgtttccattcctcagtcctcaccctaaacccaccctcacccaagtaagtccatggcttcactctctgtttcgcgccacaaccatctattctcgggccctctcccggcccgcttcaggcccaccctctctgggcccaccaggatccgaatgtccctacgggagaacggcccctccatcgcggtggtcggtgtcaccggcgctgtcggccaggagttcctctcggtgctctccgaccgcgacttcccctaccgctccatcaaaatgctggcgtcgaagcgttccgccggccgccgcatcaccttcgagggcaggaaccacgtcgtggaggagctcacggcggagagcttcgacggcgtcgacatcgcgctcttcagcgccggcggctccatcagcagggagttcggccccgtcgcggtggatcgggggacggtggtggtggacaacagctcggcgtttcggatggacgagaaggtgccattggtgattcccgaggtgaatcctgaagccatgcacaatatcaaagctggaatgggaaagggcgcactcattgctaaccctaattgctccaccattatttgcttgatggctgctacccctcttcatcgacgagctaaggtgttacgtatggttgttagcacctatcaagctgccagtggtgctggtgctgctgcaatggaggagcttgagctgcaaactcgtgaggtgttggaagggaaacagccgacttgtaaaatatttaatcaacagtatgcttttaatctgttctcgcataatgcatctgttctttcgaatgggtataatgaagaagaaatgaaaatggtcaaggagacaaggaaaatctggaatgacaatgacgttaaagtaaccgccacatgcatacgagttcctgtcatgcgggctcatgctgaaagtgtcaatcttcaatttgaaagaccccttgatgaggatactgcaagagatattttgaagaatgctccaggtgtagtggttattgatgatcgtcaatccaatcattttcctactccattggaagtgtcaaacaaagatgatgttgctgttggtaggattcgccgtgacctgtctcaggatgggaataaagggttggacatctttgtatgcggggatcaaattcgtaagggtgctgcacttaacgcaatccagattgctgagatgttgctatgagttctgatctttcaatgatgtagtacttaaaagattatgcttcttttgaatcagttttgtatctgttagttgtatgaggttattcatttcttttgtgagatttaactagtccaaggatcttttcaacgttgtggtagtacactaggtggaaacaatttttttgggtcttccgtaatgtaatccttttccttgggaataataagcattggttatggcaaaggagaatcacctatttgatcttttgaatgaagaaattgttaactatttttatttaatgatactctatttctgacttagaaagataccgcctgccacctaatcaaaacttgcaattcc

SEQ ID NO: 8072 - DNA, 2125 bp, Mimulus guttatus
atgattgtcagatcgagcttgtcatacggttatggggatgaaaccctgatgagattcttgaaagcaagatcgaaagatccaataaagggagcaaaaatgtttgttgaatggcgaaaatggagggatgaatttgtgccacaaaattgcattcttgattgtgaagttgaagatgaactaagtgctgagaaaatatatttgcaggggctatcaagaaaaggtttcccagttatgattgtcaaaggcaacaagcatttcccttccaaggatcaacttcaattcaagaaatttgtggttcatctgctcgacaagactattgcaagttcttttcaaggcaaagaaataggaaacgagaaattgataggcattcttgatctgcaacaactgtcctacaaaaacgtcgatgctcgtggtttaatcaccggttttcagttcttgcaatcgtattaccccgagcggttagccaagtgttacattgtacacatgcctggatttttcgtgcgcgtttggagattagtgtcgcgtttccttgacaaagctactattgagaaggttgtgatagtgacgaatgaagaggaacaaaaagaactcgttagagatatcggtgaagaagccctgccagaaatttacggtgggaaagccaaactcgtgcctattcaagatgtcgagttaaagccctcccaacactctccctcaaccaccaccaccaccacctcaccacgcctttcctccacaatgccaccactttctccccttcccgctccagccgcatctccaacggcggcccgttcgcagtccgcatgtccctcaaggaagacggcccctccgtcgccatcgtcggagtcaccggcgccgtcggccaggagttcctctccgtgctcaccgaccgcgatttcccctaccgatccctcaagctactcgcctccaaacgatccgccggaaaaaccctcacctacgaaaatcgagactacaccgtcgaggaattgacggaaagcagcttcgacgatgttgacattgccctattcagcgccggcgggagcataagcaagaagtttgggcctatagccgtcgacaagggcacaattgtggtcgacaatagctcggcttttaggatggatgacgggattccgctcgtgatacctgaagtcaatcccgaggccatggccggaatcaagctcaattccgggaagggcgcgcttatcgccaatccgaattgctcgacaattatctgcctcatggctgccacgccactgcatcgccgtgccaaagttacgcgcatggtcgtcagtacataccaggcagccagtggtgcaggtgccgcagcaatggaagagcttgaactgcaaactcgtgaagtcttggaaggaaaaaagccgacctgtcaaatctttaaccagcagtatgcttttaacttgttttcacataacgcacctgtcctgtcaaatggttacaatgaagaggagatgaaattagttaaagagacgagaaaaatatggaatgataagaatgtcaaagttactgccacctgtattagagtacctgtcatgcgtgctcatgccgagagtgtgaatcttcagttcgagacacctttagacgaggctgcggcaagagagattttgagcaaagctccgggagtagtagttattgatgaccgtgcagcaaacaaattcccgaccccattagaagtttctaataaagacgatgttgctgttggaagaatcaggcaagatgtttcccaagatggcaactatgggttggacatatttgtatgtggcgatcaaatacgcaagggtgctgctcttaatgccatccagattgccgagttgttgctatagatttgaaaaacctccgatttattcggtcaaatatttacggtgagatgctgatttttcgattttggatttcgattttggttgttttacagcttgctgtcttttttttatttcccttttttttctgcgattttttgtattttgattaaataagtatatttgttttgtttttgtagcttggttaagtcatatttcatctgtcttaaatcttattttggagtaatcttgccaatttcgtggtttttttttttttcctaatatcaagtggaaaataaaaacacattgttttggccatt

SEQ ID NO: 8073 - DNA, 1886 bp, Lactuca sativa
gtgattttccccattttcagtccaaaccctatcagcatttagccgcctcttttctcgctctcggttggaaattcttctcttcatttctccggtcatttactttggcaaaaatgcagtctgcagccgtcgctcaccgccacttcctcgatggtggcgccgccgcctcctccttccccctttcccatttcaaacctactccttctacggccagcccattctcagttcgtatgtcactacgcgaggacgccccatcccttgccgtcgtcggcgtcaccggtgccgtcggccaggaatttctctccgtcctctccgaccgttccttcccctaccgatccataaagatgcttgctagcaaacgctccgccggaaagaaatacacctttgaagacaatgaatatgtagtcgaagagttaaccgctgacagctttaaagacgttgacattgcgttgttcagcgccggtggttcaattagcaaggagtttggacctattgctgcgaattgtggatcggttgtggtggataatagctctgcttttcgtatggacgacggcgttccattggtgattccggaagtcaacccggatgcaatggcgcatattaaactagggtctggtaaaggggctttgattgcaaaccctaattgctctaccattatatgcttgatggctgccactcctcttcatcgacgagcaaaggtattgcgtatggtggttagcacataccaggctgctagtggtgctggtgctgcggccatggaagagcttgaactgcagactcgtgaggtgctcgaaggaaaacgacccacttgcaaaatcttcaaacagcagtatgctttcaatctattctcacacaacgcaccagttctaccaaatggatacaacgaggaagaaatgaaattagtcaaagaaacaagaaaaatctggaatgataaagacatcaaagtaacagccacttgtatacgagttcctgtgatgcgtgcacatgctgaaagtgtaaacctgcaattcgcaagcccccttgatgagaatgaagcaagagatattttaaagaaagctcctggtgtagttgtgattgatgatagagctagcaatcacttccctactcctttggaagtttctaataaagatgatgttgcagtaggcagaatccgtagggatgagtctcaagatggaaattatgggttggatatttttgtttgtggggatcaaatacgtaagggggctgctctgaatgctgttcagattgcagagttgttgctataaaccaagatgtttcctttatccaggtgacttaagatgaaaaattgttaaaggagacacaaataagatgttgattttggtttttttgaagagagatggatagattcttttgaatatgttgtcaccactttgcgattagtttacatgcatgttcctttattgcaagttttgatgtagatttaagttagttgaagatgtggagttggggttaaaaggattatgaataaagtggtgttgtgatgagattgtataattgttgtttttcattggtcatggatcatttgtgttgttaaattttggtacttttatcgagacatgtcaattcgttattcccacgcccttaaccaatcgacaataggagattcactagagcgatgcaaattctgagttgtcttttggcagtataaatcgcaattcaacagctctgatctcctctcacaactttggtctgtggtctacattttgttttttctataaatcttgttatatttgttcttgtcttctctctacaaatctggttaatggaggcaattttcgattgttgtaagttatttcttttttagttatgtgagctctatggagtgtaatcaatttttgttatttcttttaaatggttttgtaatttcc

SEQ ID NO: 8074 - DNA, 1537 bp, Medicago truncatula
gtcccaacatctctctctctctctctatagtcaagtaaaaaccctctctctctctctctctaaaaactctcactctaaacccacacgaatcaatcaatggcttcttcactctctctcttacgccaaaacacctttctctccgccaccctcccaactacccgacccaaacccaaatatgcatccgctccgggtcgtgtccgaatgtctctccaagaaaacgcacccaccatcgccgtcgttggagtcaccggcgccgtcggccaagagtttctctctgtcctctccgaccgcgacttcccatacagctccatcaaaatgctcgcatccaaacgctccgccggccgccgcatgaccttcgaagataaagagtacgtcgtggaggagctgacggcggagagtttcgacggcgtcgacattgctctcttcagtgctggtgggtcaatcagtaaagagtttggtccaattgctgtgaatcgtggaaccatagttgttgataatagctctgcgtttcgaatggatgagaatgttccgttggtgatacctgaagtgaatccagaagcaatggagaagattaaggttggaatgggaaaaggtgctctcattgctaatcctaattgttctactattatttgtttaatggctgctacccctcttcatcgacatgccaaggtgttgcgtatggttgttagtacctatcaggcggctagtggagctggtgctgctgcaatggaagagcttgagttgcagactcgtgaggtattggaaggaaaaccaccaacatgtaaaatatttaaccgacagtatgcttttaatttgttctcacacaatgcatctgttctttcgaacggatataatgaagaagaaatgaaactggtcaaggagacaaggaaaatttggaatgacaaggatgtcaaagtaactgctacatgtatacgagtacccgtcatgcgggctcatgcagagagtgtgaatcttcaattcgagagaccccttgatgaggacactgcaagagatattttgaagaattctccaggtgtagtggttattgatgaccgtgaatccaataattttcctactccattggaagtgtcaaataaggacgatgttgctgttggcaggattcgccgtgacctatctcaggatgggaatcaagggttagacatttttatatgtggggatcaaattcgcaagggagctgcacttaacgcaatccagattgctgagttgttgctatgagttctaatatgtcaaggtttcgctgagttggtacctccaagttatgctgcttttgaaacagttttgtatctcctagttggaagtagtagttctttggttttgtaaggtttagctagtcagaggaatttttcaaggatgtgataatacactcactagcttgaacacatttttgtcatggccttgattattttcacactttctgtaatccgctcctgtggaatgaataacaagcattggttatggcatgaaaatatcacccaatacattctccttgattgaggagcgagaatatatgaattca

SEQ ID NO: 8075 - DNA, 1515 bp, Medicago truncatula
tctctctctctctctctatagtcaagtaaaaaccctctctctctctctctctaaaaactctcactctaaacccacacgaatcaatcaatggcttcttcactctctctcttacgccaaaacacctttctctccgccaccctcccaactacccgacccaaacccaaatatgcatccgctccgggtcgtgtccgaatgtctctccaagaaaacgcacccaccatcgccgtcgttggagtcaccggcgccgtcggccaagagtttctctctgtcctctccgaccgcgacttcccatacagctccatcaaaatgctcgcatccaaacgctccgccggccgccgcatgaccttcgaagataaagagtacgtcgtggaggagctgacggcggagagtttcgacggcgtcgacattgctctcttcagtgctggtgggtcaatcagtaaagagtttggtccaattgctgtgaatcgtggaaccatagttgttgataatagctctgcgtttcgaatggatgagaatgttccgttggtgatacctgaagtgaatccagaagcaatggagaagattaaggttggaatgggaaaaggtgctctcattgctaatcctaattgttctactattatttgtttaatggctgctacccctcttcatcgacatgccaaggtgttgcgtatggttgttagtacctatcaggcggctagtggagctggtgctgctgcaatggaagagcttgagttgcagactcgtgaggtattggaaggaaaaccaccaacatgtaaaatatttaaccgacagtatgcttttaatttgttctcacacaatgcatctgttctttcgaacggatataatgaagaagaaatgaaactggtcaaggagacaaggaaaatttggaatgacaaggatgtcaaagtaactgctacatgtatacgagtacccgtcatgcgggctcatgcagagagtgtgaatcttcaattcgagagaccccttgatgaggacactgcaagagatattttgaagaattctccaggtgtagtggttattgatgaccgtgaatccaataattttcctactccattggaagtgtcaaataaggacgatgttgctgttggcaggattcgccgtgacctatctcaggatgggaatcaagggttagacatttttatatgtggggatcaaattcgcaagggagctgcacttaacgcaatccagattgctgagttgttgctatgagttctaatatgtcaaggtttcgctgagttggtacctccaagttatgctgcttttgaaacagttttgtatctcctagttggaagtagtagttctttggttttgtaaggtttagctagtcagaggaatttttcaaggatgtgataatacactcactagcttgaacacatttttgtcatggccttgattattttcacactttctgtaatccgctcctgtggaatgaataacaagcattggttatggcatgaaaatatcacccaatacattctccttgattgaggagcgaga

SEQ ID NO: 8076 - DNA, 1544 bp, Eutrema halophilum
aaggtctcggatcaaaaaagcctgctgtttttgtttttaaagatgcatattggaaaaatgatgaaaactctaaaatcccaaacttttgtctatcagagccgcctccaaaacctctctctctgtctctcacttcttcttcctcctcctcacgacggcgacaatggcgacgctcactcatcacactccacagacccatttcctctctaggcttcctctcagggctaaacccagagtcttctccacaagggtcaaaatgtctctccaggaatcagggccttctctcgccgtcgttggcgttaccggcgccgtaggacaagaattcctctcagtgttatccgatcgagatttcccttacagctccgtcaagatgctggcatcgaaacgctccgcagggaaacacgttgccttcgacggccgtgaatacacggtggaggagctcacggcggagagcttcgacggcgtcgacatcgccttgttcagtgccggcggatccataagcaaagagtttggtcccctcgcggcggagaaaggaaccatcgtcgttgacaatagctcggcgtttagaatggtggagggcgttccgcttgtgattccggaagtgaatcctgaggcgatgaaagggattaaagtcggaatggggaaaggtgcattgattgcgaatcctaattgctccaccattatctgcttgatggctgtaactcctcttcatcatcacgccaaggtgaagagaatggtggttagtacatatcaagcagctagtggtgcaggtgctgcagccatggaagagcttgtgcagcagactcgcgaggttttagcgggtagacctccgacttgtaacatctttgggcagcagtatgcattcaacttgttttcgcataatgctcctattactgacaatggttacaacgaagaggaaatgaaacttgtgaaagagacaaggaagatctggaatgacacagaagttaaagtaacagcgacgtgtatacgtgttcctgttatgcgtgctcatgcagagagtgtgaatctccagtttgagaatccccttgatgagaacacagcaagggagctcttgaagaaagcacctggagtttatattatagacgatcgctcttctaacaccttccctactccacttgatgtctctaacaaagacgatgttgcggttggtaggatcaggcgagacgtgtctcaagatggcaatttcgggctggatattttcgtttgtggagatcaaatacgcaaaggagctgctctaaacgctgttcagatcgctgagatgcttctctgatttcgaattcctcactttggcttcttctgattttgactagagagatcagtgtatcatcagatttgagccaagaatttgtctcatttttttttttttgtggggttttcctgtttccctatttgaccaattttgttacttctctctcattcaagaaagttgtctctgaaacctgaatcatccccacgttttgaaccttgccgatttccggttcgaaccaataccggcttggttaatggaagatgcaatttatttaaat

SEQ ID NO: 8077 - DNA, 1543 bp, Eutrema halophilum
aaggtctcggatcaaaaaagcctgctgtttttgtttttaaagatgcatattggaaaaatgatgaaaactctaaaatcccaaacttttgtctatcagagccgcctccaaaacctctctctctgtctctcacttcttcttcctcctcctcacgacggcgacaatggcgacgctcactcatcacactccacagacccatttcctctctaggcttcctctcagggctaaacccagagtcttctccacaagggtcaaaatgtctctccaggaatcagggccttctctcgccgtcgttggcgttaccggcgccgtaggacaagaattcctctcagtgttatccgatcgagatttcccttacagctccgtcaagatgctggcatcgaaacgctccgcagggaaacacgttgccttcgacggccgtgaatacacggtggaggagctcacggcggagagcttcgacggcgtcgacatcgccttgttcagtgccggcggatccataagcaaagagtttggtcccctcgcggcggagaaaggaaccatcgtcgttgacaatagctcggcgtttagaatggtggagggcgttccgcttgtgattccggaagtgaatcctgaggcgatgaaagggattaaagtcggaatggggaaaggtgcattgattgcgaatcctaattgctccaccattatctgcttgatggctgtaactcctcttcatcatcacgccaaggtgaagagaatggtggttagtacatatcaagcagctagtggtgcaggtgctgcagccatggaagagcttgtgcagcagactcgcgaggttttagcgggtagacctccgacttgtaacatctttgggcagcagtatgcattcaacttgttttcgcataatgctcctattactgacaatggttacaacgaagaggaaatgaaacttgtgaaagagacaaggaagatctggaatgacacagaagttaaagtaacagcgacgtgtatacgtgttcctgttatgcgtgctcatgcagagagtgtgaatctccagtttgagaatccccttgatgagaacacagcaagggagctcttgaagaaagcacctggagtttatattatagacgatcgctcttctaacaccttccctactccacttgatgtctctaacaaagacgatgttgcggttggtaggatcaggcgagacgtgtctcaagatggcaatttcgggctggatattttcgtttgtggagatcaaatacgcaaaggagctgctctaaacgctgttcagatcgctgagatgcttctctgatttcgaattcctcactttggcttcttctgattttgactagagagatcagtgtatcatcagatttgagccaagaatttgtctcatttttttttttttgtggggttttcctgtttccctatttgaccaattttgttacttctctctcattcaagaaagttgtctctgaaacctgaatcatccccacgttttgaaccttgccgatttccggttcgaaccaataccggcttggttaatggaagatgcaatttatttaaa

SEQ ID NO: 8078 - DNA, 1626 bp, Panax ginseng
gtcttaaataccctacaactaataaaacatccctcaaaatgaattccgccgcattcacccgccaccaatttctcggcggcggcgccatcttctctctccaccaacccaaaccaactatttccaccaccaccacttcctccagtcacttcaccgtacgcatgtcactccgagaagacggtccctccttggccgtagccggagtaaccggcgccgtaggccaggaattcctctccgtcctctctgaccgctccttcccttaccgctccatcaaaatgctcgcttccaaacgctccgccggtaaaaaattcacctttgaagacaatgaatacgtcgtcgaagagcttactcccgactccttttccggcgttgacattgccctgttcagcgccggcggttccattagtaagcagtttggtcctattgctgccgatggtggaacaattgtagtggataatagctctgcatttcgtatggacgagaatgttccgcttgtgattccagaagtgaatccggatgcaatgtcgggtatcaagctggggtctgggaaaggggctctaattgcaaaccctaattgttctactataatatgtttgatggcggtcacgcctcttcatcgaagagccaaggttgtacgcatgattgttagcacataccaggcagctagtggtgctggtgcggctgcaatggaggagcttgagcagcagactcgtgaggtcctttacgggaaacagccaacttgtaaaatctttaagcggcagtatgcctttaatcttttctcacacaatgcacctgttctttcaaatgggtacaatgaggaggaaatgaaattagtaaaagagacgaggaaaatctggaatgacacaagtgtcaaagtaacagctacatgtatacgcgttccagttatgcgtgcacatgcagagagtgtcaaccttcaatttgagaaaccccttgatgaggacacagcaagggatattctgaagaatgcttctggagtggtggttattgatgagcgggcatccaatcactttcctacaccattagaggtttcaaacaaagatgatgttgcagttggcagaattcgcagggatgtgtctcaagatggaaactacgggttgaacatctttgtctgtggtgatcaaatacgcaagggagctgctctaaatgctgtccgaattgcagagatgttgctatagatcagtttctgttagccaagaagatctcattctgcaagatgatcatacggggatgatatcaattctagtgacatcatgttgtccatgttcagctacttattaacccttggagttgaagagaaagccacctgtagcataaaaaattagggtaactaaaattttggtgccattgatcattttcaagtgtttgatccaaagggttttttgtgtgaggttaaaatagctttgctttaatagtgggagaccttgtgaaaaatcatccgcttatggggttatttttgttgcgtgggccattcagtgagtgaagaatggaagttgtgtatttgtcaagatatgtatctgagactgtctttcagtgaactcttgaagcctttgcatgtatactgggtcgataattgtgatgttgttcagccatattctatagctgtacttt

SEQ ID NO: 8079 - DNA, 1463 bp, Lupinus angustifolius
cccctctctgtttctcacttctctccataaattcaaaaccactgttccattacacactttctctctctataaccgtttctctatcatggcctctctctctcttcaacacaacacccaccacttcctctctcgggccctccctacccagcccaagcccaagcccaccttcttcgtccgaatgtccctcaaagaaaccggcccctccatcgccgtcgtcggcgtcaccggtgccgtcggccaggagttcctctctgtcctctccgaccgcgacttcccttaccgctccatcaaaatgctcgcctccaagcgctccgccggccgccgcatcaccttcgaggacaacgactacgtcgtcgaggaactcacgccggagagcttcgccggcgtcgacattgcactgttcagcgccggcggttcaatcagcagggaattcggccctatcgctgttgaacgcggaactatcgttgttgataacagttcggcgtttcgtatggatgagaaggtgccgttggtgattccagaagtgaaccctgaagctatggcgaatattaaggttggaaaggggaaaggggctctcattgctaaccccaattgttccaccattatttgtttaatggctgctactcctcttcatagaagggccaaggtattgcgtatggttgttagtacatatcaggctgctagtggtgctggtgctgcagcaatggatgagctggagctgcaaactcgtgaggtattggaaggaaaaccaccaacttgtaaaatatttaaccaacagtatgcttttaatatattctcacataatgcatctgttcttccgaatggatataatgaagaagaaatgaaaatggtcaaggagacgaggaaaatctggaatgacaaggacgttaaagtaactgccacatgtatacgagttcccgtcatgcgtgctcacgctgagagtgtgaatcttcaatttgagagcccccttgatgaggatactgcaagagatattctgaagaatgctccaggagtagtggttattgatgaccgtgaatccaatcattttcctactccattggaagtgtcaaataaggatgatgttgctgttggcaggattcgccaggacttgtctcaggatggaaatcaagggttggacatatttatttgtggggatcaaattcgtaagggagctgcacttaatgcaatccagattgctgagatgttgctatgagttctgatatttgaaggatgtggtactaacggattatgcttcttttgaatcagttttgtatctgttagttagattgagcgagtttaagtttgtaggaaaaaaggaaatggaataatatttattgtttgtgcaatttagaggtgtgctttggggtaattaatgtaaggttgttgttgctttgtaaactgcatattggaggttcaaacactagaaataatatttgtttccaagggaatggttgctttatagg

SEQ ID NO: 8080 - DNA, 2280 bp, Glycine max
ttataaaaattaaaaaaatatcacttttaaactatagaaactaaaagataatcaaaatacaaattataaaaattaaaaaaaccacaaattataaggactaaaacatacaaattatgaaactataaaaattgaattactaattaaactaaaaaaataaaataaataacagaaatacaactactaactaccataaatataaatttaaaaccaaggcaaaaacattgaaccgttgtcacttgtccttgtggaggaaggaatggagggtggtgacgttgggcgctgggtgttggagttccttcttcgaagtcggaaaccactagtgtaaagacacaacaaccataatttcggatttgttaatattataaggcttgtatatgcatagagagtaagcttttaataatccgttggaagtgaacgagacactgattgaagaacaaagtagatatgcagatgtaccttgcccacatgttattaataacaatgaggctgatacgatgggaaaggataaaacttatgtccctaggccaagtttattgggaagaaatttaacgatgcaatcctaattttttatttttgttacctgattccactcttttttagatactagttatttcataattaaaatgtatataatttaatgctctaagtctaagtcgttgtttttgaaaccaacaagtagaaaaaaaggttgggacatggaattggaagacaagttggagtgtggtggtctgttttaaaatccaacacttaatctctctcttcgcagcctaaaatcccaatggcttcactctctgttttgcgccacaaccacctcttctcgggccccctcccggcccgccccaagcccacctcctcctcctcctccaggatccgaatgtccctccgcgagaacggcccctccatcgccgtcgtgggcgtcaccggcgccgtcggccaggagttcctctccgtcctctccgaccgcgacttcccctaccgctccattcatatgctggcttccaagcgctccgctggccgccgcatcaccttcgaggacagggactacgtcgtccaggagctcacgccggagagcttcgacggtgtcgacatcgcgctcttcagcgccggcggctccatcagcaagcacttcggccccatcgccgtcaatcgtggaacggtcgtggtcgacaacagctccgcgtttcggatggacgagaaggtgcctttggtaattcccgaagtgaaccccgaagcaatgcaaaacatcaaagccggaacgggaaagggcgcactcattgctaaccctaattgctccaccattatatgcttgatggctgctacccctcttcatcgacgtgccaaggtgttacgtatggttgttagtacctatcaggctgcgagtggtgctggtgctgctgcaatggaagagcttgagctgcaaactcgtgaggtgttggaaggaaaaccacccacttgtaaaatatttaaccgacagtatgcttttaatctattctcacataatgcgtctgttctttcaaagggatttaatgaagaagaaatgaaaatggtcaaggagaccaggaaaatctggaatgacaaggatgttaaagtaactgccacatgcatacgagttcccatcatgcgagctcatgctgagagtgtgaatcttcaatttgaaagaccccttgatgaggacactgcaagagatattctgaaaaatgctccaggtgtagtggttattgatgatcgtgaatccaatcattttcctactccactggaagtgtcaaacaaggatgatgttgctgttggtaggattcggcaggacctgtctcaggatgggaatcaagggttggacatctttgtatgtggggatcaaattcgcaagggagctgcacttaacgcaatccagattgctgagatgttgctatgagttctggtttttcaaggatctggtacttaaagattatgcttcttttgaaacagttttgtatgtgctagttgtatgtggttattcatttcttttgtgatgtttaactagtccaagtatcttttcaacgatgtggtagcacactagctggaaacagtttttttaaggtcttggtgcgtaatatctgcaatccttttcaccgggaataacaagcactggttatggcaaaggagagtaacctaatgtttaatcttttgaataaagaatttgttgagcagttttatatcaagttactttatttttcacttagaacgagaccacctgcctcccagggacggatccagaaatggggctagaattttttccctttcttt

SEQ ID NO: 8081 - DNA, 2307 bp, Eutrema parvulum
acatcaaaggctctctctttctctccctctttattatctgtgcccaagccctttgagttctgaggatctgattgccaagtatcatggaggaaagtcaagaacttgccttgacccagttgagaaaatcggtcgagaaactctcttcttccacagaggggtatgagaaacagacactgatgaggttcttggtggcaagatcaatggacccagacaaggcagcaaagatgtttgtagattggcaaaaatggagagcctccatggctcctacaaatgggatcccagactcagaagtgaaggatgagttggaattcagaaagatctgtctccaaggtccaaccaaatccggacaccctttggtgcttgtcataacctctaagcattttcctgctaaggatcaagttaaattcaagaagttcgttgtgtatgtgctagacaaaacaatcgcaagtggcatcaaaggcaaagaagtaggagatgagaagttagtagccgtaatcgatctggcaaacattacatacaagaaccttgatgctcgtggattaatcaccggctttcagttcttacaatcttactacccggaacgccttgcaaaatgctacatcttgcatatgcctggattctttgtgaccgtttggagattcgtctgccgttttctcgagaaagcaactcaagaaaagattgtgatagtaacggacggagaagaagagagaaacttcaaggaggagatcggagtagatgccttgccagaagaatatggtggtcgagctaagctcacatttatccaagatgttcctcttcctcagatggctccaggaatgttaacaacaaacaataatatttctaaatcccccaaactttgtttatcagccgcctccaaattttctctctgtttcttcttcttcttcctcctctcacgacggcgacaatggcgacgctcactcatcagaccccacacacccatttcctctctaggcttcctctcagggctaaacccagagccttctccgcaagggtcaaaatgtctctccaggaatctgctccttctctcgccgtcgtcggtgttaccggcgccgtcggacaggaattcctctccgtcttatccgatcgagattttccttacagctccgtcaagatgctggcatctaagcgctccgcagggaaacgcgttgccttcgatggccgggaatacacagtggaggagctcacagcggagagcttcaacggcgtcgacatcgccttgttcagtgccggtggatccataagcaaggagtttgggcctctagcggcggagaaaggaacaatcgtcgttgacaatagctcggcatttcgaatggttgagggcgttccgctggtgatcccagaagtgaatcctgaggcaatgaaagggattaaagtcggaacggggaaaggggcattgattgcgaaccctaattgctccaccattatctgcttgatggccgttacacctcttcatcatcacgccaaggtaaagaggatggtggttagtacatatcaagctgctagtggtgcaggtgctgcagccatggaagagcttgtgcagcagactcgcgaggttttagcgggtagacctccgacttgtaacatcttcgggcagcagtatgcgtttaacttgttttcgcataatgcccccattactgagaacggttacaacgaagaggaaatgaaacttgtgaaagagacaaggaagatctggaatgatacagaagtcaaaataacagcaacgtgtatccgtgttccagttatgcgtgctcatgcagagagtgtcaatatccagtttgagaatcccctcgatgagaacacagcaagggagctgttgaagaaagcacctggggtttatattatagacgaccgctcttctaacaccttccctactccacttgatgtctctaacaaagacgacgtcgcggttggtaggatcaggcgagacgtttctcaggatggcgattacgggctggacatattcgtttgtggagatcaaatacgcaaaggagctgctctaaatgctgttcagatcgctgagatgcttctctaaatttataacccctttacttggcttcttctgattcttgacaagagatcaccactgtattatcagaatcgagccaagaatttgtctcatttattttttgtttttgtgggtttcttctgattccctatttgaccaatttttgttactttttcattcatggcgttgtctctgaactctgaatcatccccacgcttgaacctttgccaaattctgggttcgaacccgtactggcttgttaaatggaagatgcaatttat

SEQ ID NO: 8082 - DNA, 1504 bp, Citrullus lanatus
aaaatggaaaaaggttgcaaatcctaaagcgcttgttgcagtttcttttgctattcagtgggtttaccggccgcctcagctccattgaagccttttcttctctctacaatggcggctctatcttcttcacgaacctccttcttcttctccactgcttctcctcaccctaaaccaaggcgcatctctaaagttgttcgtatggcatatcaggagaacggcccctctctcgccgttgtcggcgtcaccggcgccgtcggccaggaatttctctccgtcctttctgatcgggactttccttatcgctccatcaagatgctggcctccaagcgctctgctggaaagtccgttagcttccatggcgaagagcatattgtcgaggagctcaccgctgatagcttcgacggtgtggacattgctctcttcagcgctggaggatccatcagcaagcactttggaccgcttgccgttgagaagggaactattgtggttgacaatagctccgcatttcgaatggatgagaatgtgcctcttgttattccggaggttaatcctgaagctatgaaggggattaaggttgggaaaggcaagggcgctttgattgccaatcctaattgctcaaccatcatctgcttgatggccgtcactcctctgcatcgtcacgctaaggtgttacgcatggttgttagtacatatcaagcagctagtggtgctggtgctgcagcaatggaagagcttgtgcaacaaactcgtgaggtcctagaaggaaaaccaccaacttgtaatatatttagggatcagtatgctttcaatttgttctcccacaatgcatctgttctttcaaatggatacaatgaagaggaaatgaaattagtaaaagaaacccggaaaatatggagtgatgcaaatgttaaagttactgccacttgtatacgagttcctgttatgcgcgcacatgctgagagtgtgaatcttcaatttgagaatccccttgatgagaatgcagccagagagattttgaaaaatgctcctggagtcgtcattattgacgaccgggctgccaaccagtttccaacgccattgaaagtatcaaacaaagatgacattgctgttggaaggattcgacaggatgtttcacttgacggaaataaagggttggatatcttcatctgtggtgatcaaattcgcaagggtgcggcacttaatgctgttcagattgcagagttgttactgtagttcgatgacgccagaaaatcggtatattgctagacgaagtctttgttgttactatttatgaaatcataggatgtctcttgaggcgaaaattagtctctcggtcttggaatggattaacttagagcaaattttgcaggatggtcaattaaggttatgaatttgcatgatctctggtttgaaggaaaattttggaattgatgttgtaagttttttacgataagccagtttgatgctttgtttatgagttgttgatttaatgtgtgttagaaat

SEQ ID NO: 8083 - DNA, 1527 bp, Beta vulgaris
ctttgtctctcattctctctttccgccgccaccacaaaaatgacctccgccatgaacttcaccgtcaaacctcattccccttttctctccaccacaatccgccattctcaacactcctctttctctctcctctctttcccccgctcttctccttcctccatccgcatgtctctccgcgacgacggtccttccatcgccgtcgtcggcgtcaccggcgccgttggtcaagaattcctctccgtactctccgaccgcgactttccttaccgttctatcaagcttctcgcaagcaaacgctccgccggaaaacagatgtcgttcgaaggaaaaaattacgtcgttgaagaactcgacgctaatagctttgatggcgtcgacattgcgctttttagcgccggtggatcgattagtaaacagtttggacctttggctgttgaaaaaggaactattgttgttgataatagttctgcttttagaatggtggaggatgttcctcttgttattcctgaggttaatcctgaggctatggcgcatattaaggtttctaatcgaaaaggagctttgattgctaatcctaattgttctactattatttgcttgatggctgctactcctcttcatcgtcgtgctaaggttacgcgtatggttgtcagcacatatcaggcagctagtggtgctggtgctgctgcgatggaagaacttgagttccaaacgcgtgggttttggaaggcaagcctccaacttgtaacatttttaatcagcagtagcttttaatttgttctcccacaatgcaccaatagtttcaaatggatccaatgaagaggaaatgaaattagtaaaggaaaccaggaaaatttggaatgatattaatgtcagagttaccgctacatgtataagggttcctgttatgcgtgcacatgctgagagtgtaaaccttcaatttgagaatccccttgatgaggacactgcaagagagatcttggagcatgctcctggtgtggtggttatagatgatcgtgcatcaaatatctttccgacccccttgcaagtatccaacaaggatgatgttgctgttggcaggataaggcgtgatgtctctcaagatggagatactgggttggatatttttgtttgtggtgatcaaatacgcaagggagcagcacttaatgccgtccagattgccgagatgctgctatagatttgtttctgatggctgatcttgtatttttggtgctggggtgtacgtggtttgtaacagcagcttatattcccccccctcttttttctggaaagagttttgtgatttagcaatctgtatcatgctgatctgtacaatcgagtggtaattttgtttttcgaggtgaaataaggtgtctgtattcatttttgttttgcagtgtatctgggggactggtaacatcacacatgaaattgccatgggttcatgttgaaatctgttgcctgtgaagtgccctccccctcctttcgtaacacgcatatactgatatactaaagaaagttgcaaag

SEQ ID NO: 8084 - DNA, 1306 bp, Solanum phureja
cttatgtcactttcaacttacactatctgccttttatacacactgcactctctcttaaattctcttccatactactactacttttatctttcattcttatggcatcctctacacctgatcaagaacaacaacaaccatctcagcttcctccacttcactacagggtcatatccttttaatttatattaattactcttttcgactttccgttttgatatttttttatacttaatatatctgctttttatgtttttccagacatgggttttgaaagtttccatccactgtccaggctgcaagagaaaagtcaagaaagtcctgcaaagcattgaaggtgtttatacaacagatattgatccacagcaacagaaagttatagtgactggaaatgttgaagctgagactttgataaaaaaactgataagaaatggaagaaatgctgagttatggccagagccgaagccaatattaagagagaagaaaccaaagaaaaccgaaaacagcgacgacgacgatgatgatcatgaagatgatgaacataataataatgaaaaaccagctgaacatggtcctcaaagacatggtgtgagatttggcggggttgagacttttacgatggatgtcaaagaagtaaggccagatgaaaggccgccggagaatatcgccgtcgttgagaggttcccggcgccggagcaaaaggccgccggaggtgctaagaaaaagaagaaaaagaaaaagaagaagagtactgggaataacaatgcaaatccaaatgcgagtgcagggtctaatggtgcaccgccaagcagcgaatcagatgttgcaaaaatgggtcccaatcaaatgatggatcaaacgaatctaggccattcatttcagcatccttatcctaacccgtacgatcagcatccacatgctagttatcatgttcctcagcagcatcagagttatgttgtgagttacaatgcggcacatcctatggtaagcagtgcgccgccatattactatgttccatcgtcaccgtacatgcagtctgacatttattcaaagcaacaatctacaccgttggattcttttgagatcttgagtgatgaaaaccctcatgcttgctatatcatgtgatcaaagttgatgtggaattttgtatgtatattaagataaaatagtattcgaattttggcaggaaattagagttttaattttgtattttgactttagataactactaagcatattgtaaaatgtaatgtgctatacttgcatactactactttatctttcaacttaattactaaccgttttagat

SEQ ID NO: 8085 - DNA, 1249 bp, Solanum tuberosum
aaacaatctctctattttctatctttcatttcttatggcgtcctctacacctgatcaagaacaacaactacctcagcttcctccacttcactacagggtcatatccttttaatttatattaattactctttcaactttcggttttgatatttttttatacttaatatatctgctttttatttttttccagacatgggttttgaaagtttccatccactgtccaggctgcaagagaaaagtcaagaaagtcctgcaaagcattgaaggtgtttatacaacagatattgatccacagcaacagaaagttatagtgactggaaatgttgaagctgagactttgataaaaaaactgataagaaatggaagaagtgctgagttatggccagagccgaagccaatattaagagagaagaaaccaaagaaaaacgaaaacagcgacgatgacgatgatgatcatgaagatgatgaacataataataatgaaaaaccagctgaacatggtcctcaaagacatggtgtgagatttgggggggttgagacttttactatggatgtcaaagaagtaaggccagatgaaaggccgccggagaatatcgccgtcgttgagaggttcccggcgccggagcaaaaggccgccggaggtgctaagaaaaagaagaaaaagaaaaagaagaagagtactgggaataacaatgcaaatccaaatgcgagtgcagggtctaatggtgcaccgccaagcagcgaatcagatgttgcgaaaatgggtcccaatcaaatgatggatcaagcgaatctaggccattcatttcagcatccttatcctaacccgtacgatcagcatccacatgctagttatcatgttcctcagcagcatcagggttatgttgtgagttacaatgcggcacatcctatggtaagcagtgcgccgccatattactatgttccatcgtcaccgtacatgcagtctgatatttattcaaagcaacaatgtacaccgttggattcttttgagatcttgagtgatgaaaaccctcatgcttgctatatcatgtgatcaaagttgatgtggaattttgtatgtatattaagataaaatagtattcgaattttggcaggaaattagagttttaattatgttatacattagattatgtacttgggtattttgactttagataactactaagcataattgtacaatgtcatggtggttatactttgcatactaactaactttaatcttttcaac

SEQ ID NO: 8086 - DNA, 3494 bp, Solanum phureja
gcaatttccaaataaaaatggcgaaaaagcaaaataattcttcaagattttctacaaatctaactccatcacccaaaagaaccaaacccatttcatctccatcaccaaatccagatgcattagctctgtctattccttttcctcaaaatgaagaaccagttccattgatagtgttttttccatcagttaggagaagatcttctagattcactacaaacaaattcagtactagtgctactactgctactgaattcatgaggaaaaatcggaacagcatttcacctgaaaaaacagtttttcttcttccatcaccacctacattggctggaaaaacacctccggcggaaggtacgaggaggtcgccgagattggtatcactgtcatctaggacaacgacggcggaggataagggcaaaaaagtaaattcaaggaaatcagagggtataataaaacaagtggaattatcgaggaaacggaaatcggcaagttcaaaaatggatgaaaaaagccgaaaatctccgaggttcgattccgattcatcaaatggagttcaattagagctattagcattgccggagaagagcgcgtgtggtgcaatcgccgccggcggaagaaccggcacgaagcgggaactgctggctttgatgatgacgccggcggcgaacggcagcgcgtcgaagaaacgcggctccagggggagtgattcagtaaatgcagggaacaattcacgaggatctcggaggaaagatccagtttttgctgaatcaccgggaacatcggaaaaaataactgctgagagtaattcagtgggggcgaagactttaagatcgagaaaaatacaagggagtgttaattataatgagagtaaaggaccggaaatgaaacggataaaaaattcagcagagaaaagtgtgaggaagcagaagagtaatgcatgtttcatcggagagccgatagatacagaggaagctcaagagaaatggcaatggcgatacgaattgaagaatcgaaaaatgcagcgtcaagggtggaaattaaattctggtgaagaagatgaaatcatattaaatgtggaatgccattatgctcaagctaaggttgctggtttcattttcaatatcggagattgtgcatttgtaaagggtgaaggcaagaaaaaacatattggcaggatcttggagtttttcaagacgacagagggggaagattattttagggttcaatggttcttccgagctgaagatacggtgttgcaaggtgctgcttctttccatgaccgaaagcgcgtattctattctactttagagaatgataatttactagactgcatagtttccaaagtcaacgtggtagaattaccaaccaggcttgatttgaataaaaaggatgttccacctgctcacttttattacgacatggaatactgtgttgattattccacattccgtacgttgcataatgtcaaaagctctgtttccccttcgctagttgatgcgtcatataagcctatcactacatatcctctggaggtatcgccaagttgtgaacctatgaaagtggagttgtcactattggatctatatgctggttgtggcggcatgtcaatgggattgtgccttggtaccaaactctctggtgttaatcttgtgacgaaatgggcagttgattttaatagtgctgcctgtgatagcctgaaactgaatcatcctcagacacatgttaggaatgaaggtgttgagaattttctggagctactgaaaagatgggagaagctaattaagtcatacggctgtagtgatatcaaaacaagctctaatggtgagctagacgacagagatgaaggtgaaaacaatgatgattcccagtctggttccaatgcatcttctggagaatatgaggtattaagattagttgacatatgttacggggatcccaacgacgaaggaaaatctggacttcattttaaggtgcgatggaaaggttatagtccaagtgaagatacttgggagccaattgcgaacttggaaaattgcggagacagcataaaagattttgttcgaagggggcaacagttgaaaattctgcctctaccaggtgacgttgatatgatatgtgggggtcctccttgccagggcatcagtggatataatcgccacagaaatactgatgacccattgtctgatgagaaaaatcgtcaaattattatatttatggatgttgtggaattcttacggcctaaatatgtgttgatggaaaatgttgccgacatattgaggttcgataaagcatctctaggaagatatgctttaagtcgtttggtacatatgagataccaagcaagacttggaactatggcagctggttgctatggtctcccacaattccgattgcgagttttcttttggggtgcacttccgagtgagaggttgcccccatttccacttccttcgcatgacgtgattgttaaatattggccctcacctgaatttgagcgtaatactgttgcttatgaggaaggacaaccacgtgaccttgaggaagctctggttcttcgtgatgctatatctgatatgccagctgtcacgtggcatgaaactcgtgaagaaaggccatatgagataccccccgaaacagagttccagaaatacatgagattatctaaacatgagataatgagttgttcatcaactggagttaaggaaacaaaagaacctgttttgtctgatcatcggccttgccaactaaacgaggatgattacttgcgagtttgtctagtcccacgtagaaagggagcaaatttcagggacctccctggtgtaattgtaggaggggataatgtggctcgtcgtgatactaaagatccaaaggttctaccaaacggaaagcccatggttcctgactgtgccttcaactttgagaatggaaagtctaagaggccatttgcaaggttgtggtgggatgaaacagtagcaacattagtgacgtttcctaatcatcgtgctcaggctatcttacacccagagcaagatcgagttctgaccatacgagagtatgcaagattgcaaggttttccagatttctataggtttacgggtactctcaaggaaagatattgccaagttgggaatgctgtagcagttcctgttggtcgcgcgcttgggtacgcgcttggacttgcctatcagaggctagctggaaatgagcctctaattaaattgccatcaaatttctcattcttaacgcctccaattgatgacattgttgtcttgcaaacataagctcatattcatcatttttttcctccattggcgatttcggagctactgctgatccttagcagattactccatttttctagtatgaacttttattgaacagaacagatactagattggggcgcgacgaagttgattaatttattgatcaatgaactagcattcctttgatgtgaacttgtttccttatatttataaattctcctttctgaacagctt

SEQ ID NO: 8087 - DNA, 1272 bp, Solanum tuberosum
atttccaatttaattatatttatttggtacgccatatataatatcaatagaatccatggaaacgaaagttatttcgagcggaatccaccactctactctccctcaaagttacatccgacccgaatccgataggccacgtctatcggaagtggtcgattgcgaaaatgttccaataattgacttaggttgcggagaccaagctcaaataatccgtctaattggagaagcttgtcaaacttatggtttctttcaggtaattaatcatggtgtaccaaaggaagttgtagagaaaatgctaggggtagctggggaatttttcaatctaccagtagaagagaagctaaaattgtattcagatgatccttcaaagaccatgagattatctactagttttaatgttaaaaaggagacagttcataattggagagattatctcagacttcattgtcatcctctggagaaatatgctcctgaatggccttctaatccatcgtctttcagggatatcgtgagcagatattgcacggaagttcgacaactcggatttagattggaggaagccatagcagagagcctgggcttagagaaagagtgtattaaagatgtattgggagaacaaggccaacatatggctatcaatttttatcctccttgtccacaaccagaactcacatatgggcttccggcccatactgatccaaattcacttacaattcttcttcaagacttgcaagtttctggtcttcaagttcttaaagatggtaaatggttggctgtcaaacctcaaccagatgcctttgtcattaatcttggtgatcaattgcaggcagtaagtaacggtaagtacaaaagtgtatggcatcgagctattgtgaattcagatcaagctaggatgtcagtggcttcgttcctatgtccgtgcgatagcgcgaaaatcagtgctccaaaactcctgacagaagatggatctccagtcatttatcaggacttcacgtatgctgagtattacaagaagttctggagcaggaatttggaccaggaacattgtttggaacttttcaagaattaaattcttgcaagtacgggataaggtgggatctcctgggattaagtttagaattaaagttatattttgtttggttgagcgtgagataaatctatactttcaatcaaacaaaatataaatttaatttcaaacttaatcctggatataccatcttctccgatccaatcagacttgggcatcatttagtcagcaaaccaaatgacccc

SEQ ID NO: 8088 - DNA, 1536 bp, Solanum phureja
aattcacaaattattagtcctttttttttatttccaatttaattatatttatttgctacgccatatataatatctatagattccatggaaacgaaagttatttccagcggaatccaccactctactctccctcaaagttacatccgacccgaatccgataggccacgtctatcggatgtggtcgattgcgaaaatgttccaataattgacttaggttgcggagaccaagctcaaataatccgtctaattggagaagcttgtcaaacttatggtttctttcaggtaattaatcatggtgtaccaaaggaagttgtagagaaaatgctaggggtagctggggaatttttcaatctaccagtagaagagaagctaaaattgtattcagatgatccttcaaagaccatgagattatctactagttttaatgttaaaaaggagacagttcataattggagagattatctcagacttcattgtcatcctctggagaaatatgctcctgaatggccttctaatccatcgtctttcagggatatcgtgagcagatattgcacggaagttcgacaactcggatttagattggaggaagccatagcagagagcctgggcttagagaaagagtgtattaaagatgtattgggagaacaaggccaacatatggctatcaatttttatcctccttgtccacaaccagaactcacatatgggcttccggcccatactgatccaaattcacttacaattcttcttcaagacttgcaagtttctggtcttcaagttcttaaagatggtaaatggttggctgtcaaacctcaaccagatgcctttgtcattaatcttggtgatcaattgcaggcagtaagtaacggtaagtacaaaagtgtatggcatcgagctattgtgaattcagatcaagctaggatgtcagtggcttcgttcctatgtccgtgcgatagcgcgaaaatcagtgctccaaaactcctgacagaagatggatctccagtcatttatcaggacttcacgtatgctgagtattacaagaagttctggagcaggaatttggaccaggaacattgtttggaacttttcaagaattaaattcttgcaagtacgggataaggtgggatctcctgggattaagtttagaattaaagttgtattttgtttggttgagcgtgagataaatctatactttcaatcaaacagaatataaatttaatttcaaacttaatcctggatatcccatcttctccgatccaatcagacttgggcatcatttagtcagcaaaccaaatgaccccgaatctggtgcacttatgttctagaaattcttgatccatctaggcgcctctgcagctatgaaacaacaaacaatgtcgttgtgagaaactaacttgaaacaacaaagccataaacaatactagaattttgctgttaaaaggccatgttatctagagtaccaaattaacaaaacaaatactattcagtaacatatttgcaattgacaaattaaagctgtgtcacagtccacaatta

SEQ ID NO: 8089 - DNA, 1052 bp, Nicotiana tabacum
  misc_feature (110)..(110): n is a, c, g, or t
gtcattcgtaacggttcacatcacaaatagtcccctttttgatagccagattccatggaaacaaaagttctgtccagcggaatccgccactctactatccctcaaagtanatccgccctcaatccgataggccacgcctctctgaagtcgttgattgcgaaaacgttccagtaattgacatgggctgtggagatagaaaccatataattcgtcaaattggcgaagcctgtcatctttatggttttttccaggtaattaatcatggtgtaccaacgaatttagtagaggaaatgctagagatagctcgggaattttttaaccttcctgttgaagagaagttgaagttgtactcagatgacccatccaagacgatgagattgtccactagttttaatgttaaaaaggagacggttcacaattggagagattatctcagacttcattgttatcctctggaaaaatacgctcctgaatggccttccaatcccgcctctttcagggaaattgtgagcagatattgcacagaagttcgacaactcggattcagattgcaggaagccatagcagagagcctaggcttagagaaagtgtgtataaaggatgtattgggtgaacaaggccaacacatggctatcaatttctacccaccatgtccacaaccagaactcacttatgggctcccagcacataccgatccaaatgcccttaccattcttcttcaagacttacaagtagctggtcttcaagttcttaaagatggtaaatggttggctgtcaaacctcagccagatgcctttgtcattaatctcggtgatcaacttcaggcagtgagtaatggaagatacaaaagcgtatggcatcgagctattgtaaattctgataaagcaggttgtcagtggcttcgttcctttgtccgtgcgatagcgcgaaaatcagtgctccaaagctcctgactgaagatggatctccagtcatttatcaggactttacgtatgctgagtattacaagaagttctggagcaggaatttggaccaagaacattgtttggagt

SEQ ID NO: 8090 - DNA, 1454 bp, Nicotiana benthamiana
aagtgtgagcaattttcttcattcgtaacagctcatatcacaactattccttttcttcattcttttctatatgctcgagattcaatggaagcaaaagttctttccagcggaatccgccactctactatccctcaaagttacatccgccctcaatccgataggccgcgcctttctgaagttgctgattgtgaaaacgttccagtagttgatataggttgcggtgatagaaaccttattgttcatcaaattggtgaagcctgtcgtctttatggttttttccaggtaattaatcatggtgtaccaaagaatttaatagacgaaatgctagagatagctggggaattttttaggcttccagttgaagagaagttgaaattgtactcagatgacccatcgaagacgatgagattgtcgactagttttaatgtgaaaaaggagaaggttcacaattggagagattatctcagacttcattgttatcctcttgaaaattacgctcctgaatggccttccaatccttcctctttcagggaaatcgtgagcagatattgcatggaagttcgacaactcgggttcagattgcaggaagccatagcagagagcctaggcttagagaaagagtgtataaaggatgtattgggcgaacaaggtcaacacatggctatcaatttctatcctccttgtccacaaccagaactcacttatgggctgccagcacatactgatccaaatgcccttacaattcttcttcaagacttagaagtagctggtcttcaagttcttaaagatggcgaatggttggccgtcaagcctcaaccagatgcctttgtcattaatcttggtgatcaactgcaggcagtgagtaatgggagatacaaaagcgtatggcatcgagctattgtaaattcagacaaagccaggttgtcagtggcttcgttcctttgtccgtgcgatagcgcgaaaatcagtgctccaaagctcctcactgaagatggatctcctgtcatttatcaggactttacctatgctgagtattacaaaaagttctggagcaggaatttggaccaggaacattgtttggaacttttcaagaactaaaaagttaagactatagtagtatttacaaatccaccacttcatcctggacaatctctttgcaaaatttactatttttcatgttttttttaccctttttttattttagttttgagctatagttatgggggtgggagttaaattagataaagaggaagaaagaaacagttatatgttcattgcgtagctgatcaaattacccaataacaagagtccagcgtcctgttttgcaatttgctgtcaagtagcattatcaataattagatcggaaagttggaccacagatcttgttggatttaagaggaatagcgattcagtccagttgtaataggaataattaagattagtacttattgttt

SEQ ID NO: 8091 - DNA, 1294 bp, Solanum phureja
ttcttgcattacatctctatttttgtgttcttaaacataatggaaacaacaagtgttctttccggtggattcaaccactcaaccctccctgaatcttacgttcgacctgaatcccaaagaccccgcatgtctgaagttgttgatcgtgatgatcttgttccagttatcgatatgtcttgtactgataggaacgttatcgttcatcaaattggcgaagcttgtcgcctttatgggtttttccaggtgataaatcacggtgtatcaaagaaggttatggatgaaatgttgggggtagctcatgaattttttaagcttccagtggaagaaaagatgaaattgtactcagatgatccatcaaagactatgagattatcaactagttttaatgttaagaaggaaactgttcataattggagagattatcttaggctacactgttatcctttggacaaatatgcccctgaatggccttctaatcctccttctttcagggaaatagtgagcaaatattgcatggaagttagacaagttggatatagattagaagaagcaatatcagagagcctagggctcgagaaagattgtattaaaaatgtgttgggtgaacaaggacaacatatggctatcaatttttatcctccatgtccacaacctgaactaacttatgggttaccagcccatacagatccaaatgcaattacaattcttcttcaagatttgcaagtggctggccttcaagttcttaaggatggagaatggttatctattaaacctcaacctgatgcctttgtcatcaatcttggtgatcaattggaggcattgagtaatggaaagtataaaagtatatggcatagagctattgtaaattcagataaagcaaggatgtctgtggcttctttcctctgtcccaatgattgttccattatcagtgctccaaaaaccttaattgaagatggatcttcagccatttatcgagatttcacttatactgaatattatgacaaattttggagcaggaatttagaccaggaatattgtttagaacttttcaagaacgatggaacctagtacttgtatgagttcgaagtaattatttataacttttgtatctacctaagtgtggttatcacacagttaccgtaggaaacaatcgcctaataattcaggtatggaactcgcaaaataatgatacttaaagtatgtaaattttgttcttttcctctggcattatggtgcttgcacccctgttttatatgtagaatcaaattgggaaagatgaaattgcattggctga

SEQ ID NO: 8092 - DNA, 1487 bp, Solanum lycopersicum
ctatccagtactaatttaatcaagtcagtaaaatgtgaacccattaacactaattaacattatcgtgatttggttcacgtgaaaaaaaccaagcccacaatatctaaaatatgtatatatatattagctactttaagcttcaatgacattttagttcttgtattattacatctctatttttgtgttcttaaacataatgacaacaacaagtgttctttctagtggttttaaccactcaaccctccctcaatcttacgttcgacctgaatctcaaagaccttgcatgtctgaagttgttgatagcgacgatcttgtcccagtcattgatatgtcttgtactgataggaacgttatcgttcatcaaatcggtgaagcttgtcgtctttatgggttttttcaggtgataaatcacggtgtgtcgaagaaggcgatggatgaaatgttaggggtaagtcatgaattttttaagctaccagttgaagaaaagatgaaattgtattctgatgatccatcaaagactatgagattatcaactagttttaatgttaagaaggaagctgttcataattggagagattatcttaggctacattgttatcctttggacaaatatgcccctgaatggccttctaatcctccttctttcagggaaatagtaagcaaatattgcatggaagttagagagcttggatatagattggaagaagcaatatcagagagcttagggcttgagaaggattgtataaaaaatgtgttaggtgaacaaggacaacatatggctatcaatttttatcctcagtgtccacaacctgaattaacttatgggttaccagcccatacagatccaaatgcaattacaattcttcttcaagatttgcaagtggctggccttcaagttcttaaggatggaaaatggctatctattaaacctcaccctaatgcctttgtcatcaatcttggtgatcaattggaggcgttgagtaatgggaagtataaaagtatatggcatagagctattgtaaattcagacaaagcaaggatgtctgtggcttctttcctctgtcccaatgattgttccattatcagtgctccaaaaaccttaactgaagatggatcttctgcaatttatcgacatttcacttatgctgaatattatgaaaaattctggagcaggaatttagatcaggaatattgtttagaactttttaagaacgatggaacctagtacttgtatgagtttattacttttgtatcgacctaagtgtggttgtcacacaattatgttaggaaacaatcacttgatatagttcagatatgaaattcgcaaaaaaaaaatgatacttcaagtatgtaaaactttttttgttctttttctctggcattatcatctttggaatgatatgtggagagtgtgcttccatgatatcatgaaactccgagaaaataatctcctatgatcacttacaatttgaatagatgaaaatgat

SEQ ID NO: 8093 - DNA, 1107 bp, Vinca minor
aattttaatttttaagattgtttcttaccggagttcattaatgtatactaaagttttgtctagcggagtccacatcagtctccccgaaagttatgtccgtccggaatcggaaagacctaagttgtctgaagtttctgactgtgaaaatgtccccgttattgacttaggcagcggtgataggagccttatagtccaacaaattggcgaggcctgtcgggactacggttttttccaggttataaatcatggagtaccaaaggaagtggtggagaaaatgcagaatgtggcaaatgaattcttcagtctacctgtggaagagaagttgaagctctactcagaagacccatcgaaaactatgaggctttctacgagcttcaatgtgaaaaaagagacggttcacaattggagagactatctccggcttcactgccatccgttggatcaatatgttcctgaatggccatctaatcctccccttttcaaggatattgtgaggaattactgcatggaagttcgagaacttgggttcagattggaggaactgatatctgagagccttggcctgaataaaaattgcttaaaagacgtggttggtgaacaaggacaacatatggccatcaattattatcctccttgtccagaaccagaattgacttatggattaccaggacatactgatcctaatacccttactattttacttcaagatttgggtgtggctggtcttcaagttcttaaggatggtaattggctagcagttaaaccttatccagatgcttttgtcgtcaatattggtgatcaattacaggccttgagtaatggtaagtacaaaagtgtatggcacagagctgttgtgaatgctgataaaccaagactttcagtggcttctttcctttgtccatgtgatggtgctcttttgagtgcaccaaaacctctcacagatgatggatcaccagttgtatacagggactttacctatgcagagtattacagtaagttctggagcaggaatcttgatcaagaacattgtttggaacttttcaagaactaataatttatgctatatatacttcttaatttgcctatttaactcccttgtgagtcgtg

SEQ ID NO: 8094 - DNA, 6894 bp, Solanum phureja
gcgttgttatgccgtcaccggttaagagtcttgtggggcatcaattgattgctatgcctttgggtcgggtcggtgttggtctggggagaactagggtgacgaggagctcggtagtgaagaggactaccggtttcgagaagaagttttatggagccaagcttcgggcttccgggtcggaaaggttgcacctttggcaatctgacgggccgggtcgggctccgaagctaagggtcgtggtgcgttctgcattgtctcaggtgccagagaagcctcttggactctacgatccatcatttgataaggactcttgtggcgttgggtttgttgctgaactttccggtgaaagtagccggaaaacggttactgatgctattgagatgttagtgcggatgtctcatagaggcgcgtgtggttgtgagactaataccggagatggagccggtattcttgttggtttgcctcatgacttctacaaggaggtagctagtgaggcgggatttgagctaccaccacctggacaatatgcagttggtatgttcttcctgcctacctctgacagtagaagggagcaaagcaagattgtatttactaaggtggctgagtcacttgggcatacagttcttggatggcgtccagtccctacagataattcaggactgggcaagtctgcattgcagactgagcctatcattgagcaagtgtttctgacaccaactcctaggtcaaaggtcgattttgagcgtcagatgtatattttgaggagggtggcaatggtagctatacgagctgctttaaacctccaacatggtggcgtgaaagatttctatatatgctctctttcttcaaggactgttgtttacaaaggtcagttgaagcctaatcagttgaaggaatactactttgcagatttgggcaatgaaaggtttacgagctacatggccctggtgcattctaggttctctacaaataccttccctagttgggatcgtgctcagcctatgcgtgtcttgggtcataatggtgaaattaacacacttcgaggcaatgtgaactggatgagggctcgtgagggtcttcttaaatgcaaagagcttggcctttcaaagacagaaatgaaaaaactcttgcccattgttgatgccagttcatctgactcaggagcttttgacggtgtgcttgagctactgcttagagctggtagaagcctcccagaagctgttatgatgatgattcctgaagcctggcaaaatgacaagaacatggatcctagccggaaggcattgtatgaatatttttcagccctcatggaaccatgggatggacctgctcttatgtcatttactgatgggcgctatcttggagctacgttagatcggaatggtctgcgtccaggtcgcttttatgttacatacagtggtagagttattatggcaagtgaagttggagtagttgatattccacctgaagatgtatccagaaaaggtagactaaaccctggaatgatgcttctggtggactttgagaaccatgttgttgttgatgatgatgctttgaagaagcagtactctcttgcaagaccttatggacagtggctgaaaaagcagaagatagagctgaaagacattgttgagtcagtaaattattcctatagggtccctccacccattgcaggagttttgcctgcggtaagtgatgaggacagtatggaaaatatgggacttcatggtttattggctccattaaaggccttcggttacactatagaggccttagaaatgctgctactcccaatggcaaaagatggtgttgaggctcttggttcaatggggaatgatgctccattagcagtgatgtctaacagagagaaacttacatttgagtatttcaagcagatgtttgctcaagtcacaaaccctcctattgaccctatcagggaaaaaattgttacgtctatgcaatgtatggttggtcctgaaggagatcttacggagaccactgaagaacagtgtcaccgcctctcactcaaagggcctcttttgtccattgaagagatggaagctgtaaagaagatgaactacagagggtggcgcagtaaggttcttgatattacctactccagagaccgtggtacaaaaggtctagaggagaccttagacaggatttgctctgaagcgcacgatgcaattcaggagggttatacagcaatcgtactttctgacagaggcttctcgccgaagcgtgttgctgtgagctctttattggctattggcgctgtccatcatcatttagttaaaaagcttgagcgaactcgagttgcattgattgttgaatctgccgagccacgagaagtacaccatttctgtacattggtaggatttggtgctgatgctatctgcccttatttagccgtagaagctatatggagactacaggttgatggcaaaatcccacccaagtcaaccggtgagtttcattccaaggatgagcttgtcaagaaatacttcaaagcaagtcactatggcatgatgaaggttcttgcaaaaatgggaatatcaacattggcatcgtacaagggcgctcagatttttgaggctgttggcctttcatcagaagtgatggagcgatgtttcaatggaactcctagcagagtggagggtgcaacttttgacgcacttgccaaagatgcactcaatttgcatggacttgcatttccatcacgagccttggctccagggagtgcagaagctgtggcactccctaatcctggtgattatcattggagaaagggtggtgagattcaccttaatgatccatttgccattgcaaaactgcaggaggctgcacaatctaatagtgtagctgcctacaaagaatattctaagcgagtacaggaattaaatagacaatgcaatttgaggggacttttgaaattcaaagagggagaggttaaagttcctctagaagaagttgaaccggcaagtgagattgtaaaacgtttttgtactggagccatgagttatggatcaatctccttggaggcacacgctactcttgctatggcaatgaacaagattggaggcaaatctaacacaggcgagggtggtgagcaaccttctcggatggaacctcttcccaatggttcaaagaacccaaaaagaagtgcaattaagcaggttgcaagtggtagatttggagtctcaagttattaccttacaaatgctgacgagctacagataaagatggctcagggagccaagcctggagaagggggtgaacttcctggacacaaggtcattggtgacatagctgtcactaggaactccacagctggagttggactaattagtccccctcctcatcatgatatctactcaattgaggatcttgcacagttgattcatgatcttaagaatgcaaacccaggggcacgtgttagtgtcaagttggtttctgaagctggtgttggggttatagccagcggcgttgtcaagggacatgctgatcatgtcttgatctccggtcatgatggagggactggtgcctcaagatggactggcatcaagagtgctgggcttccatgggaacttggtcttgcagagacgcatcaaactttagtggctaatgacctccgtggccgaacagtgctgcaaacagatggccaattgaaaactggaagagatgtagctatagctgctcttcttggtgcagaggagtttggtttcagcactgctcccctcataacacttggctgcataatgatgagaaaatgccacaaaaacacttgccctgtggggattgccactcaagatccaattcttcgggagaagtttgctggagaaccagaacatgtcataaatttctttttcatgctggcagaagaattgagagaaattatgtctcaacttggtttcagaacacttattgaaatggttggccgttcagacatgcttgaaatggacaatgatttagtcaagaacaatgacaaattgaagaatattgatctgtccctactgcttcgacctgctgctgatatccggcctgaagctgcccaatattgtatacagaaacaggatcatggtttggacttggctttagataacaatttaatagccctttccaaggctgctttagagaaaagtcttcctgtatatattgaaactccaatctgcaatgtaaaccgggctgttggtactatgctaagccacgaagtgaccaagcgttatcacctcgcagggcttcctgcagacaccattcatatcaagcttagtggaagtgcaggacagagtctgggggcttttctttgtcctggcatcacattagagcttgaaggagacagcaatgattatgttggtaaaggtttatcgggtggcaaaatagttgtttatcccccaaaaggaagcaagtttgaccccaaagaaaatattgtgattggaaatgtagctctttatggggcaacaagtggggaggcatattttaatgggatggcagcagaaagattttgtgtccgtaactcaggggccaaagctgttgtagaaggtgttggtgatcatggctgtgagtacatgactggtggtacggttgttgtgctaggaaaaactggaagaaactttgctgctggtatgagtggtggtgttgcctatgttcttgacttgcattccactttccactctcgttgcaattcagagctggttgatctcgataaagttgaagaagaagaagatgtcatgactttgaagatgatgatacagcaacaccagcgtaacacaaacagccaactggcgaaagaagttcttgctgactttgataatcttttgcctagatttattaaggtcttccctagagattataaacgtgttcttgcaagcatgaaaaaggaggaggcttatgaagctgcaaaagaacgtgccatcaaggaagcggaggagcaagaagaagaagagttgaaggagaaagatgcctttgaagagctgaagaagttagcagctgcatccaaggatgaatccagtcaggttgaagaggagaacacattgaagaggcccacccaagttgctgaggcagtcaagcatcgaggttttgttgcttatgagcgacagggtgtgtcttacagggatccaaatgttcggatgaaggactggaaagaggttatggaggaatcaaaacccggtccactccttacgacacaatctgcgcgttgcatggactgtggaactcctttttgtcatcaggagaactctggatgtcctcttggaaacaaaataccagaattcaatgagttagtgtatcagaatagatggcgtgaagcactagataggcttcttgagacaaacaacttccctgagttcactggccgagtgtgccctgcaccatgtgaaggatcttgtgtgcttggtatcattgagaatcctgtttctatcaaaagcattgaatgtgccattattgacaaagcttttgaggaagggtggatggtgccacgacctccttctgagagaaccgggagaagagtcgcaattgttggaagtggaccctcaggcctggctgctgctgatcagttaaatagattgggtcatactgtcaccgtgtttgaacgtgctgataggattggtggtctgatgatgtatggagtgcccaacatgaaaaccgacaaaattgatgtcgttcagaggcgggttgaccttatggagaaggaaggggtgaaatttgtggtcaatgcaaatatcggaaatgatcctgcgtactccttggatagtcttcgtgaagatcatgatgcaattatcttggccgttggagccacaaagccaagggaccttcctgttcctggacgagacttatctggagtccatttcgccatggagttccttcacgcaaacacaaaaagtttgcttgacagcaatctgcaggatggaaaatacatttcagccaagggaaagaaagtggttgttattggtggaggtgacactgggacagattgcataggaacatcaattcgccatggctgcagcagtgtagttaatctagagcttcttcctcagccaccaaacactagggctcctggaaatccttggccacagtggcctcgtgtcttccgtgtagattatgggcatcaggaagcttctgcaaagtttggtaaggatccgagatcctatgaggttttgaccaagcggttcattggagatgaaaatggaaatgtgaaaggattggaggtgatacgtgtacagtgggaaaaagatgccagtggaagattccaattcaaggaagtagaaggctctgaagaaattattggggccgatctggttatgctagccatggggttccttggtcctgaatcgacaatagcagacaaactaggattagaaaaggacaacaggtccaacttcaaggctgattatggacgcttctcaacaagtgtagagggggtgttcgcagcaggagactgtcgtaggggacagtctttggtggtttgggccatctctgaaggacggcaagcagctgctcaagttgacaagtttctcatgaaggatgacgaggactcgtctgctgatgcagctagccaacaagaatctgtcaaaaagcagccaacagtcgtgacataaggcacttgcttttggcggaggctggttttgggattttccttcaaacgacttccaagaaaagaaacacacagtaaatcaaaagcagctcagctggaacataggatagggggactagttgagaatttctgattctttttttggggggagtttgggggtaggggatagtattttgtttttttgctgcatcttgggtgttcataacactatattatgtccgtgcctgtttgcttggaaggagggtagctccaacacaggctagatgaaaaaaataaaaataatatgtacagttcgtttgcccaaaatt

SEQ ID NO: 8095 - DNA, 7100 bp, Amsonia hubrichtii
gtggaacttccgacgaatttaaactgagtcgaatcgataatacaaatctagggaaggtctttaaaccaaaacgcttatatacgaaacaaatctggtagtggaaagagctcggaatgtcggtggcgtcgggttcgtctttaattcaggcaaaaaacaatggcgttgggttgccttcggtgacgaagccatttgtcaatcatcagttgaatgtggtgcggctcagccgagcgggtggcgttagggcatctaagaggaagagtaggtgtggttggcagactagtaagtttctcggggcgaggttaccgagagcgttgggctcggaaagtttgcaccgttggcaaaccgatgggcctggtcaagctccaaagctgagggttgtcaaggtgcactctgcattgtctcaggtccccgagaagcctcttggtctctatgatccttcgtttgataaagactcctgtggagtcggctttgtggctgaactttccggcgaaagcagccgtaaaacggtgaccgatgccatagagatgttggttcggatggcacacagaggtgcttgtggttgtgagactaatactggtgatggagctggcattcttgtagctcttcctcatgatttctacaaggaggttaccaaggatgtgggttttgaactaccgccacctggagaatatgcagtgggcatgtttttcctccctacctctgaaagccgaagggaacagagcaaaattgtatttacaaaggtggctgagtcccttgggcatactgttcttgggtggcgtcctgttccaactgataactcaggattgggccagtctgctttgcagacagaacctgtcattgagcaagtgtttcttacacccactcctaggtcaaaggctgattttgagcaacagatgtacatattaaggagggtttcaatggtagctattcgagctgcattaaatctccaacatggtggagtgagggatttctatatatgttctctttcctccaggacggttgtttacaaaggtcagctgaagccagttcagttgaaagaatactactttgcagatcttggcaatgaaaggtttacgagctacatggccctgattcattcgcgtttttcgacaaatacgttcccgagctgggatcgtgctcagccaatgcgtgtcttgggtcacaatggggaaattaacacactacgaggcaatataaactggatgaaagctcgggaaggtcttttaaaatgcaaagcgttgggcctgtcaaagaccgagatgaagaaacttctacctattgtcgatgctagttcatccgattcaggagcttttgatggtgtacttgagcttttagttcgagctggtcgaagtcttcctgaagctataatgatgatgattcctgaggcctggcaaaatgacaagaacatggatcctgatcggaaagccttatatgaatacttttcggcacttatggaaccatgggatgggcctgctctcatatcatttacggatgggcgctatcttggggcaacattggatcgaaatggattgcgtccaggccgcttctatgttacacacagtggccgagttattatggcaagtgaagttggagtagttgacatcccacctgaggatgtaagtagaaaaggaagacttaatccaggcatgatgcttctcgtagattttgaaaaccatgttgtggtagatgatgatgccttgaagcagcagtattcccttgcaaggccttatggagagtggcttaagcggcaaaaaatagaactgaaagatattgttgaatctattcaagattctggcagggttcctccacccatcgcaggagttgtggctgcatctgatgatgatgaaaatctggaaaatttgggacttcatggtttattggctcccttgaaggcttttggatataccgttgaagccttagagatgctgatgttacctatggcaaaagatggtgttgaggcccttggttcaatgggaaatgatgctcctctggcagtgatgtctaatagggagaaactcacttttgaatatttcaagcagatgtttgctcaagttacaaaccctccaatcgatccaattcgggagaagattgttacctccacggaatgtatgatcggtcctgaaggtgatcttacagagacaaccgaagaacaatgtcatcgcctctcacttaaagggcctctcctctcgattgaagaaatggaagcaatcaagaaggtgaactaccgaggctggcgcagcaaagttctagatattacctattcgaaggagcgtggtaggaagggtttggaggagaccctggacaggatatgttctgaagcacgtgatgcaataaaggagggttatacaagtcttgtactttctgacagagccttctccccaaagcgtgttgctgtcagctctttattggctgttggtgctgtgcatcatcatctagttaaaaagcttgaacgaacacgagtagcactgattgttgaatctgctgagccccgtgaagttcatcacttctgtacactagtgggatttggtgcagatgctatctgcccctatttagcagtagaggccatttggagattacagattgatggaaagattccgccgaaggcaactggtgagtttcattcaaaagatgaacttgtgaagaagtacttcaaggcaagccactatggcatgatgaaagttcttgcaaaaatggggatatcaactttggcatcttacaagggtgcccagatattcgaggctgtaggcctttcatctgaagttatggagaggtgttttaaaggaactccaagcagagttgagggtgcaacttttgaagctcttgcacatgatgcactgacattgcatgaaatggcatttccatctagggtgttacctgctggaagcgcagaagctgtagcacttcctaatcctggtgattaccactggaggaaaggtggtgagattcacctgaatgatccccttgcaattgcaaaactgcaggaggctgcaaaatccaatagtgtggctgcctacaaagaatattccaaacgtatacaagagttgaacaaaagttgcaatttaagggggcttttgaaattcaaagatggtgaggtaaaggttcctttggaagaagttgaacctgctagtgagattgtaaaacgattctgtactggagcaatgagttatggctcaatatcgctagaggcacacacaactcttgctattgctatgaacaaactgggagggaagtcaaatactggtgagggaggtgagcaaccttctcgaatggagccccttccagatggttctatgaatccaaagaggagtgctattaagcaggttgcaagtgggaggtttggtgtgtcaagttattacctcacaaatgctgatgagttgcaaataaaaatggctcagggagcaaagcctggagaaggtggtgaacttcctggccacaaagtggttggtgacattgctatcacaaggaattccactgctggtgtggggctaattagccctcctccccatcatgatatatattctattgaagatcttgctcaactaattcatgatttgaagaatgctaatccaggggcccgtataagtgttaagttggtttctgaagctggtgttggggtaattgctagtggtgttgttaagggtcatgctgatcatgtcttgatctctggtcatgatggaggtactggagcctcaagatggactggcataaagagtgctgggctcccatgggaacttggtcttgcagagactcatcaaaccttagttgctaatgatctccgtggccggactgttcttcagacggatggccagctaaaaactggaagggatgtggccattgcaacccttcttggtgctgaggagtttggtttcagtactgctcccctcataactcttggctgcattatgatgcgaaagtgccacaaaaacacttgtccggtgggtattgctacccaggatccagttctacgagaaaagtttgctggggaaccagaacacgtcataaactttttctttatgctagcagaggaggtgagagaaatcatgtctcagctgggtttccgatcgattaaggaaatggttggccgctcagacatgcttgaactagatgaagatttggttaaggacaatgagaagctaaagaacattgatctctctcttttgcttcgacctgctgctgacatcaggccggacgctgctcagtattgcatacagaaacaggatcatggtttggaaatggctttggatagaaagcttatagagttatctaaatcagccttagagaaaagtattccagtgtatattgaaacagcaatttgcaatgtaaatcgggctgtaggaacaatgcttagccatgaggtaacaaaacgccatcacatgattggacttccagcggatgcaatccatatcaaatttaatggtagtgcaggccagagttttggagcttttgtttgtccaggcattacgcttgagcttgaaggtgatagcaatgactatgttgggaaggggttatccggtgggaagatcattgtttatcctcctaaaggaagcaagtttgacccaaaggagaacattgttatagggaatgtagctctctatggagcaattgctggtgaagcttactttaatgggatggcagcagaaaggttttgtgttcgcaattcaggggccaaagcagttgtagaaggggttggtgatcatggatgtgaatacatgactggtggaactgttgttgtactggggaaaactggaagaaactttgctgctggtatgagtggtggtattgcatatgttcttgatgtggattctaagttccgatcccgttgcaactctgagctcgttgatcttgataaagttgaggaggaagatgatattctgactctcaggatgatgatacaacaacatcagcgtcacaccaacagccaactggcaaaagaggttcttgcagactttgacagtcttttgcccaaatttattaaggtattccctagggactacaaacgagttcttgcaagcatgaaagaaaaggaaaatgataaaatggttgctgaaagagctgtgaaagaagttgaggagcaagaagcggcagagttgatggagaaagatgcttttgaagagctcaaaaagttggcagcttcatcttcaaatgaagaagcaaatgaggtagaagaatccaaacccaataaaagaccaaccagagtggctgatgctgtaaagcatcgtggttttgtagcgtatgagcgagagagcatttcatatagagatcctgatactcggatcagtgactggaaagaagtaatggtagaaggaaagcctggtccacttcttaagacacagtctgctcgatgtatggactgcgggactccattttgccatcaggagaattctggatgccctcttggaaataagatacctgagttcaacgagctagtataccagaacagatggcgtgaagcattagataggcttcttgagactaacaactttccagagttcactggcagagtgtgtcctgcaccttgtgaaggatcttgtgtcctgggaattattgagaatcccgtctcgattaaaagcattgagtgtgctatcatagacaaggccttcgatgaggggtggatggtaccaagacctccccccaagagaactggaaaaagagttgctgttgttggtagtggacctgctggcttggctgctgctgatcagttaaataagatgggtcattctgtgacagtgtttgagcgatctgatcgaattggtggtctcatgatgtatggagtgcctaacatgaaggcagacaaaattgatatagttcagagaagggttgaccttatggaaaaggaaggtgtaaactttgtggttaatgccaatgtaggaaatgatccctcgtatgcccttgatcaacttcgtgaggagcatgatgccattgttttggctgtgggttccacaaagcccagggaccttcctgttcctggacgcgatctctctggtgttcattttgccatggaatttcttcatgcaaatacaaaaagcttgcttgatagcaatcttcaggatgggaattacatatctgctaaaggcaagaaggtagtggttattggtggaggtgacaccggtactgattgtataggtacatccattcgacatggttgcagtagcattgttaatttagagcttctgcctcagccaccacagacgagggctccaggcaacccttggccacagtggccacgcatattccgagtggattacgggcatcaggaagctgctgccaagtttgggaaagacccaaggtcatatgaggtattaactaagcggtttgttggagatgagaatggggtggttaaaggtcttgaagtggtacgtgtaaagtgggagaaggatgcgagtggaaagttccaatttaaggaagttgaaggatctgaggagatgattgaggctgatctagtctttttggccatgggtttccttggtcctgaatcgactatagcagacaaactgggtttggagaaagacaacaggtcgaacttcaaagccgagtatggccgcttctcaaccagtgtggaaggagtatttgcagctggagactgccggcgtggccaatccctggtggtgtgggctatttctgaaggcaggcaagctgctgcacaggttgataagtatctgatgaaagatgacgatacagacatcgaattgaactccagaaaacaagaagaatataccaagaggcagcaagatagcaacaaacacacagtaatgacatagacagacatagttgcagtaaatttacttagtctcagaaacacagaggtcgcgcactgcattattaatgtacacgtgcatgccgactatttttggtttttggtggtcaggttgataaatattgtgaaggaaataagctatatgttaaattgaaaggtccaagaaagttgctgcgagctgaaaattctttcttaggatactgatagctggtttctgttctattgtaattactctcgttaataacatctccctatgtatttggtgaaaagaggagagcctctttgtggtggctacaacaaataatgtacagtttacagtttgtctttttgttctccaagtagaatt

SEQ ID NO: 8096 - DNA, 7373 bp, Sesamum indicum
ataaattcaccacctcaccacctcgccgaggctaaatccatacactcacaaccagctcacggcggcgtttatttcctccccatgctactagttcttatcaaaatccccttccctcacatttcggattcttcgccgtcgtgaataataaggactctctctctctctctacctactatagtatactcttcttatttatatttccaccccctcattcttcctccagtttaacctcctttccttttcactcgctttttctccttcgtttcctgaaaatccgttgttttcgacagcttccatcgcctctattctcaccagatctgattaattaacgcttctaaatttgtgtgactgaattaatattataagataagatttcaagctgttggttaattcgggatccgggaaagatgtcgacggtgtcaggatcggggattcagagaggctgcggcggcggcttggttaagcctgcagcatgcgcaccgagtcaccagctgaatgcggtggcggctttgagccgaagggttagggtctcgcgggaatttacatcgaagcagaggagagtaaacctggagaatagattcgtttgtggcacgaggcttcggggtgttgctgctccggatttgggttcaggctcggagaggtttcatctttggcagacggatggaccgggtcgggctccgaagctacgtgttgttgtgaagaatgctctgtctcaggtgccggagaagcccctcggcctttatgatccgtcctttgataaggactcgtgtggggtcgggtttgtggcggagctttctggagaaaccagccgtaaaacggttacggatgctgtagagatgttggtgcgcatgacgcatagaggcgcttgtggttgtgagacgaatactggggacggagctggaattctcgtggggcttcctcatgatttctacagagaggctgctaaagatgctggccttgagctgcccccacctggagaatatgcggtcgggatgtttttcttgcctacttcagatagccggagagaacaaagtaaagttgtattcacaaaggtggctgaatcacttggccacacagttctcgggtggcgtcttgtccccacagataactcaggattgggcaagtctgctctgcaaactgagcctatcattgagcaagtttttcttactgccactcccaggtcaaaggctgatttcgaacaacagatgtacatactacgcagggtttcaatggtagctatccgagctgctttgaaccttcaacatggaggagtgagagacttctacatatgttctctatcctcgaggactatcgtctacaaaggtcagttaaagcccgaccagttgaaggaatactactatgctgatcttggcaatgaaaggtttacgagctacatggccctggtacattctagattctcaacgaacacatttcctagttgggatcgagcgcagcccatgcgtgtccttgggcacaatggagagattaacacacttagaggcaacgtgaattggatgagggctcgtgaaggtctcctaaaatgcaaggagcttggcctgtcaaaaacagagatgaagaagcttctgccgattgtagatgccagctcatcagattcaggtgcatttgatggggtacttgagcttttggttcgagctggtagaagtcttcctgaagctgttatgatgatgattccagaagcctggcaaaatgacaagaatatggatcctaaccggaaggctctatatgaatatttctcagctctaatggaaccatgggatggccctgctcttatatcatttactgatggaaggtatcttggagctacattggatcgaaatgggctgcgtccaggtcgcttttacataacacacagtggcagagttatcatggcaagtgaagttggagttgtcgatattcccccagaagatgtatccagaaaaggaagacttaatcctggtatgatgctgctagtggactttgagaagcatattgttgtagacgatgaagccttgaagcaacaatactcgcttgctagaccttatggagagtggctgaaaaggcaaaagtttcagttgaaagacatagttgaatctgttcaggaatctgacaggagtcctcctcccgtagctggtgttttaccggcatctcctgaggatgaaaacatggaaagcatgggaattcatggtttgttgtcaccattaaaggcctttggttatactgttgaatccctggagatgctgttattacctatggctaaagatggcattgaggcccttggttcgatggggaatgatgctccattggcagtgatgtctaacagggagaaacttacgtttgaatatttcaagcagatgtttgctcaggtcacaaaccctccgattgatcctattcgggagaagattgttacctcaatggagtgcatgattggtccagaaggtgatcttacagagaccacagaagagcaatgtcatcgcttgtcactgaaaggtcctctgctatccattgaggaaatggaagcaatgaaaaagatgaactacagaggctggagaagcaaagttcttgacattacatactccaagggacgtggtaggaaaggcttggaagagactttagacagaatatgtaatgaagcgcataatgcaatcaaggagggttatacaacactagtgctttctgacagagctttctcatctaagcgtgtcgctgtcagctccctcttggcaattggtgctgtacatcatcatctagtaaagaagcttgagcgaacccgtgttgcactgattgtcgaatctgctgagccccgtgaagtgcaccatttttgtacacttgtaggctttggtgctgatgcaatctgcccttatttggctatagaagccatttggagattacaggttgatggaaaaattcctcccaaagcaactggtgaattccacaccaaggaggagcttgtaaagaaatactttaaagctagcaactatggcatgatgaaggtccttgccaaaatgggtatatcaactttggcctcatataagggtgctcagatctttgaggcagtgggcctctcgtcggaggtaatggaacgatgcttctcaggaaccccaagcagagtggagggtgccacttttgaagcacttgcacatgatgcacttcagttgcatgagctagcttttccaacacgtgcaacaccacctggcagtgctgaggctgtagcacttcctaatccaggagaatatcactggaggaaaggtggtgaaattcacctaaatgacccccttgctattgcaaagttgcaagaagctgcccgatccaacagtgttgctgcctacaaagaatactctaaacgagtccaggaactgaacaagtcctgtaatttgaggggtcttctgaaatttaaagaggctgaagtaaaggttcctctggaagaggttgaacccgcgagtgagattgtaaaacgtttttgtactggagcaatgagctatggatcaatatcattggaggcacatactacacttgcaattgcaatgaacaagattggtggaaagtcaaatactggtgagggaggtgaacaaccttctcgcatggaacctcttccagatggttcaagaaatccaaagaggagttctattaagcaggtcgccagtggaagatttggagtttctagttattaccttacaaacgcggatgagttacagataaaaatggctcagggagcaaaacctggtgaagggggtgaacttccggggcataaggtcattggtgacattgctgtgaccaggaattcaacagctggggtaggactcatcagtcctcctcctcatcatgacatctattcgattgaagatcttgcacaattgattcatgaccttaagaatgcaaatcccggtgctcgtataagcgttaagttggtttctgaagctggtgttggagtgattgccagtggggttgttaagggtcatgctgatcatgtcttgatctctggtcatgatggaggcacgggagctgcaagatggactggaatcaaaagtgctggtcttccatgggagcttggtcttgcagagacccaccaaacattagttgctaatgatcttcgtggtcgaactgttctgcaaacagatggccaactaaaaactggaagagatgtggctattgcagctcttcttggtgcagaggagtttggatttagcactgcccctctgataacattgggctgcatcatgatgcggaagtgccataaaaacacttgccctgttggtattgccactcaagatccagttcttagggaaaagtttgctggtgaaccagaacatgtcatcaacttcttcttcatgttggcagaagaggtaagggagatcatgtctcagcttggattccgaacactcaatgaaatggtgggccgttctgacatgcttgaactcgataaagatctggtcaagaacaatgagaagcttaagaacattgatttgtctttgttacttcgaccagctgctgatatcagaccagatgctgctcagtattgtgtgcaaaaacaggatcatgggttggacatggctttggataacaaacttatatctttagccaagcctgccttggacagaagtctacctgtgtatatcgagtcacccatttgcaatgtaaaccgagcagttggaaccatgctaagccacgaagtgacgaagcgctaccatttggcgggacttccttcggatacaattcatatcaaactaaatggaagtgcgggccagagccttggagcttttctgtgtcctggcatcacactggagcttgaaggtgacagcaatgattatgttgggaaaggcttgtcaggtgggagaattattgtttatcctcctcaaggaagcaaatttgatccgaaggagaacattgtcattggaaatgtagcgctttatggggccacaactggagaggcttattttaatgggatggcggcagaaagattcgccgttcgcaattctggggctaaagcagtagtggaaggtgtgggtgaccatgggtgtgagtacatgactggtggaactgttgtagtgctgggcaagactggaagaaactttgctgctggcatgagcggggggattgcatacgttctcgatattgattctgctttccgatcccgatgcaatctggagttggtagatcttgatcctgttgaggatgatgatgatattctgactcttagaatgatgatacaacagcatcagcgccacacaggcagccagttagctaaggatgtgcttgctgaatttgactctctcttacctaaatttatcaaggtcttccctcgtgactataaacgcattcttgcaagtaagaaagcagaggaaatttcaaaagtggccgctgaaaatgctgccaaggaagatgaggtgcaagaagaggcagagttgatggagaaagatgcttttgaagagcttaagaagcttgcagctacatctgccaatgcaaaacccagtcaggttgaacaacaaaaatcattgaagagaccaacacgggtgcctgatgctatcaagcatcggggttttgttgcttatgagcgagaggggatttcatatagggatccaaatgttcgagtgaatgactggaatgaagtcatggaagagttaaagcctggaccattgttgaaaactcaatctgctcgctgtatggattgtggtactcccttttgccatcaggagaactctggatgccctcttgggaataagatacctgaatttaatgaattggtgtaccaaaatagatggcgtgaagcattagacaggcttctggagaccaacaacttcccagagttcacaggtcgtgtatgccctgcaccttgtgaagggtcttgtgtacttggtatcatagaaaatcctgtttctatcaaaagtatagagtgttccatcatagataaagcttttgaggagggatggatggtgccacgacctcctttgaagagaactggaaaaagagttgctattgttggaagcgggccttctggtttagctgctgctgatcagttaaataagatgggtcactctgtgacggtattcgagcgtgctgacagaattggtggtctaatgatgtatggagtgccgaacatgaaggctgacaaaatagatatagtccagagacgggttgacctcatggaaaaggaaggtgtcaactttgtcgttaatgctaatgttggaaaagacccttcatactccctagatcggcttcgtgaggagcatgatgccattgttttggctgtaggagccacaaaaccaagggaccttcctgttcctggacgagacctttctggtgtgcattttgcaatggagtttcttcatgcaaacacaaaaagcttactagatagcaaacttcaggacggaaactatatctctgctaagggcaagaaagtggtggtgattggtggaggtgatactggcacagactgtattgggacatctattagacatggatgcagtagtgttgtaaatctagagcttctccccgagccaccacgtaccagggctccaggcaacccttggcctcagtggccccgcgtattccgcgtagattatggacatcaggaagctgctaccaagttcggtagagatccgaggtcgtaccaagtgttgacaaaacgctttataggagatgagaatggagtggtgaaaggacttgaggtcgtgcacgtcaactgggagaaggatgcaagtggaagatttcaatttaaggaagtcgaaggttcagaggagattattggagccgatttggtgttgctggccatgggattccttggccctgaagagacgcttgctgagaaactgggattggaacgagacaaccgatcaaactttaaagccgaatatggccgcttctcaaccaatgtcgaaggggtctttgcagctggggactgccgacgtggacaatctctagtggtgtgggcaatctctgaaggcagacaagcagctgcccaagttgataaatatctcagtgatgccactgttgctagcgaaggagatgaagaatttgtaaagaggcaacaagacagcaacagacaaagggtaatgacatagttgtcttcggcttcttggtggtacctacaaggttcgaaactgggaacctcaattatcccgttcaaatgctctttcctggaacaatcaccttcagacgacgaagatcataaggtgcatgcctgagaagcaacaggaggctggtagaatcggcaatggtgtttatcagggtggaccttaggatttagtattatggtagtttgtctctttgtttataagttgtagcatgattgttcgttttaagtgctggcgcggattgccaggtttaagggaataaataataaatgtacaggttgtctgtctgttaaatacatggggggc

SEQ ID NO: 8097 - DNA, 7344 bp, Panax ginseng
ccccctatcccctcgtgtgcccttgcctcccacgactcgagagagcgcagtcctgttgttggttagattttatctctctctttctctttctatctaattctctcgatacatatccagaaatctctctgtttcttcgaaagttttgtcctactctaactctctctctctccggattaggactggccctctttctgtttatccgtttgtctcccgttttgtaactaatttacttttccgtgatctaaatacagctcaatcatcatatataatcttatcgagtaatcgagtgattgatttgattgctagatctgacattcgatttcacctgaagctcaaaccatctgatcttttctctatcttcaattataatattaaaaaatttgaaggagaaagactcagattccgtaaaatttagtgttgctttgttaactgaattataatgtcggtcgcttcgtattcggttattcaatttcaagccgggaacaacagttcctcatcatcgttggtgcttcctttagctgctaaacttaagcctctgctgaatcctcagctcaatgttttaaaccgtgctggtgttaaggccaaggccaaaacaaaaaagccctcctgttttgtcttggagaatagattctataggacgagattgcgaggtgggtcgggtccagaaaggcaccatctttggcaatcggatggacccggccgcgctccaaaactcagggtggtggtgcggtcgtcaatgtctcaggtgcccgagaagcctcttggtctctatgatccctcctttgataaggattcctgtggtgttggattcgtcgctgaattatccggccaaagcagtcgtaaaacgataacggatgcgatagaaatgttggtgcgtatgtcacatagaggtgcttgtggatgcgaaacaaacaccggtgatggggcaggcattctggtcgctcttcctcatgacttctacaaggaggttgcaaacgatgttggctttgagctgccaccacctggtgaatatgcagtgggcatgtttttcttgcctacctcggaaaatagaaggcaacaaagcaaaattgtatttacaaaggttgcagagtcgcttgggcatactgttcttggttggcgccctgtcccaactgataactctggattgggcaggtctgctttacaaactgaacccgtcattgaacaagtgtttcttactcctacacccaggtccaaagctgattttgagcaacagatgtacatattaaggagagtttcaatggtagctataagagctgctttaaacctccaacatggtggtgtgaaggacttctatatatgttctctttcctcgagaaccattgtctacaaaggtcagttgaagcccaatcaattgaaggaatactatgcagatcttggcaatcaaaggtttacgagctacatggccctgattcattctcgattttcaaccaacacctttccaagctgggaccgagctcagcctatgcgtgttttgggacataatggagaaatcaacacacttcggggaaacgtcaactggatgaaggctcgtgagggtcttttgaagtgcaaggagcttcacctgtcaaagaatgagttgaagaaacttctgccaattgttgatgctagctcatctgattcaggagctttcgatggtgtccttgagcttttagttcgagctggaagaagtcttcctgaagcaatgatgatgatgatccctgaagcttggcagaatgacaagaatatggatcctcatcggaaagctttgtacgaatatttctcagcccttatggaaccgtgggatgggcctgctctaatatcatttactgatggtcgctatcttggggctacattggaccgaaatggattacgtcctggtcgcttttatattactcatagtggacgagttataatggcaagcgaagttggagtggtagatattccacccgaagacgtatctaggaaaggaagacttaatcctggcatgatgcttcttgtggattttgagaaccatgttgttgtagatgatgaagctctgaagcatcaatattcactagcacgaccttatgggcagtggcttgaaaggcaaaagataactctgaaaaacatagttgaatctgttcatgaatctgatagggtctctccacccatatcaggagtcttgcaagcatctactgatgatgacaacatggaaaatatgggactttgtggtttgttgtctcccctgaaagcttttggttacactgttgaatccttggaaatgctgctgctaccaatggcaaaagacggtgttgaggccctcggctcaatggggaatgatgctccattggctgtgatgtcaagcagagagaaactcaccttcgagtattttaagcagatgttcgctcaagttacaaatcctcctattgatcctatccgagagaagatagttacatccatggagtgcatgattggcccagaagctgatcttacagaaaccaccgaagaacagtgtcaccgtctatcactgaaaggcccccttctgtccattgatgaaatgcaagcaattaagaaaatgaactatagaggctggcgcagcaaagttgtagacatcacgtattctaaagaacgtggtagtaagggtttggaggagaccctagataggatttgtttagaagcacataatgctattaaggagggatatactacgctggtgctttctgaccgagctttttcgtcaaatagagtccctgttagctccctcttggctgttggtgctgtacaccatcatctagttaaaaagcttgagcgtactcgcattgcattgattgttgaatctgctgagccccgggaagtgcaccatttttgtacattggttggatttggtgcagatgggatctgcccatatttggctgtagaagccatttggagactccaggttgatggaaagatcccacccaaatcaaacggtgagtttcactcaaaggatgatctggtgaagaagtacttcaaagcaagccactatggaatgatgaaggttcttgctaaaatgggaatatcaaccttggcctcttataagggtgctcagatttttgaagctgtgggtctttcatcagaagtgatggagaggtgcttcgctggaactcctagtagagtagagggtgcaacatttgaagcccttgcccatgatgctcttcatttgcatgagctcgcatttccaacacgggcattgccacctaaaagtgctgaggctgtagcacttcctaatcctggcgattatcactggaggaaaggtggtgaagttcatctgaatgatccccttgctatagcgaagctgcaagaggctgccagaggtaatagtgtcgctgcctacaaggagtactccaagcgcatacaggaattaaataaaacctgtaatttgaggggacttttgaaatttaaagaggcagcggtcaagattcctttggaggaggtggaagccgccagtgagattgtgaagaggttttgtactggagcgatgagttatggatccatttcactggaggcgcacacaacccttgctatagcaatgaataaaattgggggaaagtccaacacaggcgagggtggtgagaacccatctcgtctagagccactttcagatggttcgatgaatcccaagaggagtgcaatcaagcaggttgcaagtgggagattcggagtttcaagttattaccttacgaatgctgatgagctacaaataaaaatggctcagggagcaaaaccgggggaaggaggtgaacttccaggacataaggttattggtgacattgcagtcactaggaattctactgctggggtgggattaataagcccacctcctcatcatgacatctattcgattgaagatcttgctcaattgattcatgatttaaagaatgctaatccagcagctagagtgagtgtgaagttagtttctgaagctggtgttggagtaattgctagcggagttgtaaaggggcacgcagatcatattttgatctctggccacgatggaggtacaggggcatctcgatggactggtatcaaaagtgctgggcttccatgggaacttggtctggcagagacccaccaaacccttgttgctaatgatcttcgtggtcgaacagttctccagacggatggtcaactgaaaacaggaagagatgtggccattgctgcacttcttggcgcggaagagtttggtttcagcacagctcctcttataactcttggctgcatcatgatgcggaagtgccacaagaacacttgcccagtcggcattgcaacccaagatccagttcttagagagaagtttgccggagaacctgaacatgtcattaatttcttcttcatgctagcggaagaggtaagggaaattatgtctcaacttggagtacgaacaatcaatgaaatggttggtcgttcagatatgcttgaaatggataaagaactgaccaagaacaatgagaagctaaagaatattgatctctctctattacttagaccttctgctgacattcgacccgaagcagcccagtattgtgtacagaagcaagaccatggtttagacatggctttggataaaaatctaatagcactgtccaggcctgctttagtgaatggtcttcctgtatacatggagactcctatctgcaatataaatcgtgcagttggaacgatgcttagccatgaagttacaaagcgctaccacatggtgggccttcctgctgataccatccacatcaaactcaatggtagtgcgggccagagcctgggagcttttctctgcccaggcatcatgctggagcttgaaggtgatagcaatgactatgttgggaaaggattatcaggtggcaagattgttgtttatcctcctaaaggaagtcagtttgacccaaaagaaaacattgtaattggaaatgtggctctctatggggcgacaaatggagaagcttattttaacgggatggcagcagaaagattctgtgtacgtaactccggtgctaaagcagttgtagaaggtgttggtgatcatggttgtgagtacatgactggtgggactgttgtcgtgcttggaaaaactgggagaaattttgcagctggcatgagtggtggaattgcttatatttttgatgtggattccaagtttcgatcgcgatgcaatcctgagctagttgatcttgataaagttgaagaagaagatgatattatgactctcagaatgatgatacagcaacatcagcgacacacaaacagtcagcttgccaaagaattgcttgctgacttcgataatcttttgtctaaatttattaaagtctttcccagggattataaaagaattcttgtaagccttaaacaggaggaaactgccaaaaaggctgtggatagggcagctaaagaagctgaagagcaagaagaggccgagttatttgagaaagatgcctttgaagagcttaagaaaatgtcagatgcatctatgaaggagaaagctagtgaggcgggtattgctgaatcgttaaagagaccaactcaggtaactgatgctgtcaagcatagaggtttcgttgcttatgagcgcaagggtgtttcatacagggatccaaatgttcggatgaatgactggaaggaagttatggaagagtcaaaacctggtccacttctaaagacacagtctgctcgctgtatggattgtggcactcccttctgccatcaagaaaactctggatgccctcttgggaataaaatacctgagttcaacgagttggtgtaccaaaatagatggcgcgaagcactaaatcggcttctggagaccaataattttccagagttcaccggccgagtgtgcccggcaccatgtgaaggttcttgtgtgcttggtattattgaaaatccagtatctatcaaaagcattgagtgctctatcattgacaaggcttttgaggaagggtggatggtgccacgacctccgcttgaaagatctgggaaaagagttgctattgttggaagtggaccttcaggcttggctgccgctgatcagttaaatagaatgggtcattctgtgacggtctttgagcgtgctgatcggattgggggccttatgatgtatggagtacctaacatgaagacagacaaaattgatgtcgttcagaggcgagttgaccttatggagaaagaaggagtgacttttgttgttaatgccagtgttggtaaagatccgtcttattctcttgagcatcttcgcgaggagaatgatgctataattctggctgtaggagccacaaagccaagggaccttcctgtacctggaagggatctatcaggagttcattttgcaatggagtttcttcatgcaaataccaaaagcttgcttgatagcaatcttcaggatggtaactatatctcagccaagggcaagaaagtagttgtaattggtggaggtgacactggtacagattgcatcgggacatctattcgacatggttgcagtagcattataaatctggagcttcttcctgagcctccaagaacaagggcgccgggtaatccttggccacagtggcctcgcatattccgcgtagattatggacatgaggaagcagcttccaagtttgggaaagaccccaggtcctatgaggtattgactaagaggtttattggagatgagaatgggactgtgaaaggactggaattagtacgtgtccagtgggagaaggatgctagtggaaagtttcagtttaaagaagttgagggctctgaggagatcattgaggctgatttagtcctactagccatgggcttccttgggcctgagtcgaaaatagctgataaactggagctggagcgagacaatagatcaaacttgaaggcagaatatggccgtttctcaaccaatgtagaaggggtgtttgctgctggtgattgccgacgtggtcaatctctggtggtgtgggccatttcagaaggccgacaagctgcttcagaggtcgataagtatctcctgagagaggaaaaagactttgacattgatttagggagacaaggtgatgtaaccaagaggcagcaagatagcaacaaacaaacagtaatgacgtaattgtttatggttttaatctcatatttggattaaaagtagaatttttgatgatttccatatggcggaggtttatggtttgatgatcttgttgttggatgagttctgttgttggatgttgtagataagcaacaagaggatggctttgaagctaaaaaggatgataggttagattgggtgttaatgtccattttaggtgggcattattatcctctttaagtgttgttctatgtaatctcttgtttattaatttt

SEQ ID NO: 8098 - DNA, 8052 bp, Theobroma cacao
tacagtgagacaacctgtggaggctcggagcccaacctagccccctcttccaaaagcacctcaacaagaaaagcagccacgcccaaggcgtctatcccctcgtcgagggacccaccatgagcggctgtcgcgtgccgcatacgatgtaacctacacgtggctgtttgatgaaaccctgagctgtcacgtctctagaaaatggtgagagtattgctgggtaaatttagagcttcctagtcgtggtccccacactcctctcactaaaaaaaatactctttttttttttctaaattttttctctataaatccagtctcatctctttagagaactgcctaaagggcaggctcccaagttgttctgctcaaaatctttttcttgttctctgattgggtctctgggttttttttttgtttgttgcgattttaatagttgagtcatataatttcgttttctaatttcatcgaggttcgcagttcgatcttgaataatctgcacgtgacagcgagatttttcataattgtataaaaatttgttcgtttgaaggatttcgtttccttaaactggatttgaaattctaatcagaaaaatctcaacacttttttctcgagaaaccattataaaaatctttcaaaatccgtagattttcagatctcttttcaaatctctctggatccgtttaacggatgtaaatctgaaaaaggagataaactttcagtccgaaatattaattttatcgaaaactaacaatcaaggaattaccattcaaagaaaatcggatttgaaaaacggtctctgaataatgtcatcggcgtcggcctttaactctcttcttcagcttcgaaatggctcttactcactcccgtcactaaacaaatcctccatcactcctcagctgaatgtcgccccctcgagccgccgtaaaactagaaccgctcgatgttccgttacgaaaaagtgctcggcggctttggagaagaaattcttagggactcgagtgctggggtctggatcggagaggttacacttatggcagtcggacgggcagggtaaggccccgaaactccgggtcgtggtgcggtcctcattatccggggtgcctcagaagccactgggtctttatgatccgtcttttgataaggactcgtgtggggtcgggtttgttgctgagctatccggtggcagcagccgcaaaactataacggatgctttggagatgttgatacggatgtctcatagaggggcttgtggatgtgagacaaacactggtgatggtgctgggattcttgtggcgcttccgcatgatttctataaggaggttgcaagggatgttgggtttgagatgccaccatcgggggaatacggggtgggcatgttctttttgcccacatctgagagccgaagggaagaaagcaaaaatgtattcactaaggttgctgagtcccttggtcatagagtccttgggtggcgttctgtaccaacagataactcaggattgggcaatgctgctttgcagacagagccagttattgagcaagtgtttcttacacctacacctagatcaaaggctgaccttgaacagcagatgtacatactaaggagggtttcaatggttgctatccgagctgcattaaacctccaacatggtggtgttagggacttttatatatgttctctttcctcaaggactgttgtttataaggggcagttaaagcctgatcaactgcaaaactactattatgcagatcttggcaatgaaaggtttacgagctacatggccctgatacactctcgattttcaacaaatacatttcctagttgggatcgtgcccaaccaatgcgtgtcttgggccataacggggagattaatacactcagaggcaatgtaaactggatgaaggcacgtgagggattattaaagtgcaaggagcttgggctatcaaagaatgagatgaaaaagcttctgcccatcgtggatgccagttcatctgattcaggggcttttgatggtgttcttgagcttctggttcgagctggtagaagtcttccagaagcagttatgatgatgattccagaagcttggcaaaatgacaaaaatatggatcctcatcggaaggccctgtatgagtatttctcagctctaatggagccatgggatggacctgccctgatatcatttactgatggtcgctaccttggagctacattggatcgtaatggactccgtcctggtcggttttacgttacacatagtggacgagtcatcatggccagtgaggttggtgttgtggatattccacctgaagatgtgcttagaaaaggaagactaaaccctgggatgatgcttctggtagattttgagaagcatactgttgtcgatgacgatgccttgaagcaacaatattcacttgctaggccttatggtgaatggcttgagagccaaaaaattgaactcaacaacatagttgattcagttcaagaatcagagagggtcactccagcaatagctggagcgattcccgcttccaatgatgatgacaatatggagcacatgggaattcatggtttattggctccgttgaaagcttttggctacactgttgaggctttggagatgctgcttcttcccatggctaaagatggaacggaggccctgggttcaatgggaaatgatactcctctggcagttatgtccaatcgggagaagcttacttttgaatatttcaagcaaatgtttgctcaagtcactaatcccccaatcgaccccattcgagagaaaatagtgacatccatggaatgcatgattggtccagaaggggatctaacggaaacaactgaagagcaatgtcatcgtctttcactgaaggggcctcttttatcagttgaagagacagaagcaattaaaaagatgaactacagaggttggcgtagtaaggttcttgacataacttattcaaaggaccgtgggaggaagggattggaggaaaccttggacaggatttgtgctgaagcacgagatgcaattaaggaaggttatacattattggtgctttctgacagagccttctcgtcaaagcgtgttgctgtaagctccctcttggcagttggtgctgttcatcaccatcttgttaaaaaacttgaacgtactcgagtgggattgatagttgaatctgcagagccccgtgaagtgcaccatttctgcacactggttggatttggtgcggatgctatatgcccatacttggccatagaggccatttggagattacaggtagatggcaagatccctccaaaatctagtggtgagttttactcaaagcatgagctggttaagaagtatttcaaggcaagcaactatggaatgatgaaggttcttgccaaaatgggaatatctactttggcctcatacaagggtgctcagatctttgaagctctgggtctttcatcagaagtgattgagaagtgctttgcaggaactcctagcagagttgaaggagcaacatttgagatgctagctcgtgatgcacttcatttgcatgagttagcattcccttctcgggctcttgctccaggaagtgcagaagctgtggcactgcccaatcctggagattatcactggaggaaaggtggtgaagtgcacctgaatgatcctcttgctatagcacagctgcaagaagctgctaggagtaatagtgttgctgcatacaaggaatatgccaaacgtattcatgaactgaacaaatcctgtaatctgcgtgggatgttgaagttcaaagaggcaggggtgaaaatcccattggatgaggtggaacctgccagtgaaattgtgaaacggttctgtactggggccatgagttatggatctatatcattggaggcacatagtacgctggctattgctatgaatagaataggggggaaatcaaatacaggtgagggaggtgagcaaccatctcgtatggaacctctgcctgatggtttgatgaatccaaaaagaagtgccattaagcaggttgcgagtgggagatttggagtttcaagttattaccttacaaatgctgatgaattacagataaaaatggctcagggtgccaagcctggtgaaggaggtgaacttcctggtcataaggtaataggagatattgcagtcaccagaaactctacagctggtgtgggacttatcagcccacctccccatcatgatatctattcaattgaagaccttgcgcaactaattcatgatcttaagaattccaatccatcggctcgaatcagtgtgaagctagtatctgaagctggagtgggagtaattgctagtggagttgtcaaggggcatgctgaccatgtcttgatatcaggtcatgatggtggtaccggggcctcacgatggacaggcataaaaaatgctgggctcccatgggaacttggtttagctgagacccaccaaactctggttgccaatgatcttcgtggccgcactgttctccagactgatggccaacttaaaacaggaagagatgtggccattgctgcacttcttggtgctgaagagtttggcttcagcacggcccctctcataactctgggttgcatcatgatgcgaaaatgccacaagaacacctgccctgttggcattgctactcaagatcctgtgcttcgagaaaaatttgctggagaacctgaacatgtcattaactttttctttatgcttgccgaggaggtgagagagataatgtctcagcttggtttccgaacacttaatgagatggttggccgttccgatatgcttgaagttgataaggaagtcctaaggaataatgagaagcttcagaatattgatctctccttattactcagacctgctgctgacattcgccctgaagctgctcaatattgtattcaaaaacaggatcatggcttggatatggctttggaccaaaagctcattaaactatctaaagctgctctagagaaaggtcttcctgtatacattgaaacacctatatgcaatgtgaaccgtgcagttggaacaatgcttagccatgaagtaactaagcgctatcacttggcagggcttcctgctggtaccatccatatcaaactctcaggaagtgcaggacagagcctgggctctttcatgtgccctggcatcatgctggagcttgaaggcgatagcaatgactacgttggtaaaggattatcaggtggcaaaattgttgtttatcctccaaaaggaagccggtttgatcctaaagaaaacatagtaattggtaatgtggctctctatggagctactagtggggaagcatatttcaatggaatggcagcagaaagattttgtgttcgtaattcgggtgccaaagcagttgtagaaggtgttggtgatcatggttgcgagtacatgacaggtgggactgttgttgtgcttgggaaaactgggaggaactttgcggcaggtatgagtggtggtattgcatatgtgcttgatgtggatgggaaatttcaatctcgatgcaatcctgagctggtagaccttgataaagttgaagaagaggaggatattatgactcttaaaatgatgattcagcaacatcagcgtcatacaaacagccagttagccagagaagtacttgctgactttgagaatcttttgcccaaattcataaaagtcttccccagggattacaagcgcgttctagcaaaggtgaaagaagaggaagcctctaaggaggcattggaacgtgctgcaaaagaagctgaggagcgagacgaagcagagttggtggagaaagatgctttcgaagagctcaagaagttagcagcaaatttgatgaatgaggaatcaagtcaggaaggagaggccaaaccagtcaagaggccttctcgggtttctgatgctgtgaaacatcgtggttttgttgcttatgagcgtgaaggcgtccaatacaggaatcctaatgtccggatgaatgactggaaggaggtcatggaggaatcaaaacctggcccacttttaaagacacagtctgctcgctgcatggactgtggtactcctttctgccatcaggagaactctggatgccctcttggaaacaaaatacctgaattcaatgagcttgtgtatcaaaataggtggcgtgaagcactagatcgtcttctagaaacaaataactttccagagttcactggccgagtgtgtcctgcaccatgtgaagggtcttgtgttctgggtattattgagaatcctgtgtccatcaaaagcattgaatgtgctatcatagacaaggcatttgaggaagggtggatggtaccacggcctcctctcaagagaacagggaaaagcattgctattgtcggaagtggaccatctggtttggctgctgctgatcagctaaatagaatgggtcactccgtgactgtgtatgagcgtgctgatagaattggagggcttatgatgtatggagtccctaacatgaaggctgacaaggttgatgtagttcaacggcgggttaaccttatggctgaggaaggagttaaattcgtggtcaatgcaaatgttggaattgacccttcctattcccttgaccagctacgagaggaaaatgatgccattgttttggcagtcggagccacaaaacccagggaccttcctgttccaggacggaatttatctggtgttcattttgcaatggaattccttcatgcaaacagtaaaagtttgcttgatagtaatctccaagatggtaactatatatctgctaagggcaagaaagtagtggtcattggtggtggtgacactggtacagattgcatagggacatctatccgccatgggtgtagtagcattgtaaatcttgagttacttcctcagccaccacgaactagagctcctggcaatccttggccacagtggcctcgcatattccgtgtagactatggacaccaagaggctgctgccaaatttggtagagacccaagatcctatgaagttttgactaagagatttgtgggagatgagaatggaactttgaaaggacttgaggtggtacgagtgcgttgggaaaaagatgccagtgggaagttccagttcaaagaagttgagggttccgtggaaataattgaggctgacttagtcctgcttgccatggggttcctagggcctgagtcgacggtggcagacaagttaggtttggagcaagacaaccgatcaaacttcaaggcagagtatggtcgctttgcaaccaatgtgaatggagtctttgctgctggagattgtcgccgtggtcagtcattagttgtgtgggcaatctcagagggaaggcaagctgctgcacaagttgacaaatacctgactaggaaagatgaggacgtaagtgttgatggcgagagccagaaagatcttgtcaagagacatgaagaccttgctcagaggcagcaaacagtaatgacataagtgatattgattattactatttgtgacaatttgctgagaaggaaggtcaatctggttcagaatagagaaagagtttccaaagggagttgtcacatggatgaccactgctggaaataagcataatcttgtggataaccaccaagggatgcttagtccgcagcaaaaggacctgggaaggcttagtagagatttaaggatttgagaagttgtggtaggataaggcactcgcagaaggttgagcaaaaatcaataaacgacttccatgggactggtataggtttggggatattttatctttcatatgtatcatcttgtttataggttttacccggcttgttgcaaggtttgctctcatggttgtcataaaggaataatgtacagttttatttcttaatcgttgattgagaaaaaaaaaaggtggggatttttttgtatttattgtttctggagattggatatcctttttacagaaaagaaaattgggtaaaacacctgctgcaatttgtcttattccactaaaaattgaaataagaccttttactttaatctaatcggatcaagtcaccaaattaccgatgagtaataaataaattaccgattt

SEQ ID NO: 8099 - DNA, 7619 bp, Theobroma cacao
ccagtctcatctcagagtacggcctaaagggcaggctcccaagttgttctgctcaaaatctttttcttgttctctgattgggtctctgggttttttttttgtttgttgcgattttaatagttgagtcatataatttcgttttctaatttcatcgaggttcgcagttcgatcttgaataatctgcacgtgacaacgagatttttcataattgtataaaaatttgttcgtttgaaggatttcgtttccttaaactggatttgaaattctaatcagaaaaatctcaacacttttttctcgagaaaccattataaaaatctttcaaaatccgtagattttcagatctcttttcaaatctctctggatccgtttaacggatgtaaatctgaaaaaggagataaactttcagtccgaaatattaattttatcgaaaactaacaatcaaggaattaccattcaaagaaaatcggatttgaaaaacggtctctgaataatgtcatcggcgtcggcctttaactctcttcttcagcttcgaaatggctcttactcactcccgtcactaaacaaatcctccatcactcctcagctgaatgtcgccccctcgagccgccgtaaaactagaaccgctcgatgttccgttacgaaaaagtgctcggcggctttggagaagaaattcttagggactcgagtgctggggtctggatcggagaggttacacttatggcagtcggacgggccgggtaaggccccgaaactccgggtcgtggtgcggtcctcattatccggggtgcctcagaagccactgggtctttatgatccgtcttttgataaggactcgtgtggggtcgggtttgttgctgagctatccggtggcagcagccgcaaaactataacggatgctttggagatgttgatacggatgtctcatagaggggcttgtggatgtgagacaaacactggtgatggtgctgggattcttgtggcgcttccgcatgatttctataaggaggttgcaagggatgttgggtttgagatgccaccatcgggggaatacggggtgggcatgttctttttgcccacatctgagagccgaagggaagaaagcaaaaatgtattcactaaggttgctgagtcccttggtcatagagtccttgggtggcgttctgtaccaacagataactcaggattgggcaatgctgctttgcagacagagccagttattgagcaagtgtttcttacacctacacctagatcaaaggctgaccttgaacagcagatgtacatactaaggagggtttcaatggttgctatccgagctgcattaaacctccaacatggtggtgttagggacttttatatatgttctctttcctcaaggactgttgtttataaggggcagttaaagcctgatcaactgcaaaactactattatgcagatcttggcaatgaaaggtttacgagctacatggccctgatacactctcgattttcaacaaatacatttcctagttgggatcgtgcccaaccaatgcgtgtcttgggccataacggggagattaatacactcagaggcaatgtaaactggatgaaggcacgtgagggattattaaagtgcaaggagcttgggctatcaaagaatgagatgaaaaagcttctgcccatcgtggatgccagttcatctgattcaggggcttttgatggtgttcttgagcttctggttcgagctggtagaagtcttccagaagcagttatgatgatgattccagaagcttggcaaaatgacaaaaatatggatcctcatcggaaggccctgtatgagtatttctcagctctaatggagccatgggatggacctgccctgatatcatttactgatggtcgctaccttggagctacattggatcgtaatggactccgtcctggtcggttttacgttacacatagtggacgagtcatcatggccagtgaggttggtgttgtggatattccacctgaagatgtgcttagaaaaggaagactaaaccctgggatgatgcttctggtagattttgagaagcatactgttgtcgatgacgatgccttgaagcaacaatattcacttgctaggccttatggtgaatggcttgagagccaaaaaattgaactcaacaacatagttgattcagttcaagaatcagagagggtcactccagcaatagctggagcgattcccgcttccaatgatgatgacaatatggagcacatgggaattcatggtttattggctccgttgaaagcttttggctacactgttgaggctttggagatgctgcttcttcccatggctaaagatggaacggaggccctgggttcaatgggaaatgatactcctctggcagttatgtccaatcgggagaagcttacttttgaatatttcaagcaaatgtttgctcaagtcactaatcccccaatcgaccccattcgagagaaaatagtgacatccatggaatgcatgattggtccagaaggggatctaacggaaacaactgaagagcaatgtcatcgtctttcactgaaggggcctcttttatcagttgaagagacagaagcaattaaaaagatgaactacagaggttggcgtagtaaggttcttgacataacttattcaaaggaccgtgggaggaagggattggaggaaaccttggacaggatttgtgctgaagcacgagatgcaattaaggaaggttatacattattggtgctttctgacagagccttctcgtcaaagcgtgttgctgtaagctccctcttggcagttggtgctgttcatcaccatcttgttaaaaaacttgaacgtactcgagtgggattgatagttgaatctgcagagccccgtgaagtgcaccatttctgcacactggttggatttggtgcggatgctatatgcccatacttggccatagaggccatttggagattacaggtagatggcaagatccctccaaaatctagtggtgagttttactcaaagcatgagctggttaagaagtatttcaaggcaagcaactatggaatgatgaaggttcttgccaaaatgggaatatctactttggcctcatacaagggtgctcagatctttgaagctctgggtctttcatcagaagtgattgagaagtgctttgcaggaactcctagcagagttgaaggagcaacatttgagatgctagctcgtgatgcacttcatttgcatgagttagcattcccttctcgggctcttgctccaggaagtgcagaagctgtggcactgcccaatcctggagattatcactggaggaaaggtggtgaagtgcacctgaatgatcctcttgctatagcacagctgcaagaagctgctaggagtaatagtgttgctgcatacaaggaatatgccaaacgtattcatgaactgaacaaatcctgtaatctgcgtgggatgttgaagttcaaagaggcaggggtgaaaatcccattggatgaggtggaacctgccagtgaaattgtgaaacggttctgtactggggccatgagttatggatctatatcattggaggcacatagtacgctggctattgctatgaatagaataggggggaaatcaaatacaggtgagggaggtgagcaaccatctcgtatggaacctctgcctgatggtttgatgaatccaaaaagaagtgccattaagcaggttgcgagtgggagatttggagtttcaagttattaccttacaaatgctgatgaattacagataaaaatggctcagggtgccaagcctggtgaaggaggtgaacttcctggtcataaggtaataggagatattgcagtcaccagaaactctacagctggtgtgggacttatcagcccacctccccatcatgatatctattcaattgaagaccttgcgcaactaattcatgatcttaagaattccaatccatcggctcgaatcagtgtgaagctagtatctgaagctggagtgggagtaattgctagtggagttgtcaaggggcatgctgaccatgtcttgatatcaggtcatgatggtggtaccggggcctcacgatggacaggcataaaaaatgctgggctcccatgggaacttggtttagctgagacccaccaaactctggttgccaatgatcttcgtggccgcactgttctccagactgatggccaacttaaaacaggaagagatgtggccattgctgcacttcttggtgctgaagagtttggcttcagcacggcccctctcataactctgggttgcatcatgatgcgaaaatgccacaagaacacctgccctgttggcattgctactcaagatcctgtgcttcgagaaaaatttgctggagaacctgaacatgtcattaactttttctttatgcttgccgaggaggtgagagagataatgtctcagcttggtttccgaacacttaatgagatggttggccgttccgatatgcttgaagttgataaggaagtcctaaggaataatgagaagcttcagaatattgatctctccttattactcagacctgctgctgacattcgccctgaagctgctcaatattgtattcaaaaacaggatcatggcttggatatggctttggaccaaaagctcattaaactatctaaagctgctctagagaaaggtcttcctgtatacattgaaacacctatatgcaatgtgaaccgtgcagttggaacaatgcttagccatgaagtaactaagcgctatcacttggcagggcttcctgctggtaccatccatatcaaactctcaggaagtgcaggacagagcctgggctctttcatgtgccctggcatcatgctggagcttgaaggcgatagcaatgactacgttggtaaaggattatcaggtggcaaaattgttgtttatcctccaaaaggaagccggtttgatcctaaagaaaacatagtaattggtaatgtggctctctatggagctactagtggggaagcatatttcaatggaatggcagcagaaagattttgtgttcgtaattcgggtgccaaagcagttgtagaaggtgttggtgatcatggttgcgagtacatgacaggtgggactgttgttgtgcttgggaaaactgggaggaactttgcggcaggtatgagtggtggtattgcatatgtgcttgatgtggatgggaaatttcaatctcgatgcaatcctgagctggtagaccttgataaagttgaagaagaggaggatattatgactcttaaaatgatgattcagcaacatcagcgtcatacaaacagccagttagccagagaagtacttgctgactttgagaatcttttgcccaaattcataaaagtcttccccagggattacaagcgcgttctagcaaaggtgaaagaagaggaagcctctaaggaggcattggaacgtgctgcaaaagaagctgaggagcgagacgaagcagagttggtggagaaagatgctttcgaagagctcaagaagttagcagcaaatttgatgaatgaggaatcaagtcaggaaggagaggccaaaccagtcaagaggccttctcgggtttctgatgctgtgaaacatcgtggttttgttgcttatgagcgtgaaggcgtccaatacaggaatcctaatgtccggatgaatgactggaaggaggtcatggaggaatcaaaacctggcccacttttaaagacacagtctgctcgctgcatggactgtggtactcctttctgccatcaggagaactctggatgccctcttggaaacaaaatacctgaattcaatgagcttgtgtatcaaaataggtggcgtgaagcactagatcgtcttctagaaacaaataactttccagagttcactggccgagtgtgtcctgcaccatgtgaagggtcttgtgttctgggtattattgagaatcctgtgtccatcaaaagcattgaatgtgctatcatagacaaggcatttgaggaagggtggatggtaccacggcctcctctcaagagaacagggaaaagcattgctattgtcggaagtggaccatctggtttggctgctgctgatcagctaaatagaatgggtcactccgtgactgtgtatgagcgtgctgatagaattggagggcttatgatgtatggagtccctaacatgaaggctgacaaggttgatgtagttcaacggcgggttaaccttatggctgaggaaggagttaaattcgtggtcaatgcaaatgttggaattgacccttcctattcccttgaccagctacgagaggaaaatgatgccattgttttggcagtcggagccacaaaacccagggaccttcctgttccaggacggaatttatctggtgttcattttgcaatggaattccttcatgcaaacagtaaaagtttgcttgatagtaatctccaagatggtaactatatatctgctaagggcaagaaagtagtggtcattggtggtggtgacactggtacagattgcatagggacatctatccgccatgggtgtagtagcattgtaaatcttgagttacttcctcagccaccacgaactagagctcctggcaatccttggccacagtggcctcgcatattccgtgtagactatggacaccaagaggctgctgccaaatttggtagagacccaagatcctatgaagttttgactaagagatttgtgggagatgagaatggaactttgaaaggacttgaggtggtacgagtgcgttgggaaaaagatgccagtgggaagttccagttcaaagaagttgagggttccgtggaaataattgaggctgacttagtcctgcttgccatggggttcctagggcctgagtcgacggtggcagacaagttaggtttggagcaagacaaccgatcaaacttcaaggcagagtatggtcgctttgcaaccaatgtgaatggagtctttgctgctggagattgtcgccgtggtcagtcattagttgtgtgggcaatctcagagggaaggcaagctgctgcacaagttgacaaatacctgactaggaaagatgaggacgtaagtgttgatggcgagagccagaaagatcttgtcaagagacatgaagaccttgctcagaggcagcaaacagtaatgacataagtgatattgattattactatttgtgacaatttgctgagaaggaaggtcaatctggttcagaatagagaaagagtttccaaagggagttgtcacatggatgaccactgctggaaataagcataatcttgtggataaccaccaagggatgcttagtccgcagcaaaaggacctgggaaggcttagtagagatttaaggatttgagaagttgtggtaggataaggcactcgcagaaggttgagcaaaaatcaataaacgacttccatgggactggtataggtttggggatattttatctttcatatgtatcatcttgtttataggttttacccggcttgttgcaaggtttgctctcatggttgtcataaaggaataatgtacagttttatttcttaatcgttgattgagaaaaaaaaaaggtggggatttttttgtatttattgtttctggagattggatatcctttttacagaaaagaaa

SEQ ID NO: 8100 - DNA, 7744 bp, Gossypium raimondii
ctataaaaaaagggcaggctctctttcaagtcggatctgctcagttaattttcttttttctctgttttctttttcctgcttgtttgcctctctttctaggtttcttgcgcattttctcggtttatttcttgaggtttgatcggtgagggaatcgggggatttcattttcctagtgttttcgagtggttcgaagatcggtctttggagaatccgcacgtgacgaagagatttttttttctctttttcatatatgtaaaagaattactatttggaaggatttggtttccgttgaactggatttttgaaactcaggacttcgttttttccccgggaaataaatcgttcgaaatattttcagatcttactagatccggttgtcggatctgaatctgaagaggaaaaagtttttcagaaaagctctttaaattgaattatagtgtaaagaatatcggagtttgtaaaaccgtttttttgaaaaaatgtcgtcggcgccgacgtctagctccctagttcaacttcggaaaagctcttgttcactcccttcaatcaacaaatcttaccttaatcctcaactgaatgtcaccctttcaaaccgccgcaaaacgagcaacgctagatgctccgttacaaaaaagtcctcggtggctttggagaagaaatttctagggacccgattgcggggatcggagaagttacacttttggcagtcggaaggcccgggtcgggttccgaaactccgggttatggtgcggtccgcattatccggggtgcctgaaaagcctctcggtctttatgatccgtcttttgataaggattcgtgtggggtcggatttgtcgctgagctatctggtgacagcagccgtaaaactgtaacggatgctttggagatgttgatacggatgtcacatagaggggcttgtggatgtgagacaaatactggagatggagctggtattcttgtggctcttccccatggtttctataaggaggttgcaaaagatgttgggtttgagttgccaccaccaggagaatacgcggtgggcatgttctttttgcccacatctgagagccgaagggaagaaagcaaaaatgtattcactaaggttgctgaatctcttggccatagagtgcttgggtggcgatctgtaccaacagataactcaggacttggcaatgctgctttgcagacagagcctgttattgagcaagtgtttcttacacccacacctagatcaaaggctgaccttgaacaacagatgtacatattaaggagggtttcaatggttgccatccgagctgcattgaacctccagcatggtggtgttagggacttctatatatgttctctttcctcaaggactgttgtatacaagggtcagttaaagcctgaccaactgcaaaattactattatgcagatcttggcaatgaaaggtttacgagctacatggccctgatacattctcggttttcaacaaatacatttcctagctgggatcgtgcacaaccaatgcgtgtcttgggccataatggggaaattaatacacttagaggcaatataaactggatgaaggcacgtgaaggattattaaagtgcaaggagcttggtctctcgaagaatgagatgaaaaagcttcttcccattgtggatgccagttcatctgattcaggggcttttgatggtgtccttgagcttctggttcgagctggtagaagtctcccagaagcagtaatgatgatgatccctgaagcctggcaaaatgacaaaaatatggatcctcagcggaaggccttgtatgaatatttctcagctctaatggagccatgggatggacctgctctgatatcatttactgatggtcgctaccttggagctacattggatcgcaatgggctccgtcccggtcggttttatgttacacacagtggacgagtcatcatggccagtgaagttggtgtagtggatattcctcctgaagatgtgctcaggaaaggaagactaaaccctgggatgatgcttttggtagattttgaaaatcacattgttgtcgacgatgaagcattgaagcaacaatattcactagctaggccttatggggaatggcttcagaggcaaaaaattgaactcaatgacattgtagactcggttcaggaatcagagaggctccctccctcaattgctggatctatgccagcttccaatgatgatgacaacatggataacttaggaattcatggcttattggctccattgaaggcttttggctataccgttgaggctttggagatgctgctgcttcccatggctaaagatgggacagaggcccttggttcaatgggaaatgatgctccattggcagttatgtccaaccgagagaagcttacatttgaatatttcaagcaaatgtttgctcaagtaaccaatccccctattgatcctattcgagagaaaatagtgacttccatggaatgcatgattggtccagaaggagatctaacagaaacaacggaagagcaatgtcatcgtctttcactgaaggggcctcttttatcaattgaagagactgaagcaattaaaaagatgaatttcaaaggttggcgtagtaaagttcttgacataacttattcaaaggactgtgggaggaagggtttagaggaaaccttggacaggatttgtgctgaagcacgagatgcgattaaggaaggttatacattactggtgctttctgacagagctttttcatcgaagcgtgttgctgtgagctccctcttggctgttggtgctgttcatcaccatcttgttaaaaatcttgagcgtacacgagttggattaatagttgaatctgcagaaccacgtgaagtgcaccatttctgcacattggttggatttggtgcagatgctatatgcccatatttggccatagagaccatttggagattgcaggtagatgggaagattcctcctaaatctagtggtgagttccactcgaaggaagagctggtcaagaaatatttcaaggcaagcaactatggaatgatgaaggttcttgccaaaatggggatatctactctggcctcatacaagggtgctcagatctttgaagcattgggcctctcttcagaagtgattgagaaatgctttgcaagaactccgagcagagttgaaggagcaacatttgagatgctagctcgtgatgcacttcatttgcatgagttagcattcccttctcgtgcttttgctccaggaagtgcagaagctgtagcactgcctaatcctggagattatcactggaggaaaggtggtgaggttcacctgaatgatcctcttgctatagcaaagctgcaagaagctgccaggagtaacagcgttgctgcctacaaggaatatgccaaacgtatccatgaattgaataaaacctgtaacctgcgtggtatgttgaagtttaaggagtcagaagccaaaattccattggatgaggtggaacctgccagtgaaattgtgaaaaggttttgtactggggccatgagttatggatcaatatcattggaggcacacgcaaccctggctattgctatgaatacacttggggggaaatcaaatactggtgagggaggtgagcaaccatctcgtatggtacctctacctgatggttctaggaatccaaaacgaagtgctatcaagcaggttgcaagtggaagatttggagtttcaagttattaccttactaatgctgatgaactacaaataaagatggctcagggtgccaagcctggtgaaggaggggaacttccaggtcataaggtaataggagatattgctgtcactagaaactctacagctggtgtgggacttatcagtccacctccccatcatgatatctattcaattgaagaccttgcacagctgattcatgatcttaagaattcaaatccctcagctcgaatcagtgtgaagctggtatctgaagctggtgtgggagtaattgctagtggggttgtcaaggggcatgcagaccatgtcttaatatctggtcatgatggtggcactggggcctcacgatggactggcataaaaaatgctgggcttccatgggaacttggtttggctgagacccaccaaactctagtcgccaatgacctccgtggccgtacagttctccagactgatggccaacttaaaactggaagagatgtggccattgctgcacttcttggtgcagaagaatttggcttcagcacagctcctctaataactctgggttgtattatgatgcgaaaatgccacaagaacacctgcccagtgggcatcgctactcaagatcctgtgctgagagaaaaatttgctggagagcctgagcatgttataaactttttctttatgctagctgaggaggtcagggagataatgtctcagcttggtttccgaacagttactgagatggttggtcgttcagatatgcttgaggttgataaggaagtccttagtaataatgagaaacttcagaatattgacctctccttgcttctcagacctgctgctgatattcgccctgaagctgctcaatattgtattcaaaaacaggatcatggcttggatatggctttggaccaaaaactcattaaactatctactgctgctctagagaaaggtcttcctgtatacattgaaacacctatatgcaatgtgaaccgtgcagttggaacaatgctgagccatgaagtgactaagcgctaccaccttgcagggcttccagctggtacaattcatatcaaactctcaggaagtgcagggcagagcttgggagctttcctgtgccctggcatcatgctggagcttgaaggtgatagcaatgactatgttggaaaaggattatcaggtggaaaaattgtagtttatcctcctaaaggaagtcggtttgatcctaaggaaaacatagtaattggtaatgtggctctctatggagctacttccggggaagcatatttcaatggaatggcagcagaaagattttgtgttcgtaattcaggtgctaaagcagttgtagaaggcgttggtgatcatggttgtgagtacatgactggtgggactgttgttgtacttggaaaaactggcaggaattttgctgcaggtatgagtggtggtattgcttatgtccttgatgtggatggaaaatttcaatctcggtgcaatcctgagctggtggaccttgataaaattgaagaagaggaggatattgtcactctgaagatgatgattcagcagcatcagcgccataccaacagccagttagctagagaagtacttgctgactttgagagccttctgcccaaattcataaaagtattccccagagattacaaacgtgttctggcaaagatgaaagaccaggaagcatctgaacgtgctgcaaaagaagctgaggagcaagatgaggtagagctgatggagaaagatgcttttgaagagctcaagaagttggcagctgcatcttcgaatgagaaatcaagtctgacagtcgaggctgaaccagtcaagaggcctactcaggtttctgatgctgtgaaacatcgtggttttgttgcttatgagcgtgaaggtgttcaatatagagatcctaatgttcggatgaatgactggaaggaggtcatggaggaatcaaaacctggcccacttttaaagacacagtctgctcgctgcatggactgtggtactcctttctgccatcaggagaactctggatgtcctctcggaaacaaaatacctgaattcaatgaactggtgtaccaaaataggtggcgtgaagcactagatcgtcttctagagacaaataacttcccagagttcactggccgagtgtgccctgcaccatgtgaagggtcttgtgtgcttggtattattgagaatcctgtgtccatcaaaagcattgaatgtgctatcatagacaagggatttgaggaagggtggatggtgccacgacctcctctcaagagaacagggaaaagcattgctattattggaagtggaccatctggcttggctgctgctgatcaactaaatagaatgggtcactctgtgactgtgtatgagcgtgctgatagaattggagggcttatgatgtatggagtccctaacatgaagactgacaaggtagatgtagttcagcgacgtgttaaccttatggctgaggaaggagttaaatttgtcgtcaatgcaaatattggaaaagacccgtcctactcccttgaccggcttcgagaggaaaatgatgccattgttttggcaattggagccacaaaacccagggaccttcctgtaccaggacgagatttatctggtgttcattttgcaatggaattcctacatgcaaatactaaaagcttgcttgatagtgatctccaagatggtaactacatatcagccaagggcaagaaagtagtagtcatcggtggaggtgacactggtacagattgcattgggacatctatccggcatggatgtagcagcattgtaaatcttgagttgcttcctcagccaccgcagacaagagctcctggcaatccttggccacagtggcctcgcatattccgtgtagactatgggcaccaagaagctgctaccaaatttggaaaagacccaagatcctatgaggttttgactaagaggtttataggagatgataatggaaatgtgaaaggacttgaggtggttcgtgtgcgttgggagaaggatgccagtgggaggttccaattcaaggaagttgagggctcagaggaaataatcgaggctgaccttgtcctgctagccatgggattccttggccctgagtcgacactggcagaaaaattaggtgtggagcaagacaatcgatcaaacttgaaggcagagtatggccgcttcacgaccaatgtggatggagtctttgcagctggagattgtcgacgtggtcagtcattagtcgtgtgggcaatctcggaaggaaggcaagctgctgcacaagtcgacaaatacctgactaaggaagacaaggacacaagtgtagagggtgagaaccaagattccgtcaagcggcaccaagaccttccccaaaagcagcaaactgtcatgaaatagatgatccatcagattgttattgtttgcgacattgggctgaaatggaacccgaatccaatacattccgaaggaaattggtatttacatggatgaccagagtgggaattaaagcatgaatcttttgcggttaaaccagcaagggggatatatgctttaatctcccaacaaagaacctataagcaaaaatcaataaacattcatggggctgagctgatatttagtagatttagggatattttgtcttttctcatgtctttgttatctttatttatagtttttattcaggttcagctctcatcgttttcttgaaaggtacaataatgtatagttttgtctcttaaatcgtttggtttagacaagaatgcgaggtgctttttaatatgaaatatttgaggttgggttttctgatgaactcagttaaagaactaaatacgacattttcacaactaaatcaattaaaaaaaaagaagcagctcaattgtcgtttaaataggttttttagcttatttcaaccaattctggtggtcaatccaattggtcaagagagagttttagagtgagaaatattaaattttccttgataaatgtatatttcaagatttttccaaatttctacaattgttattgccttcaac

SEQ ID NO: 8101 - DNA, 7610 bp, Vitis vinifera
cttctcctcgctctataaatgttcgcccatcttctctccgccgagaagacagccaccgtagagagcagagattgtgtcggtagctaaaccggaagactctcaatcctctcgcccttttccttttcattttgcttcgttctctcgctcgctttccgtcctcgtctgtgtctttgtgcgttttgtttctgcgaagtaaatcgattttctttcagttttcggttttctgggagcggtttgtttgtttgtttatgtgaattggatctcgaagagtccgacggaggacactaaaataacttgtagtcttcaacactcctttcgttgaatctgagagttttcatctaacatatagtttttgtgagtttttgtgctggagaaggtttcttggtgaaaattgttggatttggtctttgcacataggtatagatccggtggttatctcctgaagttaccgaatcagaatgtcggcgacgtctggttctggttctgttgttcaaatccgaaacaactctggttcgggtcttgtcccttctcggaagcgccctacctttgctcaccaattcaatgtgactcctttgagtcgcttcaataacaaatcgaagggttcgagctgctatgtttcaaaacgaactaatgttgttgagaacaagtttttggggaccagattgcggggatgtggatcagaaaggcttcatttttggcaatcggatggtcctggtcgatcgccgaagctcagagttgttgtgcggtcggcattgtcgcaggtgccggaaaagcctctcggtctatatgatccgtctttcgataaggattcttgtggcgttgggtttgtcgcagaattatcgggtgaaagcagccgaaaaacggtgacggatgctgtggagatgctggtgcgtatgtctcacagaggtgcatgtggctgtgaaacaaatactggcgatggagctggcattctcgttggtcttcctcatgacttcttcaaggaggttgcacaggatgttgggtttgagctaccaccccctggggaatatgcagtgggcatgttctttttgcccacatctcacactcgaagggaagaaagcaaaaatgtatttacaaaggttgcggaatctcttgggcatacagtacttgggtggcgttctgtcccaacaaataactcaggattgggcaattctgctttgcagacagaacctgttgttgaacaggtgtttcttacacctactcctcgatcaaaagctgattttgagcaacagatgtacatactaaggagggtctcaatggttgctatcagagctgcactgaacctccaacatggaggagtaagggacttctatatatgttcgctttcctcaaggactgttgtttacaaagggcagttaaagcctgatcaagtgaagggatactactatgcagatcttggcaatgaaaggtttacgagctacatggccctgatacactctaggttctctacaaacacatttcctagttgggaccgagctcaacccatgcgtgtattgggccacaatggggaaatcaacacacttcgaggcaatgtaaactggatgaaggcacgtgagggtctattgaagtgcaaggaacttggcctatcaaagaatgagatgaagaagcttctacccattgtagatgccagctcatctgattcaggagcttttgatggcgttcttgagcttctggttcgagcaggtagaagtctccccgaagctgtcatgatgatgatacctgaagcatggcaaaatgacaagaatatggatcctgatcgaaaggccttgtatgaatatttctcagctctaatggagccatgggatgggcctgctcttatatcatttactgatgggcgctatcttggagctacattggatcgcaatggattgcgtcctggtcggttttatgtaactcatagtggacgggttataatggccagtgaagttggtgttgtagacattgctcctgaagatgtgcgcagaaaaggaagacttaaccctggcatgatgcttctggtggattttgagaatcatgttgttgtagatgatgaagccctgaagcagcagtattcactagctagaccttatggggagtggcttaaacggcaaaagatagaactaaaggatattgtggaatctgttcatgaatctgacaaggtctctcccactattgcaggggtgatgccagcatctaaccaagatgacagcatggaaaacatgggcatttatggtttattggctcctttaaaaacttttggttacactgttgaagccttagagatgctgctgctgcccatggcaaaagatggtactgaggcccttggttcaatgggaaatgatgctccattggctgtgatgtcaaacagagaaaaactcacatttgagtatttcaaacagatgtttgctcaagtcacaaaccctcctattgatccaatccgtgagaagatagtcacctccatggagtgcatgattggtccagaaggtgatcttacagaaaccactgaagaacaatgtcatcgtctctcattaaaaggccctcttctctccatccaagaaatggaagcaataaaaaagatgaactacagaggttggcgcagcaaagttcttgacattacttattctaaaaaccgtggtaggaagggattggaggagaccttggataggctttgttctgaagcgcatcatgccattaagcagggttatacagtgctagtactttctgacagagcgttctcatcaaagcgtgtagctgtgagctccctattggccgttggtgctgtgcatcagcatctggttcaaaagcttgagcgcactcaggttgggttgattgttgaatctgctgagccacgtgaagtgcaccatttctgtacattggttggatttggtgctgatgctatatgcccatatttggccatagaggctattttgagactacaagttgacggaaagatcccacctaaagcaagtggtgaattccactccaaggatgagttggtcaagaagtacttcaaagcaagcaactatgggatgatgaaagttcttgccaaaatggggatatcaactttggcctcttacaagggggctcagatttttgaagctgtgggtctttcatcagaagtgatccagaggtgttttacaggaactccaagtagagtcgagggtgcaacatttgaaatgcttgcacaggatgcgcttgagttgcatgagatggcatttcccacccgggttttccctccaggaagtgcagaggctgtagcgctgcccaatcctggggattatcattggagaaaaggtggtgaggttcacctgaatgatccccttgccatagccaagttgcaagatgctgccagatctaatagtgtggctgcctacaaagaatactccaagcgcatacaggaactgaataaaacctgtaatttgcgtggacttttgaagttcaaagaggcagaagtgaaggttcctttggatgaagtggaaccagccagtgagattgtgaaacgattttgtactggtgccatgagttatggatcaatatcattagaggcacacaccaccctggctattgctatgaacagaattggagggaagtcaaatacaggtgagggaggtgagaatccatctcgtttggagtctctccctgatggatcattgaatccaaaaagaagtgcaattaagcaggtagccagtgggagattcggtgtttcaagttattaccttactaatgctgatgaactgcagataaagatggctcagggagcaaagcctggtgaaggaggtgaacttccgggtcacaaggttattggagatattgcagttacaaggaattccactgctggggtgggattgatcagcccacctccgcatcatgatatctattcaattgaagaccttgcccaattaattcacgatcttaagaatgctaatccatccgcccgagttagtgtgaagctggtatctgaagctggtgtcggagtgattgctagtggagttgtgaagggacatgctgaccatgtcttgatctctggtcatgatggaggtacaggggcttctcgatggactgggatcaagaatgctgggctgccatgggaacttggccttgctgagacccatcaaactttagttgctaatgaccttcgtggacgcacggttctccagacagatggccagctgaaaactggcagagatgtagcaattgctgcccttcttggtgcagaagaatttggttttagcactgctccccttatcacacttgggtgcatcatgatgcgaaagtgtcacaaaaacacctgcccagttggcattgcaacccaagatccagttcttcgagagaagtttgctggagaacccgaacatgtcattaacttcttctttatgctagcagaggaggtaagggagattatgtctcagcttgggtttcgaacactcagtgagatggttggccgtgcagacatgcttgaagttgataaagaagtgactaagaacaacgagaaggtgcagaatatcgatctctcactactactgagacctgctgcagatatccggccagaagctgcccagtattgtgtacagaaacaagatcatggattggacatggctttggaccaaaaactcatagctctgtccaaggcagctttagaaaaaagtcttcctgtatatattgaaacaccaatccgcaatgtgaaccgtgcagttggtacaatgcttagccatgaagtgactaagcggtaccacagtgcagggcttccagcagagactattcatattaaactcagtggaagtgcgggtcaaagtcttggagcttttctatgtcctggcatcatgctggagcttgaaggagacagcaatgattatgttgggaaaggattatcaggtggcaagattgtagtttatcctccaagacaaagcaagtttgatccgaaggaaaacattgtaattggtaatgtggctctctatggggcaacaagtggtgaagcatatttcaatgggatggcagcagaaagattctgcgtccggaattcaggggcaagagcagttgtagaaggtgtcggtgatcatggttgtgaatacatgactggtgggactgttgttgtgcttggaaaaactgggaggaattttgctgcaggtatgagcggtggcattgcttatgtttttgatgtggatgagaagttcagttctcggtgcaaccctgagctggtagatcttgacaaagttgaaaaagaggaggatattatgactcttagaatgatgatacaacaacatcagcgtcatacaaacagccagttagcaaaagaaatacttgctgactttgacaatcttctacctaaatttatcaaggtcttccccagggattataaacgggttattgaaagcatgaaacaagaggaggcttccaaaaaggcattggagcaggacactcaggaggctgaggatcaagacgagaaagaattaatggagaaagatgcttttgaagaacttaagaagctggcagctgcatcactgaatgggaaaaacagtcagaaggtggaagaggctgaaccagataagaggcctactagagtagccaatgctgtcaaacatcgaggtttcattgcctataagcgtgagggaatttcatacagagatccaaatagcagaatgaatgactggaaggaggttatggtggaaacgaaacctggcccacttctaaagacccagtcggcccgttgtatggactgtggtactcctttctgccaccaggagaactctggatgtcctcttggaaacaaaatacccgaattcaatgaattggtgcaccaaaatcggtggcgtgaagcattagatcggctcctagagacaaataacttcccagagtttacaggaagggtatgtcctgccccttgtgaaggttcttgcgttcttggtattatcgaaaatccagtatccatcaaaagcattgaatgctccatcatagacaaggcctttgaggagggctggatggtgccgcggcctccccccaagagaactgggaagagagttgcgattgttggaagtggaccagccgggttggctgctgctgatcagctaaacagaatgggccattttgtgacagtgtttgagcgtgctgaccgaattggaggtcttatgatgtatggtgttcccaacatgaaggctgacaaagtggatgtagttcaacggcgcgttaaccttatggctgaggaaggtgtcaattttgttgtgaatgctagtgttggaacagatccatcatactctcttgaccggctccgggaggagaacgatgccattgttttggctgtaggagccacaaaaccaagggaccttcctgttccggggcgggagttatcaggaatccattttgctatgaaatttctacatgcaaacacgaaaagcttgcttgacagcaaccttgaggatggtaactacatttctgccaagggcaagaaggtagtggtgattggtggaggtgacactggcacagactgcatagggacatccatccgccatggttgcagtagcgttgtgaatctagagcttctccctcagccaccacagacccgggctcccggcaacccatggccacagtggcctcgcatattccgtgtggactatggacaccaggaagctgctgccaagttcggaaaagacccaaggtcctatgaagtattgaccaagcggtttattggagatgagaacggggtcttgaaagggcttgaagtgattcgtgtccaatgggagaaggatgccagtggaaagtttcagttcaaggaagttgagggcagccaggaggtgattgaggctgacctcgttctgctagccatgggattccttggccctgaggtgacagtagcagagaagctggggttggagcgagacaaccgatcaaacttaaaggcagattatggccgctttgcaaccagcgtggaaggggtctttgcagcaggggactgccggcgtggccagtctctagtggtctgggccatctcagagggccggcaggctgcttcacaggtggacaagttcctcatgcgagaagacgaacaccttaccaacaattggcaagacgacaacatcaagaggcaacaaaaaagcatcaaacacacagtaatgacatagggtaaccttagtccatcaaaacgttggggtcgaaagccaaagcaaaaatgacaattcttacacgcatatcgttcgcgaaattgatagcaatgctccattcccagtcgtgaaaccacataaggaattgaaggagttggaagaagctaaggagaaacaagctgggctacttctgggctatggggtagggttttaggaattgtcttgtgtttatttttaaagtatcatctttctgtctatagggcttctcaccccttcttttgttgtcctcaaggtcagctctttggtggttggttgaaaaggaagaataatgtacagttttgtatctgaatattttcatttgaaaagctataaaaatgaggatttgttgcttataaaaaccgctgtgtgctccggcttgctgaatttattcacattggtgggatagcatatcctaggaaattatgttgaatgggatatatgatatttttcaatattatattcaataaacatgaaattaagata

SEQ ID NO: 8102 - DNA, 7483 bp, Vitis vinifera
tagagagcagagattgtgtcggtagctaaaccggaagactctcaatcctctcgcccttttccttttcattttgcttcgttctctcgctcgctttccgtcctcgtctgtgtctttgtgcgttttgtttctgcgaagtaaatcgattttctttcagttttcggttttctgggagcggtttgtttgtttgtttatgtgaattggatctcgaagagtccgacggaggacactaaaataacttgtagtcttcaacactcctttcgttgaatctgagagttttcatctaacatatagtttttgtgagtttttgtgctggagaaggtttcttggtgaaaattgttggatttggtctttgcacataggtatagatccggtggttatctcctgaagttaccgaatcagaatgtcggcgacgtctggttctggttctgttgttcaaatccgaaacaactctggttcgggtcttgtcccttctcggaagcgccctacctttgctcaccaattcaatgtgactcctttgagtcgcttcaataacaaatcgaagggttcgagctgctatgtttcaaaacgaactaatgttgttgagaacaagtttttggggaccagattgcggggatgtggatcagaaaggcttcatttttggcaatcggatggtcctggtcgatcgccgaagctcagagttgttgtgcggtcggcattgtcgcaggtgccggaaaagcctctcggtctatatgatccgtctttcgataaggattcttgtggcgttgggtttgtcgcagaattatcgggtgaaagcagccgaaaaacggtgacggatgctgtggagatgctggtgcgtatgtctcacagaggtgcatgtggctgtgaaacaaatactggcgatggagctggcattctcgttggtcttcctcatgacttcttcaaggaggttgcacaggatgttgggtttgagctaccaccccctggggaatatgcagtgggcatgttctttttgcccacatctcacactcgaagggaagaaagcaaaaatgtatttacaaaggttgcggaatctcttgggcatacagtacttgggtggcgttctgtcccaacaaataactcaggattgggcaattctgctttgcagacagaacctgttgttgaacaggtgtttcttacacctactcctcgatcaaaagctgattttgagcaacagatgtacatactaaggagggtctcaatggttgctatcagagctgcactgaacctccaacatggaggagtaagggacttctatatatgttcgctttcctcaaggactgttgtttacaaagggcagttaaagcctgatcaagtgaagggatactactatgcagatcttggcaatgaaaggtttacgagctacatggccctgatacactctaggttctctacaaacacatttcctagttgggaccgagctcaacccatgcgtgtattgggccacaatggggaaatcaacacacttcgaggcaatgtaaactggatgaaggcacgtgagggtctattgaagtgcaaggaacttggcctatcaaagaatgagatgaagaagcttctacccattgtagatgccagctcatctgattcaggagcttttgatggcgttcttgagcttctggttcgagcaggtagaagtctccccgaagctgtcatgatgatgatacctgaagcatggcaaaatgacaagaatatggatcctgatcgaaaggccttgtatgaatatttctcagctctaatggagccatgggatgggcctgctcttatatcatttactgatgggcgctatcttggagctacattggatcgcaatggattgcgtcctggtcggttttatgtaactcatagtggacgggttataatggccagtgaagttggtgttgtagacattgctcctgaagatgtgcgcagaaaaggaagacttaaccctggcatgatgcttctggtggattttgagaatcatgttgttgtagatgatgaagccctgaagcagcagtattcactagctagaccttatggggagtggcttaaacggcaaaagatagaactaaaggatattgtggaatctgttcatgaatctgacaaggtctctcccactattgcaggggtgatgccagcatctaaccaagatgacagcatggaaaacatgggcatttatggtttattggctcctttaaaaacttttggttacactgttgaagccttagagatgctgctgctgcccatggcaaaagatggtactgaggcccttggttcaatgggaaatgatgctccattggctgtgatgtcaaacagagaaaaactcacatttgagtatttcaaacagatgtttgctcaagtcacaaaccctcctattgatccaatccgtgagaagatagtcacctccatggagtgcatgattggtccagaaggtgatcttacagaaaccactgaagaacaatgtcatcgtctctcattaaaaggccctcttctctccatccaagaaatggaagcaataaaaaagatgaactacagaggttggcgcagcaaagttcttgacattacttattctaaaaaccgtggtaggaagggattggaggagaccttggataggctttgttctgaagcgcatcatgccattaagcagggttatacagtgctagtactttctgacagagcgttctcatcaaagcgtgtagctgtgagctccctattggccgttggtgctgtgcatcagcatctggttcaaaagcttgagcgcactcaggttgggttgattgttgaatctgctgagccacgtgaagtgcaccatttctgtacattggttggatttggtgctgatgctatatgcccatatttggccatagaggctattttgagactacaagttgacggaaagatcccacctaaagcaagtggtgaattccactccaaggatgagttggtcaagaagtacttcaaagcaagcaactatgggatgatgaaagttcttgccaaaatggggatatcaactttggcctcttacaagggggctcagatttttgaagctgtgggtctttcatcagaagtgatccagaggtgttttacaggaactccaagtagagtcgagggtgcaacatttgaaatgcttgcacaggatgcgcttgagttgcatgagatggcatttcccacccgggttttccctccaggaagtgcagaggctgtagcgctgcccaatcctggggattatcattggagaaaaggtggtgaggttcacctgaatgatccccttgccatagccaagttgcaagatgctgccagatctaatagtgtggctgcctacaaagaatactccaagcgcatacaggaactgaataaaacctgtaatttgcgtggacttttgaagttcaaagaggcagaagtgaaggttcctttggatgaagtggaaccagccagtgagattgtgaaacgattttgtactggtgccatgagttatggatcaatatcattagaggcacacaccaccctggctattgctatgaacagaattggagggaagtcaaatacaggtgagggaggtgagaatccatctcgtttggagtctctccctgatggatcattgaatccaaaaagaagtgcaattaagcaggtagccagtgggagattcggtgtttcaagttattaccttactaatgctgatgaactgcagataaagatggctcagggagcaaagcctggtgaaggaggtgaacttccgggtcacaaggttattggagatattgcagttacaaggaattccactgctggggtgggattgatcagcccacctccgcatcatgatatctattcaattgaagaccttgcccaattaattcacgatcttaagaatgctaatccatccgcccgagttagtgtgaagctggtatctgaagctggtgtcggagtgattgctagtggagttgtgaagggacatgctgaccatgtcttgatctctggtcatgatggaggtacaggggcttctcgatggactgggatcaagaatgctgggctgccatgggaacttggccttgctgagacccatcaaactttagttgctaatgaccttcgtggacgcacggttctccagacagatggccagctgaaaactggcagagatgtagcaattgctgcccttcttggtgcagaagaatttggttttagcactgctccccttatcacacttgggtgcatcatgatgcgaaagtgtcacaaaaacacctgcccagttggcattgcaacccaagatccagttcttcgagagaagtttgctggagaacccgaacatgtcattaacttcttctttatgctagcagaggaggtaagggagattatgtctcagcttgggtttcgaacactcagtgagatggttggccgtgcagacatgcttgaagttgataaagaagtgactaagaacaacgagaaggtgcagaatatcgatctctcactactactgagacctgctgcagatatccggccagaagctgcccagtattgtgtacagaaacaagatcatggattggacatggctttggaccaaaaactcatagctctgtccaaggcagctttagaaaaaagtcttcctgtatatattgaaacaccaatccgcaatgtgaaccgtgcagttggtacaatgcttagccatgaagtgactaagcggtaccacagtgcagggcttccagcagagactattcatattaaactcagtggaagtgcgggtcaaagtcttggagcttttctatgtcctggcatcatgctggagcttgaaggagacagcaatgattatgttgggaaaggattatcaggtggcaagattgtagtttatcctccaagacaaagcaagtttgatccgaaggaaaacattgtaattggtaatgtggctctctatggggcaacaagtggtgaagcatatttcaatgggatggcagcagaaagattctgcgtccggaattcaggggcaagagcagttgtagaaggtgtcggtgatcatggttgtgaatacatgactggtgggactgttgttgtgcttggaaaaactgggaggaattttgctgcaggtatgagcggtggcattgcttatgtttttgatgtggatgagaagttcagttctcggtgcaaccctgagctggtagatcttgacaaagttgaaaaagaggaggatattatgactcttagaatgatgatacaacaacatcagcgtcatacaaacagccagttagcaaaagaaatacttgctgactttgacaatcttctacctaaatttatcaaggtcttccccagggattataaacgggttattgaaagcatgaaacaagaggaggcttccaaaaaggcattggagcaggacactcaggaggctgaggatcaagacgagaaagaattaatggagaaagatgcttttgaagaacttaagaagctggcagctgcatcactgaatgggaaaaacagtcagaaggtggaagaggctgaaccagataagaggcctactagagtagccaatgctgtcaaacatcgaggtttcattgcctataagcgtgagggaatttcatacagagatccaaatagcagaatgaatgactggaaggaggttatggtggaaacgaaacctggcccacttctaaagacccagtcggcccgttgtatggactgtggtactcctttctgccaccaggagaactctggatgtcctcttggaaacaaaatacccgaattcaatgaattggtgcaccaaaatcggtggcgtgaagcattagatcggctcctagagacaaataacttcccagagtttacaggaagggtatgtcctgccccttgtgaaggttcttgcgttcttggtattatcgaaaatccagtatccatcaaaagcattgaatgctccatcatagacaaggcctttgaggagggctggatggtgccgcggcctccccccaagagaactgggaagagagttgcgattgttggaagtggaccagccgggttggctgctgctgatcagctaaacagaatgggccattttgtgacagtgtttgagcgtgctgaccgaattggaggtcttatgatgtatggtgttcccaacatgaaggctgacaaagtggatgtagttcaacggcgcgttaaccttatggctgaggaaggtgtcaattttgttgtgaatgctagtgttggaacagatccatcatactctcttgaccggctccgggaggagaacgatgccattgttttggctgtaggagccacaaaaccaagggaccttcctgttccggggcgggagttatcaggaatccattttgctatgaaatttctacatgcaaacacgaaaagcttgcttgacagcaaccttgaggatggtaactacatttctgccaagggcaagaaggtagtggtgattggtggaggtgacactggcacagactgcatagggacatccatccgccatggttgcagtagcgttgtgaatctagagcttctccctcagccaccacagacccgggctcccggcaacccatggccacagtggcctcgcatattccgtgtggactatggacaccaggaagctgctgccaagttcggaaaagacccaaggtcctatgaagtattgaccaagcggtttattggagatgagaacggggtcttgaaagggcttgaagtgattcgtgtccaatgggagaaggatgccagtggaaagtttcagttcaaggaagttgagggcagccaggaggtgattgaggctgacctcgttctgctagccatgggattccttggccctgaggtgacagtagcagagaagctggggttggagcgagacaaccgatcaaacttaaaggcagattatggccgctttgcaaccagcgtggaaggggtctttgcagcaggggactgccggcgtggccagtctctagtggtctgggccatctcagagggccggcaggctgcttcacaggtggacaagttcctcatgcgagaagacgaacaccttaccaacaattggcaagacgacaacatcaagaggcaacaaaaaagcatcaaacacacagtaatgacatagggtaaccttagtccatcaaaacgttggggtcgaaagccaaagcaaaaatgacaattcttacacgcatatcgttcgcgaaattgatagcaatgctccattcccagtcgtgaaaccacataaggaattgaaggagttggaagaagctaaggagaaacaagctgggctacttctgggctatggggtagggttttaggaattgtcttgtgtttatttttaaagtatcatctttctgtctatagggcttctcaccccttcttttgttgtcctcaaggtcagctctttggtggttggttgaaaaggaagaataatgtacagttttgtatctgaatattttcatttgaaaagctataaaaatgaggatttgttgcttataaaaaccgctgtgtgctccggcttgctgaatttattcacattggtgggatagcatatcct

SEQ ID NO: 8103 - DNA, 7742 bp, Gossypium raimondii
ctataaaaaaagggcaggctctctttcaggtcggatctgctcagttaattttcctttttctctgttttctttttcctgcttgtttgcctctctttctaggtttcttgcgcattttctcggtttatttcttgaggtttgatcggtgagggaatcgggggatttcattttcctagtgttttcgagtggttcgaagatcggtctttggagaatccgcacgtgacgaagagatttttttttctctttttcatatatgtaaaagaattactatttggaaggatttggtttcgtttgaactggatttttgaaactcaggacttcgttttttccccgggaaataaatcgttcgaaatattttcagatcttactagatccggttgtcggatctgaatctgaagaggaaaaagtttttcagaaaagctctttaaattgaattatagtgtaaagaatatcggagtttgtaaaaccgtttttttgaaaaaatgtcgtcggcgccgacgtctagctccctagttcaacttcggaaaagctcttgttcactcccttcaatcaacaaatcttaccttaatcctcaactgaatgtcaccctttcaaaccgacgcaaaacgagcaacgctagatgcttcgttacaaaaaagtcctcggtggctttggagaagaaatttctagggatccgattgcggggatcggagaagttacacttttggcagtcggaaggcccgggtcgggttccgaaacttcgggttatggtgcggtccgcattatccggggtgcctgaaaagcctctcggtctttatgatccgtcttttgataaggattcgtgtggggtcggatttgtcgctgagctatctggtgacagcagccgtaaaactgtaacggatgctttggagatgttgatacggatgtcacatagaggggcttgtggatgtgagacaaatactggagatggagctggtattcttgtggctcttccccatggtttctataaggaggttgcaaaagatgttgggtttgagttgccaccaccaggagaatacgcggtgggcatgttctttttgccctcatctgagagccgaagggaagaaagcaaaaatgtattcactaaggttgctgaatctcttggccatagagtgcttgggtggcgatctgtaccaacagataactcaggacttggcaatgctgctttgcagacagagcctgttattgagcaagtgtttcttacacccacacctagatcaaaggctgaccttgaacaacagatgtacatattaaggagggtttcaatggttgccatccgagctgcattgaacctccagcatggtggtgttagggacttctatatatgttctctttcctcaaggactgttgtatacaagggtcagttaaagcctgaccaactgcaaaattactattatgcagatcttggcaatgaaaggtttacgagctacatggccctgatacattctcggttttcaacaaatacatttcctagctgggatcgtgcacaaccaatgcgtgtcttgggccataatggggaaattaatacacttagaggcaatataaactggatgaaggcacgtgaaggattattgaagtgcaaggagcttggtctctcgaagaatgagatgaaaaagcttcttcctattgtggatgccagttcatctgattcaggggcttttgatggtgtccttgagcttctggttcgagctggtagaagtctcccagaagcagtaatgatgatgatccctgaagcctggcaaaatgacaaaaatatggatcctcagcggaaggccttgtatgaatatttctcagctctaatggagccatgggatggacctgctctgatatcatttactgatggtcgctaccttggagctacattggatcgcaatgggctccgtcccggtcggttttatgttacacacagtggacgagtcatcatggccagtgaagttggtgtagtggatattcctcctgaagatgtgctcaggaaaggaagactaaaccctgggatgatgcttttggtagattttgagaatcacattgttgtcgacgatgaagcattgaagcaacaatattcactagctaggccttatggggaatggcttcagaggcaaaaaattgaactcaatgacattgtagactcggttcaggaatcagagaggctccctccctcaattgctggatctatgccagcttccaatgatgatgacaacatggataacttaggaattcatggcttattggctccattgaaggcttttggctataccgttgaggctttggagatgctgctgcttcccatggctaaagatgggacagaggcccttggttcaatgggaaatgatgctccattggcagttatgtccaaccgagagaagcttacatttgaatatttcaagcaaatgtttgctcaagtaaccaatccccctattgatcctattcgggagaaaatagtgacttccatggaatgcatgattggtccagaaggagatctaacagaaacaacggaagagcaatgtcatcgtctttcactgaaggggcctcttttatcaattgaagagacagaagcaattaaaaagatgaaattcaaaggttggcgtagtaaagttcttgacataacttattcaaaggactgtgggaggaagggtttagaggaaaccttggacaggatttgtgctgaagcacgagatgcgattaaggaaggttatacattactggtgctttctgacagagctttttcatcgaagcgtgttgctgtgagctcccttttggctgttggcgctgttcatcaccatcttgttaaaaatcttgagcgtacacgagttggattaatagttgaatctgcagaaccacgtgaagtgcaccatttctgcacattggttggatttggtgcagatgctatatgcccatatttggccatagagaccatttggagattgcaggtagatgggaagattcctcctaaatctagtggtgagttccactcgaaggaagagctggtcaagaagtatttcaaggcaagcaactatggaatgatgaaggttcttgccaaaatggggatatctactctggcctcatacaagggtgctcaaatctttgaagctttgggcctctcttcagaagtgattgagaaatgctttgcaagaactccgagcagagttgaaggagcaacatttgagatgctagctcgtgatgcacttcatttgcatgagttagcattcccttctcgtgcttttgctccaggaagtgcagaagctgtagcactgcctaatcctggagattatcactggaggaaaggtggtgaggttcacctgaatgatcctcttgctatagcaaagctgcaagaagctgccaggagtaacagcgttgctgcctacaaggaatatgccaaacgtatccatgaattgaataaaacctgtaacctgcgtggtatgttgaagtttaaggagtcagaagccaaaattccattggatgaggtggaacctgccagtgaaattgtgaaaaggttttgtactggggccatgagttatggatcaatatcattggaggcacacgcaaccctggctattgctatgaatacacttggggggaaatcaaatactggtgagggaggtgagcaaccatctcgtatggtacctctacttgatggttcaaggaatccaaaacgaagtgctatcaagcaggttgcaagtggaagatttggagtttcaagttattaccttactaatgctgatgaactacaaataaagatggctcagggtgccaagcctggtgaaggaggggaacttccaggtcataaggtaataggagatattgctgtcactagaaactctacagctggtgtgggacttatcagtccacctccccatcatgatatctattcaattgaagaccttgcacagctgattcatgatcttaagaattcaaatccctcagctcgaatcagtgtgaagctggtatctgaagctggtgtgggagtaattgctagtggggttgtcaaggggcatgcagaccatgtcttaatatctggtcatgatggtggcactggggcctcacgatggactggcataaaaaatgctgggcttccatgggaacttggtttggctgagacccaccaaactctagtcgccaatgacctccgtggccgtacagttctccagactgatggccaacttaaaactggaagagatgtggccattgctgcacttcttggtgcagaagaatttggcttcagcacagctcctctaataactctgggttgtattatgatgcgaaaatgccacaagaacacctgcccagtgggcatcgctactcaagatcctgtgttgagagaaaaatttgctggagagcctgaacatgttataaactttttctttatgctagctgaggaggtcagggagataatgtctcagcttggtttccgaacagttactgagatggttggtcgttcagatatgcttgaggttgataaggaagtccttagtaataatgagaaacttcagaatattgacctctccttgcttctcagacctgctgctgatattcgccctgaagctgctcaatattgtattcaaaaacaggatcatggcttggatatggctttggaccaaagactcattaaactatctactgctgctctagagaaaggtcttcctgtatacgttgaaacacctatatgcaatgtaaaccgtgcagttggaacaatgctgagccatgaagtaactaagcgctaccaccttgcagggcttccagctggtacaattcatatcaaactctcaggaagtgcagggcagagcttgggagctttcctgtgccctggcatcatgctggagcttgaaggtgatagcaatgactatgttggaaaaggattatcaggtggaaaaattgtagtttatcctcctaaaggaagtcggtttgatcctaaggaaaacatagtaattggtaatgtggctctctatggagctacttccggggaagcatatttcaatggaatggcagcagaaagattttgtgttcgtaattcaggtgccagagcagttgtagaaggcgttggtgatcatggttgtgagtacatgactggtgggactgttgttgtgcttggaaaaactggcaggaattttgctgcaggtatgagtggtggtattgcttatgtccttgatgtggatggaaaatttcaatctcggtgcaatcctgagctggtggaccttgataaaattgaagaagaggaggatattgtcactctgaagatgatgattcagcagcatcagcgccataccaacagccagttagctagagaagtacttgctgactttgagagccttctgcccaaattcataaaagtattccccagagattacaaacgtgttctggcaaagatgaaagaccagaaagcatctgaacgtgctgcaaaagaagctgaggagcaagatgaggtagagctgatggagaaagatgcttttgaagagctcaagaagttggcagctgcatcttcgaatgagaaatcaagtctgacagtcgaagctgaaccagtcaagaggcctactcaggtttctgatgctgtgaaacatcgtggttttgttgcttatgagcgtgaaggtgttcaatatagagatcctaatgttcggatgcatgactggaaggaggtcatggaggaatcaaaacctggcccacttttaaagacacagtctgctcgctgcatggactgtggtactcctttctgccatcaggagaactctggatgtcctctcggaaacaaaatacctgaattcaatgaactggtttaccaaaataggtggcgtgaagcactagatcgtcttctagagacaaataacttcccagagttcactggccgagtgtgccctgcaccatgtgaagggtcttgtgtgcttggtattattgagaatcctgtgtccatcaaaagcattgaatgtgctatcatagacaagggatttgaggaagggtggatggtgccacgacctcctctcaagagaacagggaaaagcattgctgttattggaagtggaccatctgggttggctgctgctgatcaactaaatagaatgggtcactctgtgactgtgtatgagcgtgctgatagaattggagggcttatgatgtatggagtccctaacatgaagactgacaaggtagatgtagttcagcgacgtgttaaccttatggctgaggaaggagttaaatttgtcgtcaatgcaaatattggaaaagacccgtcctactcccttgaccggcttcgagaggaaaatgatgccattgttttggcaattggagccacaaaacccagggaccttcctgtacctggacgagatttatctggtgttcattttgcaatggaattcctacatgcaaatactaaaagcttgcttgatagtgatctccaagatggtaactacatatcagctaagggcaagaaagtagtagtcatcggtggaggtgacactggtacagattgcattgggacatctatccggcatggatgtagcagcattgtaaatcttgagttgcttcctcagccaccgcagacaagagctcctggcaatccttggccacagtggcctcgcatattccgtgtagactatgggcaccaagaagctgctaccaaatttggaaaagacccaagatcctatgaggttttgactaagaggtttataggagatgataatggaactgtgaaaggacttgaggtggttcgtgtgcgttgggagaaggatgccagtgggaggttccaattcaaggaagttgagggctcagaggaaataatcgaggctgaccttgtcctgctagccatgggattccttggccctgagtcgacactggcagaaaaattaggtgtggagcaagacaatcgatcaaacttgaaggcagagtatggccgcttcacgaccaatgtggatggagtctttgcagctggagattgtcgacgtggtcagtcattagtcgtgtgggcaatctcggaaggaaggcaagctgctgcacaagtcgacaaatacctgactaaggaagacaaggacacaagtgtagagggtgagaaccaagattccgtcaagcggcaccaagaccttccccaaaagcagcaaactgtcatgaaatagatgatccatcagattgttattgtttgcgacattgggctgaaatggaacccgaatccaatacattccgaaggaaattggtatttacatggatgaccagagtgggaattaaagcatgaatcttttgtggttaaaccagcaagggggatatatgctttaatctcccaataaagaacctataagcaaaaatcaataaacattcatggggctgagctgatatttagtagatttagggatattttgtcttttctcatgtctttgttatctttatttattgtttttattcaggttcagctctcatggttttcttgaaaggtacaataatgtatagttttgtctcttaaatcgtttggtttagagaagaatgcgaggtgctttttaatatgaaatatttgaggttgggttttctgatgaacccagttaaagaactaaatacaacattttcacaactaaatcaattaaaaaaaaagaagcagctcaattgtcgtttaaataggttttttagcttatttcaaccaattctggtggtcaatccaattggtcaagagagagttttagagtgagaaatattaaattttccttgataaatgtatatttcaagatttttccaaatttctacaattgttattgccttca

SEQ ID NO: 8104 - DNA, 7140 bp, Mimulus guttatus
tctgttgaatcacctaaaatttcaccagatctgatttaccgacgattggtgtaactaatttcaaaattaaaaaaaacgtaagatttatcttaaggcggtggattgatttcggattccgagaaacatgtcggcggtgtcaggatcgggcattcatgtgaaaggcggtggcctggtgaagccgccgtgcgcgccgagtcaccagctaaatgcggtggccgctttgagccggagggttagggcgtcgcagggatttacggcaaagcagaggacggtacgcctggagaataagttcgttttcggcacgagcctgaagagcggtgccgcagagaggttgcatctctggcagacgaccggggcgggtcggtctccgaagatacggtttgtggtgaagaattcgatgtctcaggttccggaaaagccgctcgggctttacgatccgtcttttgataaggactcttgtggtgtcggcttcgtggctgagctttctggtgaaagcagccgtaaaacggtaacggatgctattgagatgttggtgcgcatgtcgcatagaggtgcgtgtggttgcgagacgaatactggagatggtgctggaattctcgtcggcgttcctcatgatttttacaaagtggctcttaaagatgctggatttgagctaccaccacttggagagtatgcagtgggcatgtttttcttgcctacttcagacagccggagggaacaaagtaaaattgtgttcgcaaaggtggctgaatctcttggccacacagttcttgggtggcgttcagtccccactgataactctggattgggaaactctgctatgcagacagaacctgtcattgaacaagttttccttacagcctctcccaggtcgaaagctgattttgaacaacagatgtacatattaaggagggttgccatggtagctatccgagctgcactaaacattcaacatggtgcagtgagagacttctacatatgttctctgtcctcgaggactgttgtctacaaaggtcagttgaagccagaccagttgaagggatactactacgcagatcttggcaatgaaaggtttacgagctacatggccctgatacattctagattctcgacaaacacatttcctagctgggatcgagctcagcccatgcgtgtccttggccacaatggagaaattaatacccttcgaggcaatgtcaattggatgagggctcgtgagggtcttctgaaatgtaaggagcttggcctatcgaaggcagaaatgaagaagcttctgccaattgtagatgccagctcatctgattcaggttcatttgacggtgtgcttgagcttttggttagagctggcagaagtctacctgaagctgtaatgatgatgattccagaagcctggcaaaatgataagaacatggatcctagtcgaaaggctctgtatgaatatttctcagctctaatggagccatgggatgggcctgctcttatatcatttactgatggaagatatctgggagcaacattggatcgaaatgggctgcgaccaggtcgcttttacgtaacacatagtggcagagttatcatggcaagtgaagttggagttgttgatattcccccagaagatgtatccagaaaaggaagacttaatcctggtatgatgcttcttgtggactttgagaagcatgtcgttgtggatgatgaagccttgaagcaacaatactcgctgtcaagaccttatggagagtggcttcaaaggcaaaagttacagttgaaagacatagtcgaatctgttccggaatctgacagggtccctcctcccatggctggtgttttaccggcatctcccgatgatgaaaatatggagaacatgggacttcatggtttattgtcaccactaaaagcttttggttacactgttgaatccttggagatgctgctactacctatggcgaaagatggcattgaggcccttgggtcgatgggaaatgacgctccattggcagtgatgtctaacagggagaaactaacatttgaatatttcaagcagatgtttgctcaagtcacaaaccctcccattgatcctatccgggagaagattgttacctccatggaatgcatggttggtccagaaggtgatcttacagagaccacagaagagcagtgtcaccgcctgtcacttaaaggacctctgctatccattgaagaaatggaagcaatgaaaaagatgaaccacaggggatggagaagcaaagttcttgacattaccttctccaagagtcatggcaagaagggcttagaggaaacgttagacagaatatgcaccgaagcacatactgcaatcaaggagggttatacaacacttgtgttatctgacagagctttctcgccaaagcgagttgcggtcagttccctgttggctgttggtgctgtacatcatcatctagtgaagaacctcgagcgaacccgtgttgcattgattgttgaatctgctgagcctcgtgaagtccaccatttttgtacgcttgttggatttggtgctgatgcaatctgcccttatttggctgtagaagctatttggagattgcaagttgatggaaaaattccacccaaagcaaatggtgaattccacccaaaaggggagcttgtcaagaaatattttagagctagcaactatggcatgatgaaggtccttgccaagatgggtatatcaactttggcctcatataagggtgctcagatctttgaggctgtgggcctctcgtcagaggtgatggaacggtgcttcaagggaactcctagcagagtggagggcgccactttcgaagcacttgcacaagacgcacttcagttacatgaggtggctttcccaacacgtgccttgccgcctggtagtgctgaagctgtagctcttcctaatccaggagattatcactggaggaaaggtggtgaggttcaccttaatgacccctttgccattgcaaagttacaagaggctgccagatccaacagtgtgtctgcctacaaagagtactctaaacgtgtccaagaattgaacaagtcttgtaatttgagagggcttctgaaatttaaagatgctgaagcaaaggttccattggaagaagtcgaaccagcgagtgagattgtgaaacattttgttactggggctatgagctatggttctatatcattggaggcacattcaacactcgctattgcaatgaacaagattgggggaaagtcgaacactggtgagggaggtgaacaaccatctcgtatggagcctcttcctgatggttcaaggaacccgaagaggagttctattaagcaggtcgctagtggaagatttggagtttctagctattaccttacaaatgcagatgagttgcagataaaaatggctcagggagcgaagcctggtgaggggggtgaacttccaggtcataaggtcattggtgacattgctgtgaccaggaattccacagctggggtgggtctaatcagtcctcctccccatcacgacatctattcaattgaagatcttgcacaattgattcacgaccttaagaatgcaaatccggatgcccgtgtaagtgtgaagttggtttctgaagctggtgttggagttatagccagtggtgttgtcaaaggtcacgcagatcatgttcttatctctggtcatgatggaggtacaggggcttcaagatggactggaattaaaagtgctggtcttccatgggaacttggtctggcagagacccaccaaaccttagttgctaatgatcttcgcggtcgaactgttcttcaaacagatggccaactgaaaaccggaagggatgtggcgattgctgcacttcttggtgctgaggagtttggttttagcactgctcctctcataacactgggttgcattatgatgaggaaatgccataaaaacacatgtcctgttggtattgccactcaagacccggttcttagggaaaaatttgctggtgaaccagaacatgtcatcaacttcttcttcatgctggcagaagagctaagggagatcatggctgaccttggatttcgaacactcagagaaatggtaggccgttcggacatgcttgaactggataaagatgtggctgagaacaatcagaagcttaggaacattgatctgtccttattacttcgaccagctgctgatatcagaccagatgctgcacagtattgtgtgcagaaacaggaccacggtttggacatggctttggataacaaactaatcgcgctatcaaagcctgccttggagaaaagtcttcccgtttacattgaatcacctatctgcaatgttaaccgagcagttggaaccatgctaagccatgaggtgacgaagcgctaccatatggctggacttccttcggataccattcacatcaaactcagtggtagtgcaggtcagagtcttggagcttttctgtgccctggcattacacttgagcttgaaggagatagcaatgattatgttgggaaaggcttgtcaggtggaaagataactgtttatcctcctaaaggtagcacatttgatccaaaggagaacattgtcattggaaatgtagcgctttatggagccactactggagaagcttattttaatgggatggcggcagaaagatttgctgttcgcaattctggtgctacagcagtagtggaaggtgtgggtgaccatgggtgtgagtacatgaccgggggcactgttgttgtgctgggcaagactgggagaaactttgctgctggcatgagtgggggcattgcctatgttcttgatgccgattcgactttcaaatcgcgatgcaatctggaattggtagatcttgacccagttgaagaagaggaggatattttaacactcagaatgatgatacaacagcatcagcggcacacaggcagtcaattagctaaagaagtgcttgcgaattttgattctcttttacctaaatttattaaagtcttccctcgtgactacaaacacatcctcgccagcatgaaagcaggggatgtagcaaaagcagctgctgaaaatgcagccaaagaagctgaggtggaagaagaggccgagttgaataagaaagatgcttttcaagtgcttaaagatatgtcggttgtatcagatgacaacaataccagtcaggctgaagaggaacagttattgaagagaccaactagtgtttctaaccctgtcaagaatgggggttttgttgcttacgagcgagagggagtttcatacagggaccccactgagaggatggaggactggaatgaagttatggtagagtcgaaacctgggccactgttgaaaacacagtctgctcgctgtatggattgtggtacccctttttgtcatcaggagaactctggatgccctcttggtaataagatacctgaatttaatgagttagtgtaccaaaatagatggcgtgaagcattggacaggcttttggagactaacaacttcccggaatttacgggccgtgtatgccctgcaccttgtgaaggttcatgtgttctcggtattatagaaaatccagtctctatcaaaagtatagagtgctctatcatagataaagcttttgcggagggatggatggtgccacgtcctcctttgaagagaactggaaaaaaagttgctattgttggaagtgggccttctggcatggcggctgctgatcagttgaacaaaatgggacactctgtgacagtatttgagcgctcggacagagttggtggcctgatgatgtatggggtgcccaacatgaagactgacaaaattgatatagtcaaaagacgagttgatctcatggcaaatgaaggagtcaactttgtagttaatgccaatgttggtcaagatccctcctactcactagaccgacttcgtgacgagcatgacgccattatcttggctgtaggagccacaaaaccaagggaccttcctgttcctgggagagatctttctggagtccattttgccatggagtttcttcatgctaatacaaaaagcttgctagatagcaatctcgaggatggaaattacatctctgctaagggaaagaaggtagtagtgattggtggaggtgacactggcaccgactgtatagggacatctattagacatggctgcactaacatcataaatctggagcttctccctgagccacctcgtactagagctgccggcaacccttggcctcagtggcctcgcgtattccgcgtagattatgggcaccaagaagctgcaaccaagttcggcaaggatccaaggtcctatgaagttttgacaaaacgtttcataggaggtgaggatggagttgtgaaaggactcgagcttgtgcgcgtccaatgggcgaaggacgaaagtggaagattccaatttaaggaagtagaaggttcagaggagatcatcgaagctgatctagtcttgctggcaatgggattccttggtcctgaacagacaatggcagagaaactggggttggagcaagacaaccggtcaaacataaaagctgagtatggccgtttctcgaccaatgtggaaggggtgtttgccgcaggggattgcagaaggggacagtctctggtggtgtgggctatatctgaaggaagacaagcagcttcacaagttgacaaatttctcacgaaagatgaaagcgatgctgcacaaggacaggaagacgaatttgcggacaaacatcaagatggaaacagacaaacagtgaagacctaataatacggcttaaaacttgttgtctttggctcgaaagggctctcttacttggagtgatcgttcgtccacagacaatgtggaaaggtgcattgagagatcagaaccaagaggagagagccttttgtagaagcaggatttagaattttataatgatagtttgtgaaagtttttgtgtttatataagttatatatattaatttagtatgatttgaaatttgatgtggttggtttatgttcaggcaatcttttttgccaggttggttaaggtaagggaataaataacaatgtacaggtcgttgtctgatttaattttctttgagaaattgattatatacactactgggggattttagtttttctttttacttaaataactttccaacttttta

SEQ ID NO: 8105 - DNA, 7514 bp, Lactuca sativa
gaaagtttaccctaaaagtggcaaattggtaagcgggccccacgcccaacaatggcaccttgttgagaagatgagctggtaccccctgcctccctctataaaatcaacctactacccacctcgtcgaggccgagaaaaaccccacccaccagaaccctttctctctctctctctctctctctctctctcgtgtgtgtgtctgcgggagtgtgcataacagcagccgtcggctgctacgtcggttgttcagttttgttcgttttatcttttaaagattcatcttgaatccatataccctgcgtatcgagtccatatacaaaaccccccaactaaatcggcctgtcaattggaggaaagtgggcgcttgatttgaaccattccttctttaaactaagttgatagctatccagatctgataataaacgcttcacaaatctgtttattggaaagatctgaagcagggggagtttttgataaaaattgttggtatctgataatgtcggtggctttgaatcatgctgtccaggcccgacccgacgcggacgtaacgaaacctttcgcttccgcttcccgtccgttaagcgggttagcccggattggggttggccggagccgcacatggacgagccgtggctcggtcgttaaacagtctagtctgttagggaagaagttgtatgggactaggctgcaacgggggtcggtttccgagacgctccatcaatggaaatcggatggtccgggtcgtgacccgaagcttaaggtggtggttcggtctgctttgtcgctagtgccggagaagcccttaggtctttatgatccatcctttgataaggatgcatgtggggtcggttttgttgctgaattatccggcaaaagtaaccgcaatacggtgactgatgcgattgagatgttggttcgtatgtcacatagaggtgcctgtggatgtgaaacaaacaccggcgacggtgccggaattctcgtcggtcttccacatgacttctacaaggaggttgctaaagatgaggggtttgagctaccaccacctgggaagtacgcagtggggatgttcttcttgcctacttccgataccagaagggagcaaagcaagattgtgttcacaaaggttgctgaatcacttgggcacacagttcttggctggcgaactgttcccacagataattctggattggggaagtccgctattcaaacagaacccgtcattgaacaagtgttcctcacacccacatctaggtcaaaagctgattttgagcagcagatgtacatactaaggagggtttcaatggtagctatccgggctgcattgaacctacaacatggtgggatcagggacttctatatatgttctttatcatcaagaactattgtgtacaaaggtcagttaaaaccgaaccagttgaaggagtattattatgcagatcttgggaatgaaaggtttacgagctacatggccctgattcattctcggttttcaaccaacacttttcctagctgggatcgagctcagcctatgcgtgttcttggccacaatggagagatcaacacacttagagggaatgttaactggatgaaggcacgtgaaggtcttctgaaatgcaaagagcttggtctttcaaagaatgagatgaagaaacttcttcccattgtagatgccagctcatcagattcaggtgcttttgatggtgttcttgagcttttggtgcgagctggtagaagtcttccagaagctgttatgatgatgattccagaagcctggcagaatgacaagaatatggatcctaaaaggaaggcattatatgaatacttttcagctttaatggagccatgggatggacctgcacttgtttcatttactgatgggagataccttggagctacactggacagaaatggtctacgtccaggtcgattttatgttactcatagtggaagagttgtaatggcaagtgaagttggagttgttgatattccacctgaggatgtttctagaaaaggaagacttaaccctggaatgatgcttcttgtggactttgagaaacatacagttgtagatgatgaagccttgaaaaaacaatactcattacaaagaccatatggaaagtggcttgaacaacaaaagatagaattgaagcacattgttgaatctgttaacaaatctgcccgtgcatgtccccctattgctggagtttcacaagcatctcccaatgacgagaacatggagaacatgggtattcgtggccttttggctccattgaaggctttcggttacactattgaagctttggagatgcttttacttccaatggcaaaagatggtgttgaggcacttggttcaatgggaaatgatgctccattggctgtgatgtcagacagagagaagctaacatttgagtatttcaagcaaatgtttgcacaagtaacaaacccacctatcgatcctatcagggagaaaattgtaacttccatggaatgcatggtggggcctgaaggtgatcttacagagacaacagaagagcaatgtcatcgcctttctctaaaaggaccactcttgtctattgaagagatggagtccattaaaaaaatgaacttcagagggtggagaagcaaggttcttgatataacctacccaaaagaacttggcaaaaagggtttggaggaaaccctagatagaatctgttcacaggcacacaatgccatcaaagagggttataccacattggtcctttctgacagagccttttcatcaaaacgagtagcagtaagctcactgttggcagttggtgctgtccaccatcatttagtgaagaagcttgagagaaccagagttgctttaatggtggaatcagctgagccacgtgaagtacaccatttttgtactttagttggatttggtgttgatgccatctgtccctatttagcagttgaagccatttggaggatgcaagttgatggcaagattccaccaaagtcaaacggtgacttccattcaaaagaggaattagtcaaaaagtactacaaagcaagccactatggaatgatgaaggttcttgcaaaaatgggtatatcaactttggcttcatataaaggtgctcaaatctttgaagcagttgggttatcaacagaagtaatggaaagatgctttgctggaactccaagtagagttgaaggagcaacatttgaagcacttgctggtgatgctcttcagttacatgatttagggtttccatcacgccagttccctcccaacagtgctgaagctgttgctttacctaaccctggtgattatcattggagaaaaggtggtgaagttcatttgaatgaccctcttgctattgccaagttacaagaagctgctagaggcaacagtgttgaagcctataaagagtattcgaaacgtatacacgagttaaacaaaacctgcaatcttcgtggacttttgaagttcaaagagggaaaagtcaaggttcctttagaagaagttgaacctgcaagtgaaattgtgaaaagattctgtactggagccatgagttatggttctatatcgcttgaagcacacagcacccttgcaatcgccatgaacaaaattggaggcaaatctaacactggtgagggaggtgagaatccatctcgtttggaaccacttccagatggttcaatgaacccaaaaaggagtgcaatcaagcaagttgctagtggaagatttggggtcaacagttattaccttacaaacgcagatgaaatacagataaaaatggcacagggagcaaaaccaggtgaaggtggtgaacttccaggacacaaagtcatcggagacatcgccaccactagaaactcgacagctggcgttggtctaatcagccctccacctcaccacgacatctactcaatcgaagatctcgctcaactaattcacgatttaaagaacgcgaatccttctgctcgagtgtctgtgaaactagtatctgaagcaggtgtaggagtaatcgcaagtggagtagtgaaaggccatgcggaccatgtcttgatttcaggtcacgatggtgggaccggtgcgtccaggtggaccgggatcaagagtgctggactcccatgggaactcggtctagccgagacccaccaaaccctagttgcaaacgacctccgtggtcgaaccgtgcttcaaacagatggccaattgaaaaccggaagagatgtagccattgctgctcttttaggagcagaagaattcggattcagtacagctccactcatcacactcggctgcatcatgatgcgaaagtgtcacaaaaacacatgtcctgtaggcatcgccactcaggatcctgtcctccgtgaaaaattcgcaggagaacccgaacatgtcatcaacttcttcttcatgttagcagaggaaatgcgtgaactcatgtcagaaatgggatttagaacagtcaatgaaatggttggacgtgcagacatgcttgaagtcgataaagagttgaccaaaagcaacgagaagctcaagaacattgacctctcacttctacttcgacccgctgctgacatcagatcagatgctgcacagacatgcgtacaaaaacaagatcatggtcttgacatggcactcgatcaacggctgatatcgctcgcaaaacccgcattagaaaaaggtcttcccgtttacatcgagtcaccgatctgtaacgtgaatcgtgcggttgggacgatgcttagtcatgaagtgactaaaaggtatcatttaccgggtcttccagctgatacgatccatattaagctccatggaagtgcggggcagagtatcggagcctttttatgtcccgggattatgcttgagcttgaaggtgatagtaatgattatgttggaaaagggttgtctggtgggaagattgtggtttatcccccgaagggaagtgggtttgatccgaaagagaatattgtgattgggaatgtggctttatacggggcgacaagtggcgaagcttattttaatggaatggcggctgaaagattctgtgtgaggaactcaggggcaaaaacggtagttgaaggtgttggtgatcatgggtgtgagtacatgacaggtgggacggttgtcatattgggaaaaaccgggaggaattttgctgcggggatgagcggtgggatcgcgtatgttcttgatgttgacttgaagtttcggtcaaggtgtaatactgagctggttgatcttgataaggttgaagatgaggaggatattatgactttgaaaatgttgattcagcaacatcagagacacacaaacagccagctggcgaaggaagtacttgctgactttgaccatcttttgcctaagtttatcaaggttttcccgagggattataagcggattttggccaccatgaaagaaacggaagtcgctaaaaaagctgctgatttggctgctgaagaagctgacattcgtgaggaagatgtgctgaaggagaaagatgcttttgaggaacttaagaagctggcagccaagtcattgactgagacagttaatcagttgattgagactgttaatcaggtgaaggaggatgaaaaagccgaacaggcaacccgaccatcgcgagttgctgatgcggtcaaacatcgtgggtttgttgcgtatgagcgcgagggtgtgtcttaccgggacccgtctgtacggatgaatgattggaatgaagttatggaagagtcgaaaccgggcccgctattgacaactcaatctgcacggtgcatggattgtggtactcctttttgccatcaggaaaacacgggttgccctctcgggaacaaaatccctgaattcaacgagttggtttatcagaacagatggcgtgaggcattggatcgacttcttgaaacaaataacttcccggagttcacgggccgggtttgccccgctccatgtgaaggttcatgtgtgctgggtataatcgaaaacccggtgtccatcaaaagcattgagtgttcaatcatagacaaagcctttgaagaaggatggatggtgcccagaccccccctcaagagaacagggaaaaaagttgctattgttggaagtgggccctctggattggctgcagctgatcaactaaacagaatgggtcatacagtgactgtgttggagcgggctgatcgaattggtggactgatgatgtacggtgttcctaacatgaagacagacaagattgatgttgtccaaagacgggttgacctgatggctacagaaggtgtgaattttgtggtgaacgcaaatgtaggaaccgatccggtgtactcaatcgaacgtcttcgccaagagaatgatgcggttattttagcagtgggggccacaaagccaagggacctccctgttcctggacgtgagctctcaggtgtgcattttgcaatggaatttctacatgcgaatactaaaagcttattggatagcaatcttgaagatggaaactacatctctgcaaaggggaagaaggtggttgtgattggtggaggtgacactggtacggattgtatcgggacatcaatccgacatggttgcaccagcatcgtaaacctcgagcttcttcctgagccacctcgaacccgggccccaggcaacccgtggccacagtggcctcgtgtgttccgtgtggattatggacaccaggaagctgctacaaaattcgggaaagacccgcgatcgtatgaggtgttgactaaacggtttattagtgatgaaaatggagcagtgaaagggttggagttggttagagttcaatgggggaaagatgaaagtggaaggtttcagtttaaggaggtggaaggttctgaagagattcttgaggctgatttggttttgttagccatgggcttccttggtcctgaatcgacgatagcggataaattggggttggagaaagacgggaggtcgaacgtgaaggcggaatatgggagatttgctacaaatgtggaaggtgtgtttgcagctggtgattgtaggagagggcagtcgttggtggtgtgggcgatatcggaagggcggcaggcggcggctcaggtggataagtttgtgatgaaggaagaggaggagattgaagatgggaggttgcagatagaggaggggaagaagagggaggagcaacaggcgtttagaacatagacacgtggaggatggtgggggtggtggtgattataaatttataatgataattatagtgtggaagcttagtttttgtatcttattatcctccacctctcctgtgtcctggtagctgctgtttatagcctttttccttttggttttggtggattgcttgtttttgaactttgaaaaaaataaataaatgtacagatgagtctgtttcgtttcatgttatgcgattgtttttggtaaactggaagagcctactatgctttaaaataaaacgttggtagcctatcattgtattatctcacccttgaaagtgctcctaaagagattattgaatatagggatgaaagagcaaatggactga

SEQ ID NO: 8106 - DNA, 6385 bp, Vinca minor
ggtcaagctccaaagctcagggtggtccaggtccaatcagcattgtctcacgtccacgataagcctctaggtctctatgatccttcctttgataaggattcctgtggagtcggcttcgttgctgaactttccggcgaaagcagccgtaaaacggtgaccgatgccatagaaatgttggttcggatggcacatagaggtgcttgcgggtgtgagactaatactggtgatggagctggcattcttgttgcccttcctcatgatttctacaaggaggttacgaaggatgcgggttttgaactaccgccacctggagaatatgcagtgggcatgtttttcctccctacctctgaaagccgaagggaacagagcaaaattgtatttacaaaggtggccgagtctcttggtcacaccgttctcgggtggcgtcttgttccaacggataactctggattgggccagtctgctttgcagacagaacccgtcattgagcaagtttttcttacacccactcctaaatcgaaggctgatcttgagcagcagatgtacatattaaggagggtctcaatggtagctattcgagctgcattaaatctccaacatggtggagtgagggacttctatatatgttctctttcttccaggactgttgtttacaaaggtcagttgaagccggatcagctgaaagaatactactttgcagatcttggcaatgaaaggtttacgagctacatggccctgattcattcgcgattttcaacaaatacgttccccagctgggatcgtgctcagccaatgcgtgtcttgggtcacaatggtgaaattaacacactgcgtggcaatataaactggatgagggctcgtgaaggccttctaaaatgcaaagcattgggcctctcaaagactgagatgaagaaacttctacctatcgtagatgctagttcgtcggattcaggagcatttgatggtgttcttgagcttttaatccgagctggtcgaagccttcctgaagctataatgatgatgattcccgaggcctggcaaaacgacaagaacatggatcctgatcgaaaagccttgtatgaatacttttcagcactcatggaaccatgggatgggcctgctctcatatcatttacggatgggcgctaccttggggcgacactggatcgaaatggattgcgtcctggccgcttctatgttacccacagtggccgtgttattatggcaagtgaagttggagtagttgacatcccacccgaagatgtaagtagaaaaggaagacttaatccagggatgatgcttctagtagattttgagaaccatgtggtggtagatgatgaggcattgaagcagcagtattcccttgcaaggccttacggacagtggcttgagcggcataagatagaactaaaagatattgttgaatctgttcaagattctcacagggtccctccaccgattgctggagttgtagatccatccaagaatgatgaaaacatggaacatatgggaattcatggattattggctccactgaaggcttttggatatactattgaagccttggagattgctgttattacccatggcaaaagatggtgttgaggctcttggttcaatgggaaatgatgctcctctggcagtgatgtcggatagggagaaactgacatttgaatatttcaagcagatgtttgctcaagttacaaatcctccaattgatccaattcgggagaagattgttacctctatggaatgcatggttggcccagaaggtgatcttacagagacaactgaagaacagtgccaccgcctgtcacttaaagggcctctgctctccattgaagaaatggaagccatcaagagaatgacctatcgaggctggcgcagcaaagttctagacataaccttttccaaggagcgtggtaggaagggcttagaggagaccctggacaggatatgttcagaagcacatcaggccattaaggagggttatacaactcttgtactttctgacagagccttctctcctaagcgtgttgctgtcagctccttattggcagtcggtgctgtgcatcatcatctagttaaaaaccttgagcgaacgcaagttgcactgatcattgaatctgctgaacctcgtgaagttcaccacttctgtacactagtaggatttggtgcagatgctatctgtccctatttggcagtagaggccatttggagactacaggttgatggaaagattcctcctaaggctaccggtgagtttcattcaaaagctgagcttgtgaagaagtacttcaaagcaagcaactatggcatgatgaaagttcttgccaaaatggggatatcaactttggcatcttataagggcgcccagatatttgaggctgtaggcctttcatctgaaattatggagaggtgttttaaaggaactccaagcagagttgagggtgcaacttttgaagcacttgcacatgatgcgcttgtattgcatgaactggcatttccatctagggccttacctgctggaagcgcagaagctgtagcactccccaatcctggtgaatatcactggaggaaaggtggtgagattcacctgaatgatccccttgccattgcaaaactgcaggaagctgcaaaatccaatagtgtggctgcttacaaagagtattccaaacgtatacaagaattaaacaaaagttgcaatttgaggggacttctaaagttcaaagagggtgtaaaggttctgttggatgaagttgaaccagctagtgagattgtgaaaagattttgcactggagcaatgagttacggctcaatatcactagaggcacattcaactcttgctattgctatgaacagacttggcgggaagtcaaatactggtgagggaggtgagcaaccttctcgaatggagccccttccagatggttctatgaatccaaaaaggagtgcaattaagcaggttgcaagtgggagatttggagtgtcaagttattacctcaccaatgctgatgagttacaaataaaaatggcacagggagcaaaacctggagaaggtggtgaacttcctggccacaaggtggttggtgacattgctgtcactcggaattctactgctggagtagggttaattagtcctcctccacatcatgatatctattcaattgaggatcttgctcaactaattcatgacttgaagaatgcaaacccaggggctcgtataagtgtgaagttggtttctgaagctggtgttggggtaattgctagtggtgttgtcaagggtcatgctgatcatgtcttgatctccggtcatgatggaggtactggagcctcaagatggactggcataaagagtgctgggctcccatgggaacttggtcttgcagagacacatcaaaccttagttgctaatgatctccgtggccgaaccactcttcagacagatggccagctaaaaactggaagggatgtggccattgctacccttcttggtgccgaagagtttggtttcagcaccgctcctctcataactcttggctgcataatgatgcgaaagtgccacaaaaacacttgtccagtgggtattgcaacccaggatccagttctacgggaaaagtttgctggagaacctgaacatgtaataaactttttctttatgctagctgaggagttgagagagatcatgtctcagctgggtttccgatcgattaaggagatgattggccgctcggatatgctcgaactagatggtgatttggttaaggacaatgagaagcttaagaacattgatctctctcttttgcttcagcctgctgctgatatcaggccagatgctgctcagtattgcatacagaaacaggatcatggcttggacttggctttggataacaaactgatagagttgtctaaatctgctttggaaaagagtgttcctgtgtatattgaaacagcaatctgtaatgttaatcgatctgtaggaaccatgcttagccataaggttaccaagcgccatcacatggttggacttccagcagatacaatccatgtcaaatttaatggtagtgccggacagagttttggagcctttgtttgcccaggagttacgcttgagctcgaaggagatagcaatgactatgttgggaagggattatctggtgggaagatcattgtttatcctcctaaaggaagcaattttgaccctaaagaaaacattgtcatagggaatgtggctctctatggggcaactgctggtgaagcttacttcaatggaatggctgcagaaaggttttgtgttcgcaattcaggggccaaagctgttgtagaaggggttggtgatcatggatgtgaatacatgactggtggaactgttgttatcctagggaaaactgggaggaactttgcagctggtatgagtggtggagttgcatatgttcttgatgtggattctacgttccaatcccgttgcaaccctgagctcgttgatcttgataaagttgaggacgaagatgatatcctgactctcaagatgatgatacaacaacatcagcgtcacaccaaaagtcaactggcaaaagaggttcttgcggacttcaacaatcttttgcataaatttatcaaggtattccctagggactacaaacgagttcttgcaagcatgaaagaaaagggaaactctaaattggctgctgagcgagctgtaaaagaaatcgaggagaatgaggaggctgagttaatggagaaagatgcttttgaagagctcaaaaagttggcagattcgtccttgaatgaaaaggtagaagaaccccaacccaataagagacccaccagggtggctgttgctgtaaagcatcgtggttttgtagcatatgagcgggagagcgtttcatatagagacccaaatactcgtatcagtgactggaaagaagtaatgatagaaggaaagcctggtccgcttctgtcaacacagtctgctcgatgtatggattgcgggactccattttgccatcaggagaattctggatgccctcttgggaacaagatacctgaattcaacgagctagtataccaaaacagatggcgtgaagcattagataggctccttgagactaacaacttccccgagttcactggaagagtgtgtcccgcaccatgtgaagggtcttgtgtccttgggattatcgagaatccggtctccattaaaagcattgagtgtgctatcatagacaaagccttcgaggaggggtggatggtaccaagacctccgcccaagagaactgggagaagagttgctgttgttggtagtggacctgctggcttggctgctgctgatcagttaaataagatgggtcattctgtgacggtgtttgaacgcgctgaccgaattggtggtctcatgatgtatggagtgcctaatatgaaggcagacaaagttgacgtagttcagagaagggttgaccttatgaaaaaggaaggtgtcaactttgtggttaatgccaatgtaggaaatgatccctcatatgcccttgaccgactccgtgaggaccatgatgccattgttttggccgtgggttccacaaagcctagggaccttcctgttcccggacgtgagctttctggtgttcattttgctatggagtttcttcatgcaaatacaaagagcttgctggatagcgatcttcaggatgggaaattcatatctgctaaaagcaagaaggtagtggttattggtggaggtgacacaggtaccgactgtataggtacatctattcgacatggttgcagtagtattgtgaatttagagctgctgcctcagccaccaaataccagggctccaggcaacccttggccacagtggccacgtgtattccgtgtagattacgggcaccaggaagctgaaaccaagtttggtaaagacccaaggtcgtatgaagtcttaacgaagcagtttgttggagatgagaatggtgtggttaaaggtcttgaagtagtacgtgtagagtgggagaaggatgccaatggcaggttccagtttaaagaagttgaagggtccaatgagataattgaggctgatctagttttgttagccatgggtttccttggtccagaatcgacaatagcagaaaaactgggtttggaaacagacaacaggtcgaacttcaaagcagagtacggccggttctcaaccagcgtggaaggagtatttgcagcaggggactgccggcgcggccaatccttagtggtgtgggctatatctgaaggcaggcaagctgcttcacaggttgacaagttcctgatgaaagatgaaaccgatgccgaatcaaacatcggaaaacaagaagaatttacaaagagacgtcaagttagcaacaaacacacgacggta

SEQ ID NO: 8107 - DNA, 6998 bp, Ricinus communis
tttggtttgtcaataatgtcggcgacctcttcttctagttctcttcttcaacctcgacgaggagctaatcttaacataacgaaacagccctgttccatttctcctaaactaaacgttattgctcctatatctcgccgaacctctagacctacacgatgctccgttaccaagaaatcagcggttttggacaaaaagatctttggaactagacttagggctgcaggaaccgagaggctccatttctggcaatccgatggacctggatgctctcccaagctccgggttatggttcgctccgcattgtccggagtcccagagaagcctctcggtctttatgacccatcttttgataaggattcttgtggggtcgggtttgttgctgagttatccggtgaaaatagccgtaaaacggtgactgatgcgttggagatgttgatacgcatgtctcatagaggggcatgtggttgtgaaactaatactggtgatggcgctggtattcttgttgctcttcctcatgatttttacaaggaggttgcgaaggagagtgggtttgagctaccgggacctggagaatatgcagttggcatgttctttttgcccacatcagacaaccgaagggaagagagcaagaatgttttcactaaggttgcggagtcactcgggcatacagttcttggttggaggcgagtaccaacagacaattcaggtttgggcaatgctgctttgcaaactgaaccagttgttgagcaagtgtttctcactcctagtcctagatcaaaagctgattttgaacagcagatgtatatattaagaagagtgtcaatggtcgccattcgagctgcattgaaccttcagcatggtggtgttagggacttctacatatgttctctttcctcgaggactattgtctacaaaggtcaattgaagccagtacaggttaaggattactattatgcagatcttgggaatgaaaggtttacgagctacatggccctgatacactcgcggttttctaccaatacatttcctagttgggaccgtgcccaacccatgcgtgtcttaggccataatggggaaattaatacacttagaggcaacgtcaactggatgaaggcacgtgaaggtctcttaaagtgcaaggagctaggtctgtccaagaatgagatgaagaagcttctaccaattgtggatgctagttcttcggactcaggggcttttgatggtgtccttgagcttctagttcgagctggtagaagtctccctgaagctgtaatgatgatgatccctgaggcttggcaaaatgataaaaatatggatcctcaacgaaaggccttgtatgaatacttttcagcccttatggaaccatgggatgggcctgcacttatctcatttacggatggccgataccttggagccacattggatcgcaatggactgcgtcctggaaggttttatgtaacacgaagtggacgagttattatggctagtgaagttggtgttgtggacattccacctgaagatgtccttaggaaaggaagactaaaccctggaatgatgcttctggtggattttgagaagcatactgttgtagatgatgaagcattgaagcagcaatactccctatcaaggccctatggggagtggctgaaaaggcaaaagattacactcaaggatattgttacctcagttccagaatctgatatagctctccctgctatagctggagtccttcctgcatctaatgacgatgacaacatggagaacatgggcattcatggtttagtggcaccattgaaagcttttggttatactgtcgaagccttggagatgctgttgcttcctatggcaaaagatgggactgaggctcttggttcaatgggaaatgatgctcccttggctgtcatgtctgatagagaaaagctcacttttgagtacttcaagcaaatgtttgcccaagtgacaaaccctccaattgatcctattagagagaagatagttacttccatggagtgcatgattggaccagaaggtgatctgacagaaacaaccgaggaacaatgccatcgcctatcactaaaaggtcctctcttatccattgaggaaatggaatctataaaaaagatgaactatagaggttggcgaagcaaagttcttgacattacttattcaaaggaacgtggtagaaaggggttggaggagactttggataggatatgtgctgaagctcgtgatgcaattagagagggatatactttgttggttctatctgacagagccttctcatcagagcgtgttgctgtaagctctctcttggctgttggtgctgtccatcatcatctggttaaaaaacttgagcgaacccgaataggtttgatagttgaatctgctgaaccacgtgaagtccaccatttttgtaccttagttggatttggtgctgatgccatatgtccatacttagccatagaggccatatggagattacaggttgatgggaagatcccacccaaatctactggagacttccactcaaaggaagagctagtcaaaaagtatttcaaagcaagcaactatggaatgatgaaggttctagctaagatggggatttcaactttggcctcatacaagggtgctcagatttttgaagctctaggtctttcttcagaagtgattgagaagtgctttgcaggaactcccagcagagtggagggagcaacctttgagatgcttgccagtgatgcacttcatttgcatgggttggcatttcccacccgagtctttcctcctggaagtgctgagtctgtagctctcccaaatcctggggattaccattggagaaaaggtggtgaaatccacttgaacgatcctcttgctatagcaaagctccaagaagctgccagaggtaatagtgtggcagcctacaaggaatattctaaacgtatccaggagttaaacaaatcttgcaatttgcgtggacttctaaagttcaaagaggcagatgtaaaagttccactggatgaagtggaaccagccagtgagattgttaaacgattctgtactggggctatgagttatggatcaatatcattggaggcacactcgacactggctattgctatgaatagtcttggagggaaatcaaacacaggtgagggaggtgaacagccatctcgcatggagcctcttccagatggttcaatgaatccaaggagaagtgcaatcaaacaggttgctagtgggaggtttggagtttcaagttattatctcacaaatgctgatgaactccagatcaagatggctcagggggccaaacctggggagggaggtgagcttccaggccacaaggtcataggagacattgcagttaccagaaactctacagctggtgtgggacttatcagtcctcctcctcaccatgatatttattcaattgaagaccttgcccagttgattcatgaccttaagaattccaatccaggagctcgtattagtgtcaaattagtatctgaagctggtgtaggtgtaattgccagtggggtggtgaagggccatgctgaccatgttttgatctcaggtcatgatggaggtacaggagcttctagatggactggcatcaagaatgctgggctcccatgggaactaggattggccgagacccaccaaactcttgttgctaatgatcttcgtggccgcactgttcttcagacagatggccaactgaaaactggaagagatgtggccattgctgcacttcttggtgcagaagaatttggcttcagcaccgcaccgctcataacacttggctgtattatgatgcgaaaatgccataagaacacttgtcctgttggcattgccactcaagatccagtactgagggagaagtttgctggggagcctgaacatgttatcaatttcttctttatgctagcagaggagctcagggagataatatctcagctcggtttccgtacactcaaggagatggttggtcgctctgacatgcttgaagttgataaagaagttattaagaataatgagaagctggaaaatattgatctctctctattacttagacctgctgctgacattcgccctgaagctgcccaatattgtgtccaaaagcaggatcatggcttggacatggctttggataaaaaattaatcaccctctcccaggcttctctggagaagaaacttcctgtgtacatcgagtcaccaatatgcaatgtgaaccgcgctgttggtacaatgcttagccatgaagttactaagcggtatcacttggctggacttcctgcggataccatacatgtcaagctgacaggaagtgcaggacagagcctgggagctttcctctgccctgggattacactagagcttgagggtgacagcaacgactatgttggtaaaggattatcaggtggcaaggttgtagtttatcctccaaaaggtagcctatttgatccaaaagagaacattgtcattggcaatgtagctctatatggtgccacaaatggtgaggcatatttcaatggaatggcagcagaaagattctgtgtccgtaattctggtgccagggcagttgtagagggtgttggtgatcatggttgcgagtacatgactggtgggactgtcgttgtgcttggaacaactggaagaaattttgcagcaggtatgagtggtggtgttgcttatgttcttgatgtggatgggaaatttcattctcgatgcaaccctgaactggtagatcttgataaagttgaggaagaagaggatatcatgactctcagaatgatgatacagcaacatcaacgtcacacaaacagtcaactagctagagaagtacttgctgattttgaaacgctcctgccaaaatttattaaggtcttccctagagattacaagcgtgttcttgcaaagatgaaacaagaagaagccttaaaagattctgcagaggaggatgaggagcaggatgaagcagagttgaaggagaaggatgcttttgaggagctcaaaaagatggcagcagcatctttgaacggcgcgtctagtcagaaggatgaagactccgagccattgaaaaggcctactcaggttaatggtgctgttaagcatcgtgggttcattgcttatgagcgtgagggtgttcagtacagggatcctaatgttcgaatgaatgactggaatgaagttatgcaggaatcggaacctggcccacttttaaagactcaatcagctcgttgcatggactgtggcactcctttctgccatcaggagaactctggatgccccttggggaacaaaatacctgaattcaatgaattagtgtaccagaatcggtggcgtgaagcattagatcgtctccttgagacaaataacttcccagagttcactggcagagtgtgccctgccccttgtgaagggtcttgtgttcttggtattattgagaatcctgtatctatcaaaagcatagagtgttccatcattgataaggcttttgaggaaggatggatggtgccacggccacccctgaagagaactgggaaaaaggttgctattgttgggagtggaccggctggcttagcggctgctgatcaactaaatagaatgggtcacttagtgactgtatatgagcgcgctgatcgaattggaggactaatgatgtatggagtacccaacatgaaggctgacaaagtggatatagttcaacgccgtgttaacctcatggctgaagaaggcatcaattttgtggtcagtgctaatgtcggaattgatcctctttactctcttgagcggcttcgtgaggagaatgatgccattgttttggcagtaggagccacaaagccaagggaccttcctgtaccaggacgggaattatcaggtgtccattttgccatggagtttcttcatgcaaatacaaaaagtttgctcgacagcaatctagaggatggtaactacatatccgctaagtggaagaaggtagttgtaattggcggtggtgacactggtacagattgtatcgggacatctatccgtcatggttgtagcagcattgtaaatctggagcttctaccagagccaccacgaagtagagctcctggcaacccctggccacagtggcctcgtacattccgtgttgattatgggcaccaagaagctgctgcaaagtttggtaaagacccaaggtcctatgaggtgctgactaagcgttttattggagatgagaatggggatgtgaaaggactggaggtggtatgtgtccgctgggagaaagatgctagtgggaaatttcagttcaaggaggtcgagggcagtgaggagattattgaggctgaccttgttctattagccatgggattccttggtcctgaggcgaatgtggcagacaagttgggcttggagcgggacaatagatcaaacttcaaggcagattatggccgattctcaaccagtgttgaaggtgtctttgcggctggggattgcaggcgtgggcagtctcttgttgtctgggcgatatcagagggtcgacaaactgcttcccaggtggacaagtatctcatgagagaggatgtgacaattagccccgacgcccaggatgatcttgtgaagagacgccaggatcttaccaagaagcaccaagataacaaacacacggttatgacataggtgaatcttttcttcttcttcttgttgttgcaacagtgcttgaaagaagtaggaacagattcaccttttacttcaaacaatcatgaaatcaattgttatacggacgacgcaagttgaaggataatatcaaatttacagttatggagctgagtgatgcagaaaacagggagcaggaatatagaagtggtttccatgggggctggtacagaaagtaggatattatattattatattcctttttctatgtcatatagttgatagcttcgcccagcttgtttgaaagttagctttgttactcttgtttttgaggaataataataatgtacagttttgtt

SEQ ID NO: 8108 - DNA, 7297 bp, Euphorbia peplus
cgccggtgctgctcctccgacgaacctcttttgctccgccgctctctccgccgtctgtcttgtttttgacagccgtcgttgttcttttttcactaatctcagctgtctgtctctttggccttcttgtttgcttcgtgttcttcaatgctggatctcgttatatccgtctgagattatttcctattgaagaaaaattgaacaatttaataaatctgttttacttttctgaatctaatcttctgtttttccgtcgaaaaatcgattgatttcgtcgctaaatcgatttaaattcacttgataaacagagatatttcttagatctcggttttgattcaacgttttcggatctgaaactgtgccgtttcgtttgccagaatacttatccaatccaatcccgtgaaattgacgctttgaattaaataaaagagtgatattcatattctgatttagtttccagcttgtcgataatgtcggcgggttcgagctctcttcttcaacctagagccaagtcttctgctctttcagcgctcaataagcctgcgatttcgcataaattgaatgttgtagcacctttttctctccggaatacgagagctggaccatgctcggggttgcgaaattcggagaagaagttgtttgggacgaaattgaggacttctggttcggagaggcttcttcatctctggcaatcagacggtccgggtcggtctccgaagctccgggttgtggttcgttctgcattgtctggggtgcccgaaaagcctcttgggctttatgatccgtcgtttgataaggactcgtgtggggttgggtttgtggctgaattgtctggggaaaccagccggaaaactgtgacggatgcgttggagatgttgattcgtatgactcatagaggtgcttgcgggtgtgaagcaaatactggagatggtgctgggattcttgtggctctccctcacgacttctacaaagaggttgcgaaggataatggatttgaactacctccacctggggagtatgcagttgggatgctttttctgcccacatctgaaaaccgacgggaagaaagcaagaatgtcttcaccaaggtcgctgagtctcttgggcatactgttcttgcctggcggcatgtccccacagaaaactcgggattgggtaagtctgctttgcagaccgaaccggtggttgagcaagtgttcctcacaccttctccgaggtcaaaagctgattttgagcaacagatgtacatattgaggagagtttcaatggttgccatcagagctgcgttgaacctgcagcatggtggtataagggacttctacatatgttccctctcgtcaaggactgtagtgtataaaggtcaactgaagcccgtacagttgaaggattactattatgcagatcttggcaatgaaaggtttacgagctacatggccctgatacactctcgcttttctacaaatacattcccaagctgggatcgtgctcaacctatgcgtgttttgggccataatggagaaatcaacacacttagaggcaatgtgaactggatgaaggcacgtgagggtctcttgaaatgtaaggagcttggtttgtccaaaaatgagttgaagaagcttctacctattgtggatgctagttcctcagattcgggggcttttgatggtgtgcttgagcttcttgttcgagctggcagaagtctccctgaagctatgatgatgatgatccctgaggcttggcaaaatgataagaatatggatcctcagagaaaggctttgtatgaatatttttcagcccttatggagccatgggatgggcctgcacttatctcatttacggatggtaggtaccttggagctaccttggatcgcaatggactccgcccaggtagattttatgtaacaaggagcggacgagttattatggccagtgaagttggtgttgtggacattccacctgaagatgttcttaggaaaggaagacttaaccctggaatgatgcttctggttgattttgagaagcatattgttgttgatgatgatgccctgaagcagcagtactccatagcaaggccctatggcgagtggctgaagaagcagaggattgaacttaaagatgttgttgggtctgttcaagaatcagatgtcaatgttcctgccattgctggagttattcctgcatctatggaagacaacaatatggagaacatgggcattcatggtctgatagcaccactcaaagctttcggttatacacgcgaagccctagaaatgttgttgcttcccatggcaaaagatgggactgaggctcttggttcaatgggaaatgatgctccattggctgttatgtctgaccgagaaaaactcacttttgagtacttcaagcaaatgtttgctcaagtgacaaatcctcctattgatcctattagagagaagatcgtcacttctatgcaatgcatgattggaccagaaggtgatctaacggaaacaactgaggaccaatgccatcgcctatctcttaagggccctctgttatccatcagggagatggaagcaattaaaaagatgaactatagaggttggcgaagcaaagttcttgacataacttattccaaagagcgaggtaggaagggattggaggaaactttagataggatttgtgttgaagcacgagaagcaataaaaatgggttatacattgttggtgctctctgacagagcgttctcatcaaagcgtgtttctgtgagctccctcttggctgttggtgctgttcatcaccatttagttgaaaagcttgaacgcacccggataggattgatagttgagtctgctgaaccacgtgaagtgcaccatttctgtactttggttggttttggggctgatgccatatgcccatacttggccgtagaagccatttggagattgcaggttgatgggaagattccacctaaatctagtggagacttccattcaaaggatgagctagtcaaaaagtatttcaaagcaagcaactatgggatgatgaaggttcttgctaagatggggatttcaacattggcatcgtacaagggtgctcaaatttttgaagctctgggcctatcatcagaagtgattgagaaatgctttgcaggaactccaagtagagtagagggagcaacttttgaaatgcttgctcgtgattcacttcatttgcatgagatggcatttcctaccagggtttatccacctggaagtgctgaatctacagctctccccaaccctggagattaccactggagaaaaggaggtgaaattcacttgaatgatcctctagctatagcaaaacttcaagaagctgctagaggtaacagtgtagaagcctacaaggaatattctaaacgcatccaggagttgaacaaagcctgtaatttacgtgggcttttgaagttcaaagaagcagaagtcaaagttccattggaggaagttgaaccagccagtgagattgttaaacgcttctgtactggggccatgagttatggttcaatatcattggaagctcatacaacgctggctatggctatgaataaaattggagggaaatcaaatactggtgagggaggtgaacagccatctcggatggagcctcttcttgatggtacaatgaatccaaagagaagtgcaatcaagcaagttgctagtggcagatttggagtttcaagttattatcttacaaatgctgatgaactacagattaagatggcccagggtgccaagcctggggaaggaggtgaacttcctggtcacaaggttataggagatattgccgttaccagaaattcaacagctggagtgggacttatcagccctcctccgcatcacgatatctattctattgaagaccttgcccagttgattcatgaccttaagaatgccaatcctgcagctcgaattagtgtcaaattagtgtctgaagctggtgtcggtgtaattgccagtggagtggtgaagggacatgctgaccatgtccttatcgctggtcatgatggaggcacgggggcttctagatggaccggtataaagaatgctgggttaccatgggagctaggtttagctgagacccaccaaactcttgttgcaaatgacctccgtggccgcacagttcttcagacagatggccagctgaaaactggaagagatgtggctgtggctgcacttcttggtgcagaagaatttggcttcagcactgcaccccttataactcttggctgcatcatgatgcgaaagtgccacaagaacacctgccctgttggcattgcaactcaagatccagtcctgcgagaaaagtttgctggagaacctgaacatgtcatcaatttcttttttatgctagcagaggagctcagggagattatgtcaatgcttggtttccgcacaatcaatgagatggttggtcgttcagacatgcttgaggttgacaaggaagtcatcaagaacaacgagaagttggaaaatattgatttatctctcttgcttagacctgctgctgatattcgccctgaagctgcacaatattgtgttcaaaagcaagaccatggcttggacatggctttggatctgaagttgatttctcttgctcaacctgcgctggaaaaaggtttccctgtgtacattgacacaccaatccgcaatgtgaaccgtgctgttgggaccatgctgagtcatgaggtcactaagcgttatcacatggcagggcttccagcagacactattcatgtgaagctttcaggaagcgcagggcagagtcttggagctttcctttgccctggaattacaatggagttagagggtgacagcaatgactatgttggtaaaggattatcaggtggcaagattgtagtctatcctccaaaaggtagtctatttgatccaaaagagaacattgttattggaaatgtagctctttatggggccacaactggtgaggcatatttcaacgggatggctgcagaaagattctgtgtgcgtaattccggggcaagggcagttgtagaaggtgtaggtgaccatggatgtgagtacatgacaggtggaactgttgttgtgcttggaaaaactggcaggaattttgcagcaggtatgagtggtggcattgcttatgttctagatgtggatggaaaattccattccaggtgcaatccggagctagtagatcttgatagagttgaggaagaagaggatattatgaccctcaaaatgatgatacagcaacatctacgccacacaaacagccagctagcaagagaaatacttgctgattttgatcctcttctgccaaaatttatcaaggtcttcccaagggattacaaacgtattcttgcaaaagtgaaacaagaagcatccttcactgaggctaagcaggcccctgttaaagaagaagctgaagagcaagatgaagtggagttaattgagaaggatgcttttgaggagctcaagaagatggcagctgcatctttgaaggaatccagtcagaaggttgaagatgctgagccattagggaggccatctcgggttaataatgcagttaaacatcgggggttcattgcttatgagcgcgagggtgttcaatacagggaccctgatgttcggatgaatgactggaatgaagttatggaggaaacaaaacctggcccattattaaatactcagtcagctcgttgcatggactgtggaactcctttctgccatcaggagcactctggatgccctcttggaaacaagatacccgagttcaatgaattagtataccaaaataggtggcgagaagcattggatcgtctccttgagactaacaacttcccagaatttacaggccgagtgtgccctgcgccttgtgaaggttcttgtgtacttggtatcattgagaatcccgtgtccatcaaaagcattgaatgttccatcattgacaaagcttttgaggaagggtggatggttccacgaccacccctcaagagaactggtaagaaggttgcaatagttggaagtgggccatctggcatggctgcagctgatcaactaaatagaatgggtcacttggtgacagtgtatgaacggtctgatcgaattggaggacttatgatgtatggggtcccaaacatgaagacagacaaagtggatgtagtccagcgtcgtgttgatctcatggctagggaaggcatcaattttgttgtcaatgctaacattggaattgatcctgagtattcccttgataagctccgagaggagaatgatgctattgttttggcagttggagccacgaagccaagagatcttccggtaccaggaagggagtttaaaggtgtccattttgccatggaatttcttcatgcaaatactaaaagtttgctggacagcaatcttcaggacgggaactacatatctgccaagggcaagaaagtagtagtaattggtggaggcgacactggtacagattgtatcgggacatctattcgtcacggttgtacaagcatggtaaacctggagcttctaccaaagccaccacaaactagagctccaggcaacccctggccacagtggccccgtgtattccgggtagattatggacatcaagaagctactgccaagtttggcaaagatcctaggtcctacgaggtcttgactaaacgttttgttggagatgaaaatgggaatgtgaaaggacttgaggtgatacgtgtccaatgggagaaagattctagtgggagatttcaattcaaggaaattgaaggctcggaggaaataatcgcagctgacattgtcctactagctatgggttttcttggtcctgaggcgaatttggcagaaaagctaggcttggagcgagacaacaggtcaaacttcaaagcagagtatggacgctttgccacaagtgtagaaggcatatttgcagctggagattgcaggcgtggccaatcactggtagtctgggcaatatccgagggacgccaaacagcttcccaagtggataaatacctaatggaagaccctgaagactccactggtaccgcagacaaccaagatgaccttgtcaagaagcagcaagatcttaccaagagacaacaagacaacaaacacacagttatgacataggtgaggactattatctcatcgttgtcgtcatagtactatgttttgcttgaaacaagtagaagtcattcaattatatactctacacaatccgaaaagatggacattggggaattggggaaaggcgaattggtcatcattcttgtggataacagaagtgtttagagacaagaaagaaa

SEQ ID NO: 8109 - DNA, 7177 bp, Citrus sinensis
gattcgacgacttttcaataatgtcggcaacggcctcgagctctttcgtccaactacgagcgaattcctcgcttacttcgcttagcagaaagtccggttatcctcagtcgaatattgtcagtcctctgtctagcggaggcagagcgaaggccgcacgatgcgcggcggcgaaaaaatcgacggttttggagaggagattcttcggaaaccagctgcgcttggccggatcagagcgggtgcacttgtggcgctctgacggtccaggaaagtcaccgaagcttcgagtggtggtccggtcggcattgtctggagttccagagaagccgctcggattatacgatccaaagtttgataaggactcgtgcggtgtcgggtttgtcgcggaattgtccggcgaaagcagccgcaaaacgataacggatgctttagaaatgttggtacggatggcgcatagaggtgcttgtggatgtgaaactaatactggtgatggagcaggaattctcgttgctcttccacacgatttctttaaggaggctgccaagaatgttggttttcaacttcccccgcctggtgagtatgctgttggtatgttctttttgccccaatctgagaaccggagggaggaaagcaagaaagtatttactaaggttgccgagtctttgggccatacagttcttggctggcgggctgtgccaactgataattctggattgggcaattctgccctgcaaacagagccagtggtggagcaagtgttccttacaccctcccttaggtcaaaagttgattttgagaatcagatgtacatactcaggagggtttcaatggctgctataagagagtcattaaaccttgaacatgggggtgcaaaggacttctatatatgttccctttcctcacggactgttgtttacaaaggtcagttaaaacccattcagatgaaggattactattatgcagatcttggcaatgaaaggtttacgagctacatggccctgatacattcacgattttctacaaatacgtttcctagctgggatcgtgctcaacccatgcgtatcttgggccataatggggaaattaacaccctacgaggcaatgtaaactggatgaaggcacgcgagggtctacttaagtgcaaggaacttggcctgtccaaggatgagatgaagaagcttctgccaattgtagatgttagttcatctgattcaggagcttttgatggtgtccttgagcttctggttcgagctggtagaagtcttcctgaagccgtaatgatgatgatccctgaagcgtggcaaaatgataagaacatggatcctcagaggaaggccttgtatgaatacttctcagctcttatggagccatgggatggacccgcccttatatcatttactgatggccgttatctgggagctaccttggatcgcaatggactgcgtcctggtcgattctacatcactcacagtggacgggttatcatggctagtgaagttggtgtagtggatattccccctgaagatgttctcagaaaaggaagacttaaccctggtatgatgcttctggtagattttgagaagcgcattgttgtagatgatgaagccttgaagcagcaatattcactggcaaggccttatggggagtggcttcagaggcaaaagatagaactcaagaatatagttgaatccattcacaaatctgaaagggtttctcctggcatagccggagttctacctgcatctaatgacgatgacaacatggagaatatgggcattcatggtttattggctccattaaaagcttttggttacactgttgaagctttggaaatgttgatgcttcccatggcaaaagatggcacagaggctcttggttcaatgggcaatgatgcacccttggcagtaatgtctaatagagaaaaactcacttttgagtacttcaagcaaatgtttgctcaagtaacaaatcctccaattgatcccatccgagaaaagatagttacttccatggagtgcatgattggtccagaaggtgtcctgacagaaacaactgaggaacaatgtcatcgcctctctctaaaaggtcctctattgtctattgaagagatggaagcaattaaaaggatgaattatagaggttggcgaagcaaggttctcgacataacttattcaaaggaccatgggaggaggggattggaggagactctggacaggatttgtgctgaagcacgtgatgcaatcaaggagggttatacgttattagttctttcagacagagctttctcatcgaagcgtgttgctgtgagctccctcctagccgttggtgctgtccatcaccatcttgtcaaaaatcttgagcgcactcggataggattgatagttgaatcggctgaaccaagagaagtgcatcatttctgtacactggttggatttggtgcagatgctatatgcccttacctggcgacagaggcaatttggagattgcaagttgatggaaaaattccaccaaaagctagtggtgaatttcattcaaaggatgagctggtcaagaagtacttcaaagcaagcaactatggaatgatgaaagttcttgcgaaaatggggatttccactttggcttcgtataagggtgctcagatttttgaagctttgggcctttcatcagaagtgatagaaaagtgctttgcaggaactcctagcagagtagacggagcaacatttgaggtgcttgccagtgacgctcttcacttgcatgagttggcttttccaactcggattttacctcctggaagtgcagaagctgtagctctgccaaatcctggggattatcattggaggaaaggtggtgagattcacttgaatgatcctcttgcgatagcaaagttgcaagaagctgcaaggggtaacagtgttgctgcttataaggaatattccaagcgcatccaggaattaaataaaacctgcaatttgcgggggctcttaaaatttaaggaggcagatgtgaaaataccgctggaggaagtagaaccagccagtgaaattgtaaaacggttctgtacgggggccatgagttatggatctatatcattggaagcgcacacaacactggcgactgctatgaataaaattggtggtaaatcaaacacaggtgagggaggtgagcaaccatctcgtatggagcctctttctgatggttccatgaatccaaaaagaagtgcgatcaagcaggtcgcaagtggaagattcggagtgtcaagttactacctaacaaatgctgatgaactacaaataaaaatggctcagggagccaagcctggtgaaggtggtgaacttcctggccacaaggttataggagacattgctgtcaccagaaattctacggctggggtgggacttatcagtccacccccgcatcatgatatatattcaattgaagaccttgcccaattgatatacgatcttaagaatgccaatcctggggctcggataagtgtgaagttagtatctgaagctggtgtgggagttattgccagtggggttgtgaaggggcacgctgatcatgtcttgatatcaggtcatgatggaggtactggggcttctcgatggactggcataaaaaatgctggcctcccatgggaacttggtttggctgaaacccaccaaactctagttgctaatgatcttcgtggccggacaattctccagactgatggtcaactaaaaactgggagagatgtggccattgctgcacttcttggtgcagaagagtttggcttcagcactgcaccacttattacgcttggctgtattatgatgcggaagtgccacaagaatacctgtcctgttggcattgcaactcaagatccagttcttcgtgaaaagtttgctggagaacctgagcacgtcattaatttcttttttatgctagctgaagagttgagggagattatgtctcagcttggtttccgaacaataactgagatgattggtcgttcagatatgcttgaagttgacaaggaagtcacaaagaccaatgagaagctggagaatattgatctctccctgttacttagacctgctgctgacttacggcctgaagctgctcagtattgtgtccaaaaacaggatcatggcttggacatggctttggaccaaaagcttatcaaactgtccaaggctgccttggagaaagctcttcccgtgtacattgaaacacctgtctgcaatgtgaaccgtgctgttgggacaatgcttagccatgaagtgactaagcgttaccacttggtgggtcttcctgcggataccattcacataaaacttactggaagtgcaggacagagcgttggagctttcctttgccctggcatcttgttggagcttgaaggtgacagcaatgattatgttggtaaaggcttatcaggtggcaagattgttgcgtatcctccaaagggaagtctttttgatccaaaggtaaacatagtcatcggtaatgtggctctctatggggctacaagcggagaggcatattttaatggcatggcagcagaaagattctgtgtccgtaattcaggggcaagggctgttgtagaaggtgttggtgatcatggatgtgaatacatgacaggcgggacggttgttgtgctcggcaaaactggaaggaattttgcagctggtatgagtggtggtatagcttatgttcttgatgtggatggaaaatttagatctcgatgcaatcctgagcttgttgatcttgataaggttgaagaagaagaggatattataactctgagaatgatgatacagcaacatcagcgttacacaaacagccagttggccaaagaagtacttgctgacttcgagaatcttttgcctaaatttataaaggttttccctagggattacaaacgtgttcttgcaagcatgaaagtagcagctgcccaagaggcagcggaagatgctgttaaagatgctgaggagcctgatgaggcagacttcaaggagaaagatgcctttgaggagctcaagaagatggcaattgcatctttgaatgagaaatcaaatcaggaggcagaacaagttgaaccaaccaagaggcctagtcgagttgctgatgctgttaagcatcgaggttttattgcttatgagcgtgagggtgttcaatatagggatcctaacattcgtatgaatgattggaaggaagttatggaggaatcaaaacctggccctcttctgaagacgcagtcagcccgctgtatggattgcggtactcctttctgccatcaggagaactctgggtgtcctcttggcaacaaaataccagaattcaatgagttggtgtaccaaaataggtggcgtgaagcactagatcggcttcttgagacaaataacttcccagagtttactggccgagtttgtcctgctccttgcgaaggttcttgtgtactaggcattattgagaatcctgtatctatcaagaatattgaatgtgccattatagataaggcctttgaagaggggtggatggtgccccgcccacctccaaggagaactgggaaaagagttgcaatagttggaagtggaccggctgggttggctgcagctgatcagctaaacaaaatgggccatttggtgactgtctatgagcgtgcagatcgaattggtgggcttatgatgtatggtgttcccaacatgaaggctgacaaagtagatgtagtgcaaaggcgggttaaccttatggccgaggaaggtgtcaagtttgtggtgaatgctaatgttggaattgatcctatgtactctcttgatcagcttcgggaggagaatgatgctattgtattagcagtaggctccacaaaacctagggatcttcctgtacccggaagggatttgtcaggcatccattttgcaatggagttccttcattcaaataccaaaagcttgctagatagcaatctcgaggatgatagctacatttctgccaaggggaagaaagtagttgttattggtggaggagatactggtacggactgtataggtacatctattcgtcatggttgtagtagcatcgtaaatctagagcttctccctcagcctccacaaactagggctcctggcaacccttggcctcagtggcctcgtgtattccgtgtagactatggacaccaggaagttgctgccaaattcggcaaagacccaaggtcatatgaggtattgacaaagcggtttattggagatgaaaatggggttgtgaaaggactagagatagtacgtgtgcattgggagaaggatgctagtgggaagtttcaattcaaagaggttgaaggctctgaggaaataattggggccgacctagtccttctggccatgggattccttggccctgaagcgacggtggcagaaaagttgggactggagcgagacaaccgatcaaatttcaaggcagaatacggtcgctttgcaaccagtgtggatggtgtctttgcagctggggattgccggcgtggccagtctcttgtggtatgggcaatctcagagggccgccaagctgctgctcaagtggacaattacctcagctcttctagcgacagccaagaggaggattttgtcaagatgcaacaaggcttcaccaagaggccgcaagacttgaacaagaagcagcaacacattgtcatgacttaggtgatcccaattattttctttctcatacagttggttaaaaagaaacagaaccggtacacaatacacaaaagtttgttccagaaccccatggattctgctagttaaatgatgaagtctgttggtatctagtgagacatggctgaggtgagggacttgcgaggtttagcttgagcagaaagcgagaaggcaggcattgggcgattcaatataggtttttttagccttttaggttaaagtaaaacttggcgttctttcttgtttatagttttgcggcgctttggttggttatgagtttggttaattatgacggaacattgtacagttctctttttaattattgattgggaaagaaaatatggtattttatttaggagctcttctctcttctcaaggttgccaaaatctttattccaattctgaataattcaggtcacgaattcatgtagaagctgctaaggctaaactgtattgcaagtttttaaaagaccttaaatatttctgcc

SEQ ID NO: 8110 - DNA, 7232 bp, Populus trichocarpa
ccaatcccgttggcttttccgaacaataaaaagcttcactgttcaggttttttgtgtaaacgagagtaatgtcggctgcagcgagctctggagctctccttcaaccaaaatcggtgaaagctccgttttcttcgcttagtaaatcgtcttctctttctccttcgctcaatgttgccacagcagcatctgtttctcggcggagcgcgagggcaaaccgatgtgcttcgacgaggaaatcggtggttgttgagagaaaatcgtttttgggaagtaaagtgcgggggtctgctggatcggagagattgcatttttggcagtcggatggaccgggtagagagccgaaacttcgagttgttgtccggtctgcattgtccggtgtgccggagaagccgcttgggttgtatgacccgtcgtttgataaggattcgtgcggggttggttttgtggctgaattatctggggatagcagtcgtaaaacggtaaatgatgctttggagatgttggtgaggatgacacatagaggggcttgtggatgtgagacgaatactggtgatggggctggtattcttgtggctcttcctcatgatttctacaaggaggttgctaaggatatagggttcgaactgccaccaccaggggaatatgcagttggcatgttctttttgcccacatctgataatcgtaaggaagaaagcaagaatgtattcactaaggttgcggagtctcttgggcatactgtacttgggtggcgaccagtaccaacagataactctggactgggaaattctgctttgcagaccgagcctgtcattgagcaagtgttccttacagccactcctaggtcgaaggctgattttgagcagcagatgtacatattaaggagggtgtcaatggtagctattagagctgcactaaaccttcaatatggtggtgttagggacttttatatctgttccctttcctcaaggacggttgtttataaaggtcagttgaagcctgaacagttgaagggttactattatgcagatcttggcaatgaaaggtttacgagctacatggccctggtacactcacgattttcaacaaatacatttcctagctgggaccgtgcacaacccatgcgtgtcttgggccataatggggaaatcaacacgctaagaggcaatgtaaactggatgaaggctcgcgagggcctaataaagtgcaaggagctcggtctctcgaagaatgagatgaagaagcttcttccaattgtagatgctagttcttccgactcaggggcttttgatggtgtgctggagcttttaattcgagctgggagaagtctccctgaagctgtcatgatgatgattcctgaagcctggcaaaatgacaagaatatggatcctcaaaggagggcactgtacgaatacttctcagctcttatggaaccgtgggatgggcctgcacttatctcatttactgatggccactacttgggagctactctggatcgcaatgggttacgtccaggaagattttatgttacacgaagtggacgagttatcatggctagtgaagttggtgttgtggatattcctcctgaagatgtccttaggaaaggaagacttaaccctggaatgatgcttctggtggattttgagaagcatattattgtagatgatgaagccttgaagcaacaatattccctagcaaggccctatggagagtggctgaagaggcaaaagattgaactcagtgacatagttgactcggttcaagaatctgagagagttgctccagccatttctggggttgttcctgcatctgatgatgacaccagcatgcagaatatgggcactcatggtttgctggcaccattaaaagcttttggctatactgttgaagccttggagatgctgatgcttcccatggcaaaggacgctacagaggctcttggttcgatgggaaatgatgctcccttggctgtcatgtctaacagggaaaaactcactttcgagtacttcaagcaaatgtttgctcaagtgacaaaccctccaattgatcccatcagagagaagattgtcacttccatggaatgcatgattgggccagaaggtgatttgacagaaacaactgaagaacaatgccaccgtctctctctaaaaggccctcttttatcaattgagcaaatggaagcaatgaaaaaaatgaactttagcggttggcgaagcaaagttctcgacataacttattcaaaggaacggggtaggaagggattggaggagactttagataggatttgtgctgaagctcacgaggcaatcaaggaaggttatactgtgttggttctttctgacagagccttctcatcaaagcgtgttgctgcaagctccctcttggctgttggcgctgtccaccaatatctagtaaaaaagcttgagcgaactcaagtcgggttgatagttgaatctgctgaaccacgtgaagtgcaccatttctgtacgttggttggttttggcgcagatgctatctgcccatacttagctgtagaggccatttggagattacaggttgatggcaagatcccaccaaaatccactggcgagttccacacaaaggatgagctagtcaagaagtatttcaaggcaagcaactatggcatgatgaaagtgcttgccaaaatgggaatttcaactttggcctcctacaagggtgctcagatttttgaaggcctgggcctttcatcagaagtgattgacaagtgctttgcaggaactccaagcagggtagaaggagcaacatttgagatgcttgcccgtgattcacttcatttgcatgagttggcatttccttcccgtgttctccctcctggaagtgcagaagctgtagcactgcccaatccgggggattatcattggagaaaaggtggtgagattcaccttaatgatcctcttgctattgcaaagcttcaagaagctgccagaggtaatagtgtggctgcctataaggaatattctaaacgtgttcaggagttaaacaaagcttgtaatttgcgtgggcttttgaagttcaaagaggcagatgtgaaagtttctttggatgaagtagaaccagccagtgagattgttaaaaggttctgtactggtgcaatgagttatggatcaatatcattggaggcacacaccacactggctcaggctatgaacaaaattggaggaaaatcaaacacaggtgagggaggtgaacaaccatctcggatggagactcttcctgatggttcaatgaacccaaagaggagtgcaattaagcaggttgcaagtgggagatttggagtgtcaagttactatcttacaaatgctgatgagctgcagataaagatggctcagggtgccaagcctggtgaaggaggtgagcttcctggccacaaggtcataggagacattgcaattaccagaaattctactgcaggggtgggcctcattagtcctcctccccatcatgatatctattcaattgaagaccttgctcaattgattcacgatctcaagaatgccaatccagcagccagaataagtgtcaagttggtatccgaagctggtgtcggagtcattgccagtggggtggtgaagggacatgctgaccatgttttgatctcaggtcatgatggaggtacaggtgcttctcgatggactggcatcaagaacgctgggctcccatgggaacttggtttggctgagacccatcaaacacttgttgccaatgaccttcgtggccgaacagttcttcagactgatggccaactaaaaactggacgagatgtggccattgcagcccttcttggcgcagaagagtttggtttcagcactgcaccccttataacacttggttgcatcatgatgcgaaagtgccataagaacacctgccccgtaggcattgctactcaagatccagtgctgagggaaaagtttgctggagaacctgaacatgttatcaacttcttttttatgctagcagaggagctcagggagattatggcacagcttggtttccgtacgatgactgagatggttggtcgttcagacatgcttgaagttgataaagaagttgttaagagcaacgagaagctggaaaatattgatctctctttgttacttagacctgctgctgacattcgacctgaagctgctcagtattgtgtccaaaagcaggatcatggtttggacatggcattggataataaactcattaaactctctgaggctgcattggaaaaaggtcttcctgtgtacattgaaacacctatctgcaatgtgaaccgtgctgttggaacgatgcttagtcatgaagttactaagcgttaccacttggcagggcttcccgcagatactattcacatcaaactcacaggaagtgctgggcagagtctaggagctttcctttgccctggcattatgctggaactggaaggggatggcaatgactacgttggtaaaggattatcaggtgggaagattgtagtttatcctccaaaaggaagcctgtttgatccaaaagaaaacattgtgatcggtaatgtagctctttatggagccacatgtggtgaagcatatttcaatgggatggcagcagaaagattttgtgtccgtaattctggggcaagggctgttgtagaaggtgttggtgatcatggctgtgagtacatgacaggtggaactgttgttgtgcttgggaaaactggaaggaattttgctgctggtatgagtggtggtgttgcttatgttcttgatttggatgggaaattcagatctcgttgcaatcctgaactcgtagatcttgacaaagtcgaggaagaggaggacattacaactctaaaaatgatgatacaacaacaccagcgtcacacaaatagcctgctagctagagaagtacttgctgattttgataatcttctacctaaatttattaaggtcttcccgagggattacaaacgtgttcttgccaacatgaaagaggaatctgccacaaaagaggctgctgacctagctgctaaagaagttgaggaagctgaggagcaagatgaagcagagttgaaggagaaagatgcttttgaggagctaaagaagctggcagctgcatctttgaatgggaattccattcaggtagaagatggacctctgaaaaggcctacccgtgttaatgatgctgttaaacatcgagggtttattgcttatgagcgagaaggtgttcagtacagagatccaaatattcgaatgaatgactggaaggaagttacggaggagtcaaaacctggccctcttttaaagacccagtcagcccgttgcatggactgtggcactcctttctgtcaccaggagaactcaggatgccctcttggaaacaaaatccctgaatttaatgagctagtgcatcaaaatcggtggcgtgaagcattagataggttacttgagacaaataacttcccagagttcactggcagagtgtgccctgcaccctgtgaaggttcctgtgttcttggcataattgatgatccagtatctataaaaaacattgaatgttcaattattgacaaggcctttgaggagggttggatggttccgcggcctcccctcaagagaactgggagacgagtggctattgttggaagcgggccttctggtttggctgctgctgatcagctaaacaaaatgggtcatttggtgactgtgtatgagcgtgctgatcgaattggagggctgatgatgtatggagttcccaacatgaaaactgacaaagtggatatagttcaacggcgtgttaaccttatgtctgaggaaggcatcaattttgtggtaaatgctaatgttggaattgatcctttgtattctcttgatcggcttcgagatgagaacaatgcaattgttttggcagtgggagccacaaaacctaggcaattgtcaggcgtctattttgctatgcagtttcttcatgcaaataccaaaagtttgcttgacagcaatttgcaggatggtaactacatatccgcaaagggcaagaaagttgttgtcattggtggaggtgacactggaacagattgcattgggacatctattcgccatgggtgtagtagcattgtaaatctagagcttctacctgagccaccacgaactagaggcccgggcaacccttggccacagtggcctagagtattccgggtagactatgggcaccaggaagctgccgccaagttcgggaaagacccgaggtcttatgaggtgttgactaagcgtttcattggagatgagaatgggaatgtgaaaggacttgagctggtacgtgtccattgggagaaggatgccacagggaaatttcaatttaaggaggttgagggctctgaggaagttattgaggctgacctagtcctactagcaatgggattccttggtcctgagctgaatgtggcagagaagttgggcttggagcaagataatagatcgaatttcaaggcagaatatggccgcttctcaaccaatgtggaagggatctttgcagctggggattgcaggcgaggccagtccctagttgtatgggcaatatcagaaggacgacaagctgcttcccaggtggacaaatatctcatgaaagaagaggatgctaccattaacaccgataatactcaggatgaccttgtcaagaggcaccaggacctcaccaagagacatcaagacagcagcaagcacactgtcatgacgtagacaacccttgagtcttttttcttctcttcctcagacagtgctgaaaagggattacacaggatgcacatcattctaggatcaatcatctcatagaatgatgttgtggaaggaataaattgaagatcaccagaatggtgcttggttctcacatgtgaaccctggggacttggaatgattgagcagaagtgagaagtagcattgtgcagctggtatagaaattaggatatttatggtgctcatttttatttttttataatagcgttcaaccagcttgcttgaaaattgttaagctcattcggtagttgttgaggaataatgtacagttttgtttcttcaaatattttatggaaatatgtgggaaattgttttgttctggattgtccagttatttgttcttgagtaacagatataatttttttggcagaaggataacgttgtgccttgtggtttagctatatacataaagaagtgcagacttcaattgaatttgatctgcca

SEQ ID NO: 8111 - DNA, 7011 bp, Echinacea purpurea
atatccgcagccgtcgttaacacgtcggtttttgttagttttcatctctttaaatcagatcaaatcgaatccaaatacaaaccgtatataagcagatcttcttgtttgatcgaaataatctctttctttttaaaatttatccagatctgataatcagagaaagtttctgataaaaaccgtcggtgttcataatgtcggtggctttgaatcacgctcttcaagcccgacccgacccgaatttgacgaaaagcttttccacccgtccggtaaacgggttgactcggattggtgtgaaacaatccagtcttttagggaagaagttgtacggaaccagggtgggacgtcgggtcgggtccgtgtcctggtcgggttctgagacgctccataagttagatgggccgggtcgtaaagtggtggttcgggcgggtttgtcgttggtacccgagaagccgttggggttatatgatccggcttttgataaggattcgtgtggggttgggtttgttgctgaattatccggtgaaggtaaccgtaaaacggtgactgatgcgattgagatgttggttcgtatgtcacatagaggtgcttgtggatgtgagacgaacaccggtgatggtgccggaattcttgttggtcttccacatgagttcttcaaggaggtggcaaaggatgaggggtttgagctaccgccactgggtcaatacgcggtcggcatgttcttcttgcccacttctgatactagaagggagcaaagtaagattgtgtttacaaaggttgccgagtcacttgggcacactgttcttggctggcgtactgtcccgacagataattctggtttgggtaaatctgctctacaaaccgagcctgttatagaacaagtgtttctcactcccacttctagggccaaggtcgattttgagcggcagatgtacatactaagaagggtttcgatggtagccatcagggctgcattgaaccttcaacatggtggtgttaaggacttctatatatgttctttatcatctagaactgttgtatacaaaggccagttaaaaccgaaccagttgaaggagtattatcatgcagatcttggcaatgaaaggtttacgagctacatggcaatgattcattctcgattttcaacaaacacttttcctagctgggatcgtgctcaacctatgcgtgttcttggacataatggtgaaattaacacgcttagaggcaatgttaattggatgaaggcacgtgaaggtcttttaaaatgcaaagagctaggtctctccaagaatgagatgaaaaaacttcttcctatcgtagacgccagctcatcagattcaggtgcttttgatggtgttttggagcttttagtgcgagctggcagaagtcttcctgaggcagttatgatgatgatccctgaagcatggcaaaatgacaagaacatggatcctcaaaggaaggctttatatgaatattgttcagctttaatggagccatgggatgggcccgctctagtttcatttactgatggtcggtaccttggagcaacactggaccgaaacggactgcggcccggtcggttctatgttactcacagtggacgcgttataatggcgagtgaagttggagtcgttgatattccgccagaagatgttgctagaaaaggaagactgaaccctggaatgatgcttcttgttgactttgacaaacatatcgttgtagatgatgaagctttgaaacaacagtattctcttgcaagaccgtatggaaaatggcttgaaacgcaaaagatagaactgaaaaagattgtggaatctgttaataaatctttacggtcctgccctcccatcgctggagtgtcaaaggctgaggaggacatgggtatacagggtcttttggctccattgaaagcttttggttatacaattgaatccttggaaatgcttttactaccaatggctaaagacggtgttgaggcactgggttcaatgggaaacgatgctccgttggctgtgatgtctaacagagagaagctaacatttgagtatttcaaacaaatgtttgcacaagtaaccaacccaccaattgatcctataagagagaaaattgtaacttcaatggaatgcatggtgggcccagaaggcgatcttacagaaacaacagaagagcaatgccatcgtctttcactaaaaggcccacttttatctattgaagagatggagtccattaaaaacatgaactacagaggctggagaagcaaagttcttgatataacctaccctaaagagcttggcaaaaagggtttggaggaaaccctagatagaatctgttctcaggcgcatgatgcaattaaagagggctatactacattggtgctttctgacagagctttttcatcaaagcgagttgcagtaagctctcttttggcagttggtgcggtccaccatcatttggtcaaaaagctggaacgaaccagggttgcattaatggtggaatccgcagagccacgtgaagtgcaccatttttgtacgcttgttgggtttggcgctgatgccatttgcccctatttggcagttgaagccatttggaggttacaagctgatggtaaaatcccaccaaaatccaacggtgagttccacacaaaagaggaattagttaagaagtactataaagcaagtcactatggaatgcaaaaggttcttgccaaaatgggaatttcgactttagcatcatataaaggtgctcaaatctttgaagcagtcgggttatcgacagatgtgatggaaagatgctttgccggcactccaagtagagttgaaggagctacgtttgaagcacttgctggtgatgcgcttaacttgcatgatttaggttttccagcacgcaagttcccgccaaacagtgcagaagctgttgctttgcctaaccctggtgattaccattggaggaaaggtggtgaaattcatttgaatgacccgttagctattgcaaaactgcaagaagctgctaggggaaacagtgttgctgcatataaagagtattcaaaacgcattcatgaactaaataagacttgtaatcttcgtgggcttttgaagtttaaagagggaaatgcgaaggtgcctttggaagaggttgagcctgctagtgaaatagtgaaacggttctgtactggtgccatgagttacgggtccatatccttggaggcccacacaacccttgctattgctatgaataaaatcggaggcaaatctaacacaggtgagggaggtgaaaatccatctcgtttggtatcgcttccagatggttcaatgaatcccaaaaggagtgcaatcaagcaggttgctagtgggcgatttggggtttcaagttattaccttacaaatgctgatgaattgcagataaaaatggctcagggagcaaagcccggtgaaggtggtgaacttccggggcacaaagttattggagatattgctgtcacaagaaattcaacagctggagttggattaattagccctcctccacatcatgatatctattcaatcgaagaccttgctcaattaattcatgatttaaagaatgcgaatccttccgctcgagtaagtgtgaagttggtttctgaagctggtgtgggagtgattgctagcggtgtggtcaagggccatgcagaccatgttttgatctcgggtcatgatggtggaaccggtgcttccagatggacggggatcaagagtgctgggctcccatgggagcttggtctagccgagacacaccaaactcttgttgcaaacgaccttcgtggtcgaactgtattacagactgatggtcaactaaaaacggggagagacgtagccattgctgcccttcttggggctgaggagtttggtttcagtacagccccacttatcactcttggttgcatcatgatgaggaaatgtcacaaaaacacttgccctgttgggatagccacccaagatcctgttctccgtgagaaatttgcaggggaacccgaacatgtaatcaatttcttcttcatgttagcagaggaaatgagggaaatcatggctgatttgggtttccgaactgttaatgaaatggtgggacgtgcagatatgcttgaagtagataaggatttgacaaaggacaatgagaaactaaaaaacatcgatctttcgctattacttcgaccagccgctgatatccgcccggatgctgcccaaatttgtgtacaaaaacaagatcacgggttagatatggctcttgatcaacggttaataccgcttgctaaaccagctttagaaaagggtttacctgtatacatcgaatcacctatttgtaatgtaaaccgtgcggttgggacgatgcttagtcatgaagttactaaacgataccacttggctggccttccagccgacactatccatatcaaacttaatggtagtgcaggccagagtattggagccttcctttgcccgggaattttgcttgagcttgaaggagacagcaatgattatgttgggaaagggttgtcaggtggcaagattgttgtttatccaccgaagggaagcgggttcgaccctaaagaaaacattgtgattggaaacgtggctctttatggtgcaacgagtggtgaagcttattttaacgggatggcggcagagcgtttctgcgttagaaactcgggggctaatgcggtggtggaaggtgtcggtgatcatgggtgtgaatacatgacgggtgggactgttgtcatattgggtaaaactgggaggaactttgctgctgggatgagtggtggaattgcctatgtccttgatgttgacgccaagttccggttaagatgtaacgctgagcttgttgatcttgataaggttgaagacgaggatgatattatgactctaagaatgatgattcagcaacaccaacggtacacaaacagccagctggctaaggaagtactggctgactttgacaaccttttgccaaaatttattaaagttttcccgagagattataagcgtattcttgctaccatgaaagaaaaagaaaacgccaaaaatgctgctgctgagatggctcctgaagaagccgatattcgggaggaagatgagttgaaggagaaagatgctttcgaggagcttaaaaagttggcagccaaagcattgagtgaggcggtcaatattaatgtcaaagaaatggtcaatgaggtcaaagaggttgaaatggctgaaccagccacgagaccatcccgagttgaagatgcagtcaaacaccgtggttttgttgcttacgagcgtgagggagtatcgtaccgggacccggctgttcggatggaggactggaatgaagttatggaagagacaaaacctggccctcttttaaaaactcaatctgcacggtgtatggattgtggtacaccgttttgtcatcaggataactcgggttgtcctctcggcaacaaaattcctgaattcaacgagctggtttatcagaaccgatggcgtgaggcattagatcgactccttgagacaaataacttcccagagttcaccggccgggtctgccctgctccatgtgaaggttcttgtgtgctcggtataattgaaaatccagtctcgattaaaagcatagagtgctcgatcatagacaaagcctttgaggaaggatggatggtgcctcgacctcccctcaagagaaccgggaaaaaagtagctattgttggaagtggtcctgctgggttagctgcggctgatcaactaaatcgattgggccatacagtgaccgtgttcgagcgtgctgaccgaattggtggactcatgatgtatggggttcctaacatgaagactgacaaaatcgacgttgttcaaagacgggttgacttgatggctgaggaaggtgtgaattttgtggtcaatgccaacgtaggaaccgatccatcatattccattgaacggcttcatgaagagaatgatgccgttattttagcagtgggatcaacaaggccgagggaccttcctgttcctggacgagagctatcggggatacattttgctatggagtttttgcatgcgaatactaaaagcttattggatagcaatctcgaggatggtaattatatctctgccaagggtaaaaaggtaattgtaattggtggtggtgacaccggtacagattgtattgggacatccattcgccatggttgcaccagcattgtaaatctggagcttcttccccagccaccacaaacccgagcacctggcaacccctggccacagtggcctcgtgtattccgtgtagattatggacaccaagaagctgctacgaaattcggtaaagacccgcggacatatgaagtcttgactaaaaggttcattagtgacgataatgggtcagtaaaaggtgttgaggtggtgcgtgttcagtgggcgaaggacgaggccggtcagtttaagttcaaggaggttgagggttctgaggagatcctcgaggctgacctggttttgctagccatgggcttcctcggtcctgaatcgacgatagcggacaaactgggattggagaaggacgggagatcaaatgttaaggcagagtatgggcggttttcaacaaacgtggaaggcgtgtttgcggcaggtgattgccgaagagggcagtcgttggtggtgtgggccatctcagaagggcggcaggcggcagcacaggtggataagtttttgtcgaaagatgagaaggatgttgaaagcagattagaaaaggggaagagggagcagcaagcagttcggacattatagattgatacatacaagattgatgttaaaaaaaggaaagggttatagagaggtggttttgtgtgggaagttagttttgtgtccttcaggctctgctgtttatagccttcttttctttttgttattggttgttgcttgttttgaactttgaaacaataaatgtacagatgaatctgttttgggtttttgttatttttaatccaaatggttaacatactgttttggccaa

SEQ ID NO: 8112 - DNA, 7034 bp, Echinacea purpurea
tatatatacactatacctgctgtgtgtatatccgcagccgtcgttaacacgtcggtttttgttagttttcatctctttaaatcagatcaaatcgaatccaaatacaaaccgtatataagcagatcttcttgtttgatcgaaataatctctttctttttaatatttatccagatctgataatcagagaaagtttctgataaaaaccgtcggtgttcataatgtcggtggctttgaatcacgctcttcaagcccgacccgacccgaatttgacgaaaaccttttccacccgtccggtaaacgggttgactcggattggtgtgaaacaatccagtcttttagggaagaagttgtacggaaccagggtgggacgtcgggtcgggtctgtgtcctggtcgggttctgagacgctccataagttagatgggccgggtcgtaaagtggtggttcgggcgggtttgtcgttggtacccgagaagccgttggggttatatgatccggcttttgataaggattcgtgtggggttgggtttgttgctgaattatccggtgaaggtaaccgtaaaacggtgactgatgcgattgagatgttggttcgtatgtcacatagaggtgcttgtggatgtgagacgaacaccggtgatggtgccggaattcttgttggtcttccacatgagttcttcaaggaggtggcaaaggatgaggggtttgagctaccgccaccgggtcaatatgcggtcggcatgttcttcttgcccacttctgatactagaagggagcaaagtaagattgtgtttacaaaggtcgccgagtcacttgggcacactgttcttggctggcgtactgtcccgacagataattctggtttgggtaaatctgctctacaaaccgagcctgttatagaacaagtgtttctcactcccacttctaggtcaaaggtcgattttgagcggcagatgtacatactaagaagggtttcgatggtagccatcagggctgcattgaaccttcaacatggtggtgttaaggacttctatatatgttctttatcatctagaactgttgtatacaaaggccagttaaaaccgaaccagttgaaggaatattatcatgcagatcttgggaatgaaaggtttacgagctacatggcactgattcattctcgattttcaacaaacacttttcctagctgggatcgtgctcaacctatgcgtgttcttggacataatggtgaaattaacacgcttagaggcaatgttaattggatgaaggcacgtgaaggtcttttaaaatgcaaagagctaggtctctccaagaatgagatgaaaaaacttcttcccatcgtagacgccagctcatcagattcaggtgcttttgatggtgttttggagcttttagtgcgagctggcagaagtcttcctgaggcagttatgatgatgatccctgaagcatggcaaaatgacaagaacatggatcctcaaaggaaggctttatatgaatattgttcagctttaatggagccatgggatgggcccgctctagtttcatttactgatggtcggtaccttggagcaacactggaccgaaacggactgcggcccggtcggttctatgttactcacagtggacgcgttataatggcgagtgaagttggagtcgtcgatattccgccagaagatgttgctagaaaaggaagactgaaccctggaatgatgcttcttgttgactttgacaaacatatcgttgtagatgatgaagctttgaaacaacagtattctcttgcaagaccgtatggaaaatggcttgaaacgcaaaagatagaactgaaaaagattgtggaatctgttaataaatctttacggtcctgccctcccatcgctggagtgtcaaaggctgaggaggacatgggtatacagggtcttttggctccattgaaagcttttggttatacaattgaatccttggagatgcttttactaccaatggctaaagatggtgttgaggcactgggttcaatgggaaacgatgctccgttggctgtgatgtctaacagagagaagctaacatttgagtatttcaaacaaatgtttgcacaagtaaccaacccaccaattgatcctataagagagaaaattgtaacttcaatggaatgcatggtgggcccagaaggcgatcttacagaaacaacagaagagcaatgccatcgtctttcactaaaaggcccactcttatctattgaagagatggagtccattaaaaacatgaactacagaggctggagaagcaaagttcttgatataacctaccctaaagaacttggcaaaaagggtttggaggaaaccctagatagaatctgttctcaggcgcatgatgcaattaaagagggctatactacattggtgctttctgacagagctttttcatcaaagcgagtggcagtaagctctcttttggcagttggtgcggtccaccatcatttggtcaaaaagctggaacgaaccagggttgcattaatggtggaatccgcggagccacgtgaagtgcaccatttttgtacgcttgttgggtttggcgctgatgccatttgcccctatttggcagttgaagccatttggaggttacaagctgatggtaaaatcccaccaaaatccaacggtgagttccacacaaaagaggaattagttaagaagtactataaagcaagtcactatggaatgcaaaaggttcttgccaaaatgggaatttcgactttagcatcatataaaggtgctcaaatctttgaagcagtcgggatatcaacagaagtgatggaaacatgctttgctggcactccaagtagagttgaaggagctacgtttgaagcacttgctggtgatgcgcttaacctgcatgatttaggttttccagcacgcaagttcccgccaaacagtgcagaagctgttgctttgcctaaccctggtgattaccattggaggaaaggtggtgaaattcatttgaatgacccgttagctattgcaaaactgcaagaagctgctaggggaaacagtgttgctgcatataaagagtattcaaaacgcattcatgaattaaataagacttgtaatcttcgtgggcttttgaagtttaaagagggaaatgcgaaggtgcctttggaagaggttgagcctgctagtgaaatagtgaaacggttctgtactggtgccatgagttacgggtccatatccttggaggcccacacaacccttgctattgctatgaataaaatcggaggcaaatctaacacaggtgagggaggtgaaaatccatctcgtttggtatcgcttccagatggttcaatgaatcccaaaaggagtgcaatcaagcaggttgctagtgggagatttggggtttcaagttattaccttacaaacgctgatgaattgcagataaaaatggctcagggagcaaagcccggtgaaggtggtgaacttccagggcacaaagttattggagatattgctgtcacaagaaattcaacagctggagttggattaattagccctcctccacatcatgatatctattcaattgaagaccttgctcaattaattcatgatttaaagaatgcgaatccttctgctcgagtaagtgtgaagttggtttctgaagctggtgtgggagtgattgctagcggtgtggtcaagggccatgcagaccatgttttgatctcgggtcatgatggtggaaccggtgcttccagatggacggggatcaagagtgctgggctcccatgggagcttggtctagccgagacacaccaaactcttgttgcaaacgaccttcgtggtcgaactgtattacagactgatggtcaactaaaaacggggagagacgtagccattgctgcccttcttggggctgaggagtttggtttcagtacagccccacttatcactcttggttgcatcatgatgaggaaatgtcacaaaaacacttgccccgttgggatagccacccaagatcctgttctccgtgagaaatttgcaggggaacccgaacatgtaatcaatttcttcttcatgttagcagaggaaatgagggaaatcatggctgatttgggtttccgaactgttaatgaaatggtgggacgtgcagatatgcttgaagtagataaggatttgacaaaggacaatgagaaactaggaaacatcgatctgtcgctattacttcgaccagccgctgatatccgcccggatgctgcccaaatttgtgtacaaaaacaagatcacgggttagatatggctcttgatcaacggttaataccgcttgctaaaccagctttagaaaagggtttacctgtatacatcgaatcacctatttgtaatgtaaaccgtgcggttgggacgatgcttagtcatgaagttactaaacgataccacttggctggccttccagccgacactatccatatcaaacttaatggtagtgcaggccagagtattggagccttcctttgcccgggaattttgcttgagcttgaaggagacagcaatgattatgttgggaaagggttgtcaggtggcaagattgttgtttatccaccgaagggaagcgggttcgaccctaaagaaaacattgtgatcggaaacgtggctctttatggtgcaacgagtggtgaagcttattttaacgggatggcggcagagcgtttctgcgttagaaactctggggctaatgcggtggtggaaggtgtcggtgatcatgggtgtgaatacatgacgggtgggactgttgtcatattgggtaaaacagggaggaactttgctgctgggatgagtggtggaattgcctatgtccttgatgttgacgccaagttccggttaagatgtaacgctgagcttgttgatcttgataaggttgaagatgaggatgatattatgactctaagaatgatgattcagcaacaccaacggtacacaaacagccagctggctaaggaagtactggctgactttgacaaccttttgccaaaatttattaaagttttcccgagagattataagcgtattcttgctaccatgaaagaaaaagaaaacgccaaaaatgctgctgctgagatggctcctgaagaagccgatattcgggaggaagatgagttgaaggagaaagatgctttcgaggagcttaaaaagttggcagccaaagcattgagtgaggcggtcaatattaatgtcaaagaaatggtcaatgaggtcaaagaggttgaaatggctgaaccagccacgagaccatcccgagttgaagatgcagtcaaacaccgtggttttgttgcttacgagcgtgagggagtatcgtaccgggacccggctgttcggatggaggactggaatgaagttatggaagagacaaaacctggccctcttttaaaaactcaatctgcacggtgtatggattgtggtacaccgttttgtcatcaggataactcgggttgtcctctcggcaacaaaattcctgaattcaacgagctggtttatcagaaccgatggcgtgaggcattagatcgactccttgagacaaataacttcccagagttcaccggccgggtctgccctgctccatgtgaaggttcttgtgtgctcggtataattgaaaatccagtctcgattaaaagcatagagtgctcgatcatagacaaagcctttgaggaaggatggatggtgcctcgacctcccctcaagagaaccgggaaaaaagtagctattgttggaagtggtcctgctgggttagctgcggctgatcaactaaatcgattgggccatacagtgaccgtgttcgagcgtgctgaccgaattggtggactcatgatgtatggggttcctaacatgaaggctgacaaaatcgacgttgttcaaagacgggttgacttgatggctgaggaaggtgtgaattttgtggtcaatgccaacgtaggaaccgatccatcatattccattgaacggcttcatgaagagaatgatgccgttattttagcagtgggatcaacaaggccgagggaccttcctgttcctggacgagagctatcggggatacattttgctatgaagtttttgcatgcgaatactaaaagcttattggatagcaatctcgaggatggtaattatatctctgctaagggtaaaaaggtaattgtaattggtggtggtgacaccggtacagattgtattgggacatccattcgccatggttgcaccagcattgtaaatctggagcttcttccccagccaccacaaacccgagcacctggcaacccctggccacagtggcctcgtgtgttccgtgtagattatggacaccaagaagctgctacgaaattcggtaaagacccgcggacatatgaagtcttgactaaaaggttcgttagtgacgataatgggtcagtaaaaggtgttgaggtggtgcgtgttcagtgggcgaaggatgagaccggtcagtttaagttcaaggaggttgagggttctgaggagatcctcgaggctgacctggttttgctagccatgggcttcctcggtcctgaatcgacgatagcggacaaactgggattggagaaggacggaagatcgaatgttaaggcggagtatgggcggttttcgacaaacgtggaaggcgtgtttgcagcgggtgattgccgaagagggcagtcgttggtggtgtgggccatctcagaagggcggcaggcagcagcacaggtggataagtttttgtcgaaagatgagaaggatgttgaaagcagattagaaaaggggaagagggagcagcaagcagttcggacattatagattgatacatacaagattgatgttaaaaaaggaaagggttatagaggtggttttgtgtgggaagttagttttgtgtccttcaggctctgctgtttatagccttcttttctttttgttattggttgttgcttgttttgaactttgaaacaataaatgtacagatgaatctgttttgggtttttgttatttttaatccaaatggttaacttactgttttggcca

SEQ ID NO: 8113 - DNA, 7003 bp, Echinacea purpurea
atacactctatacctgctgtgtgtatatccgcagccgtcgttaacacgtcggttgtttaaatttgttagttttcatctctttaaatcagatcaaatcgaatccaaatacaaaccctatataagcagatcttcttgtttgatcgaaataatctctttctttttaaaatttatccagatctgataatcagagaaagtttctgataaaaaccgtcggtgttcataatgtcggtggctttgaatcacgctcttcaagcccgacccgacccgaatttgacgaaaagcttttccacccgtccggtaaacgggttgactcggattggtgtgaaacaatccagtcttttagggaagaagttgtacggaaccagggtgggacgtcgggtcgggtccgtgtcctggtcgggttctgagacgctccataagttagatgggccgggtcgtaaagtggtggttcgggcgggtttgtcgttggtacccgagaagccgttggggttatatgatccggcttttgataaggattcgtgtggggttgggtttgttgctgaattatccggtgaaggtaaccgtaaaacggtgactgatgcgattgagatgttggttcgtatgtcacatagaggtgcttgtgggtgtgagacgaacaccggtgacggtgccggaattcttgttggtcttccacatgagttcttcaaggaggtggcaaaggatgaggggtttgagctaccgccactgggtcaatacgcggtcggcatgttcttcttgcccacttctgatactagaagggagcaaagtaagattgtgtttacaaaggttgccgagtcacttgggcacactgttcttggctggcgtactgtcccgacagataattctggtttgggtaaatctgctgtacaaaccgagcctgttatagaacaagtgtttctcactcccacttctaggtcaaaggtcgattttgagcggcagatgtacatactaagaagggtttcgatggtagccatcagggctgcattgaaccttcaacatggtggtgttaaggacttctatatatgttctttgtcatctagaactgttgtatacaaaggccagttaaaaccgaaccagttgaaggagtattatcatgcagatcttggcaatgaaaggtttacgagctacatggcaatgattcattctcgattttcaacaaacacttttcctagctgggatcgtgctcaacctatgcgtgttcttggacataatggtgaaattaacacgcttagaggcaatgttaattggatgaaggcacgtgaaggtcttttaaaatgcaaagagctaggtctctccaagaatgagatgaaaaaacttcttcccattgtagacgccagctcatcagattcaggtgcttttgatggtgttttggagcttttagtgcgagctggcagaagtcttcctgaggcagttatgatgatgatccctgaagcatggcaaaatgacaagaacatggatcctcaaaggaaggctttatatgaatattgttcagctttaatggagccatgggatgggcccgctctagtttcatttactgatggtcggtaccttggagcaacactggaccgaaatggactgcggcccggtcggttctatgttactcacagtggacgcgttataatggcgagtgaagttggagtcgttgatattccgccagaagatgttgctagaaaaggaagactgaaccctggaatgatgcttcttgttgactttgacaaacatatcgttgtagatgatgaagctttgaaacaacagtattctcttgcaagaccgtatggaaaatggcttgaaacgcaaaagatagaactgaaaaagattgtggaatctgttaataaatctttacggtcctgccctcccatcgctggagtgtcaaaggctgaggaggacatgggtatccagggtctcttggctccattgaaagcttttggttatacaattgaatccttggagatgcttttactaccaatggctaaagatggtgttgaggcactgggttcaatgggaaacgatgctccgttggctgtgatgtctaacagagagaagctaacatttgagtatttcaaacaaatgtttgcacaagtaaccaacccaccaattgatcctataagagagaaaattgtaacttcaatggaatgcatggtgggcccagaaggcgatcttacagaaacaacagaagagcaatgccatcgtctttcactaaaaggcccactcttatctattgaagagatggagtccattaaaaacatgaactacagaggctggagaagcaaagttcttgatataacctaccctaaagaacttggcaaaaagggtttggaggaaaccctagatagaatctgttctcaggcgcatgatgcaattaaagagggctatactacattggtgctttctgacagagctttttcatcaaagcgagttgcagtaagctctcttttggcagttggtgcggtccaccatcatttggtcaaaaagcttgaacgaaccagggttgcattaatggtggaatccgcagagccacgtgaagtgcaccatttttgtacgcttgttgggtttggcgctgatgccatttgcccctatttggcagttgaagccatttggaggttacaagctgatggtaaaatcccaccaaaatccaacggtgagttccacacaaaagaggaattagttaagaagtactataaagcaagtcactatggaatgcaaaaggttcttgccaaaatgggaatttcgactttagcatcatataaaggtgctcaaatctttgaagcagtcgggttatcaacagaagtgatggaaagatgctttgctggcactccaagtagagttgaaggagctacgtttgaagcacttgctggtgatgcgcttaacttgcatgatttaggttttccagcacgcaagttcccgccaaacagtgcagaagctgttgctttgcctaaccctggtgattaccattggaggaaaggtggtgaaattcatttgaatgacccgttagctattgcaaaactgcaagaagctgctaggggaaacagtgttgctgcatataaagagtattcaaaacgcattcatgaactaaataagacttgtaatcttcgtgggcttttgaagtttaaagagggaaatgcgaaggtgcctttggaagaggttgagcctgctagtgaaatagtgaaacggttctgtactggtgccatgagttacgggtccatatccttggaggcccacacaacccttgctattgctatgaataaaatcggaggcaaatctaacacaggtgagggaggtgaaaatccatctcgtttggtatcgcttccagatggttcaatgaatcccaaaaggagtgcaatcaagcaggttgctagtgggcgatttggggtttcaagttattaccttacaaatgctgatgaattgcagataaaaatggctcagggagcaaagcccggtgaaggtggtgaacttccggggcacaaagttattggagatattgctgtcacaagaaattcaacagctggagttggattaattagccctcctccacatcatgatatctattcaatcgaagaccttgctcaattaattcatgatttaaagaatgcgaatccttccgctcgagtaagtgtgaagttggtttctgaagctggtgtgggagtgattgctagcggtgtggtcaagggccatgcagaccatgttttgatctcgggtcatgatggtggaaccggtgcttccagatggacggggatcaagagtgctgggctcccatgggagcttggtctagccgagacacaccaaactctagttgcaaacgaccttcgtggtcgaactgtattacagactgatggtcaactaaaaacggggagagacgtagccattgctgcccttcttggggctgaggagtttggtttcagtacagccccacttatcactcttggttgcatcatgatgaggaaatgtcacaaaaacacttgccccgttgggatagccacccaagatcctgttctccgtgagaaatttgcaggggaacccgaacatgtaatcaatttcttcttcatgttagcagaggaaatgagggaaatcatggctgatttgggtttccgaaccgttaatgaaatggtgggacgtgcagatatgcttgaagtagataaggatttgacaaaggacaatgagaaactaggaaacatcgatctgtcgctattacttcgaccagccgctgatatccgcccggatgctgcccaaatttgtgtacaaaaacaagatcacgggttagatatggctcttgatcaacggttaataccgcttgctaaaccagctttagaaaagggtttacctgtatacatcgaatcacctatttgtaatgtaaaccgtgcggttgggacgatgcttagtcatgaagttactaaacgataccacttggctggccttccagccgacactatccatatcaaacttaatggtagtgcaggccagagtattggagccttcctttgcccgggaattttgcttgagcttgaaggagacagcaatgattatgttgggaaagggttgtcaggtggcaagattgttgtttatccaccgaagggaagcgggttcgaccctaaagaaaacattgtgattggaaacgtggctctttatggtgcaacgagtggtgaagcttattttaacgggatggcagcagagcgtttctgcgttagaaactctggggctaatgcggtggtggaaggtgtcggtgatcatgggtgtgaatacatgacgggtgggactgttgtcatattgggtaaaacagggaggaactttgctgctgggatgagtggtggaattgcctatgtccttgatgttgacgccaagttccggttaagatgtaacgccgagcttgttgatcttgataaggttgaagacgaggatgatattatgactctaagaatgatgattcagcaacaccaacggtacacaaacagccagctggctaaggaagtactggctgactttgacaaccttttgccaaaatttattaaagttttcccgagagattataagcgtattcttgctaccatgaaagaaaaagaaaacgccaaaaatgctgctgctgagatggctcctgaagaagccgatattcgggaggaagatgagttgaaggagaaagatgctttcgaggagcttaaaaagttggcagccaaagcattgagtgaggcggtcaatattaatgtcaaagaaatggtcaatgaggtcaaagaggttgaaatggctgaaccagccacgagaccatcccgagttgaagatgcagtcaaacaccgtggttttgttgcttacgagcgtgagggagtatcgtaccgggacccggctgttcggatggaggactggaatgaagttatggaagagacaaaacctggccctcttttaaaaactcaatctgcacggtgtatggattgtggtacaccgttttgtcatcaggataactcgggttgtcctcttggcaacaaaattcctgaattcaacgagctggtttatcagaaccgatggcgtgaggcattagatcgactccttgagacaaataacttcccagagttcaccggccgggtctgccctgctccatgtgaaggttcttgtgtgctcggtataattgaaaatccagtctcgattaaaagcatagagtgctcgatcatagacaaagcctttgaggaaggatggatggtgcctcgacctcccctcaagagaaccgggaaaaaagtagctattgttggaagtggtcctgctgggttagctgcggctgatcaactaaatcgattgggccatacagtgaccgtgttcgagcgtgctgaccgaattggtggactcatgatgtatggggttcctaacatgaaggctgacaaaatcgacgttgttcaaagacgggttgacttgatggctgaggaaggtgtgaattttgtggtcaatgccaacgtaggaaccgatccatcatattccattgaacggcttcatgaagagaatgatgccgttattttagcagtgggatcaacaaggccgagggaccttcctgttcctggacgagagctatcggggatacattttgctatgaagtttttgcatgcgaatactaaaagcttattggatagcaatctcgaggatggtaattatatctctgctaagggtaaaaaggtaattgtaattggtggtggtgacaccggtacagattgtattgggacatccattcgccatggttgcaccagcattgtaaatctggagcttcttccccagccaccacaaacccgagcacctggcaacccctggccacagtggcctcgtgtattccgtgtagattatggacaccaagaagctgctacgaaattcggtaaagacccgcggacatatgaagtcttgactaaaaggttcgttagtgacgataatgggtcagtaaaaggtgttgaggtggtgcgtgttcagtgggcgaaggatgaggccggtcagtttaagttcaaggaggttgagggttctgaggagatcctcgaggctgacctggttttgctagccatgggcttcctcggtcctgaatcgacgatagcggacaaactgggattggagaaggacggaagatcgaatgttaaggcggagtatgggcggttttcgacaaacgtggaaggcgtgtttgcagcgggtgattgccgaagagggcagtcgttggtggtgtgggccatctcagaagggcggcaggcagcagcacaggtggataagtttttgtcaaaagatgagaaggatgttgaaagcagattagaaaaggggaagagggagcagcaagcagttcggacattatagattgatacatacaagattgatgttataaaaaaggaaagggttatagaggtgtggttttgtgtgggaagttagttttgtgtccttcaggctctgctgtttatagccttcttttctttttgttattggttgttgcttgttttgaactttgaaacaataaatgtacagatgaatctgttttgggtttttg

SEQ ID NO: 8114 - DNA, 7100 bp, Plantago ovata
cggccgggggttcagagagagacaaacaaaactaaaccagctttctccatttcatctcctcccccaattcactcacctctctctttaggtttcttcgtctcgtcgaaccaatcgcctctctctacctctcttcctaattcaattcaatcggaaaaaatttgatcggcgttatgtcggtggcgtcgggatcgggaataggaggcgccgtgaggccggcggtgaggagccaccagctgaatgcggtggcagcgttgagtcagaggagggttagggtttcaaaggagacgagatcagcatgtagcagcaggttggttatgagtcggaacgatgccgttttatgtcccggtttgcataggttgcgatcggtgcgtccaacagggcgggtttcttcgggtcgggttatggcgacgaagggtgggatgtctcaggtgccggagaagccgctggggctgtatgacccggcgtttgataaggactcgtgtggggtcgggtttgttgctgagctgtctggcgaaagcagccgtaaaacggtgacagatgctgtagagatgttggtgaggatgacgcatagaggggcgtgtggttgtgagactaatactggtgatggagctggtattcttgtcggtcttcctcatcatttctatgcacaggttgctaaagatgctggctttgagctacccggacctggtgaatatgcaattggcatgttttttttgccgacctctgatacacgcagggagcaaagtaagagtgtattcaaaaaggttgcggaatcacttggtcatacagttcttggctggagacctgttccaacagataactcgggattagggaaatctgccttggacacagaacccattattgagcaggtttttctatctgctacgtcaaggtctactgcagatattgaacaacagatgtacatattaaggagggttgcaatggtagccatccgagctgctttaaacatgcagcatggtggtgctaaagacttctacatatgttctctgtcctcaaggactgttgtatacaaaggtcagttgaagcctgaccagttgaaggactactactacgcggatcttggcaatgaaaggtttacgagctacatggccctggtacattcgcgattctctacaaacacatttccaagttgggatcgtgcacagcccatgcgtgtccttggacacaatggtgagataaacacactccgaggcaatgtaaattggatgaaggcccgtgaaggactcctaaagtgcagcgagcttggcttatcgaaggcagagatgaagaagcttctcccaattgttgatgccagctcgtcggattctggtgcatttgatggtgtacttgagcttttgattagagctggtagaagtcttccagaagctgtgatgatgatgattcctgaagcctggcaaaatgataagaacatggatcctgagcggaaggctctgtatgagtacttctcagctctaatggaaccgtgggatggccctgctcttatatcatttaccgatggaagatatcttggagcaacattagatcgaaatggtttacgccctggtcgtttttacgtaactcacagtggcagagttgtcatggcaagtgaagttggagtggttgatatccccccagaagatgtatcccgtaaaggaagacttaatcctggtatgatgcttctcgtagactttgagaatcacgttgttgttgatgacgatgccttgaagcaacaatactcgcaagcgagaccatatggggagtggctagaaaggcaaaagatacagttgaaagacattgtcgaatctgtccaggagtctgatcgcatggctcctctgatagctggtgttatgcagggatctgttgatgacgaaaacatggaaaatatgggacttcatggtttgctgtcaccattaaaggcatttggttacactgttgaatccttggagatgttacttctgcctatggcgaaagatggcgttgaggctcttggttctatggggaacgatgccccattggctgtgatgtctaacagagagaaacttacgttcgagtatttcaagcagatgtttgctcaggtcacgaaccctccaattgatcctattagggagaagattgttacctccatggagtgcatgatcggccctgagggtgatcttacagagaccacggaagaacagtgtcaccgcttatcactgaaaggtcctttgctttccatcgaagaaatggaagcagtgaaaaagatgaactacagaggttggagaagtaaagttcttgacattacctattccaagagtcgtggtaggaagggtttggaagaaaccttagacaggatatgttcggaagcacatgaagcaatcaaagatggatacactacacttgtgctttctgatagagctttctctccgaagcgtgttccagtcagctcactcttggctgtcggtgctgtacatcatcatcttgtaaataatcttgagcgtacccgtgttgcattgatcgttgaatcagctgagccacgtgaagtgcaccacttctgtacgcttgtaggatttggtgctgatgctatctgcccttatttggctgtggaagcgatttggagactgcaagttgatggaaagattccacccaaatcgactggtgaatttcactcaaagggcgagcttgtgaagaaatattttaaggccacgacctatggcatgatgaaggtgcttgctaaaatgggtatttcaactttggcctcatataaaggtgctcaaatctttgaggcagttgggctctcatcagaggtgatgtcacgctgctttgctgggactcccagcagagttgagggtgccactttcgaagcactagcaattgatgcacttcagttgcatgagatggctttcccaacacgtgcattaccgcctggcagtgccgaggctgtagcacttcccaatcctggtgattaccactggaggaaaggtggggaagttcatctgaatgatccccttgctattgcaaaattacaagaagctgccagaaccaacagcgtggctgcatacaaagagtactcaaaacgtgtccaggagttgaataagtcttgcaatttaagagggctacttaaatttaaagagactgatgttggggtacctttagaagaagttgaaccagcaagtgaaattgttaaacgtttttgtactggagccatgagttatggatcaatatctttggaagcacatacaacattggccttggctatgaacaagattggtggaaagtcaaacactggtgagggcggtgaacaaccatcacgcatggagcctctctcagatggttcaagaaatcctaagaggagctcgattaagcaggtggccagtggaagatttggagtttctagctactaccttacaaatgcagatgagttgcaaataaaaatggctcagggagcgaagcctggagaagggggtgaacttcctgggcataaggtcataggtgacattgcgataactaggaattccacagctggcgtgggactcatcagccctcctccccatcatgacatctactcgattgaagatcttgctcaattgattcatgaccttaagaatgcaaatcctggtgctcgtataagtgtcaagttggtttctgaagcaggtgttggtgtgatagccagtggggttgtcaaaggtcatgcagatcacgtcttgatatctggtcatgatggaggtactggagcatcaagatggactggaatcaagagtgctggtctcccatgggaacttggtcttgcagagactcaccaaaccttagttgctaatgatctccgtggccgaactgttcttcaaactgatggtcaactgaagactggacgagatgttgcaattgctgcacttcttggtgctgaagagtttggctttagtactgcacctctcataacgcttggttgcattatgatgcggaagtgccataaaaatacctgtcctgttggaatcgccacacaagatccagtcctccgggaaaagtttgccggcgaaccagaacatgttataaacttctttttcatgctggcagaagaagtcagagagatcatgtcacagcttggatttagaacacttactgaaatggtgggccggtcagacatgcttgaattggacagggatgtggcccagaacaatgagaagcttaagaatattgatttatccttgttacttcgacctgcagctgacattagaccagatgctgcacaggtatgcgttcagaagcaggatcatgggttggacattgctttggataacaagctaattgatttagccaagcctgctttggataaaagttttcctgtttacattgaatcgcctatctgcaacgttaaccgagctgttgggaccatgctaagccatgaagtgacaaagcgatttcatatggaagggcttccttcagatacgattcatataaaactcaacggaagtgccggccagagtcttggagcttttctatgtcctggtatcacactggagctcgaaggtgatagcaatgattatgttgggaaaggcttgtcaggcggaagaattatagtctatcctcctaaacagagcaattttgatccaaaggaaaacattgtgattgggaatgtagcactttatggttccacaaaaggtgaggcctatttcaatggcatggcggctgagagatttgctgttcggaattctggtgctcgagcagtcgtggaaggtgtgggtgaccatggctgtgaatacatgactggtggaactgttgttgttctaggcaatactgggagaaactttgctgcgggtatgagtgggggtgttgcctatgttcttgatgtcaactccacgttccgatcacgttgcaacacagagttggtagatcttgatccagttgaagaggaggatgatattatgaccctcagaatgatgatacagcagcatcagcgccacacaggaagccagttggctaaagaagtgcttgctgattttgagtcacttttacctaaatttatcaaggtattcccgcgtgactataaacgtgttcttgcaagcatgaaagcagatgaaatatcaaaagcagtggaagctgagaatgctgcaaaagatgagagaaatgaagaggcagagttgaaggaaaaagatgcttttgaagagctgaagaagctagcagccacatctttgaatggacaacagagtcagatcgaagaagataaatctgagaagaggcctactagagtttctgatgcagtaaagcatcgcggtttcgttgcttatgaacgtgaaggtgtatcgtacagagatcctactgttcggatgaatgactggaatgaagttatggaagaggctaaacctgggccacttctcaaaacacaatctgctcgctgtatggactgtggtactcctttctgtcatcaggagaactctggatgtcctcttgggaataagatacccgagtttaatgagttggtataccaaaatagatggcgtgaagctctcgacaggcttttggagacgaacaacttcccggagttcactggccgtgtgtgccctgcaccctgtgaaggctcttgtgtgcttggaattatagaaaatccggtgtccataaaaaatatagagtgttcgatcatagataaagcttttgaagagggatggatggtgccacgaccccctctcaagaggactggaaaacgagttgctattattggaagtggacctgctggtttggctgcggctgatcagttgaacaaaaagggtcacttggtgactgtgtttgagcgagccgacagaattggtgggcttatgatgtatggagtgcctaacatgaaggctgataaaattgatgtagttcaaagacgtgttgacctcatggaaaaggaaggagtcaactttgtgaccaacgctaatattggaaaggacctatcatactctctagagaacctccgcaaggagcatgatgccattgttttggctgtaggagccacgaaaccgagggaccttcctgttcctggacgtgaactctctggggtccatttcgctatggagttccttcatgcaaatacgaagagtttgcttgacagcaaacttgaggatggtaactacatctctgcaaatggcaagagagtagtggtaattggtggtggtgacaccggcacagactgcattgggacttctattagacatggatgtagcagcgtcgtgaatctagagcttcttcctataccaccacagacccgagctcctggcaacccttggccccagtggcctcgtgttttccgtgtggattatgggcatcaggaagctgctacgaagtttggaaaggacccaaggacgtacgaggtgttgacaaagagattcataggaggtgaaaatggagcagtgaaaggacttgaggtggttcgtgtcaaatgggaaaaggatgccagtggaaggtttcaattcaaggagattgaaggttcagaggagattatcgaggctgatcttgtattacttgccatgggattccttgggcctgaatcgacactcgctgagaagcttgggttagaacaagacaacaggtctaacttcaaagctgagtatgggcgtttctcaaccaatgtcgaaggtatttttgcagccggggattgccgtagaggacagtcacttgtggtgtgggcaatctctgaaggaagacaatcagcagcacaggtcgacaagtatctcatgaaagatgaagaaacctccgatacaagacaaggtgaattggttgaagacagacgaacggtgatgacataagtttcccctgttcgactttagtatcttttctctttgttctttgttctttttttcttcttccgtttgtggtacacatggtttgcattaggaaccaatgtctatcatttcaagtgtgaagggcgggaattgtagaggtagctatgtgtggaagaatgggggagttgtgatctaggagatatctggtagtgtatttatagaagttgtgtattgtttgggggtgttttttccttatttcaagtgcagttgggcaaattttgccagattgtaggaataatgatgaatgtacagttctttttgctgtttatgctctctatcaagagccagtaatatgagcaagtttggtct

SEQ ID NO: 8115 - DNA, 7231 bp, Populus trichocarpa
gctacactaacaataatgtcggctgctgcttcgagttcgagcgctatccttcaaccaaaatcggtgaaatcttcaatttcctcgcttaacaaatcatcatcctgtgttttttctccttcgcttaatgttgccacggcagcatctatttctcgacggagagggagggcaactcgatgtgtttcggcgaggaactcggcggtagttgagagaaaatcgtttttaggaagtaaagtgcgcggctctccatcggagaggttgcatttttggctgtcggaaggaccgggcagagagccgaaactacgagttgtggtccgctctgcattgtctggtgtgccggagaagccgcttgggctttatgacccgtcgtttgataaggattcgtgcggggttgggtttgttgctgagttgtcaggggaaaacagtcgcaaaacggtgaacgatgctctggagatgtcggtgaggatggcacatagaggagcttgcggatgcgaaaccaatactggtgatggtgctgggattcttgtggctcttcctcatgactactacaaggaggtggctaaggatattgggttcgaactgcctccttcaggggaatatgcagtgggcatgttctttctgcccacatctgataatcgcagggaagaaagcaagaatgtattcaccaaggttgcggagtctcttgggcatacagtacttggatggcgaccagtgccaacagataattctgcattgggaaatgctgctttgcagaccgaacctgtcatcgagcaagtgtttcttacagccactcctaggtcgaaggctgattttgagaagcagatgtacatattgaggagggtgtcgatggtagctattacagctgcactaaaccttcaatatggtggtgttaaggacttttatatctgttccctttcctcaaggacggttgtttataaaggtcagttgaagcctgaccagttgaaggcttactattatgcagatcttggcaatgaaacgtttacgagctacatggccatggtgcactcacgattttcaacaaatacatttcctagctgggatcgtgctcaacccatgcgtgtcttgggccataatggggaaatcaacacgctcagaggcaatgtgaactggatgaaggctcgtgagggccttttaaagtgcaaggagctcggtctctcaaagaatgagatgaagaagattcttcctattgtagatgctagttcttctgattcaggggcttttgatggtgtgcttgagcttctaattagatccgggagaactctccctgaggctgtcatgatgatgattcctgaagcctggcaaaatgacaagaacatggatcctcaaaggagggcactgtatgaatattcctcagcccttatggaaccatgggacgggcctgcacttatctcatttactgatggccactacttaggagctactctggaccgcaatgggttacgtccaggtagattttacgtcacacgaagtgggcgagttatcatggccagtgaagttggtgttgtggatattcctcctgaagatgtccttaggaaaggacggcttaaccctggaatgatgcttctggtggattttgagaagcatacggtagtggatgatgaagccttgaagcaacaatattccttagcgaggccctatggggagtggttgaagaggcaaaagattgaactcagtgacatagttaactcagttcaagaatctgataaagttgctccagccatttctggggttgtcgccgcatctgatgatgatgacagtatggtgcatatgggcattcatggattgttggcaccattaaaatcctttggttatactgttgaagccttggagatgctgatgcttcccatggcaaaggacggtactgagcctcttggttcgatgggaaatgacgcccccttggctgtcatgtctaacagggaaaagctcacttttgagtacttcaagcaaatgttcgctcaagtgacaaatcccccaattgatcctatcagagagaagattgtcacttccatggaatgcatgattgggccagaaggagatctgacagaaacaactgaagaacaatgccgccgtctctctctaaaaggcccacttttatcaatcggggaaatggaagcgatcaaaaagatgaactataatggttggcgaagcaaagttcttgacataacttattcaataaaacggggcaggaagggattggaggagactttagataggatttgtactgaagctcatgaggcaatcaaggaaggttatactgtgttggttctttctgacagagccttctcatcaaagcgtgttgctgtcagctccctcttggctgttggcgctgtccaccaatatcttgtaaaaaagcttgagcgtactcaagttgggttgatagttgaatctgctgaaccacgtgaagtgcaccatttctgtacattggttggttttggtgcagatgccatctgcccatacttagccatagatgccatttggagattacaggttgatggtaagatcccaccaaaatccactggcgagttacactcaaaggatgagctagtcaagaagtatttcaaagcaagcaactatggcatgatgaaggtgcttgcgaaaatgggaatttcaactttggcatcctacaagggtgctcagatttttgaagggctgggcctttcatcagaagtgattgacaagtgctttgcaggaaccccaagcagggtagaaggagcaacatttgagatgcttgctaatgattcacttcgtttgcatgagttggcgtttccctcccgtgctctccctcctggaagtgcagaagctgtagctcttcccaatcctggggattatcattggagaaaaggtggtgagattcaccttaatgatcctcttgctattgcaaaacttcaagaagctgccagaggtaatagtgtggctgcctataaggaatattctaagcgcattcaggagttaaacaaagcttgtaatttgcgtgggcttttgaagttcaaagtggcagatgtgaaagtttctttggatgaagtggaaccagccagtgaaattgttaaacggttctgtactggggctatgagttatggatcaatatcattggaggcacacaccacgttggctcaggctatgaataaaattggaggaaaatcaaatacaggtgagggaggtgaacaaccatctcgtatggagcctcttcctgatggttcaatgaatccaaagaggagtgctattaagcaagttgcaagtgggagatttggagtttcaagttactatcttacaaatgctgatgaactgcagataaagatggctcagggtgccaagcctggtgaaggaggtgagcttcctggtcacaaggtcataggagacattgcagttaccagaaattctactgcaggggtgggtcttattagtcctcctccccatcatgatatctattcaattgaagaccttgcccaattgattcatgaccttaagaatgccaatccatcagcaagaataagtgtcaagttggtatctgaagctggcgtgggagtaattgccagtggggtggtgaagggacatgctgatcacgttttgatctcaggccatgatggaggtacaggtgcttctagatggactggcatcaagagtgctgggctcccatgggaacttggtttggctgagacccatcaaacacttgttgccaatgaccttcgtggccgaacagttcttcagactgatggccaactaaaaactggccgtgatgtggccattgcagctcttcttggtgctgaagaatttggcttcagcactgccccccttataacacttggctgcatcatgatgcgaaagtgccataagaacacctgtcccgtaggcattgctactcaagatccagtgctgagggataagtttgctggagaaccagaacacgttattaacttcttctttatgctagcagaggagctcagagagatcatggctcagcttggtttccgtactatgaatgagatggttggtcgttcagacatgcttgaagttgataaagaagttgttaagagcaatgagaagctggaaaatattgatctctcctcgttacttagacctgctgctgacattcgacctggagctgcccaatattgtgtccaaaagcaggatcatggtttggacatggcattggatcaaaaactcatcaaactttctgaggctgcattggaaaaaagtcttcctgtgtacattgaaacacctatccgcaatgtgaaccgtgctgtcggaacaatgcttagccatgaagttactaagcgttaccacttggcagggcttcctgccgatactatccatatcaaactcaaaggaagtgcagggcagagcctgggagcttttctttgcccaggcattatgctggagctggaaggtgatggcaatgactatgtcggtaaaggattatcaggtgggaagattgtagtttatcctccaaaaggaagcctcttcgatccgaaagagaacattataattggtaatgtagctctttatggagccacaggtggtgaagcatatcttaatggaatggcagcagaaagattttgtgtccgtaattctggagcaagggctgttgtagaaggtattggtgatcatggctgcgagtacatgacaggtgggactattgttgttcttgggaaaactggcaggaattttgctgctggtatgagtggcggcgttgcttatgttctcgatttggatgggaaattcaaatctcgatgcaatcttgaacttgttgatcttgataaagttgaggaggaggaggacattatgactctaaaaatgatgatacaacaacaccagcgtcacacaaacagccttctagctagagaagtacttgctgattttgataatcttctgcctaagtttatcaaggtctttcccagggattacaaacgtgttcttgcaaacatgaaagaggaatctgcttcaaaagaggctgctgagcttgctgctaaagaagctgaggagaaaaatgaagcagagttgagggagaaagatgcttttgaggagctcaagaagatggcagctgcatccttgaatgggaaatccaatcaggtagtagaagatgaaccactgaaaaggcctacccgggttaataatgctgtcaaacatagaggcttcattgcttatgagcgtgaaggtgttcaatacagagatcctaatgttcgaatgaatgactggaaggaagttatggagtcgtcaaaacctggccctctattaaatacgcagtcggcccgttgcatggactgtggcactcctttctgtcaccaggaaaactcgggatgccctcttggaaacaaaattcctgaatttaatgaattagtgcaccaaaataggtggcgcgaagcattagacaggttgcttgagacaaataacttcccagagttcactggcagagtgtgccctgcaccttgtgaaggttcctgtgttcttggcataattgatgatcctgtctcaataaaaaacattgaatgttcaattattgacaaggcttttgaggagggttggatggtgccgcggcctcccctcaagagaactgggaaacgagtggctattgttggaagtgggccttctggtttggctgctgcagatcaactaaacaaaaggggtcatttggtgactgtgtatgagcgtgctgatcgaattggagggctaatgatgtatggagttcccaacatgaaaactgacaaagtggatatagttcaacgtcgtgttaatcttatggccaaggaaggcatcaattttgtggtcaatgctaatgttggtatcgaccctctgtactctcttgatcagctaagacaggagaacgatgctattgttttggcagtgggagccacaaaacctagggaccttccggtacctggtcgggagatgtctggtgtccattttgctatggagtttcttcacaaaaataccaaaagtttgcttgacagcaatctacaggatggtaactacatatctgcaaagggcaagaaagtagttgtcattggtggaggtgacactggaacagattgcatggggacatctattcgccacggttgcagtggcgttgtaaatctagagcttctacctgagccaccacaaactagagctccgggcaacccatggccacagtggcctaaagtattccgggtagactatgggcaccaggaagctgcttccaagtttgggaaagacccaaggtcttatgaggtgttgactaagcgtttcattggagacgaagatgggagcgtgaagggacttgaggtggtacgtgtccattgggagaaggatgctagtgggaaatttcagtataaggaggttgagggctctgaggaaattattgaggctgacctagtcctgctagctatgggattccttggtcctgaaccgaatgtggcaaagaagttgggcttggagcaagataatcgatcaaacttcaaggcagaatatggccgcttctcaaccaatgtggaagggatctttgccgccggggattgcaggcgaggccagtcgctagttgtatgggcaatatcagaaggacgacaagctgcttcccaggtggacaaatatctcatgaaagaagaggatgttaccattagcactgataatacccaggatgaacttgtcaagaggcacaaagacctcaccaagaggcatcaagacagcagcaaacacactgtcatgacataatcaacccatgaaattttcttttgttgctcactcggtactgaaaagatatggaactgatacacaggactaggattaataatcgcatagaatgatgccatgcaaggaataaattggagaatcaccagaatggtgtccggctcccgcatgtgaggacttgcaagattgggtagacgtgagaagtagcatgtgtgtagctggtatagagttagaatgattttggtgttcgttcttttatagctttcaacctgctggcttgaaaatcgttaagctcttctggtagtgttgaggaataatgtacagctttgtctcttgaatattttaagaaaatatgtggggaaattatttacatctttattgtccagttagttgttctcgagaaacacaggatcgtttttgggagatgaatagcctcgtgcctcgttgtttagctaagaatgtaatggggtgcacctccatgcacagagaagtgcaaagttatactgaatttgatctcttatggaagctgaaactattctgcctgaggttttga

SEQ ID NO: 8116 - DNA, 7053 bp, Malus domestica
atgttggcgagcactggcggttccgtcgttcagctccgagccaaatcgtcacttctgccgtcgcagctcaatgcgacgccggtagctcggctcggcgggagcagggcggcggtgactacctgctctgcttcccggaaatctagcaaggctctggcgaagaagttcttcgggacccgattgagggcgtccggatccgagaggctccatttgtggcgctccgacggtccaggtcgctctccgaagctccgagtcgtcgtacgcaacatgctctccgccgttccagagaagcccctcgggctatacgacccgtcgtttgataaggactcgtgtggtgtcggcttcgtcgccgaattgtccggcgaggtcagccgcaaaacgattacggatgcaattgaaatgttggagcggatgacgcacagaggagcgtgtgggtgcgaaacgaatactggtgatggagctgggattctcgtcggtgttcctcacgacttctacaaggaggttaccaaagatgccgggtttgatcttcccccggcaggggaatacgccgttggaatgttcttcttgcctgcatctgagagtcgaagagaagaaagcaaaagagtatttgcaaaggttgcagagtcccttggacacactgttcttgggtggcgatctgtcccaacagataactcggacttggggaagtctgccttgcagacagaacctgttattgagcaagtgttccttactgcgaccccaaggtcaaaacttgacctcgagcgacagatgtacatattaagaaggctgtcaatggttgctatccgagctgcattaaaccttgaacttggtggcgctaaagacttttatatatgttcgctttcctcaagaactgttgtgtacaagggtcagctgaagcccattcagctgaaggattactattatgcagatcttggcaatgaaaggtttacgagctacatggccctggttcactctcgattctcaacaaatacctttcccagctgggatcgcgctcagcctatgcgtattattggccacaatggtgaaatcaacaccctcagaggaaatgttaactggatgaaggcacgtgagggactgcttaagtgtaaggaacttggtctatcagaaaatgatttaaagaagctgttacccattgtggatgccagttcttcggattcaggtgcttttgatggtgttcttgagcttctggttcaagctggaagaagtctccctgaagctattatgatgttgattcctgaagcatggcaaaatgacaagaacatggacccagataggaaagcactgtatgagtatttctcatctctcatggagccatgggatgggccagctcttatatcatttactgatggacgctatttgggagctacactggatcgtaatggactccgacctggtcgattttacgtcacccacagtggacgcgttattatggccagtgaagttggcgtagtggacattccaccggaagatgtcagcaggaaaggaagacttaaccctggaatgatgcttttggtggactttgagaaccacgttgttgtggacgacgaagccttgaagcagcaatattccttggcaaggccgtatggggagtggcttcaaaggcaaaagattgagctcaaggacattgtagattctgttcatgaatctgacagggtccctccgtccatagctggagctattcctgcatctactgatgatgaaaccatggaaaacatgggaatccacggtttattggcaccactgaaagcttttggttatacagttgaatccttggaaatgttgttgcttcccatggcaaaagatggtgtagaggctcttgggtcgatgggaaatgataccccgttggctgttatgtctaatagagaaaagcttacatttgagtatttcaagcaaatgtttgctcaagtaacaaaccccccaattgatcccatccgagagaaggtagtaacttctatggaatgcatgattggtccagagggtgatctgacagaaaccaccgaagagcaatgtcaccgtctctcactcaaaggtcctcttttgaccattgacgaaatggaagcaatcaagcaaatgaactatagaggttggcgctgcaaagttcttgatataacttattccaagaaacgtggtagggaaggattggaggaaaccttggacaggatttgtgctgaagcgcgtgaagcaataaagaagggatataccacacttgttctttcagacagagccttctccccaaagcgtgttgcagtaagctccctcttggctgttggcgctgttcatcaacatctagtcaaaaaccttgaacgcacacaagtggggttgataattgaatctgctgagccacgtgaagttcatcatttctgtacactggttggcttcggtgcagatgctatctgcccatacttggctatagaggccatttggagactgcaggtggacggaaagatcccaccaaaagctaatggggcaatatactccaaggatgaactggttaaaaagtacttcaaagcaagcaactatggaatgatgaaggttcttgccaagatggggatatctactttggcctcttacaagggtgcacagatttttgaagctttgggtctttcatcagaagtagttgagaggtgctttgcaggaacccctagtagagttgagggtgcaacattcgagatgctagctcgcgacgaacttcatatgcacgagttggcatttccctctcgaagctatcctccaggaagtgccgaggcagtggcactgccaaatcctggggattaccattggagaaaaggtggtgaggttcacctaaatgatccttttgctatagcgaagcttcaagaggctgccagaactaacagtgttgctgcatataaagaatactccaagttcattcatgaattaaataaagcctgcaatctccggggtcttttgaaatttaaaaacacagagcagcagattcacttggatgaagtagaacctgctagtgagattgttaaacggttctgtaccggtgctatgagttatggatcaatatcattggaggcgcatagtacactggccattgctatgaacagaattggaggaaagtcaaatacaggtgagggaggcgagcaaccatctcgtatggagcctctttcagatggttcacggaatccaaagaggagtgcaattaagcaggttgccagtgggagatttggagtttcaagttactatctgacgaatgctgatgaactgcagataaaaatggctcagggtgccaagcctggtgaaggaggtgagcttcctggacacaaggttattggagacattgcagttacgaggaattctactgccggtgtgggtcttatcagtccacctccccatcatgatatctactcaattgaagaccttgcgcaattaattcatgatcttaagaatgctaacccagcagctcgaattagtgtcaagttggtatcggaggcaggtgttggagtagttgctagtggagttgtgaaggggcacgcagaccatgttttgatctctggacatgatggaggcacgggggcctctagatggacaggaattaagaatgcagggcttccatgggaacttggtttggctgagacccatcaaaccttggttgctaatgatcttcgtggccgcacaactctccagactgatggccaactaaaaactggaagagatgttgccatagctgcacttcttggtgcggaagagtttggcttcagcactgcacctctcataacccttggctgcattatgatgcggaagtgccacaagaacacatgtcctgttggcatcgcaactcaagatcctgtacttcgtgagaagtttgctggagaacctgaacatgttattaattttttctttatgatagctgaggaactcagagagattatggcgcagcttggtttccgtactataaatgagatggttggacgttcagatatgcttgaagttgatagagaagtgactaaaaacaatgagaagcttgacaatattgatctatctttgttacttcgacctgcagcagaccttcggcctggagctgcacaatattgtgttgagaaacaagaccatggcttggatatggctcttgatcacaagttaattgctatgtctaaagctgctttggaaaaggctcttcctgtatattttgagacaccaatttgcaatgtgaaccgtgctgttggaacaatgcttagccacgaggtgacaaagcgttacaacagggcagggcttcctgctgacaccattcatatcaaatttagtggaagtgcagggcagagtcttggagcatttttgtgccctggaatcatgcttgagcttgagggtgacagtaatgattatgttggtaaaggtttgtctggtggaaagattgtagtttatcctcccaagggaagcaagtttgacccaaaagaaaatattgtcatcggtaatgtagctttatatggtgccactagtggtgaggcatacttcaatggaatggcagcagaaagattttgtgttcgcaattcaggggctaaggcagttgtcgagggtgttggtgatcatggctgtgaatatatgacaggtggcactgttgttgtgctcgggaaaactggcaggaactttgctgctggtatgagtggtggcattgcctatgtttatgatgtggatggacaatttcggtctcgatgtaatcctgagcttgtagatcttgatagactagaagaagaagatattctgactcttcaaatgatgatacaacaacatcaacggcacactaacagcctgctggccattgaagtactggctgattttgaaaatcttttgcctaagtttatcaaggttattccaagagagtacaagcgtgttcttgcagatatgaaagaggaaaccaaacaggttatagagcacgaggaggaagatgagccagagcttgaagagaaagatgcttttgaagaacttaagaagttggcggctgcatctttaaatgggaaatccaatcaggtagaagatgctgaagcattgaagaggccttctcaggtcactgatgctgttaaacatcgcggttttatttcttatgagcgcgagggcgttcaatatagggatcctaatgttcggatgaatgactggaaggaagttatggaggaaactaaacctggaccacttgtgaagactcagtcagcccgttgcatggattgcgggactcctttctgccatcaggagaacactggatgtcctcttggtaacaaaataccagagttcaatgagttggtgtaccagaataggtggcatgaagcattagagagacttcttgagaccaataacttccccgagtttactggtcgggtttgtccggcaccatgtgaaggttcttgtgttctgggtattattgagaatcccgtatctatcaaaagcatagaatgtgccatcatagacaaggcttttgaggaagggtggatggtgccacgacctcccgtaaagagaactgggaaaagggttgccattgtaggaagtgggccagctggtctagctgctgctgatcagctaaacagaataggccacacagtgactgtgtatgagcgtgctgatagaatcggagggctcatgatgtatggagttcctaatatgaagactgataaagtggagatagttcaacggcgggttaaccttatgactgaggaaggtgtcaactttgtggttaacgctaatattggaaatgatcctttgtactcacttgaaaggcttcgagaggagaacaatgccattgttttagctgtaggagcaacgaaaccaagggatcttcctgtaccagggagagagctgtccggagtacattttgcaatggaatttctacgtgcaaacaccaagagcttattagatagcaatctcgaggacggtaactacatttctgccaaggggaagaaagttgtggtaattggcggaggtgacactggcacagattgcattggaacatctgttcgccatggctgcactagcatcataaatctggagcttctccctgagccaccacgaacaagggctccaggaaacccttggccacagtggcctcgtgtattccgtgtggattatgggcaccaagaagttgcagctaagtttggcaaagatccaagaacttatgaggtgctgacaaagagatttgtgggagatgagaatggggccgtgaaaggactcgaggtggtacgtgtcaaatgggagaaggatgaaactgggcggttccaattcaaggaaatcgagggatctgaggagatcctcgaggctgacctcgtcctactcgcaatggggttccttggaccggaggcgacggtagcagagaagttgggtttggaacgtgaccaacgctcaaactacaaggcggactatggtcggttctcaaccaatgtggatggggtatttgccgctggggattgccggcgtggtcaatcccttgtggtgtgggcaatctcggagggaaggcaagccgctgcacaggttgacaaatacctctcgaacgaggaagaagaccgcaccatcagcaacgggagccacccagatcttagcaagaggcatcaagacctcagcaagagaaacccaaccggtagcagtaaacacacagtgatgacatagacgactcgaccatcatccaagattattattattaaagaacctaaacagcagcagcaaacatcatacgcagatcgacatgtttcggtttcggaaggatttttcgcaatcgattcatggattcaccactgcgatgaagctgaggccggaggtagcagcagaagcaggaggtggtggcgaaaaaattaaactagtttgctgcgggagctgggtgtaggggttttaaaatatattaatttgtttatagtttttcccgggtctctttgcgtggttattattaaaaaaataaatgtacagttttggttctttaccaattatttaaaaaatattattaagggaaatattatgtttaagagcagataatgaaattaaaagctgaattatgaaattaatgctcaaggccaagaaataaattttctgtacaaaaaa

SEQ ID NO: 8117 - DNA, 6891 bp, Eutrema halophilum
tctctctcgattcacggagaaaaaaatgtcggcagcttcttcaagctccgttctccacctccgaaacaatcagttgttaccaatccgttctctgaaaaatcccaccgtcgttgcttctcaattggccgtcgcgcctggcgtcggtcggagacgagcatgtaccgcacgatgctccgtgaagaaaccggcggctcccgagagtcctttcctgggtactcggatgaggagatccggatcggagacgcttcagttctggagatcggacggtcctggaaggtctccgaagctgaaaacggtggttaggtcgtcgttttccggtgttccggagaagcctctcggtctctacgatccttccttcgataaagactcttgtggagtcggtttcgttgcggagttatccggcgagaccagccgcaaaacggtgactgattcattggagatgttgatacgtatgactcatagaggcgcttgtggttgtgagagcaacactggtgacggcgctgggattctcgtcggtcttcctcatgagttctacgcagaggcaacgaaagagcttggctttgtgctccctcctgctggaaagtatgctgttggtatgttcttcttgccaaaagctgagtcccggagaaatgagagcaaaaatgttttcaccaaggttgctgagtcgcttgggcattcagttattgggtggaggccagttcctactgataactctgggctggggaagtctgctttgcagaccgagccgattatcgagcaggttttcctcactccaactactaaatcgaaagccgaccttgagcaacagatgtatatcctgaggagggtttccatggttgctatccgagcagcgttgaaccttgaacatggtgcgatgaaggatttctacatctgttctttgtcttctaggactgttgtctacaaagggcaactgaagcctgatcagctcaaggactattactacgcggatcttgggagtgaaaggtttacgagctacatggccctggtccactctcgattctctaccaacacatttcccagctgggatcgtgctcagccaatgcgggttttgggccacaacggggagattaatacgcttagaggaaacgtgaactggatgagggctcgtgagggcctgcttaagtgcaaggaacttggtttatcaaagaacgagttgaagaagcttctacctattgtggatgttagctcttctgactcaggtgcttttgatggtgttcttgagcttcttgtccgagctggcagaagtcttcctgaagctgttatgatgatgatcccagaagcatggcagaatgacaaaaacatagatccaagcaggaaagcattttatgaatacttatctgccctaatggagccatgggatggacctgctctcatctcatttaccgacggtcgctacttaggtgccacattggaccgtaatggacttcgtcctggtaggttctacattacccacagtggaagggttatcatggctagtgaagttggggtagtggatgtaccgcctgaagatgtgatgaggaaaggaaggcttaacccgggcatgatgcttcttgtcgattttgagaagcatattgttgttgatgacgatgccttgaagcaacagtattcacaggcaaggccgtatggtgaatggcttgaaaggcaaaagattgaacttaaagacatcattaagtcagttccggagagtgaacggattgcttctccaatttctggggttgtaccggcgtctgatgatgatgactcaatggagagcatgggcattcatggtttattgtctccactaaaagcctttggctatacagttgaggccttggaaatgctgctgcttccgatggctaaagatggcactgaagcacttggttctatgggaaatgatactcctttagctgtgatgtcaaacagagagaaattatgttttgagtacttcaagcaaatgtttgctcaagtaaccaatcctccaatcgatcccattcgtgagaaaattgttacttcaatggagtgcatgatcggtccagaaggtgatctaaccgaaacaactgaagagcaatgtcaccgtctctccctaaaaggtcctcttttgaccatagaagagatggaatcaatcaagaaaatgaattacagaggctggaggactaaagttcttgatataacgtatcaaaaagaccaaggtacaaaagggttggagaagacattggaccgaatttgtgatgaagcaaatgaagcgataaaggagggctacacattactggttttgtctgatcgagctttctccgctacgcgagttgctgtgagctctctcttggctgttggtgccgtccatcaccacctggttaagacacttgcgcgcactcaagttggtttggtagtggaatctgctgaaccacgtgaagtgcatcatttctgcacacttgtcggattcggagcagatgctatttgcccatatttggctgttgaggccgtttttagattgcaggtcgatggcaagataccacccaaatctaatggggaattccattcgaaagaggagctggtcaagaagtattacaaggccagtaactatggaatgatgaaggttcttgccaaaatgggaatttctactctggcctcatacaagggtgctcaaatatttgaagctcttgggctttcgtctgaagtaatagagaagtgttttgctggcaccccaagcagagtggaaggagcaacatttgagatgcttgcacgagatgcgcttcttttgcatgagatggcctttccagcccgtggctatgcccctggaagtgctgaagcctcggcactttccaaccctgggaactatcactggaggaaaaatggggagattcatctcaatgatcctctggcgattgcaaaactgcaagaggcagcacggactaacagtgtcgctgcctacaaagaatactcgaagcgtataaatgaattgaacaagcaaagtaacttgcgcgggtttatgaagttcaaagaagcagatgtaaagattcctctagatgaagtggagcctgccagtgaaatcgttaaacggttctgcactggcgccatgagttatggatcaatatcactggaggcgcatacaacccttgcaatggccatgaacaaacttggaggaaagtccaatacaggtgagggaggggaactgccatcccgtatggagcctcttccagatggttcaaggaatccgaaaagaagttccatcaaacaaattgctagtggaagatttggagtttcgagctactatcttactaatgccgatgagctgcagataaagatggctcagggtgctaaacctggtgaaggaggcgagctacctggccacaaggttataggagacatcgctatcaccagaaattccaccgccggtgtggggcttatcagtccacctcctcatcatgatatctactctatcgaggatcttgcccaactaattcatgatcttaagaatgccaaccctggggcccgtattagtgttaaacttgtatcggaagctggtgttggagttattgctagcggtgtggtgaaaggccacgctgaccatgttctgatagcaggtcatgatggaggtactggtgcatctcgctggaccggtataaaaaatgctggtcttccgtgggaacttggtctagctgagacacaccaaactcttgtcgctaatgaccttcgtggtcgtactgttcttcagacagatggccaactgaaaactggcagagatgttgcagttgctgcgcttcttggtgcagaagagtttggttttagtactgcaccccttattacactcgggtgtatcatgatgagaaaatgccacaagaacacctgccctgtgggaattgctactcaagatccagttctccgtgaaaaatttgctggggagcctgaacatgtcattaatttcttctttatgcttgctgaggaagttagggagatcatgtctggacttggtttccgaactctaactgaaatgattggtcgggcagatatgcttgaacttgacagggaagtggtcaagaacaatgataagctggagaacattgacctctctcttttgctcaaacccgctgctgagattcgtcctggggctgctcagtactgtgtccagaaacaagatcatggcttagacatggctttggatcaagagcttattgcattgtccaagtctgctctagagaaatctcttccggtgtacattgaaactcctatctgcaacgtcaaccgtgctgttgggactatgctgagccatgaggttaccaaacgctatcacttggctgggctaccaaaggatacaattcatatcaagttcaaaggaagtgctgggcagagtcttggtgctttcctgtgtcctggaattacgctagaactggagggtgatagcaacgactatgttggaaaaggtctctccggaggaaaagtcgttgtctaccctcctaaaggaagcagctttgatccaaaagaaaacattgttatcggtaacgtagcactttacggggccactagtggtgaagcctactttaatgggatggctgctgaaagattctctgttcgtaattctggtgccaaagctgttgtggaaggtgttggtgatcatggttgtgagtacatgactggtggtactgttgtggtgcttggaaagactggtagaaactttgctgctggtatgagtggtggtattgcttatgtccttgatgtggatggaaagtttcacacgagatgcaaccttgaactggttgatctggacaaagttgaagatgaagacgacaaaatgacgctaaaaatgatgatccagcaacatcagcgacacacagacagccaacttgctcaagaagttcttgcggactttgagaatttggtaccgaagtttgtcaaggttttcccaagagattacaaacgtgttttatcagccatgaaacatgaagaggtctcgaatcaagccatagagcgtgcttctgaagaagctgacgagatggaagagaaagaactagaggagaaagacgcctttacagagctgaagaacatggcagctgcctcttcaaaagaggagatgtcaggaaacggcgtggcagctgaagctccgaagaaaccttctctggtaaatgatgctgttaaacatcgtggtttcattgcttatgaacgtgagggagttaagtacagggaccctaatgttcgtcttcatgactggaacgaagtcatggaggaatcaaaacctggaccgctccttacaactcagtctgctcgctgcatggactgtggaactccattctgccaccaggagaactctgggtgtccgcttggtaacaagatccctgaattcaatgaacttgtctaccagaacagatggcaagaagcgttgaaccgtctacttgagacaaataactttcccgaattcactgggcgagtttgccctgcaccatgtgaaggttcttgtgttcttggaataattgagaaccctgtttctatcaaaagcatcgaatgtgctatcatagataaagcctttgatgaagggtggatggtaccaagacctcctctcaagagaacagggagaaaagttgcaattatcggaagtgggccggctggactggctgctgctgaccagctgaacaaaatgggtcactcggtaaccgtgtatgagcgtgctgacagaattggcgggcttatgatgtatggagtcccaaacatgaagactgacaaaattgacatagttcaacgtcgggttgatcttatgaccaaagaaggtatcaactttgtggtcaatgccaatattggaaaagacccgtctttctccctggatggacttaaggaggagaatgatgcaatcgttcttgctgttggttccacaaaaccaagagatcttccagtgtctggtcgtgagctatctggtgttcactttgccatggagtttcttcatgcaaacaccaaaagcttgcttgatagcaatcttgaagatggcaattacatttccgcaaaggggaaaaaggttgtcgttattggtggaggtgatacgggcacagattgcattggaacatctatccgccatggatgcaccaacattgtaaacctagagcttcttcctcagccaccttcaacgagagctccaggaaacccttggccacagtggcctcgtgtattccgtattgactacggacatcaagaagcagcgaccaaattcggaaaggaccctagaacctatgaggtcttaactaagcgattcataggagatgacaatggaaacgtgaaagggctagagattgtgcgcgtgagttgggagaaggatgaaaccgggaggttccaattcaaggagatcgaaggctccgaggaaataattgaagcggaccttgttttcttagccatgggattccttggacctgagccaacacttgccgagaaactaggactcgaatgtgacaacaggtcgaactttaaggcagagtatggccggttttcaacaacagtggaaggtgtttttgctgcaggtgattgtcgaagaggacagtctttggtggtctgggccatctcagaaggacgccaagctgcatctcaggtcgacaaatacctcagcaaaactgatgacgaccaagcagatgccaagctacgacagagcctcaaccagatgaagcacaacgacactaggacgagttaagagacaggaagacctcacatctgaagcaaaacttaggttgtctttgtttgttatcgtccatatggtaataatgatttataagtacattttcttggtagggtttcgttagctttctttttttaatgctttcgaaaattgaaggccttttgtttttctctatggctgcttctggattttaatttaaggaaaggtaatgcatagttccttgttatttttgttttttcttccct

SEQ ID NO: 8118 - DNA, 6970 bp, Eutrema halophilum
aaaaaatgtcggcagcttcttcaagctccgttctccacctccgaaacaatcagttgttaccaatccgttctctgaaaaatcccaccgtcgttgcttctcaattggccgtcgcgcctggcgtcggtcggagacgagcatgtaccgcacgatgctccgtgaagaaaccggcggctcccgagagtcctttcctgggtactcggatgaggagatccggatcggagacgcttcagttctggagatcggacggtcctggaaggtctccgaagctgaaaacggtggttaggtcgtcgttttccggtgttccggagaagcctctcggtctctacgatccttccttcgataaagactcttgtggagtcggtttcgttgcggagttatccggcgagaccagccgcaaaacggtgactgattcattggagatgttgatacgtatgactcatagaggcgcttgtggttgtgagagcaacactggtgacggcgctgggattctcgtcggtcttcctcatgagttctacgcagaggcaacgaaagagcttggctttgtgctccctcctgctggaaagtatgctgttggtatgttcttcttgccaaaagctgagtcccggagaaatgagagcaaaaatgttttcaccaaggttgctgagtcgcttgggcattcagttattgggtggaggccagttcctactgataactctgggctggggaagtctgctttgcagaccgagccgattatcgagcaggttttcctcactccaactactaaatcgaaagccgaccttgagcaacagatgtatatcctgaggagggtttccatggttgctatccgagcagcgttgaaccttgaacatggtgcgatgaaggatttctacatctgttctttgtcttctaggactgttgtctacaaagggcaactgaagcctgatcagctcaaggactattactacgcggatcttgggagtgaaaggtttacgagctacatggccctggtccactctcgattctctaccaacacatttcccagctgggatcgtgctcagccaatgcgggttttgggccacaacggggagattaatacgcttagaggaaacgtgaactggatgagggctcgtgagggcctgcttaagtgcaaggaacttggtttatcaaagaacgagttgaagaagcttctacctattgtggatgttagctcttctgactcaggtgcttttgatggtgttcttgagcttcttgtccgagctggcagaagtcttcctgaagctgttatgatgatgatcccagaagcatggcagaatgacaaaaacatagatccaagcaggaaagcattttatgaatacttatctgccctaatggagccatgggatggacctgctctcatctcatttaccgacggtcgctacttaggtgccacattggaccgtaatggacttcgtcctggtaggttctacattacccacagtggaagggttatcatggctagtgaagttggggtagtggatgtaccgcctgaagatgtgatgaggaaaggaaggcttaacccgggcatgatgcttcttgtcgattttgagaagcatattgttgttgatgacgatgccttgaagcaacagtattcacaggcaaggccgtatggtgaatggcttgaaaggcaaaagattgaacttaaagacatcattaagtcagttccggagagtgaacggattgcttctccaatttctggggttgtaccggcgtctgatgatgatgactcaatggagagcatgggcattcatggtttattgtctccactaaaagcctttggctatacagttgaggccttggaaatgctgctgcttccgatggctaaagatggcactgaagcacttggttctatgggaaatgatactcctttagctgtgatgtcaaacagagagaaattatgttttgagtacttcaagcaaatgtttgctcaagtaaccaatcctccaatcgatcccattcgtgagaaaattgttacttcaatggagtgcatgatcggtccagaaggtgatctaaccgaaacaactgaagagcaatgtcaccgtctctccctaaaaggtcctcttttgaccatagaagagatggaatcaatcaagaaaatgaattacagaggctggaggactaaagttcttgatataacgtatcaaaaagaccaaggtacaaaagggttggagaagacattggaccgaatttgtgatgaagcaaatgaagcgataaaggagggctacacattactggttttgtctgatcgagctttctccgctacgcgagttgctgtgagctctctcttggctgttggtgccgtccatcaccacctggttaagacacttgcgcgcactcaagttggtttggtagtggaatctgctgaaccacgtgaagtgcatcatttctgcacacttgtcggattcggagcagatgctatttgcccatatttggctgttgaggccgtttttagattgcaggtcgatggcaagataccacccaaatctaatggggaattccattcgaaagaggagctggtcaagaagtattacaaggccagtaactatggaatgatgaaggttcttgccaaaatgggaatttctactctggcctcatacaagggtgctcaaatatttgaagctcttgggctttcgtctgaagtaatagagaagtgttttgctggcaccccaagcagagtggaaggagcaacatttgagatgcttgcacgagatgcgcttcttttgcatgagatggcctttccagcccgtggctatgcccctggaagtgctgaagcctcggcactttccaaccctgggaactatcactggaggaaaaatggggagattcatctcaatgatcctctggcgattgcaaaactgcaagaggcagcacggactaacagtgtcgctgcctacaaagaatactcgaagcgtataaatgaattgaacaagcaaagtaacttgcgcgggtttatgaagttcaaagaagcagatgtaaagattcctctagatgaagtggagcctgccagtgaaatcgttaaacggttctgcactggcgccatgagttatggatcaatatcactggaggcgcatacaacccttgcaatggccatgaacaaacttggaggaaagtccaatacaggtgagggaggggaactgccatcccgtatggagcctcttccagatggttcaaggaatccgaaaagaagttccatcaaacaaattgctagtggaagatttggagtttcgagctactatcttactaatgccgatgagctgcagataaagatggctcagggtgctaaacctggtgaaggaggcgagctacctggccacaaggttataggagacatcgctatcaccagaaattccaccgccggtgtggggcttatcagtccacctcctcatcatgatatctactctatcgaggatcttgcccaactaattcatgatcttaagaatgccaaccctggggcccgtattagtgttaaacttgtatcggaagctggtgttggagttattgctagcggtgtggtgaaaggccacgctgaccatgttctgatagcaggtcatgatggaggtactggtgcatctcgctggaccggtataaaaaatgctggtcttccgtgggaacttggtctagctgagacacaccaaactcttgtcgctaatgaccttcgtggtcgtactgttcttcagacagatggccaactgaaaactggcagagatgttgcagttgctgcgcttcttggtgcagaagagtttggttttagtactgcaccccttattacactcgggtgtatcatgatgagaaaatgccacaagaacacctgccctgtgggaattgctactcaagatccagttctccgtgaaaaatttgctggggagcctgaacatgtcattaatttcttctttatgcttgctgaggaagttagggagatcatgtctggacttggtttccgaactctaactgaaatgattggtcgggcagatatgcttgaacttgacagggaagtggtcaagaacaatgataagctggagaacattgacctctctcttttgctcaaacccgctgctgagattcgtcctggggctgctcagtactgtgtccagaaacaagatcatggcttagacatggctttggatcaagagcttattgcattgtccaagtctgctctagagaaatctcttccggtgtacattgaaactcctatctgcaacgtcaaccgtgctgttgggactatgctgagccatgaggttaccaaacgctatcacttggctgggctaccaaaggatacaattcatatcaagttcaaaggaagtgctgggcagagtcttggtgctttcctgtgtcctggaattacgctagaactggagggtgatagcaacgactatgttggaaaaggtctctccggaggaaaagtcgttgtctaccctcctaaaggaagcagctttgatccaaaagaaaacattgttatcggtaacgtagcactttacggggccactagtggtgaagcctactttaatgggatggctgctgaaagattctctgttcgtaattctggtgccaaagctgttgtggaaggtgttggtgatcatggttgtgagtacatgactggtggtactgttgtggtgcttggaaagactggtagaaactttgctgctggtatgagtggtggtattgcttatgtccttgatgtggatggaaagtttcacacgagatgcaaccttgaactggttgatctggacaaagttgaagatgaagacgacaaaatgacgctaaaaatgatgatccagcaacatcagcgacacacagacagccaacttgctcaagaagttcttgcggactttgagaatttggtaccgaagtttgtcaaggttttcccaagagattacaaacgtgttttatcagccatgaaacatgaagaggtctcgaatcaagccatagagcgtgcttctgaagaagctgacgagatggaagagaaagaactagaggagaaagacgcctttacagagctgaagaacatggcagctgcctcttcaaaagaggagatgtcaggaaacggcgtggcagctgaagctccgaagaaaccttctctggtaaatgatgctgttaaacatcgtggtttcattgcttatgaacgtgagggagttaagtacagggaccctaatgttcgtcttcatgactggaacgaagtcatggaggaatcaaaacctggaccgctccttacaactcagtctgctcgctgcatggactgtggaactccattctgccaccaggagaactctgggtgtccgcttggtaacaagatccctgaattcaatgaacttgtctaccagaacagatggcaagaagcgttgaaccgtctacttgagacaaataactttcccgaattcactgggcgagtttgccctgcaccatgtgaaggttcttgtgttcttggaataattgagaaccctgtttctatcaaaagcatcgaatgtgctatcatagataaagcctttgatgaagggtggatggtaccaagacctcctctcaagagaacagggagaaaagttgcaattatcggaagtgggccggctggactggctgctgctgaccagctgaacaaaatgggtcactcggtaaccgtgtatgagcgtgctgacagaattggcgggcttatgatgtatggagtcccaaacatgaagactgacaaaattgacatagttcaacgtcgggttgatcttatgaccaaagaaggtatcaactttgtggtcaatgccaatattggaaaagacccgtctttctccctggatggacttaaggaggagaatgatgcaatcgttcttgctgttggttccacaaaaccaagagatcttccagtgtctggtcgtgagctatctggtgttcactttgccatggagtttcttcatgcaaacaccaaaagcttgcttgatagcaatcttgaagatggcaattacatttccgcaaaggggaaaaaggttgtcgttattggtggaggtgatacgggcacagattgcattggaacatctatccgccatggatgcaccaacattgtaaacctagagcttcttcctcagccaccttcaacgagagctccaggaaacccttggccacagtggcctcgtgtattccgtattgactacggacatcaagaagcagcgaccaaattcggaaaggaccctagaacctatgaggtcttaactaagcgattcataggagatgacaatggaaacgtgaaagggctagagattgtgcgcgtgagttgggagaaggatgaaaccgggaggttccaattcaaggagatcgaaggctccgaggaaataattgaagcggaccttgttttcttagccatgggattccttggacctgagccaacacttgccgagaaactaggactcgaatgtgacaacaggtcgaactttaaggcagagtatggccggttttcaacaacagtggaaggtgtttttgctgcaggtgattgtcgaagaggacagtctttggtggtctgggccatctcagaaggacgccaagctgcatctcaggtcgacaaatacctcagcaaaactgatgacgaccaagcagatgccaagctacgacagagcctcaaccagatgaagcacaacgacactaggacgagttaagagacaggaagacctcacatctgaagcaaaagttgaaaactttgctctttctaaaacaggaggcgaaaagaaccgacttattgcagagatggagattgcaggaggaaaatgatcttggaagaggaggagaaagggaaggaaaaaaagcttaggttgtctttgtttgttatcgtccatatggtaataatgatttataagtacattttcttggtagggtttcgttagctttctttttttaatgctttcgaaaattgaaggccttttgtttttctctatggctgcttctggattttaatttaaggaaaggtaatgcatagttccttgttatt

SEQ ID NO: 8119 - DNA, 6970 bp, Arabidopsis lyrata
tgttgattccgtaacagaaaaatgtcggcagcttcttctagctccgttcttaacctccgaaccaaccaacaattgttgtcactccgatctctcaaaaattccacctccgttgcatctcaattggccgttacgtctggtgttagccgtagaaggtcgtgtacggcgcgatgttctgtgaagaaaccggtggctccagagagtcctttcctagggactcgtgtgcggagatccggatccgagacgcttcagttctggagatcggatggtcctggacggtctgcgaagctccgaacggtggttaagtcgtcattttccggtgttccggagaagcctctcggtctttatgatccttcctatgataaagactcttgtggtgtcggttttgtagcagagttgtccggcgagaccagtcgcaaaacggtgactgattcgttggagatgttgataaggatgactcatagaggtgcttgtggttgtgaaagcaacactggtgacggcgctgggattcttgttggtctgcctcacgatttctatgcagaggctgcgacagagcttggctttgtgcttcctcctgcgggaaaatatgctgttggtatgttcttcttgccaactgttgaaagccggagagaagaaagcaagaatgttttcactaaggttgctgaatcacttggccattcggttcttggatggagattagtgcctaccgataattccgggctgggaaattccgctttgcagacggaaccgataattgcgcaagttttccttactcctacaactaaatctaaagctgactttgagcaacagatgtatatccttagaagggtttctatggttgctattcgagctgcgttgaaccttcaacatggtgcgatgaaggacttctatatctgttctttgtcttctaggactattgtctacaaaggacaattgaagcctgatcaactgaaggactattattacgcagatcttgggagtgaaaggtttacgagctacatggccctggttcattctcggttctctaccaatacatttcccagctgggatcgtgctcagccgatgcgtgttttgggccacaatggggagatcaatacactcaggggaaacgtgaactggatgagggcacgtgagggtctgctcaagtgcaatgaacttggattatcaaagaaggagttgaagaagcttctacctattgtggacgttagctcttctgactcaggtgcttttgatggtgttcttgagcttcttgtccgagctggcagaagtcttcctgaagctgttatgatgatgatccctgaagcatggcaaaatgacaaaaacatagatccaagcaggaaagagttttatgaatacttatctgctctgatggagccatgggatggacctgccctcatttcattcactgatggtcgatacttgggtgccacattggaccgtaatgggcttcgtcctggtaggttttacataacccacagtggaagggttatcatggctagtgaagttggggtagttgatgtaccacctgaagatgttatgaggaaaggaagacttaacccgggtatgatgcttcttgtcgattttgagaagcatattgttgttgatgacgatgccttgaaacaacaatattcactggcaaggccttatggcgagtggcttaaaaggcaaaagattgaacttaaagacatcattgagtcagttccggcggctgaacggattgctccttcaatttctggggttgtaccggcctctaatgatgatgactcgatggagagcatgggcattcatggtttattgtctccactaaaagcctttggttacacagttgaggccttggagatgctgctgcttccgatggctaaagatggctctgaagcacttggttctatgggaaatgatacccctctagctgtaatgtcaaacagagagaaattatgctttgagtacttcaagcaaatgtttgctcaagtaacaaatcctccaattgatccaattcgtgagaaaattgttacttcgatggagtgcatgataggtccagaaggtgatctaaccgaaacaactgaagagcaatgtcaccgtctctcccttaaaggtcctcttttgaaaatcgaagagatggaagctatcaagaaaatgaattacagaggctggcggactaaagttctagatataacttatgcaaaagaacgaggtacaaaagggttagaggagaccttggaccgaatttgtgatgaagcaaatgaagcgataaaggagggctacacattactggttttgtctgatcgagctttctctgcaacccgtgttgctgtgagctccctcatggctgttggtgccgttcatcaccacctagttaagacacttgcgcgcacccaggttgggttggtagtggaatctgctgaaccacgtgaagtgcatcatttctgcacacttgtcggattcggagcagatgctatctgcccatatttggctgtggaggccgtttatagattacaggttgatggcaagataccacccaaatctaacggggaattccattccaaagaagagctggtgaagaagtattacaaggcaagtaactacggaatgatgaaggttcttgccaaaatgggaatttctactctggcctcatataagggtgctcagatatttgaagctcttggactttcatctgaagtaattcagaaatgttttgcgggcaccccaagcagagtggaaggagcaacatttgagatgcttgctcgagatggacttcaattgcatgagttggcctttccaacccgtcgctatgcccctggaagtgcagaagcctcagcacttaccaaccctgggaactatcactggaggaaaaatggagagattcatctcaacgatccccttgctattgcaaagttgcaagaggctgcacggactaacagtgtggccgcctacaaggaatactcaaagcgtatcaatgaactgaacaagcaaagtaatttgcgtgggctcatgaagtttaaagacgcagatgtgaaaatttcacttgatgaagtagagcctgccagtgaaattgttaagcgattctgcactggtgccatgagttatggatcaatatctctggaggcgcatacaacccttgcaatggccatgaacaagcttggaggaaagtcgaatacaggtgagggaggggagctgccatcccgtatggagcctcttgcggatggttcaaggaaccccaaaagaagttcgatcaaacaaattgctagtggaagatttggagtttcgagctactatcttacaaatgctgatgagctgcagataaagatggctcagggtgccaaacctggggaaggcggggagctaccaggccacaaggtcataggagacattgctataaccagaaattccactgctggtgtagggcttatcagtccacctcctcatcatgacatctactctatcgaggatcttgcccagctaattcacgatcttaagaatgccaatcctggggcacgtattagtgttaagcttgtatctgaagctggtgttggagttattgctagcggagtggtgaaggggcatgctgaccatgttctgatagcaggtcatgatggaggtactggtgcatctcgctggaccggtattaaaaatgctggtcttccatgggaactgggtctagctgagacacaccaaactcttgttgccaatgaccttcgtggccgcactgttcttcagacagatggccagctaaaaactggcagagatgttgcagttgcagctcttcttggtgcagaagagtttggttttagtactgcaccccttatcacactagggtgtatcatgatgagaaaatgccacaagaatacctgccctgtgggaattgctactcaagatccagttctccgtgaaaaatttgctggggagcctgaacatgttattaacttcttctttatgcttgctgaggaagttagggagatcatgtctggacttggttttagaactgtaactgagatgattggtcgtgcagatatgcttgaacttgacagggaagttgtcaagaacaatgataagctggagaacattgacctctctcttttgctcagacctgctgctgagattcgtcctggggctgcgcagtactgtgtccagaaacaagatcacggtttagacatggctttggatcaagagctgattgcattgtctaaatctgctctagagaaatctcttccagtgtacattgaaactcctatctgcaacgttaaccgtgctgttgggacaatgctgagccatgaggtaactaaacgttaccacttggctgggcttccgaaggatacaattcatatcaagttcacaggaagtgctgggcagagtcttggagctttcctgtgtccaggaattatgctagaacttgagggcgatagcaatgactatgttggaaaagggctctcaggaggtaaagttgttgtctaccctccaaaaggaagcagctttgatccaaaggaaaatatcgttatcggtaatgtagcactttatggtgccactagtggtgaagcatacttcaatgggatggctgctgaaaggttctctgttcgtaattctggtgctaaagccgttgtggaaggtgttggtgatcatggttgtgagtacatgactggtggtactgtagtggtgcttggaaagactggtagaaactttgctgctggtatgagtgggggtattgcttatgtccttgatgtggacggaaagttccacacgagatgcaaccttgaactggttgatttggataaagttgaagatgaggaagacaaaatgtcgctcaaaatgatgattcagcaacatcaacgacacaccaacagccaacttgctcaagaagttcttgcagactttgagaatttgctgcctaagtttattaaggttttcccaagagattacaaacgtgttttgtcagccatgaaacatgaagaggtctccaagcaagccatagagcgtgcttctgaggaagctgacgaaatggaagaaaaagaacttgaggagaaagacgcctttgcagagctgaagaacatggcagctgcttcgtcaaaagaggtgtccggaaacggagtggcagctgaagctaaaccttctcaggtagataatgctgttaaaaacggtggtttcattgcttatgagcgtgagggagttaagtacagggatcccaatgttcgtcttaatgactggaacgaagtcatggaggaatcaaaacctggaccactccttacaactcagtcagctcgttgcatggattgtggaactccattctgccaccaggagaactctgggtgtcctctcggtaataagatccctgaattcaacgaacttgtctaccagaacagatggcaagaagccttgaatcgtctacttgagacgaacaactttccagaatttactgggcgagtatgccctgcaccatgtgaaggttcttgtgttcttggaataattgagaatcctgtttctatcaaaagcattgaatgtgctattatcgataaagcctttgaggaagggtggatggtaccaaggcctcctctcaagagaacagggaaaaaggttgctattatcggaagtggaccggctggactagctgcggctgaccagctgaacaaaatgggccactcagtaaccgtgtatgagcgctctgacagaattggtgggcttatgatgtatggagtaccaaacatgaagactgacaaaattgatgtagttcaacggcgggttgatcttatgaccaaagaaggtatcaactttgtggttaatgccaatattggaaaggacccgtcttactcccttgatggacttaaggaagagagtgatgcactcattcttgctgttggttctacaaaaccaagagatcttccagtgcctggtcgtgatctatctggtgttcactttgccatggagtttcttcatgcaaacaccaaaagcttgcttgatagcaatcttgaggatggcaattacatttctgcaaaggggaaaaaggttgtcgttattggtggaggtgataccggtacagattgcattggaacatctatccgccatggatgcaccaacattgtaaacctagagcttcttcctcagccaccttcaacaagagctcctggaaacccttggccacagtggcctcgtgtgttccgtattgactacggacatcaggaagctaccaccaaatttggaaaagacccaagaacctatgaggtcttaaccaagaggttcataggagatgacaatggaaacgtgaaagggcttgaaattgtgcgagtgagttgggagaaggatgataccgggaggttccagttcaaggaaatcgaaggctctgaggaaataatcgaagcagacctcgttttcttggccatgggtttccttggacctgagccaacacttgcggagaagctaggactcgaatgcgacaacaggtcgaactttaaggcagagtatggccggttttccacaactgtggaaggtgttttcgcagcaggtgattgtcggagaggccagtctttggttgtctgggccatctcagaaggacgtcaagctgcagctcaggtcgacaaattcctcagcaaaactgatgatgatgaagacgccaagctacaacaagaccttaaccagatgaaacacaacactatcacaaactgaggtaaagaaagccttactcatctgaagcaaaagtcgagagaaagacaaccgatttggctcttttagagacagagaggcgaaaaggtccgacttatggcagagatgaagggagaagagttgcggaggaaaaaaaacgaccttgatggtttaggagagaagtaaaagtttaggttgtttttgtttattatcgtccataaagtaataatgattcataagtacattttctttgtaggattttcagtagctttcttttgttaaaaagctttctgaatttgaaggccttttgttttgtctctatggctgtttctaagtttgaatttctaag

SEQ ID NO: 8120 - DNA, 7355 bp, Arabidopsis lyrata
tcttctataaatataaacgtctcgcctcctgagtaacgtataaactctcacatactctccccagccgccacctaccctccgccgcctcctttagccgcctcggcctcgcttcgccgcgcgctgcgctttttccttttaaccaagactgttttttattttcccgaagaatctctctgttaggattttgtttgattctggtgtttatccagatcagagataatcgtgatcccttttttctctctcactttaggaaaaaaaagcaaatctgataatcgaaactgatcacactgttgattccgtaacagaaaaatgtcggcagcttcttctagctccgttcttaacctccgaaccaaccaacaattgttgtcactccgatctctcaaaaattccacctccgttgcatctcaattggccgttacgtctggtgttagccgtagaaggtcgtgtacggcgcgatgttctgtgaagaaaccggtggctccagagagtcctttcctagggactcgtgtgcggagatccggatccgagacgcttcagttctggagatcggatggtcctggacggtctgcgaagctccgaacggtggttaagtcgtcattttccggtgttccggagaagcctctcggtctttatgatccttcctatgataaagactcttgtggtgtcggttttgtagcagagttgtccggcgagaccagtcgcaaaacggtgactgattcgttggagatgttgataaggatgactcatagaggtgcttgtggttgtgaaagcaacactggtgacggcgctgggattcttgttggtctgcctcacgatttctatgcagaggctgcgacagagcttggctttgtgcttcctcctgcgggaaaatatgctgttggtatgttcttcttgccaactgttgaaagccggagagaagaaagcaagaatgttttcactaaggttgctgaatcacttggccattcggttcttggatggagattagtgcctaccgataattccgggctgggaaattccgctttgcagacggaaccgataattgcgcaagttttccttactcctacaactaaatctaaagctgactttgagcaacagatgtatatccttagaagggtttctatggttgctattcgagctgcgttgaaccttcaacatggtgcgatgaaggacttctatatctgttctttgtcttctaggactattgtctacaaaggacaattgaagcctgatcaactgaaggactattattacgcagatcttgggagtgaaaggtttacgagctacatggccctggttcattctcggttctctaccaatacatttcccagctgggatcgtgctcagccgatgcgtgttttgggccacaatggggagatcaatacactcaggggaaacgtgaactggatgagggcacgtgagggtctgctcaagtgcaatgaacttggattatcaaagaaggagttgaagaagcttctacctattgtggacgttagctcttctgactcaggtgcttttgatggtgttcttgagcttcttgtccgagctggcagaagtcttcctgaagctgttatgatgatgatccctgaagcatggcaaaatgacaaaaacatagatccaagcaggaaagagttttatgaatacttatctgctctgatggagccatgggatggacctgccctcatttcattcactgatggtcgatacttgggtgccacattggaccgtaatgggcttcgtcctggtaggttttacataacccacagtggaagggttatcatggctagtgaagttggggtagttgatgtaccacctgaagatgttatgaggaaaggaagacttaacccgggtatgatgcttcttgtcgattttgagaagcatattgttgttgatgacgatgccttgaaacaacaatattcactggcaaggccttatggcgagtggcttaaaaggcaaaagattgaacttaaagacatcattgagtcagttccggcggctgaacggattgctccttcaatttctggggttgtaccggcctctaatgatgatgactcgatggagagcatgggcattcatggtttattgtctccactaaaagcctttggttacacagttgaggccttggagatgctgctgcttccgatggctaaagatggctctgaagcacttggttctatgggaaatgatacccctctagctgtaatgtcaaacagagagaaattatgctttgagtacttcaagcaaatgtttgctcaagtaacaaatcctccaattgatccaattcgtgagaaaattgttacttcgatggagtgcatgataggtccagaaggtgatctaaccgaaacaactgaagagcaatgtcaccgtctctcccttaaaggtcctcttttgaaaatcgaagagatggaagctatcaagaaaatgaattacagaggctggcggactaaagttctagatataacttatgcaaaagaacgaggtacaaaagggttagaggagaccttggaccgaatttgtgatgaagcaaatgaagcgataaaggagggctacacattactggttttgtctgatcgagctttctctgcaacccgtgttgctgtgagctccctcatggctgttggtgccgttcatcaccacctagttaagacacttgcgcgcacccaggttgggttggtagtggaatctgctgaaccacgtgaagtgcatcatttctgcacacttgtcggattcggagcagatgctatctgcccatatttggctgtggaggccgtttatagattacaggttgatggcaagataccacccaaatctaacggggaattccattccaaagaagagctggtgaagaagtattacaaggcaagtaactacggaatgatgaaggttcttgccaaaatgggaatttctactctggcctcatataagggtgctcagatatttgaagctcttggactttcatctgaagtaattcagaaatgttttgcgggcaccccaagcagagtggaaggagcaacatttgagatgcttgctcgagatggacttcaattgcatgagttggcctttccaacccgtcgctatgcccctggaagtgcagaagcctcagcacttaccaaccctgggaactatcactggaggaaaaatggagagattcatctcaacgatccccttgctattgcaaagttgcaagaggctgcacggactaacagtgtggccgcctacaaggaatactcaaagcgtatcaatgaactgaacaagcaaagtaatttgcgtgggctcatgaagtttaaagacgcagatgtgaaaatttcacttgatgaagtagagcctgccagtgaaattgttaagcgattctgcactggtgccatgagttatggatcaatatctctggaggcgcatacaacccttgcaatggccatgaacaagcttggaggaaagtcgaatacaggtgagggaggggagctgccatcccgtatggagcctcttgcggatggttcaaggaaccccaaaagaagttcgatcaaacaaattgctagtggaagatttggagtttcgagctactatcttacaaatgctgatgagctgcagataaagatggctcagggtgccaaacctggggaaggcggggagctaccaggccacaaggtcataggagacattgctataaccagaaattccactgctggtgtagggcttatcagtccacctcctcatcatgacatctactctatcgaggatcttgcccagctaattcacgatcttaagaatgccaatcctggggcacgtattagtgttaagcttgtatctgaagctggtgttggagttattgctagcggagtggtgaaggggcatgctgaccatgttctgatagcaggtcatgatggaggtactggtgcatctcgctggaccggtattaaaaatgctggtcttccatgggaactgggtctagctgagacacaccaaactcttgttgccaatgaccttcgtggccgcactgttcttcagacagatggccagctaaaaactggcagagatgttgcagttgcagctcttcttggtgcagaagagtttggttttagtactgcaccccttatcacactagggtgtatcatgatgagaaaatgccacaagaatacctgccctgtgggaattgctactcaagatccagttctccgtgaaaaatttgctggggagcctgaacatgttattaacttcttctttatgcttgctgaggaagttagggagatcatgtctggacttggttttagaactgtaactgagatgattggtcgtgcagatatgcttgaacttgacagggaagttgtcaagaacaatgataagctggagaacattgacctctctcttttgctcagacctgctgctgagattcgtcctggggctgcgcagtactgtgtccagaaacaagatcacggtttagacatggctttggatcaagagctgattgcattgtctaaatctgctctagagaaatctcttccagtgtacattgaaactcctatctgcaacgttaaccgtgctgttgggacaatgctgagccatgaggtaactaaacgttaccacttggctgggcttccgaaggatacaattcatatcaagttcacaggaagtgctgggcagagtcttggagctttcctgtgtccaggaattatgctagaacttgagggcgatagcaatgactatgttggaaaagggctctcaggaggtaaagttgttgtctaccctccaaaaggaagcagctttgatccaaaggaaaatatcgttatcggtaatgtagcactttatggtgccactagtggtgaagcatacttcaatgggatggctgctgaaaggttctctgttcgtaattctggtgctaaagccgttgtggaaggtgttggtgatcatggttgtgagtacatgactggtggtactgtagtggtgcttggaaagactggtagaaactttgctgctggtatgagtgggggtattgcttatgtccttgatgtggacggaaagttccacacgagatgcaaccttgaactggttgatttggataaagttgaagatgaggaagacaaaatgtcgctcaaaatgatgattcagcaacatcaacgacacaccaacagccaacttgctcaagaagttcttgcagactttgagaatttgctgcctaagtttattaaggttttcccaagagattacaaacgtgttttgtcagccatgaaacatgaagaggtctccaagcaagccatagagcgtgcttctgaggaagctgacgaaatggaagaaaaagaacttgaggagaaagacgcctttgcagagctgaagaacatggcagctgcttcgtcaaaagaggtgtccggaaacggagtggcagctgaagctaaaccttctcaggtagataatgctgttaaaaacggtggtttcattgcttatgagcgtgagggagttaagtacagggatcccaatgttcgtcttaatgactggaacgaagtcatggaggaatcaaaacctggaccactccttacaactcagtcagctcgttgcatggattgtggaactccattctgccaccaggagaactctgggtgtcctctcggtaataagatccctgaattcaacgaacttgtctaccagaacagatggcaagaagccttgaatcgtctacttgagacgaacaactttccagaatttactgggcgagtatgccctgcaccatgtgaaggttcttgtgttcttggaataattgagaatcctgtttctatcaaaagcattgaatgtgctattatcgataaagcctttgaggaagggtggatggtaccaaggcctcctctcaagagaacagggaaaaaggttgctattatcggaagtggaccggctggactagctgcggctgaccagctgaacaaaatgggccactcagtaaccgtgtatgagcgctctgacagaattggtgggcttatgatgtatggagtaccaaacatgaagactgacaaaattgatgtagttcaacggcgggttgatcttatgaccaaagaaggtatcaactttgtggttaatgccaatattggaaaggacccgtcttactcccttgatggacttaaggaagagagtgatgcactcattcttgctgttggttctacaaaaccaagagatcttccagtgcctggtcgtgatctatctggtgttcactttgccatggagtttcttcatgcaaacaccaaaagcttgcttgatagcaatcttgaggatggcaattacatttctgcaaaggggaaaaaggttgtcgttattggtggaggtgataccggtacagattgcattggaacatctatccgccatggatgcaccaacattgtaaacctagagcttcttcctcagccaccttcaacaagagctcctggaaacccttggccacagtggcctcgtgtgttccgtattgactacggacatcaggaagctaccaccaaatttggaaaagacccaagaacctatgaggtcttaaccaagaggttcataggagatgacaatggaaacgtgaaagggcttgaaattgtgcgagtgagttgggagaaggatgataccgggaggttccagttcaaggaaatcgaaggctctgaggaaataatcgaagcagacctcgttttcttggccatgggtttccttggacctgagccaacacttgcggagaagctaggactcgaatgcgacaacaggtcgaactttaaggcagagtatggccggttttccacaactgtggaaggtgttttcgcagcaggtgattgtcggagaggccagtctttggttgtctgggccatctcagaaggacgtcaagctgcagctcaggtcgacaaattcctcagcaaaactgatgatgatgaagacgccaagctacaacaagaccttaaccagatgaaacacaacactatcacaaactgaggtaaagaaagccttactcatctgaagcaaaagtcgagagaaagacaaccgatttggctcttttagagacagagaggcgaaaaggtccgacttatggcagagatgaagggagaagagttgcggaggaaaaaaaacgaccttgatggtttaggagagaagtaaaagtttaggttgtttttgtttattatcgtccataaagtaataatgattcataagtacattttctttgtaggattttcagtagctttcttttgttaaaaagctttctgaatttgaaggccttttgttttgtctctatggctgtttctaagtttgaatttctaagttcctgcttcttgtttttgctctctttctctttgttttcctttcatgttattatggtggaatgcataaaaaggtaagaaacgtaagcaatggtaaga

SEQ ID NO: 8121 - DNA, 7026 bp, Prunus persica
atgttggcgagctctggttccgttgttcaactccgaaccaaaccttccctcgcatctcagctcaatgccacgccgatagcaaggctcgggagcagagccgccgcatgctctgctaccaggaaatccacgaaggctttggccaacaagttcttcgggacccgattgcggcccgccggatctgagaagctccacatatggcgatccgacggtcccggccgctcgcccaagcttcgggtcgtcgtccgctccttactctccgccgttcccgagaaacccctcggcctatacgacccgtcgttcgataaggactcgtgtggggttggtttcgtcgctgaattgtccggcgaaggcagccgcaaaacgattacggatgctttggaaatgttggtgcgtatggcacacagaggagcttgcgggtgtgaaacgaatactggtgatggagctgggattctcgtcggtcttcctcacgacttctacaaggaggttgccaaggatgttgggtttaagcttccaccggcaggggaatatgctgttggaatgtttttcttgcccacatctgacagtcgaagagaagaaagcaaaaatgtatttacaaaggttgcagagtctcttggacatactgttcttggatggcgatctgttccaacagataactcagacttggggaagtctgctttgcagacagaacctgttattgagcaagtgtttcttaccccgactccaaggtcaaaacttgacctcgagcgacagatgtacatactcagaagggtttcaatggttgccatccgagctgcattaaaccttgaacatggtggtgctaaagacttctatatatgttccctttcctcaaggactgttgtttacaaaggtcagctgaagcccattcagctgaaggattactattttgcagatcttggcaatgaaaggtttacgagctacatggccctggtacactcgcggttctcaacaaatacttttcccagctgggatcgtgctcagcctatgcgtgtcattggccacaatggagaaatcaatacccttaaaggaaatgttaactggatgaaggcacgcgagggactgcttaagtgcaaggaacttggtctatcaagaaatgagttaaagaagctgttaccaattgtggatgccagttcttctgattcaggagcttttgatggtgtccttgagtttctggttcaagctggcagaagccttcctgaagctatgatgatgatgattcctgaagcatggcaaaatgacaagaacatggatcctcataggaaagcgctgtatgaatatttctcatctctcatggagccatgggatgggccagctcttatatcatttactgatggtcgctatttgggagctacactggatcgtaatggacttcggcctggtcgattttatgtcacccacagtggacgagttattatggccagtgaagttggtgtagtagacattcctccagaagatgtcagtaggaaaggaagacttaaccctggaatgatgcttttggtggattttgagaatcatattgttgtagatgatgaagctttgaagcagcaatactcgttggcaaggccatacggggagtggcttgaaaggcaaaagattgagctcaaggacatagtagcttctgttcaagaatctgacagggcccctccatccatagcgggagttattcctgcatctactgatgatgaaaacatggaaaacatgggaatccatggtttattggcaccattgaaagcttttggctatacacttgaatccctggaaatgttgttgcttcccatggcaaaagatggtgtagaggctcttgggtcaatgggaaacgataccccattggctgtcatgtctaacagagaaaagcttacatttgagtatttcaagcaaatgtttgctcaagtaacaaaccctccaattgatcccatccgagagaaggtagtcacttctatggaatgcatgattggtccggagggtgatctgacagaaaccactgaagaacaatgtcatcgtctctcactcaagggttctcttttaaccatagaagaaatggaagcaatcaaaaaaatgaactacagaggttggcgttgcaaagttcttgatataacttattccaaggaacgtggtagggaaggattggaggagaccttggatagaatctgtgctgaagcacgtgaagcgattaagaagggatataccacacttgttctttcagacagagccttctccccaaagcgtgttgctgtaagctcccttttagctgttggtgctgttcatcaacacctagttaaaaatcttgaacgcacaagagtagggttgataattgaatctgctgagccacgtgaagtacaccatttctgtacactagttggttttggtgcagatgctatctgcccatacttggctatagaagccatttggagactgcaggttgacggaaagatcccaccaaaagctaatggtgtaatatactcaaaggatgaactggttaaaaagtacttcaaagcaagcaactatggaatgatgaaggttcttgccaagatggggatatccactttagcctcttacaagggtgcacagatttttgaagctttgggtctttcatcagaagtaattgagaggtgctttgccggaacccctagtagggttgagggtgcaacatttgagatgcttgctcacgatgaacttcatatgcacgagttggcatttccatctcgaacttttcctccaggaagtgcagaagcagttgcactgccaaatcctggggattatcattggagaaaaggtggtgaggttcacctaaatgatcccttcgctatttcaaaacttcaagaggctgctagaactaacagtgtggctgcatataaagaatactcgaagttcattcatgaattaaacaaagcctgcaatctccggggtcttctgaaatttaaaagcacagagcagaagattcacttggatgaagtggaacccgccagtgagattgtaaaacggttctgtactggtgctatgagttatggatcaatatcattggaggcacacactacactggccatggctatgaacaaaattggaggaaagtcaaatacaggtgagggaggtgagcagccgtctcgtatggagccacttccagatggttcaagaaacccaaagaggagtgcaattaagcaggttgctagtggcagatttggagtttcaagttactatcttacgaatgctgatgaactgcagataaaaatggctcagggggccaagcctggtgaaggaggtgagcttcctgggcacaaggttattggagacattgctgttacaaggaattctactgctggtgtgggtcttatcagtccacctccccatcatgatatctactcgattgaagaccttgctcaattaattcatgatcttaagaatgctaacccgacagctcgaattagcgtaaagttagtatctgaagtaggtgtgggagtagttgctagtggagttgtgaaggggcatgctgaccatgtgttaatctctggacatgatggaggcacaggggcctctagatggacgggtattaagaatgctgggcttccatgggaacttggtttggctgagacgcatcaaaccttggttgctaatgatcttcgcggtcgcacaactcttcagacagatggccaactaaaaaccggaagagatgttgccatagccgcacttcttggtgcagaagagtttggtttcagcacagcacccctcataactcttggctgcattatgatgcggaagtgccataagaatacctgtcctgttggcattgcaacccaagatccagtacttcgagagaagtttgcaggagaaccagaacatgtcattaattttttctttatggtagcagaagaattgagagaaataatgtcacagcttggtttccgtactttaaatgagatggttggtcgttcagatatgcttgaagtcgataaagatgtgactagaaacaatgaaaagcttgataacattgatctatccttattacttagacctgcagcagaccttcggcctgacgctgcacaatattgtgtccagaaacaggatcatggtttggacatggctcttgaccacaaactaatttctctgtccaaggctgctattgaaaagtctcttcctgtatactttgaaacaactatttgcaatgtgaatcgtgctgttgggacaatgcttagccatgaggtgaccaaactttacaacagggaagggcttcctgctgacactatccatatcaaattcaatggaagtgcaggacagagtctcggagcattcctgtgcccgggtatcatgcttgagcttgaaggtgacagcaatgattatgttggaaaaggattgtcaggtggaaagattgtagtttatcctcccaagaaaagcaagtttgatccaaaagaaaatattgtgatcggtaatgttgctctttatggtgcaactagtggagaggcatacttcaatggaatggcagcagaaagattctgtgttcgcaattctggggctagggcagttgtcgaaggcgttggggatcatggttgtgaatacatgacgggtggcactgttgtggtgcttgggaaaactggcaggaactttgctgctggtatgagtggtggtattgcctacattcttgatgtggatgggcaatttcggtcccgatgcaatctcgagcttgtagatcttgataaacttgaagaagaagatgtgatgacccttaaaatgatgatacagcagcatcaacggcacacaaacagcttgctggccagtcaagtactggctgattttggcaatcttttgcctaagtttatcaaggttatcccaagagagtacaagcgtgttcttgcaaatatgaaagacgaagcctccaaacaggatgccgctgacgaagctgagcaagacgaaccagagttaattgagaaagatgcttttgaagaacttaagaagttggcagcatcatcatcattaaatgggaaatccaatcagacggtagaggattctgaaatatttaagaggccttctcaggtcagcgatgctgtcaaacatcgcggttttatttcttatgagcgtgagggcgttcaatatagggatcctaatgttcggatgaatgactggaaggaagttatggaggaaactcaacctggaccgctattaaagactcagtcagcccgttgcatggactgtggcactcctttctgccatcaggagaactctggatgtcctcttggtaacaaaatacccgagttcaatgagttggtgtaccagaataggtggcatgaagcattagaaagacttctagagacaaataacttccctgagtttactggtcgagtttgcccggcaccttgtgaaggttcctgtgttctgggtattattgagaatcctgtatctatcaaaagcatcgaatgtgccatcatagacaaggcttttgaggaaggttggatggttccacgacctcctctcaagagaactgggaaaagggttgccattgttggaagcggaccagctggtctagctgctgctgatcaactaaacagattaggccatacggtgactgtgtatgagcgtgctgatagaattggagggctcatgatgtatggagttcctaatatgaaggctgacaaagtggatatagttcaacggcgggttaaccttatggctgaggaaggtgtcaactttgtggttaatgctagtgttggaaatgatcctttgtactcgcttgatcgccttcgagaggagaataatgccattattttagcagtaggagcaacaaaaccaagggaccttcctgtaccagggcgagagttgtcaggtgttcattttgctatggagttccttcacgcaaacaccaaaagcttactagatagcaatcttcaggatggtaactatatttctgctaagggcaagaaagttgtggtaattggtggaggtgacactggcactgattgcataggaacatccgttagacatggctgtagtagcatcataaatttggagcttctccctcagccaccacgaacaagggctccaggaaacccttggccacagtggcctcgtgtattccgggtagattacgggcaccaagaagttgcagctaagtttggcaaagatccaagatcttatgaggtgcttactaagagatttgtgggagatgagaatggggctgtgaaaggacttgagctggttagtgtcaaatgggagaaggatgctactgggaagttccaattcaaggaaatcgagggctctgaggagatcattgaggttgacctagtcctactagcaatgggtttccttggacctgaggcgacggtagcagagaagttggggttggagcgtgacaatcgctcaaactacaaggcggagtatggtcggttctcaaccaatgtggatggggtatttgcagctggggactgccggcgtggtcaatccctggtggtgtgggcaatctcagaggggcggcaagctgctgcacaagttgacaaatacctctccattgaggaagaggacgaccacaccattagcaatggcagccatgaaaatattttgaaaaggcatcaagatcttagcaagaggaacacaggtagtagcaaacacacagtgatgacatagatgacatgatcatcaagatttttactaaagaaccaagacagcagcaagcaaatacagtgacagcgacacagaaacatatggcttgtttcgattttggaaggaagtttcaagattgattagcctcatgggtgaaccacttcgttcgtgatgcgatggagctgaggccagaagggacagcagaagcaggaggtggcggcttcacttttgggggcaacaaagcctttctattctcgcataatcaaagtagttttttcagcggagcctgggtataggttttagaacatttctttgtttatagttttacccgggtcttttttgcgtggttgttttaaaggaataatgtacagttttggttcttcaccaattatttaagattatatatatgatggggaattattatta

SEQ ID NO: 8122 - DNA, 7021 bp, Eutrema parvulum
ctcaatagaacaaatctatctgatattgagccagaaataaaatttcactgttgattccgtcggaaaaaaatgtcggcagcttcttctagctccgttctgcagctccgaaacaaccagttgtttccagtccgatctctgaagaaaaatcccaccgccgtttcccaattggcagtcgcgcctggcgtcagccgtagaagagcatgtactgcacggtgctctgtgagtaaaccggcggctccggagaagcctttcatgggtactcggatgaggagatccggatccgagacactccagttctggagatcggacggtcctggacggtctccgaagctcaaaacggtggttaagtcgtcgttttccggtgttccggagaagcctctcggtctctatgatccttccttcgataaagactcttgtggagtcggtttcgtcgcggagttgtccggcgataccagccgcaaaacggtgactgattcattggagatgttgatacggatgactcatagaggcgcttgtgggtgtgagagcaacactggtgacggcgctgggattcttgttggtatgcctcatgagttctatgcagaggctgctaaagagcttggctttgtgcttcctcccgctggaaagtatgctgttggtatgtttttcttgccaactgctgagtccaggagagatgaaagcaaaaatgttttcaccaaggttgctgaatcacttgggcattcagttattggatggagatcagttcctaccgataactctgggttggggaagtctgctttgcagacggagccaattatggagcaagttttccttactcctacaactaaatcgaaagtcgaccttgagcaacagatgtatatccttcgaagggtttccatggttgctatccgagcagcgttgaaccttgaacatggtgcaatgaaggacttctacatttgttctttatcatctaggactgttgtctacaaaggacaactgaagcctgaccagctgaaggactattactacgcggatcttgggagtgaaaggtttacgagctacatggccctggttcactctcggttctctaccaatacatttcccagctgggatcgtgctcagccgatgcgtgttttgggccacaatggggagattaatacgcttaggggaaacgtgaactggatgagggcacgtgagggtctgctcaagtgcaaggaacttggactatcaaagaaggagttgaagaagcttctacctattgtggatgttagctcttctgactcaggtgcttttgatggtgttcttgagcttcttgtccgagctggcagaagtcttcccgaggctgttatgatgatgattcctgaagcatggcagaatgacaaaaacatagatccaagcaggaaatccttttatgaatacttatctgccctaatggagccatgggatgggcctgctctcatatcatttactgacggtcgctacttgggtgccacattggaccgtaatggacttcgtcctggtaggttctacataacccacagtggaagggttatcatggctagtgaagttggggtagtggatgtgccacctgaagacgtgatgaggaaaggaagacttaacccgggcatgatgcttcttgtcgattttgagaagcatattgttgttgatgatgatgccttgaagcaacagtattcgcaggcaagaccctatggtgaatggcttaaaaggcaaaagattgaacttaaagacatcattaagtcagttccggagactgaacgaattgccccattaatttctggggttgcactggcgtccaataatgacgactcaatggacagcatgggaattcatggtttgttgtctccactaaaagcctttggttatacagttgaggccttggaaatgctgctgcttccgatggctaaagatggcagtgaagcacttggttctatgggaaatgatgcccctctagctgtaatgtcaaacagagagaaattatgttttgagtacttcaagcaaatgtttgctcaagtaacaaatcctccaatcgatcctatccgtgagaaaattgttacttcaatggagtgcatgatcggcccagaaggtgatctaactgaaacatctgaggagcaatgtcaccgactctccctaaaaggtcctcttttgaccatcgaagagatggaagcaatcaagaaaatgaactacagaggctggcggactaaagttcttgatataacttatccgaaagaacaaggtacaaaagggttggagacgaccttggaccgaatttgtgctgaagcaaatgaagcgataaaggagggctacacattactggttttgtctgatcgagctttctcttcgacgcgagttgctgtgagctctctcttggctattggtgctgttcatcaccaccttgttaagacacttgcgcgcactcaagttgggttggtagtggaatctgctgaaccacgtgaagtgcatcatttctgcacacttgtcggattcggagcagacgctatctgcccatatttggctgtagaggccgtccatagattgcaggttgatggcaagataccacccaaatctaatggggaattccattccaaagaagaactggtcaagaagtattacaaggcaagcaactatggaatgatgaaggttcttgctaaaatgggaatttctaccctggcctcatacaagggtgctcagatatttgaagctcttgggctttcgtctgaagtgatagagaagtgttttgcgggcaccccaagcagagtggagggagcaacatttgagatgcttgcacgagatgcacttcttttgcatgagatggccttcccagcccgtggctttgcccctggaagtgcagaagcctcagcactttccaaccctgggaactatcactggaggaaaaatggggagattcatctcaatgatcctctcgcaattgcaaaactgcaagaggcagcacggactaacagtgtggccgcctacaaggaatactcaaagcgtatcaatgaattgaacaagcaaagtaatttgcgcgggctcatgaagttcaaagaagcagatgtaaaaattccattagacgaagtggagcctgctagtgagattgttaagcggttctgcactggcgccatgagttatggatcaatatcactggaggcgcatacaacccttgcaatggccatgaacaaacttggaggaaagtcaaatacaggtgagggaggggaactgccatcccgtatggagcctcttccagatggttcaaggaaccctaaaagaagttccatcaaacaaattgctagtggaagatttggtgtttcgagctactatcttactaatgctgatgagctgcagataaagatggctcagggagccaaacctggggaaggtggggagctacctggccacaaggttataggagacatcgccatcacaagaaattccaccgcaggtgtggggcttatcagcccacctcctcatcatgacatttactctatcgaggatcttgcccaactaattcacgatcttaagaatgccaatcctggggctcgtattagtgttaaactagtatcggaagctggtgttggagttattgctagcggtgtggtgaagggccacgctgaccatgttctgatagctggtcatgacggaggtactggtgcctctcgttggaccggtattaaaaatgctggtcttccgtgggaactgggtctagcggagacacaccaaacacttgttgctaatgaccttcgtggccgtactgttctccagacagatggccagctgaaaactggaagagatgttgcagttgctgctcttcttggtgcagaagagtttggttttagtactgcaccccttattacactcgggtgtatcatgatgcgaaagtgccacaagaacacctgccctgtgggaattgctactcaagatccagttctccgtgaaaaatttgctggggagcctgaacatgttattaatttcttctttatgcttgctgaggaagttagggagatcatgtctggacttggtttccgtaccctaactgaaatgattggtcgcgcagatatgcttgaacttgacagggaagttgtcaagaacaatgataagctagagaacattgatctctctctattgctcagacccgctgctgagattcgtcctggagctgctcagtattgtgtccagaaacaagatcacggcttagacatggctctggatcaagagctgattgcattatctaaatctgctctagataaatctcttccggtgtacattgaaactcctatctgcaatgttaaccgtgcggttgggactatgcttagccatgaggttaccaagcgctaccacttggctgggctaccaaaggatacaattcatatcaagttttcaggaagtgctgggcagagtcttggagctttcttgtgtcctgggattacactagaacttgagggtgatagcaacgactatgttggaaaagggctctccggaggtaaagttgttgtctaccctcctacaggaagcagttttgatccaaaagaaaacattgttattggtaatgtagcactttacggggccaccagtggtgaagcctactttaatgggatggctgctgaaagattctctgttcgtaattctggtgccaaagctgttgtggaaggtgttggtgatcacggttgtgagtacatgactggtggtactgttgtggtgcttggtaagactggtagaaactttgctgctggtatgagtggtggtattgcttatgtccttgatgtggatggaaagtttcacacgagatgcaaccatgaactggttgatctggacaaagttgaagatgacgatgacaaaatgacgctcaaaatgatgatccagcaacatcaacgacacacaaacagccaacttgctcaagaagttcttgcggactttgagaatttgttgccgaagtttgtcaaagttttcccaagagattacaaacgtgttttgtcagccatgaagcacgaggaggtctccaagcaagcgattgagcgtgcttctgaagaagctgacgagatggaggaaaaagaactcgaggagaaagacgcctttgcagagctgaagaacatggcagctacctcttcaaaagaggtgatgtcaggtaacggagttgcagctgaagctccaacgaaaccttctaaagtagatgatgctgttaaacatcgtggtttcattgcttatgagcgagagggagttaagtacagggaccccaatgttcgtcttaatgattggaacgaagtcatggaggaatcaaaacctggaccgctccttaagactcagtctgctcgttgcatggactgtggaactccattctgccaccaggagaactctggatgcccccttggtaacaagatccctgaattcaatgaacttgtctaccagaacagatggcaagaagctttgaatcgtctacttgagacaaacaactttccagaatttactggtcgagtatgccctgcaccatgtgaaggttcttgtgttcttggaataattgaaaaccctgtgtctatcaaaagcatcgaatgtgccattatagataaagcctttgatgaagggtggatggtaccaagacctcctctcaagagaacagggaaaaaagttgcgattatcggaagtgggcctgctggacttgctgctgccgaccagcttaacaaaatgggccacttggtaaccgtgtatgagcgctctgacagaattggtgggcttatgatgtatggagtcccgaacatgaagactgacaaaattgacatagttcaacgtcgggttgatcttatgaccaaagaaggtatcaactttgtggtcaatgccaatattggaaaagacccgtcttactccctagatggactgaaggaggagaatgatgcaatcgttcttgctgttggttccacaaaaccaagagatcttccagtgcctggtcgtgagttatccggtgttcactttgccatggagtttcttcatgcgaacaccaaaagcttacttgatagcaatcttcaagatggtaattacatttctgcaaaggggaagaaggttgtcgttattggtggaggtgataccggcacagattgtataggaacatctatccgccatggatgcactaatattgtaaatctagagcttcttcctcagccaccttcaacgagagctcctggaaacccatggccacagtggcctcgtgtattccgtattgactacggacatcaggaagctgccaccaaattcggaaaagaccctagaacctatgaggttttaaccaagcgtttcattggagatgataatggaaacgtgaaaggtcttgaaattgtgcgtttgagttgggagaaggatgaaaccggaaggttccaattcaaggagattgaaggctccgaggaaataattgaagcggaccttgttttcttggccatgggattccttggacctgagccaacacttgcggagaagctaggactcgaatgcgacaacaggtcgaactttaaggcagagtatggccggttctccacaactgtggaaggtgtttttgcagcaggtgattgtcggagaggtcagtctttggtggtctgggccatctcagaaggacgtcaagctgcatctcaggtcgacaaattcctcagcaaaaacgaggacgacctagtagacgcaaaggtaggacaaaacctcatgaagcacgacaactctagaaagacttgagagaaagaaggccttacatctgaagcaaaacttaggttgtgtttttttcttttgtctattatcgtccatatagtaataatgaaacatgaagtacatttttcttggtagggtttcgttagcttttcttttgttaatgctttcggaattgaaggccttttgtttttctctatggctgcttgtggatttgaatttaaggaacggttggtaatgcatagttcctggttctttgtcttttcctctctttgtttatttcgtgttattgtggaaagtgtaagaactaaaaaaattgaacattgataaagaaatcgtaagacttgcaagt

SEQ ID NO: 8123 - DNA, 6866 bp, Eutrema parvulum
ttccgtcggaaaaaaatgtcggcagcttcttctagctccgttctgcagctccgaaacaaccagttgtttccagtccgatctctgaagaaaaatcccaccgccgtttcccaattggcagtcgcgcctggcgtcagccgtagaagagcatgtactgcacggtgctctgtgagtaaaccggcggctccggagaagcctttcatgggtactcggatgaggagatccggatccgagacactccagttctggagatcggacggtcctggacggtctccgaagctcaaaacggtggttaagtcgtcgttttccggtgttccggagaagcctctcggtctctatgatccttccttcgataaagactcttgtggagtcggtttcgtcgcggagttgtccggcgataccagccgcaaaacggtgactgattcattggagatgttgatacggatgactcatagaggcgcttgtgggtgtgagagcaacactggtgacggcgctgggattcttgttggtatgcctcatgagttctatgcagaggctgctaaagagcttggctttgtgcttcctcccgctggaaagtatgctgttggtatgtttttcttgccaactgctgagtccaggagagatgaaagcaaaaatgttttcaccaaggttgctgaatcacttgggcattcagttattggatggagatcagttcctaccgataactctgggttggggaagtctgctttgcagacggagccaattatggagcaagttttccttactcctacaactaaatcgaaagtcgaccttgagcaacagatgtatatccttcgaagggtttccatggttgctatccgagcagcgttgaaccttgaacatggtgcaatgaaggacttctacatttgttctttatcatctaggactgttgtctacaaaggacaactgaagcctgaccagctgaaggactattactacgcggatcttgggagtgaaaggtttacgagctacatggccctggttcactctcggttctctaccaatacatttcccagctgggatcgtgctcagccgatgcgtgttttgggccacaatggggagattaatacgcttaggggaaacgtgaactggatgagggcacgtgagggtctgctcaagtgcaaggaacttggactatcaaagaaggagttgaagaagcttctacctattgtggatgttagctcttctgactcaggtgcttttgatggtgttcttgagcttcttgtccgagctggcagaagtcttcccgaggctgttatgatgatgattcctgaagcatggcagaatgacaaaaacatagatccaagcaggaaatccttttatgaatacttatctgccctaatggagccatgggatgggcctgctctcatatcatttactgacggtcgctacttgggtgccacattggaccgtaatggacttcgtcctggtaggttctacataacccacagtggaagggttatcatggctagtgaagttggggtagtggatgtgccacctgaagacgtgatgaggaaaggaagacttaacccgggcatgatgcttcttgtcgattttgagaagcatattgttgttgatgatgatgccttgaagcaacagtattcgcaggcaagaccctatggtgaatggcttaaaaggcaaaagattgaacttaaagacatcattaagtcagttccggagactgaacgaattgccccattaatttctggggttgcactggcgtccaataatgacgactcaatggacagcatgggaattcatggtttgttgtctccactaaaagcctttggttatacagttgaggccttggaaatgctgctgcttccgatggctaaagatggcagtgaagcacttggttctatgggaaatgatgcccctctagctgtaatgtcaaacagagagaaattatgttttgagtacttcaagcaaatgtttgctcaagtaacaaatcctccaatcgatcctatccgtgagaaaattgttacttcaatggagtgcatgatcggcccagaaggtgatctaactgaaacatctgaggagcaatgtcaccgactctccctaaaaggtcctcttttgaccatcgaagagatggaagcaatcaagaaaatgaactacagaggctggcggactaaagttcttgatataacttatccgaaagaacaaggtacaaaagggttggagacgaccttggaccgaatttgtgctgaagcaaatgaagcgataaaggagggctacacattactggttttgtctgatcgagctttctcttcgacgcgagttgctgtgagctctctcttggctattggtgctgttcatcaccaccttgttaagacacttgcgcgcactcaagttgggttggtagtggaatctgctgaaccacgtgaagtgcatcatttctgcacacttgtcggattcggagcagacgctatctgcccatatttggctgtagaggccgtccatagattgcaggttgatggcaagataccacccaaatctaatggggaattccattccaaagaagaactggtcaagaagtattacaaggcaagcaactatggaatgatgaaggttcttgctaaaatgggaatttctaccctggcctcatacaagggtgctcagatatttgaagctcttgggctttcgtctgaagtgatagagaagtgttttgcgggcaccccaagcagagtggagggagcaacatttgagatgcttgcacgagatgcacttcttttgcatgagatggccttcccagcccgtggctttgcccctggaagtgcagaagcctcagcactttccaaccctgggaactatcactggaggaaaaatggggagattcatctcaatgatcctctcgcaattgcaaaactgcaagaggcagcacggactaacagtgtggccgcctacaaggaatactcaaagcgtatcaatgaattgaacaagcaaagtaatttgcgcgggctcatgaagttcaaagaagcagatgtaaaaattccattagacgaagtggagcctgctagtgagattgttaagcggttctgcactggcgccatgagttatggatcaatatcactggaggcgcatacaacccttgcaatggccatgaacaaacttggaggaaagtcaaatacaggtgagggaggggaactgccatcccgtatggagcctcttccagatggttcaaggaaccctaaaagaagttccatcaaacaaattgctagtggaagatttggtgtttcgagctactatcttactaatgctgatgagctgcagataaagatggctcagggagccaaacctggggaaggtggggagctacctggccacaaggttataggagacatcgccatcacaagaaattccaccgcaggtgtggggcttatcagcccacctcctcatcatgacatttactctatcgaggatcttgcccaactaattcacgatcttaagaatgccaatcctggggctcgtattagtgttaaactagtatcggaagctggtgttggagttattgctagcggtgtggtgaagggccacgctgaccatgttctgatagctggtcatgacggaggtactggtgcctctcgttggaccggtattaaaaatgctggtcttccgtgggaactgggtctagcggagacacaccaaacacttgttgctaatgaccttcgtggccgtactgttctccagacagatggccagctgaaaactggaagagatgttgcagttgctgctcttcttggtgcagaagagtttggttttagtactgcaccccttattacactcgggtgtatcatgatgcgaaagtgccacaagaacacctgccctgtgggaattgctactcaagatccagttctccgtgaaaaatttgctggggagcctgaacatgttattaatttcttctttatgcttgctgaggaagttagggagatcatgtctggacttggtttccgtaccctaactgaaatgattggtcgcgcagatatgcttgaacttgacagggaagttgtcaagaacaatgataagctagagaacattgatctctctctattgctcagacccgctgctgagattcgtcctggagctgctcagtattgtgtccagaaacaagatcacggcttagacatggctctggatcaagagctgattgcattatctaaatctgctctagataaatctcttccggtgtacattgaaactcctatctgcaatgttaaccgtgcggttgggactatgcttagccatgaggttaccaagcgctaccacttggctgggctaccaaaggatacaattcatatcaagttttcaggaagtgctgggcagagtcttggagctttcttgtgtcctggaattacgctagaactggagggtgatagcaacgactatgttggaaaaggtctctccggaggtaaagttgttgtctaccctcctacaggaagcagttttgatccaaaagaaaacattgttattggtaatgtagcactttacggggccaccagtggtgaagcctactttaatgggatggctgctgaaagattctctgttcgtaattctggtgccaaagctgttgtggaaggtgttggtgatcacggttgtgagtacatgactggtggtactgttgtggtgcttggtaagactggtagaaactttgctgctggtatgagtggtggtattgcttatgtccttgatgtggatggaaagtttcacacgagatgcaaccatgaactggttgatctggacaaagttgaagatgacgatgacaaaatgacgctcaaaatgatgatccagcaacatcaacgacacacaaacagccaacttgctcaagaagttcttgcggactttgagaatttgttgccgaagtttgtcaaagttttcccaagagattacaaacgtgttttgtcagccatgaagcacgaggaggtctccaagcaagcgattgagcgtgcttctgaagaagctgacgagatggaggaaaaagaactcgaggagaaagacgcctttgcagagctgaagaacatggcagctacctcttcaaaagaggtgatgtcaggtaacggagttgcagctgaagctccaacgaaaccttctaaagtagatgatgctgttaaacatcgtggtttcattgcttatgagcgagagggagttaagtacagggaccccaatgttcgtcttaatgattggaacgaagtcatggaggaatcaaaacctggaccgctccttaagactcagtctgctcgttgcatggactgtggaactccattctgccaccaggagaactctggatgcccccttggtaacaagatccctgaattcaatgaacttgtctaccagaacagatggcaagaagctttgaatcgtctacttgagacaaacaactttccagaatttactggtcgagtatgccctgcaccatgtgaaggttcttgtgttcttggaataattgaaaaccctgtgtctatcaaaagcatcgaatgtgccattatagataaagcctttgatgaagggtggatggtaccaagacctcctctcaagagaacagggaaaaaagttgcgattatcggaagtgggcctgctggacttgctgctgccgaccagcttaacaaaatgggccacttggtaaccgtgtatgagcgctctgacagaattggtgggcttatgatgtatggagtcccgaacatgaagactgacaaaattgacatagttcaacgtcgggttgatcttatgaccaaagaaggtatcaactttgtggtcaatgccaatattggaaaagacccgtcttactccctagatggactgaaggaggagaatgatgcaatcgttcttgctgttggttccacaaaaccaagagatcttccagtgcctggtcgtgagttatccggtgttcactttgccatggagtttcttcatgcgaacaccaaaagcttacttgatagcaatcttcaagatggtaattacatttctgcaaaggggaagaaggttgtcgttattggtggaggtgataccggcacagattgtattggaacatctatccgccatggatgcaccaacattgtaaacctagagcttcttcctcagccaccttcaacgagagctccaggaaacccttggccacagtggcctcgtgtattccgtattgactacggacatcaagaagcagcgaccaaattcggaaaggaccctagaacctatgaggtcttaactaagcgattcataggagatgacaatggaaacgtgaaagggctagagattgtgcgcgtgagttgggagaaggatgaaaccgggaggttccaattcaaggagatcgaaggctccgaggaaataattgaagcggaccttgttttcttagccatgggattccttggacctgagccaacacttgccgagaaactaggactcgaatgtgacaacaggtcgaactttaaggcagagtatggccggttttcaacaacagtggaaggtgtttttgctgcaggtgattgtcgaagaggacagtctttggtggtctgggccatctcagaaggacgccaagctgcatctcaggtcgacaaatacctcagcaaaaacgaggacgacctagtagacgcaaaggtaggacaaaacctcatgaagcacgacaactctagaaagacttgagagaaagaaggccttacatctgaagcaaaagtcgagagaagacgaagagatttttgctctttttgaaacaggaggcgaaaaggacttgacttatggcagagatgatgaaggtagaagagttgcagacgaaaaggatattggaaagaggaggagaagaggaattttatggtttagaattgaaggaaaagcttaggttgtgtttttttcttttgtctattatc

SEQ ID NO: 8124 - DNA, 7128 bp, Arabidopsis thaliana
aaacaaaaaacaaatctgataatcgaaactgatcactcactgctgattccgtaacctaaaaaatgtcggcagcttcttctagctccgttcttcacctccgaaccaaccaacaactgttatcactccgatctctcaaaaattccacctccgttgcttctcaattggccgttacgtctggtgttagccgtagaagatcgtgtacggcgcgatgctctgtgaagaaaccggtgattcctgagagtcctttcctagggactcgtgtgcggagatccggatccgagacgcttcagttctggagatcagatggtcctggacggtctgcgaagcttcgaacggtggttaaatcgtcattttccgctgttccggagaagcctcttggtctttatgatccttcctatgataaagactcttgtggtgttggttttgtagcagagttgtccggcgagaccacccgcaaaacggtgactgattcgttggagatgttgatacggatgactcatagaggtgcttgtggttgtgagagcaacactggtgacggcgctgggattcttgttggtctgcctcatgatttctatgcagaggctgcgacagagcttggctttgtacttccttctgctggaaattatgctgttggtatgttcttcttgccaactgttgaaagcaggagagaagaaagcaagaatgttttcactaaggttgctgaatcacttggccactcggttcttggatggagattagtgcctaccgataattctggactgggaaactccgctttgcagactgaaccgattattgcgcaagttttccttactcctacaactaaatctaaagctgactttgagcaacagatgtatatccttagaagggtttctatggttgctattcgagctgcgttgaaccttcaacatggtgcgatgaaggacttctacatctgttcgttgtcttctaggactatcgtctacaaaggacaattgaagcctgatcaactaaaggactattactatgcggatcttgggagtgaaaggtttacgagctacatggccctggttcattctcggttctctaccaatacatttcccagctgggatcgtgctcagccgatgcgtgttttgggccacaatggggagatcaatacactcaggggaaacgtgaactggatgagggcacgtgagggtctgctcaagtgcaatgaacttggattatcaaagaaagagttgaagaagcttctacctattgtggacgttagctcttctgactcaggtgcttttgatggtgttcttgagcttcttgtccgagctggtagaagtcttcctgaagctgttatgatgatgatccctgaagcatggcaaaatgacaaaaacattgatccaagcaggaaagagttttatgaatacttatctgctctaatggagccatgggatggacctgccctcatatcattcactgatggtcgctacttgggtgccacattggaccgtaatggacttcgtcctggtaggttctacataacccacagtggaagggttatcatggctagtgaagttggggtagtggatgtaccacctgaagatgtgatgaggaaaggaagacttaacccgggtatgatgcttcttgtcgattttgagaagcatattgttgttgatgacgatgccttgaagcagcagtattcactggcaaggccttatggtgagtggcttaaaaggcaaaagattgaacttaaagacatcattgagtcagttccggaggctgaacggattgctccttcaatttctggggttgtaccggcctctaatgatgatgactcaatggagagcatgggcattcatggtttattgtctccactaaaagcctttggctacacagttgaggccttggagatgttgctgcttccgatggctaaagatggctctgaagcacttggttctatgggaaatgatacccctctagctgtaatgtcaaacagagaaaaattatgctttgagtacttcaagcaaatgtttgctcaagtaacaaatcctccaattgatcctattcgtgagaaaattgttacatcaatggagtgcatgatcggtccagaaggcgatctaaccgaaacaactgaagagcaatgtcaccgtctctccctaaaaggtcctcttttgaaaatcgaagagatggaagccatcaagaaaatgaactacagaggctggcggactaaagttctggatataacttatgcaaaagaaagaggtacaaaagggttagaggagactttggaccgaatttgtgatgaagcaaatgaagcaataaaggagggctacacattactggttttgtctgatcgagctttctctgcaacacgtgttgctgtgagctccctcatggctgttggtgccgttcatcaccacctggttaagacacttgcgcgcacccaagttggtttggtagtggaatctgctgaaccacgtgaagtgcatcatttctgcacacttgtcggatttggagcagatgctatctgcccatatttggctgtagaggccgtttatagattacaggttgatggcaaaataccacccaaatctaatggggaattccattccaaagaagagttggtcaagaagtattacaaggcaagtaactatggaatgatgaaggttcttgccaaaatgggaatttctactctagcctcatacaaaggtgctcagatatttgaagctcttgggctttcatctgaagtaattcagaaatgttttgccggtaccccaagccgagtggaaggagcaacatttgagatgcttgcacgagatggacttcaattgcatgagttggcctttccaacccgtggctatgccccaggaagtgcagaagcttcagcacttaccaaccctggaaactatcactggaggaaaaatggagagattcatctcaacgatcctcttgcaatagccaaattacaagaggcagcacggaccaacagtgtggccgcctacaaggaatactcaaagcgtatcaatgaattgaacaagcaaagtaatttgcgtgggctcatgaagtttaaagacgcagatgtgaaaattccactagatgaagtcgagcctgccagtgaaattgttaagcggttctgcactggtgccatgagttatggatcaatttctctggaggcgcatacaacccttgcaatggccatgaacaagcttggaggaaagtcgaatacaggtgagggaggggaactgccatcccgtatggagcctcttgcggatggttcaaggaaccccaaaagaagttcgatcaaacaaattgctagtggaagatttggagtttctagctactatcttacaaatgctgatgagctgcagataaagatggctcagggtgccaaacctggggaaggtggggagctaccaggccacaaggtcataggagacattgctataaccagaaattccactgctggtgtaggacttatcagtccacctcctcatcatgatatctactctatcgaggatcttgcccagctaattcacgatcttaagaatgccaatcctggcgcacgtattagtgttaagcttgtatctgaagctggtgttggagttattgctagcggtgtggtgaaggggcatgctgaccatgttctgatagcaggtcatgatggaggtactggtgcatctcgctggaccggtattaaaaatgctggtcttccatgggaactgggtctagctgagacacaccaaactcttgttgccaatgaccttcgtggccgtactgttcttcagacagatggccagctaaaaactggcagagacgttgcagttgctgcacttcttggtgcagaagaatttggttttagtactgcaccccttatcacactagggtgtatcatgatgagaaagtgccacaagaacacctgccctgtgggaattgctacccaagatccagttctccgtgaaaaatttgctggggagcctgaacatgttattaacttcttctttatgcttgctgaggaagttagggagatcatgtctggacttggttttagaactgtaactgagatgattggtcgtgcggatatgcttgaacttgatagggaagttgtcaagaacaacgataagctggagaacattgacctatctcttttgctcagacctgctgctgagattcgtcctggggctgctcagtactgtgttcagaaacaagatcatggtttagacatggctttggatcaagagctgattgcattgtctaaatctgctctggagaaatctcttccggtgtacattgaaactcctatctgcaacgttaaccgtgctgttgggacaatgctgagccatgaggtaaccaaacgttaccacttgactgggcttccaaaggacacaattcatatcaagttcacaggaagtgctgggcagagtcttggagctttcttgtgtcctggaattatgctagaacttgaaggagatagcaatgactatgttggaaaagggctctctggaggtaaagttgttgtttaccctccaaaaggaagcagctttgatccaaaagaaaatatcgttattggtaatgtagcactttacggtgccactagtggtgaagcatacttcaatgggatggctgctgaaaggttctctgttcgtaattctggtgctaaagctgttgtggaaggtcttggtgatcatggttgtgagtacatgactggtggtactgttgtggtgcttggaaagactggtagaaactttgctgctggtatgagtggtggtattgcttatgtccttgatgtggacggaaagtttaacaccagatgcaaccttgaactggttgatttggataaagttgaagatgaggaggacaaaatgacgctcaaaatgatgatccagcaacatcaaagacacaccaacagccaacttgctcaagaagttcttgcagactttgagaatttgctgcccaagtttatcaaggttttcccaagagattacaaacgtgttttatcagccatgaaacacgaagaggtctccaagcaagcaatcgagcgggcttctgaggaagctgacgagactgaagagaaagaactcgaggagaaagatgcatttgcagaactgaagaacatggcagctgcttcgtcaaaagaggagatgtcaggaaacggagtggcagctgaagctagaccttctaaggtagataatgctgttaaaaacggtggtttcattgcttatgagcgtgagggagttaagtacagggatcccaatgttcgtcttaatgactggaacgaagtcatggaggaatcaaaacctggaccactccttacaactcagtcagctcgttgcatggattgtggaactccattctgccaccaggagaactctgggtgtcctctcggtaataagatccctgaattcaatgaacttgtctaccagaacagatggcaagaagccttgaatcgtctacttgagacaaacaactttccagaatttactgggcgagtatgccctgcaccatgtgaaggttcttgtgttcttggaataattgagaaccctgtttctatcaaaagcattgaatgtgctattatcgataaagcctttgaggaagggtggatggtaccaaggcctcctctcaagagaacagggaaaaaggttgctattatcggaagtggaccggctgggttagctgcggctgaccagctgaacaaaatgggccatttagtaaccgtgtatgagcgctcggacagaattggtgggctgatgatgtatggagtaccaaacatgaagactgacaaaattgacgtcgttcaacggcgggttgatcttatgaccaaagaaggtatcaactttgtggtcaatgccaatattggaaaggacccatcttactcccttgatggacttaaggaagagaatgatgcaatcgttcttgctgttggttccacaaaaccaagagatcttccagtgcctggtcgtgatctatctggtgttcactttgccatggagtttcttcatgcaaacaccaaaagtttacttgacagcaatcatgaggatggcaattacatttctgcaaaagggaaaaaggttgttgttattggtggaggtgataccggcacagattgcatcggaacatctatccgccatggatgtaccaacattgtaaacctagaacttcttcctcagccaccctcaacaagagctcctggaaacccttggccacagtggcctcgtgtattccgtattgactacggacatcaagaagctaccaccaaattcggaaaagaccctaggacctatgaggtcttaacgaagaggttcataggagatgacaatggaaacgtgaaggggcttgaacttgtgcgtgtgagttgggagaaggatgaaaccgggaggttccagttcaaggagatcgaaggctctgaggaaatcattgaagcagacctcgttttcttggccatgggtttccttggacctgagccaacacttgctgagaagctaggtctcgaatgtgacaacaggtcaaactttaaggccgagtatggccggttttccacaaccgtggaaggtgttttcgcagcaggtgattgtcggagaggccagtctttggttgtctgggctatctcagaaggacgtcaagctgcagatcaggtagacaaattcctcaccaaaacggatgatgacgaagacgccaagctacaacaagaccttaaccagatgaaacacaacactatcacaaactgaggtaaaagaaagccttactcatctgaagcaaaagtcgagagagaaagacaactgatgttactcttttagaggacacacaggcgtaaaggaccgacttatggcagagatgaaggaagagagttgcagaggaaaagtaccgaacttgatgatttagtagagagaagtaaaagtttaggtttgtttttgtttattatcgtccataaagtaataatgattcataagtacattctctttgtaggatttcagtagctttcttttgttaaagctttctgaaattgaaagccttttgttttttctctatggctgtttctaagtttgaattttaaggaattgtaatgcagttcctgcttcttgtttttgccctctttgtgttctttcatattatttatggtggtgtaaactgtaaacaatgttaggaatcataagacttgctcagtaa

SEQ ID NO: 8125 - DNA, 7380 bp, Arabidopsis thaliana
tcctctataaatataaacgtctcgcctcctgagaaaaacgtataaactctcacactctccctagccgccacctaccctccgccgcctccttttcgccgcctgcttcgctccgccgcgcgcagcgcttttagtctttttctgagactgtttccgaagaatctctctgttaggattttgtttgattctggtcgttatccagatcagagaaatccgtgatccttttttctctctcactttcttctctgaaataggaaaaacaaaaaacaaatctgataatcgaaactgatcactcactgctgattccgtaacctaaaaaatgtcggcagcttcttctagctccgttcttcacctccgaaccaaccaacaactgttatcactccgatctctcaaaaattccacctccgttgcttctcaattggccgttacgtctggtgttagccgtagaagatcgtgtacggcgcgatgctctgtgaagaaaccggtgattcctgagagtcctttcctagggactcgtgtgcggagatccggatccgagacgcttcagttctggagatcagatggtcctggacggtctgcgaagcttcgaacggtggttaaatcgtcattttccgctgttccggagaagcctcttggtctttatgatccttcctatgataaagactcttgtggtgttggttttgtagcagagttgtccggcgagaccacccgcaaaacggtgactgattcgttggagatgttgatacggatgactcatagaggtgcttgtggttgtgagagcaacactggtgacggcgctgggattcttgttggtctgcctcatgatttctatgcagaggctgcgacagagcttggctttgtacttccttctgctggaaattatgctgttggtatgttcttcttgccaactgttgaaagcaggagagaagaaagcaagaatgttttcactaaggttgctgaatcacttggccactcggttcttggatggagattagtgcctaccgataattctggactgggaaactccgctttgcagactgaaccgattattgcgcaagttttccttactcctacaactaaatctaaagctgactttgagcaacagatgtatatccttagaagggtttctatggttgctattcgagctgcgttgaaccttcaacatggtgcgatgaaggacttctacatctgttcgttgtcttctaggactatcgtctacaaaggacaattgaagcctgatcaactaaaggactattactatgcggatcttgggagtgaaaggtttacgagctacatggccctggttcattctcggttctctaccaatacatttcccagctgggatcgtgctcagccgatgcgtgttttgggccacaatggggagatcaatacactcaggggaaacgtgaactggatgagggcacgtgagggtctgctcaagtgcaatgaacttggattatcaaagaaagagttgaagaagcttctacctattgtggacgttagctcttctgactcaggtgcttttgatggtgttcttgagcttcttgtccgagctggtagaagtcttcctgaagctgttatgatgatgatccctgaagcatggcaaaatgacaaaaacattgatccaagcaggaaagagttttatgaatacttatctgctctaatggagccatgggatggacctgccctcatatcattcactgatggtcgctacttgggtgccacattggaccgtaatggacttcgtcctggtaggttctacataacccacagtggaagggttatcatggctagtgaagttggggtagtggatgtaccacctgaagatgtgatgaggaaaggaagacttaacccgggtatgatgcttcttgtcgattttgagaagcatattgttgttgatgacgatgccttgaagcagcagtattcactggcaaggccttatggtgagtggcttaaaaggcaaaagattgaacttaaagacatcattgagtcagttccggaggctgaacggattgctccttcaatttctggggttgtaccggcctctaatgatgatgactcaatggagagcatgggcattcatggtttattgtctccactaaaagcctttggctacacagttgaggccttggagatgttgctgcttccgatggctaaagatggctctgaagcacttggttctatgggaaatgatacccctctagctgtaatgtcaaacagagaaaaattatgctttgagtacttcaagcaaatgtttgctcaagtaacaaatcctccaattgatcctattcgtgagaaaattgttacatcaatggagtgcatgatcggtccagaaggcgatctaaccgaaacaactgaagagcaatgtcaccgtctctccctaaaaggtcctcttttgaaaatcgaagagatggaagccatcaagaaaatgaactacagaggctggcggactaaagttctggatataacttatgcaaaagaaagaggtacaaaagggttagaggagactttggaccgaatttgtgatgaagcaaatgaagcaataaaggagggctacacattactggttttgtctgatcgagctttctctgcaacacgtgttgctgtgagctccctcatggctgttggtgccgttcatcaccacctggttaagacacttgcgcgcacccaagttggtttggtagtggaatctgctgaaccacgtgaagtgcatcatttctgcacacttgtcggatttggagcagatgctatctgcccatatttggctgtagaggccgtttatagattacaggttgatggcaaaataccacccaaatctaatggggaattccattccaaagaagagttggtcaagaagtattacaaggcaagtaactatggaatgatgaaggttcttgccaaaatgggaatttctactctagcctcatacaaaggtgctcagatatttgaagctcttgggctttcatctgaagtaattcagaaatgttttgccggtaccccaagccgagtggaaggagcaacatttgagatgcttgcacgagatggacttcaattgcatgagttggcctttccaacccgtggctatgccccaggaagtgcagaagcttcagcacttaccaaccctggaaactatcactggaggaaaaatggagagattcatctcaacgatcctcttgcaatagccaaattacaagaggcagcacggaccaacagtgtggccgcctacaaggaatactcaaagcgtatcaatgaattgaacaagcaaagtaatttgcgtgggctcatgaagtttaaagacgcagatgtgaaaattccactagatgaagtcgagcctgccagtgaaattgttaagcggttctgcactggtgccatgagttatggatcaatttctctggaggcgcatacaacccttgcaatggccatgaacaagcttggaggaaagtcgaatacaggtgagggaggggaactgccatcccgtatggagcctcttgcggatggttcaaggaaccccaaaagaagttcgatcaaacaaattgctagtggaagatttggagtttctagctactatcttacaaatgctgatgagctgcagataaagatggctcagggtgccaaacctggggaaggtggggagctaccaggccacaaggtcataggagacattgctataaccagaaattccactgctggtgtaggacttatcagtccacctcctcatcatgatatctactctatcgaggatcttgcccagctaattcacgatcttaagaatgccaatcctggcgcacgtattagtgttaagcttgtatctgaagctggtgttggagttattgctagcggtgtggtgaaggggcatgctgaccatgttctgatagcaggtcatgatggaggtactggtgcatctcgctggaccggtattaaaaatgctggtcttccatgggaactgggtctagctgagacacaccaaactcttgttgccaatgaccttcgtggccgtactgttcttcagacagatggccagctaaaaactggcagagacgttgcagttgctgcacttcttggtgcagaagaatttggttttagtactgcaccccttatcacactagggtgtatcatgatgagaaagtgccacaagaacacctgccctgtgggaattgctacccaagatccagttctccgtgaaaaatttgctggggagcctgaacatgttattaacttcttctttatgcttgctgaggaagttagggagatcatgtctggacttggttttagaactgtaactgagatgattggtcgtgcggatatgcttgaacttgatagggaagttgtcaagaacaacgataagctggagaacattgacctatctcttttgctcagacctgctgctgagattcgtcctggggctgctcagtactgtgttcagaaacaagatcatggtttagacatggctttggatcaagagctgattgcattgtctaaatctgctctggagaaatctcttccggtgtacattgaaactcctatctgcaacgttaaccgtgctgttgggacaatgctgagccatgaggtaaccaaacgttaccacttgactgggcttccaaaggacacaattcatatcaagttcacaggaagtgctgggcagagtcttggagctttcttgtgtcctggaattatgctagaacttgaaggagatagcaatgactatgttggaaaagggctctctggaggtaaagttgttgtttaccctccaaaaggaagcagctttgatccaaaagaaaatatcgttattggtaatgtagcactttacggtgccactagtggtgaagcatacttcaatgggatggctgctgaaaggttctctgttcgtaattctggtgctaaagctgttgtggaaggtcttggtgatcatggttgtgagtacatgactggtggtactgttgtggtgcttggaaagactggtagaaactttgctgctggtatgagtggtggtattgcttatgtccttgatgtggacggaaagtttaacaccagatgcaaccttgaactggttgatttggataaagttgaagatgaggaggacaaaatgacgctcaaaatgatgatccagcaacatcaaagacacaccaacagccaacttgctcaagaagttcttgcagactttgagaatttgctgcccaagtttatcaaggttttcccaagagattacaaacgtgttttatcagccatgaaacacgaagaggtctccaagcaagcaatcgagcgggcttctgaggaagctgacgagactgaagagaaagaactcgaggagaaagatgcatttgcagaactgaagaacatggcagctgcttcgtcaaaagaggagatgtcaggaaacggagtggcagctgaagctagaccttctaaggtagataatgctgttaaaaacggtggtttcattgcttatgagcgtgagggagttaagtacagggatcccaatgttcgtcttaatgactggaacgaagtcatggaggaatcaaaacctggaccactccttacaactcagtcagctcgttgcatggattgtggaactccattctgccaccaggagaactctgggtgtcctctcggtaataagatccctgaattcaatgaacttgtctaccagaacagatggcaagaagccttgaatcgtctacttgagacaaacaactttccagaatttactgggcgagtatgccctgcaccatgtgaaggttcttgtgttcttggaataattgagaaccctgtttctatcaaaagcattgaatgtgctattatcgataaagcctttgaggaagggtggatggtaccaaggcctcctctcaagagaacagggaaaaaggttgctattatcggaagtggaccggctgggttagctgcggctgaccagctgaacaaaatgggccatttagtaaccgtgtatgagcgctcggacagaattggtgggctgatgatgtatggagtaccaaacatgaagactgacaaaattgacgtcgttcaacggcgggttgatcttatgaccaaagaaggtatcaactttgtggtcaatgccaatattggaaaggacccatcttactcccttgatggacttaaggaagagaatgatgcaatcgttcttgctgttggttccacaaaaccaagagatcttccagtgcctggtcgtgatctatctggtgttcactttgccatggagtttcttcatgcaaacaccaaaagtttacttgacagcaatcatgaggatggcaattacatttctgcaaaagggaaaaaggttgttgttattggtggaggtgataccggcacagattgcatcggaacatctatccgccatggatgtaccaacattgtaaacctagaacttcttcctcagccaccctcaacaagagctcctggaaacccttggccacagtggcctcgtgtattccgtattgactacggacatcaagaagctaccaccaaattcggaaaagaccctaggacctatgaggtcttaacgaagaggttcataggagatgacaatggaaacgtgaaggggcttgaacttgtgcgtgtgagttgggagaaggatgaaaccgggaggttccagttcaaggagatcgaaggctctgaggaaatcattgaagcagacctcgttttcttggccatgggtttccttggacctgagccaacacttgctgagaagctaggtctcgaatgtgacaacaggtcaaactttaaggccgagtatggccggttttccacaaccgtggaaggtgttttcgcagcaggtgattgtcggagaggccagtctttggttgtctgggctatctcagaaggacgtcaagctgcagatcaggtagacaaattcctcaccaaaacggatgatgacgaagacgccaagctacaacaagaccttaaccagatgaaacacaacactatcacaaactgaggtaaaagaaagccttactcatctgaagcaaaagtcgagagagaaagacaactgatgttactcttttagaggacacacaggcgtaaaggaccgacttatggcagagatgaaggaagagagttgcagaggaaaagtaccgaacttgatgatttagtagagagaagtaaaagtttaggtttgtttttgtttattatcgtccataaagtaataatgattcataagtacattctctttgtaggatttcagtagctttcttttgttaaagctttctgaaattgaaagccttttgttttttctctatggctgtttctaagtttgaattttaaggaattgtaatgcagttcctgcttcttgtttttgccctctttgtgttctttcatattatttatggtggtgtaaactgtaaacaatgttaggaatcataagacttgctcagt

SEQ ID NO: 8126 - DNA, 7203 bp, Eucalyptus grandis
gccttcgtcgtttcgataatgtcgtccgcttcgtcgagctcgctccttcagccgaaaacgggacctcatgctctgccgacgtcgctcgccaggccgtccattacgccccagctgagcgtgtcccgttacagggacagggcgaaggtggcgagccgatgctctgtttccaagcagtcaacgggcgttctgcagaagaatttcttcgggccccggctccgggagaccggatccgagaggctccgcgccttggcgtccgatgggtcgtcgaagctccgcctcctcgttcggtctgcattgtcggcggtcccggagaagcctcttggtctctacgacccgaggttcgataaggactcttgcggagtcggttttgttgccgagctgtctggtgaaagcagccgcaagacggtgacggatgctgtggagatgctgattcgtatgtcgcaccgcggtgcttgcggttgcgaaacgaacactggggatggagctggaattctcgttgcgcttccgcatgaattctaccaggaggttgtcagggagaatggatttaaattaccgcctcctggcgagtacgctgttggcatgttgtttttgccgacgtctgacactcgacgggaacagagcaaaaaagtattccaaaaggttgcggagtctcttgggcacgtggtcattggttggagatctgttccaactaataattcagggctgggcaagtcggctttggagacggaacctgtaattgaacaagtattccttacgcctagttccaggtcaaaagttgatttggagcgacagatgtacatactcaggagggtctcgatggtagctattcgtgcggccttgaacctccaacatggcagtgctagggacttctacatatgttctctgtcctcaagaactgttgtctacaagggtcagctgaaacctgttcagttgaaagattattactatgcagaccttggcgatgaaaggttcacgagctacatggccctgatacactcccgcttctcaacaaacacattcccaagctgggatcgcgcacaaccaatgcgaatcttaggtcataatggggagattaatacactcagaggcaatgtgaactggatgaaagcacgtgagggtctcttaaaatgcaaggagcttggtctatcaaagaatgagttgaagaagcttctaccaattgtagatgccagttcatctgattcaggagcttttgatggtgttcttgagcttctagttcgagctggcagaagtctccctgaagctgtgatgatgatgatccctgaagcatggcaaaatgacaagaacatggatcctcaaagaaaggctttgtatgaatacttctcagctcttatggagccatgggatgggccagctctgatttcatttactgatggccgctaccttggagcaacattggatcgcaatggcctgcgtcctggtcgtttctacgtcactcatagtggaagagtaataatggcaagtgaagttggtgtggtcgacattcctcccgaagatgtgtctaggaaaggaaggctgaaccctgggatgatgcttttggtggattttgagaagcatattgttgtagatgatgaagccttgaagcaacaatattctatggcgaggccttatggagaatggcttagaaggcaaaagattgaactcaaggacatagttgactctgttcctgaatctaaaaggaaagctccagccgttgctggggtggtggcagcatctgcagatgatgacagcatggaaaatatgggaattcatggtttactggcccctttgaaagcctttggttacactgttgaagctttagaaatgttgctgcttcctatggcaaaagacggtacggaggcccttggatcaatgggaaatgatacgcctttggctgtcatgtctgatagagaaaagctcacatttgagtacttcaagcaaatgtttgctcaagtgacaaaccctcctattgatccaatcagggagaagatagttacttcgatggaatgcatgattgggccagaaggtgatcttacagagaccactgagcaacagtgccatcgcctctcgctaaaaggtcctcttctgtccattgaagaaatggaagctgttaaaaagatgaattacatcagttggcaaagcaaaatcatagacataacttactccaagagacgtgggagaaagggactggaggaaaccttggataggatctgtgcagaagcaagcaaagctatcaaggagggctatacaactcttgtactgtctgatagagccttctcccctgagcgtattgctgtaagctctctcttggctgtgggtgctgtccatcatcaccttgtaagaaagcttgagcgcactcaggtggggctaattattgaatctgccgagccacgtgaggtgcaccatttctgtacacttgttgggttcggtgctgatgccatatgcccgtatctggcaatagaggcaatctggagattgcaagttgatggaaaaattccatccaaagcaaacggtgaatttttttcaaagcatgagctggtcaagaagtattttaaagcaagcaactatggaatgatgaaggttcttgcaaaaatggggatttcaactttggcctcctataagggtgctcagatatttgaagctttgggtctttcatcggaagttattgagaagtgctttgctggaactccaagcagggtggagggtgcaacatttgagatgcttgcccaagatgcacttgatttgcatgagtcggcatttcctaatcgtgtcttcccccctggtagtgcagaagccgttgcgctacctaaccctgggtcttatcactggaggaagggtggtgagattcacctgaacgaccctcttgctatggcgaagctgcaagaagctgccagaactaatagtgtggctgcatataaggagtactcgaggcgcatccaggaattgaacaaaagctgcaatttgcgtggtctcttgacattcaaggaagtggcagtcaaagtccctctagatgaagttgaaccggctagtgagattgttaagcggttctgcactggtgctatgagctatggatcaatttcacttgaggcacatacggcactggccatggcaatgaacagaattgggggcaagtcaaacacaggcgagggaggagagcaaccatctcgaatggagcctcttccagatggctctgtgaatccaaagaggagtgccatcaagcagattgctagtgggagatttggggtttcaagttactaccttactaatgctgatgagttgcaaataaaaatggctcagggggccaagcctggtgagggaggtgagctccctggccacaaggtgataggagatattgcagtgaccaggaattctactgctggtgttggactgataagtcctcctccacatcatgatatctattcaattgaagaccttgcccaattaattcatgatcttaagaattccaatcctgcagctcgaatcagtgtgaagttagtgtctgaggctggagttggagtgatagcaagtggtgtagtgaaagggcatgccgaccacgttttgatctcagggcatgatggaggaacgggggccgcaagatggacaggtataaaaaatgcagggctaccatgggaacttggtttggctgagacacatcaaaccctggttgcgaatgaccttcgtggccggacggttcttcagactgatggccaactaaaaactggaagagatgttgccatggccgcactcctcggagctgaggagtttgggtttagcactgctcccctcattacacttggctgcatcatgatgagaaagtgccacaagaacacctgccccgttggcattgctactcaagatcctgttctccgtgagaaatttgctggagaacctgaacatgtcattaacttcttcttcatgttggctgaggaagttagggaaatcatgtctcagctgggatttcggacgatgaaggagatggttggtcgttctgatatgcttgaggttgacagagaagtaaccaagaccaatgaaaagctggagaatattgacctctccttgcttcttagacctgcagctgagataaggcctgatgctgctcagtattgtgtccagaagcaggaccatggcttggatatggctttggaccagaaactcatttcccagtccaaagctgctttggaaaaaagtctccctatctatattgaaatgcctatttgcaatgtgaatcgtgctgttggaacaatgctcagccatgaggtgactaaacgctatcacttggctggactacctacagataccatccatattaaactctctggaagtgctggccagagtcttggagcttttctctgccctggcatcacattggagctcgaaggtgacagtaatgattatgttggcaaaggattatcaggtggaaaaattgtagtttatcctccaaagggaagtgaatttgatccaaaagagaatattgtgattggaaatgtggctctttatggggctacaagtggggaggcatacttcaatggaatggctgcggaaagattctgtgtgcgcaattctggggcaagagctgtagtagaaggggttggtgatcatggatgcgagtacatgactggtgggacagtcgttgtgctgggaaaaactggcaggaactttgctgctggtatgagtggcggcattgcatatgttctagatgtggatggtaaattccagtcatgttgcaatcttgagttggtagatcttgataaagtcgaggaagaggaggatattatgaccctcagaatgatgattcagcaacatcagcgtcatacaaacagccaattggcaaaagaggtgttagtagacttcgagagtcttctgcctaagtttatcaaggtattccccagggattacaagcgaattcttgcagacatgaaagcaggagaagctaccaaaaatgctcagaaaaatatggaggaagaacaggagcaagatgagggagagctgatggagaaaaatgcttttgaagagcttaagaagatggcagctgcatcaaccaatgccaaagccagtgcgacggtagaatctgttgaggctcccaagaggcctacgcaagttcatgatgccattaagcatggaggatttattgcttatgagcgcgaaggtgttaaatatagggaccctaatgttcggatgaacgattggaaggaagtcatggaggagtccaaaccaggtcccctgttaaaaactcagtctgcccggtgcatggactgtggcactccattctgccatcaggaaaactctggatgccctcttggaaacaaaatacctgagttcaacgagctggtataccaaaataggtggcaggaagcactagatcgactgttggagacaaataattttcctgagtttacgggccgcgtgtgtcctgcaccgtgtgaaggttcttgtgttcttggtatcattgagaatcctgtttccatcaagaatattgaatgctcgatcatagacaaggcctttgaggaggggtggatggtgccccggccaccccagaagagaacagggaaaaaagttgcgatagtgggaagtggaccggctggattggctgcggctgaccagctgaacaggatgggccattttgtgacagtgtatgagcgtgccgatcgaattgggggcctaatgatgtatggtgtgccaaacatgaagactgacaaagtggatgtagttcaacggcgagttaacttgatggctcaagaaggggtcaattttgtggtgaatgccagcgttgggaaggattcatcatactctcttgataggctccaaaaggaaaatgatgctattgttttagctgttggtgccacaaaaccaagggaccttcctgtacctggacgcgaattgtcaggtgttcattttgccatggagttccttcatgcaaacacaaagagcttgcttgacagcaatctcaaggatggtaactacatatctgcaaagggaaagaaggtagtggtcattggtggaggtgacactggcacggattgcataggaacatctatcaggcatggctgcagtagaattgtaaacttggagctgctttctaagccaccggagaagagggctccaggcaacccttggccacagtggcctcgcgtctaccgtgttgattatggccaccaggaagctgcagctaagtttgggaaagacccaaggtcttatgaagtgctaactaagcggtttattggtgatgaaaatggggtcgttaaagggcttgaagtagtgcgtgttgggtgggagaaggatgcaagtgggaagtttcagttaaaagaaatcgagggatctgaggaaatcattgaggctgatctggttttactggccatgggattccttggtccagaatcgacaattgcagacaagttaggtctagagagagatggcaggtcaaacttcaaggctgactatggccggtttgcgaccaatgtggagggagtttttgctgccggggattgccgacgcggtcagtctctggtggtgtgggccatctccgagggaaggcaagctgcggcgcaggtcgatagattcctcctgccaaaggaggaggatctcaccgtcgaccctgagaaccaagaggacttgacctctcagcagcaggacatcaacaagcggcaagaaggcagcggcaaattcactgtggtgacatagagattcgcggattctagtgttttgcgcggcgggggcaaacggtaaaaaccgagcccgtcgtgaatatgcgagaggagcctcctcttcagttcgtgctgtggatcggagacgctatcgtaaggcccgagggagggaacgaggaaggtggtggggaagattggcaggctgaacgtgcccatgtgatgctggctgaggcttcatatggttcgaagttattctacttctggggtgcggggcttaatcttagagtctttgtttgggtttaggtctgaaagtttgttgattgttacaaacgaataatgtacagttttctttgtcgacggacaaggtttataataggggcaagatgcttcgtatttcatcgaacagccgatgcactttgctattctttttttttgggtatcataaccggtagcttcttcattcgagacggttgccaaccttgtgtaacaagggatgatggaacgtgatgtgagtgagagtaccatatctgttaataagaaaagctgcagcacagcgttgtgaaac

SEQ ID NO: 8127 - DNA, 7244 bp, Citrullus lanatus
attagtggtaggggtataacttcgatactatatttgtggtattaatatcgtctgtgattttacaatgctggcgaaacctggttctcttcttaaactttcggctgctccttccacatttgataacacctctgttaagcctcaattgaatgttaaccctaaagctcgtttgggagcgagagctgctcgatgctctgctttgaagggaccaacgaggttgtcgaatgtgtcggagaagaagttctttggagcccgcttgagggctccgggatccggaagagtccagttctggcatttggacggtcctggccggtcaccgaagctccgactggttgtacggtcgggtctgtcggctgtgcctgagaaacctcttggcctttacgatccttcattcgataaggactcctgtggagttgggttcgttgctgaattatccggcgaaaccagccgcaaaacgattacagatgctttggaaatgttggttcgtatgtcacatagaggtgcttgcggttgtgaaacaaatactggtgatggagctgggattcttctggctcttccacacgagttctttaaagaggcacgaattttcgcggcaagagataatggcttcgaacttccaccggcgggacagtatgccgtcggtatgtttttcttgcccacgtcggattctcgtagagaagaaagtaaaaaagtttttgcgaaggttgctgaatcacttgggcattctgttcttggatggcggtctgtgcaaacagacaatactggattggggaagtctgccttacagacggaacctgtgattgagcaagtgttccttaccccgagtacgaggtccaaagttgacttggagaaacagatgtacatattaaggaggctttcaatggtagctattcgtgctgcactaaatcttgagcacggtggtgctagagacttctacatttgttctctctcctcgaggactattgtgtacaaaggtcagttgaagcctgtacagttgaaagattattatctggatcttgggaatgaaaggtttacgagctacatggccctggtacactcccggttctcaacgaacacttttcctagttgggatcgtgcccagccgatgcgtgtcttgggccacaatggagaaatcaacacccttagaggcaacgtgaattggatgaaggcacgtgaaggtctactaaagtgtaaggaactcggtctatcagaagacgagttaaaacatctattgcccattgtggatgccagctcctcagattcaggagcttttgacggtgttcttgagcttttaattagagctggtagaagtcttccagaagctgtcatgatgatgatccctgaagcatggcaaaatgacaagaatatggatcctcagaggaaggcgttgtatgaatacttctcatgtctcatggaaccgtgggatggaccagctcttatttcatttactgatggccgctatcttggagctactttggatcgcaatggactgcgtcctggtcgtttctatgtaactcacagtgggcgggttataatggccagtgaggttggtgttgtagacattgcaccggaagatgtttcacggaaaggaaggctcaatcctgggatgatgcttttagtggattttgaaaatcatgctgttgtagatgatgaagccctgaagcagcaatattctcttgctaggccttatggagagtggcttaaaaagcagaagattgaactgaaggacattgttggctcaattgataaacgtgaaacgacctctccagcaattgcaggagcgatgtctgctgttgatggcaatatgaaaaatatgggcattcatggcttactcgctcccttgaaagcctttggctacaccactgaagccttggagatgttactgcttcctatggcaaaagatggtgttgaggctcttggttccatgggaaatgatactcccttagctgtcatgtccaacagagaaaagctcacctttgagtatttcaagcaaatgttcgcacaggttacaaatcctcccattgatcccattagagagaagatagtgacctccatgcaatgtatgattggtccagaaggggacctgactgaaactactgaagaacaatgtcatcgtctctcattgaaaggtcctctcctatccattgaagaaatgcaagcaataaaacggatgaactataggggctggcaaagtaaagttttagatatcacatatccaaaataccttggtaggagaggattggaggagaccttggataggatttgtgctgaagctcatagtgcaattaaggaggggtatactacacttgttctttctgatagagcattctcaaccaagcgtgttgctgtgagctcgcttctggctgttggtgctgtccatcagcatctagttaaaaatctagaacgcactcaagttggtttgatagtggaatctgcagaaccccgcgaagtccaccatttttgtacacttgtggggtttggtgctgatgctatatgcccttacctggctattgaagcgatctggagattacaagttgatggaaaaattccggcaaaatcaagtggggaattccacaccaaggaggaattggtcaaaaagtacttcaaggcaagcaactacgggatgatgaaagttcttgcgaagatgggaatatcaactttggcctcgtataaaggtgctcaaatttttgaagcacttggtctttcgtcagaagtggttgagaagtgctttgctggaactccaagtagagttgagggtgcaacatttgaaatgctggctcgtgatgcacataatttgcatgacatggctttcccctctagagctttcccacctggtagtgcagaagctgtagcattaccaaaccctggggattatcattggaggaaaggtggggaaattcacttaaacgatccagttgccatagcaaaattgcaagaggctgctcgaactaatagtgtaaatgcctataaggagtactccaagcttgtccatgaattaaataaagcatgtaatttgagaggacttctgaaatttaaagagacaggggcgagtattcctttggatgaagtggagcctgctagtgaaattgttaagcggttttgcactggtgcaatgagttatggatcaatctctctggaggcgcacactactttggccatggctatgaacaaaattggtggaaaatcaaacacaggtgagggaggtgagcaaccatctcgaatggagcctcttcctgatggttcaatgaatccaaagagaagtgctatcaaacaggttgcgagtgggaggtttggagtttcaagttactacctcactaatgcagacgaactgcagattaaaatggctcagggggccaagcctggtgaaggtggtgaacttcctggtcacaaggtggttggtgaaattgcgaaaacaagaaattctacagctggggtagggcttatcagcccacctcctcatcatgatatctattctattgaagatcttgctcagttaatccatgatctcaagaattcaaacccagctgctcggattagtgtgaagttggtgtccgaagcaggtgttggtgtaattgctagtggagttgttaagggccacgcagatcatgtactaatttcaggtcatgatggaggtacgggtgcatcaaggtggactggcatcaagaatgctgggcttccatgggaactgggcttggctgaaactcaccaaactctggttgctaatgatcttcgtggtcgtacggtgcttcagacggatggtcaattaaaaaccggaagagatgtggctatagctgctttgcttggtgcagaggaatttggcttcagcactgcaccccttattacaatgggctgcattatgatgcggaagtgtcacaagaatacatgtcctgttggaattgctactcaagatcccgttcttcgagagaagtttgctggagaacctgaacatgtgatcaactttttctttatggtagctgaggaaatgagggagatcatgtcccagcttggatttcgtacagtcaatcagatggttggtcgttcagatgtgttagaagttgataaagaagttgcttggcaaaacgagaagctagagaatattgatctatctctgcttcttagacctgctgctgatctacgacctgaagctgcacaatactgcgtgcagaaacaagatcacggtctggacatggctttggatcaaaaactgattgcactttcaaagtctgctttagaaaagagtattcctgtgtacattgaaacaccaatcatcaatgttaaccgtgctgttggaacaatgcttagccatgaggtaaccaagcgttaccacatggctgggcttccttcggaaactattcacatcaaattcactggaagtgctgggcagagtcttggagcgtttctctgccctggcataatgctagagctggagggtgacagcaatgactatgttggcaaaggattatcaggtggcaaaattgttatttaccctccaaagggaagtttatttgatcctaaggagaacataatcataggtaatgtggctctttatggtgctaccagtggtgaggcctatttcaatgggatggcagccgaaaggttttgtgtacgtaattcaggggcaaaggctgttgtggagggtgttggtgatcatggatgcgaatatatgactggtggcactgttgtcattcttgggaaaactggaagaaattttgctgctggtatgagtggaggtgttgcttatgttcttgacatggatggagaatttgaatcccgatgcaatctagagcttgtggatcttgataaagttgaagaagaggatgatattttgactctaaaaatgatgatacagcagcatcagcgtcacacatcaagcaatttagccaaagaagtccttgacaactttgacaacctattgcctagatttattaaggtcttcccaagggaatataagcgtgttcttgcaaacaagaaagctcaagaagctgccaaagaggcttcagaaccatctgctaaagatgctgaagagtcggatgaggcagagttagttgaaaaggatgcgtttgaggagctcaagaaaatggctgctgcctccttgaatgggaattccaaacaggttgaaaagacagaagccccaaagagacctactgagatacctgatgctgttaagcatcgaggttttattgcttacgaacgtgagggagtgaagtacagggatcctaatgttagaatgggagattggaaggaggttatggaagaatcaaaacctgggccgctcttaaagactcagtcagctcgatgcatggattgtggtaccccattttgccatcaggagaactctggctgccctcttggcaataaaattcctgaattcaatgagttagtttatcagaataggtggcgtgaggccctggagcggcttcttgaaacaaacaacttcccagagtttactgggcgtgtctgcccagccccatgcgaaggatcttgtgttctgggcattattgagaatcctgtgtccatcaaaaacattgaatgtgccatcatagacaaggcctttgaagaggggtggatgactccaaggcctcctcctgtgagatccgggaaaagagtagctattgttgggagtggaccagctggcttggctgcagccgaccagctaaataaaatgggacacagggtaactgtgtatgaacgagctgacagaattggaggacttatgatgtatggagttcctaatatgaagactgacaaagtggatgtagttcagcggcgtgttaaacttatggcagaggaaggggtaaattttgttgttaatgctaatgttgggactgatccctcatactctctcgatcaacttcgtgcggaaaatgatgcactcgttttggctgttggtgccacaaaaccaagggatcttcctgtacctggacgagaactagctggagtccattttgccatggaatttcttcattcaaacacaaagagcttgcttgatagcaatctccaagatggtaaatacatttctgcaaaggacaagaacgtagttgtcattggtggtggtgacactggaacagattgcataggaacctctataaggcatggttgcagtagtattgtaaacctagagcttcttcctcagccgccacagaccagggctccaggaaacccttggccacagtggcctagaatattccgagttgattatggacaccaggaagcagctgcgaaattcggaaaagatccaagaacctacgaggttttgaccaagcggtttattggagatgagaatggggtagtgaaaggactcgaagtaattcgtgttcagtgggagaaagatgccaatggaaggttccagtttaaggaggtggaaggtagcgaggaaatattagaggcggatcttgttttactggcgatggggttcctggggcctgaatcgacgatagcagagaagctgggcgttgagaaagatgataggtctaacttcaaggctgagtatggccgcttctcaactagtgtagatggaatcttcgcagcgggagactgccgtcgaggccagtcccttgtggtttgggccatctctgaaggacggcaagcagctgctcaggtggacaagtatctctcaaaggaagacaagaaccttcctgtaggtgaaggaggctatgaaggcgttggtgaaagctcccaagattacaacaataggcaacaggatagtagtagtagcagcagacatacagtaatgacataggtgataaaaagctttttgtccaaacttctctaaagtgaagaaaggaaaaaattgatacttttggctgaagatttgatatttcttctactcaataaaagccaattccagagggagcaccaaaaaggcaaggtgtgcagcatgtgagaattgggtttctgctgttggctcttatatttatatatttagaggggaaaggtaaaggaatgaccaggtgtggagatagggttatatattattagtagaggtttgtgatatttgtagtactttggtggtttcaatttgtctcttatcatgttgataggtgtcttttttttaaaaaaaagccccaatccccactttcaagttttagatagttggctctgtttttctcaaaatgaataatgtacagttggtttattttccccttttgataattgttattggttgttggcgagttaagatgttcttgcaccttgaagttaatggaatcttaatatcagcattttcggtcaagatggctattaaaatc

SEQ ID NO: 8128 - DNA, 7243 bp, Brassica rapa
ctcctctataaatataatacctaagcaatgcaaatactcacaaaaactctctccccctagccgccacctccccccctctgccgccttgctcccagactgatctgagtattgttatctcatcagctccttttggtgtttgtttacataaattcgatctcgtgatattcctaatagaacaaacgaatctgatattcatccattaaaacaaaaaaaaactcttcactgttgttttctcgagaagagagaaaaaaatgtcggcagcttcttcgtcgagctcccttctgcagatccgaaacaaccgcttgtttcccgcccgatctctgaggagagactccacctccgtttctcaactggccgtcgcgtctggcgtcagccgcaggggctcatgttccgtgaagaatccgttcatggggacccggatcaagagatccggatccgagacgcttcagctctggagatcggacggtcccggccgatctccgaagctgaggacggtggttaagtcgtcgttctccggtgttccggagaagccgatgggtctgtacgatccttcgtttgataaagactcttgcggagtcggttttgtcgcggagttgtccggcgagactagtcgcaaaacggtgacggattcattggagatgttgataaggatgactcacagaggcgcgtgtgggtgtgagagcaacactggtgacggcgctggtattcttgttggtatgcctcatgagttctatgctcaggctgctaaagatctaggctttgtgcttcctccggctggaaagtatgctgttggtatgttcttcttaccaaccgccgagtccaggagagatgaaagcaaaagtgttttcaccaaggttgctgaatcacttggtcattcagttattggatggagatcagttcctactgataactctggtttggggaagtctgctttgcagacagagccgatcatcgagcaagttttcctcactcctacaactaaatcccaagttgaccttgagcaacagatgtacatccttagaaggctttccatggttgctatccgagcagcgttgaaccttgaacatggtgccatgaaggacttctacatctgttctctatcttctaggactgttgtctacaaaggacaactgaagcctgatcagctcaaggaatactactatgcggatctagggagtgaaaggtttacgagctacatggccctggtccactctcggttctctaccaatacatttcccagctgggatcgtgctcagcctatgcgtgttttgggccacaacggagagattaatacccttaggggaaacgtgaactggatgagggcacgtgagggtctgctcaagtgcaaggaacttggactatcaaagcaggagttgaagaagcttctacctattgtggatgttagctcttctgactcaggtgcttttgatggtgttcttgagcttcttgtccgagctggaagaagtcttcctgaagctgtcatgatgatgatccctgaagcatggcagaatgacaaaaacattgacccaagcagaaaatcgttctatgaatacttatctgcgctaatggagccatgggatggacctgctctcatctcatttactgatggccgctacttgggtgccacattggaccgtaacgggcttcgtcctggtaggttctacataacccacagtggaagagtcatcatggctagtgaagttggggtggttgatgtaccacctgaagatgtgatgaggaaaggaagacttaacccaggcatgatgcttcttgtcgattttgagaagcatatcgttgttgatgacgatgccttgaagcaacagtattcccaggcaaggccctatggcgaatggcttgaaaggcaaaagattgagctcaaagacatcattaagtcagttccggagactgaacggattgctccaccaatttctggggctgtaacggcgtctagtgatgatgactcaatggagagcatgggcattcatggtttactgtctccactaaaagcctttggctacacagttgaggccttggagatgctgctgcttccgatggctaaagacggcactgaagcacttggttctatgggaaatgatgcacctctagctgttatgtcgaacagggagaagttatgttttgagtacttcaagcaaatgtttgctcaagtaacaaatcctccgatcgatcctatccgtgagaagattgttacttcaatggagtgcatgattggcccagaaggtgatctaacggaaacaactgaggagcagtgtcaccgtctctctctgaaaggtcctctattgaccattgaagagatggaatctgttaagaagatgaactacagaggctggaggactaaagttcttgatataacttatcctaaagaagaaggcacaaaagggttggagatgaccttagaccgaatctgtgctgaagcaaatgaagcgatcaaggagggatacacattactagttttgtctgatcgagctttctcttcaacgcgtgttgctgtgagctctctcttggctgttggcgccgttcatcaccacctggttaagagccttgcgcgaactcaagttggtttgatagtggagtctgccgagccacgtgaagtgcatcatttctgcacactcgtcggattcggagcagatgctatctgcccatatctggctgtagagaccgtccatagacttcaggttgatggcaagataccacctaaatccaacggggagttccactccaaagaagagcttgtcaagaagtattacaaggctagcaactatgggatgatgaaggttctcgccaaaatgggaatctctaccctggcctcatacaagggtgctcaaatcttcgaagctcttgggctctcctctgaagtcattgagaagtgtttcgccggtaccccaagcagagttgaaggagctacgtttgagatgcttgcacgtgacgcgcttcttttgcacgagatggcttttccagcacgtgcctatgcacctggaagcgcggaagcttcagcactctccaaccctgggaactatcactggaggaagaacggggagattcatcttaacgaccctctcgcaattgctaagttgcaagaggcagcaaggactaacagtgtagccgcctacaaggagtactcgaagcgtattaatgagttgaacaagcagagtaacttgcgtgggctcatgaagttcaaagaagcagatgtcaagattccacttgatgaagtggagcctgccagtgaaattgttaagcggttctgcactggagctatgagttatggatcgatatcgctcgaggcacatcaaacgcttgcaatggctatgaacaaacttggaggaaagtcaaatacaggtgagggaggagaactgccatcccgtatggagcctcttccagatggttcaaggaaccccaaaagaagttccatcaaacaaattgctagtggaagatttggtgtttcgagctactatcttaccaatgctgacgagttgcagataaagatggctcagggagccaaacctggggaaggtggagagctacctggtcacaaggttataggagacatagctatcaccagaaattccaccgctggtgtggggcttatcagcccacctcctcatcatgacatctactctatcgaggatcttgcccagctaattcacgatctcaagaatgccaatcctggggctcgtatcagtgttaaacttgtatcagaagctggagttggagttattgctagtggtgtggtgaagggtcacgctgaccatgttctgatagcaggtcatgatggtggtaccggtgcctctcgttggactggtattaaaaatgctggtcttccgtgggagcttggtctagcagagacgcaccaaacccttgttgctaatgaccttcgtggccgtactgttcttcagacagatgggcagctgaaaaccggcagagatgttgcggttgctgctcttctcggtgctgaagagtttggtttcagtactgcgcctcttattacactcgggtgtatcatgatgaggaagtgccacaagaacacgtgccctgtaggaatcgctactcaagatccagttctccgtgagaagtttgccggggagcctgagcatgttatcaacttcttcttcatgcttgctgaggaagtcagagagatcatgtctggtcttggtttccgaactctaaccgaaatgatcggtcgtgcagatatgcttgagctagacagggaagttgtgaagaacaacgataagcttgcgaacatcgatctctctcttctgctcagacccgctgctgagattcgtccaggtgctgctcagtactgtgtccagaaacaagatcacggcttagacatggccttggatcaagagctgattgcgttgtccaaatctgccctagagaagtctcttcctgtgtacattgaaactcccatctgcaacgttaaccgtgctgttgggacaatgctgagccacgaggttaccaaacgctaccacttggctgggctaccaaaggatacaattcacatcaagttctcaggaagtgctgggcagagtcttggagctttcttgtgtcctggtattacgctagagcttgagggtgatagcaacgactatgttggtaaaggtctctccggaggtaaagttgttgtctaccctcctaaaggaagcagcttcgatcccaaagaaaacattgttatcggtaacgtggcgctttacggtgccactagtggtgaagcctactttaacgggatggcggctgagagattctctgttcgtaactctggtgctcaagccgttgtggaaggtgttggtgaccacggttgcgagtacatgactggtggaaccgttgtggtgcttggaaagactggtagaaactttgctgctggtatgagcggtggtattgcttacgtccttgacgtggatgggaagttccacacgagatgcaaccttgaactcgttgatctggacaaagttgaagatgatgaagataaaatgacgctcaagatgatgatccagcagcatcaacgacacacaaacagccaacttgcacaagaggttctcggagactttgagaatctgcttccgaagtttatcaaggtcttccctagagattacaaacgtgttttggcggccatgaaagacgaggaagtctccaagcaagcgattgatcgtgctgctgaagaagctgaggagatggaagagaaggaagttgaggagaaggacgcctttgcagagctgaagaacatggcagcagcagcctcttccaaagaggttgtgtctggaaacggagctgccactgaagctccgaagaagccttctctggtagataatgctgttaagcatcgtggcttcattgcttatgagcgtgagggagttaagtacagagatcccaatgttcgtatgaatgactggaacgaagtcatggaggaatcaaagcccggaccgcttctcaagactcagtctgctcgttgcatggactgtggaactcctttctgccaccaggagaactctgggtgtcccttaggtaacaagatccctgagttcaatgaacttgtttaccaaaacagatggcaagaagcgctgaatcgtctacttgagacgaataacttccctgagtttactgggagagtatgcccggcaccgtgtgaaggttcatgtgttcttggtataatcgagaaccccgtttctatcaagagtatcgagtgttctattatagataaagcctttgaggaagggtggatggtaccaagacctcctctcacgaggacagggaagaaagttgcaattatcggtagtggtccggctggacttgctgctgccgaccagctgaacaaaatgggccactcggtaacggtctatgagcgtgctgatagaattggtgggcttatgatgtatggagtcccaaacatgaagaccgacaaaattgacatagttcagcgccgggttgatcttatgaccaaagaaggtatcaactttgtggtcaatgctaacattggaaaagacccgtcttactctctagatggactcaaggaggagaatgatgcaatcgttctcgctgttggctccactaaaccaagagatcttccagtgcctggtcgtgacttaactggtgttcactttgctatggagtttcttcatgcaaacaccaagagcttgttggacagcaatcttgaagatggcaattacatttccgccaagggtaagaaggttgtggttattggtggaggtgataccggcacggattgtatcggtacctctatccgccatggttgcaccaacattgtaaacctagagcttcttcctcagccaccatcaacgagagctcctggaaacccttggccacagtggcctcgtgtgttccgtattgattacggacatcaagaagctgccaccaaatttggaaaagaccctagaacctatgaggtcttgaccaagaggttcataggagatgacaacggaaacgtgaaagggcttgagatcgtgcgtgtgagttgggagaaggatgaatccggaaggttcaatttcaaggagattgaaggctctgaggaaataattgaagcggaccttgttttcttggcaatgggattccttggacctgagcctacacttgctgagaagctaggactagaatgcgacaacaggtcgaactttaaggcagagtatggcaggttctccacaactgtgggaggtgtctttgcagctggtgattgtaggagaggccagtctttggtggtttgggctatctcagaaggacgtcaagctgcatctcaggtggacaaattcctcagcaaaaacgaggatgacctagttgacgcaacggtaggacaaaatctcaacgaggtgaagcaccaacactaggaacaagagaggaagccttgaatctgaagcaaaagcttaggttgttttggtcttttgtttattatcgttcatatagtaataatgaatgtggattacatttttcttggtaggggtttcttagctttattttgttaatgcttttggaattgaatttcttttgttttctgctttggatttgaacataagggaatggtaatgcatagttcctggttgttcagtcttttctttttctttgtttattttaagcttcttaatcttaagcaattgtgaatcttatttacatcagcaaggactagttttacaatatatagtaaatcttatggtgacatagttccttttctgttattatatcggacaatgtagttctatgagatgaccttacgaaatgttca

SEQ ID NO: 8129 - DNA, 7434 bp, Fragaria vesca
tcctcctgaaatatttcccgtttccgttttctcaaccggaacggcttcgttttcagctctcacggatctcacaggggagtgtgtgtctcagcctcgctctctagtccggatctacaaacccgtctccgtgttaatctgctgaaaaatctcagtctcctgaaaaaaatcaaatcaggagagtctaaaacgaaattaaatacacacagaaattcactggtagactactattatatagcggtgtactgttatatatatacatatataactctgattctgatttgtggaaacgataatgttggcggcgagctccggttccgttctccaactccgaaccaagccttccgtcctcgcctcgccgcagctcaatgcctcgccgattgcgcggctcagcaccggcagagccgccacctctcggtcggcgtcgaaagcaatagcgaacaagttcttcgggactcgattgagagcagccgccggatccgagaggcttcacctatggcgatccgaaggtcccggccgttcgccgaagctcaaggtggtggtccggtccatgctctccgccgtgccggagaagccgcaggggctgtacgacccgaagatggataaggactcgtgcggtgtcggcttcgtggcggaattgtccggtgaaagcagccgtaagacgattacggatgctttggaaatgctggtgaggatgacacatagaggagcttgtggatgtgaaacgaacactggtgatggagctggtgttcttgtggcgattcctcacgatttctacaaggaggctgccaaagatattgggtttgagcttccagcgctgggtgagtatgctgttggtatgctctacttgccaacatctgagagtcgtcgagaagagagcaaaaatgtgtttacaaaggttgccgagtctcttgggcataccgttctcggttggcgatctgttccaactgataactcagatttggggaactctgctctccagacggaacctgttattgagcaagtgttccttaccccaactccgaggtcaaaagttgatcttgagcgccagatgtatatacttagaagggtttcaatggttgccattcgtgctgcattaaaccttcaatatggtggtgctaaagatttctacatatgttcactttcatcgaggacggttgtttataagggtcagctgaaacccgaacagctgaagggttactattatgcagatcttggcaatgaaaggtttacgagctacatggccctggttcattcacgattctcaacaaatacatttcccagctgggaccgtgctcagcctatgcgtgtcataggccacaatggagaaatcaacacccttagaggaaatgttaactggatgaaggcgcgtgagggactgctcaagtgtactgaacttggcctttcaaaaaatgagttgaagaagctgttaccaattgtggatgccagctcttctgattcaggagcatttgatggtgtccttgagcttctggttagagctggcagaagcctccctgaagctattatgatgatgattcctgaagcatggcaaaatgacaagaacatggatcctgataagagagcactgtatgaatatttttcatctctcatggagccatgggatgggccagctctaatatcatttactgatggacgctatctgggagctacattggatcggaatggactccgaccaggtcgattttacgtcacccacagtggacgagttattatggcgagtgaagttggggttgtagacgtacccccagaagatgtctgcaggaaaggaagacttaatcctggaatgatgcttttggttgattttgagaatcatatagtggtcgatgatgaagccttgaagaagcaatattcactggcgaggccatatggggagtggcttaaaaggcaaaagattgagctcaaggacatagttgattctgttaatgaatctgacagggtccctccatccatagctggagttgctcctgcatctactgatgatgaggacatggaaaacatgggagtccacggtttactggcaccattgaaggcttttggttacacagttgaagccttggagatgttgttgcttcctatggcaaaagatggtgtagaggctcttgggtcaatggggaatgatacccctttggctgttatgtccaatagagaaaagcttacatttgagtatttcaagcaaatgttcgctcaagtaacaaaccctccaattgatccaatcagagagaaggtagtcacttctatggaatgtatgatcggtccagaaggtgatctaacagaaaccactgaagaacaatgccatcgtctctcactcaaaggtcctcttttaaacattgaagaaatggaagcgataaaaaaaatgaactatagaggttggcgctgtaaggttcttgatataacgtactccaaggaacgtggtagaaagggattggaggagaccttggataggatctgtgctgaagcacgtgaggcaattaaaaagggatataccacactggtgctttcagacagagccttctccccaaaacgtgttgctgtaagctcactcttggctgttggtgctgtccatcaacatctagttaaaaatcttgagcgcacaagggtagggttgataattgaatctgctgagccgcgtgaagtacaccatttctgtacgttagttggattcggtgcagatgctatttgcccctacctggctgtagaggccatttggagactgcaggttgatggaaagatcccaccaaaatctaatggaacaatatattccaaggctgaactggttaaaaagtacttcaaggcaagcaactatggaatgcagaaggttcttgccaagatgggcatatctactttggcctcttacaagggtgcacagatttttgaagctttgggtctttcctctgaagtgattgagagatgctttgtgggaactcctagtagagtcgagggggcaacatttgagatgcttgctcgtgatggacttcatctgcatgatttggcattcccctctcgggcttttcctcccggtagtgcagaagctgtggcactaccgaatcctggggattatcattggagaaaaggtggtgaggttcacctaaatgatccttttgctatttccaagcttcaggaggctgccagaactaacagtgtggctgcttataaagaatattccaagctcattcaccaattaaataaagcctgcaatctccgtggtcttctgaaatttaaaaacacagagcagcaaattcacttggatgaagtagaacctgccagtgagattgttaaacgtttctgtactggggcaatgagttatggatcaatatcattggaggcacacactacattggccattgctatgaacagaatggggggaaagtcaaatacaggtgagggaggtgagcagccctctcgtatggagcctcttcccgatggttcaatgaatccaaagaggagttcaattaagcaggttgcaagtgggagatttggagtttcaagttactatctaacaaatgctgatgaactccaaataaaaatggctcagggggccaaacctggtgaaggtggtgagcttcctggccacaaggttattggagacattgctgttactaggaattccactgctggtgtgggacttatcagtccacctccccatcatgatatctactcaattgaagaccttgctcaactaattcatgatcttaagaatgctaacccaggggctcgaatcagcgtcaagttagtatctgaagctggtgtaggtgtagttgctagtggagttgtgaaggggcatgccgatcatgttttaattgccggacatgatggaggcactggggcctctagatggactggcattaagaacgctgggcttccgtgggaacttggcttggctgagacccatcagaccttggttgctaatgatcttcgtggccgcacagttctccagacagatggccaactaaagaccggaagagatgtggccatagccgcacttcttggtgctgaagagtttgggttcagcacagcacccctcataaccctcggctgcattatgatgcggaagtgccacaagaacacctgtcctgttggtattgcaactcaggatccagtacttcgtgagaagtttgctggagaacctgaacatgttatcaactttttcttcatggtagctgaggaggtgagagagataatggcacaacttggttttcgaactctaaatgaaatggttggtcgttccgatatgcttgaagtcgataaagaagttactaaagacaatgaaaagctgaacaacattgatttatccctgttacttcgacctgctgcagacattcgacctgaagctgcacaatattgtgttcagaaacaggaccatgggttggacatggctctggaccacaaacttatttctctttctaattctgctatagaaaaggctgttcctgtatattttgaaactccggtttgcaatgtgaatcgtgctgttggaacaatgcttagtcatgaggtgaccaaacgttacaataggcaagggcttcccgcagacaccattcatatcaaattcaatggaagtgcaggccagagccttggagctttcctctgccctggcatcacgcttgagcttgaaggtgacagcaatgattacgttggtaaaggattgtctggtggcaagattattgtttacccccccaaggaaagcaagtttgacccgaaagaaaacattgtcattggtaatgtagctctttatggtgccactagtggggaggcatatttcaatggaatggcagcagaaagattctgtgttcgtaattccggtgctcgggcagtagttgaaggtgtgggtgatcatggctgtgagtacatgacaggtggcactgttgttgtgcttgggaaaactggcaggaactttgctgctggtatgagtggtggcatagcctacgtttttgatgtcgatggaaaatttttatccagatgcaatcctgagcttgtcgatcttgacaaggttgaagaagaagaagatattctgactcttaggatgatgatacagcagcatcaacgccatacaaaaagcctgctggccagtgaagtactggctgattttgagaatcttttgcctaaattcatcaaggtaatccccagagagtacaagcgtgcacttgcaaatctgagggaggaggcctccaaacaggcagtcgaggacgctgatgaagaggctgagaagcaagaggaggaggagcttaaactgaaagagaaagatgcatttgaagaacttaagaagatggcatctgcatctttaaatgaacttaagaacatggcatctgcatccttaaatgggaattccaatcaggtaaaagttcaggtagaagatgctgaaacattgaagaggcccaaagaggtcagcaaagctgttaaacaccggggtttcatttcttatgagcgtgagggcgttcaatacagggatcccaatgttcggatgaatgactgggacgaagttatggaggaaactaaacctggcccacttgtgaatactcagtcagcccgttgtatggactgtggcactcctttctgccatcaggagaacactggttgtcctcttggtaacaaaatacctgagttcaatgaattggtgtaccagaataggtggcatgatgcattagagagacttctcgagacaaataatttccctgagtttactggtcgagtatgtccggcaccttgtgaaggttcatgtgttcttggtatcattgagaatcctgtctctatcaaaagcattgaatgtgcaatcatagacaaggcttttgaggaaggttggatggtaccacgacctcctgtcaagagaactgggaaaaaggttgccatcgtcggaagtgggcctgctgggctagctgctgctgatcaactaaacagaataggtcatacagtgacagtttatgagcgtgctgatagaattggagggcttatgatgtatggagtgcctaatatgaaagctgacaaagttgatgtagttcagcggcgggttaaccttatggccgaggaaggtgtcaactttgtggtcaatgctaatgttggaaatgactcatcctattcgtttgaccgccttcgagaggagaacaatgcgatcattttagcagtaggcgcaacaaaaccaagggaccttcccgtgcctgggcgagagctgtcaggagttcattttgctatggagtttctacacgcaaacaccaaaagcttgcttgatagcaatctcgagaatggaaactacatttctgccaagggtaagaaggttgtggtcattggtggaggtgacactggcactgattgcattggaacctctgttcgccatggctgtactgacatcgtaaatttagagcttctccctcagccaccacaaacaagggctccaggaaacccttggccgcagtggcctcgtatcttccgagtagattatgggcacgcagaagttgcagccaagtttggcaaagatccaagaacgtatgaggtgctgaccaagaggtttgtgggagatgagaatggggttgtgaagggaatcgaggtagtacgtgtcaaatgggagaaggatgctactggcaagttccaatttaaggaaattgagggctctgaggagataattgaggcggacctcgtccttctagcaatggggttccttggacccgaggcggcgattgcagagaagttgggtttggagtgtgacaatcgctcaaacttcaaggctgattatggtcggttctcaaccaatgtggatggggtctttgctgctggggattgccggcgtggtcagtccctggtggtgtgggcaatctcagagggacggcaagcagctgcacaggttgacaactacctctgcaaggaagaagaggaccacacagacagcaactcaagccctgaatctgatctcttgaagcggcatcaagaaatcaccaagagccaaaagacagtggcaagcacatcgtagacgtagatgatgatgatcaagtactcatgattctaaattagagaaccaagacagagcaacacagatggcatcttttttcattttgttagtgtgacagacatacagggatttttcaaacgtggttgtttcatggatgatccactcggtgatgcttttccctgtgatggagctgagactggagggagcatcaagtggccgttcaatggggcaacaactagcttttattcgcataatggagtggggtattctcatttcgccggagtcgggtattataggtcgtaggataattattgtctatagttttcccctggctcatttgcgtggttgttttaaaggaataatgtatagttttggttcttcatcaatgatttagaatcaatgaagcatatatggaaattattaggttgttttccatcggccacttctgtgttgtgtcgcttttctgcagaaactaaacgttc

SEQ ID NO: 8130 - DNA, 7192 bp, Papaver somniferum
aaaaaatcatcagagattagattgattcttaataaatgatttcaaaagagaatcaggttttctgagctgaaaaggtctttttagatctgtttaaaaaatcgtcgaaaaattacttattcgaaagttctgttcagaaaatcttatacctgatctggtgttagtatcggtatttatccgtgagcttgaaaaacaaaaaaaaacgacagaaaatcaaaactgaatacaaaaaccagattagagcgttaaaggaaacttcattggagttgaagatctttgattttgaaccgatgtcggcactatctggttctgtttttcaagctcgaaacagttctattgtcttaccatcatcaactcgttgttctgttaataatgatcaatggaatgttgttgttcctttgagacgtaatggatcttcatcatcaacgactcgttgttcttctaatacaagaagagagaatctttttacagagaacaagtttttaggaacacgattgagatcttcacctgaaagatttcagttgtggagatcagatggcccaggacgttctccaacacttagagttgttgtacgctcgatgttatcacaagttcctgaaaaaccacttggtttgtacgatccttcttttgataaggattcttgtggagttggatttgttgctgagttatcaggaataagtagccggaaaactgttactgatgctatagagatgttggtaaggatgacacatagaggtgcttgtggttgcgaacaaaacactggagatggtgctggaattcttgttgctcttcctgacgactttttcattgaggtcgctaaggatgttggatttcagctaccaccagcaggggagtatgctgttggcatgttgtttatgccaacatctgactctcgaagggaagaaagtaaaattgttttcacaaaggttgcggagtcacttggacatgaagtactcgggtggcgtactgtgccaacagataattctggtttgggaaagtctgctctacaaacagaacctgttgttgaacaagtattccttgcaaaaagtcctagatcgaaagctgattttgagcagcagatgtacatattaagaagggtggctatggtggctatcagagctgctttgaatctccagcatggtggagttaaagacttctatatatgttccctttcctctaggactattgtttacaaaggtcaactaaaacccgaccagttgaagaattactactatgcagaccttaacaatcaaaaatttacgagctacatggccctggtgcattctcgcttctcaacgaacactttccctagctgggatcgtgcccaacctatgcgagtcttgggccataatggtgaaataaacacgcttcgaggcaacgtgaactggatgaaggcacgcgaaggtttgctcaagtgcaaggagcttggcttgtcaaagaatgagatgaagaaacttcttcccattgtggatgccagctcgtctgattcaggagcatttgatggcgtccttgagctcctagttcgagctggtagaagtcttcccgaggctgtgatgatgatgattcctgaagcatggcaaaatgacaagaatatggatcctgagcggaaggctttgtatgaatatttttctgctcttatggaaccgtgggatgggcctgctcttatatcattcactgatggccgttatcttggagccacattggatcgaaatggattgcgtcctggtcggttttatgttacccatagcagacgagttgtgatggcaagtgaagttggtgttgtagacatacctccagaagatgtatgcaggaaaggaaggttaaatcctggcatgatgctcttagtagattttgagaagcatattgtggtggatgatgcggctcttaagaagcaatattcagcagctaggccatacagagaatggatcagtaaacagaagataacactaaaggacatcgtcagttccctcaatgcatctgacatggtcccgccacttatttctggtgtggtgcctgtatctaaaatggatgaaagcatggaaaacatgggagttcgtggtttgttggctccactgaaggcttttggttacactgtagaaggattagaaatgttgatgttgccaatggccaaggatggtactgaagccctcggttcaatgggtaacgatgctcctttagctgtgatgtcaaacagggagaaacttgcatttgagtatttcaagcagatgtttgctcaagtaacaaacccgcctattgacccaattcgtgagaagatagttacgtcgatggagtgcatgattggtccggaaggcgatcttactgagaccactgaagagcagtgtcaccgcctttcacttaaaggtccacttctttccattcaagaaatggaggccattaaaaagatgaactacagagggtggcgtagcaaggttgttgacataacttactccaagatccgtggtaagaaaggtttggaagagactttggataggatctgcggtgaagcacatactgccattaaagaggggtatacgacattggtgctttccgatagagctttctcttcgaaacgtgttgctgtaagctccctcctggctgttggtgctgttcatcaacatttggtctcaaagcttgagaggactcgaattgggctgatagtcgaatctgcagagccacgtgaagttcaccatttctgtactcttgttggatttggtgctgatgctatatgtccatatttagccatagaggctatttggagattacaaattgatgggaagattccatctaggtcctccggtgagttgcacaccaaggaagagctggtgaagaagttcttcaaagcaagcaactatgggatgatgaaggttcttgctaaaatgggtatctcaaccctggcctcttacaaaggtgcacagatatttgaagctcttggtctctcatctgaggtgatccagaagtgtttcaatggtactccaagcagagtcgagggtgcaacatttgaaatgcttgctagagatgctcttcgactgcatgaacttgcatttccagcccgagttttgcctgctggaagtgcagaggccgttgcactgcccaatcctggagattatcactggaggaagaacggtgaggtgcatcttaatgatccacttgctatatcaaaactgcaagaggctgcaaggacaaacagtgtggccgcgtataaggagtactcaaaacgcattcaggagctgaataaatcgtgtaacttacgagggatgttgaaattcagagattcagaagtgaaagttccattggaagaggttgaacctgctagtgagatagtgaaacgcttttgcactggagccatgagttatggatcaatttctttggaggcacacacatccttggctgttgccatgaatacgattggggggaagtctaatactggagagggaggtgaaaacccatcccggatggagcctcttcctaatggttcaatgaacccgaagagaagtgcgatcaagcaagttgcaagtggaagattcggagtttcaagctactatcttacaaatgctgatgagatacaaatcaaaatggctcagggggctaagccaggtgaaggaggagaacttccaggccataaggtcattggagacatcgcgatcactagaaattctactgctggtgtgggcctcatcagtccaccacctcatcacgacatctactccattgaagatttggcgcaattgattcacgacctcaagaatgccaatccgggggcccgaatcagtgtgaagcttgtatctgaagctggagttggagtaattgccagtggagttgttaagggtcatgcagatcatgtcttgattgcaggtcatgatggaggcacaggagcttcccgctggaccggtattaagaatgctggactcccttgggagcttggtcttgctgaaacccatcaaactctcgttgcaaacgatcttcgcggccgaactactcttcaaactgacgggcagttgaagacaggaagagatgtggccattgcagcacttcttggtgcggaggaatttggtttcagcactgctcctcttataaccctgggttgcattatgatgaggaagtgccacaaaaacacctgccccgttggtattgctacacaagatcccgttctccgtgaaaaatttgctggtgaaccagaacatgtcatcaatttcttctttatgcttgcggaagagatgcgagaaattatgtcggaccttggatttcgaacaatcaacgagatgattggtcgatcagacatgttggaggttgataaagaagttgtgaaatgtaatgaaaagctggagaacattgatctttctctgctcctaaggcctgctcgtgatattaggcctgaagctgcacaattttgcatccaaaagcaagatcatggtttggatatggctttagaccgaaagcttataaccttgtctgaacctgcactagagaaaaaatttcctgtatatatagatgtaccaattaagaatgtaaatcgtgctgttggcaccatgctcagccatgaagtaactaaacgccatcacttggaagggcttcctaaggacaccattcacatcaagcttagtggaagtgcaggtcagagccttggagccttcctctgccctggcatcatgctagagcttgaaggtgacagcaatgattacgtcggaaaaggattatcaggtggtaagattgtagtttaccctccaaggaacagccggtttgatccaaaggagaacatagtgatcggtaatgttgctctctacggagctacttgtggtgaggcctattttaatgggatggcagctgagagattttgtgttagaaactcaggggctaaggcagttgttgaaggtgttggagatcatggttgtgaatacatgactggtgggacagttgttgtgctcggtaaaactggtaggaattttgcagctggtatgagtggtggaatagcatacgttctcgacagggatcagacgttcagcactcgatgcaatcttgagttggtggatcttgataaagttgaagaggaagaggataaatcgactctgatgatgatgatccaacaacatcaacgtcatacaaagagtgaactagccaaagaagttcttgcagattttgataatcttctgtccaagtttgttaaagtgttcccaagagattataagcgggttcttcaggacatgaaggcacagactggcaaaaaagaagccgatccacaagctccaagtgatactgaggacccagacgaagctgagtggaaggaaaaggatgcctttgaagagcttaagaaattggcagcagctggaaggaaagcaagtgaggtgaaagaagcaggagaagaagaagaagaatccccagccaggcctactagtgttactggtgcagtaaagcatcggggcttcattgcttatgagcgtgagagcatttcatacagggatcctacagttcgtatgagtgactgggacgaggttatgatagaaagcaagccaggaccactcttgaaaacccaatctgctcgttgcatggactgtggaactcccttctgtcatcaggaaaacagtgggtgtcctcttggaaacaagataccggagttcaatgagttagtgttccaaaataggtggcgtgaggcgctcgatcggctgttggagacgaacaatttcccagagttcactgggcgtgtgtgccctgctccatgcgaaggttcttgtgttctcggcatcatcgataaccctgtttctattaaaaatatagagtgctccattatagataagggctttgaggaagggtggattgtacctcgacctccagtcgtgaggacaggaaagagggttgctgtcgttgggagtggaccagctggtttagctgctgcagatcagctgaacaaaatgggccatctggtgactgttttcgagcgtgctgatagaattgggggactgatgatgtatggagttcccaacatgaaggctgataaaatgggtgttgttcagcgacgcgtgaacctaatggctgcggaaggcatcaattttgtggtgaacgctagtgttggaaacaatcccatgtactctcttgaaaagcttcgaaacgaacatgatgcaattgttctggctttaggagctacaaaaccaagggatcttcctgttcctggacgagaactgtcaggagtgcattttgccatggagtttcttcatgcaaacacaaaaagcctgctcgatagcaatcttgaagatggaagatacatttctgctgaaggaaagaaagtagtagtcattggaggtggcgacactggtactgactgcatagggacatccattcgtcatggctgtaccagcgtcgtaaatctggagcttctacctgagccacctcgtaccagagctccaggcaacccttggccacagtggccacgtattttccgtgtggattatggtcaccaagaagcagcaaccaagtttggcaaagatccaaggtcatacgaggtcttgaccaagcggtttgttggagatgagaatggagttatcaaagggttggagttggtccgagttcagtgggataaggatgccagtggaaagtttcagtttaaggaggttgagggatcagaggaggtaatagaggctgatcttgttctccttgctatgggtttccttggacctgaatcgactgttgctgatggactaggattggagaaagacaaccaatcaaactacaaggcggagtatggtcggttctcaacaaacgttgaaggagtattcgcagcaggggattgccgaagaggtcaatctttagtagtgtgggccatttctgaaggacgacaagctgctgctcaagtagacaaatacctgatggaaggtgaagatgaagccgaccacaacagcatcagtgatgataacctcaagaaccaacttgagagggcatacaaaccataattaccctcattaccctgatagttttctaccctttttttttcttcgtgaaatagaaataactttttgatccataatgaagtgtggatactataaacgcagctctgtgggctttatttttctcggtaaattaataattatagaattttttaaatgtgtcctctcccatagaaagtcttgggggtttggggaaggaataatgtacagtggttttgcttgaaagctaatataaagaaagggctttttggttggtgtttggc

SEQ ID NO: 8131 - DNA, 7457 bp, Phaseolus vulgaris
cacacgccctcagccatcgctctctctctttctctcccttcctccatatttccaaaggttgggtattctgtcttcatcataccagaccgtccttgttttgattcgaaagctttaacatctatttcctcacacccgctgcttctcaagccacttaaccggaatccggatcttcaaccgataaatccagatctgtttctgttaatgtgaaaaataccccaaatcctttgtatttcttctggatatatgtttatctgttcattctttctctattcaggcacttgtaacagaatctggacgctcaaataagactcccataacaaccacaacattttctcacaagttaactaaattaaaactatcgcaaaaaagaaacacctggttttcacgtttctgtttctttatttgttattttcttcgaccggacaatgtcgaacgctttgtcgttcacgctacccgctctaaacaaccctcaaataagcgctttcaacagccctaacaaagcgcgtctgcatctgagaagtagggttgcacgatgccccgcctcgaccgtagagaagaaaagactgttcggcgcacaggtgcggtcgagcgggtttgaccggatccggttgctgcaatcggggcggttgccaaaatggagggtggcggtccggtcagcattctctgccgtgccggagaagccgctggggctgtatgatccggcgatggacaaggactcgtgcggggtggggttcgtggcggagttgtcgggagagtgtaaccgcagaacggtaaccgacgcgctggaaatgttggtgaggatgacgcacagaggtgcttgcggatgcgaagccaacactggagatggtgccggaattcttgttgctctgcctcatgtcttttaccaggaggttgtggattttgagcttcctccccaaggaaaatatgcagttggcatgtttttcttgccaaagtctgaaaaccgaaggaaggaaagcaaaaaattatttagcaaggttgctgaatctctggggcacactgttcttggttggcggtctgtaccaactgataacacaggattgggcaaatcggccctacagactgaaccagtgattgaacaggtgtttcttacaccaagtgctgaatcaaaagttgatttggaaagacagatgtacatattaaggaagctcagcatggcagctattacatctgcattaaacctccaaaatgatggcattactgatttctatatctgttcactttcatcaaggactgttgtttacaaaggtcagctaacaccagctcagttgagggattattattttgctgatcttggcaatgaaaggtttacgagctacatggccctgatacattcacggttttctacaaatacttttcctagctgggatcgtgctcaacctatgcgtgtattaggacacaatggggaaatcaacacactcagaggcaatgttaactggatgaaggcacgtgagggtttactaaaatgcaaggagcttggtttatcagagaataaattaaagaagcttttgcccattgtggatgcaaattcatccgattcaggagcttttgatggtgtgcttgagtttttgcttcattcaggaaaaagtctccctgaagctgttatgatgatgattcctgaagcatggcaaaatgacaagaacatggattctcagcgtaaagcattttatgaatacttctcagccctcatggagccatgggatgggccagctcttatatcatttaccgatggtcactatcttggagctacattggataggaatggactgcgaccaggccgtttctatgtcacccatagtggacgagttataatggcaagtgaagtgggggttgttgacattccaccagaagatatatgtaggaaaggtagactaaatcctggcatgatgcttctggttgattttgaaaagcatgcagttgtaaatgatgatgccttaaaagagcagtactcattggcaagaccatatgaggattggctcaaaaatcagaaaattgaactcaaagacattgttgattctgttcctaaatctgggagagtaccaccacctatagcaggagtggctccaccgtccaatgatgacgaagatatggtaaatatgggcattcatggcttactggctccattgaaagcttttggatattcagttgaatctttggaaatgctgttgcttcctatggccaaggatggtgtagaagcccttgggtcaatgggaaatgatacaccgctagctgtcatgtctaatagagagaaacttacttttgaatatttcaagcaaatgtttgctcaagtgacaaaccctcctattgatcctattagagagaaaatagtcacttctatgcaatgcatggttggtccagaaggcgatctgactgaaatcacggaagagcaatgccaccgcctttccctcaaaggtccccttttatacactgaagaaatggaagccattaaaaaaatgaattataggggatggcacagcaaagttatagacataacgtactcaaaggaacgtggtaagggagggttggaagaagcattggacaggatatgtgcagaagcacatgatgcaattagtgaaggctataccactcttgtgctgtcagatagagccttctcaaggaaacgagttgccgtgagctccctcctagctgttggtgctgtccatcaacatctagttaaaacacttgagcgcactagagttgccttaatagttgaatctgctgagccccgtgaagtgcaccatttctgtacacttgttggttttggtgctgatgctatatgcccatatttggctatagagacaatttggcgactgcaggttgatggaaagatcccacctaaatcaagtggtgaattccactcaaaagaagagttggtcaagaagtatttcaaagcaagcaactatggaatgatgaaggttcttgccaagatgggaatatcaactttggcatcatacaaaggtgctcagatttttgaagctctaggtctttcatctaaagtgattgaaaagtgctttgctgggactccaagtcgagttgagggtgcaacattcgagacactcgctcgtgatgcttttcaactgcatgagttggcttttccttcccgtgttttctctcctggaagtgcagaagctgtaacgttgccaaatcctggtgattatcactggagaaaaggtggtgaagttcacctgaatgatcctcttgctatagcaaagctccaagaggctgccagaactaacagtgtagattcatataaacagtatgctaagttcattcatgaattgaacaaggcttgtaatttgcggggactactgaaatttaaagagacagctgttaaaattcctattgatgaagtggagcctgctagcgaaatagtaaaacggttttgcaccggggccatgagttatgggtcaatatcattggaggcacacacagcattagcaatggctatgaataaaattggagggaaatccaacacaggtgagggaggggagcaaccatctcgtatggagcctcttcctaatggcacaatgaatcccaaaaggagtgccattaagcaagtggctagtgggagatttggagtttcaagttactaccttacaaatgctgatgaactacagataaaaatggcccagggagcaaaacctggtgagggaggcgaacttcctggccacaaggttataggagacattgctgttactaggaattcaactgcaggggtaggacttatcagtccacctccccatcatgatatttattcaattgaagaccttgcccaactaattcatgatctgaagaatgccaacccaactgctcggattagtgtgaaattggtctctgaagctggagtggggattattgctagcggagttgttaaaggccatgccgaccatgtgttgatctcaggtcatgatggaggtactggggcatccagatggactggcataaagaatgctgggcttccttgggaacttggcctggctgagacccaccagactttggttgctaatgatctacgcggtcgcacagtcctccaaactgacgggcaactgaaaactgggagagatgtggcaatagctactctgcttggtgcagaagagtttggtttcagtactgctccactcatcactcttggctgcatcatgatgcggaagtgccacaagaacacctgtcccgttggcattgctactcaagatcccgtactcagagaaaagtttgctggagaacccgagcatgttatcaacttcttttttatggtggcagaagaaatgagagaaattatgtcccagcttgggtttaggacagttaatgagatggttggtcgatctgatatgcttgaagttgataaggaagtcattaagagcaacgagaaactagaaaacattgatctctctctattgcttagacctgcagctgaattgcggccggaagctgctcaatattgtgtgcaaaaacaggatcatggtttggaaaatgccttggataacaagctcataagtctatctaatgctgctttggaaaagggtctccctgtatacattgagactccaatctataatgtaaaccgtgcagtgggaactatgcttagccatgaggtgactaaacggtaccacctagctggtcttccaagcgacaccattcatatcagatttactggcagtgcaggccagagctttggtgcattcctctgtcctggtatcactttggaacttgaaggtgatagtaatgactacgttggtaaaggattatccggtggcaagattgtagtgtatcctccaaaaggaagtaattttgaccctaaggagaacattgtgattggtaatgtggctctgtatggggccactcaaggggaagcttacttcaacgggatggcagccgaaagattttgtgtccgtaattctggggctaaggctgttgtggaaggtgttggtgatcatgggtgtgagtacatgactggtgggactgttgttgtgcttggggaaactggtagaaattttgctgcaggtatgagtggcgggattgcttatgttcttgatttggatggaaaattccaatctcgatgcaacttggaactagtagatctggacaaggttgaagaggaagaggatgtttatacacttagaatgttgatacagcagcatcagcgtcacacaaatagtctgcttgccaacgaagtgcttgatgattttgagaatcttcttcctaaatttatcaaggtgttccctcgggagtataaacgtgttctagccagtgtgaagtctgaggaggcctccaaagatgcagtggtgcaggcagcaaaagacgcagaagatcaagatgatgaagcacaagcagtagagaaggatgcttttgaagaacttaagaaactggcaactgtatctttgaatgagaaacagagtcaggctgagacacccaagaggccaagtcaagtcactgatgccattaaacatagaggttttgttgcttatgagcgcgagggtgttcagtacagggatcctaatgttcgcatggctgattggaatgaagtgatggaggagacaaagcctggtccactgttgaaaacacagtcagcccgttgcatggactgtggtacccctttctgtcatcaggaaaattctggatgtcctcttggaaataaaataccagaatttaatgagctagtataccaaaataggtggagggaagcattagagaggcttcttgaaacaaataactttcccgaatttactggtcgggtatgcccagcaccttgtgaaggttcttgtgtccttggtattattgagaaccccgtatccattaaaagcattgaatgtgccataatagacaaggcttttgaggagggttggatggtgccacgacctccagtcaagagaactgggaaaagagtagccatcgttggaagtggaccatctggtttggcagctgctgatcagctaaataaaatgggtcatgcggtaacagtgtatgaaagagctgataggattggagggcttatgatgtatggggtccccaacatgaaatctgacaaagtggatgtagttcaacgacgagtgaatcttatggcggaggagggagtagattttgtggtgaatgctaatgttggaaatgatcctttatactctcttgatcggcttcgggaggaaaacgatgccattgtcttggctgtaggatctacaaaacctagggatcttcctgtacctggtcgggagctgtcaggagtccattttgccatggagtttctccatgcaaatactaaaagcttgcttgatagtaatcttgaggatggtagctacatttcagccaagggcaagaaagttgttgtcattggtggaggtgacactggcacagattgcataggaacatccattcgtcatggttgtagtagcattgtaaatcttgaactccttcctcagcccccaccaactagggctcccggcaacccgtggcctcagtggcctcgcatattccgagtagattacggtcaccaagaggctgcagccaaatttggtaaagatccaagatcgtacgaggttctgactaagaggtttttgggagatgaaaatggagttttgaaaggacttgaagtgattcgtgtttgctgggagaaggatgaaaccggcaggtttcagtttaaggaaattgagggttcggaggagattattgaggctgacctagttttactagccatggggttccttggtcccgagcctacaattgcagagaagttgggtttggatcgagacaacaggtcaaacttcaaggctgattatggccgcttctcaaccaatgtcaaaggggtgtttgcagcaggtgattgtcgccggggtcagtccctggtggtgtgggccatttcagagggacgacaagctgcggcacaggtggacaactacctcgtcaaagacgatgatgagcacaggaatcaggatgggcttgtcaagaggcagcaggggctcaacaagaagcagcagggcagcagcaaacacacggtgatgacttaggtggcgcgtgtaatttttcatgaagttcccaaagaattgcacagaataaaataagattgttgtatggttcagcctgagattaattggtctacttaggtattcttgattggaagttgctaccccgaagggatgaaataatcacaaataaagacatttagagtgtagggagagctagaaggacgtcttcttggtgttggtggatcttaggttattgcacatttgagtgtttttgttcatagtttgttattattcgggctttattgttcggaagtttagctgtattagttggtaatggtgactattatatgtaatgaaatgtacagtttggtaattattattatttggatgcaacattgtttcaattttaaacatctttctgaatttaaagtagaaatgttgtcatcattatcttatttcttaaatgcagcagcacttttaagtaaa

SEQ ID NO: 8132 - DNA, 6579 bp, Malus domestica
atgttggcgagcactggcggttccgtcgttcagctccgaaccaaaccgtcgctcctgccgtcctgctctccttcccggaaatcatgcaaggctctggccaagaagttcttcgggaccagattgagggcgtccggatccgagaggctccatttgtggcgctccgacggtcccggtcgctcgccgaagctccgagtcgtcgtgcgcaacatgctctccgccgttccagagaagcccctcgggctatacgacccgtcgttcgataaggactcgtgtggtgtcggcttcgtcgccgaattgtccggcgaaggcagccgcaaaacgattacggatgcaattgaaatgctggtgcggatgacgcacagaggagcgtgtgggtgtgaaacgaataccggtgatggagctgggattctcgtcggtgttccgcacgacttctacaaggaggtaaccaaagatgccgggtttgatattccaccggcaggggagtacgctgttggaatgttcttcttgcccacatctgagagccgaagagaagaaagcaaaagagtatttgcaaaggttgcagagtcccttggacacactgttctggggtggcgatctgttccaacagataactcagacttggggaattctgctttgcagactgaacctgttattgagcaagtgttccttactgcgaccccaaagtcaaaagttgatttcgaacgacagatgtacatactaagaaggctgtcaatggttgctatccgagctgcattaaaccttgaacacggtggtgctaaggacttttatatatgttcgctgtcctcaaggactgttgtttacaaaggtcagctgaagcccgttcagctgaagggttattattatgcagatcttggcaatgaaaggtttacgagctacatggccctggtacactctcgattctcaacaaatacctttcccagctgggatcgtgctcagcctatgcgtgtcattggccacaatggtgaaatcaacaccctcagaggaaatgttaactggatgaaggcacgcgagggactgctgaagtgtaaggaacttggtctatcagaaaatgatttaaaaaaacttttacccattgtggacgccagttcttcagattcaggagcttttgatgctgtccttgaacttctggttcaagctggaagaagcctccccgaagctatcatgatgatgattcctgaagcatggcaaaatgacaagaacatggacccggataggaaagccctgtatgagtatttctcatctctcatggagccatgggatgggccagctctcatatcatttactgatggccgctatttgggagctacactggatcgtaatggactcagacctggtcgattttacgtcactcacagcggacgggttattatggccagtgaagttggcgtcgtagacattccaccggaagatgtcagcaggaaaggaagacttaaccctggaatgatgcttttggtggactttgagaaccacgttgtggtggatgatgaagcgttgaagcagcaatattctttggcaaggccgtatgcggagtggcttcaaaggcaaaagattgagctcaaggacattgtagattctgttcatgaatctgacagggtccctccgtccatagctggagttattcctgcatctactaatgatgaaaccatggaaaacatgggaatccatggtttattggcaccgctgaaagcttttggttatacagttgaatccttggaaatgttgttgcttcccatggcaaaagatggcgtagaggctcttgggtcgatgggaaatgataccccattggctgttatgtctaagagagaaaagcttacctttgagtatttcaagcaaatgtttgctcaagtaacaaaccctccaattgaccccattcgagagaaggtggtcacttctatggaatgcatgattggtccagagggtgctttgacagaaaccaccgaagaacaatgtcatcgtctctcactcaaaggtcctcttttaaccattgatgaaatggaagcaatcaagaaaatgaactatagaggttggcgctgtaaagttcttgatataacttattccaagggacgtggtagggaaggattggaggaaaccttggataggatttgttctgacgcacatgaagcaataaagaagggatacaccactcttgttctttcagacagagccttctccccaaagcgcgttgcagtaagctccctcttggctgttggcgctgttcatcaacatctagttaaaaaccttgaacgcacacaagtggggttgataattgaatctgctgagccacgtgaagttcaccatttctgtacactggttggttttggtgcagatgctatctgcccttacttggctatagaggccatttggaggctgcaggtggacggaaagattccaccaatagctaatggtgcaatatactccaaagatgaattggttaaaaagtacttcaaagcaagcacatatggaatgatgaaggttcttgccaagatggggatttctactttggcctcttacaagggtgcacagatttttgaagctttgggtctttcatctgaagtaattgagaggtgctttgcaggaacccctagtagagttgagggtgcaacattcgagatgctagctcacgacgaacttcatatgcacgaattggcatttccctctcgaagctatcctccaggaagtgcagaagctgtagcactaccaaatcctggggattaccattggagaaaaggtggtgaggtacacctaaacgatcctgttgctatagcaaaacttcaagaggctgccagaactaacagtgttgctgcatataaagaatactccaagcttattcatgaattaaataaagcctgcaatctccgcggtcttttgagatttaaaaacacagagcagcagattcacttggatgaagtggaacctgctagcgagattgttaaacggttctgtactggtgctatgagttatggatcaatatcattggaagcgcatagtacactggccattgctatgaacagaattggaggaaagtcaaatacaggtgagggaggtgagcagccatctcgtatggagcctcttccagatggttcaaggaatccaaagaggagtgcaattaagcaggttgccagtgggagatttggagtttcaagttactatctgacgaatgctgatgaactccagataaaaatggctcagggtgccaagcctggtgaaggaggtgagcttcctggacacaaggttattggagacattgctgtcaccaggaattctactgctggtgtgggtcttatcagtccacctccccatcatgatatctactcgattgaagaccttgcccaattaattcatgatcttaagaatgctaacccagcagctcgaattagtgtcaagttggtatcggaagcaggtgtgggagtagttgctagtggagttgtgaaggggcatgctgatcatgttttgatctctggacacgatggaggcacaggggcctctagatggacaggaattaagaatgcagggcttccatgggaacttggtttggctgagactcatcaaaccttggtttctaatgatcttcgtggccgcactactctccagactgatggccaactaaaaactggaagagatgttgccatagctacacttcttggtgcggaagagtttggcttcagcactgcacctctcataacccttggctgcattatgatgcggaagtgccacaagaacacatgtcctgttggtatcgcaactcaagatccagtacttcgtgagaagtttgctggagaacctgaacatgttattaattttttctttatgattgctgaggaactcagagagataatggcgcagcttggtttccgtaccataaatgagatggttggtcgttcagatatgcttgaagttgatagagaagtgactaaaaacaatgagaagcttgacaatattgatctatctttgttacttcgacctgccgcagaccttcggcctggagctgcacaatattgtgttgagaaacaagaccatggcttggatatggctcttgatcacaagctaatttctatgtctaaagctgctttggaaaaagctcttcctgtatattttgagacaccaatttgcaatgtgaaccgtgccgttggtacaatgcttagccacgaggtgacaaaacgttacaacagggctgggcttcctgctgacaccattcatatcaaatttagtggaagtggaggacagagtcttggagcatttttgtgctctggaatcatgcttgagcttgagggtgacagtaatgattatgttggtaaaggtttgtctggtggaaagattgtagtttatcctcccaagggaagcaggtttgacccaaaagaaaatattgtcatcggtaatgtagctttatatggtgccactagtggtgaggcatacttcaatggaatggcagcagagagattttgtgttcgcaattcgggggctaaggcagttgtcgagggtgttggtgatcatggctgtgaatacatgacaggtggcactgttgttgtgctcgggaaaactggcaggaactttgctgctggtatgagtggtggtattgcctatgtttatgacgtggatggacaatttcggtctcgatgtaatcctgagcttgtagatcttgatacacttgaagaagaagatattctgactcttcaaatgatgatacaacaacatcaacgtcacacaaacagcctgctggccgttcaagtactggctgattttgaaaatcttctgcctaagtttatcaaggttatcccaagagagtacaagcgagttcttgcagatatgaaagaggaaaccaaacaggttatagagcacaaggaggaagatgagccagagcttgaagagaaagatgcctttcaagaacttaagaagttggcggctgcatctttaaatgggaaatccaatcagaaggtagaagatgctgaagcattgaaaaggccttctcaggtcactgatgctgttaaacatcgtggttttatttattatgagcgcgagggcgttcaatatagggatcccaatgttcggatgaatgactggaaggaagttatggaggaaactaaacctggaccacttgtgaagactcagtcagcccgttgcatggactgcgggactcctttctgccatcaggagaactctggatgccctcttggtaacaaaataccagagttcaatgagttggtgtaccagaataggtggcatgaagcattagagagacttctcgagacaaataacttccctgagtttactggtcgtgtttgtccagcaccatgtgaaggttcttgtgttctgggtattattgagaatcctgtatctatcaaaagcatagaatgtgccatcatagacaaggcttttgaggaaggttggatggtgccacgacctcccgtaaagagaactgggaaaagggttgccattgtaggaagcgggccagctggtctagctgctgctgatcagctaaacagaataggccacacagtgactgtgtatgagcgtgctgatagaattggagggcttatgatgtatggagtgcctaatatgaagactgataaaaaggagatagttcaacggcgggttaaccttatggctgaggaaggtgtcaactttgtggttaatgctaatattggaaacgatcctttgtactcgcttgatcgccttcgagaggagaacaatgccattgttttagcagtaggagcaacaaaaccaagggaccttcccgtaccagggcgagagctgtcaggagtacattttgctatggaatttcttcatgcaaacaccaaaagcttactagatagcaatcttgaggatggtaactacatctctgccaagggcaagaaagttgtggtaattggtggaggtgacactggcactgattgcattggaacatccgttcgccatggctgcactaacatcataaatttggagcttcttcctgagccaccacgaaaaagggctccaggaaacccttggccacagtggcctcgtgtattccgtgtggattatgggcaccaagaagttgcagctaagttcggcaaagatccaagaacttatgaagtgctgacaaagagatttgtgggagatgagaatggggccttgaaaggactcgaggtggtccgtgtcaaatgggagaaggatgaaaccgggcggttccaattcaacgaaatcgagggatctgaggagatcctcgaggctgacctcgtccttctcgcaatggggttccttggaccagaggcgacggtagcagagaagttgggtttggaacgtgaccaacgctcaaactacaaggcggactatggtcggttctcaaccaatgtggatggggtatttgccgctggggattgccggcgcggtcagtcccttgtggtgtgggcaatctcagagggaaggcaagtcgctgcacaggttgacaagtacctctcgaaggaagaagaagaccacgccatcagcaatgggagccatcaaaatgttggcaagaggcaccgagaccttaacccaacaggcaccagcaaacacacagtgatgacatagatggctcgacgatga

SEQ ID NO: 8133 - DNA, 6839 bp, Cucumis sativus
tgctggcgaaacctggttctcttcttaaacttccggctgctccttacacatttaatgataacacctctgttaagcctcaattgaatgttaaccccaaaactcgtttaggagcgagagctgctcgatgttccgcttccaagggaacgtccgggttgttaaatgtgtcggagaagaagttttttggagcccgcttgagggctccgggatctggaagagttcagttttggcatttggatggtcctggccggtcaccgaagctccgacttgctgtccggtcgggtttgtcgtctgtgcctgagaaacctcttggtctttatgatccttcgttcgataaggactcctgtggagttgggtttgttgctgaattatccggcgaaaccagccgcaaaacgattacagatgctttggaaatgttggttcgtatgtcacatagaggtgcttgcggttgtgaaacaaatactggtgatggagctggaattcttcttgctcttccgcacgagcggcaagagataatggtttcgaactcccaccggcggggcagtatgccgttggcatgtttttcttgcccacttcggattctcgtagagaagagagtaaaaaagtatttgcacaggttgctgaatcacttgggcactctgttcttggatggcggtctgtgcaaacagacaatactggattggggaagtctgccctgctgacggaacctgtgattgagcaagtgttccttaccccaagtacaaaatcgaaagttgacttggagaaacagatgtacatattaagaaggctttcaatggtagcaattcgtgctgcactaaatctcgagcacggtggtgctagagatttctacatatgttctctctcctcaaggactattgtgtacaaaggtcagttgaagcctgtacaattgaaagattattacctggatcttgggaatgaaaggtttacgagctacatggccctggtacactctcggttctcaaccaacactttccctagttgggatcgtgctcagcctatgcgtgttttgggccacaatggagaaatcaacacccttagaggcaacgtgaattggatgaaggcacgtgaaggtctgctgaagtgtaaggaactcggcctatcagaagacgagttaaaacatctattgcctattgtggatgccagttcttcagattcaggagcttttgacggtgttcttgagcttttaattagagctggtagaagtcttccagaagctgtcatgatgatgatccctgaagcatggcaaaacgacaagaatatggatcctcagaggaaggcattatatgagtacttctcttgtcttatggaaccatgggatggaccggctcttatttcatttactgatggtcgctatcttggagctactttggatcgcaatggactgcggcctggtcgtttctatgtaactcacagtgggagagttataatggccagtgaggttggtgttgtagacattgcaccagaagatgtttcacggaaaggaaggctcaaccctgggatgatgcttttagtggattttgaaaatcatgttgttgtagacgatgaagccctgaagcagcaatattctcttgctaggccttatggagagtggcttaaaaaccagaagattgagctaaaggacgtcattagctcaattgataaaagtgaaatgacttctccaacgattgcaggagcattgtctgctgaggacaatatgaacaatatgggcattcatggcttaataactcccttgaaagcctttggctacactactgaagccttggagatgttgttgcttcctatggcaaaagatggtgttgaggcccttggttccatgggaaacgatactcccttagctgtcatgtccaacagagaaaagctcacctttgagtacttcaagcaaatgttcgcacaggttacaaatcctcccattgatcccatcagagaaaagatagtgacctccatgcaatgtatgattggtccagaaggggatctaactgaaactactgaagaacaatgtcatcggctctcattgaaaggtcctctcttatccattggagaaatggaagcaataaaaaagatgaactataggggctggcgaagtaaagttttagatatcacatatccaaaataccttggtaggagaggattggaggagaccttggataggatttgttctgaagctcagaatgcaattaacgagggttttaccacacttgttctttctgatagagcattctcaagcaagcgtgtttctgtgagctcactcctggctgttggtgctgtccatcagtatctagttaaaaatctagaacgcactcaagttggcttgatagtagaatctgcagaaccccgtgaagttcaccatttttgtacacttgtggggttcggtgctgatgctatatgcccttacctggctattgaagccatctggagattacaaattgacggaaaaattccggcaaaatcaagtggggaattccacaccaaggaggaattggtcaaaaagtatttcaaggcaagcaactacgggatgatgaaagttcttgcgaagatgggaatatcaactttggcctcgtataaaggtgcccaaatttttgaagcacttggcctttcatccgaagtggttgagaagtgctttgctggaactccaagcagagttgagggtgcaacatttgagatgctggctcgtgatgcgcataatttgcatgaaatggctttcccctctagagctttcccccctggtagtgcagaagctgtagcattaccaaaccctggggattatcattggcggaaaggtggtgaaattcacttaaacgatccagttgtcatggcaaaattgcaagaggctgctcgaactaatagtgtaaatgcctataaggagtactccaagcttgtccatgagctaaataaagcatgtaatttgagaggacttctgaaattcaaagagacgggagcgagtattcctttggatgaagtggagcctgctagtgaaattgttaagcgcttttgcactggtgcaatgagttatggatcaatctctctggaggcacacactactttggccatggcgatgaacaaaattggtggaaaatcgaacacaggtgagggaggtgagcaaccatctcgaatggagcctcttcctgatggttcaatgaatccaaagagaagttctatcaaacaagtcgcgagtgggaggtttggagtttcaatttactacctcactaatgcagacgaactgcagattaaaatggctcagggtgccaagcctggtgaaggtggtgaacttcctggtcataaagtggttggtgaaattgcaaaaacgagaaactctacagctggggtagggcttatcagcccacctcctcatcatgatatatattctattgaagatcttgctcagttaatccatgatctcaagaattcaaatccagctgctcggattagtgtgaagttggtttctgaagcaggtgttggtgtaattgctagtggagttgttaagggccatgcagatcatgtactaatttcaggtcatgatggaggtacaggtgcatcaaggtggactggcatcaagaatgctgggcttccttgggaactggggttggctgaaactcaccaaactctggttgctaatgaccttcgtggtcgtacagtgcttcagacggatggtcaattaaaaaccggaagagatgtggctatagctgctttgcttggtgcagaggaatttggcttcagcactgcaccccttatcacaatgggctgcattatgatgaggaagtgccacaaaaacacatgtcctgttggaattgctactcaagatcctgttcttcgagagaagtttgcaggagaacctgaacatgtgatcaactttttctttatggtagctgaggaaatgagggagatcatgtcacagcttggatttcgtaccgtcaatcagatggttggtcgttcagatgtgttagaagttgataaagaagttgcttggcaaaatgagaagctagagaatattgatctatctctgcttctcagacctgctgctgatctacgacctgaagctgctcaatactgcgtgcagaaacaagatcatggtctggacatggctttggatcaaaaactgattgcactttcaaagtctgctttagaaaaaagtatccctgtgtacattgaaacaccaatcatcaatgttaaccgtgccgtcggaacaatgcttagccatgaggtaaccaagcgttaccacatggctgggcttccttctgaaactattcatatcaaattcagtggaagtgctggacagagtcttggagcgtttctctgccctgggataatgctagagctggagggtgacagcaatgactatgttggcaaaggattatcaggtggcaaaattgttgtttacccaccaaagggaagtttatttgatcccaaggagaacataatcataggtaatgtggctctttatggtgctacaagtggtgaggcctatttcaatgggatggcagcagaaaggttttgtgttcgtaattcaggggcaaaggctgttgtggagggtgttggcgatcatggatgtgaatatatgactggtggcactgttgtcattcttgggaaaactggaaggaattttgctgctggtatgagtggaggtattgcttatgttcttgacatggatggtaaatttgaatcccgatgcaatctagagcttgtggatctagataaagttgaagaagaggatgatattttgactctaaaaatgatgatacagcagcatcagcgtcacacatcaagcaatttagccaaagaagtccttgacaactttgagaacctattgcctagatttattaaggtcttcccaagggaatataagcgtattcttgccaacataaaagttcaagaagctgtcaaagaggcttcagaaccatctgctaaagatgctgaggagttggatgaggcagagttagttgaaaaggatgcttttgaggagctcaagaaaatggctgctgcctcgttgaatgggaattccgaacagacagaacctccaaagagacctactgagatacccgatgctgttaagcatcgaggttttatcgcttatgaacgtgaaggagtgaagtacagagatcctaatgttcgaatgggagattggaatgaggttatggaggaatcaaaacctgggccgctcttaaagactcaatcagctcgatgcatggattgtggtacccccttttgccatcaggagaactcgggttgccctcttggtaacaagattcctgaattcaatgagttagtttatcagaataggtggcgtgaagccctggagcggcttcttgaaacaaacaacttcccagagtttactggccgtgtctgcccagcaccgtgtgaaggatcttgtgttctgggcattattgagaatcctgtgtccatcaaaaacattgaatgtgccatcatagacaaggcctttgaagaggggtggatgattccacggcctccccaagcgagatccgggaaacaagtagctattgttgggagtggaccagctggcttggctgcagccgaccagctaaataaaatgggacacaaggtaactgtgtatgaaagagctgacagaattggaggacttatgatgtatggagttccaaatatgaagactgacaaagtggatgtagttcagcggcgggttaaccttatggcagaggaaggtgttaactttgttgttaatgctaatgttggaactgatccgtcatattctcttgatcagcttcgcaaggaaaatgatgcactcgttttggctgttggtgcaacaaaaccaagggaccttcctgtacctggacgagaactagctggagtccattttgccatggaatttcttcattcaaacacaaagagcttgcttgatagcaatctccaagacggcaactacatttctgcaaaagacaagaaggtagttgtgattggtggtggtgacactgggacagattgcataggaacctctataaggcatggttgcagtaggatagtaaacctcgagcttcttccacagccgccacagaccagggctcccggaaacccttggccgcagtggcctagaatattccgagttgattatgggcaccaggaagcagctgccaaattcggaaaagatccaagaacatacgaggttttgactaagcggtttattggagatgagaatggggtagtgaaaggacttgaagtaattcgtgttcagtgggagaaagatgccgacggaaggttccagtttaaggaggtggaaggcagcgaggaaataatagaggcggatcttgttttactggcgatggggttcctggggcctgaatcgacagtagcagagaagcttagcatagagaaagacaataggtctaacttcaaggccgagtatggccgcttctcaactactgtagacggagtatttgcagcgggagactgtcgtcgaggccaatcccttgtggtttgggctatctcggaaggacggcaagcagctgctcaggtggacaagtatttagcaaaggaggacaaggggggtattgtaggtgaaggagggtatgaaggcgttggtaacggctctcaagattataaaaatagacaacaagatagtagtagtagcagcagacacacagtaatgacataggcgataaaagcttttgtccaagctttccccaaaaatggagaaaaggaaaaattcaaaatacttttggctgaagaaagatttgataacattttctactcaataaaaagccaattccagagggagcacccagaagcaaggtggtgcagcatgtgaggatttggtttctgctgttggctctattactattattattatattttta

SEQ ID NO: 8134 - DNA, 6649 bp, Aquilegia formosa
ggttttattttgaataatgtcagtgatttctggttctgcttttcaactcaaaagcaattctgttgttcttaattcgatcaatcgttctattatcacaaatcatcatggattgagtgttgtttcacctttgaactatcgcacaaagaacagaatatgctctgttaagaaaagtgacaatgacaatgtgattgaacacaagttttacggaactcgattgcgacaacaatcgagttcagagaggtttcatctatggagaacagaaggtcctggacgttctccaaagcttcgagttgctgtgcgatcaatggcattgtcgcaagttccagagaaaccacttggtttatatgatccatcttttgataaggatgcgtgtggagttggatttgttgctgagctttctggagaaagtcatagaaaaactgtgatggatgcaattgagatgttggtaaggatgactcatagaggtgcttgtggttgcgaaactaacactggtgatggggctggaattcttgttggtctacctcatgaattctttatggaggttgctaaagatatgggatttcagttaccaccacggggaaattatgctgttggcatgttgttcttgccaacatctgagaatcgcaggcaagaaagcaaagcagtttttacaaaggttgcagagtcactagggcacactgttctaggttggcgtcctgtcccaactgacaatacaggtttgggtaaatctgccctagaaacggagcctgttgttgagcaagtatttcttacaccaagtccgaggtcgaaagctgattttgaacaacagatgtacatattaagaagattttcaatggaggctattcgttctgctcttaacctccaacatggtggagtgaaggacttttatatatgttctctgtcttcaaggactattgtttacaaaggtcaactaaagccggaccagttgaaagactattattacgccgatcttggtgatgaaagattcaagagctatatggctttggtccattctcgtttctcaacaaacactttccctagctgggaccgtgctcaacccatgcgcatcgtgggccacaatggggagatcaacacactcaggggaaatgtgaactggatgagggcacgtgagggtctattgaagtgcaaggagctcggcctaacaaagaatgagatgaaaacgcttctgcctatagtggatcacagctcatctgattctggagcttttgatggcgtccttgagcttctagttcgagcaggcagaagtctacctgaagcagtcatgatgatgataccagaggcatggcaaaatgacaagaatatggatcctgaacggaaggccttctatgaatacttttcaactctaatggaaccatgggatggccctgcccttgtatcatttactgatggtcggtatcttggagctacattagatcgtaatggattacgtcctggtcgtttttacatcacacatagtggacgtgttataatggcaagtgaagttggtgttgtagatgttccacctgaagatgtgtgtaggaaaggtagattgaaccccggaatgatgctgttggtggattttgagaaccatgttgttgtagatgatgatgccctgaaaaagcaatattcatttgcaaagccctatggggagtggctgaaaagacagaaaatagaactgaaagacattgttgaatctgttcacaaatcagacagggccccaccagtcatatcaggagcactatctgcggctgtgaatggtgatactgtggataacaagggcattcatggtctcttggctcctttaagggcttttggttacactgttgaagcattggatatgttgctgctacccatggcaaaagatggtacagaagcccttggctcaatgggaaatgatgctcccttggctgtgatgtcagaccgggagaaacttacatttgagtatttcaagcagatgtttgctcaggttacgaaccccccaattgacccaatccgagagaagattgttacttccatggagtgcatgattggaccggaaggcgatctcactgaaaccactgaagagcaatgtcatcgcctctctttaaagggtcctctccttaccattgaagaaatggaggcaataaaaaagatgaactacagaggatggagaagcaaggttcttgacataacttactctaaaacccgtggtaggaaaggattggaggagaccttagataggatctgctatgaggcatgtaatgcaatcaaggacggtttcacaacattggtactttctgatagagctttctcatcaaaacgtgttgctgttagctccctcctagctgttggtgctgttcatcatcatttagtctcgaagctcgaacgcactcgagtagggttgataattgaatctgcagaaccacgtgaagtgcaccatttctgtactctggtaggttttggtgccgatgctatatgtccatacttggccatagaaaccgtatggagactgcagattgatgggaggattccaccaaaatcaagtggtgattttcattccaaggaggaattggtcagaaagtacttcaaggcaagcaattatggaatgatgaaggttcttgctaaaatgggtatatcgactttggcctcatacaagggagcccaaatctttgaagctctcggtctctcatctgaggtgatccgaaagtgtttcagtggtactccaagtagagttgaaggtgcaacatttgaaatgcttgctcaagatgctctacaactgcatgaacttggatttccaagccggtttttgcctcctggaagtgccgaggaagtggcgttgccaaatcctggggattatcattggcgaaagggtggcgaggtgcatttaaatgatcctcttgccatagcaaagcttcaagaagctgccaggacgaacagcgtggctgcatataaagagtattccaagcgcatacaggagctgaacaagagctgcaatctgcggggtatgttgaagtttaaagatgcagaagtacaggttcctttgggagaagtggaacctgccagtgagattgtgaagcacttttgtacaggggccatgagttatgggtcaatttcgttggaggcgcacaccaccctggctctcgccatgaacaaaattggtgggaaatcaaataccggtgagggaggtgaaaatccatctcgcatgaagccccttccagatggctcaatgaatccaaagaggagttcaattaagcaggttgcaagtggaagatttggagtctcgatcaattatcttacaaatgctgatgaattacagataaaaatggctcagggggccaaaccaggtgagggaggtgaacttccaggccataaggtcattggagatattgcagttactagaaactccactgctggtgttggactcatcagccctcctcctcatcatgatatctattccattgaagatcttgcacaattaattcacgatcttaagaactctaatccaaaagcaagaattagcgtaaaattagtgtctgaagctggagtgggagtaatagccagtggggttgtgaagggacatgctgaccatgtcttgatctcaggtcacgatgggggtacaggggcttcacgttggactggtattaagagtgctgggctcccatgggagcttggtttggctgagacccatcagacactggttgcaaatgaccttcgtggaagaaccactcttcagacagatggtcaattgaaaactggaagagatgtagccattgctgcacttcttggtgcagaagaattcgggttcagcactgcccctctcataactcttggatgcatcatgatgcggaaatgccataaaaatacctgccctgttggcattgccacccaagaccctgttctccgtgagaaatttgctggagaacctgaacatgtcatcaatttctttttcatgttagctgaggaggtaagggagatcatgtctcagctgggttttcgaacaatgaaagagatggttggccgttctgatatgttagaagtcgatagcgaagtggtaaagaataatgagaagctggaaaacattgacctctcactattactcaaacccgcagcagaaatccgtcccgaagctgcacaatactgcattcaaaaacaagatcatgcgttggacatggcattggaccaaaaactgataaccttatctaatgctgctctgcaaagaagtcttcctgtatatattgaacttccaatctgtaatgtgaaccgtgcagttggaacaatgcttagtcatgaagtgactaaacgttaccacgtggatggacttccagcagataccatccacatcaagctcaccggtagtgctggtcagagcttgggagcttttctttgccctggcatcatgctcgagcttgaaggtgatagcaatgactatgttgggaaaggattatcaggtggtaaaattgtcgtttaccctccaagaaaaagcactttcaatccaaaagaaaacattgtgatcggaaatgtggctctttatggagcaactagtggagaggcttattttaaaggaatggcagctgagaggttttgtgtgcgtaattcaggggccaaggccgttgtagaaggaataggtgatcatgggtgtgagtatatgacaggtggaattgttgttattctcgggaaaaccggaagaaattttgcagcaggaatgagtggtgggattgcatatgtttttgatgtggataaaacgttccaatctcggtgtaatcttgaattggtggatcttgataaagttgaagatgatgaggacatcatgacgctgagaatgatgatacaacaacaccaacgctacaccaaaagtgagttagcttgggaaatcttggatgattttcagaatcttttacccaagttcatcaaggtattccctagggattataagcgagttcttcagaacatgaaggtggaaaaggctgttccacaagttgacatgcaagctgaaaaccaggaagaggcagaattgatggagaaggatgcttttgaggagctaaagaagttggccgtaaaatcacagcatgagaaaggaagtcaggtggacgaggcccaatctttgaagaggcctacagaggttcacgatgcggtgaagcatcgtggttttgttgcttatgaccgtgagaccatttcatacaggaatcctgaaaatcggatcaatgactggaaagaagttatggagaagtccaaaccaggccctctgctaaagacacaatctgcgcgttgcatggactgtggaactcccttttgccaccaggataactatggatgccctcttgggaataagatacccgaatttaatgagttggtttaccagaataggtggcgagaagcattggatcgtcttctggagacaaataactttccggagtttactggccgtgtgtgccctgcaccttgtgaaggttcttgtgtccttggcataattgagaatcctgtatccattaaaagcatagagtgctccattatcgataaggcgttcgatgaggggtggatgatcccacgacctccgctaagaagaactgggaagaaagttgctattgtaggtagcggaccagcaggattggctgctgccgatcagcttaacagaatgggtcactctgtcacagtgtttgagcgtgctgaccgaattggaggactcatgatgtacggtgttcccaacatgaaggctgacaaggtgaacatcgttcaacgacgtgtaaaccttatggctgaggaaggcatcaattttgtggtgaatgctaatgttggatcagatccaatttattctattgaacgactccgttctgagaatgacgccattattttgtctttgggagcaacaaaaccaagggatcttcctgttccaggacgggagctatcaggtatccatttcgcaatggagtttttacatgcaaacacaaaaagcttgcttgatagcaatctgcaagatgggaaatacatatctgccaaggggaagaaggtagtggtcataggaggaggtgacacaggtaccgactgtatagggacatctcttagacatggctgcaccaacattgtcaaccttgagcttctccctgagccaccccagaagagggctccaggcaacccttggccacagtggccccgcatcttccgtgtcgattacggccaccaagaagcattgacaaagtttggtaaagatccaaggtcttacgaggtcttgaccaagaggtttgtgggggataagaatgggtttgtgaaaggagttgaggtggtgcaggtgcactgggaaaaggattccagcgggagatttcagtttaaagaaattgaaggttcggagatgataatagaggctgaccttgttttccttgccatgggattccttggtcctgagccgataattgcggatcaacttggcttggagcaagacaacagatcaaactacaaggcagagtacgggcgcttcttaactagtgtggagggggtgtttgctgctggagattgtcgacgtggacaatctcttgtggtctgggctatatcagagggacgacaggctgcttcccaagtggacgagtaccttatgagagagatggaggacctcagtaatacaactaatcaggagaccgtaaacaggcagcacaataacagcaagtactcagtaatgaga

SEQ ID NO: 8135 - DNA, 7296 bp, Arachis hypogaea
aaggaatctcagccaaacagaacctagctgcaggttcttacgggcggcgctctttccctctgaaaagtgaaaaccgttttctctgctttttttcgccaaacagatcttcgcgccaacgacacagaacaacacaaacacatcgattcttcccttttcttcttctctaatttctgtttctattccggcgtcgttctgtctcagaagcaaaacacacacggcctggatttgattgatttgcggttgaaaaacctagatctaacgtgaaacaaaatttgaaaaaaaaaattaaaatctataacagaaaacacatcgttttttctctcggaaaatttttccgtgtacgaaaaatctgaacgaaacgatgtcgtcttcttcactttcgttcgcagcggctccggcttggtctgcgtgcactctaccgtcgaatatcgcaagcagcaggacgcagctcaatgtgcgaactgtggcgaaggcgaaaccgatgagcttcttcggtactcgtttgcgttcgagctgcaggtcactcggttcggagcggctgcacgtgtggcggtcgcaggggccagggaggtcgccggagctgagggtggtggtccggtcggcattgtcggctgtaccagagaagccgatggggctttacgatccagctatggataaggactcatgcggagtggggttcgtagcggagctgtccggcgagggcaaccgtaaaacggtgacagatgctttggagatgttggtgcgcatgacgcacaggggagcttgcgggtgcgaagcaaacactggagacggagccgggattcttgtggctctacctcaccagttttacacggaggtcgtggattttgagcttccacctcctggaaaatatgcagttggcatgtttttcttgcccacctccgacagtcgtagggaagagagcaaaaatgtatttagaaaggttgccgaatcactgggccactctgttcttggctggcgttctgtgcccactgataatacaggattgggcaaatcggccctgcagaccgaaccagtgattgaacaagtgtttcttacgccaagcaccaaatcaaaacttgatttggaaagacagatgtacatattaaggaagctttcagatgccgctataacatcagctttagatctccatagtgatggcattgctgatttttatacatgttcactttcatcaaggactgttgtttataaaggtcagttaacaccagctcagttgaagggttactactttgcagaccttggcaatgaaaggtttacgagctacatggccctgatacattcacgattctcaactaatacttttcctagttgggatcgtgctcaaccaatgcgagttttgggccacaatggagaaatcaacacacttagaggcaatgttaactggatgaaggcacgtgagggcctactaaagtgcaaggagcttggtctatccgagaacgagttaaagaagcttttgcccattgtgaatacaacttcatctgattcaggtgcttttgatggcgtgcttgagtttttggttcagtctggaaaaagtcttcctgaagctgtcatgatgatgatccctgaagcatggcaaaatgacaagaacatggatccccagcgtaaagcattttacgagtatttctcggctctcatggagccatgggatgggcctgctcttatatcatttactgatggtcactatcttggagcaacattggataggaatggtctgcggccaggccgcttttatgtcactcacagtggacgagttataatggcaagtgaagttggggttgtagacattcctcctgaagacgtttgtaggaaaggaagactaaatcctggcatgatgcttctagtagattttgagaagcatgctgttgtgaatgatgatgccttgaaggaacagtactctttgtcacggccttatggggagtggctaaaaaatcagaagattcagctccaagacatagttgactctgttcatgaatctgaaagagtgcctccaagcatagccggggtgattccagcatctggtgatgatgcagatatggaaaatatgggaattcatggtttactgactccattgaaagcttttggctatacagttgaatccttggagatgttattacttcccatggcaaaggatggtacagaagcccttggttcaatgggaaatgatactccactagctgtcatgtctaaccgggagaagcttacttttgagtacttcaagcaaatgtttgcccaagtgacaaacccacctattgatcctattcgtgagaaaatagtcacttccatggaatgtatggttggtccagaaggggacctgacagaaattactgaggaacaatgccaccgtctttcactaaaaggccctcttttatccattgaacaaatggaagccattaaaaagatgaattataggggatggcggagcaaagtgatagacatcacatactcaaaggattgtggtaagaaagggttggacgaagctttggacaggatatgtgcagaagcacatgatgcaattaatgctggctacaccacccttgtgctgtctgatagagccttctcaaggaaacgggtttctgttagctccctcttggccgttggtgctgtccatcaacatctagttaaaacacttgagcgcactagagttgccttgatggttgaatctgctgaaccacgtgaagtgcatcacttctgcacgcttgttgggtttggtgctgatgctatatgcccatatttggctatagagacaatctggcgactgcaagttgatggaaagatcccaccaaaagctggtggggaattctactcaaaaggtgaattggtcaagaagtacttcaaagcaagcaactatggaatgatgaaggtcctttcgaagatgggaatatctactttggcctcttacaaaggtgctcagatttttgaagctctgggtctttcctcagaagtaattgaaaggtgctttgccggaaccccaagccgagttgagggggcaacatttgagatgcttgctcgcgatgctcttaaattgcatgaattggcatttcctcctcgtgttttctctcctgggagtgctgaagctgttgctttgccaaatcctggcgattaccactggagaaaaggtggtgaaattcacttgaatgatccacttgctatagcaaagcttcaagaggctgccagaactaacagtgtagatgcatataaacagtactccaagatcattcatgagttaaataaggcttgcaacttgcgaggaatactgaaatttaaagaggcagcagtgaagatttcacttgatgaagttgaacctgctagtgagatagttaaacgattttgcactggggccatgagttatgggtcaatctcattggaggcgcacacaacattggcaactgctatgaataagattggagggaaatccaacacaggtgagggtggtgagcaaccatcacgcatggagcctcttcctgatggctcaatgaacccaaaaagaagtgctatcaagcaggttgctagtgggagatttggtgtttcaagttactatcttacaaatgctgatgaattgcagataaagatggcccagggagctaaaccaggagagggaggtgaacttcctggccacaaggttgtaggagacattgctgtcaccaggaattcaactcctggggtaggacttatcagcccacctcctcatcacgatatttattccattgaagatcttgcccaattaattcatgatctaaagaatgccaacccggctgctcgaattagtgtcaagttggtatcagaagctggagtaggcataattgctagtggagttgttaaagggcatgctgaccatgtcttgatctccggccatgatggagggacaggggcatccaggtggactggcataaagaatgctgggctcccttgggaacttggcttggccgagacccaccaaactttggtagctaatgacctccgtggtcgcacaactctccaaactgatgggcaactcaaaacaggaagagatgtggccatagctgctctccttggtgcagaagagtttggtttcagtacagctccactcattactctcggttgcattatgatgcggaagtgccacaagaatacctgtcctgttggcattgctacccaagatccagtactcagagaaaagtttgctggagaacctgagcatgtcatcaacttcttcttcatggttgctgaagagatgagagaaattatggcccagcttgggtttaggactgtcaatgagatggttggccgttcagacatgcttgaagttgataaagaagtcactaagaccagtgagaaattgcagaacattgatctctctctattgcttagacctgcagctgaactgcggccagaagctgctcaatactgtgtgcaaaaacaagatcatggtttggacatggctttggataataagctcattggtttgtcccatgctgctttggagaagggtctcccagtatacattgaaagtccaatttataatgtgaaccgtgctgtgggaactatgcttagccatgaggtgaccaaaaggtacctcttagatggtcttccaaatgacaccattcatatcagatttacaggaagcgcaggccagagctttggtgcattcctttgtcctggtatcactctggaacttgaaggcgatagcaatgattatgttggtaaagggttgtctggcggcaagattgtagtatatcctccaaagaagagtacctttgacccaaagactaatattgtaattggtaatgtggcactctatggagctacacgtggtgaggcatatttcaatgggatggccgcagaaagattttgtgtgcgtaattctggggctaaggcggtagttgaaggcgttggagatcatggatgcgagtatatgactggtgggatagtagttgtccttggaaacactggtcgaaattttgcggcaggaatgagtggtggaattgcttacgttcttgatatggatggaaaattccaatctcgatgcaaccaggaacttgtagatttggacaaggttgaggaggaggaggatattattactcttagaatgttgatacaacaacatcagcgtcacacagatagcgtgcttgccaaagaagtgctttctgactttgaaaatcttcttccaaaatttatcaaggtgttccccagggagtacaaacgtgttttggctggtatgaagtcaaaggaagcctccaaaaacgcatcttcgcctgctgcaattgcagaagaggggccagatgaagcagaactgaatgagaaagatgcttttgaagagcttaagaaaatggctgctgcatcttcaaatgggaagccaagtcagaaggttgaacaggctgaatcatccaagagaccaagtagagtcactgatgcagttaaacatagaggttttgttgcttatgagcgtgaaggtgttcagtatagggatcctaatgttcggatgaacgattggaaggaagtgatggaggagtcgaagcctggcccacttctgaaaacccagtcagcccgttgcatggactgtggtactcctttctgtcatcaggaaaattctggatgtcctcttggaaataaaataccagagtttaatgagttagtataccaaaataggtggcgcgaggcattggaaaggcttcttgagacaaataacttccccgagttcactggtcgggtgtgcccagcaccctgtgaaggttcttgtgtccttggcattattgagaatccagtgtctattaaaagcattgaatgtgctatcatagacaagggatttgaggagggttggatggtgccacggcctccccccaaaagaactgggagaagagttgccattgttggaagcggaccagctgggttggcagctgctgatcaactgaataaaatgggacacacagtaactgtgtatgagagagctgacaggattggagggcttatgatgtatggggttcccaacatgaaaacagacaaagtggatatagttcaacgacgggtcaaccttatggcagaggagggagtcaattttatggtgaatgctaatgttggacatgatcctatgtacgctcttggtcggcttcaagaagaaaatgatgctattgtgttagctgtcggagctacgaaaccaagggatcttcctgttcctgggcgggagttgtcaggagttcattttgccatggagtttcttcatgcaaacactaaaagcttgctcgatagcaatcttcaagatggtaactacatttctgcaaagggaaaaaaagttgtggtcattggtgggggtgatacgggcacagattgcatagggacatccattcgtcatgggtgtagtagcatagtaaaccttgaacttctcccacagcctcccgaaactagggcaccaggcaacccttggccacagtggcctcgcgtattccgtatagattacgggcaccaagaagctgcagctaaatttggcaaagatccaagatcttatgaggtattgactaagcggtttgtgggagatgagaatggagttttgaagggacttgaagtcatacgagtccgctgggaaaaggatgagacagggaagtttcagtttaaggaaattgagggcagtgaggaaatcatcgaggctgatctagtgttacttgccatgggattccttggccctgaatctacaattgcagagaaattgggtatggagcgagacaacaggtcaaacttcaaggcagattatggtcgcttctcaaccagtgtgaaaggtgtctttgcagccggcgattgtcgccgtggccagtccctcgtggtatgggcaatttcggagggacgccaagctgcttcacaagttgataggtacctcacgaaagaagacacagagtacaacattgctcataccaagaggcagcagcaagacctcaccaagagacagcagggcggtagcaagtacacagtgatgacttaaaagaactctcacctgtgatttttttcccctttcgtttcatacagtagcagacagagaataagaataagatggttccaagattgagcagggtgttctttttgttttaccataggcattattattattggttggtagtagttgacgcacaccaataaggagaaaaattaggaagctaggattgtagtataatcagagcaagaggtttgtcttgctgtttggtcgctcaagggtacaaggtgatttcattcaaatcttgttcatagttttgatgtgtttggaaaggcaagctgttagctaattattattattgtattgtgtgaaatgaaatgtac

SEQ ID NO: 8136 - DNA, 7149 bp, Glycine max
ctcttgaaaccactgatctcaaaccatcacttacctggcggcggcgcagttcagttttctcatcacttcttcttcttccgtttgcatctgaaactgttggccttgttttgattcaacagaatatgactttgtgaattactataaaaaagccagatctgttgcttttcatccattaacgagggaaaaaaacattaatataacgagcaatttctcgtttttttctctcttctaattaaccagtttcctgaagcgatgtcgtgttctctctcgttttcaaggctttcggctcggtcagcgagaactcttccgcgcgaaaacgagaagccacgtctcaacgcacgatgtcccgtgagagtgacgaagtttctgggaacgcggctgcgttcgagtgggaggagcctccgttcggagagatttcacgtttggcagtcggagggtccgggtcggacgccgaagctcagggtcgcagttcggtcggctctttccgccgtgccgaacaagccgctcgggctttacgatccggctatggacaaggactcgtgcggagtgggattcgtggcagaactgtccggcgaaagtagccgccaaacggtgaccgatgctttggagatgctggtgcgcatgacgcacagaggtgcttgcgggtgtgaagccaacactggagatggagcagggatcatggtcgctctacctcaccagttttacaaggaggttgtggattttgagcttccgccaccaggaaaatatgcagttggcatgcttttcttgcctacatccaatagtcgcagggaagagagcaaaaatgtatttcaaaaggttgccgaatctctggggcattctgttcttggttggcgttctgtgcccacagataacacaggattgggcaaatcggccgtgctaactgaaccagtgattgaacaagtgtttcttactccaagtactcagtcaaaagttgatttggaaagacagatgtatatattaaggaagctgtccatggttgctatatcatctgcattaaacctcgataatgatggcattatagatttctatatctgttcgctttcatcaaggactgttgtttacaaaggtcagttaacaccagctcagttgaaggattactattttgcagaccttggcaatgaaaggtttacgagctacatggccctgatacattcacgattttctacaaatacttttcctagttgggatcgtgctcaacctatgcgtgtattgggccacaatggagaaatcaacacacttagagggaatgtaaactggatgaaggcacgcgagggcctactgaagtgcaaggagcttggtctatccgagaatgagttaaagaagcttttgcctattgtggatgcaaattcatctgattcaggagcttttgatggtgtgcttgagtttttgattcagtctggaaaaagtctccctgaagctgttatgttgatgattcctgaagcatggcaaaatgacaacaacatggatcctcagcgtaaagcattttatgaatacttctcagctctcatggagccatgggatgggccagctcttatagcatttactgatgggcactatcttggagcaaccttggacaggaatgggctgcgaccaggccgcttttatgtcacccacagtggacgagttgtaatggcgagtgaagttggggttgtagacattcctcttgaagacgtgagtcagaaaggaagactaaatcctggcatgatgcttctagtggattttgagaagcatattgttgtgaatgatgatgccttaaaggaacagtattcattggcaaggccatatggggaatggctcaaaaagcagaagttagaactcaaagacatagttgattctgttcatgaatctgaaagagttcctccatcaataacaggagtgatgccagcatctggtgatgatgtggatatggaaaatatgggaattcatggtttactggctccattgaaagcttttggatataccgtcgaatccttggaaatgttgttacttcccatggcaaaagatggtacggaagcccttgggtcaatgggaaatgatactccattagccatcatgtctaatagagaaaaactcacttttgagtactttaagcaaatgtttgcccaagtgacaaacccaccgattgatcctattcgagagaaaatagtcacgtccacagaatgtatggttggtccagaaggtgacttaacagaaatcactgaggaacagtgccaccgtctttccctaaaaggtccccttttatccattgaggaaatggaagccattaaaaaaatgaattacaggggatggcggagcaaagttatagatataacatactcaaagggccgtggtaagaaagggttggaggaagccttggacaggatatgtgcagaagcacatgatgcaattagtgatggctacactacccttgtgctgtctgatagagctttctcaaggaaacgtgttgctgtgagctccctgctggctgttggtgctgtccatcaacatctagtgaaaacacttgagcgtactagagttgccttagtaatagaatctgccgagccacgtgaagtgcaccatttctgcacacttgttggcttcggtgctgatgctatatgtccatatttggctgtagaggcaatttggcgactacaggttgatggaaagatcccaccaaaagcaaatggtgaattctactcaaaagatgagctggttaagaagtacttcaaagcaagcaactatggaatgatgaaggtgcttgcgaagatgggaatatccactttggcctcttacaaaggtgctcagatttttgaagctctgggtctttcatcagaagtgattgaaaggtgctttgctggaaccccaagtcgagttgagggtgcaacatttaagatgcttgctcgtgatgctcttcaattgcatggattagcatttccttctcgggttttctctcctggaagtgctgaagcaaaggcattaccaaatcctggggattatcattggagaaaaggtggggaaattcacttgaatgatccacttgcaatatcaaagcttcaagaggctgccagaactaacagcatagatgcatataaacagtactctaagctcattcacgagttaaataaagcttgcaatttgcggggacttctgaaatttaaagaggcagctgtgaaagttccccttgatgaagtagaacctgctagtgagattgttaaacggttttgcactggtgccatgagttatgggtctatatcattggaggcacacacagcattggcaactgctatgaataagattggagggaaatcgaacacaggtgagggaggtgagcagccatctcgtatggagcctctttctgatggctcaaagaacccgaaaaggagtgctattaagcaggttgctagtgggagatttggagttacaagttactatcttacaaatgctgatgaattgcagataaagatggcccagggagcaaaacctggtgagggtggcgaacttcccggccacaaggttgtaggagacattgctgtcacaaggaattcaacccctggtgtaggacttatcagcccacctcctcatcatgatatttactccattgaagatcttgcccaactaattcatgatctaaagaatgccaaccctgctgctcgagttagtgtgaagttggtatctgaagctggagttggtgtagttgccagtggagttgttaaaggccatgctgatcatgtcttgatctctggccacgacggaggtacaggggcgtccagatggactggcataaagaatgctggtctcccttgggaacttggcttggctgagacccatcaaactttggttgctaatgacctccggggtcgcactgttctccaaactgatgggcaaattaaaacaggaagagatgtggccatagccactcttcttggtgccgaagagtttggtttcagtacagctccactcattactcttggttgcatcatgatgcgcaagtgtcacaagaatacctgccctgttggcattgctacccaagatccagtactaagagaaaagtttgctggagaacctgagcatgtcattaacttttttttcatgatagcagaagaaatgagagaaattatgtcccagcttgggtttcgtactgtcaatgagatggttggccgttcagatatgctcgaagttgataaggaagtaattaaaagtaatgagaaactagagaacattgacctctctttattgcttagacctgcagctgaactgcgaccagaagctgctcaatactgtgttcaaaaacaagatcatggtttggacatggcattggataataagcttataggtctgtccaatgctgctttggtaaagggtctcccggtatacattgaaagtccaatccataatgtaaaccgtgcagtgggaactatgctaagccatgaggtgacaaaaaagtaccacttaaatggtcttcctactgacactattcatatcagatttaatggcagtgcaggccagagctttggcgcattcctttgtcctggcatcactttggaacttgaaggtgatggcaatgactatgttggtaaaggactgtcaggtggaaagattgtagtatttcctccaaaggggagtacctttgaccctaagcagaatattgtaattggtaatgtggctctatatggggccacatctggtgaggcatatttcaatgggatggcagctgaaaggttttgtgtgcgtaattctggagccaaggcagtagtggaaggtgttggcgatcatggatgtgagtacatgactggtgggatagtagttgtgcttggaaacacaggcagaaattttgctgcaggtatgagtggtgggattgcttacgttcttgatatggatggcaaattcctatctcggtgcaaccatgagcttgtagatctggataaggttgaagaggaagaggatattactactcttagaatgttgatacaacaacatcagcgccacacaaatagtgtgcttgccaaagaagtgctcgctgactttgagaatcttgttccaaaatttatcaaggtgttccccaaggagtataaacgagttttggcaagtattaaatcgaaggaagcttccaaagatgcagcggagtctgcttctaaacatggagaggagcaagatgaaattgaattggtggagaaagatgcttttgaagagcttaagaaactggctactgcatcggtgaatgggaagcctattgaggctgaatcattcaagaggcctagtcaagtcattgatcctgttaaacacagaggttttgttgcttatgagcgggaaggtgttcagtacagggatcccaatgctcgaataaatgactggaatgaagtgatgaaggaaacaaagcctggtccacttttgaaaacccaatcagcccgttgcatggactgtggtactcctttctgtcatcaggaaaactctgggtgccctcttggaaataaaataccagaatttaatgagttagtataccaaaataggtggcgtgaagcattagagaggcttcttgagacaaataacttcccagagtttactggtagggtatgcccagcaccttgtgaaggttcttgtgtccttggtattattgagaatccagtatctattaaaagcatagaatgtgctatcatagacaaagcttttgaggaggggtggatggtgccacgacctccagctaggagaactgggaaaagagtggccgttgttggaagtggaccgtctggcctggcagctgctgaccaactgaataaaatgggccatacagtaactgtgtatgaaagagctgataggattggagggcttatgatgtatggtgttcccaacatgaaagctgacaaagtggatatagttcaacggcgggtcaaccttatggcagaggagggaattaactttgtggtgaatgctaatatcgggcatgatcctttacattctctcgataggcttcgggaggaaaataatgctattgtcttggctgtaggagccacaaaaccaagggatctcccagtacctgggcgggagctgtcaggagttcattttgctatggagtttcttcatgcaaacactaaaagcttgcttgatagcaatctccaggatggtaacttcatttctgctaagggaaagaaagttgtggttattggtgggggtgacacgggcacagattgcatagggacatccattcggcatgggtgtagtagcattgtaaatctggaacttctccctcagccaccacaaactagggccccaggcaacccttggccacagtggcctcgcatataccgagtagattatgggcaccaagaaggtgcggcgaaatttgggaaagatccaagatcttatgaggtattgactaagcggtttgtgggagatgaaaatggagttgtgaagggacttgaagtaatacgtgttcgctgggagaaggatgaaactgggaggtttcaatttaaggaaattgagggctccgaggagattattgaggctgacctagttttactggccatgggattccttggccctgagtctacaattgcagagaagttgggtatagagcgagacaataggtcaaacttcaaggcagagtatggtcgcttctcaaccagtcttaaaggggtgtttgcagctggagattgtcgacgtggtcagtccttggtggtatgggcaatttcagagggacgacaagctgcagcacaagttgacagtttcctcacaaatgaagatttagagcacaatgttgccgggagtccagacgaacttatcaagaagaagcagcaaccaagggacactgtggcagtggcaaacaaacagtgattacttaggagccttctgtggtttttctattcttaaaagatggaataataaaagatgactgctggagattcattgagcattgttggttcgtagttggtgccccatataaatgtaagggggaaaataataaagaagcgatctaagggtgcaaggttagtgcacagtagaaaattaggaatgttcataggcttcgtgatggaaaggttagttcttagttaattattgtggcattgtgtggaatgaaatgtacagtttgataattaatgatttaggttattgtttccaatcttaagttgctttgaatgagtattgaggttcttg

SEQ ID NO: 8137 - DNA, 8089 bp, Glycine max
ttttaagataaaaaagttccatcgccaaacggaaaaaacactcactccctccctccctctctataaattcatcctttacttctcttgaaaccactgatctcaaaccatcacttacctggcggcggcgcagttcagttttctcatcacttcttcttcttccgtttgcatctgaaactgttggccttgttttgattcaacagaatatgactttgtgaattactataaaaaagccagatctgttgcttttcatccattaacgagggaaaaaaacattaatataacgagcaatttctcgtttttttctctcttctaattaaccagtttcctgaagcgatgtcgtgttctctctcgttttcaaggctttcggctcggtcagcgagaactcttccgcgcgaaaacgagaagccacgtctcaacgcacgatgtcccgtgagagtgacgaagtttctgggaacgcggctgcgttcgagtgggaggagcctccgttcggagagatttcacgtttggcagtcggagggtccgggtcggacgccgaagctcagggtcgcagttcggtcggctctttccgccgtgccgaacaagccgctcgggctttacgatccggctatggacaaggactcgtgcggagtgggattcgtggcagaactgtccggcgaaagtagccgccaaacggtgaccgatgctttggagatgctggtgcgcatgacgcacagaggtgcttgcgggtgtgaagccaacactggagatggagcagggatcatggtcgctctacctcaccagttttacaaggaggttgtggattttgagcttccgccaccaggaaaatatgcagttggcatgcttttcttgcctacatccaatagtcgcagggaagagagcaaaaatgtatttcaaaaggttgccgaatctctggggcattctgttcttggttggcgttctgtgcccacagataacacaggattgggcaaatcggccgtgctaactgaaccagtgattgaacaagtgtttcttactccaagtactcagtcaaaagttgatttggaaagacagatgtatatattaaggaagctgtccatggttgctatatcatctgcattaaacctcgataatgatggcattatagatttctatatctgttcgctttcatcaaggactgttgtttacaaaggtcagttaacaccagctcagttgaaggattactattttgcagaccttggcaatgaaaggtttacgagctacatggccctgatacattcacgattttctacaaatacttttcctagttgggatcgtgctcaacctatgcgtgtattgggccacaatggagaaatcaacacacttagagggaatgtaaactggatgaaggcacgcgagggcctactgaagtgcaaggagcttggtctatccgagaatgagttaaagaagcttttgcctattgtggatgcaaattcatctgattcaggagcttttgatggtgtgcttgagtttttgattcagtctggaaaaagtctccctgaagctgttatgttgatgattcctgaagcatggcaaaatgacaacaacatggatcctcagcgtaaagcattttatgaatacttctcagctctcatggagccatgggatgggccagctcttatagcatttactgatgggcactatcttggagcaaccttggacaggaatgggctgcgaccaggccgcttttatgtcacccacagtggacgagttgtaatggcgagtgaagttggggttgtagacattcctcttgaagacgtgagtcagaaaggaagactaaatcctggcatgatgcttctagtggattttgagaagcatattgttgtgaatgatgatgccttaaaggaacagtattcattggcaaggccatatggggaatggctcaaaaagcagaagttagaactcaaagacatagttgattctgttcatgaatctgaaagagttcctccatcaataacaggagtgatgccagcatctggtgatgatgtggatatggaaaatatgggaattcatggtttactggctccattgaaagcttttggatataccgtcgaatccttggaaatgttgttacttcccatggcaaaagatggtacggaagcccttgggtcaatgggaaatgatactccattagccatcatgtctaatagagaaaaactcacttttgagtactttaagcaaatgtttgcccaagtgacaaacccaccgattgatcctattcgagagaaaatagtcacgtccacagaatgtatggttggtccagaaggtgacttaacagaaatcactgaggaacagtgccaccgtctttccctaaaaggtccccttttatccattgaggaaatggaagccattaaaaaaatgaattacaggggatggcggagcaaagttatagatataacatactcaaagggccgtggtaagaaagggttggaggaagccttggacaggatatgtgcagaagcacatgatgcaattagtgatggctacactacccttgtgctgtctgatagagctttctcaaggaaacgtgttgctgtgagctccctgctggctgttggtgctgtccatcaacatctagtgaaaacacttgagcgtactagagttgccttagtaatagaatctgccgagccacgtgaagtgcaccatttctgcacacttgttggcttcggtgctgatgctatatgtccatatttggctgtagaggcaatttggcgactacaggttgatggaaagatcccaccaaaagcaaatggtgaattctactcaaaagatgagctggttaagaagtacttcaaagcaagcaactatggaatgatgaaggtgcttgcgaagatgggaatatccactttggcctcttacaaaggtgctcagatttttgaagctctgggtctttcatcagaagtgattgaaaggtgctttgctggaaccccaagtcgagttgagggtgcaacatttaagatgcttgctcgtgatgctcttcaattgcatggattagcatttccttctcgggttttctctcctggaagtgctgaagcaaaggcattaccaaatcctggggattatcattggagaaaaggtggggaaattcacttgaatgatccacttgcaatatcaaagcttcaagaggctgccagaactaacagcatagatgcatataaacagtactctaagctcattcacgagttaaataaagcttgcaatttgcggggacttctgaaatttaaagaggcagctgtgaaagttccccttgatgaagtagaacctgctagtgagattgttaaacggttttgcactggtgccatgagttatgggtctatatcattggaggcacacacagcattggcaactgctatgaataagattggagggaaatcgaacacaggtgagggaggtgagcagccatctcgtatggagcctctttctgatggctcaaagaacccgaaaaggagtgctattaagcaggttgctagtgggagatttggagttacaagttactatcttacaaatgctgatgaattgcagataaagatggcccagggagcaaaacctggtgagggtggcgaacttcccggccacaaggttgtaggagacattgctgtcacaaggaattcaacccctggtgtaggacttatcagcccacctcctcatcatgatatttactccattgaagatcttgcccaactaattcatgatctaaagaatgccaaccctgctgctcgagttagtgtgaagttggtatctgaagctggagttggtgtagttgccagtggagttgttaaaggccatgctgatcatgtcttgatctctggccacgacggaggtacaggggcgtccagatggactggcataaagaatgctggtctcccttgggaacttggcttggctgagacccatcaaactttggttgctaatgacctccggggtcgcactgttctccaaactgatgggcaaattaaaacaggaagagatgtggccatagccactcttcttggtgccgaagagtttggtttcagtacagctccactcattactcttggttgcatcatgatgcgcaagtgtcacaagaatacctgccctgttggcattgctacccaagatccagtactaagagaaaagtttgctggagaacctgagcatgtcattaacttttttttcatgatagcagaagaaatgagagaaattatgtcccagcttgggtttcgtactgtcaatgagatggttggccgttcagatatgctcgaagttgataaggaagtaattaaaagtaatgagaaactagagaacattgacctctctttattgcttagacctgcagctgaactgcgaccagaagctgctcaatactgtgttcaaaaacaagatcatggtttggacatggcattggataataagcttataggtctgtccaatgctgctttggtaaagggtctcccggtatacattgaaagtccaatccataatgtaaaccgtgcagtgggaactatgctaagccatgaggtgacaaaaaagtaccacttaaatggtcttcctactgacactattcatatcagatttaatggcagtgcaggccagagctttggcgcattcctttgtcctggcatcactttggaacttgaaggtgatggcaatgactatgttggtaaaggactgtcaggtggaaagattgtagtatttcctccaaaggggagtacctttgaccctaagcagaatattgtaattggtaatgtggctctatatggggccacatctggtgaggcatatttcaatgggatggcagctgaaaggttttgtgtgcgtaattctggagccaaggcagtagtggaaggtgttggcgatcatggatgtgagtacatgactggtgggatagtagttgtgcttggaaacacaggcagaaattttgctgcaggtatgagtggtgggattgcttacgttcttgatatggatggcaaattcctatctcggtgcaaccatgagcttgtagatctggataaggttgaagaggaagaggatattactactcttagaatgttgatacaacaacatcagcgccacacaaatagtgtgcttgccaaagaagtgctcgctgactttgagaatcttgttccaaaatttatcaaggtgttccccaaggagtataaacgagttttggcaagtattaaatcgaaggaagcttccaaagatgcagcggagtctgcttctaaacatggagaggagcaagatgaaattgaattggtggagaaagatgcttttgaagagcttaagaaactggctactgcatcggtgaatgggaagcctattgaggctgaatcattcaagaggcctagtcaagtcattgatcctgttaaacacagaggttttgttgcttatgagcgggaaggtgttcagtacagggatcccaatgctcgaataaatgactggaatgaagtgatgaaggaaacaaagcctggtccacttttgaaaacccaatcagcccgttgcatggactgtggtactcctttctgtcatcaggaaaactctgggtgccctcttggaaataaaataccagaatttaatgagttagtataccaaaataggtggcgtgaagcattagagaggcttcttgagacaaataacttcccagagtttactggtagggtatgcccagcaccttgtgaaggttcttgtgtccttggtattattgagaatccagtatctattaaaagcatagaatgtgctatcatagacaaagcttttgaggaggggtggatggtgccacgacctccagctaggagaactgggaaaagagtggccgttgttggaagtggaccgtctggcctggcagctgctgaccaactgaataaaatgggccatacagtaactgtgtatgaaagagctgataggattggagggcttatgatgtatggtgttcccaacatgaaagctgacaaagtggatatagttcaacggcgggtcaaccttatggcagaggagggaattaactttgtggtgaatgctaatatcgggcatgatcctttacattctctcgataggcttcgggaggaaaataatgctattgtcttggctgtaggagccacaaaaccaagggatctcccagtacctgggcgggagctgtcaggagttcattttgctatggagtttcttcatgcaaacactaaaagcttgcttgatagcaatctccaggatggtaacttcatttctgctaagggaaagaaagttgtggttattggtgggggtgacacgggcacagattgcatagggacatccattcggcatgggtgtagtagcattgtaaatctggaacttctccctcagccaccacaaactagggccccaggcaacccttggccacagtggcctcgcatataccgagtagattatgggcaccaagaaggtgcggcgaaatttgggaaagatccaagatcttatgaggtattgactaagcggtttgtgggagatgaaaatggagttgtgaagggacttgaagtaatacgtgttcgctgggagaaggatgaaactgggaggtttcaatttaaggaaattgagggctccgaggagattattgaggctgacctagttttactggccatgggattccttggccctgagtctacaattgcagagaagttgggtatagagcgagacaataggtcaaacttcaaggcagagtatggtcgcttctcaaccagtcttaaaggggtgtttgcagctggagattgtcgacgtggtcagtccttggtggtatgggcaatttcagagggacgacaagctgcagcacaagttgacagtttcctcacaaatgaagatttagagcacaatgttgccgggagtccagacgaacttatcaagaagaagcagcaaccaagggacactgtggcagtggcaaacaaacagtgattacttaggagccttctgtggtttttctattcttaaaagatggaataataaaagatgactgctggagattcattgagcattgttggttcgtagttggtgccccatataaatgtaagggggaaaataataaagaagcgatctaagggtgcaaggttagtgcacagtagaaaattaggaatgttcataggcttcgtgatggaaaggttagttcttagttaattattgtggcattgtgtggaatgaaatgtacagtttgataattaatgatttaggttattgtttccaatcttaagttgctttgaatgagtattgaggttcttgaatatcccaaactcacactcttcatcctcttgaacccacacctgatagcactagcaagcatagaaacatgtttagacagcgtttgcgacactcacgagccagtaatccgattcccgttccgcatagagggagagcaagagaattcatgcggccacccagggttcagcgtatcctgcagccagaacggccaaacactacttaacctattttactgcggcgaactcagaatccaaagaataaactacgcagcacacttggagtacctcgttcgtcgctaccggcccataaactatctcagcgattctcctaagtacgtcgtttaatttttgcgacgccttcttcgaccgtgtttggacacttggtggccacggtgatagagtcggtccagtcgccgtttaacgatcgagtgacgtcgttggaactcagcggattcaagagcaacgacacttttgagctcgactgttcccgtgtcccttcaaaagcattaagagtactggttagtcccagaccccacgatgggcctagggctcatgatacggtgccagattttgaggctccagcaggctaacggcccaccacagtcacgggcctcgacaggcccacaattgaatcctacccaaaaatagtgataggtgagaagtacatgcccaaagagacagtgaaaaccatacctgaatgtggacactgctttcatgcacaatgcatcgatgaatggcttccactgaacgcgtcatgcccaatttgtcgaacttctccacgaatgttaccacaaccacgtgctcgttctgtcgttcatcaccataatgcttcaatcttttatctcccaaatttatgtaccaatcattttagttgctattga

SEQ ID NO: 8138 - DNA, 7311 bp, Medicago truncatula
ctctttctctcttgtttttttctctcttgttgttgttgttttagttttttcagtttttcagattcgaatctccacataaccacttctccaaaatctggatcttattgttcttcagtttcatcaatctcagatctgttacatataataacaaacaaaactgaataacagttagaaaaagccaaaactcgaaaacgcgaatcaatttttgaaataattttaatctccaatgtcgaattctctttcgttaacgtttacggcgttaaacaatcctcagataaacgctataagtaaccctagcgcgcgtttacgtccgttagcgagggttacaagatgttctgccacgtgtgtggagaggaagaggtggttagggacgaaattgcgaagtggtggtggtttggagaggattcagctttgggaatccggtggattagggaggttgccgaagctcagagtggcggttaagtcgtcgttttcggctgtgccggataaaccgatgggactttatgatccggcttttgataaggattcttgtggtgttggatttgttgctgaattgaacggtcaaagtagtcgaaaaacggtaactgatgcgttggagatgttggttaggatgacacatagaggtgcttgtggatgtgaagcaaataccggtgatggtgctggtatacttgtggctttgcctcatggcttctaccaagaggttgtggattttcagcttcctcctcaaggaaactatgcagttggcatgtttttcttacctaaatccggtagtcggagaaaggaaagcaaaaatatatttactaaggttgccgagtctcttggtcacaaggttcttggttggcgttctgtgcccaccgataacacagggttgggcaaatcagcccagctgactgaaccagtgattgaacaagtgtttcttacaccaagttctgactcaaaagttgatttggagaaacagatgtacatattaaggaagctcagcatggtttctattacatctgcgttaaacctccaaagcgacggaattacagatttctatatctgttcactttcatctaggactgttatttacaaaggtcagctaacaccagctcagttgggggaatattattatgcagatcttggcaatgaaaggtttacgagctacatggccctgatacattcccgattctctacaaatactttccctagttgggatcgtgcccaaccttttcgtgtattgggccacaacggggaaatcaacacactcagaggcaatgttaactggataaaagcacgtgagggcctactgaaatgcaaggaacttggcttatcagagaatgatttaaagaagtttttaccgattgtggatgcaaattcatcagattcaggatgttttgatggtgtcctcgagtttttgcttcattctggaaaaagtcttccggaagctgttatgatgatgattcctgaagcgtggcagaacgacaagaacatggaccctcagcgtaaagcattttatgaatactattcagctctgatggagccatgggatgggccagctcttatctcatttaccgatggtcactatcttggagctacattagataggaatggactacgacctggccgcttctatgtcacccacagtggacgggttataatggcaagtgaagtcggcgttgtagatattcctccagaagatgtgtgcaggaaaggaagactaaatccaggcatgatgcttctggtggattttgagaagcaaatagttgtgaacgatgatgccttaaaagagcaatactcattggcaagaccctatggagattggcttgaaaagcagaagatcgaactgaaggacatagttgactctgttcatgaatctgatattgtgccaccaaccatatcaggagtgcctccactgtctaatgatgatgtggatatggaaaatatgggaattcaaggtttgctggctccattgaaagcttttgggtattctgtagaatcattggaaatactattacttcccatggcaaaggatggtgtcgaagcacttggttcaatgggaaatgatactccattagctgtcatgtctaatagagaaaaactcacttttgagtatttcaaacaaatgtttgctcaagtgacaaatcctcctatcgatcctattcgagagaaaatagtcacttcgatgcgttgtatggttggtccagaaggtgatctgacagaaaccactgaggaacaatgccaccgcctttcactaaaaggtccccttttatccactaaggaaatggaagccatcaaaaaaatgaattataggggatggaggagcaaagttatagacattacttactcaaaggaacgtggtaagaaagggttggaggaagccttagacaggatatgcacagaagcacacaatgcaattagtgaaggctacaccacccttgttctttctgatagagccttctcaaagaaacgtgttgctgtgagctctcttttggctgttggtgcagtccaccaacatctagttaaaacacttgagcgcacaagagttgccctaatggttgaatcagctgagccacgcgaagtgcaccatttctgcacacttgttggttttggcgctgatgctatatgcccatatttggctatagaggcaatttggcgactgcaggttgacggaaagatcccaccaaaagcaagtggtgatttcaactcaaaggatgagttggtcaagaagtatttcaaagcaagcacctatgggatgatgaaggttcttgccaagatgggaatatcaactttggcctcatataaaggtgctcagatatttgaagctctgggtctttcttcagaagtgatcgaaaagtgctttgctggaactccaagtcgagttgagggtgcaacgtttgagatgcttgctcaagatgcacttgatctgcatgagttggcttttccttctcggaatttctctcctggaagtgcagaagcagtagcattgccaaaccctggagattatcattggagaaaaggtggcgaagttcatctgaatgatccacttgctattgcaaagcttcaagaggctgccagaactaacagtgtagaagcatataaacagtattccaagatcattcatgaattgaataaggcttgcaatttgcgagggctcctgaagtttaaagatgcagcaagtaaggttcctattagtgaagttgaacctgctagtgaaattgttaaacggttttgcactggggctatgagttatgggtcaatatcattggaggcccacacagcattagcaacggcaatgaacaaaattggagggaaatccaacacaggtgagggaggtgagcaaccatctcgtatggagcctcttgctgatggctcaaggaatcccaaaaggagtgccattaagcaggttgctagtgggagatttggtgtttcaagttactacctcacaaatgctgatgaacttcagataaagatggcccagggagcaaaacctggtgaaggaggtgaacttcctggccacaaggttataggagacattgctattactaggaattcaacagccggagtagggctcatcagtccacctccccatcacgatatttattcaattgaagatcttgctcaattgattcacgatcttaagaatgccaacccagctgctcgaattagtgtgaaactagtatctgaagcaggagttggggtaattgctagtggagttgttaaaggtcatgctgagcatgtcttgatctcaggtcatgatggaggtacaggagcatccagatggactggcataaaaagtgccggactgccttgggaacttggtctggctgaaacccaccaaacattagttgctaatgacctacgtggtcgtacaactctgcaaactgacgggcaactaaaaaccggaagagatgtggccatagccgcccttcttggtgcagaagagtatggtttcagtactgctccactcattactcttggctgcatcatgatgcggaagtgccacaagaacacctgtcctgttggaattgcgactcaagatccagtacttagagagaaatttgctggagaacccgagcatgttattaacttcctttttatggtggctgaagagatgagagaaattatgtcccaacttgggtttagaacagtcaatgaaatggttggccgttcagatatgctcgaagttgataaagaagttgttaagggaaatgcaaaactagagaatattgatctctctctattgcttagacctgcagctgaactgcggccagaagctgcccaatactgtgttcaaaagcaagatcatggcttggacatggctttggataataagctcataagtctgtccaatgctgctttggaaaagggtcttccagtatacattgaaacaccaatctgcaatactaaccgtgctgtgggaactatgcttagccacgaggttactaagaggtacaatttagctggtcttccagccgacaccatccatatccaatttactggtagtgcaggccaaagctttggtgcattcctatgtcctggaatcacattggaacttgaaggtgatagcaatgactacattggtaaaggattatcaggtggcaaagttgtagtatatcctccaaaaggaagcaattttgaccccaaagacaacatcttaattggcaatgtggcactgtatggggcaacacgtggtgaggcatatttcaatgggatggcagcagaaagattttgtgtgcgtaattctggggctcaggctgtagtcgaaggtgttggtgatcatggatgcgagtacatgactggtgggacagttgtcgttcttgggaaaactggtagaaattttgctgcaggtatgagtggtggaattgcttatgttcttgatgtggatggaacattccagtctcggtgcaacctggagcttgtagatctggataaggttgaagaggaagaggacattattactcttaggatgttgatacagcaacatcaacgtcacacaaacagtttgcttgccaaggaagtgcttgttgattttgataatcttcttcctaaatttgtcaaggtgttccctcgggagtataaacgtgttcttgcaagtatgaagtctgatgcagcctctaaagatgcagtggagagtgctgcggaagatgtagatgaacaagatgatgaagcccaagcagtggagaaagatgcttttgaagaactcaagaagctggcaactgcgtctttgaatgagaaaccaagtgaggctcccaagaggccaagtcaggtcactgatgctgttaaacatagaggttttgttgcttatgagcgtgagggtgttcagtacagggatcctaatgttcgcctgaatgattggaatgaggtgatgatggagacaaagccgggtccacttttgaaaacacagtctgcccgttgcatggactgtggtactccattttgtcatcaggaaaattctggatgtcctcttgggaacaaaataccggaatttaatgagctagtgtatcaaaataggtggcaagaagcattagagaggcttcttgaaacaaacaactttcccgagttcactgggcgggtttgccctgcaccttgtgaaggttcttgtgtcctcggtattattgagaatccagtttctattaaaaatattgaatgtgctatcattgacaaggcttttgaggagggttggatgattccacgacctcctgtcaagagaactggaaaacgagtagccattgttggaagtggaccatcaggcttggcagctgcagatcagctaaataaaatgggtcatatagtaacagtgtttgaaagagctgatcgcattggtggccttatgatgtatggagttccaaacatgaaaactgacaaagtggatatagttcaaaggcgagtcaatctcatggctgaggaaggaataaattttgtggtgaatgcaaacattgggcttgatcctttatactctcttgaacgacttcgagaggaaaacgatgccattgtcttggctgttggagctacaaagccaagggatcttcctgtgcctggaagggagctatcaggagttcattttgccatggagtttcttcatgcaaacactaaaagtttgcttgatagcaatttacaggatggtaactacatctctgccaagggtaagaaggttgtggtcattggcgggggtgacactggcacagattgcattggaacatccattcgtcatggttgtactgctgttgtcaatctagaacttctccctcagccaccaccaactagggccccaggcaacccatggcctcagtggcctcgcatattccgtgttgattatggtcaccaagaagctgaaactaaatttggaaaagatcctagaacatatgaggtactcactaagaggtttgtgggagatgaaaatggagttgttaaaggacttgaagtggtacgtgttcgctgggagaaagatgaaactggcaagtttcaatttaaagaaattgagggcagtgaggagattattgaggctgacctagttttactagccatgggattccttggccccgaggcgactatagcagaaaagttgggtgtggaacgagacaacaggtcaaacttcaaggctgattatggccgcttctcaaccagtgttgatggggtatttgcagcaggtgactgtcggcgtggtcagtcgcttgtggtatgggctatttcagagggaaggcaagctgccgcacaagttgacagctacctcaccaaagaagaccacggtattgatgggaatcaggatgaatttgtcaagaggcaacaagacctcaacaagaagcacagcaaacacacagtgatgacttaggatgctttctttgattttacaagttcctcgagttcctaaagcaagtgcacataataaaagaaaagtgaatgttgaatgttacattttaggcattcttggttggcagttagtaagccgaatgggcgaaataagaacgaaaacaataaagataaataatttagtgtaaggaaagcaagaggttgtcttggtttttggtggtattagggtaagatttgagtgttgttcatagttcttatttggattttgttattgggaaggctagcttagttatggttttgtggaaatgaaatgtacagtttggtaattaattatttattctgaagtgcaattgtttctgcatttttgagctagtgttgttctttctgatgggtattttgattccctgactttgcttaaataaaaacaatctgtcaatatatttctgcattgtgcttcaggaccttaaaacaagcacaagttacaacttaggtttatagattgtgtctatcttggcatctatc

SEQ ID NO: 8139 - DNA, 7458 bp, Phaseolus vulgaris
cacacgccctcagccatcgctctctctctttctctcccttcctccatatttccaaaggttgggtattctgtcttcatcataccagaccgtccttgttttgattcgaaagctttaacatctatttcctcacacccgctgcttctcaagccacttaaccggaatccggatcttcaaccgataaatccagatctgtttctgttaatgtgaaaaataccccaaatcctttgtatttcttctggatatatgtttatctgttcattctttctctattcaggcacttgtaacagaatctggacgctcaaataagactcccataacaaccacaacattttctcacaagttaactaaattaaaactatcgcaaaaaagaaacacctggttttcacgtttctgtttctttatttgttattttcttcgaccggacaatgtcgaacgctttgtcgttcacgctacccgctctaaacaaccctcaaataagcgctttcaacagccctaacaaagcgcgtctgcatctgagaagtagggttgcacgatgccccgcctcgaccgtagagaagaaaagactgttcggcgcacaggtgcggtcgagcgggtttgaccggatccggttgctgcaatcggggcggttgccaaaatggagggtggcggtccggtcagcattctctgccgtgccggagaagccgctggggctgtatgatccggcgatggacaaggactcgtgcggggtggggttcgtggcggagttgtcgggagagtgtaaccgcagaacggtaaccgacgcgctggaaatgttggtgaggatgacgcacagaggtgcttgcggatgcgaagccaacactggagatggtgccggaattcttgttgctctgcctcatgtcttttaccaggaggttgtggattttgagcttcctccccaaggaaaatatgcagttggcatgtttttcttgccaaagtctgaaaaccgaaggaaggaaagcaaaaaattatttagcaaggttgctgaatctctggggcacactgttcttggttggcggtctgtaccaactgataacacaggattgggcaaatcggccctacagactgaaccagtgattgaacaggtgtttcttacaccaagtgctgaatcaaaagttgatttggaaagacagatgtacatattaaggaagctcagcatggcagctattacatctgcattaaacctccaaaatgatggcattactgatttctatatctgttcactttcatcaaggactgttgtttacaaaggtcagctaacaccagctcagttgagggattattattttgctgatcttggcaatgaaaggtttacgagctacatggccctgatacattcacggttttctacaaatacttttcctagctgggatcgtgctcaacctatgcgtgtattaggacacaatggggaaatcaacacactcagaggcaatgttaactggatgaaggcacgtgagggtttactaaaatgcaaggagcttggtttatcagagaataaattaaagaagcttttgcccattgtggatgcaaattcatccgattcaggagcttttgatggtgtgcttgagtttttgcttcattcaggaaaaagtctccctgaagctgttatgatgatgattcctgaagcatggcaaaatgacaagaacatggattctcagcgtaaagcattttatgaatacttctcagccctcatggagccatgggatgggccagctcttatatcatttaccgatggtcactatcttggagctacattggataggaatggactgcgaccaggccgtttctatgtcacccatagtggacgagttataatggcaagtgaagtgggggttgttgacattccaccagaagatatatgtaggaaaggtagactaaatcctggcatgatgcttctggttgattttgaaaagcatgcagttgtaaatgatgatgccttaaaagagcagtactcattggcaagaccatatgaggattggctcaaaaatcagaaaattgaactcaaagacattgttgattctgttcctaaatctgggagagtaccaccacctatagcaggagtggctccaccgtccaatgatgacgaagatatggtaaatatgggcattcatggcttactggctccattgaaagcttttggatattcagttgaatctttggaaatgctgttgcttcctatggccaaggatggtgtagaagcccttgggtcaatgggaaatgatacaccgctagctgtcatgtctaatagagagaaacttacttttgaatatttcaagcaaatgtttgctcaagtgacaaaccctcctattgatcctattagagagaaaatagtcacttctatgcaatgcatggttggtccagaaggcgatctgactgaaatcacggaagagcaatgccaccgcctttccctcaaaggtccccttttatacactgaagaaatggaagccattaaaaaaatgaattataggggatggcacagcaaagttatagacataacgtactcaaaggaacgtggtaagggagggttggaagaagcattggacaggatatgtgcagaagcacatgatgcaattagtgaaggctataccactcttgtgctgtcagatagagccttctcaaggaaacgagttgccgtgagctccctcctagctgttggtgctgtccatcaacatctagttaaaacacttgagcgcactagagttgccttaatagttgaatctgctgagccccgtgaagtgcaccatttctgtacacttgttggttttggtgctgatgctatatgcccatatttggctatagagacaatttggcgactgcaggttgatggaaagatcccacctaaatcaagtggtgaattccactcaaaagaagagttggtcaagaagtatttcaaagcaagcaactatggaatgatgaaggttcttgccaagatgggaatatcaactttggcatcatacaaaggtgctcagatttttgaagctctaggtctttcatctaaagtgattgaaaagtgctttgctgggactccaagtcgagttgagggtgcaacattcgagacactcgctcgtgatgcttttcaactgcatgagttggcttttccttcccgtgttttctctcctggaagtgcagaagctgtaacgttgccaaatcctggtgattatcactggagaaaaggtggtgaagttcacctgaatgatcctcttgctatagcaaagctccaagaggctgccagaactaacagtgtagattcatataaacagtatgctaagttcattcatgaattgaacaaggcttgtaatttgcggggactactgaaatttaaagagacagctgttaaaattcctattgatgaagtggagcctgctagcgaaatagtaaaacggttttgcaccggggccatgagttatgggtcaatatcattggaggcacacacagcattagcaatggctatgaataaaattggagggaaatccaacacaggtgagggaggggagcaaccatctcgtatggagcctcttcctaatggcacaatgaatcccaaaaggagtgccattaagcaagtggctagtgggagatttggagtttcaagttactaccttacaaatgctgatgaactacagataaaaatggcccagggagcaaaacctggtgagggaggcgaacttcctggccacaaggttataggagacattgctgttactaggaattcaactgcaggggtaggacttatcagtccacctccccatcatgatatttattcaattgaagaccttgcccaactaattcatgatctgaagaatgccaacccaactgctcggattagtgtgaaattggtctctgaagctggagtggggattattgctagcggagttgttaaaggccatgccgaccatgtgttgatctcaggtcatgatggaggtactggggcatccagatggactggcataaagaatgctgggcttccttgggaacttggcctggctgagacccaccagactttggttgctaatgatctacgcggtcgcacagtcctccaaactgacgggcaactgaaaactgggagagatgtggcaatagctactctgcttggtgcagaagagtttggtttcagtactgctccactcatcactcttggctgcatcatgatgcggaagtgccacaagaacacctgtcccgttggcattgctactcaagatcccgtactcagagaaaagtttgctggagaacccgagcatgttatcaacttcttttttatggtggcagaagaaatgagagaaattatgtcccagcttgggtttaggacagttaatgagatggttggtcgatctgatatgcttgaagttgataaggaagtcattaagagcaacgagaaactagaaaacattgatctctctctattgcttagacctgcagctgaattgcggccggaagctgctcaatattgtgtgcaaaaacaggatcatggtttggaaaatgccttggataacaagctcataagtctatctaatgctgctttggaaaagggtctccctgtatacattgagactccaatctataatgtaaaccgtgcagtgggaactatgcttagccatgaggtgactaaacggtaccacctagctggtcttccaagcgacaccattcatatcagatttactggcagtgcaggccagagctttggtgcattcctctgtcctggtatcactttggaacttgaaggtgatagtaatgactacgttggtaaaggattatccggtggcaagattgtagtgtatcctccaaaaggaagtaattttgaccctaaggagaacattgtgattggtaatgtggctctgtatggggccactcaaggggaagcttacttcaacgggatggcagccgaaagattttgtgtccgtaattctggggctaaggctgttgtggaaggtgttggtgatcatgggtgtgagtacatgactggtgggactgttgttgtgcttggggaaactggtagaaattttgctgcaggtatgagtggcgggattgcttatgttcttgatttggatggaaaattccaatctcgatgcaacttggaactagtagatctggacaaggttgaagaggaagaggatgtttatacacttagaatgttgatacagcagcatcagcgtcacacaaatagtctgcttgccaacgaagtgcttgatgattttgagaatcttcttcctaaatttatcaaggtgttccctcgggagtataaacgtgttctagccagtgtgaagtctgaggaggcctccaaagatgcagtggtgcaggcagcaaaagacgcagaagatcaagatgatgaagcacaagcagtagagaaggatgcttttgaagaacttaagaaactggcaactgtatctttgaatgagaaacagagtcaggctgagacacccaagaggccaagtcaagtcactgatgccattaaacatagaggttttgttgcttatgagcgcgagggtgttcagtacagggatcctaatgttcgcatggctgattggaatgaagtgatggaggagacaaagcctggtccactgttgaaaacacagtcagcccgttgcatggactgtggtacccctttctgtcatcaggaaaattctggatgtcctcttggaaataaaataccagaatttaatgagctagtataccaaaataggtggagggaagcattagagaggcttcttgaaacaaataactttcccgaatttactggtcgggtatgcccagcaccttgtgaaggttcttgtgtccttggtattattgagaaccccgtatccattaaaagcattgaatgtgccataatagacaaggcttttgaggagggttggatggtgccacgacctccagtcaagagaactgggaaaagagtagccatcgttggaagtggaccatctggtttggcagctgctgatcagctaaataaaatgggtcatgcggtaacagtgtatgaaagagctgataggattggagggcttatgatgtatggggtccccaacatgaaatctgacaaagtggatgtagttcaacgacgagtgaatcttatggcggaggagggagtagattttgtggtgaatgctaatgttggaaatgatcctttatactctcttgatcggcttcgggaggaaaacgatgccattgtcttggctgtaggatctacaaaacctagggatcttcctgtacctggtcgggagctgtcaggagtccattttgccatggagtttctccatgcaaatactaaaagcttgcttgatagtaatcttgaggatggtagctacatttcagccaagggcaagaaagttgttgtcattggtggaggtgacactggcacagattgcataggaacatccattcgtcatggttgtagtagcattgtaaatcttgaactccttcctcagcccccaccaactagggctcccggcaacccgtggcctcagtggcctcgcatattccgagtagattacggtcaccaagaggctgcagccaaatttggtaaagatccaagatcgtacgaggttctgactaagaggtttttgggagatgaaaatggagttttgaaaggacttgaagtgattcgtgtttgctgggagaaggatgaaaccggcaggtttcagtttaaggaaattgagggttcggaggagattattgaggctgacctagttttactagccatggggttccttggtcccgagcctacaattgcagagaagttgggtttggatcgagacaacaggtcaaacttcaaggctgattatggccgcttctcaaccaatgtcaaaggggtgtttgcagcaggtgcattacggccggggtcagtccctggtggtgtgggccatttcagagggacgacaagctgcggcacaggtggacaactacctcgtcaaagacgatgatgagcacaggaatcaggatgggcttgtcaagaggcagcaggggctcaacaagaagcagcagggcagcagcaaacacacggtgatgacttaggtggcgcgtgtaatttttcatgaagttcccaaagaattgcacagaataaaataagattgttgtatggttcagcctgagattaattggtctacttaggtattcttgattggaagttgctaccccgaagggatgaaataatcacaaataaagacatttagagtgtagggagagctagaaggacgtcttcttggtgttggtggatcttaggttattgcacatttgagtgtttttgttcatagtttgttattattcgggctttattgttcggaagtttagctgtattagttggtaatggtgactattatatgtaatgaaatgtacagtttggtaattattattatttggatgcaacattgtttcaattttaaacatctttctgaatttaaagtagaaatgttgtcatcattatcttatttcttaaatgcagcagcacttttaagtaaa

SEQ ID NO: 8140 - DNA, 7134 bp, Manihot esculenta
atgtcggcgacatccaactctctacttaagccccgagctcactcctctgctctttcaaccctcagtaaaccttccatttcgcctaaattaaatgctattgctcctgtatcttgccggaataacaggtccgcaagatgctccgctaccaaaaaatcgactgtggtggataagaagttatttggaaccaaactgcgggctcctggattggagaggcttcatttatggcaatcggatgggcccggaaggtccccaaagcttcgagttgtggttcgttccgcattgtccggagtgccggagaaaccactcggtctttacgatccgtcatttgacaaggactcttgtggggttggattcgtggctgagttatccggtgacagtagccgtaaaacagtggcagatgcgctggagatgttgatccgcatggcgcatagaggtgcttgcgggtgtgaaacgaataccggtgatggagctgggattcttgtggcccttcctcacgatttctacaaggaggttgctaaggatattgggttcgacctgccgccacctgggggctatgcagttggcatgttctttttgcccacgtcagataagcgaagggaagaaagcaaaaatgtgtttactaaggttgcggagtctcttgggcatacagtccttggctggcgaagagtaccaacagacaactcgggactgggcaatgctgccctgcagactgaacctgtggtcgagcaagtgttccttacacctactcctaggtcaaaagctgatttggaacaacagatgtacatactacgacgagtgtcaatggtggctatccgagctgcattgaacatgcagcatggtggtgttaaagacttctatatatgttctctttcctcgaggactattgtctacaaaggtcaattgaagcccattcagttgaaggattactattatgcagatcttggcaatgaaaggtttacgagctacatggccctgatacactctagattttctacaaatacatttcctagctgggatcgtgctcaacccatgcgtgtcttgggccataatggggaaattaatacgcttagaggcaatgtgaactggatgaaggcacgtgaaggtctattgaagtgcaaggagcttggtctctccaagaatgagatgaagaagctcctacctattgtggatgctagttcttctgactcaggggcttttgatggtgtacttgagcttctagttcgagctgggagaagtctccctgaagctatcatgatgatgatccctgaagcttggcaaaacgataagaatatggatcctcatcgaaaggccttgtatgaatacttctcagcccttatggagccatgggatgggcctgcccttatttcatttacggatggccggtacctaggagctacactggatcgcaacggactgcggccaggtaggttttatgttacccggagtggacgagttattatggctagtgaagttggtgttgtggacattccacctgaagatgtcctcaggaaagggagacttaaccctggaatgatgcttctggttgattttgagaagcatatagttgtagatgatgaagccttaaagcaccagtactccctagcaaggccctatggggagtggctgaagaggcaaaaaattgaactgaatgacattgttggctcagttctagaaactgacaaggctattccttgtatagctggagttgttcctacatctaacgatgatgagggcatggagaacatgggcgttcatggtttactagcacctctaaaagcttttgggtatactgttgaagccttggagatgttgctgcttcccatggcaaaagatgggagtgaggctcttggttcgatgggaaatgatgctcccttggctgttatgtccaatagggaaaagctcacttttgagtactttaagcaaatgtttgctcaagtgacaaacccccctattgatcctattagagagaagatagtcacttccacggagtgcatgattggaccagaaggtgatttgacggaaacaactgaggagcaatgccatcgtctttcattgaaaagccctctcttatccattgaggaaatggaagcaattaaaaagatgaattacagagggtggcgaagcaaagtccttgacataacttactcaaaggactgcggtaggaagggattggaggagacattagataggatttgtgctgaagcacatgacgcaattaaggagggttacactttgttggttctatctgacagagccttctcgtcaaagcgcgttgctgtaagctcactcttggcggttggcgctgtccatcatcatctggttaaaaagcttgagcgcactcgtataggtttgatagttgaatctgctgaaccacgtgaagtgcaccatttctgtacattggttgggtttggtgctgatgccatatgcccttacttagccatagaagccatctggagattgcaggttgatgggaagatcccaccaaaatctaccggtgaattccactcaaaggatgagctagtcaaaaggtatttcaaagcaagcaactatggaatgatgaaggttcttgctaaaatgggaatttcaactttggcctcatacaagggtgcccagatctttgaagcattgggcctttcatcagaagtgattgagaagtgctttgcaggaactccaagcagggtagagggagcaaccttcgagatgcttgccagtgacgcacttcatttgcatgaattggcatttcccacccgggtctaccctcctggaagtgccgaagctgtagcactccccaatcctggggattaccattggaggaagggtggtgaaatccacttgaatgatcctcttgctatagcaaagcttcaagaagctgccagagctaatagtgtggctgcatataaggaatattctagacgcattcaggagttgaacaaagcctgcaatttgcgtgggcttttgaagttcaaagaatcagatgtaaaagttccattagatgaagtggaaccagctagtgaaattgttaaacggttctgtacaggagctatgagttatggttcaatatcacttgaggcacacacatctttggcgattgcgatgaataaaattggagggaaatcaaacacaggtgagggaggtgaacaaccatctcgcatggagcctcttccaaatggttcaatgaacccaaagagaagtgcaatcaagcaggttgcaagtgggagatttggagtttctagttactatctaacaaatgctgatgaactacagatcaagatggctcagggggctaagcccggggaaggaggtgagcttcctggtcacaaggtcataggagatattgcagttaccagaaattccacagctggtgtgggacttatcagtcctcctccccatcatgatatctattcgattgaagaccttgcccagttgattcatgaccttaagaatgccaatccaggagctcgaataagtgtcaaattagtatctgaagctggtgtgggggtaattgctagcggtgtggtgaaggggcatgctgaccatgtgttgatctcaggtcatgatggaggtacaggggcttctaggtggactggcatcaagaatgctgggctcccttgggaactaggtttggctgagacccatcaaactcttgttgcaaataaccttcgtggccgcacagttcttcagacagatggccaacttaaaactggaagagatgtggccattgctgcacttcttggtgcagaagaatttggcttcagcactgcacctctcataacacttggctgcatcatgatgcgaaaatgccacaagaatacttgccctgttggcattgctacccaagatccagttctgagggaaaagttcgctggagaacccgagcatgtcataaatttcttctttatgttagcggaggagctgcgggagataatgtctgagcttggtttccgtactgtcaatgagatggtgggccgcacagacatgcttgaagttgataaagaagtcactaagaacaatgagaagctggaaaatattgatctctccctgctgcttaggcctgcagctgaccttcggcctgaagctgaccttcggcctgaagctgcccagtattgtgtccaaaagcaggatcatggcttggacatggctttggataacaaattgataaccctttcaaaggctgctttggagaaaaatcttcctgtgtacatcgagactccaatctgcaatgtgaatcgtgcagtgggaacaatgcttagccatgaagtcaccaaacgttaccacttggcagggcttcctgcagatactatacatgttaagcttaatggaagtgctgggcagagtctgggagcttttctttgccctggtatcaccctggagctagagggtgacagcaatgattatgttggtaaagggttatcaggtggcaagattgtagtttatcctccaaagggtagtttatttgatccaaaagataatattgttattggcaatgtagctctctatggggccacgagcggtgaggcatatttcaatgggatggcagctgaaagattctgtgtacgtaactcaggggccagggctgttgtagaaggtgttggtgatcatggatgcgagtacatgacaggtgggactgttgttgtacttgggaaaactggcaggaattttgctgcgggtatgagtggtggtgttgcttatgttcttgatgttgatgggaactttcattctcgatgcaattctgagctggtagatcttgatggagtcgaggaagaagaggatattatgactctcagaatgatgatacagcaacatcagcgccacacaaacagccagctatctagagaagtactagctgattttgaaaatcttctgccaaaatttattaaggtcttccccagggactacaagcgggttcttgccaaaatgaaacaagaagcagctctgacagagcttgctgttaaagaagcagaggagaaggatgaagcagagctgatggagaaggatgcttttgaggagctcaagaagttggcagctgcctctttgaatgagaaatctagtctgaaagaagttgctgaaacggtgaaaaggcctactttggttaatgatgctgttaaacaccgaggcttcattgcatatgagcgtgagggtgttcgatacagggatcctaatgttcgaatgaatgattggaatgaagttatggaggaatcagaacctggcccacttctgaagactcagtcagctcgttgcatggactgtggtactcctttttgccatcaggagaactctgggtgccctttaggaaacaagatacctgaattcaatgaattagtataccagaatagatggcgtgaagcgttcgataggctcctcgagacaaataacttcccagaattcactggccgagtttgccctgcgccttgtgaaggttcttgtgttcttggtattattgagaatcctgtttctatcaaaagcattgaatgtgctatcattgacaaggccttcgatgagggatggatggtgccacgaccacccgttaagagaactgggaaaggagttgctattgttggaagtggacctgctggcttggccgctgctgatcaactgaataggatgggtcacttggtgactgtgtatgagcgtgctgatcgaattggaggactcatgatgtatggcgttcccaacatgaagactgacaaagtggatgttgttcaacgacgtgttaatctcatggctgaggaaggcatcaactttgtggtcaatgccaatgttggaattgatcctctttactctcttgataaacttcgagaagagaatgatgcaattgtcttggcagtaggagccacaaagccaagggaccttcctgtacccggacgggagttatcaggtgtccatttcgccatggagtttcttcatgcaaatacaaaaagtttgctcgacagcaatctagaggatggaaactacatatctgcaaagggtaagagagtagttgtcattggtggaggtgacactggtacagattgtataggaacatctatccgacatggttgttctagcattgtaaatctagagcttctaccagagcctccacgaaccagagcgcctgggaacccatggccacagtggcctcgtattttccgtgtagattatgggcaccaggaagctgctacaaagtttggcaaggacccaaggtcctatgaggtgctgaccaagcgtttcattggagatgaacatggcaatgtgaagggccttgaggtaatacgtgtccactgggagaaggatgctagtgggaaatttcagtttaaggaggtcgagggcagcgaggaaactatcgaggctgaccttgtcctactagccatggggttccttggtcccgagtcgaatgtggcggagaagttgggcatggagagagataatcgatcaaacttcaaggccgagtatgggcgtttctctacgagtgtggaaggtgtgtttgcagctggagattgcaggcgtggccagtccttggttgtgtgggcaatatcagaaggacgtcaagctgcttcccaggttgacaaatatctgatgagagaagaggaagaggatgtcacagttagtaccgactcccaagatgatcttgtcaagagacgtcgagatcttaccaagaggcagcaagacagcaaacacacagtcgtgacataggtggcgatttccttcagtcctttgaaagaagtagaactgattcacattatacttcaaaaatcccaaatcgtcggacagatgatgcaaggagggaaacaattttctctatgctttaaaccgatatagagtcgagtgaagtgggaaaaggtttgagcagaagtaatgaagtgaagagtggcttccatggggctgacacaggaaaccgaatattgtcgttactttttccatattgttgatagcttcacccagcatgtttgaaagttggctttttgtggcccttgtcgaggaataatgtacagttttgcttctagctatatataatatgggcaaagcagctgtgttgctaattgccgggttatttttggttgatagggctgctcccccagcctctcattatctcctttgcctctgcattatgtgattcattttgatatatagagatttacttcagcggacggttgattc

SEQ ID NO: 8141 - DNA, 6922 bp, Glycine max
gatgtcgtgctctctctcgttttcaaggctttacgctcgctcggagagaactcttccgagcgaaaacgagaagccacgactcaacgtacgatgtccggtgagagtgacgaagtttttaggaacgcggctgcgttcgagcgggaagagcctcggttcggagcggtttcacgtttggcaatcggaggggccgggtcggtcaccgaagctgagggttgcggttcggtcggctatgtccgccgtaccgaacaagccgctcgggctttacgatccggccatggataaggactcgtgtggagtgggattcgtggcggaactgtccggcgaaagtagccgcaaaacggtgactgatgctttggagatgctggtgcgcatgacgcacagaggtgcttgcggctgtgaagccaacactggagatggagcagggatcatggtggctctacctcaccagttttacaaggaggttgtggattttgagcttccgccaccaggaaaatatgccgttggcatgcttttcttgcctacatccaatagtcgcagggaagagagcaaaaatgtatttcaaaaggttgccgaatctctggggcactctgttattggatggcgttctgtgcccactgataacacaggattgggcaaatctgccgtgctaactgaaccagtgatcgagcaagtgtttcttactccaagtactcagtcaaaagttgatttggaaagacagatgtacatattaaggaagctgtccatggttgctataacatctgcattaaacctcgataatgatggcattacagatttctatatctgttcactttcatcaaggaccattgtttacaaaggtcagttaacaccagctcagttgaaggattactattttgcagatcttggcaatgaaaggtttacgagctacatggccctgatacattcacgattttcgacaaatacttttcctagttgggatcgtgctcaacctatgcgtgtattgggccacaatggagaaatcaacacacttaaaggaaatgtaaactggatgaaggcacgtgaaggcctactgaagtgcaaggagcttggtctatccgagaatgagttaaagaagcttttgcctattgtggatgcaaattcatctgattcaggagcttttgatggtgtccttgagtttttgattcagtctggaaaaagtcttcctgaagctgttatgatgatgattcctgaagcatggcaaaatgacaagaacatggatcctcagcgcaaagccttttatgaatacttctcagctctcatggagccatgggatgggccagctcttatatcatttactgatggccactatcttggagcaacgttggacaggaatgggctgcgaccaggccgcttttatgtcacccacagtggacgagttgtaatggcgagtgaagttggggttgtagacattcctgttgaagacgtgagtcggaaaggaagactaaatcctggcatgatgcttctggtggattttgagaagcatattgttgtgaatgatgatgccttaaaggaacagtattcattggcaaggccatatggggaatggctcaaaaagcagaagttagaactcaaagacatagttgattctgttcatgaatctgaaagagtgcctccatcaataacaggagtggtgccagcatctggtgatgacgtggatatggaaaatatgggaattaatggtttattggttccattgaaagcttttggatataccgttgaatccttggaaatgttattacttcccatggcaaaagatggtacggaagcccttgggtcaatgggaaatgatgctccattagccgtcatgtcaaatagagaaaaactcacttttgagtactttaagcaaatgtttgcccaagtgacaaacccaccgattgatcctattcgagagaaaatagtcacgtccacggaatgtatggttggtccagaaggcgacttaacagaaataactgaggatcaatgccaccgtctttccttaaaaggtccccttttatccattgaagaaatggaagccattaaaaaaatgaattacaggggatggcggagcaaagttatagatataacatactcaaagggccgtggcaagaaagggttggaggaagccttggataggatatgtgcggaagcacatgatgcaattagtgatggctacactacccttgtgttgtctgatagagccttctcaaggaaacgtgttgctgtgagctccctgctggctgttggtgctgtccatcaacatctagtgaaaacacttgagcgtactagagttgccttagtaatagaatctgctgagccacgtgaagtgcaccatttctgcacacttgttggcttcggtgctgatgctatatgtccatatttggctgtagaggcaatttggcgactacaggttgatggaaagatcccaccaaaaacaaatggtgaattctactcaaaagatgagctggttaagaagtacttcaaagcaagcaactatggaatgatgaaggtgcttgcgaagatgggaatatctactttggcctcttacaaaggtgctcagatttttgaagctctgggtctttcatcagaagtgattgaaaggtgctttgctggaaccccaagtcgagttgagggtgcaacatttgagatgcttgctcgtgatgctcttaaattgcatgagttagcatttccttctcgggttttctctgctggaagtgctgaagcaaaggcattaccaaatcctggggattatcattggagaaaaggcggggaaattcacttgaatgatccacttgccatatcaaagcttcaagaggctgccagaactaacagcaaagatgcatatgaacagtactctaagctcattcacgagttaaataaagcctgtaatttgcggggacttctgaaatttaaagaggcagctgtgaaagtttcccttgatgaagtagaacctgctagtgagattgttaaacggttttgcactggtgccatgagttatgggtctatatcattggaggcacacacagcattggcaactgctatgaataagattggagggaaatccaacacaggtgagggaggtgagcagccatctcgtatggagcctctttctgatggctcaaggaacccgaaaaggagtgccattaagcaggttgccagtgggagatttggagttacaagttactatcttacaaatgccgatgaattgcagataaagatggcccagggagcaaaacctggtgagggtggtgaacttcccggccacaaggttgtaggagacattgctgtcacaaggaattcaacccccggtgtaggacttatcagcccacctcctcatcatgatatttactctattgaagaccttgcccaactaattcatgatctaaagaatgccaaccctgctgctcgagttagtgtgaagttggtatctgaagctggagttggtgtagttgccagtggagttgttaaaggccatgctgatcatgtcttgatctctggccacgacggaggtacaggggcttccagatggactggcataaagaatgctggtctcccttgggaacttggcttggctgagacccatcagactttggttgctaatgacctccggggtcgcacagttctccaaactgacgggcaaattaaaacaggaagagatgtggccatagccactcttcttggtgcagaagagttcggtttcagtacagctccactcattactcttggctgcatcatgatgcgcaagtgccacaagaatacctgccctgttggcattgctacccaagatccagtactaagagaaaagtttgccggagaacctgagcatgtcattaacttttttttcatgatagcagaagagatgagagaaattatgtcccagcttgggtttcgtacggtgaatgagatggttggccgttcagatatgctcgaagttgataaggaagtcattaaaagtaatgagaaactagagaacattgacctctcttttttgcttagacctgcagctgaactgcggccagaagctgctcaatactgtgttcaaaaacaagatcatggtttggacatggccttggataataagcttataggtctgtccaatgctgctttggaaaagggtctcccggtatacattgaaagtccaatccataatgtaaaccgtgcagtgggaactatgctaagccatgcggtgactaaaaagtaccacttaaatggtcttccaactgacactattcatatcagatttaatggcagtgcaggccagagctttggtgcattcctttgtcccggcatcactttggaacttgaaggtgatggcaatgactatgttggtaaaggattgtcaggtggcaagattgttgtatttcctccaaaggggagtacctttgaccctaagaagaatattgtaattggtaatgtggctctatatggggccacatctggtgaagcatatttcaatgggatggcagctgaaaggttttgtgtgcgtaattctggagctaacgcagtagtggaaggtgttggcgatcatggatgtgagtacatgactggtgggatagtagttgtgcttggaaacactggcagaaattttgctgcaggtatgagtggtgggattgcttatgttctagatatggatggaaaattcctatctcagtgcaaccatgagcttgtagatctggataaggttgaagaggaagaggatattactactcttagaatgttgatacaacaacatcagcgccacacaaatagtgtgcttgccaaagaagtgctccctgactttgagaatcttgttccaaaatttatcaaggtgttccccaaggagtataaacgagttttggcaagtacgaaatcaaaggaagcttccaaagatgctgtggagtctgcttctaaccatggagaggagcaagatgaaatagaattggtggaggaagatgcttttgaaaagcttaagaaactggctactgcatcgataaatgggaagcctagtgaggctgaatcatccaagaggcctagtcaagtcattgatcctgttaaacacagaggttttgttgcttatgagcgggaaagtgttcagtacagggatcccaatgctcgaataaatgactggaacgaggtgatgaaggaaacaaagcctggtccacttttgaaaacccaatcagcccgttgtatggactgtggtactcctttctgtcatcaggaaaactctgggtgtcctcttggaaataaaataccagaatttaatgagttagtataccaaaataggtggcgtgaagcattagataggcttcttgagacaaataacttcccagagtttaccggtagggtatgcccagcaccttgtgaaggttcttgtgtccttggtattattgagaatccagtatctattaaaagcatagaatgcgctatcatagacaaagcttttgaggagggttggatggtgccacgacctccagctaggagaactgggaaaagagtggccgttgttggaagtggaccatccggcctggcagctgctgatcaactgaataaaatgggccatactgtaactgtgtatgaaagagctgataggattggagggcttatgatgtatggcgttcccaacatgaagactgacaaagtggatatagttcaacggcgggtcaaccttatggcagaagagggaattaactttgtggtgaatgctaatatcgggcatgatcctttatactctcttgatagacttcgggaggaaaatgatgctattgtcttggctgtaggagccacaaaaccaagggatcttccagtacctgggcgggagctgtcaggagttcattttgctatggagtttcttcatgcaaatactaaaagcttgcttgatagcaatctccaggatggcaacttcatttctgccaagggaaagaaagttgtggtcattggtgggggtgacacgggcacagattgcatagggacatccattcggcatgggtgtagtagcattgtaaatctggaacttctccctcagccaccacaaactagagccccaggcaacccttggccacagtggcctcgcatataccgagtagattatgggcaccaagaaggtgcagcaaaatttgggaaagatccaagatcttatgaggtattgactaagcggtttgtgggagatgaaaatggagttgtgaagggacttgaagtaatacgtgtcctctgggagaaggatgaaactgggaggtttcaatttaaggaaattgagggctccgaagagattcttgaggctgacctagttttactggccatgggattccttggccctgagcctacaattgcagagaagttgggtattgagcgagacaacaggtcaaacttcaaggcagagtatggtcgtttctcaaccagtcttaaaggggtgtttgcagccggagattgtcgacgtggtcagtccctggtggtatgggcaatttcagagggacgacaagctgcagcacaagttgacagtttcctcacaaatgaagacatagagcacaatgttgccggaagtccagacgacaagctgcagcacaagtttgcagtgccaaacaaacagtgattacttaggaaagccttctgagatttttcttttctacaagatggaataataagagatggctgctggagattcattgagcattgctggttcgtggttgcggccccatataaatttaggggggaaaataataaagaagcgatttaagggtacaaggatagtgcatagtagaaaattaggaatgttcataggctttgttatggaaaggctatttcttggttaattattgctgtgtggaatgaaaatgtacagtttggtaattaatgatttaggttattgtttccaatttaaattgctttgaaatgagtattgtgaggttcttgctcatctgactgatttttccacacagccaaatgttgattattg

SEQ ID NO: 8142 - DNA, 7245 bp, Glycine max
ctcacactcactccctctctataaattcatcctttatttctcttgaagccactgatctcaaaccaacactgtttacctaccggcggcgcagtttttctcatcgcttcttcttcttcttcttctttcgtttgcatctgaaactgttggctctgtttttattcaactcaacagcacatcactttgtaaattactataaaaagccagatctattgcttttcatccattaacgaggggaaaaaaacaatatagcaatcaaacagataacaatttctcgattattttctcccttctatattgactgtttcctgaagcgatgtcgtgctctctctcgttttcaaggctttacgctcgctcggagagaactcttccgagcgaaaacgagaagccacgactcaacgtacgatgtccggtgagagtgacgaagtttttaggaacgcggctgcgttcgagcgggaagagcctcggttcggagcggtttcacgtttggcaatcggaggggccgggtcggtcaccgaagctgagggttgcggttcggtcggctatgtccgccgtaccgaacaagccgctcgggctttacgatccggccatggataaggactcgtgtggagtgggattcgtggcggaactgtccggcgaaagtagccgcaaaacggtgactgatgctttggagatgctggtgcgcatgacgcacagaggtgcttgcggctgtgaagccaacactggagatggagcagggatcatggtggctctacctcaccagttttacaaggaggttgtggattttgagcttccgccaccaggaaaatatgccgttggcatgcttttcttgcctacatccaatagtcgcagggaagagagcaaaaatgtatttcaaaaggttgccgaatctctggggcactctgttattggatggcgttctgtgcccactgataacacaggattgggcaaatctgccgtgctaactgaaccagtgatcgagcaagtgtttcttactccaagtactcagtcaaaagttgatttggaaagacagatgtacatattaaggaagctgtccatggttgctataacatctgcattaaacctcgataatgatggcattacagatttctatatctgttcactttcatcaaggaccattgtttacaaaggtcagttaacaccagctcagttgaaggattactattttgcagatcttggcaatgaaaggtttacgagctacatggccctgatacattcacgattttcgacaaatacttttcctagttgggatcgtgctcaacctatgcgtgtattgggccacaatggagaaatcaacacacttaaaggaaatgtaaactggatgaaggcacgtgaaggcctactgaagtgcaaggagcttggtctatccgagaatgagttaaagaagcttttgcctattgtggatgcaaattcatctgattcaggagcttttgatggtgtccttgagtttttgattcagtctggaaaaagtcttcctgaagctgttatgatgatgattcctgaagcatggcaaaatgacaagaacatggatcctcagcgcaaagccttttatgaatacttctcagctctcatggagccatgggatgggccagctcttatatcatttactgatggccactatcttggagcaacgttggacaggaatgggctgcgaccaggccgcttttatgtcacccacagtggacgagttgtaatggcgagtgaagttggggttgtagacattcctgttgaagacgtgagtcggaaaggaagactaaatcctggcatgatgcttctggtggattttgagaagcatattgttgtgaatgatgatgccttaaaggaacagtattcattggcaaggccatatggggaatggctcaaaaagcagaagttagaactcaaagacatagttgattctgttcatgaatctgaaagagtgcctccatcaataacaggagtggtgccagcatctggtgatgacgtggatatggaaaatatgggaattaatggtttattggttccattgaaagcttttggatataccgttgaatccttggaaatgttattacttcccatggcaaaagatggtacggaagcccttgggtcaatgggaaatgatgctccattagccgtcatgtcaaatagagaaaaactcacttttgagtactttaagcaaatgtttgcccaagtgacaaacccaccgattgatcctattcgagagaaaatagtcacgtccacggaatgtatggttggtccagaaggcgacttaacagaaataactgaggatcaatgccaccgtctttccttaaaaggtccccttttatccattgaagaaatggaagccattaaaaaaatgaattacaggggatggcggagcaaagttatagatataacatactcaaagggccgtggcaagaaagggttggaggaagccttggataggatatgtgcggaagcacatgatgcaattagtgatggctacactacccttgtgttgtctgatagagccttctcaaggaaacgtgttgctgtgagctccctgctggctgttggtgctgtccatcaacatctagtgaaaacacttgagcgtactagagttgccttagtaatagaatctgctgagccacgtgaagtgcaccatttctgcacacttgttggcttcggtgctgatgctatatgtccatatttggctgtagaggcaatttggcgactacaggttgatggaaagatcccaccaaaaacaaatggtgaattctactcaaaagatgagctggttaagaagtacttcaaagcaagcaactatggaatgatgaaggtgcttgcgaagatgggaatatctactttggcctcttacaaaggtgctcagatttttgaagctctgggtctttcatcagaagtgattgaaaggtgctttgctggaaccccaagtcgagttgagggtgcaacatttgagatgcttgctcgtgatgctcttaaattgcatgagttagcatttccttctcgggttttctctgctggaagtgctgaagcaaaggcattaccaaatcctggggattatcattggagaaaaggcggggaaattcacttgaatgatccacttgccatatcaaagcttcaagaggctgccagaactaacagcaaagatgcatatgaacagtactctaagctcattcacgagttaaataaagcctgtaatttgcggggacttctgaaatttaaagaggcagctgtgaaagtttcccttgatgaagtagaacctgctagtgagattgttaaacggttttgcactggtgccatgagttatgggtctatatcattggaggcacacacagcattggcaactgctatgaataagattggagggaaatccaacacaggtgagggaggtgagcagccatctcgtatggagcctctttctgatggctcaaggaacccgaaaaggagtgccattaagcaggttgccagtgggagatttggagttacaagttactatcttacaaatgccgatgaattgcagataaagatggcccagggagcaaaacctggtgagggtggtgaacttcccggccacaaggttgtaggagacattgctgtcacaaggaattcaacccccggtgtaggacttatcagcccacctcctcatcatgatatttactctattgaagaccttgcccaactaattcatgatctaaagaatgccaaccctgctgctcgagttagtgtgaagttggtatctgaagctggagttggtgtagttgccagtggagttgttaaaggccatgctgatcatgtcttgatctctggccacgacggaggtacaggggcttccagatggactggcataaagaatgctggtctcccttgggaacttggcttggctgagacccatcagactttggttgctaatgacctccggggtcgcacagttctccaaactgacgggcaaattaaaacaggaagagatgtggccatagccactcttcttggtgcagaagagttcggtttcagtacagctccactcattactcttggctgcatcatgatgcgcaagtgccacaagaatacctgccctgttggcattgctacccaagatccagtactaagagaaaagtttgccggagaacctgagcatgtcattaacttttttttcatgatagcagaagagatgagagaaattatgtcccagcttgggtttcgtacggtgaatgagatggttggccgttcagatatgctcgaagttgataaggaagtcattaaaagtaatgagaaactagagaacattgacctctcttttttgcttagacctgcagctgaactgcggccagaagctgctcaatactgtgttcaaaaacaagatcatggtttggacatggccttggataataagcttataggtctgtccaatgctgctttggaaaagggtctcccggtatacattgaaagtccaatccataatgtaaaccgtgcagtgggaactatgctaagccatgcggtgactaaaaagtaccacttaaatggtcttccaactgacactattcatatcagatttaatggcagtgcaggccagagctttggtgcattcctttgtcccggcatcactttggaacttgaaggtgatggcaatgactatgttggtaaaggattgtcaggtggcaagattgttgtatttcctccaaaggggagtacctttgaccctaagaagaatattgtaattggtaatgtggctctatatggggccacatctggtgaagcatatttcaatgggatggcagctgaaaggttttgtgtgcgtaattctggagctaacgcagtagtggaaggtgttggcgatcatggatgtgagtacatgactggtgggatagtagttgtgcttggaaacactggcagaaattttgctgcaggtatgagtggtgggattgcttatgttctagatatggatggaaaattcctatctcagtgcaaccatgagcttgtagatctggataaggttgaagaggaagaggatattactactcttagaatgttgatacaacaacatcagcgccacacaaatagtgtgcttgccaaagaagtgctccctgactttgagaatcttgttccaaaatttatcaaggtgttccccaaggagtataaacgagttttggcaagtacgaaatcaaaggaagcttccaaagatgctgtggagtctgcttctaaccatggagaggagcaagatgaaatagaattggtggaggaagatgcttttgaaaagcttaagaaactggctactgcatcgataaatgggaagcctagtgaggctgaatcatccaagaggcctagtcaagtcattgatcctgttaaacacagaggttttgttgcttatgagcgggaaagtgttcagtacagggatcccaatgctcgaataaatgactggaacgaggtgatgaaggaaacaaagcctggtccacttttgaaaacccaatcagcccgttgtatggactgtggtactcctttctgtcatcaggaaaactctgggtgtcctcttggaaataaaataccagaatttaatgagttagtataccaaaataggtggcgtgaagcattagataggcttcttgagacaaataacttcccagagtttaccggtagggtatgcccagcaccttgtgaaggttcttgtgtccttggtattattgagaatccagtatctattaaaagcatagaatgcgctatcatagacaaagcttttgaggagggttggatggtgccacgacctccagctaggagaactgggaaaagagtggccgttgttggaagtggaccatccggcctggcagctgctgatcaactgaataaaatgggccatactgtaactgtgtatgaaagagctgataggattggagggcttatgatgtatggcgttcccaacatgaagactgacaaagtggatatagttcaacggcgggtcaaccttatggcagaagagggaattaactttgtggtgaatgctaatatcgggcatgatcctttatactctcttgatagacttcgggaggaaaatgatgctattgtcttggctgtaggagccacaaaaccaagggatcttccagtacctgggcgggagctgtcaggagttcattttgctatggagtttcttcatgcaaatactaaaagcttgcttgatagcaatctccaggatggcaacttcatttctgccaagggaaagaaagttgtggtcattggtgggggtgacacgggcacagattgcatagggacatccattcggcatgggtgtagtagcattgtaaatctggaacttctccctcagccaccacaaactagagccccaggcaacccttggccacagtggcctcgcatataccgagtagattatgggcaccaagaaggtgcagcaaaatttgggaaagatccaagatcttatgaggtattgactaagcggtttgtgggagatgaaaatggagttgtgaagggacttgaagtaatacgtgtcctctgggagaaggatgaaactgggaggtttcaatttaaggaaattgagggctccgaagagattcttgaggctgacctagttttactggccatgggattccttggccctgagcctacaattgcagagaagttgggtattgagcgagacaacaggtcaaacttcaaggcagagtatggtcgtttctcaaccagtcttaaaggggtgtttgcagccggagattgtcgacgtggtcagtccctggtggtatgggcaatttcagagggacgacaagctgcagcacaagttgacagtttcctcacaaatgaagacatagagcacaatgttgccggaagtccagacgacaagctgcagcacaagtttgcagtgccaaacaaacagtgattacttaggaaagccttctgagatttttcttttctacaagatggaataataagagatggctgctggagattcattgagcattgctggttcgtggttgcggccccatataaatttaggggggaaaataataaagaagcgatttaagggtacaaggatagtgcatagtagaaaattaggaatgttcataggctttgttatggaaaggctatttcttggttaattattgctgtgtggaatgaaaatgtacagtttggtaattaatgatttaggttattgtttccaatttaaattgctttgaaatgagtattgtgaggttcttgctcatctgactgatttttccacacagccaaatgttgattattgcaatgttcttg

SEQ ID NO: 8143 - DNA, 7162 bp, Cajanus cajan
gaaacaccgaggtttttcctttcctttcttattttgttgtcgttttctcagagtgaacaatgtcgaacgcgctgtcgtttacgctcccggcgctgaacaaccctcagctgaacgctctgagtagccctaacaacgcgcgtctgcggctgggcctgagaagcagggtagcccgatgcgcgacgtcgtgcgtggagaggaagaggttgttggggacgcgggtcgggtcggaccggatccggttgctgcaaccggggcggtggccgcggctgagggtggcggttcggtcggcgttctcggcggtgccggagaagccgcaagggctctatgatccggcgatggataaggactcgtgtggggttgggttcgtggcggagttgtcgggcgagagtaaccgcaaaacggtgcgtagagggttggttggttttggatgaggcgtttatgaatagatggggtgtgattgtgtgtgtgcatgtgcactgcaggtgacggacgcgctggagatgttggtgcgcatgacgcacagaggggcttgcggatgcgaagccaacaccggagatggtgccggcattcttgtcgctctgcctcatgcctttttcaaggaggttgtggattttgagcttcctccccaaggaaaatatgcagttggcatgtttttcttgccgaggtctgacaaacgaagggaggaaagcaaaaaaatatttagtcaggttgctgaatctctggggcactcagttcttggatggcgatctgtgcgtactgataacacaggattgggcaaatcggccctgcagaccgaaccagttatcgagcaggtgtttcttacgccaagtgctcaatcaaaagttgatttggaaagacagatgtacatattaaggaagctcagcatggttgctattacatctgcattaaacctccaaaatgatggcattacagatttctatatctgttcactttcatcaaggactgttatttacaaaggtcagctaacaccagctcagttgagggattattattttgcagatcttggtgatgaaaggtttacgagctacatggccctgatacattcacggttttctacaaatacttttcctagctgggatcgtgcccaacctatgcgtgtattgggccacaatggagaaatcaacacactaagaggcaatgttaactggatgaaggctcgtgagggcttattgaaatgcaaggagcttggtttatcagaaaatgaattgaagaaacttttgcccattgtggatgcaaattcatcggattcaggagctttcgatggtgtgcttgagtttttgcttcactcaggaaaaactcttccggaagctgttatgatgatgattcctgaagcatggcaaaatgacaagaacatggatcctcagcgtaaagcattctatgaatacttctcagctctcatggagccatgggatggaccagctcttatatcatttaccgatggtcactatcttggagctacattggataggaatggactgcggccaggccgtttttatgtcacccatagtggacgagtgataatggcaagtgaagttggggtggtagacattcctccagcagatgtgtgtaggaaaggaagactaaatcccggcatgatgcttttggttgattttgagaagcatatagttgtaaatgatgatgccttgaaagagcagtactcattggcaagaccctatgaggattggcttaaacggcaaaaaattgaactcaaagacatagttgactctgttcatgaatctgaaagagtaccaccacccatcgcaggagtggctccactatccagtgatgacacggatatggaaaatatgggaattcatggtttactggctccattgaaagcttttggatatacagttgaatcattggaaatgctattacttcctatggccaaggatggggtagaagcccttgggtcaatgggaaatgacactccattagctgtcatgtctaatagagaaaaacttacttttgagtatttcaagcaaatgtttgctcaggtgacaaaccctcctattgatcctattagagagaaaatagtcacttctatgcaatgcatcgttggtccagaaggtgatctgacagaaatcactgaggagcaatgtcaccgtctttcactaaaaggcccccttttatccactgacgaaatggaagccattaaaaaaatgaattttaggggatggcgcagcaaagttattgacataacttactcaaaggaacttggcaagcgaggcttggagggagcgttggacaggatatgtgcagaagcacatgatgcaattaatgaaggatatacgactcttgtgctgtctgatagagccttctcaaggaaacgtgttgctgtgagctccctcctggctgttggtgctatccaccaacatctagttaaaacacttgagcgcacaagagttgccttaatagttgaatctgctgagccacgtgaagtgcaccatttctgcacacttgttggttttggcgctgatgctatatgcccatatttggctctagaggcaatttggcgactgcaggttgatggaaagatcccaccaaaagcaagtggagaattccactcaaaagatgagttggtcaagaagtatttcaaggcaagcaactatgggatgatgaaggttcttgccaagatgggaatatccactttggcatcatacaaaggagctcagatttttgaagctctgggtctttcatcggaagtgattgagaagtgcttttctggaactccaagtcgtgttgagggtgccacgttcaagatgcttgctcatgatgcttttcaactgcatgagttggcttttccttctcgggttttctctcctggaagtgcagaagccgtagcattaccaaatcctggggattatcactggagaaaaggtggagaagttcacctgaatgatccacttgctatagcaaagcttcaagaggctgccagaagtaatagtgtggatgcttataaacagtattccaagctcattcatgaattgaataaggcttgcaatttgcgtgggctcctgaaatttaaagagacagcagctaagattcctattgatgaagtggagcctgctagtgaaatagtaaaacggttttgcacaggggccatgagttatgggtcaatatcattggaggcacacacatcgttagcaatggctatgaataaaattggagggaaatccaacacaggtgaaggaggggagcaaccatctcgcatggaaccacttcctgatggctcaatgaatcccaaaaggagtgccattaagcaagtggctagtggaagatttggagtttcaagttactaccttacaaatgctgatgaactacagataaaaatggcccagggagcaaaacctggtgagggaggtgaacttcctggccacaaggttataggagacattgctgttactaggaattcaactgctggggtaggacttatcagtccacctccccatcatgatatttattcaatagaagaccttgcccaactaattcatgatctgaagaatgccaatccagctgctcggattagtgtgaagttagtatctgaagctggagtggggataattgctagtggagttgttaaaggacatgccgaccatgtattgatctcaggtcatgatggaggtactggggcatccagatggactggcataaagaatgctggcctgccttgggaacttggcctggctgagactcaccaaactttagttgccaatgatctacgaggtcgtacagtcctccaaactgatgggcaactgaaaactgggagagatgtggccatagccactcttcttggtgcagaagagtttggtttcagtactgccccactcatcactcttggttgcatcatgatgcggaagtgccacaagaatacttgtccagttggcattgctactcaagatccagtacttagagagaagtttgctggagaacctgagcatgttatcaacttcttctttatggtggccgaagaaatgagagaaattatgtcccagcttgggtttagaacagttaatgagatggttggtcgttctgatatgctcgatgttgataaggaagttgttaagagcaatgaaaaactagagaacattgatctctccctattgcttagacctgcagctgaactgcggccagaagctgctcaatactgtgtgcaaaagcaggatcatggtttggacatggccttggataataagctcataagtctttctaatgctgctttggaaaagggactcccagtatacattgaaactcccatctataatgtaaaccgtgctgtgggaactatgcttagccatgaggtgactaaacagtaccacctagctggtcttccaactgacaccatccatatcagatttactgggagtgctggccagagctttggtgcattcctttgtcctggtatcactttggaactggaaggtgatagcaatgactatgttggtaaaggattatctggtggcaagatcatagtgtatcctccaaaaggaagtaactttgaccctaaggaaaacattgtgattggtaatgtggcactgtatggggcgacatgtggggaagcttatttcaatgggatggcagcagaaagattttgtgtgcgtaattctggagcgaaggctgtagtggaaggtgttggggatcatgggtgtgagtacatgactggcgggactgttgttgtgcttggtgaaactggtagaaattttgccgcaggtatgagtggtgggactgcttatgttcttgatatggatggaaaattccaatctcgatgcaacttggaacttgtagatctagatagcgttgaagatgaagaggacattcttacacttagaatgttgatacagcagcatcaacgtcacacaaatagtcagcttgccaaacaagtgcttgatgattttaagaatcttcttcctaaatttatcaaggtgttccctagggagtataaacgtgtacttgcaagtatgaagtcagcggaaacctccaaagatggagtggcgcatgctgctaaagataaacaagagcaagatgatgaagcacaagcagtggagaaggatgcttttgaagagctcaagaaattggctaccgcatctttgaatgagaaaccaagtgaagctgaatcacccaagaggccaagtcgagtcactggtgccattaaacatagaggttttgttgcttatgagcgtgagggtgttcagtatagggatcctaatgttcgcatgactgattggaaggaagtgatggaggagacaaagcctggtccccttttgaaaactcagtcagctcgttgcatggactgtggtactcctttctgtcatcaggaaaattctggatgtcctcttggaaataaaataccagaatttaatgagttagtataccaaaataggtggcgtgaagcattagagaggcttcttgaaacaaacaactttccggagtttactggtcgggtgtgcccagcaccttgtgaaggttcttgtgtccttggtattattgagaatcccgtatctattaaaagcattgaatgtgccatcatagacaaggcttttgaggagggttggatggtgccacgacctccagttaagagaactggaaaaagagtagccatcgttggaagtggaccagctggcttggcagcttctgatcaactaaataaaatgggtcatacagtaacagtgtatgaaagagctgatagaattggagggcttatgatgtatggggttcccaacatgaaaactgacaaagtggatatagttcaacgaagagtaaatctgatggccgaggagggaatagattttgtggtgaatgcaaatgttggacatgatcctttgtactctcttgatcggcttcgagaggaaaatgatgccattgtcttggctgtaggagctacaaaacctagggatcttcctgtacctggacgggagctgtcaggagtgcattttgccatggagtttctccatgcaaacactaaaagcttgcttgatagcgatctccaggatggtaactacatttctgccaagggcaagaaagttgtggtcattggtgggggtgacactggcacagattgcatagggacatccattcgtcatggttgtactagtattgtaaatcttgaactccttcctcagccaccaccaactagagcccccggcaacccttggcctcagtggcctcgtatattccgtgtagattacggtcaccaagaggccgcagccaaatttggcaaagatccaagatcgtacgaggtactgaccaagaggtttgtcggagatgaaaatggagttgtgaaaggacttgaagtagttcgtgtacgctgggagaaggatgaaaccggcaagtttcagtttaaggaaattgaggggtcggaggagattattgaggctgacctagtttttcttgctatgggattccttggtcccgagcctacaattgcagagaagttgggtgtggagcgagacaacaggtcaaacttcaaggctgattatggccgcttctcaactaatgtgaaaggggtgtttgcagctggtgattgtcgccggggtcagtccctggtagtgtgggctatttccgagggacggcaagcggcggcatgggtggacaactacctcgtccaagaccaagatcacaggaatccagatgagcttgtcaagaggccacaaggccgcaacaaaaagcagcagggcagcagcaaacacacggtgatgacttaagtgcctcctgtgatttttcatgctcacaaagttagttccaaaaggaattgcacagaataaagtaacattgttctatgtttgagcacgagattcattggtttatcttaggtattcttgttggcagttgctatcccaaaggggcgaaaataagcagaaagaaataaagagagatttagtgtacggaaagcaagaggttgtcatggtgttgtttggtggtcttacggtataaagtttattgcagattcgagtgttcacttgttcatagtttgttttcattcgggctttattgttaggaaggttattagctcttttagttggtaatggcgacgatgattatatgaaatgaaatgtacagtttgacaattattatttagttatgacatcgtttcaattttaagcttgtttctgaatgagttagctatgtcaatatggggttataa

SEQ ID NO: 8144 - DNA, 7125 bp, Cajanus cajan
gcttccgacggcgaggacgactctgccatgcgaaaacgagagctccgcggtgttcaacgcgcggtgtgcggcgagggtgacgaggtttttcggaacgcggttgcgttcgagcgggaggagcctcggttcggggcggcttcacgtttggcaaatggaggggccgggtcgggcgccgaagctgagggtcgtggttcgctcggctatgtccgccgtgccgaacaagccgctcggcctttacgatccggcgatggacaaggactcatgcggcgtgggattcgtggcggaactgtccggcgaaagcagccgcaaaacggtgaccgatgctttggagatgctggtgcgcatgacgcacagaggcgcttgcgggtgcgaagccaacactggtgatggagctgggattatggttgctcttcctcaccagttttacaaggaggttgtggattttgagcttcctcccctaggatcttatgcagttggcatgcttttcttgcctacatgcaacagtcgctgggaaaagagcaaaaatgtatttcaaaaggttgccgaatctctggggcattctgttcttggttggcgttctgtgcccactgataacacagaattgggcaaatcggccctgctaactgaaccagtgatcgaacaagtgtttcttactccaagtaccaagtcaaaagttgatttggaaagacagatgtatatattaaggaagctttccatggttgctataacatctgcattagacctccataatgatggcatcacagatttctacatctgttcactttcatcaaggactgttgtttacaaaggtcagttaacaccagctcagttgaaggattactattttgcagaccttggcaatgaaaggtttacgagctacatggccctggtgcattcacgattttctacaaacacttttcctagttgggatcgtgctcaacctatgcgtgtattgggccacaatggagaaatcaacacacttaaagggaatgtaaactggatgaaggcacgtgaaggcctactgaaaagcaaggagcttgggctatcggagaatgagttaaagaagcttttgcctattgtcaatgcaaattcatctgattcaggagcttttgatagtgtccttgagtttttgattcagtctggaaaaagtcttcctgaagctgttatgatgatgattcctgaagcatggcaaaatgacaagaacatggatcctcagcgtaaagcattttatgaatacttttcagctctcatggagccatgggatgggccagctcttatagcatttactgatggccactatcttggagcaaccttggacaggaatgggctgcgaccaggccgcttttatgtcacccacagtggacgagttgtaatggcgagtgaagttggggttgtagacattcctctagaagacgtgtgtaggaagggaagactaaatcctggcatgatgcttcttgtggattttgagaagcatattgttgtaaatgatgatgccttaaaggaacagtattcattggcaaggccatatggggagtggctgaaaagacagaagttagaactgaaagacatagttgattctgtccatgaatctgaaagagtgccaccaacaatagcaggagtggtgcaaacatctggtgaagacgtggatatggaaaatatgggaattcatggtttactggctcctttgaaagcttttggatatacaattgaatccttggaaatgttattacttcccatggcaaaagatgggacggaagcccttgggtcaatgggaaatgatactccattagccgtcatgtctaatagagaaaaactcacttttgagtacttcaagcaaatgtttgcccaagtgacaaacccaccgattgatcctattcgagagaaaatagtcacttccatggaatgtatggttggtccagaaggtgacttgacagaaatcactgaggcacaatgccctttccctaaaaggtccccttttatccatcgaagaaatggaagcccttaaaagaatgaattaccggggatggcggagcaaagttatagatataacatactcaaaaggccgtggtaagaaagggttggaggaagccttggacagaatatgtgcagaagcacatgatgcaattagtcatggctacactacccttgtgctgtctgatagagccttctcaaggaaacgcgttgctgtgagctccctactggctgttggtgctgtccatcaatatctagtgaaaacacttgagcgtactagagttgccttggtaatagaatctgccgagccacgtgaagtgcaccatttctgcacacttgttggcttcggtgctgatgctgtatgtccatatttggctgtagaggcaatttggcgattacaggttgatggaaagataccaccaaaagcaagtggtgaattatactcaaaagatgagttggttaagaagtatttcaaagcaagcatctatggaatgatgaaggtgcttgcgaagatgggaatatctactttggcctcttacaaaggtgctcagatttttgaagctctgggtctttcttcagaagttattgaaaggtgctttgctggaaccccgagtcgagttgagggtgcaacatttgagatgcttgctcgtgtcgctcttcaatcgcacgagttagcatttccttctcgggttttctctcctggaagtgctgaagcaatagcattgccaaatcctggggattatcattggagaaaaggtggtgaaattcacctgaatgatccacttgccatatcaaagcttcaggaggctgccagaactaacagcatagatgcatataaacagtactctaagctcattcatgagttaaataaagcttgcaatttgcggggacttctgaaatttaaagaggcagcagtgaaagttcctcttgatgaagtagagcctgctagtgagatagttaaacggttttgcactggagccatgagttatgggtcaatatcattggaggcacacactgcattggcaactgctatgaataagattggagggaaatccaacacaggtgagggaggtgagcagccatctcgtatggagcctcttcctgatggctcaaggaacccgaaaaggagtgctatcaagcaggtagctagcgggagatttggagtttcaagttactatctgacaaatgccgatgaattgcagataaagatggcccagggcgcaaaacctggtgagggtggtgaacttcctggccacaaggttataggagacattgctgtcacaaggaattcaactcctggtgtaggacttatcagcccacctcctcatcatgatatttactccattgaagatcttgcccaattaattcatgatctaaagaatgccaaccctgctgctcgaattagtgtgaagttggtatctgaagctggagttggtgtagttgccagtggagttgttaaaggccatgctgatcatgtcttgatctctggccatgatggaggtacaggggcatccagatggactggcataaagaatgctggtctcccttgggaacttggcttggcggagacccatcaaactttggttgctaatgaccttaggggtcgcacagttgtccaaactgacgggcaacttaaaacaggaagagatgtggccatagccgctcttcttggtgcagaagaatttggtttcagtacagctccactcattacacttggttgcatcatgatgcgcaagtgccacaagaatacctgccctgttggcattgccacccaagatccagtacttagagagaagtttgctggagaacctgagcatgtcattaacttctttttcatgatagcagaagaaatgagagaaattatgtcccagcttgggtttcggactgtcaatgagatggttggccgttcagatatgctcgaagttgataaagaagttgttaaaagcaatgagaaactagagaacattaacctctctttattgcttagacctgcagctgaactgcggccagaagctgctcagtactgtattcaaaaacaagatcatggtttggacatggccttggataataagcttataagtctgtccagagctgctttggaaaagggtctccaggtatacatagaaagtccaatctataatgtaaaccgtgctgtgggaacaatgctaagccatgaggtgactaaaaggtaccacttaaagggtcttccaactgacactattcatatcagatttaagggcagtgcaggtcagagctttggcgcattcctctgtcctggcatcactttggaacttgaaggcgatggcaatgactatgttggtaaaggattgtcaggtggcaagattgtagtatatcctccaaaggtaagtacctttgaccctgagaagaatattgtaattggtaatgtggctctatatggggccacaactggtgaggcatatttcaatgggatggcagctgaaagattctgcgtgcgtaattctggggctaaggcagtagtggaaggtgttggcgatcatggatgtgagtacatgaccggtgggatagttgttgtgcttggaaacacaggcagaaattttgctgcaggtatgagtggtgggattgcttatgttcttgacatggatggaaaattcctatctcggtgcaacagtgagcttgtagatctggataagattgaagaggaagaggatattagtactcttagaatgttgatacaacaacatcagcgccacacaaatagtgggcttgccaaagaagtgctcgctaactttgagaatctccttccaaaatttatcaaggttttccctaaggagtataaacaagttttggcaactatgaaattgaaggaagccaccaaaaatgcagcagagcctgcttctaaacatcgagaggggcaagatgaaatagaattggtggagaaagatgcttttgaagagctcaagaaagtagctactgcatcgttgaatgggaagcctagtcaggatgaagcatccaagaggcctagtcaagtaagtgatcctgttaaacatggaggttttgttgcttatgagcgggaaggtgtccagtacagggatcccaatgctcgaataaatgattggaaagaagtgatgatggaaacaaagcctggcccacttttgaaaacacaatcagcccgttgcatggactgtggtactcctttctgtcatcaggaaaattctgggtgtcctcttggaaataaaataccagaatttaatgagttagtgtaccaaaataggtggcgtgaagcattagagaggcttcttgagacaaataacttcccagagtttactggtagggtatgcccagcaccttgtgaaggttcttgtgtccttggtattattgagaatccagtatctattaaaagcatagaatgtgctattatagacaaagcttttgaggagggttggatggtgccacgacctccagctaggagaactgggaaaagagtggccgttgttggaagtggaccagctggcttggcagctgctgatcaactgaataaaatgggccatacagtaactgtatacgaaagagctgataggattggagggctcatgatgtatggggttcccaacatgaaagctgacaaagtggatatagttcaacggcgggtcaaccttatggcagaggagggaattaactttgtggtgaatgctaatatcgggcatgatgctttatactctcttgataggcttcgagaggaaaatgatgccattgtcttggctgtaggagccacaaaaccaagggatctcccggtacctgggcgggagctatcaggagttcattttgctatggagtttcttcatgcaaacactaaaagcttgcttgatagcaatctcgaggatggtaacttcatttctgccaagggaaagaaagttgtggtcattggtgggggtgacacgggcacagattgcatagggacatccattcggcatgggtgtactagcattgtaaatttggaacttctccctcagccaccacaaactagggctcctggcaatccttggccacagtggcctcgcatttaccgtgtagattatgggcaccaagaaggagcagctaaatttgggaaagatccaagatcttatgaggtattgactaagcggtttgtgggagatgaaaatggagttttgaagggacttgaagtggtacgtgttcgctgggagaaggatgaaactgggaagtttcaatttaaggaaatcgaaggttctgaggagattattgaggctgacctagctttactggccatgggattccttggccctgagtctacaattgcagagaagttgggcatagagcgagacaataggtcaaacttgaaggcagagtatggtcgcttttcaacgagtgttagaggggtgtttgcagctggagattgtcgacgcggtcagtccctggtggtatgggcaatttcagagggacgacaagctgcagcacaagttgacagttacctcacaaatgaagatatagagcacggtattgctgggaatccagatgaacttatcaagaagcagcaggacctaaccaagaggggcaccgtggcagtggcaaacaaacaatgatgacttcggagccttctttgattcttcgtttcttacagcactagttactaggtagaataaataaaagaaaatatggcttcaaggttgtgctagagattcattgaacattattgattgggagttggtgcgccatatacatttaagcggggaaataataaagaaaggagatttagtatacgcaaagcaagatgtttgttttgccgtatagtgcataagggtacaaggttagagcataggaaattataaatgtttatagcttttatgcagaagcttcgtgttggaaacagggaaggttagttcttagttaattatggtcttatgtggaatgaaatgtacagtttcatgattaatgatttaagattattgtttccaatttaaatcgctttgagtgagtattgatgttctagaatatgtgagctcctcatctgactgacttttccacagccaaatgctggttacagtgttctcctgggaggaggtttcaaatatcgatttatttgtttggtatgaatagaattgaaattagagactctgaatttggatacacttgaaagttaaataaattggatgtttc

SEQ ID NO: 8145 - DNA, 6423 bp, Echinacea purpurea
tgtgggtgtgagacgaacaccggtgatggtgccggaattcttgttggtcttccacatgagttcttcaaggaggtggcaaaggatgaggggtttgagctaccgccactgggtcaatacgcggtcggcatgttcttcttgcccacttctgatactagaagggagcaaagtaagattgtgtttacaaaggttgccgagtcacttgggcacactgttcttggctggcgtactgtcccgacagataattctggtttgggtaaatctgctgtacaaaccgagcctgttatagaacaagtgtttctcactcccacttctaggtccaaggtcgattttgagcggcagatgtacatactaagaagggtttcgatggtagccatcagggctgcattgaaccttcaacatggtggtgttaaggacttctatatatgttctttgtcatctagaactgttgtatacaaaggccagttaaaaccgaaccagttgaaggagtattatcatgcagatcttggcaatgaaaggtttacgagctacatggcaatgattcattctcgattttcaacaaacacttttcctagctgggatcgtgctcaacctatgcgtgttcttggacataatggtgaaattaacacgcttagaggcaatgttaattggatgaaggcacgtgaaggtcttttaaaatgcaaagagctaggtctctccaagaatgagatgaaaaaacttcttcccattgtagacgccagttcatcagattcaggtgcttttgatggtgttttggaacttttagtgcgagctggcagaagtcttcctgaggcagttatgatgatgatccctgaagcatggcaaaatgacaagaacatggatcctcaaaggaaggctttgtatgaatattgctcagctttaatggagccatgggatgggcccgctctagtttcatttactgatggtcggtaccttggagcaacactggaccgaaacggactgcgaccgggtcggttttatgttactcacagtggacgtgttataatggcaagtgaagttggagttgttgatattccgccagaagatgttgctagaaaaggaagactgaaccctggaatgatgcttcttgtcgactttgacaaacatatcgttgtagatgatgaagctttgaaacaacagtattctcttgcaagaccatatggcaaatggcttgaaacgcaaaagatagaactgaaaaagatcgtggaatctgttaataaatctttacggtcttgccctcccatagctggagtgtcaaaggctgaggaggacatgggtatccagggtctcttggctccattgaaagcttttggttatacaattgaatccttggaaatgcttttactaccaatggctaaagacggtgttgaggcactgggttcaatgggaaatgatgctccgttggctgtgatgtctaacagagagaagctaacatttgagtacttcaaacaaatgtttgcacaagtaaccaacccaccaattgatcctataagagagaaaattgtaacttcaatggaatgcatggtgggcccagaaggcgatcttacagaaacaacagaagagcaatgccatcgtctttcactaaaaggcccactcttatctattgaagagatggagtccattaaaaacatgaactacagaggctggagaagcaaagttcttgatataacctaccctaaagaacttggcaaaaagggtttggaggaaaccctagatagaatctgttctcaggcgcatgatgcaattaaagagggctatactacattggtgctttctgacagagctttttcatcaaagcgagttgcagtaagctctcttttggcagttggtgcggtccaccatcatttggtcaaaaagctggaacgaaccagggttgcgttaatggtggaatccgcagagccacgtgaagtgcaccatttttgtacgcttgttgggtttggcgctgatgccatttgcccctatttggcagttgaagccatttggaggttacaagctgatggtaaaatcccaccaaaatccaacggtgagttccacacaaaagaggaattagttaagaagtactataaagcaagtcactatggaatgcaaaaggttcttgccaaaatgggaatttcgactttagcatcatataaaggtgctcaaatctttgaagcagtcgggttatcgacagatgtgatggaaagatgctttgccggcactccaagtagagttgaaggagctacgtttgaagcacttgctggtgatgcgcttaacttgcatgatttaggttttccagcacgcaagttcccgccaaacagtgcagaagctgttgctttgcctaaccctggtgattaccattggaggaaaggtggtgaaattcatttgaatgacccgttagctattgcaaaactgcaagaagctgctaggggaaacagtgttgctgcatataaagagtattcaaaacgcattcatgaattaaataagacttgtaatcttcgtgggcttttgaagtttaaagagggaaatgcgaaggtgcctttggaagaggttgagcctgctagtgaaatagtgaaacggttctgtactggtgccatgagttacgggtccatatccttggaggcccacacaacccttgctattgctatgaataaaatcggaggcaaatctaacacaggtgagggaggtgaaaatccatctcgtttggtatcgcttccagatggttcaatgaatcccaaaaggagtgcaatcaagcaggttgctagtgggcgatttggggtttcaagttattaccttacaaatgctgatgaattgcagataaaaatggctcagggagcaaagcccggtgaaggtggtgaacttccggggcacaaagttattggagatattgctgtcacaagaaattcaacagctggagttggattaattagccctcctccacatcatgatatctattcaatcgaagaccttgctcagttaattcatgatttaaagaatgcgaatccttctgctcgagtaagtgtgaagttggtttctgaagctggtgtgggagtgattgctagcggtgtggtcaagggccatgcagaccatgttttgatctcgggtcatgatggtggaaccggtgcttccagatggacggggatcaagagtgctgggctcccatgggagcttggtctagccgagacacaccaaactcttgttgcaaacgaccttcgtggtcgaactgtattacagactgatggtcaactaaaaacggggagagacgtagccattgctgcccttcttggggctgaggagtttggtttcagtacagccccacttatcactcttggttgcatcatgatgaggaaatgtcacaaaaacacttgccccgttgggatagccacccaagatcctgttctccgtgagaaatttgcaggggaacccgaacatgtaatcaatttcttcttcatgttagcagaggaaatgagggaaatcatggctgatttgggtttccgaactgttaatgaaatggtgggacgtgcagatatgcttgaagtagataaggatttgacaaaggacaatgagaaactaggaaacatcgatctgtcgctattacttcgaccagccgctgatatccgcccggatgctgcccaaatttgtgtacaaaaacaagatcacgggttagatatggctcttgatcaacggttaataccgcttgctaaaccagctttagaaaagggtttacctgtatacatcgaatcacctatttgtaatgtaaaccgtgcggttgggacgatgcttagtcatgaagttactaaacgataccacttggctggccttccagccgacactatccatatcaaacttaatggtagtgcaggccagagtattggagccttcctttgcccgggaattttgcttgagcttgaaggagacagcaatgattatgttgggaaagggttgtcaggtggcaagattgttgtttatccaccgaagggaagcgggttcgaccctaaagaaaacattgtgatcggaaacgtggctctttatggtgcaacgagtggtgaagcttattttaacgggatggcggcagagcgtttctgcgttagaaactcgggggctaatgcggtggtggaaggtgtcggtgatcatgggtgtgaatacatgacgggtgggactgttgtcatattgggtaaaacagggaggaactttgctgctgggatgagtggtggaattgcctatgtccttgatgttgacgccaagttccggttaagatgtaacgctgagcttgttgatcttgataaggttgaagatgaggatgatattatgactctaagaatgatgattcagcaacaccaacggtacacaaacagccagctggctaaggaagtactggctgactttgacaaccttttgccaaaatttattaaagttttcccgagagattataagcgtattcttgctaccatgaaagaaaaagaaaacgccaaaaatgctgctgctgagatggctcctgaagaagccgatattcgggaggaagatgagttgaaggagaaagatgctttcgaggagcttaaaaagttggcagccaaagcattgagtgaggcggtcaatattaatgtcaaagaaatggtcaatgaggtcaaagaggttgaaatggctgaaccagccacgagaccatcccgagttgaagatgcagtcaaacaccgtggttttgttgcttacgagcgtgagggagtatcgtaccgggacccggctgttcggatggaggactggaatgaagttatggaagagacaaaacctggccctcttttaaaaactcaatctgcacggtgtatggattgtggtacaccattttgtcatcaggataactcgggttgtcctctcggcaacaaaattcctgaattcaacgagctggtttatcagaaccgatggcgtgaggcattagatcgactccttgagacaaataacttcccagagttcaccggccgggtctgccctgctccatgtgaaggttcttgtgtgctcggtataattgaaaatccagtctcgattaaaagcatagagtgctcgatcatagacaaagcctttgaggaaggatggatggtgcctcgacctcccctcaagagaaccgggaaaaaagtagctattgttggaagtggtcctgctgggttagctgcggctgatcaactaaatcgattgggccatacagtgaccgtgttcgagcgtgctgaccgaattggtggactcatgatgtatggggttcctaacatgaaggctgacaaaatcgacgttgttcaaagacgggttgacttgatggctgaggaaggtgtgaattttgtggtcaatgccaacgtaggaaccgatccatcacattccattgaacggcttcatgaagagaatgatgccgttattttagcagtggggtcaacaaggccgagggaccttcctgttcctggacgagagctttcggggatacattttgctatggagtttttgcatgcgaatactaaaagcttattggatagcaatctcgaggatggtaattatatctctgccaagggtaaaaaggtaattgtaattggtggtggtgacaccggtacagattgtattgggacatccattcgccatggttgcaccagcattgtaaatctggagcttcttccccagccaccacaaacccgagcacctggcaacccctggccacagtggcctcgtgtattccgtgtagattatggacaccaagaagctgctacgaaattcggtaaagacccgcggacatatgaagtcttgactaaaaggttcattagtgacgataatgggtcagtaaaaggtgttgaggtggtgcgtgttcagtgggcgaaggacgagaccggtcagtttaagttcaaggaggttgagggttctgaggagatcctcgaggctgacctggttttgctagccatgggcttcctcggtcctgaatcgacaatagcggacaaactaggattggagaaagacgggagatcgaatgttaaggcggagtatgggcggttttcgacaagcgtggaaggcgtgtttgcggcgggtgattgccgaagagggcagtcgttggtggtgtgggccatctcagaagggcggcaggcggcagcacaggtggataagtttttgtcgaaagatgagaaggatgttgaaagcagattagaaaaggggaagagggagcagcaagcagttcggacattatagattgatacatacaagattgatgttaaaaaaggaaagggttatagagaggtggttttgtgtgggaagttagttttgtgtccttcaggctctgctgtttatagccttcttttctttttgttattggttgttgcttgtttttaactttgaaacaataaatgtacagatgaatctgttttgggtttttgttatttttaatccaaatggttaacatactgttttggccaa

SEQ ID NO: 8146 - DNA, 8074 bp, Cicer arietinum
aaccatataatgggacccacacacaaacggctgtcgcgtgccgcatagtcgcatctcacacgtgtcgtcaccgtgattcctttgctgtcaacgaaagaaaactgaaaaacagtgaggactgagttggtaaaattactaacacacacaccaaaacacaaatacacaactatgtgggtcccacaagaaatgggtcccacttctttttctcatctttctctctcgcactcattataaatccatcctctccctctatcaaccgaagaaccctcacacaatcgccgctattctctctctctgtctcgttttttcctctctcatttttttcttacagtttcagattcgaatctcgctaaatcatttctgcaaaaattcggatcttataccttttcacttgaataaattcagatctaaatcaattgatgtgaaaaacgtctccaatttttacatttcatcaatttttcctccatttccataacaaaatctgaaacacttaattaacagtatctcataataattaccgaacataatttcagcgaccagttacaaaaaagccaaaacgtgaaggctattaattttcccattttcaaaattttgaattttcattttgtcgttttggttgaacaatgtcgaacactgcgtcggtaacgtttacggcgttgaacaatcctcaaataaacgcgataagaaacccaaacgggcggttacgtcctttagcgagcgtgcgaagcagggttacgagatgttccgccacgtgtgtggagaaaaagaggtggttagggactcgattacgcgggagcggttcggaccgggttcaattttgggaatcgggtggaccggggaggttaccgaagctgagagtggcggttaagtcgtcattttcggctgtacctgagaaaccgatggggctttacgatccggctatggataaagattcgtgtggtgttggattcgtggctgaattgaacggtcaaagtagtcgtaaaacgataactgatgcgttggagatgttggttcgaatgacacatagaggtgcttgtggatgtgaagcaaatactggtgatggtgctgggattcttgtggctctgcctcatgctttctatcaagaggtgttggattttcagcttcctccccaaggaaaatatgcagttggcatgtttttcttgcctaaatccgacagccggaggaaggaaagtaaaaatatatttaaaaaggttgccgcgtctctcggtcacactgttcttggttggcgttctgtgcccacagataacacaggattgggaaaatcagccctgcagaccgaaccagtgattgaacaggtgtttattacaccaagttctcactcaaaagttgatctggaaaaacagatgtacatactacggaagctcagtatggctgctattacatctgcattaaacctccaaaatgatggaataacagatttctatatctgttcactgtcatcaaggactgttatttacaaaggtcagctaacaccagctcaattgggggactattataatgcagatcttggcaatgaaaggtttacgagctacatggccctggtacattcccgattttctactaatactttccctagctgggatcgtgctcaaccttttcgtgtattgggccacaatggagaaatcaacactctccggggaaatgttaactggataaaggcacgtgagggcctattgaaatgcaaggagcttggcttgtcagaggatgatttaaagaagtttttaccaattgtggatgcaaattcatcagactcaggatgttttgacggtgtccttgagtttttgcttcattctgggaaaagtcttcctgaagctgtcatgatgatgattcccgaagcatggcagaatgacaagaacatggaccctcaacgtaaagcattttatgaatactactcagctctgttggagccatgggatgggccagctcttatatcttttaccgatggtcactatcttggagcaactttggataggaatggattgcgacctggccgcttctatgtcacccacagtggacgggttataatggcaagtgaagttggcgttgtagatattcctccagaagacgtgtgcaggaaaggaagactaaatcctggtatgatgctactggtggactttgagaagcatattgttgtgaacgatgatgccttaaaagagcaatactcattggcaagaccctatggggattggcttaaaaatcagaagattgaactgaaagacatagtcgactctgttcatgaatctgatatagtgccaccaaccataacaggagtggctccactatctaatgatgacgtggatatgggaaatatgggaattcatggcctgctggctccattgaaggcttttgggtatagtgttgaatcattggaaatgctattacttcccatggcaaaagatggtgtcgaagcacttgggtcaatgggaaatgatactccattagctgtcatgtctaatagagaaaagcttacttttgagtatttcaagcaaatgtttgctcaagtgacaaatcctcctatcgatcctattagagagaaaattgtcacttcaatgcaatgtatggttggtccagaaggtgatctgacagaaaccaccgaggaacaatgccaccgcctttcactaaaaggtccccttttaaccactaaggaaatggaagccataaaaaaaatgaattataggggatggcggagcaaagttatagacataacttactcaaaggaacgtggtaagaaagggttggaggaagccttggacaggatatgcacagaggcacacaacgcaattgatgaaggctacactacccttgtgctttctgatagagccttctcaaggaaacgtgttgctgtgagctcccttctggctgttggtgctgtccaccaacatctagttaaaacacttgaacgcacaagagttgctctaatggttgaatctgctgagccacgtgaagtgcaccatttctgcacgcttgttggttttggcgccgatgctatatgtccatatttggctgtagaggcaatttggcgactgcaggttgatggaaagatcccaccaaaagcaagtggtgaattccactcaaaagatgagttggtcaagaagtatttcaaagcaagcaactatggaatgatgaaggttcttgctaagatgggaatatcaactttggcttcatataaaggtgctcagatatttgaagctctgggtctttcttcagaagtgattgaaaagtgctttgctggaactccaagtcgagttgagggtgcaacgtttgagatgcttgctcatgatgctcttcatctgcacgagttggcttttccttctcgggttttctctcctgggagtgcagaagcagtagcattgccaaaccctggggattatcattggagaaagggaggcgaagttcatctgaatgatccacttgctattgcgaagcttcaagaagctaccagaactaacagtgtagaagcatataaacagtattccaagaccattcatgaattgaataaggcttgcaatttgagagggcttctgaaatttaaagagacatcatgtaagatttctattgatgaggtcgaacctgcaagtgaaatagttaaacgattttgcactggtgccatgagttatgggtcaatatcgttggaggctcacacagcattagcaacggcaatgaacaaaattggagggaaatccaacacaggcgagggaggtgagcagccatctcgtatggagcctcttgctgatggctcaaggaatcccaaaaggagtgccattaagcaggttgctagtgggagatttggagtttcaagttactaccttacaaatgctgatgaacttcagataaagatggcccagggagcaaaacctggtgaaggaggtgaacttcctggccacaaggttgtaggagacattgctgttactaggaattcgacagccggtgtagggctcatcagtcctcctccccatcatgacatttattcaattgaagatctcgctcaattaattcatgatctgaagaatgccaacccagctgctagaattagtgtgaaactagtatctgaagctggagttggggtaattgctagcggagttgttaaaggtcatgctgagcatgtcttgatctctggtcatgatggcggtacaggagcatccagatggactggcataaagaatgcagggctgccttgggaacttggtctggccgagacccaccagactttggttgctaatgacctacgtggtcgcacaactctccaaactgatggacagctgaaaacgggaagagatgtggcaatagccactcttcttggtgcagaagagtttggtttcagtactgctccactcattactcttggctgcatcatgatgcggaagtgccacaagaacacctgtcctgttggcattgctactcaagatccagtacttagagagaaatttgctggagaacctgagcatgttattaacttcttttttatggtggcagaagagatgagagaaattatggcccagcttgggtttagaacagtcaatgaaatgattggccgttcagatatgctcgaagttgataaagaagtcattaagggcaatgcaaaactagagaacattgatctctctctattgcttcgacctgcggctgaactgcgcccagacgctgcacaatactgtgtgcaaaaacaagatcatagtttggacatggctttggataataagctcataagtcagtccaatgctgctttggaaaagggtctcccagtatacattgaaacaccaatatgtaatacaaaccgtgctgtgggaactatgcttagccatgaggtgactaagaggtacaacttagctggtcttccatctgacaccatccatatccaatttactggtagtgcaggccaaagctttggtgcattcctctgtcctggcatcactttagaacttgaaggtgatagcaatgactacattggtaaagggttatcaggtggcaagattgtagtatatcctccaaaaggaagcacttttgaccccaaggacaacatcataattggcaatgtggcactgtatggggcaacacgtggtgaggcatatttcaacgggatggcagcagaaagattttgtgtgcgtaattctggggctcaagctgtagttgaaggtgttggtgatcatggatgtgagtacatgactggtgggactgttgttgttcttgggaaaactggtagaaattttgctgcaggcatgagtggtggaatcgcttatgttcttgatgtggatggaacattccagtctcggtgcaaccttgagcttgtagatctggataaggttgaagaggaggaggacattattactctaagaatgttgatccagcaacatcaacgtcacacaaatagtgcgcttgccaaagaagtgcttgttgattttgagaatgttgttcctaaatttgtcaaggtgtttcctcgggagtataaacgtgttcttgcaagtattaagtctgacgcaacctctaaagatgcagtggagtctgctgctaaagatgtagatgggcaagatgatgaatcccaagcagtagagaaggatgcttttgaagagctcaagaaactggcaactgcatctttgaatgagaaaccaagtgaggctcccaagaggccaagtcaggtcattgatgctgttaaacatagaggttttgttgcttatgagcgtgagggtgttcagtatagggatcctaatgttcgcctgaatgattggaaggaagtgatgatggagacaaagccgggcccgcttttgaaaacacaatctgcccgttgcatggactgtggtactcccttttgtcatcaggaaaattctggatgtcctcttggaaataaaataccagaatttaatgagttagtatatcaaaataggtggcaagaagcattagataggcttcttgaaacaaacaactttcccgagttcactggtcgggtgtgcccagcaccttgtgaaggttcttgtgtccttggtattattgagaatcctgtatctattaaaaacattgaatgtgctatcatagacaaggcttttgaggagggctggatggtgccacgacctcctgtcaagagaactgggaaaagagtagccatagttggaagtggaccatctggcttggcagctgctgatcagctaaataaaatgggtcatacagtaacagtgtttgaaagagctgatcggattgggggccttatgatgtatggggttcccaacatgaaaaccgacaaagtggatatagttcaaaggcgagtcaatctcatggcggaggaaggagtaaattttgtggtgaatgctaacattggacacgatcctttatattctcttgaacggcttcgagaggaaaatgatgccattgtcttggctgttggagccacaaagccaagggatcttcctgtacctggaaggcagctatcaggagttcattttgccatggagtttcttcatgcaaacactaaaagcttgcttgatagcaatttacaggatggtaactacatctctgccaagggaaagaaggttgtggtcattggtggcggtgacactggcacagattgcatcggaacatccattcgtcatggttgtactgccgtcgtaaatcttgaacttctccctcagccaccaccaactagggccccgggcaacccatggcctcagtggcctcgcatattccgtgtagattacgggcaccaagaagcggagtctaaatttggcaaagatccaagaacatacgaggtactgactaagcggtttgtgggagatgaaaatggagctgtgaaaggtcttgaagtggtacatgttcgctgggagaaggatgaaaccggcaagtttcaatttaaggaaattgagggcagtgaagagattattgaggcagacatagttttactagccatgggattccttggtcctgagtcgaatattgcagagaagttgggtgtggagcgagacaacaggtcaaacttcaaggctgattatggtcgcttctcgaccaatgtgaatggggtgtttgcagcaggtgattgtcgccgcggtcagtcgttagttgtatgggctatttcagagggaaggcaagctgccgcacaagtcgacagctacctcaccaaagaagaccaagaccataatattgatgggaatcaggatgaatttgtgaagaggcaaaaagatctcaacaagaagcaccaggacagtggcattcacacagtgatgacataggatatgtcttctgtgatttttatgttggctgagttcctaaatcaaatgcacagaataaaaaagaaaatgaatgttcaatgattaagcaggactttcattggtttttccttttaggcattcttggttggcagttggtatgctgcagggcgaaataaggagaaaaacaaataaagaaaaataatttagtgtaaggaaaacaagaatcatcagtcttggtttttagtggggtattagtagagtactaggttatttcagatttgagtgttcatagttcttatttggacttcaattatttgggaagttagctcgtcgttatgattttatgaaatgaaatgtacagtttgataattatttatttatttactctggtgttcaatgcgatcttgtgtggttgacttcatgcacggttataattgtgttctttctgatgtgtatttaattccttgtgataccatcggattgatttgtgaatgctgggaggaggtgtattgtgaattgtgatatgcggaattggaattatcttagcatatatgttgggcaattcgtaatgtgatgattgtgtttcccggattgtgatcctctcgtctttttctttgaggtcgtgagagtattagatacaaatttaatttttattaattttatataaataaaataaagtaaaataatatttttgtatctaatactcccacaatatggaacaaaaaggatcgtaatccgcgtttctcaactggcagtggccggtggtcatctaagtcctctttttaacaatataagatgttgtcccttttgggattaccgagtaaaataaggagagatgcacatctcccacattgtttacaggc

SEQ ID NO: 8147 - DNA, 6620 bp, Manihot esculenta
ctaacgcctgttctctttcaaccgtcagtaaaccctcattttcgcctaaattaaatgttattgctcccttatctcgccggaatgataacagaactgcccgatgctccgtcgcctataaatcgacggtgctggataaaaagttttttgggaccaaactgcgggctcttggaacggagaggcttcatttatggcaatcggatgggcccggaaagtcaccaaagctccgagtcgtggttcgttccgcattgtccggagtgccggagaaacccctaggtctttatgatccgtcatttgataaggactcgtgtggggtcggattcgtggctcagttatccggtgaaagcagccgcaaaactgtgacagatgcgctggagatgttgatacgcatgtcgcatagaggtgcatgtgggtgtgaaacgaataccggtgatggagctgggattcttgtggcgcttcctcaccacttttacaaggaggttgctaaggatatggggtttgagctgccgccacctggggaatatgcagttggcatgttctttttgcccacatcggacagccgaagggaagaaagcaaaaatgtgtttgctaaggttgcggagtctcttgggcatacagtccttggctggcgtcaagtaccaacagacaactctggattgggcaagtctgctttgcagactgaacctgtggttgagcaagtgttcctcacacctagtcctaggtcaaaagctgatttggaacaacagatgtacatattaagaagagtttcgatggtggctatccgagctgcgttgaaccttcagcatggtggtgttagggatttctatatatgttctctttcctcgaggactgttgtctacaagggtcagttgaagcccattcagttgaaggagtactattatgcagatcttggcaatgaaaggtttacgagctacatggccctgatacactctcgattttctacaaatacatttcctagctgggatcgtgctcagcctatgcgtgtcttgggccataatggggaaattaatacacttagaggcaatgtgaattggatgaaggctcgtgagggtctattgaagtgtaaggagcttggtctgtccaagaatgagatgaagaagcttctaccaattgtggatgctagttcttccgactcagggtcttttgatggtgtacttgagcttctagttcgagctgggagaagcctccctgaagctatcatgatgatgattcctgaagcttggcaaaatgataagaacatggatcctcatcggaaggccttgtatgaatatttctcagcccttatggagccatgggatgggcctgcacttatttcatttacggatggtaggtacctgggagctacactggatcgtaatggactgcggccaggcagattttatgttactcgaagtggacgggttattatggctagtgaagttggtgttgtagacattccacctgatgatgtccttaggaaagggagacttaatcctggaatgatgcttctggtggattttgagaaccatatagttgtagatgatgaagcgttgaagcagcagtactccctagcaaggccctatggggagtggctgaacaggcaaaaaattgaactcaacgatattgttggctcagttccagtagctgatctggctattcctcctatagctggagcagttactacatctaatgatgatgacaacatggagaacatgggcattaatggtttactagcaccgttgaaagcttttggttatactgttgaagctttggagatgttgttgcttcccatggcaaaagatggggctgaggctcttggttcaatgggaaatgatgctcccttggctgttatgtctaatagggaaaaactcacttttgagtacttcaagcaaatgtttgctcaagtaacaaaccctccaattgatcctatgagagagaagatagtcacttccatggagtgcatgattggaccagaaggtgacctgactgaaacaaccgaggaacaatgccatcgcctttcactaaaaggccctctcttagctgttgaggaaatggaggcaattaaaaagatgaattacagaggctggcgaagcaaagtcctggacataacttactcaaaggaccatggtagaaagggattagaagagacattagaaaggatttgtgctgaagcacgtgatgcaattagcaagggttatactttattggttctttcagatagagccttctcatcaaaccgtgtcgctgtaagctccctcttggctgttggtgctgtccatcaacacctggtaaagaagcttgagcgcacccgtgtaggtttgatagttgaatctgctgaaccacgtgaagtgcaccatttctgtacattggtaggatttggtgctgatgccatatgcccatacttggctatagaagccatttggagattgcaggttgatgggaagatcccaccaaaagctactggtgaattccactcaaaggatgaggtagtcaagaagtatttcaaagcaagcaattatggaatgatgaaggttcttgctaaaatggggatttcaactttggcctcctacaggggtgctcagatttttgaagctctgggcctttcctcagaagttattgagaagtgcttcgcaggaactcccagcagagtagagggagcaaactttgagatgcttgctcgagatgcacttcatttgcatgaattagcatttcctacccgggtctaccctcctggaagtgctgaatctgtagctctccccaatcctggggattaccattggaggaagggcggtgaaatccacttgaatgatcctcttgctatagcaaagcttcaagaagctgctagagccaatagtgtggctgcctataaggaatattctaggcacattcaggagttgaacaaagcctgcaatttacgtgggcttttaaagttcaaagaggcagaggtaaaagtaccattagatgaagtggaaccagccagtgaaattgttaaacggttctgtactggagctatgagctatggatcaatatccttggaggcacactctacgcttgctattgctatgaataaaattggaggcaaatcaaacactggtgagggaggtgaacaaccatctcgcatggagcctcttccaaatggttcaatgaatccaaagagaagtgcaatcaagcaggttgcaagtgggagatttggagtttcaagttattatcttacaaatgctgatgaactccagatcaagatggctcagggcgcaaagcctggggagggaggtgagcttcctggccacaaggtcataggggatattgcagttaccagaaattctactgctggtgtgggacttataagtcctcctccacatcatgacatctactcaattgaagaccttgcccagttgattcatgaccttaagaatgccaatcctggagctcgaattagtgtcaaattagtatctgaagctggtgtcggggtaatcgcgagtggtgtggtgaaggggcacgctgaccatgtgttgatctcaggtcatgatggaggtacaggggcttctaggtggactggtataaaaaatgctgggctcccatgggaactaggtttggctgagacccaccaaacacttgttgcgaatgaccttcgtggccgcactgttcttcagacggatggccaacttaaaactggaagagatgtggccattgctgcacttcttggtgctgaagaatttggcttcagtactgcacccctcattacacttggttgcatcatgatgcgaaaatgccacaagaatacttgccctgtgggcattgccactcaagatccagttttgagggaaaaatttgctggaaaacctgagcatgttatcaatttcttctttatgttagcagaggaggtaagggagataatgtctgatcttggtttctgtacagttaatgagatggttggtcgatcagacatgcttgaagttgataaagaagtcacgaagaacaatgagaagctggaaaacattgatctctccctgttacttagacctgctgctgatatacggcctgaagctgcccaatattgtgtccaaaagcaggatcatggcttggacatggccttggataataaattgatagaactgtcaagggctgctttggaaaaaagtcttcctgtgtacattgagactccaatctgcaatgtgaatcgtgctgtgggaacaatgctcagtcatgaagttactaaacgttaccacttgaatgcgcttcctgcagatactatccatgtcaagcttaatggaagtgcagggcagagtctgggagcttttctatgctctggcatcttcctggagcttgagggtgacagcaatgactatgttggtaaaggattatcaggtggcaagattgtagtttatcctccaagtggtagcttatttgatccaaaagataatattgttattggcaatgtagctctctatggggctactgatggtgaggcatatttcaatgggatggcggctgaaagattctgtgtacgaaattcaggggccagagcagttgtagaaggtgttggtgatcatggatgtgagtacatgacaggtgggactgttgtagtacttgggaaaactggcaggaattttgctgcaggtatgagcggaggtattgcctatgttctggatgtcgagggaaaatttcattctcgatgcaatcctgaactagtagatcttgataaagttgaggaagaagaggatattacgacactcagaatgatgatacagcaacatcagcgtcacaccaacagccagctagctagagaagtactggctgattttgagtctcttctgccaaaatttatcaaggtcttcccgaaggactacaaacgtgttcttgcaaacatgaaagaagcagcagccctaaaagaggttgctgttgaagaaaatgaagatctgaatgaagcagagttgatggaaaaggatgcttttgaggagctcaagaagttggcagctgcctctttgaacaagaaatccagtcaggtagaagctgctgaagcagtagaaaggcctattgtggttaatgatgctgtcaaacacagaggcttcattgcttatgagcgtgcgggtgttcaatatagggatcctagcattcgaatgaatgactggaaagaagttatgcaggaatcaaaacctggaccacttctgaagactcagtcagctcgttgcatggactgtggtactcctttctgccatcaggagaactctggatgccctttgggaaacaaaatacctgaattcaatgaattagtgtaccaaaatagatggcgtgaagcattagataggctccttgagacaaataacttcccagaattcactgggcgagtgtgccctgcaccttgtgaaggttcttgtgttcttggtattattgagaatcctgtatctatcaaaagcattgaatgtgcaatcattgacaaggcctttcaggaagggtggatggtgccacagccaccgcttaggagaactgggaagagagttgctattgttggaagtggaccagctggcttggctgctgccgatcaactaaatagaatggggcacttagtgactgtgtatgagcgtgctgatcgaattggagggctcatgatgtatggagttcccaacatgaagaccgacaaggtggatatagttcaacgtcgggttaatctgatggctgaggaaggcatcaattttgtggtcaatgccaatgttggaattgatcatctgtactcccttgataggcttcgagaggagaatgatgccattgttctagcagtaggagccacaaagccaaggcaagacatgaagcaggaccttcctgtaccaggacgagagttatcaggtgtccattttgccatggagtttcttcatgcaaatacaaaaagcttgctcgacagcaatctagaggatggtaattatatatctgctaagggcaagaaagtagttgtcattggtggaggtgacactggaacagattgtgtagggacatctatccggcatggttgtagtaggattgtaaatctagagcttctgccggagccaccacgcaccagagcgcctgggaacccctggccacagtggcctcgcatatttcgtgtagattatgggcaccaggaagcttctacaaagtttggcaaagacccaaggtcattcgaggtgttgactaaacgcttcattggagatgaacacggtcgtgtgaaaggacttgagttagtacgcgtccactgggagaaggatgctagtgggaaattccaatttaaggaggttgagggcactgaggaaactattgaggctgaccttgtcctgctagccatggggttccttggtcctgagccgaatgtggcagacaagttaggcttagagcgagacaatcggtcaaacttcaaggccgagtatggccgcttctctaccagtgtggaaggtatctttgcagctggagattgtaggcgtggccagtccttggttgtctgggcaatatcagaaggacgtcaagctgcttctcaggtggacaaatatctcatgagagaagatgaagctgctattagcgcagacaaccaaggtgaccttgtggagagcgatattgccaagaggcagcaggacagcaagcatacaatcatgacgtag

SEQ ID NO: 8148 - DNA, 7311 bp, Glycine max
aacaacgtggaccccactcttcctcctcctaccccctcttcttcgttataaatcaaccttctcctctctcagcaacaaccctcacaccacacgccctcagccgtcactctctctctccctcgtctgttccttcctcctcagtcttggtattgtgtctgcaacttacgagacagccctttttgtgattcgaatctcttttaagctttaacctcttcaattgttaccgttccatcacaaccccgtgcttaataagccatttcacccaaatccggatcttattagatcaataaattcagatctgtttcttttaatgtgaaaaaagccccaatccttttcattatttttggatatatttcttttttactttgtctattaaggcggttgtaagttgtaacagaatttggacgctgaaataagagttcccacaaatacaagaacacttcttcactgaacatattaaaaattattatagcaaaaaaagaaacaccaacaccaaggcttttccttttatctctttttatttgttgttgttttctgtaagggaacaatgtcgaacgcgctgtcgtttacgctcccggctctcaacaaccctcagctaaacgctttgaatagccctaacaaggcgcgtctgcgccacggcctgagaatccgggttgttgcgtcgtgcatagagaggaagaggttcttggggacccgggtgcggccaagtgggtcggacaggatctggttgctgcagtcgggtcgggtgccgaagctgagggtggcggtgcggtcggcattctcggcggtgccggagaagccgctggggctgtatgatccggcgatggacaaggactcgtgcggggtcgggttcgtggcggagttgtctggcgagagcagccgcaaaacggtgacggacgcgctggaaatgttggtgcggatgacgcacagaggtgcatgcggatgcgaagccaacactggagatggtgccggcattcttgtggctctgcctcatgtcttttaccaggaggttgtggattttgagcttcctccgcaaggaaaatatgcagttggcatgcttttcttgccgaagtctgagaaacgaagggaggaaagcaaaaaaatgtttagcaaggttgctgaatctctggggcacacgattcttggatggcggtctgtgcctactgataatgcaggattgggaaaatcggccctgcagactgaaccagtgattgaacaggtgtttcttacaccaagtgctaaatcaaaagttgatttggaaagacagatgtacatattaaggaagctcagcatggctgctattacatctgcattaaacctccaaaatgatggcattacagatttctacatctgttcactttcatctaggactgttgtttacaaaggtcagctaacaccagctcagctgagggattattactttgcagatattggcaatgaaaggtttacgagctacatggccctgatacactcacggttttctacaaatactttccctagctgggatcgtgctcaacctatgcgtgtattgggacacaacggagaaatcaacacactcagaggcaatgttaactggatgaaggcacgtgagggtttactcaaatgcaaggagcttggtttatcagagaatgaattaaagaagcttttgcctattgtggatgcaaattcgtcagattcaggagcttttgatggtgtgcttgagtttttgcttcattcgggaaaaagtcttcctgaagctgttatgatgatgattcctgaagcatggcaaaatgacaagaacatggattctcagcgtaaagcattctatgaatacttctcagctctcatggagccatgggatgggccagctcttatatcatttactgatggtcactatcttggagctacattggataggaatggactgcgaccaggccgtttctatgtcacccatagtggacgagttattatggcaagtgaagttggggttgtagacattccaccagaagatgtgcgtaggaaaggaagactaaatcctggtatgatgctgttggttgattttgagaagcatatagtcgtaaatgatgatgccttgaaagaacagtactctttggcaagaccttacgaggattggctcaaaaggcagaaaattgaactcaaagacatcgttaactctgttgatgaatctgaaagagtgccgccacccatagcaggagttgctccactatccaatgatgatgcggatatggaaaatatgggaattcatggtttattggctccattgaaagcttttggatatacagttgaatcattggaaatgctattacttcctatggccaaggatggcgtagaagccctagggtcaatgggaaatgatactccattggctgtcatgtctaaaagagaaaaactcactttcgagtatttcaagcaaatgtttgctcaagtgacaaaccctcctatcgatcctattagagagaaaatagtcacttctatgcaatgtatggttggtccagaaggtgatctgacagaaatcactgaggagcaatgtaaccggctttcactaaaaggtcctcttttatccactgaagaaatggaagccattaaaaaactgaattataagggatggcgcagcaaagttatagacataacttactcaaaggaatgtggtaagagagggttggaggaagccttggacaggatttgtgcagaagcacaccatggaattagtgaaggctacaccactcttgtgctgtctgatagagccttctcaaagaaacgtgttgctgtgagctccctccttgctgttggtgctgtccatcaacatcttgttaaaaatcttgagcgcactagagttgccttaatagttgaatctgctgagccacgtgaagtgcaccatttctgcacacttgttggttttggtgctgatgctatatgcccgtatttggcagtagatgcaatttggcgactgcaggttgatggaaagatcccaccaaaagcaagtggtgaatttcactcaaaagatgagttggtcaagaagtatttcaaagcaagcaactatggaatgatgaaggttctggccaagatgggaatatcaactttggcatcatacaaaggtgctcagatttttgaagcattgggtctttcgtcggaagtgattgcaaagtgctttgctgggactccaagtcgagttgagggtgcaacgttcgagatgcttgctcgtgatgcttttcaactacatgagttggcttttccttcttgggttttctctcctggaagtgcagaagctgttgctttgccaaatcctggggattatcactggagaaaaggtggtgaagttcacctgaatgatccacttgctatggcaaagcttcaagaggctgccagaactaacagtgtagatgcatataaacaatattccaagctcattcatgaattgaacaaggcttgcaatttgcgtgggcttctgaaatttaaagagacagcagttaagattcctattgatgaagtggagcctgctagtgaaatagttaaacggttttgcactggggccatgagttatgggtcaatatcattggaggcacacacagcattagcaatggctatgaataaaatgggagggaaatccaacacaggtgagggaggggagcaaccatctcgtatggagcctcttcctaatggctcaatgaatcccaaaaggagtgccattaagcaagtggctagtgggagatttggagtttcaagttactaccttacaaatgctgatgaactgcagataaaaatggcccagggagcaaaacctggtgagggaggtgaacttcctggccacaaggttataggagacattgctgtcactaggaattcaactgctggggtaggacttatcagtccacctccccatcatgatatttattcaatcgaagaccttgcccagctaattcatgatcttaagaatgccaacccagctgctcggattagtgtgaagttggtatcggaagctggagtggggataattgctagtggagttgttaaaggccatgccgaccatgtattgatctcaggtcatgatggaggtactggggcttccagatggactggcataaagaatgccgggctgccttgggaacttggcctggctgagacccaccaaactttggttgctaatgatctacgtggtcgcacagtcctccaaactgatgggcaactgaaaaccgggagagatgtggccatagccactcttcttggtgcagaagagtttggtttcagtactgctccgctcatcactcttggctgcatcatgatgcggaagtgccacaagaacacttgtccagttggcattgctacacaagatccagtacttagagagaagtttgctggagaacctgagcatgttatcaacttcttttttatggtagcagaggaaatgagagaaattatgtcccagcttgggtttagaacagttaatgagatggttggccattccgatatgcttgaatttgataaggacgttgttaagagcaatgaaaaactagagaacattgacctctctctattgcttagacctgcagctgaactgcggccagaagctgctcaatactgtgtgcaaaaacaggatcatggtttggacatggccttggataataagctcataagtctgtctaatgctgctttggaaaagggtcttccagtatacattgaaactccaatctataatgttaaccgtgctgtgggaactatgcttagccatgaggtgactaaacggtaccacctagctggtcttccaactgataccatccatgttagatttactggcagtgcaggccagagctttggtgcattcctctgtcctggtatcactttggaacttgaaggtgatagcaatgactatgttggtaaaggattatctggtggcaagattgtagtgtatcctccaaaagaaagtaactttgaccctaaggagaacattgtgattggtaatgttgcactgtacggggcgacatgtggggaggcttatttcaatgggatggcagcagaaagattttgtgtgcgtaattctggagctaaggctgtagtagaaggtgttggtgatcatgggtgtgagtacatgactggtgggactgttgttgtgcttggtaaaactggtagaaactttgctgcaggtatgagtggtgggattgcttatgttcttgatgtggatggaaaattccaatctcgatgcaacttggaacttgcagatctagataaggttgaagaggaagaggacattcttgcacttagaatgttgatacagcagcatcaacgtcacacaaatagtctgctagccaaagaagtgcttgatgattttgagaatcttcttcctaaatttatcaaggtgttccctagggagtataaacgtgttcttgcaagtatgaagtctgaggaaacctccaaagatgcattggtgcatgctgctaaagacgaccaagatgatgaagcacaagcagtggagaaggatgcttttgaagagcttaagaaactggtgatggcatctttgaatgaggaaccgagtcaggaaaattctggatgtcctcttggaaataaaataccagaatttaacgagttagtataccaaaatagatggcgtgaagcattagagaggcttcttgaaacaaataactttccagagtttactggtcgggtgtgcccagcaccttgtgaaggttcttgtgtccttggtattattgagaatcccgtatccattaaaagcattgaatgtgccatcatagacaaggcttttgaggagggttggatggtgccacgacctccagtcaagagaactgggaaaagagtagccatcgttggaagtggaccatctggcttggcagctgctgatcagctaaataaaatgggtcatacagtaaccgtgtatgaaagagctgataggataggagggcttatgatgtatggggttcccaacatgaaaactgacaaagtggatatagttcaacggcgagtaaatcttatggctgaagagggaatagattttgtggtaaatgctaatgttggacatgatcctttatacactcttgatcggcttcgaggggaaaacgacgccattgtcttgactgtaggagctacaaaacctagggatcttcctgtacctggtcgggagctgtcaggagttcattttgccatggagtttctccatgcaaacactaaaagcttgcttgatagcaatctccaggatggtaactacatttctgccaagggcaagaaagttgtggtcattggtgggggtgacactggcacagattgcataggaacatccattcgtcatggttgtagtagcgttgtaaatcttgaactccttcctcagccaccaccaactagggctcccagcaatccatggcctcagtggcctcgcatattccgtgtagattatggtcaccaagaggctgcagccaaatttggcaaagatccaagatcgtacgaggtactaactaagaggtttatcggagatgaaaatggagttgtcaaaggacttgaagtgattcgtgtttgctgggagaaagatgaaactggaaagtttcagtttaaggaaattgagggatcggaggagattattgaggctgacctagttttactagccatgggattccttggtccagagtctacaattgcagagaagttgggtgtggagcgagacaacaggtcaaacttcaaggccgattatggccgcttctcaactaatgtcaaaggggtgtttgcagccggtgattgtcgccgcggtcagtccctggtggtgtgggcgatttcagagggacggcaagcggcagcacaggtggaaaactacctcatcaaagaagaccaagaccacaggaatcaagatgggcttgtcaagaggcagcagggcctcaacatgaagcagcagggcagcaacaaacacacagtaatgacttaggtggcttctctgatttttcatgctcataaaattccaaaaggaatttgcacagaataaaataagattgttccaagtttgagcaagagattcattggtttactttaggtattcttggttggcagttgctacccaaaggggcgaaataagcataaataaagtgaagcttagtgcagagaaagcaagagttgttttggtgtttggtgtggtcttagggtatgaagttattgcagattcgagtgttcagttgttcatagattgttttattcgggctttattgttgggaaggttaactttcttagttggtaatggtgacgatgattgcatgtaatgaaatatacaatttgattattatttagatgttacatcgtttcaatttttaaactttgtttttg

SEQ ID NO: 8149 - DNA, 6435 bp, Musa acuminata
tagagttcgtcatctatggcggcggtcccaggttcggccatcaaactccagaatcagtcggtcgctctcccttccgttgtcaaccataagcggaacgtctgccgcggaggtagggctgcgcgattcgctgcctacaggcgagctcaggcggtgtctttggagagccagtttcttggtgcaaagcttcgagcttctgaacgtgttcagcgttggcggatcgatggcccgggacgttcccccaagctgagggttgtctctccatctatggccctgtctcaggtgccggagaagccccttggtctctatgatccatccttcgataaagattcttgcggtgttggctttatcgctgaactctcgggcgagtatagccggaaaacggttgctgattccttggagatgctggtgagaatggctcatcgtggtgcgtgtggctgtgagaccaacacaggcgatggcgctggcatcctcgtagcactccctcacggcttcttcaaggaggcacggatcttgtccttttcaatcgttaccgaggatattgggattcaactgccaccacccggtcaatatgcagttggcatgtttttcttgccaacggatgacagtcgaaggaaggaaagcaaaattgttttcactaaggttgcagaatctttgggacatgtggttcttggttggcgcccggtaccaacagataaccgagatctgggtgagtcagctcgacaaacagagccactcatcgaacaagttttccttacaccaagtccacggtcaagtgctgattttgagcaacagatgtatatactacggagggtttcaatggtagctatccgagctgccctgaatctgcagcatggtggagctagggacttctatatatgctcactatcttccaggactgtggtttataaaggccagttgaaacctgttcagttgaaggactactactatgcagatctcggtgatgaaaggtttacaagttacatggccctggtccactcacgattctccacaaacacctttcctagctgggatcgtgcacaacctatgcgtgttttgggtcataatggagaaatcaacacattgcgaggaaatgtgaattggatgaaggcacgagaaggccttttaaagtgcaaggaactaggcttatcaaagaatgaaatgaagaaacttcttccgattgtggatgctagctcatcggattcaggggcatttgatggcgttcttgaacttttggtccgtgctggtagaagtctccctgaagctgttatgatgatgattcctgaggcatggcagaatgacaagaacatggaccctgatagaaaggctttgtatgaatatttctcagccctcatggagccctgggatggacctgctctaatatcttttacagatggtcgctatcttggagcaactttagatcgtaatgggctgagacctggacggttttacatcacacatagtggacgtgttatcatggctagtgaagtaggtgttgtagacattcctcctgcagatgtgttgaggaaaggaaggcttaaccctgggatgatgttgttagtggattttgaaaatcgtactgttgttgatgatgaagcattgaagaagcagtactcacaagctaggccatacagggaatggcttaagaggcagaagatttgtcttgatgacattgtcaattctattcctaaaagtgacatgattcctccaaacatatttggaactgtaccatcccagaatcatgatgaggacatggaaaatatggggattcgtggtcttctggcaccactcaaggcttttggctacactgttgaagctttggatatgctgttgttgcctatggcaaaagatgccactgaagctctaggttcaatgggaaatgatgctcccttggctgtaatgtcaaacagagagaaactttcatttgagtacttcaagcagatgtttgctcaagttacaaatccaccaattgatccaattcgggagaaaatagttacatctatggagtgcatggttggtccagaaggcgatcttactgaaaccactgaagagcagtgccatcgtctctcgttgaaggggcctcttttatccattgatgaaatggaatctataaaaatgatgaactacagaggttggcgcagcaaagtgcttgacatcacgtatccaaaaaaacatggtcgaaagggtttagaggaaaccttgaataggatttgcttggaagctcgtgccgcaatccgtgaggggtatacgacccttgtactgtctgacagaggcttttcgtctgagcgtgttgctgtaagttccctcttggcagttggtgctgttcatcaacatctagtgtcaacgcttgaaaggacacgcatagggttgctggtggaatctgctgagcctcgtgaagtacatcatttttgtacccttgttggatttggtgcagatgccatctgcccgtatttggccatggaagcaatttggcggtacttcaaagcgagcaactatggaatgatgaaagttctcgctaaaatggggatatccactcttgcatcttacaagggtgcacagatttttgaagctctaggtctttcttccgaggtgatcgagaaatgcttcaaaggaaccccaagtagagttgaaggtgcaacatttgaaatgcttgccggggatgccctttgtgaagtgcaccttaatgatccccttgcaattgccaagttacaagaggcagccagagctaatagtgttgcagcatacaaagaatactctaggcgtatacaggagctgaacaagacatgcaacttgcgtggtatactgaagtttaaggacgtcgctgagaaggttcccttggatgaagtagagtctgccagtgagattgtcaagcgtttctgcacgggggcaatgagttatggttcaatctcgttagaagcacattctaccctagcaattgcaatgaataaaattggaggcaaatctaatacgggtgagggaggtgagcaacctgctcgtatggaacccctgtcagatggttcaaggaatccaaagcggagtgcgattaaacaagtggcaagtggtaggtttggagtgacaagctactacctcacaaacgcagatgagctccagataaagatggctcagggtgctaagccaggtgaaggaggcgaacttccaggtcataaagttattggtgatattgcagtcactagaaattccactgccggtgtgggtcttattagtcctcctcctcaccatgatatatattcaattgaggaccttgcacaacttattcatgaccttaagaactcgaacccaggtgctcgaatcagtgttaaactagtctctgaggctggcgttggggtaattgctagtggagttgtaaaaggacatgcagaccatgttttgatatctggccatgatggaggtactggtgcctctcgttggactggcattaaaaatgcagggcttccctgggagctaggtttggcagagacacatcaaactctagttgcaaatgacctccgtggccgaacagtcctgcaaactgatggccagttaaaaacaggacgagatgttgcaattgctgctctacttggtgcagaagagtttggtttcagcactgcacctttaattactcttggttgcattatgatgaggaagtgtcacaaaaatacttgcccagttggcattgccactcaagatcctgtacttcgtgaaaaatttgctggagagcctgaacacgttataaactttttctttatgctggcagaggaagttcgtgagattatgtcacagctgggctttcgaacaattaatgagatggttggtcgtgcagacatgcttgaaattgacaaggaagtggccaagagtaatgaaaaattgggaaatattgatctgtcattgctgcttagacctgcagctgatattcgtccaggagttgcccaatattgcattcagaaacaggatcatggtctcgagatggcattggatcaggatctcatcacttcatcaaaagctgctcttgaaaaaggcttacctgtttatgttgagacaccaatccgcaatgtaaatcgtgcagtcggtaccatgcttagtcacgaggtcactaaacaatatcaattgaaaggcttgccttcagataccatccatattaagctagttggaagtgctggtcagagcctaggggcttttctctgcccaggaatcacccttgagcttgagggtgacagcaatgactatgttgggaaaggattatctggtggcaaaattgtcgtttatcctccaagagagagccaatttgacccaagtgaaaacattgttgttggcaatgttgcactatatggagctacaagtggggaggcatattttaacggaatggcagcagagagattctgtgtccgaaactcaggtgcaagagcagttgttgaaggtgttggtgatcatggatgtgagtacatgactggtggtacagttgttattcttggcaaaactggaagaaattttgctgctggtatgagtggtggaattgcatatgtttttgatgtggatgggatgtttcacacaagatgcaatcctgaattggttgatcttgaaaagattgaagatggagaagatatcacaaccttgagaatgatgatacaacaacatcagcgccataccagcagtgtgttggcaagagaagtcctctccaactttgactctctgctgcctaagtttgttaaagtatttccaagagattataaaagaattgttcagaacttgaagatagaacaagcagccaaagaatctgaggagcaagaagaaaaggagctgatggagaaggatgcatttgaagaactcaagaaaatggcagcagcatctttgaacgggaagaaagcggaaggtttggctgcagcaaaaaggccaacacaggttgataatgctgtcaagcatcgaggttttattgcttacgagcggcagggtatctcatacagggaccctaatgatagaatcaaagattggaaagaagttgccacagaatcaaaacctgggccactaatgaaaacccaatctgctcgctgcatggactgtggaactcccttttgtcatcaggagaactctggttgccctcttggaaataagataccagaatttaatgaactggtccatcaaaataggtggcgagaagccttagataggcttttggagacaaataacttcccagaatttactggtcgagtttgccctgctccttgtgaaggatcatgtgttcttggcatcattgagaatcctgtatctattaaaagcatagagtgtgccatcatagacaaggcatttgaagaaggatggatggtacctcgtcctccacaaaagagaacagggaagagagttgccattgttggtagtggtccagccggtcttgctgcagctgatcagctaaataaaatgggtcacctggtcactgtttacgaacgtgctgatcgcatcggtggtctaatgatgtatggagttccaaacatgaaggctgacaaggttgatgttgttcaacgccgtgtagacctgatgactagggaaggcgttaactttatggtgaatgctaatgttggagttgaccccatgtactccctcaaccatctccgtgctgagaatgatgccatcgtgttggcttgtggagctacaaagccaagggatcttcctgttcctggaagagaactatctggagttcactttgctatggagtttctccatgcaaacaccaaaagcttgcttgatagcaatctgcaggatggtaaatacttgtctgctaaggggaagaaggtggttgtgataggtggtggagacacaggaacagattgtattgcaacatctatccgacatggctgcaccaacatgatcaatctagaactccttccagagccacctcaaaaacgagcaccaggcaatccatggccacagtggcctcgcatttttcgagtagattatggtcatcaagaagcatcagccaagttcggaaaagacccacgatcctatgaggtcctgactaaacgattcgtgggagacgaaagtggagttgtcaaaggccttgaggtggtccgtgtacattgggcaaaggatagtggtggcaaatttcagtttgaggaaatcaagggttcggaggagattatagaggctgacctggttcttttagccatgggtttccttggtccagagttgacgattgctgatcagctgggcttggagcgggacaacaggtcgaacttcaaggcagagtacgggcatttctcgaccagcgtagatggggtgtttgctgcaggagactgtcgacgaggccagtcgcttgtcgtttgggccattaacgagggccgtcaagctgcctcccaggtggacaagtatctgatgaaagatgtgaatacttgtagcaaggagaaccctgtctccagtgaagatttagtccacagagtgacggcctagatt

SEQ ID NO: 8150 - DNA, 2707 bp, Solanum phureja
ctttcataagtatcctaaatttactatcaagaaatatacttctctacttttttagtgactgtattctttaaaaatgcatgcagcttcttcaaccccatcattttcttgaagtttacagctttaattcctcaaagaaatcagcaaaaaaattgcatttgccatgggaattgcaaaaacagtgcagggctcatgttggcttcttgtattcatgttgttttttctgtttaatttatcagatgagttcttagaaccttcacaatctgaagctatagtgaaaatcaagcagcttttgaacttccctcaagatttgagtagttggagtgacaatacagacttttgcaatagtgagccaaacactgccttgacactcatgtgttatgaagataacataacacagcttcatatttctggctataactggtttcctaatttgcctcaggggttttctacagatacccttttctctaatcttgctcttttgcctaatttaaaggtactttctttggtttctttaggtttgagaggaactttacctaaaaagattggatttttatcttctttggagattattaatatcagttcaaacttcttttatggtgagattccaggagagatttcatatttgaagagtcttcagacacttatattggatgataataagtttacaggtcaagttcctgaaggggttggtttacttcattctttgtctgttttgagtttcaagaacaattcattttcaggttcattgcctaattctttgtcaaatttacaaaccctaagaatcctttctatttctggtaataatttttctggggttgttccaaaccttcataatctgtcaaatctacaagttcttgatttggaaagtaacaatcttggacctaatttccctaatattccaaccaagttggtatctttggtacttaggaagaacaagttcagtttaggggtaccaaaagaactgagttcatgttatcagttaaagaaactggatatttcttctaatgagcttgttggacccttttcaccaacaattttatcattgccatcactaagctatttggatatttctggaaataaactaactgggaagcttctaaagaatgtgacatgtagtcaagacctttcttttgtgaatttatcatcaaattacttgacaggggagttgcctgattgcttgcaccctagttctggttccaagattgtattgttttctgggaattgtctgtcgaataaagagcaatggcagcatccttattcattttgccataatgaagctttggctgttagtattgagcctcataagggaaaggttaaagggggaaatggtaaagctgttcttgcatcaagtatggtaggaggttttgttggagtagtagcgattgtcggtttggctttcgtggttgttagaagagagtatgccaagcagaaagctagcaaagcccctcaaacaagattgatacttgaaaaggtctctcctgctcacactcttaagctgcttaatgatgcaaggtatatttctgaaacgaggaagttgggattgcttggggcccctccttatcgaacgtttgtcttggatgagcttcgagaggccactaataactttgatatatcaaatctaattggcgcaagctccagtggacagatttacaaagggcgtctcacagatggcactgtggttgctataaaaagcataaaaatgaggaagaggcatagtgtccagtcctacactcaccaactcgggcgtatttcaaagatcagatactgccacttagttagtactattggacactgctttgagtgctaccaagatgactcaagtgttagccgaatatgtttagtctttgaatttgtgccaaatgtgacgctgcggggggtcatatcaggagcaaattcagctcaaaagtttacatggacgcaacggatgtcagctgcaatagggatagcaaagggaattcagttccttcatactggaatagtaccagggatattctccaatcaattgaagattacagatgtattactggatcagaatttccacgtaaagattagcaaatacaatctgcctttgttaattgaaaataagaaaatggatactggaccgtcttctagtggatcaaagggaaatgatgggcaaaggttaaaatacgaggagaaagatgatgtgtatgactttggagtaatcttacttgaaatcatatcgggaaggacaatcgatacaaaaaatgatatagatgtttctaaagacattctaatagttagcttaacagctgacgaaatagctcggaggaacatcattgatccagctgttcggaaggaatgctcagatagttctcttagaacattaatggaactatgcataaaatgtctttcagatgaaccatcgcaacgtccttctgtagaagacttgatatggaacttgcagtttgcagctcaggtccaagacccttggaatagagacacttatggcaaccaagagtcccctggtcatgtgtaagaacttccaatgatcaatggaccttttcttgtacaaaatgtaacattataccactaggatagtagttccaattatttagtagtctctattgcaacacttttggctatatgaggtttcagtactctttggaggttaaactctacatttgagccaaaatttgtgagcaaatggctatttcttgcactttttttttaacgaacctaaaattta

SEQ ID NO: 8151 - DNA, 2529 bp, Nicotiana benthamiana
tttagttcatggtatccgaaattaattatcaagaaatgtaccactttactctgtagtgagtgtaatctttaaaatacatgcagcttcttcaaccccaccatttcttgaaaaataaaaactttagttcctgaaaagaatcagcaaaatttgctatgagaattgcaaattcaatgcagtgttcattgtggtttttagtgttcatagtgtttcttctgttcaactattcagatgagttcttggaatcttcacagtatgaagcaatagagaaaatcaagctgctgttgaacttcccacaagatttgagtagctggagtgacaacacagatttttgcaacagtgagccaaacactgctttaacacttgtttgctatgatgataacataacacagcttcatgtttctggttacaactggtttcctaatttacctcagggcttttctacagacacccttttctctagtcttgctcttttgcctaatttaaaggttctctctttagtttctttgggtttgagaggaactttacctaaaaatattggcttattatcttctttggaaattgtcaacattagttcaaacttcttttatggtgaaattccaggagatatttcatatttgaagagtcttcaaacacttattttggatgataataagttcaccggtcaagttcctgaatgggtaggttcacttccttctttgtctgttttgagtttcaagaacaattcattttatggttcattgcctaattctttgtccaatttacaaaccctaagaatcctttctctttctgctaataatttttctgggcaagttccaaattttcaaaatctgtcaaatttacaagttcttgatttggaaagtaacaatcttggacccaatttccctactcctccaaaaaagttagcttctttggtacttaggaagaacaagttcagtttagggctaccaaatgaattgagttcctgttatcagttaaagaagctggatatttccttcaatgagcttgttggacccttttcacctacaattttgtcactgccatcactcagctttttggatatttctggaaataaattaaatgggaagcttctgaagaatatgacatgtagtcaagagctttcttttgtgaatctgtcgtcgaattacttgacaggggagttgcctgcttgcttgcaccctagttctggttctaaggttgttttgttttctgggaattgtttgtggaatagagagcaatggcagtatccttattcattttgccataatgaagctttggctgttagtattgagcctcataaagaaaaggtcaaagggggaaatggtaaagctgtccttgcatcaagtatggtaggaggatttgttggaggaatagcgattatcggtttggctttcgtggttgttagaagagagtatgccaagaagaaagctagcaaaacccctcaaacaaaactgatacttgaaaaggtctctcctgctcacactcttaagctgcttaatgatgcaaggtatatttctgaaacaaggaagttgggactgcttggagcccctccttatcgaacatttgtcttggatgagcttcgggaggccactaataactttgatatatcaaatctaatcggtgcaggttctaatgggcagatctacaagggatggctcacggatggcactgtggtcgctataagaagcataaagatgaggaagaggcatagcgtccagtcttatactcatcaactacggcgtatttcgaagatcagatactgccatttagttagtactattggacactgctttgactgctatcaagatgactcaagtgttagccgaatatgtatagtctttgaatttgtgccaaatgggacactgcggggggtcatatcagaagcaaattcagctcaaaagtttacgtggacacaaaggatgggagctgcactagggatagcaaagggaattcagttcctacatacgggaatagttccaggaatattctccaatcaattgaagataacagatgtcttgctggatcagaatctccatgtaaagattagcaaatacaatcttcctttgttaattgagaacaaaatggataccagattgtcttcaactggatcaaagggaaatgatgggcaaaggttgataaacgaggagaaaaatgatgtgtacgactttggagtaatcttacttgaaatcatcgttggaaggacgatcaacacaaaaaatgatatagatgtctctaaagacattctaaaagttagcttaacagctgatgaaatagctcggagaaacatcatcgatccagctgttcaaaaggaatgttcagatagttctcttaggacattaatagagctatgcataagatgtctttcagacgaaccatcgcaacgtccatctgtggaagacttgatctggaacttgcagttttcagctcaggtccaagatccttggaatagagacacgtatggcaaccaggagtcccctggtcatgtgtagtagttgtgcaaatatccaatgatcaatggagtttttcttgtac

SEQ ID NO: 8152 - DNA, 2773 bp, Nicotiana benthamiana
agtttcattcattggatcctaaattaattatcaagaaatgtaccactctactttctagtaagtgtagtgtaatctttaaaagtacatgcagcttcttcaaccccaccatttcttgaaaaataaaaacttagttcctgaaaacaatcagcaaaaatttgctatgagaattgcaaattcaatgcagtgttcattgtggcttctggtattcatggtgtttcttcagttcaactactcacaccagttcttggaatcttcacagtatgaagcaatagagaaaatcaagcagcttttgaacttcccacaagatttgagtagttggagtgacagcacagatttttgcaacagtgagccaaatactgctttaacacttgtatgctatgatgataacataacacagcttcatgtttctggttacaacttgtttcctaatttacctcagggcttttctacagacacccttttctttaatcttgctcttttgcctaatttaaaggttctttctttagtttctttgggtttgagaggacctttacctagaaacattggcttattatcttctttggaaattgtcaacattagttccaacttcttttatggtgaaattccaggagagatttcatatttgaagagtcttcagacacttattttggatgataataagttcaccggtcaagttcctgaatgggtaggttcacttccttctttgtctgttttgagtttcaagaacaattcattttatggttcattgcctaattctttgtccaatttacaaaccctaagaatcctttctctttctggtaataatttttctgggcatgttccaaactttcaaaatctgtcaaatttacaagttcttgatttggaaagtaacaatcttggacccaatttccctactcctccaaaaacgttagcttctttggtacttaggaagaacaagttcagtttagggctaccaaaagaattgagttcctgttatcagttaaagaaactggatatttctttcaatgagcttgttggacccttttcaccatcaattttgtcattgccatcactcagctatttggatatttctggaaacaaattaactgggaagcttttaaagaatatgacatgtagtcaagagctttcttttgtgaatctgttgtcgaattacttgaccggggagttgcctgcttgcttgcatcctagttctagttctaaggttgttttgttttctgggaattgtttgtggaatagagagcaatggcagcatcctttttcattttgccataatgaagctttggctgttagtattgagcctcataaagaaaaggtcaaagggggaaatggtaaagctgtccttgcatcaagtatggtaggaggatttgttggaggaatagcgattatcggtttggctttcgtggttattagaagagagtatgccaagaagaaagctagcaaaacccctcaaacaaaactgatacttgtaaaggtctctcctgctcacactcttaagcttcttaatgatgcaaggtatatttctgaaacaaggaagttgggactgctcggggcccctccttatcgaacgtttgtcttggatgaccttcgggaggccacaaataactttgatatatcaaatctaatcggtgcaggctctaatgggcagatgtacaaaggacggctcacagatggcactgtggttgctgttagaagcataaaaatgaggaagaggcatagtgttcagtcctatactcatcaactagggcgtatttcaaagatcagatactgccatttagttagtactattggacactgctttgactgctatcaagatgactcaagtgttagctgaatatgcatagtcttcgaatttgtgccaaatgggactctgcggggggtcatatcagaagcaaattcagctcaaaaatttacgtggacacaacggatgggagctgcactagggatagcaaagggaattcagttcctacataccggaatagtaccagggatattctccaatcaattgaagataacagaggtcttgctggatcagaatctccatgtaaagattagcaaatacaatctgcctttgttaattgagaataggaaaatggataccagattgccttccagtggatcaaagggaaatgatgggctaaggttgataaacgaggagaaaaatgatgtatatgactttggagtaatcttacttgaaatcattgtccgaaggacaatcgatacaaaaaacgacatagatgtctctaacgacattctaaaagttagcttaacagctgatgaaatagctcggaggaacatcatcaatccagctgttcaaaaggaatgttcagatggttcgcttaggacattaatcgagctatgcgtaagatgtctttcagacgaaccatcagaacgtccatctgtggaacacttgatctggaacttgcagttttcagctcaggtccaagatccttggaatagagacacctatggcaaccaggagtcccctggtcatgtgtaagtagtagtgcaaatgtccaatgatcaaaacggagtttttcttgtaaaaaatgtaacattatactaggataatcagtttcatatctttagcagtctctgttgcagcacttctcatcattgatggccatgaggaactcttactctacatttgacttttgagccatcatatgatgctttgtttgtttgcaaaagattctgtggagaatttttgaagtgtaactgaatttttagaatcctaatccagtgaataggacaccttagaaaagggagaaaagag

SEQ ID NO: 8153 - DNA, 1814 bp, Solanum tuberosum
agtttcagaaaattataacaagaaacttctttcaaagatagccacaaatgatggtcatggagaaaattcagcttattttgatggttggaaagcttatgaaaatgatccatttcatccaacacaaaatcctcatggtgttattcagatgggtttggctgaaaatcagctttgttttgatttaattcaagaatggatagtcaacaacccaaaagcctcaatttgtacctatgaaggagttcaagattttcaagatattgctattttccaagactatcatggcttgccagaatttagaaaggcagttgcaagattcatggagaaagttagaggagatagagtcacatttgatccagaaagaatagttatgagtggaggagcaacaggagctcatgaaagtttggccttttgtttggctgatcctggtgatgcatttctagttcctacaccatattatccaggatttgatagagatttgaggtggagaacaggagtacaactttttcctgttgtttgtgagagttctaacaacttcaaggtaacaaaagaagccttagaagaagcatataaaaaagctcaagaatcaaatatcaaagtaaaaggattacttataaacaatccatcaaatccattaggtacaattttggacaaggaaacattaaaagacatactaagattcatcaatgacaaaaacatacatctagtatgtgatgaaatctatgcagcaaccgcgtttagtcaaccttcattcatcagtatatcagaagtcatgagtgaagttgttggatgcaacgatgatttagtacatatagtgtatagtctctcaaaagatctagggttccctggatttagggttgggattatttactcgtacaatgatgttgttgtcaatattgcacgtaagatgtcaagttttggacttgtttcaacacaaacacaacggttaattgcttccatgctatcagacactatctttgttgaaaatttcatcgcgaagagcgcgatgaaattgtcacaaagacatgatttgttcactaaaggattaggacaagttggaattacaacattgaagagtaatgctggcctatttatttggatggatttgagaaggtttcttgaaaagtcaacatttgataatgaattgaaactttggcatataattattaataaagtgaaacttaatgtttcacctggttgttcatttcattgctcagagccaggttggtttagggtttgttttgctaatatggatgatgctacaatgcaagttgcattgaaaagaattagacattttgtctacttacaaccaagtaagggagttgaagttgcaacaaagaaacaatattgtagaacaaggagcaaacttgaaataagtttgtcatttaggagattggatgattttatgaactctcctcattcacctatgtcttctcctatggtccaagcaaggaattaatcgtggcattcagatcagcttgtacacacatcatccaattcaggttatatggacacgtcgactattttactgagtacttgattgtaagtctagttacataacatagaatggaagtttatagtgattctttgtattcttttattaaaagtttattatttttttgcctataatatactatgattgcaaaaaaaaaaagaaaaaaaagcaatcaagttatgggcttttattatattgtgaaatgtgaaattctttatttcttgtgttatttttttctgtatagctttttgtaagttgaggaaactcaatttgtaacttgagttcaagaggcaaatgcagaggatatatacctatcaattttttc

SEQ ID NO: 8154 - DNA, 1956 bp, Solanum phureja
atcaactaaaatttcaaagtctctttaatttctaccaaaaaaataaaaatctctatattagcaaattagccaccaacaaaaagaaatttccaaacttttttttgatagtttttgagttttattaagaaaaaaatggggttaatttcagaaaattataacaagaatcttctttcaaagatagccacaaatgatggtcatggagaaaattcagcttattttgatggttggaaagcttatgaaaatgatccatttcatccaacacaaaatcctcatggtgttattcagatgggtttggctgaaaatcagctttgttttgatttaattcaagaatggatagtcaacaacccaaaagcctcaatttgtacctatgaaggagttcaagattttcaagatattgctattttccaagactatcatggtttgccagaatttagaaaggcagttgcaagattcatggagaaagttagaggagatagagtcacatttgatccagaaagaatagttatgagtggaggagccacaggggctcatgaaagtttggccttttgtttggctgatcctggtgatgcatttctagttcctacaccatattatccaggatttgatagagatttgaggtggagaacaggagtacaactttttcctgttgtttgtgagagttataacaacttcaaggtaacaaaagaagccttagaagaagcatataaaaaagctcaagaatcaaatatcaaagtaaaaggattacttataaacaatccatcaaatccattaggtacaattttggacaaggaaacattaaaagacatactaagattcatcaatgacaaaaacatacatctagtatgtgatgaaatctatgcagcaaccgcgtttagtcaaccttcattcatcagtatatcagaagtcatgaatgaagttgttggatgcaacgatgatttagtacatatagtgtatagtctctccaaagatctagggttccctggatttagggttgggattatttactcgtacaatgatgttgttgtcaatattgcacgtaagatgtcaagttttggacttgtttcaacacaaacacaacggttaattgcttccatgttatcagacactatctttgttgaaaatttcatcgcgaagagcgcgatgagattgtcacaaagacatgatttgttcactataggactaggacaagttggaattacaacattgaagagtaatgctggcctatttatttggatggatttgagaaggtttcttgaaaagtcaacatttgatgatgaattgaaactttggcatataattattaataaagtgaaacttaatgtttcacctggttgttcatttcattgctcagagccaggttggtttagggtttgttttgctaatatggatgatgctacaatgcaagttgcattgaaaagaattagacattttgtctacttacaaccaagtaagggagttgaagttgcaacaaagaaacaatattgtagaacaaggagcaaacttgaaataagtttgtcatttaggagattggatgattttatgaactctcctcattcacctatgtcttctcctatggtccaagcaaggaattaatcgtgatgttcagatcagcttgcacacacatcgtccaattcaggttatatggacatgttgattatttcactgagtacctgattgtaagtctagttacataacatagaatggaagtttatagtgattctttgtattcttttattaaaagtttattatttttttgcctataatatactatgattgcaaaaaaaaaaaaaaaaaaaaaagcaatcaagttatgggcttttattatattgtgaaatgtgaaattctttatttcttgtgttatttttttctgtatagctttttgtaagttgaggaaactcaatttgtaacttgagttcaagaggcaaatgcagaggatatatacctatcaattttttc

SEQ ID NO: 8155 - DNA, 1873 bp, Nicotiana benthamiana
caactaagatttcaaagtctctttaatttctaccaaaaaacctctaccaaattagccccaatttttttttaaaaaaaaatcattttttcttgatataacctttgatattttttcttaaggattgagaagaaaatgggatttatttctggcaataataaacttctttcaaaaatagcaacaagtgatggacatggtgaaaactcagcatattttgatggttggaaagcttatgaaaatgatccttttcatctaataaaaaaccctaatggtgttattcagatgggtttggctgaaaatcagctttgttttgatttaattcaagaatgggtagtcaacaacccaaaagcctccatttgcactgctgaaggagctcaagatttcaaggatattgctatttttcaagactatcatggcttgccagaatttagaaaggcagtttcaagatttatggaaaaagtgagaggagataaagtcacatttgatccagatcacattgttatgagtggaggggcaactggagctcatgaaactctagcattttgtttggctgatcctggtgatgcatttctggttccaacaccatattatccaggatttgatagagatttgaggtggagaactggagtacaactatttcctgttgtttgtgagagttctaacaattttaaggtaacaaaagaagccttagaatttgcatatgaaaaagctcaagaatcaaatatcagagtaaaaggtttacttataaacaatccatcaaatccattaggcacaatcctggacagggaaacattaaaagacatactaagtttcatcaatgacaaaaacatccacttagtatgcgacgaaatttatgctgcaacggtctttagccagcccgatttcatcagtatatccgaagtaatgcaggaagtaaatggttgcaatgaaaatttggtacacgttgtttatagcctgtcgaaagatttgggattccctggattcagagtcgggattatttactcatacaacaacgttgtagtgaattgtgctaggaaaatgtcaagttttggactcgtttcaacacaaacgcaattcttgattgcttccatgttatcggatgagattttcgttgaaaatttcatcgcgaaaagctcagtgagattgtcacaaaggcattgtttgttcactaaaggattagcacaagttggaattagtacattgaagagtaatggtggattatttttttggatggatttgagaagattacttaaagagtcaacatttgaagctgaattggatctttggcatataattataaatgaagttaaactcaatgtttcacctggtgtttcatttcattgttctgagcctggttggtttagagtttgttttgctaatatggatgatgaaacaatgagagttgcattaagaagaattagacattttgtgctacaaagaaagggattaattgaagttgccaccaagaaaccatgtagaaggagaaaacttgaaattagtttatcttttagaagattggatgatttcatgaattctcctttcatgaattctcctcactctccaatgtcttctcctatggtccaggcgaggacttaaaaccaggcgtccagatcagcttgcttacacatcgactatctcactgagtacctaaaaacatgcatccagattagcttgtgtacacgtcgacaaacaagcgtccagatcagcttgcgtacacgtcgactatttcattgagtacttgatacatccgtctaatgggaggaggatgagttctatagttgtagtagtgattgattggtctgattacaaaacatagaatgaaagttcatagggattctttgaatgttttattagagtttttgcctatactatgatt

SEQ ID NO: 8156 - DNA, 1845 bp, Capsicum annuum
aaattcaacaaactacaattactaataacgttcaaagtctaaaaagagcttcttttttcattttattgaaattttttgattcttttagaagaattttttgaaaattaagatggaattcatttcaagaaataaccaaaaacaacagcttctttcaaagatagcaactaacgatggacatggagaaaactcagcttattttgatggttggaaggcttatgcaaatgatccttttcatctaactgataatcctaatggtgttattcagatgggtcttgctgaaaatcagctttgctttgatttgatccaagaatgggtggtgaataatccaaaagcatcaatttgcactgctgaaggagctgaagatttccaggagattgctatttttcaagattatcatggcttgccagagtttagacaagcagttgcaagatttatggagaaagtgagaggagacagagttacatttgatccaaacagaatagtaatgagtggaggtgcaactggtgctcatgaaatgcttgctttttgcttggctgatcctggtgatgcctttttggttcctacaccatattaccctggatttgatagagatttgaggtggagaactggtgtgcaactatttccagttgtttgtgaaagttctaatgattttaaagtcactagaaaagccttagaagaagcatatgaaaaggctcaagaatccaacatcaaaataaagggcttacttataaacaatccttcaaatccattaggcactcttcttgacaaggacacattgagagacattgtaacattcatcaactcgaaaaacatccacttagtatgcgatgaaatctatgctgccacggtctttgatcagcctagattcatcagtgtttctgaagttgtcgatgaaatgattggatgtaaccaagatttgatccacattgtctatagcttgtccaaagatttgggatttccaggattcagggtcgggattgtttactcgtacaatgatacagtagtggacatcgctagaaagatgtcgagctttgggttagtttcaacacagacacaacatctgcttgcgtcaatgttgtctgatgaaattttcattgaaaaattcattgctgagagttccgaaaggctcggaaaaaggcaggggatgttcacaaaaggactagcacaagttggaatcagtacactgaaaagcaatgctggtttgtttttctggatggatttaaggagacttcttaaagaaccaacattcgatgctgaattggaactgtggaggattattattcatgaagtgaaacttaatgtttcaccaggtgtttcttttcattgttctgaacctggttggtttagagtctgtttcgcgaatatggatgatgaaactatgagaactgcattaagaaggataaggaactttgtgcttcagacaaagggacttaacaacaaagttgctgttcttaagaaacaatgcagcaggagcaaacttcaaatcagtttatcttttcgacgattggatgatttcatgaactcaccagctaactctccgatgaattcgcctttggtcaggacttgaaggaacaaaaataaataacttagcttatatattcttgttgtttgtctaataagatgaggaaaaaatttcctttgttatagttatgagcgatatagtttgctatatatattaagtatttgatttcatagttcattccatagaagattcaattatagtgtgttttggatttttatcatcccatcaatgtattaaaatggagtgtactgtggaattttctgttcttggtttttttaattccttcttgaaaatggaaggtcaaagttgtaaccaaaaagaaa

SEQ ID NO: 8157 - DNA, 1804 bp, Nicotiana benthamiana
ctctacaactttcacaagatggtgttcatttcaggcaaagtccaaaagcagcagctactttcaaaaatagccacaaatgatggacatggagaaaactcagcttattttgatggttggaaggcttatgaaaatgacccttttcatctttctaacaatccaaatggtgttattcagatgggtctggcagaaaatcagctttgctttgatttaatccaagaatgggtagtcaataacccaaaagcctctatttgcacaactgaaggagctgaagattttaaagatattgccatttttcaagactatcatggcttgccagaatttagacaggcagttgcaagatttatggaaaaagtcagaggagacaaagtcacatttgacccaaatcgcattgttatgagtggaggagcaactggagctcatgaaacactggctttttgtttggctaatcctggagatgcattcttggttcctaccccatactatcctggatttgacagagatttaaggtggagaactggtgtacaactatttccagttgtttgtgacagttctaatgatttcaaggtcactaaaaaagccttagaatctgcgtatgaaaaagctcaagaatccaatattaatataaagggtttgcttataaacaatccttcaaatccattaggcactcttcttgacagtgacacactgaaagacatagtaacattcataaactcgaaaaacatccacttaatatgcgacgaaatttatgctgctactgtctttgatcagcccaaattcatcagtgtttctgaaatagttgatgaacatgttggatgcaacaaagatttgatccacgttgtttatagcttgtcgaaagatttgggatttccaggattcagagtcggaattgtttactcatacaacgatacagtagtcaacattgctagaaaaatgtcaagcttcgggcttgtttcaacacagacacaacatttgattgcatcgatgttgtctgatgaaattttcatcgaaaaattcattgctgagagctccgaaagactcgggaaaagacacgggatgtttactaaaggactagcacaagttggaattagtacattgaagagtaatgctggtttatttttttggatggatttaagaaggctactaaaagagtcaacatttgaagctgagttagaactgtggagaattattatcaatgaagtgaaacttaatgtttctccaggttgttcctttcattgttctgaaccaggttggtttagggtttgtttcgcgaatatggacgatgaaactatgagaattgctctaagaagaataaggaactttgtgcttcaaacaaaaggacttaacagtaaaactgcagttaagaaacaatgcagcaggagcaaacttcagatcagtttatcgtttcgacgaatggatgatttcatgaattcaccagttcattctccaatgagttcacctttggtcaggacttgaagagaaaaaatggcttagtttcttgttgtttgtttaataagaggagtgaaaatttcctctattatagtgatgactgatagaatatatatatatatagtactttgatttcagattttatcccattttgtgcagctgatcaagataagaaacaagttcttcagagaatgttttggacttttattatctgaatttttcctatgatttcatcaatgtaaagtgtatcaaaatgggatatactgtggaatttttttctgttcttggttttttttgttttccttctcgagaaaaggaagctcaaagttgtaaccagaatttgtacttgcttatatat

SEQ ID NO: 8158 - DNA, 1966 bp, Nicotiana benthamiana
ttacaagacttgtacaaacaaatattcaaagtctaaaaacagcttcgtttaccataaaatatttaccaaattagccaacacccacttcattatattgataatctttgatttttctccacaactttcagaagatggtgttcatttcaggcaacgtccaaaagcagcaacttctttcaaaaatagccacaaatgatggacatggagaaaactcagcttattttgatggttggaaagcttatgaaaatgatccttttcatctctctaacaatccaaatggtgttattcagatgggtcttgcagaaaatcagctttgctttgatttaatccaagaatgggtggtgaataacccaaaagcctccatttgcacaactgaaggagctgaagattttaaggatattgccatttttcaagattatcatggcttgccagaatttagacaggcagttgcaagatttatggaaaaagccagaggagacaaagtcacatttgacccaaatcgcattgttatgagtggtggagcaactggagctcatgaaacactggctttttgtttggctaatcctggagatgcatttttggttcctacaccatattatcctggatttgacagagatttaaggtggagaactggtgtacaactatttcctgttgtttgtgacagttctaatgatttcaaggttactaaaaaagccttagaatctgcatatgaaaaagctcaagaatccaatattaatataaagggattgcttataaacaatccttcaaatccattgggcactcttcttgacagtgacactctgcgagacatagtaacattcataaattcgaaaaatatccacttaatattcgacgaaatttatgctgctactgtctttgatcagccaaaattcatcagtgtttctgaaatagttgaagaacatgttggatgcaacaaagatttgatccacattgtgtatagcttgtcaaaagatttgggatttccaggattcagagtcggaattatttactcatacaacgatacagtagtcaacattgctagaaaaatgtcaagcttcgggctagtttcaacacaaacacaacatttgattgcatcaatgttgtctgatgaaattttcgtcgaaaattttattgctgagagctcagaaagactcgggaaaagacacgagatgttcactaaaggactagcacaagttggaattagtacattgaagagtaatgctggtttatttttctggatggatttaagaagattactaaaagagtcaacttttgaatctgaattagaattgtggagaattattatcaatgaagtgaaacttaatgtttcaccaggttgttcttttcattgttctgaaccaggttggtttagggtttgtttcgcgaatatggacgatgaaactatgagaattgctctaagaaggataaggaattttgtgcttcaaacaaaaggatttaacagtaaaactgcatttaagaaacaatgcagcaggagcaaacttcagatcagtttatcgtttcgacgaatggatgatttcatgaattcaccagttcattctccaatgagttcacctttggtcaggacttgaagagaaaaaatggcttagtttcttgttgtttgtttaataagaggagtgaaaatttcctctattatatagtgatgagtgatagaatatttgatatatatatctatctatatatatatatcagtatttgatttcacagtttattccattttgtgcagctgatcaagataagaaacaagttcttcagagaatgttttggaattttattatctgaatttttcctatgatttcatcaatgtaaaatgtatcaaaatgggatatactgtggaattttatttgttcttggtttttttttgtattcctttttaagaaaaggaaactcaaagttgtaaccagaacttttacttgcttatatatgaaatttactggtgtgttcttgacaa

SEQ ID NO: 8159 - DNA, 1763 bp, Solanum phureja
tacccatatcatttttttgagaatctttgattctttcttttttcaaaattaagatggtgtctatttcaaacaacaataaccaaaagcaacaacttctttcaaagatagccacaaatgatggtcatggagaaaactcaccttattttgatggttggaaggcttatgcaaatgatccttttcatttaactgataatcctaatggtgttattcagatgggtcttgctgaaaatcagctttgttttgatttaatccaagaatgggtggtgaataatccaaaagcatcaatttgcactgctgaaggagctgaaaatttccaggatattgctatttttcaagattatcatggcttgccagagtttagacaagcagttgcaaggtttatggaaaaagtgagaggtgacagagtgacatttgatccagacagaatagtaatgagtggaggagcaactggtgctcatgaaatgcttgctttttgcttggctgatcctggtgatgcctttttggttcctacaccatattatcccggatttgatagagatttgagatggagaactggtgtgcaactatttccagttgtttgtgaaagttgtaatgatttcaaagtgactaaaaaagccttagaagaagcatatgaaaaagctcaacaatccaacatcaaaataaaaggcttacttataaacaatccttcaaatccattaggtactcttcttgacaaggacacactcagagacattgtaacgttcattaactcgaaaaacatccatttagtatgcgatgaaatctatgctgctacggtctttgatcagcctagattcatcagtgtatctgaaatagttgaggagatgattgaatgcaacaaagatttgatccatattgtctatagcttgtctaaagacttaggatttccaggattcagagttgggattgtttactcgtacaacgatacagttgtaaacattgctagaaagatgtctagctttgggctagtttcaactcagacacaacatttgcttgcatcaatgttgtctgatgagatattcattgagagattcattgctgagagttccgaaaggctcgggcaaaggcaggggatgttcacaaaaggacttgcacaagttggaattagtacattgaaaagcaatgctggtttgtttttctggatggatttaaggagacttcttaaagaagcaacatttgatggtgagttagaattatggagaatgattattaatgaagtgaaacttaatgtttcaccaggatgttcttttcattgttctgaacctggttggtttagagtttgttttgcaaatatggatgacgaaacgatgaaaacagcattaagaaggataaggaactttgtgcttcaaacaaagggacttaacaacattgctgctattaagaaacaatgcagtaggagtaaacttcagatcagcttatcgtttcgaagattggatgattttaactcaccagctcactctccgatgaattcgcctttggttaggacttaaagaagaagaaaaaatggcttagatttgttcttgttgtttgcataataagagaaggaaaaaaaaaaatcctctgttatagtgaagagtggtagttttgatgtatacatttattagtgtttgattatagagtattccattttggatttttatcatctgaatttttctatgtaacattgtatcaaaatgggattcaatgtggaattttatttgtaagttgtaacgagaaattctatagttatatttaattaatggtgt

SEQ ID NO: 8160 - DNA, 1662 bp, Nicotiana tabacum
gaaattcggacgaggatctagagaaatattaattagctacgatatacgtacatcattttcttgttattcttttattcttctcccgtttcaagaaattaagattgagaagatggggttcatttcaagcatcgacaatgagctgctttctaaggtagcaaccaataatgggcatggtgaaaactcagcctattttgatggttggaaggcctatgaaattgatccttttcatccaacacaaaattctgatggggttattcagatgggtctcgcagaaaatcagctttgctttgatttaatacaagaatgggtggtgaagaatccaaaagcctccatttgcacagctgaagggtctcaagatttcaaggatattgcaatttatcaagattatcatggtttgccagaattccgaagtgctgttgcaaggttcatgggaaaagtgagaggagacagaataacatttgagccagaacgcatagttatgagtggaggggctactggagctcatgaattactggccttctgcttggctgatcctggagaggcatttctggttcctacaccctattatccaggatttgacagagatttgaggtggcgaactggggtgcaactttttcctgttgtttgtgaaagctctaacaatttcaaggtcacaaaagaagccttagaagctgcataccagaaagctcaagaatccaatattacagtaaagggcttgcttttaaacaatccatctaatccactgggcacaatcttagacagggaaacattaaaagacacagtaaggttcattaacgagaaaaacatccacctcgtatgtgacgaaatatacgctgccacaatctttaacaagcccgatttcatcagcatatccgaagtaataatggaggaagatgttgaatgtgaccgcgatttaatacacattgtttatagcctgtcaaaggatttgggatttcctggattcagagtcgggattatttactcatacaacgatgttgtaacaaattgtgcccgaaaaatgtcaagtttcgggttagtttcaacacaaactcaattcttgatttcaaacatgctatcggacgaaaatttcgttacgaaattcattggtgagagtagtgaaaggttacaaaaaagacatggcatgtttactaggggacttgcacaagtggggattaacacattgaagagtaacgctggcttgtttatatggatggatttgagaaggcttcttaaggagcttacattcgaagctgagctcgaactttggcgaataattattaatgaagttaaacttaatgtttcgcccggttgttcttttcattgttcagagcctggttggtttagagtttgttttgcaaatatggatgatgaaactatgaggattgccttaagaaggattaacaactttgtgattcaacgtaaagggattgaaggaggagtcaagaaattacaatgtcggaggagtaaattggagattagtttatcgttcagaaaattggatgattttatgaactctcctcactctccaatgtcttcgcctttggtccaggctaggacataaaagttaaaaaaaggggggttattacttattagaacttgtaatgtttctttttctttatatttccttgttcgaaattgaatgaataatcaagtcttaaccac

SEQ ID NO: 8161 - DNA, 761 bp, Glycine max
cggccaattgaggggaacagcgttaagatattatgaattgtagcgacttttgcttatgtaaatttgaggatgaaattgataattatgcctatttaaagtgcacgacggtgctttttgttctgtttctaaaacactatcccttttactgtttattgacaaagagaaacaatcggaggatctgttctgttccataagatggctggacttttaggatataggagccttccacctaaggcaaagaatctggtagttgctgggggtttgacagcttttgtctttggtgcatacttctacaccatgagggctgttggaggcactgatgaactgcaggtagcaattgataagtttgaagctgacaagagcaagaatgagggtgatgccaacatgccatcaaaggtctaaagcttgtacaataaagcaatactttgggtgtattcactgttttggtttgggatcaagctttttacttagtatgagaatgttctaaaaggaatgatattgaatctagttgctaataagtttcaaccagctttatgtactatgactgtgtggtagggaatctaaattgagattctgttttggccttattgaggtgtttcacgaggataacacaaatctgtgatcattagtatatgtaagaacagctgctactgtgactttgggcagaattccattacaaacttaaaatgaaaaccatgtgcacttattggagagaaaaatgagaagctaagatgaattaagcttattctatatgttaaaat

SEQ ID NO: 8162 - DNA, 698 bp, Glycine max
ttaagatattatgaattgtagcgacttttgcttatgtaaatttgaggatgaaattgataattatgcctatttaaagtgcacgacggtgctttttgttctgtttctaaaacactatcccttttactgtttattgacaaagagaaacaatcggaggatctgttctgttccataagatggctggacttttaggatataggagccttccacctaaggcaaagaatctggtagttgctgggggtttgacagcttttgtctttggtgcatacttctacaccatgagggctgttggaggcactgatgaactgcaggtagcaattgataagtttgaagctgacaagagcaagaatgagggtgatgccaacatgccatcaaaggtctaaagcttgtacaataaagcaatactttgggtgtattcactgttttggtttgggatcaagctttttacttagtatgagaatgttctaaaaggaatgatattgaatctagttgctaataagtttcaaccagctttatgtactatgactgtgtggtagggaatctaaattgagattctgttttggccttattgaggtgtttcacgaggataacacaaatctgtgatcattagtatatgtaagaacagctgctactgtgactttgggcagaattccattacaaacttaaaatgaaaaccatgtgcacttattggagagaaaaat

SEQ ID NO: 8163 - DNA, 516 bp, Vigna unguiculata
acaaaaggaagagtatccattgtgctgtgttcacaaatccaaagaagtgaagtgaatcggaggatcttcttttgttccataagatggctggacttttaggatataggagccttccacccaaggcaaagaattttgtagttgctgggggtttgacagcttttgtctttggtgcctacttctacaccatgagggctgttggaggcactgatgaactgcaggtagcaattgataagtttgaatctgacaagagcaagaaggagggtgaagccaacttgccatcaaaggtctaaagctcattcattgcttgtaccacaacaatactttgggtgtattcactgttttggtctgtaatcaagctttttacttagcttgaaagtgttaaaacgaagaatgatatttaatctagtgctaataataagtttcaaccagctttatgtacaaataatgtgttagggaacgttttggccttgctgagtgcttcatgatgataatagaaatctgtgatcatatatactt

SEQ ID NO: 8164 - DNA, 570 bp, Glycine max
aaataaaatgccacttataaatttccgtcgtttgattttgatatttaaagtgcacgacggtgtgtcctgttccgttcctaaaagactatcccttttacaaactgaagtgaatcggaggatctgttctgttccataagatggctggacttttgggatataggagccttccacctaaggcaaagaatttggtagttgctgggggtttgacagcttttgtctttggtgcctacttctacaccatgagggctgttggaggcactgatgaactgcaggtagcaattgataagtttgaagctgacaagaacaagaatgcgggcgatgccaacatgccatcaaaggtctaaagcttgtacaataaagcaatactttgggtgtattcactgttttggtttgggatcagctatttacttagtatgagtgttaaaaaaagaatgatattgaatctagttgctaataagtttcaaccagcttaatgtacaatgactgtgtggtagggaaactataattgagattctgttgataaaaaaaaaaataattgagattctgttgtggtcttattgaggtgtttct

SEQ ID NO: 8165 - DNA, 616 bp, Glycine max
cacttataaatttccgtcgtttgattttgatatttaaagtgcacgacggtgtgtcctgttccgttcctaaaagactatcccttttacaaactgaagtgaatcggaggatctgttctgttccataagatggctggacttttgggatataggagccttccacctaaggcaaagaatttggtagttgctgggggtttgacagcttttgtctttggtgcctacttctacaccatgagggctgttggaggcactgatgaactgcaggtagcaattgataagtttgaagctgacaagaacaagaatgcgggcgatgccaacatgccatcaaaggtctaaagcttgtacaataaagcaatactttgggtgtattcactgttttggtttgggatcagctatttacttagtatgagtgttaaaaaaagaatgatattgaatctagttgctaataagtttcaaccagcttaatgtacaatgactgtgtggtagggaaactataattgagattctgttgataaaaaaaaaaataattgagattctgttgtggccttattgaggtgtttcttgaggataacacaaatctgtgatcattagtatatgtaagaacagctgctactgtgac

SEQ ID NO: 8166 - DNA, 988 bp, Cajanus cajan
atgtaacaaaagtatatttaagcacgcgaagctgcgctctgttccgttccatcttgtaaaaggaagagcaccgtttctgctctgttcacaaagcgagaaaagtgaatcctatctcttctgttcgataagatggctggacctttaggatataggagtcttccacctaaagcgaagaatttggtagttgctgggggtttgacagcttttgtctttggtgcctacttctacaccatgagggctgttggaggcaccgatgaactacaggtagcaattgataagtttgaagctgccaagagcaagagtgaggctgatgcaaacttgtcatcaaaggtctaaggcttatttattgcttgtacaataaaaacaatactttgggtgcatttactgttttggtctggaatcaaacatttcactcagcatgataatgttaaaacagaatgatattgaatctagttgtaataagttaaccagttttatgtacaatgactgcgtagtaaggaaattataattgggatcctgttttggtcttattgaagtgctttgttgataaccaaggttataaaaaacagttcgtgtattcaataggataccagtatatcacggagatgtatgggtggatactgatccattgatatcaatggcttttcttccctagatcacattggtagtactgattaaattaaatcactgaggtaatacaactacagaaaaaaaaaatgcccttttatccgcgcagaaaattcactttctttcacgagctttactgcttgactgcttcaattctttgtacaagggatcaaaaagaaattgcgtatagcaagaaaggaagaagaattaacgtcaaggtttttggagtgttcaagaaatgcaatgaaattgtgatcttaaaaatgttgctgataacacaaatctgtgatcatatgatatgtaataacagctactactgttattgagtgtggggctcagggaagaatgtcattacaaactt

SEQ ID NO: 8167 - DNA, 261 bp, Glycine max
ggtaattgtaattgtgtgaaattgtgctaaccctttttcccccattgatcaagatggctggacttttgggatataggagccttccacctaaggcaaagaatttggtagttgttgggggtttgacaacttttgtctttggtgcctacttctacaccatgagggctgttggaggcactaatgaactgcaggtagcaattgataagtttgaagctaacaagaacaagaatgtgggtgatgccaacatgcgatcaaaggtctaaa

SEQ ID NO: 8168 - DNA, 260 bp, Glycine max
ggtaattgtaattgtgtgaaattgtgctaaccctttttcccccattgatcaagatggctggacttttgggatataggagccttccacctaaggcaaagaatttggtagttgttgggggtttgacaacttttgtctttggtgcctacttctacaccatgagggctgttggaggcactaatgaactgcaggtagcaattgataagtttgaagctaacaagaacaagaatgtgggtgatgccaacatgcgatcaaaggtctaa

SEQ ID NO: 8169 - DNA, 740 bp, Arachis hypogaea
cccctatcccctgtgtgccttggcagtctcagaagcagtggtatcaacgcagagtacggggggaagcatagggaataaacctgaacagtggacaattgtctattctttctaatctcgccgactccaatcgtcgccgtcgctaccgccgctaccgccgccctaagccactgctgctaacctgcttttaccgccaattcttccgtctcttcgaatctctcgtaaaaagatggctggactctcaggatttaggagccttcctcccaaagctaagaatttggtggttgccgggggtttgacagcatttgtcttcggaacgtactactacacgatgagagctgttggaggtacagatgaactgcaagtagcaatagataaatttgaagcagagaagagcaagacagagggtgatggtactagcatgccatcaaaggtctaatttctttttgcaagaaaaacagtagttttctctctgcttttactactttgtgttaagataaaggctttagttgttttacatgacatgaaaatgttaaaatgtgatattgaactcagttgttatcaagtttcatgtatgataactaagtggtagggaaagtatagtataactgagattctcttgttggattgtgaagaatttatgatgaaaagccaagttggggattatgatgcatgtaaaataaactttgccactgctttctattgtatgaagctggggcagaatggcattacaaggttaagat

SEQ ID NO: 8170 - DNA, 754 bp, Arachis hypogaea
tcccctgtgtgccttggcagtctcagaagcagtggtatcaacgcagagtacgggggagggaaatagggaataaacctgaacagtggacaattgtctattctttctaatctcgccgactccaatcgtcgccgtcgctaccgccgccgtaagccactgctgctaacctgcttttaccgccgattcttccgtctcttcgaatctctcgtaaaaagatggctggactctcaggatttaggagccttcctcccaaagctaagaatttggtggttgccgggggtttgacagcatttgtcttcggaacgtactactacacaatgagagctgttggaggtacagatgaactgcaagtagcaatagataaatttgaagcagagaagagcaagacagagggtgatggtactagcatgccatcaaaggtttaatttctttttgcaagaaaaacagtagttttctctctgcttttactactttgtgttaagatcaaggctttagttgttttacatgacatgaaaatgttaaaatgtgatattgaactcggttgttactaagtttcatgtatgataactgagtggtagggaaagtatagtataactgagattctcttgttggattgtgaagaatttatgatgaaaagccaagttggggattatgatgcatgtaaaataaactttgccactgctttctattgtatgaagctggggcagaatggcattacaaggttaagatgaaaaaaatacagcacattttctgttta

SEQ ID NO: 8171 - DNA, 591 bp, Arachis hypogaea
actttctaatctcgccgactccaatcgtcgccgtcgctaccgccgctaccgccgccctaagccactgctgctaacctgcttttaccgccaattcttccgtctcttcgaatctctcgtaaaaagatggctggactctcaggatttaggagccttcctcccaaagctaagaatttggtggttgccgggggtttgacagcatttgtcttcggaacgtactactacacgatgagagctgttggaggtacagatgaactgcaagtagcaatagataaatttgaagcagagaagagcaagacagagggtgatggtactagcatgccatcaaaggtctaatttcttttgcaagaaaaacagtagttttctctctgcttttactactttgtgttaagataaaggctttagttgttttacatgacatgaaaatgttaaaatgtgatattgaactcagttgttatcaagtttcatgtatgataactaagtggtagggaaagtatagtataactgagattctcttgttggattgtagaagaatttatgatagaaagccaaggttggggattatgatgcatagtaaaaataactttgccactg

SEQ ID NO: 8172 - DNA, 550 bp, Arachis hypogaea
ctcgccgactccaatcgtcgccgtcgctaccgccgccgtaagccactgctgctaacctgcttttaccgccgattcttccgtctcttcgaatctctcgtaaaaagatggctggactctcaggatttaggagccttcctcccaaagctaagaatttggtggttgccgggggtttgacagcatttgtcttcggaacgtactactacacaatgagagctgttggaggtacagatgaactgcaagtagcaatagataaatttgaagcagagaagagcaagacagagggtgatggtactagcatgccatcaaaggtttaatttctttttgcaagaaaaacagtagttttctctctgcttttactactttgtgttaagatcaaggctttagttgtttacatgacatgaaaatgttaaaatgtgatattgaactcggttgttactaagtttcatgtatgataactgagtggtaaggaaagtatagtataactgagattctcttgttggattgtgaagaatttatgatgaaaagccaaagttaggggattatgatgcat

SEQ ID NO: 8173 - DNA, 777 bp, Arachis hypogaea
cagtggacaattgtctattctttctaatctcgccgactccaatcgtcgccgtcgctaccgccgccgtaagccactgctgctaacccgcttttaccgccgattcttccgtctcttcgaatctctcgtaaaaagatggctggactctcaggatttaggagccttcctcccaaagctaagaatttggtggttgccgggggtttgacagcatttgtcttcggaacgtactactacacaatgagagctgttggaggtacagatgaactgcaagtagcaatagataaatttgaagcagagaagagcaagacagagggtgatggtactagcatgccatcaaaggtttaatttctttttgcaagaaaaacagtagttttctctctgcttttactactttgtgttaagatcaaggctttagttgttttacatgacatgaaaatgttaaaatgtgatattgaactcggttgttactaagtttcatgtatgataactgagtggtagggaaagtatagtataactgagattctcttgttggattgtgaagaatttatgatgaaaaaccaattggggattatgatgcatgtaaaataaactttgccactgctttctattgtatgaagctggggcagaatggcattacaaggttaagatgaaaaaaatacagcacattttctgtttatgattgtgtagtgttgctgaataagattgtgtgatgggttaaactccaaaaaaaaagaaaaaaaaaaaagtactctgcgttgataccactgcttcgctctatca

SEQ ID NO: 8174 - DNA, 781 bp, Arachis hypogaea
cagagtacggggggagctattgaagaatagggaaatagggaataaacctgaacagtggacaattgtctattctttctaatctcgccgactccaatcgtcgccgtcgctaccgccgccgtaagccactgctgctaacctgcttttaccgccgattcttccgtctcttcgaatctctcgtaaaaagatggctggactctcaggatttaggagccttcctcccaaagctaagaatttggtggttgccgggggtttgacagcatttgtcttcggaacgtactactacacaatgagagctgttggaggtacagatgaactgcaagtagcaatagataaatttgaagcagagaagagcaagacagagggtgatggtactagcatgccatcaaaggtttaatttctttttgcaagaaaaacagtagttttctctctgcttttactactttgtgttaagatcaaggctttagttgttttacatgacatgaaaatgttaaaatgtgatattgaactcggttgttactaagtttcatgtatgataactgagtggtagggaaagtatagtataactgagattctcttgttggattgtgaagaatttatgatgaaaagccaagttggggattatgatgcatgtaaaataaactttgccactgctttctattgtatgaagctggggcagaatggcattacaaggttaagatgaaaaaaatacagcacattttctgtttatgattgtgtagtgttgctgaataagattgtgtgatgggttaaactccaaattcta

SEQ ID NO: 8175 - DNA, 769 bp, Lotus japonicus
ggactttaccttttcttcccattctctccctcaattgaatcaatgcactgaccctccctctctcggcctctcagtcgcacccctccgcgccgtcgcctgtttgatcggaagccacaccggagtttcacggccgcagacttcatctccatttcgggtctctctatttgcatcaatctttcgcacaaggtgggctctattattccatttatatattgcaaatcctggtttctgaagaatgttccatatgcactctggcaaaaaaagatgggattatagttgttcaatgaaaaggtcgtattctcaagagggttctgtgtgtagcgttgcctgtctctcaaacactcgctctctcaatctcaaagggaaaacaaaaatactaagactcattcaccgccaccgcgactctccgccaacgttcgccgagatttttccccattcaccaagatggctggagttttaggatttgcaagccttccacccaaggcaaagaatttcgtagttgccgggggtttgacagcatttgtcttcgggacctacttctacaccatgagagctgttggaggtactgatgagctgcaagtagcaattgacaagtttgaagctgacaagagcaagcaagagggtgaaccaagcgtgccatcaaaggtctagagatgttttcttgtggaacaaaaacaatactttgtgtgtattcactattttgcttttcagcatcagaagaaaaatgtattttcaatctagtgcataataagttcagccagttttgtgt

SEQ ID NO: 8176 - DNA, 653 bp, Vigna unguiculata
ggggcttcggtggctttgtattttgaggtaactaacacaatgtcgctgaggcgtttcttaggcttttctgatggtgaggtcatgaggtctgacgcaaaaccttgttctcggctaatgaggcacacggctggaatctgtagtgttgggggagcattaggattttggatcctttgtcgactgcattatggtcctcgaattacaaatcctaggagccttcgttgggcagcatgtggagctgtaactgtaagctcaagcacggctttactggttcgtttatttagtcctgaatgtgagccccagaatatagctgcttacgacaataaaaagtaacactgatattgtcacccctttcatatttcactgttagttaatataaaaaaggggaaattatgagtttttgagaaccttttctccccaggaaatggaccaacatattgaaatcacatcactcttgtagcattataatatacttgattagctaggttgcaaatatattgcatatgtaaggtttatggaatggattaggctaattattctcattatgaattgctattagaaagggcaaaatacttcaactctataacttctccgctgaaaattttcggaatgaaattttcagtgtataaaataaatttctaagagtccagtccgga

SEQ ID NO: 8177 - DNA, 1295 bp, Arachis hypogaea
cccccccccccctctctcactcacacggattctcaagcgagggaacaaaaagtgaagaaaccctaatacccttctcgaacagccaccagcccaccacccaccatccaaagctcatcacccaaacagcaaaggaggtcgccgaacccttctcctcgccgtggttgccactgttgcctgtggaaaggtctactcggcccacttctcaccgttcgtcttctcctcgccgtcgaacgagatctgggtcgagctcgtggcgtcgccgtcgaataaggttgctgggtccgtcagtcctcgtcccttcgagctctctgtctctccattcgagctcactttcctgttcgagctctctctctgtccaagctcacttcctttctctctcgtcgccggcgccacctccagtccgccacactcccagcaggccaacaccgtcccattctgcggcagccaccagcgtccagttcttctccagacgccgccgtcctttctgctccgccgtgatagtctccctcatctccgacggtgcgtgcccttcctctcccagagattgaagctgcgagttcctctgtccgccactccgcgagctctgccgtcgtcttctgcgtctcgttgccgtctccttcagcacgactcgcctgcagttccatcccttccggcgttcagctaaagtaataagatgtcgctgaggcgtttcttgggattttccgatggtgagctgatgaggtctgatgcaaaaccttgctccaggttgatgagacacactgcagggatatacagtgttggtggagccttaggattttgggtcctgtgccgattgcactatggccctcgaattacaattcccaggagtcttcgttgggcagcttgtggtgctgtaactacaagcgcaagcacagctttgctggttcgtttatttagtcccgagtgtgaaccccagaatatcgctgcttatgacaacaaaaagtagtactggctgttcctctctctcttattacatagaaagcagaaaaaaaatgatatattttggatgctttaatgatggactagcaacagtgaatcacaccacaccagtaactcttttagcatctacttagtggatcaggttaccgttttattgcatttgtaagttttattgtatgccctttgaattttatcgtataaccaatgaaggtcacttcataacatcacaaggagtaaattaagctagttacttaccatgtctaataatcttttttctcaaaactaacacttaagatattcgattatatgctgactataaagatcatgaagaaagtcag

SEQ ID NO: 8178 - DNA, 847 bp, Arachis hypogaea
tcgccgccacactcccaccaggccaacaccgtcccgttctgctgcagccaccagcgtccagttcttctccagacgccgccgtcctttctgctccgccgtgatagtctccctcatctccgacgttgcctggccttcctctcccagagattgaagctgcgagttcctctgtccgccactccgcgagctctgttgtcgccttgccgtcgtcttctgcctctcgttgccgttttcttcagccagactcgcctccagttccatcccttccggcgttcagctaatgtaataagatgtcgctgcggcgtttcttgggattttccgatggtgagctgatgaggtctgatgcaaaaccttgctccaggttgatgagacacactgcagggatatacagtgttggtggagccttaggattttgggttctttgccgattgcactatggccctcgaattacaattcccaggagtcttcgttgggcagcttgtggtgctgtaactacaagcgcaagcacagctttgctggttcgtttatttagtcccgagtgtgaaccccagaatatcgctgcttatgacaacaaaaagtagtactggctgttcctctctctcttattacatagaaagcagaaaaaaaatgatatattttgggatgctttaatgatggactagcaacagtgaatcacaccacaccagtaactcttttagcatctacttagtggatcaggttaccgttttattgcatttgtaagttttattgtatgccctttgaattttatcgtataaccaatgaaggtcacttcataacatcacaaggagtaaattaagctagttacttaccatgtctaataatctttttt

SEQ ID NO: 8179 - DNA, 809 bp, Cicer arietinum
ggacattttgcatatttcactctctcacctccattttacaacttcagtctctaaaaatgttgttatagtgatttccaattcagaccaaatccaagtgaaccacaccacaattaggtacaaaggagaagaagttacttccgtttcatcattgaaagcttcagcagtagtgaacggtaactgatacgatgtcattgagacgtttcttaggctattctgatggcgaggtcatgaggtctgatgcaaaaccttgttctagactaatgagacacacagccggaatctttagtgttggtggagctttgggattttgggtcctttgccgaatgcactatggtcctcgaattacaattcctaggagtcttcgttgggcagcatgtggagctgtaactgtaagttcaagcacagctttgctggttcgtttgtttagtcctgaatgtgaaccccaaaatatagctgcttatgacaataaaaagtagcactggcagtaactccctcctttcccccacatacagaaatagggaaatgataaatttggaggtgttgtgagaatgaaatcgcgttactcttgtaacttaataatctacataatgaggcaggttacaaatattttgcatccgtaagttttttggtataaattaccttttatagtatcaagaggtgaaattgttactttcattatttgctcactatgcaaagtaagtttttatactttcaaatttgtctgaccacggtgattttatggatcggaattacaacatcacacataggtttcgtttacagctttgaattacaacaccaacaaacatttc

SEQ ID NO: 8180 - DNA, 1042 bp, Arachis hypogaea
cgccacctccagtccgccacactcccagcaggccaacaccgtcccattctgcggcagccaccagcgtccagttcttctccagacgccgccgtcctttctgctccgccgtgatagtctccgtcatctccgacggtgcgtgcccttcctctcccagagaatcagagattgaagctgcgagttcctctgtccgccactccgcgagctctgccgtcgtcttctgcgtctcgttgccgtctccttcagcacgactcgcctgcagttccatcccttccggcgttcagctaaagtaataagatgtcgctgaggcgtttcttgggattttccgatggtgagctgatgaggtctgatgcaaaaccttgctccaggttgatgagacacactgcagggatatacagtgttggtggagccttaggattttgggtcctgtgccgattgcactatggccctcgaattacaattcccaggagtcttcgttgggcagcttgtggtgctgtaactacaagcgcaagcacagctttgctggttcgtttatttagtcccgagtgtgaaccccagaatatcgctgcttatgacaacaaaaagtagtactggctgttcctctctctcttattacatagaaagcaaaaaaaaatgatatattttggatgctttaatgatggactagcaacagtgaatcacaccacaccagtaactcttttagcatctacttagtggatcaggttaccgttgtattgcatttgtaagttttatcgtatgccctttgaattttatcgtataaccaatgaaggtcacttcataacatcacaaggagtaaattaagctagttacttaccatgtctaataatcttttttctcaaaactaacacttaagatattcgattatatgctgactataaagatcatgaagaaagtcagcaatttcctttttggtctgattatatgctgattatcttagttaagagtttcaatctagttatacgagtaatgacattagtttatctttatactcctatttttcctagctgctcaagtgcttatgctg

SEQ ID NO: 8181 - DNA, 751 bp, Cajanus cajan
gaggggccacagcagcgtaaccctgacaagcttctctagcaccgttctctttctgtttcgaggtaattaacacgatgtcgttgaggcgtttcttaggctattctgatggtgaggtcatgaggtctgatgcaaaaccttgttctaggctaatgaggcatacagctggaatttttagtgttggtggagcactagcattttgggtcctgtgccgaatgcactatggtcctcgaattacaattcccaggagtcttcgatgggcaacatgtggagctgttactgtaagctcaagtacggctttgctggttcgtttgtttagtcctgaatgtgagccccagaatatcgctgcttatgacaataaaaagtaacattgatattattacccctttcctttttccctacttgttaatataaaaagggggaaatgattagtttatgatgtggtgttataataaccttttgtacccggggaaatgaacttgcgtgattgaaatctcatcactctaataacattatgatacacttgcaaagaatagtgggatgttataatgatctcatcacactgagcttggtttcagatattctgcatatgtaagttttatggtatggatatcatttagtggcatcacaaaggggaaaataggctgtttactcccactattcttagctattagaaagggtaaaaattgtatttcaattttctgttttctccctgaaaaatttcctccaacaatttttattccaaattagtcgt

SEQ ID NO: 8182 - DNA, 633 bp, Pisum sativum
gtagaaagaacaataatttacttccatttcagcggtgaaggcttcagaattcgtcaccgtaagagtaaatactggtaccaccaccgagatttagccgggctctcgcaggtaactgatacaatgtcactaaggcgtttcttagactattctgatggcgaggtcatgaggcctgatgcaaaaccctgttctagactaatgagacatacagccggaatctttagtgttggtggagcattgggattttgggtgctttgccgaatgcattatggtcctcgaattacagttccaaggagtctccgttgggctgcatgtggagctgtgaccgtaagttcaagcacagctttgctggttcgtttgttcagtcctgaatgtgagccccagaatatagctgcttatgacaataaaaagtactagcactgttggtaactccccttttcccccacatacagaaatagggaaatgataaaatttggaggcgttgcatgaatgaaattgtattactgttttaactttgtaatctacatcagtagggctaccagtatggtatagatgaaccttttatggcatcacgaggcaaaattaggctagttactttcataagttttggagctattgcacttgcaaaagtatgtt

SEQ ID NO: 8183 - DNA, 526 bp, Vaccinium corymbosum
gacagaggcgacgaccaacccaccggcgaccaccaccaccatcggcgagaatcttctgggcgacaccattatccagccacgaaggatcatcctagttttaggaaatcggtacatggcattgaggcgttttctcggattttctgatggcgagctgatgaggtcagacgcaaaaccttgtagtaggttaatgaggcaaactgctgggatttttagtgttggaggagcattagggttttggattctctgtcgtttgcattatggtcctagaattacaatccccaggagccttaggtgggcaggttgtggagcggtctctgttagttcaaccactgctttgctggtccgccttttcagtcccgaatgcgaaccacagaatatagctgcttatgacaataagaaatgatgcttttttgtttgtttagtacaccttgattttgaagaatgaaatgacatgaagaatctcgaggggtggtgtttttccactctcccagatgaacctccacaactatttctctaaccaggttgc

SEQ ID NO: 8184 - DNA, 561 bp, Glycyrrhiza uralensis
atggcgacctcgacctcattgtgtgatattttgctccttgcgaacacttgatcccatcctacgagctaacgaagcaactaagacgatgtcgttgaggcgtttcttgggctattctgatggcgaggtcatgaggtctgatgcaaagccttgttctagactaatgagacacacagcaggaatctttagtgttggtggagcattaggattttgggtcctttgccgaatgcactatggtcctcgagttacaattcctaggagtcttcgttgggcagcatgcggtgctgtaactatgagctcaagcacggctttgctggtgcgtttgtttagtcctgaatgtgagccccagaatatagctgcctatgacattaagaagtagcactgataatgtaccttccttttctcctccacgtatagaaagagcgaaatgattaatgttggggtgttgtgactgtgagaatgaaattgtatcactcttataactttataataatttacttaatgagtcaggtcacggatctcttgtatctgtaagttttaatggtataaatgtccttttatggc

SEQ ID NO: 8185 - DNA, 349 bp, Lotus japonicus
gtaactacacgatgtcgttgaggggtttcctagggctttctgagggtgaggtcatgaggtctgatgcaaaaccttgttcgaggttgatgagacacacagctggaatttgtagtgttggtggagcattaggattttggatcctttgccgattgcattacggtcctcgaattacagttcctcggagtcttcgttgggcagcgtgtggagctgtaactatgagctcaagcacagctttgctggttcgtttgtttagtcctgaatgtgaaccccagaacatagctgcttatgacacaaaaaactagcactatattgtaactccttttctttttccctcctcatatagaaaggg

SEQ ID NO: 8186 - DNA, 641 bp, Glycine max
gtttattgcagaattaaaaactatcatagggatagttttactaaaaaaattcaaagtagtttccacaacatgcaatatcagcagcatcaggagatattttgttccttgcatatacttgattccatcctactagccaattaggtagataacacaatgtcgctgaggcgtttcttaggctattctgatggtgaggtcatgaggtctgatgcaaaaccttgttccaggctaatgaggcacacagctgcaatctttagtgttggtggagcattaggattttgggtcctttgccgaatgcactatggtcctcgaattacaaatcctaggagtcttcgttgggcagcatgtggagctgtaactgcgagctctggcacggctttgctggttcgtttgtttagtcctgaatgtgagccccagaatatagctgcttatgacaataaaaactaactggtgttgtcacccactttctttttcgcctactgataacattataatatacttgatgaggtaggttgcaattatctcacatgtgtaagttttatggtatggatgacattttctggcacatcactaagggaaaatttggctaattaatccaactattcttagatattataaagggtaaaaaattattttcattctct

SEQ ID NO: 8187 - DNA, 634 bp, Glycine max
gtttattgcagaattaaaaactatcatagggatagttttactaaaaaaattcaaagtagtttccacaacatgcaatatcagcagcatcaggagatattttgttccttgcatatacttgattccatcctactagccaattaggtagataacacaatgtcgctgaggcgtttcttaggctattctgatggtgaggtcatgaggtctgatgcaaaaccttgttccaggctaatgaggcacacagctgcaatctttagtgttggtggagcattaggattttgggtcctttgccgaatgcactatggtcctcgaattacaaatcctaggagtcttcgttgggcagcatgtggagctgtaactgcgagctctggcacggctttgctggttcgtttgtttagtcctgaatgtgagccccagaatatagctgcttatgacaataaaaactaactggtgttgtcacccactttctttttcgcctactgataacattataatatacttgatgaggtaggttgcaattatctcacatgtgtaagttttatggtatggatgacattttctggcacatcactaagggaaaatttggctaattaatccaactattcttagatattataaagggtaaaaaattattttc

SEQ ID NO: 8188 - DNA, 633 bp, Glycine max
caaatgtcgtccccctgttataatactaacccggcctgggtcacttgactccggcacaaggaaagctgcttcttctttgcaaaggcggcgaggcaccaacgctctctagctccggtctctttgtattttgaggtagataacacaatgtcgctgaggcgtttcttaggctattctgatggtgaggtcatgaggtctgatgcaaaaccttgttccaggctaatgaggcacacagctgcaatctttagtgttggtggagcattaggattttgggtcctttgccgaatgcactatggtcctcgaattacaaatcctaggagtcttcgttgggcagcatgtggagctgtaactgcgagctcaggcacggctttgctggttcgtttgtttagtcctgaatgtgagccccagaatatagctgcttatgacaataaaaactaactggtgttgtcaccccctttctttttcccctactgataacatcataatatacttgatgaggtaggttgcaattatctcgcatgtgtaagttttatggtatggatgacattttctggcacatcactaagggaaaatttggctaattaatccaactattcttagatgctataaagggtaaaaaattattttcattctctt

SEQ ID NO: 8189 - DNA, 612 bp, Glycine max
ctgttataatactaacccggcctgggtcacttgactccggcacaaggaaagctgcttcttctttgcaaaggcggcgaggcaccaacgctctctagctccggtctctttgtattttgaggtagataacacaatgtcgctgaggcgtttcttaggctattctgatggtgaggtcatgaggtctgatgcaaaaccttgttccaggctaatgaggcacacagctgcaatctttagtgttggtggagcattaggattttgggtcctttgccgaatgcactatggtcctcgaattacaaatcctaggagtcttcgttgggcagcatgtggagctgtaactgcgagctcaggcacggctttgctggttcgtttgtttagtcctgaatgtgagccccagaatatagctgcttatgacaataaaaactaactggtgttgtcaccccctttctttttcccctactgataacatcataatatacttgatgaggtaggttgcaattatctcgcatgtgtaagttttatggtatggatgacattttctggcacatcactaagggaaaatttggctaattaatccaactattcttagatgctataaagggtaaaaaattattttca

SEQ ID NO: 8190 - DNA, 882 bp, Trigonella foenum-graecum
cggccgggtaattggtgcatctctagtctttcagcagtgaagccttcggaagtcatcaccggtaactgatacaatgtcgctgaggcgtttcttaggctattctgatggcgatgtcatgaggtctgattgcaaaccttgttccagactaatgagacacacagccggaatctttagtgttggtggagcattgggattttgggtcctttgccgaatgcactatggtcctcgaattcatattcctaggagtcttcgttgggcagcatgtggagctgtaactgtaagttcaagcacagctttactggttcgtttgtttagtcctgaatgtgagccccagaatatagctgcttatgacaataaaaagtagcactgttagtagtaactcccttttccctcatatacagaaatagggaaatggtaaatttggaggtgttgcaagaatgaaattgtgttgttactctaataactttatagtttatacataatgagtcagacgaatatcttgcatctgtgagttttgtggtataatttataaatgaccttttatggcatcactatgcgaaattagactagttacttttgtaaattgtggagctatttcacttgaaaaagtatgttttctacttctttgtttttcaaactcatctttttaatacttccaaactagttattagtaatttagataacaagttaatcaagcctattttcttttaggacagtaaatagaacaacccaaatgaccataatttaaactcttacctaaatagagagttgtgtagcttaactggtttttttttttgtagatagctcaactggtttaagttagagtttgaaggagtaacactaagtactaacatttttctatccaaaagaactgttagcaca

SEQ ID NO: 8191 - DNA, 760 bp, Medicago truncatula
gcaactttcaaggttctcttcaaccgtacaataagttacttccgttggcttcagcagtcgttaccgagaaagatattgctaccatcatctgaatttacaagggaacatttgccttgtacgcaactttgttcttttcttggttagtcgggctctccgaggtaattgataacgatgtcactgaggcgttttttaggcttttctgaaggcgatgtcatgaggtctgattgcaaaccttgttctagactaatgagacacacagccggaatctttagtgttggtggagcattgggattttgggtcctttgccgaatgcactatggtcctcgaattcaaattcctaggagtcttcgttgggcagcctgtggagctgtaactgtaagttcaagcacagctttgctggttcgtttgtttagtcctgaatgtgagccccagaacatagctgcttatgacaataaaaagtagcaccgttagtaactccccttttccatccgacatacagaaatagggaaatgataaatttggaggtgttgcgataatgaaatcgtgttactcttattactttataatctacataatgagtttgattacgaatatcttgcatctgtaagttttgtggtaaaaatgatcttttatggcatcactaggggaaattaggctagttactttcgtaaattgtggagctattgcacttgcaaaagtatgttttatacttttttgtttttcaaactcatcttttaatacttccaaactgttattagta

SEQ ID NO: 8192 - DNA, 774 bp, Valeriana officinalis
actaggaacgaattctctcctcaaccggaaatcagccattcgttagatcgagtctcttgcaggtatgttcttgtgatctcaaatcagattcattgcttgaaagaattagggcggatcctaggatcctgaatccgcaactatggaaccctacttgttcagaactccattgatattgatcgtttggtctgccatgttcaaattacccccctacatgtgtataattctcaatgtgtatcacttttactcaatgttgaaattaaccctctcctgttgttgttccgttaatggataacgtgaaagaaatgaaaattgaaaccctaatcaaaagaaccaatatttcctttcgtgcttgaaccatagaactagggtttgtttcgagacttgatattcttgatgggctaagttagatataacaacaggcttctgcatcaaaaggaaattctgaacactaggtttcaaatatggcgttacggagattctttggtttttctgatggagaattaatgagatcagatgcaaaaccgtgcaccagattgatgagacaaactgccggaatctttacagttggaggagctttaggattttgggttctctgccgtttgcattatggtccgagaattacagttccccgcagtcttcggtgggccgcgtgcggagctgttacagtgagctcgagtacagctctgctggttcgcctttttagccctgaatgtgaacctcaaaatattgctgcgtttgacaagaaaaagtagtttaatcttttgttgtagtcaa

SEQ ID NO: 8193 - DNA, 469 bp, Vaccinium corymbosum
gcgacaccattatccagcgacgaaggatcatcctagttttaggaaatctgtacatggcattgaggcgttttctcggattttctgatggcgagctgatgaggtcagacgcaaaaaccttgtagtaggttaatgaggcaaactgctgggatttttagtgttggaggagcattagggttttggattctctgtcgtttgcattatggtcctagaattacaattcccaggagccttaggtgggcaggttgtggagccgtctctgttagctcaaccactgctttgctggtccgccttttcagtcccgaatgcgaaccccagaatatagctgcttatgaccataagaaatgatgccttttttgtttgttcagtacaccttgattttgaagaaagaaatgacatgacgaatctcaaggggtgttgttttttcactctcccagctgaacctccacaactatttctctaactaggttgc

SEQ ID NO: 8194 - DNA, 767 bp, Solanum lycopersicum
accgtagaatgggtaattatggaaactgaaatgacgctgcttctctccctatttaaccttctactcttctaaagtatttgaggaaaaaaaataaaaacccacttttaggaagcagagctgtaattgagaaggataacaatttttttgagaagccctatcttcagtagctgcaacagcgattcaattgtgcatttggtgattattgaggtttctggtgtgatggctttaaggcgtatgcttgggtattcggatggagagttaatgagatcagatgcaaaaccttgcacaagactaatgagacaaactgctgggattttttctgttggaggagcattaggattttggattctttgccgattgcactatggtcctagaatcacagttcctagaagtcttagatgggcagcttgtggggctgttactgtgagctcaagcaccgctttgctagttcgtctatttagtcctgaatgtgaaccacaaaatatagctgcctatgacaagaagggatgatgttgcttttcttcggagatcagtacgtaaaactgaggtgttttaaggattctccttccacaggcataacacatatggtggttgcgtgggttagccactggagaacgaccagcgtttcaattcttaactattttctcactgagggcctattatatttgccactaatatttcaattgctattgcttaaaattctatgcacttatttgtgtgaatgatttatcatttggcttaagcttcaaaggttatctgatggtatg

SEQ ID NO: 8195 - DNA, 714 bp, Coffea canephora
tctccaaaaaccctgcgattgctgccggagattctcgttgtcgccgccgtagttactgacggtgaagccacatacatttggacctcgtttacagttgtcgtctttcactggtcactacccgctctgtctctcctcctccaccttttgagaggtgaaaactggaattttgggccaaaaactagccagcctatggcattgaggcgctttttggggttttctgatggggagttaatgagatcagatgctaaaccctgttcccggttgatgagacaaacggctgggattttctctgttggtggagcattaggattttgggttctctgtcgcctgcattatggtcccagaattacaattcctcgaagtcttaggtgggctgcctgtggagcaatcactgcaagctcatctacagctttgcttgtccggctgtttagtcctgaatgtgagccacaaaatatagctgcttttgacaagaaaaagtagtaattaacacattcaagttttgatatttgtaaaactacagtgtctcctgtgagtttctctcctaaaagtgggcatttgcatgttttataaactattctgcatggggaagggtggttgtattgtaagcaatcaaaagttttatcaaaaaaggtggaaggttggttgtaagcatggaagggtggttgctttcaatatatttcgccgttttatcatccaaaaatgaaaaaaatggaa

SEQ ID NO: 8196 - DNA, 737 bp, Medicago truncatula
cggccgggggcaactttcaaggttctcttcaaccgtacaataagttacttccgttggcttcagcagtcgttaccgagaaagatattgctaccatcatctgaatttacaagggaacatttgccttgtacgcaactttgttcttttcttggttagtcgggctctccgaggtaattgataacgatgtcactgaggcgttttttaggcttttctgaaggcgatgtcatgaggtctgattgcaaaccttgttctagactaatgagacacacagccggaatctttagtgttggtggagcattgagattttgggtcctttgccgaatgcactatggtcctcgaattcaaattcctaggagtcttcgttgggcagcctgtggagctgtaactgtaagttcaagcacagctttgccggttcgtttgtttagtcctgaatgtgagccccagaacatagctgcttatgacaataaaaagtagcaccgttagtaactccccttttccatccgacatacagaaatagggaaatgataaatttggaggtgttgcgataatgaaatcgtgttactcttattactttataatctacataatgagtttgattacgaatatcttgcatctgtaagttttgtggtaaaaatgatcttttatggcatcactaggggaaattaggctagttactttcgtaaattgtggagctattgcacttgcaaaagtatgttttatacttttttgtttttcaaact

SEQ ID NO: 8197 - DNA, 849 bp, Sarracenia psittacina
cttacacccgccgcatctcacttctcagtgtttctctccacccaacgtagctacgccttctcctcgacgatttcaaatcggaaatcgcctcagtcgcctgaatcgatttcgtcttcttctccgcctctgaatcgatttcgtttcgtcttctcctcgacctcgacgtttcggtcttctcctcgacccgacgattttgtctgcgactgaattgatttcgtccgttgcctccgttcgccgcttgtctcgccgctcgtctgagagaggtccgttctattttcagtgttaaaagactaaaatttaaaccaacagggcaagcatctggctattgggttgaaatttattgctcgtaaggagattgatacatggcattgaggcgctttttcgggttttctgatggtgagctgatgagatcagatgcaaaaccttgttcccggttaacgaggcacactgctgggatttttactgttggaggagcattgggattttgggttctctgtcgtttgcattatggtcctagaattacaattccgaggagccttaggtgggcaggttgtggagccgtctctgtaagttcgacctctgctttgctcgtgcgccttttcagtcccgaatgcgaaccccagaatatagctgcttatgacaataaaaagtgatggttaattgattcttgtttaaactcaaatgaattttgatgtatgaaatgacctgtagtccctcacggaggagaatgctattctcattttccagatggatcaccatgataatttaatttctccttgtattggttactctttgaatgtagtccttacaatcaccagattattgaaatctctatctgagcgtggggta

SEQ ID NO: 8198 - DNA, 647 bp, Camellia sinensis
ccgccgtttgcctttccgccgctgctgctctccgctcaccgcccaccgccgctgctcttcgcttgtcgtcggtcattcctattttcactggccgggacccattaaaagcctgttgcaccatacaagctggaaagagactaaatttcgaaccaccagcacaagcagcagggtgtttggctcaattttttttttccttctcacaaggacatggcattgaggcgttttttcgggttttctgatggcgagctgatgagatcagacgcaaagccttgttccagattaatgaggcaaactgctgggatttttactgttggtggaggattggggttttgggttctctgtcgtctgcattatggccctagaatcacagtgccaaggagccttagatgggcagcttgtggagccgtctctgtaagctcgaccactgctttgttggtctgccttttcagtcctgaatgcgaaccccagaatatagctgcctatgataataaaaaatgatgctcgattcttgtcaaagtattgaattttcatatatgaaattacctcaagtccctcaaggagggtgatattccgatttctcaggtggaccaccaggactatttcttgttattcataatctgtcttagcatgtgaaatagtttcttaac

SEQ ID NO: 8199 - DNA, 978 bp, Solanum lycopersicum
taacagagctttttaagaacttatttggtgtttcagggaacaaaggatgcaatgcagaagatgccatctccagtccagttagtatcttgattggcattgttaccttacatggactgggtctcagcaggcttgtgaagtcttcccattgtcacccactatatttgaggcaaaaaaataaaaacccacttttaggaagcagagctgtaattgagaaggataacaatttttttgagaagccctatcttcagtagctgcaacagtgattcaattgtgcatttggtgattattgaggtttctggtgtgatggctttaaggcgtatgcttgggtattcggatggagagttaatgagatcagatgcaaaaccttgcacaagactaatgagacaaactgctgggattttttctgttggaggagcattaggattttggattctttgccgattgcactatggtcctagaatcacagttcctagaagtcttagatgggcagcttgtggggctgttactgtgagctcaagcaccgctttgctagttcgtctatttagtcctgaatgtgaaccacaaaatatagctgcctatgacaagaagggatgatgttgcttttcttcggagatcagtacgtaaaactgaggtgttttaaggattctccttccacaggcataacacatatggtggttgcgtgggttagccactggagaacgaccagcgtttcaattcttaactattttctcactgagggcctattatatttgccactaatatttcaattgctattgcttaaaattctatgcacttatttgtgtgaatgatttatcatttggcttaagcttcaaaggttatctgatggtatgtctacacttcaataagatcttactactattctttagttttgttaacttcaggtcaaataccactttataatggaatatttaagattaaagtagaaggcttgtttccaaataaaataaattatttttg

SEQ ID NO: 8200 - DNA, 565 bp, Panax ginseng
aaaacccacttctgctgcaccttaaacttttaagtggaaccctttgaattgttgcgtaaagtaagcaatggcactaagacgtttctttggattttctgagggtgagctgatgagatcagattcaaaaccttgcaccagattgatgagacaaaccgctggaattttttctgtcggaggagcattagggttttgggttctctgtcgcttgcattacggtcctagaatcacagttcctcggagtcttaggtgggctggttgtggagctgtgtctgtaagctcaagcacagctttgctggttcgccttttcagccccgagtgtgaaccccagaatatagctgcttatgacacaaagaaatagtggtcggtttttatcaagtatttatactcagtttcaagaaaggagatcttaatcctattcagatgagccatcaggactgatatgaatttaaacattgttttctctttggaaatgaggtcattgtcaaatatcctcacttaattgcatttaagattatatattttatgtgtgtgtgtgtagttatatactatgaatgatcatatctaa

SEQ ID NO: 8201 - DNA, 812 bp, Panax ginseng
ccctggtagatcaggggtgggggcgggaaggggcagctagcccgacgccggcggtccggtcttcttcagttcttcttcggtcttcttctgcagatctgctcctgcaccactgctcctccagtcctccagtcctcctcttcacgacttcacctcatcaggaagagatattgcatcataaaagctacaacagtgtgaagtttttgaaacccacttctgctgcaccttaaacttttaagtggaaccctttgaattgttgcgcaaagtaagcaatggcactaagacgtttctttggattttctgagggtgagctgatgagatcagattcaaaaccttgcaccagattgatgagacaaaccgctggaattttttctgtcggaggagcattagggttttgggttctctgtcgcttgcattacggtcctagaatcacagttcctcggagtcttaggtgggctggttgtggagctgtctccgtaagctcaagcacagctttgctggttcgccttttcagccccgagtgtgaaccccagaatatagctgcttatgacacaaagaaatagtggtcggtttttatcaagtatttatactcagtttcaagaaaggagatcttaatcctattcagatgagccatcaggactgatatgaatttaacattatcaaggcttttgctactctagggcttattatctttggaagaaaaggccatagcaagattacatgaagtcataattgagtgtttaattattatgttgtccctttttaaagagtttttgtttcttaatatttgttatttaaaaatttcaattaaatat

SEQ ID NO: 8202 - DNA, 294 bp, Prunus persica
atggcgttgaggcgctttttagggttttcggatggcgagctgatgaggtcggatgcaaaaccttgttctagattgatgagacacactgctggtattttcagtgttggcggagcattgggattctggatcctttgtagactgcattatggacccagaattacagttcctaggagtcttcgttgggcagcatgtggcgcagtttctatgagctcaaccactgctttgctggttcgcttatttagtccagagtgtgagccccaaaacatagctacttatgacaaaggaaattagcac

SEQ ID NO: 8203 - DNA, 376 bp, Solanum phureja
gctgcaatagcgattcaattgtgcatttggtgatttttgaggtttctggggtgatggctttgaggcgtatgcttgggtattcggatggagagttaatgagatcagatgcaaaaccctgcacaagactaatgagacaaacagctgggatcttttctgttggaggagcattaggattttggattctttgccgattgcactatggtcctagaatcacagttcctagaagtcttagatgggcaacttgtggggctgttactgtgagctcaagcaccgctttgctagttcgtctattcagtcctgaatgtgaaccacaaaatatagctgcctacgacaagaagggatgatgtttcttttcttcagagatcagtatgtaaaa

SEQ ID NO: 8204 - DNA, 605 bp, Solanum melongena
aaagataattgatttttgagaagccttcggtagctgctagagcgccttctctttcctattcaattgtgtatctggcgatttttgagggttctgggttaatggcgttgagacgtatgcttgggtattcggatggagagttaatgagatcagatgcaaaaccttgctcaagactaatgagacaaacagctgggattttttctgttggaggagcattaggattttggattctttgtcgattgcactatggtcctagaatcacagttcctcgaagtcttagatgggcaacttgtggggctgtttctgtgagctcaagcaccgctttgctagttcgtctatttagtcctgaatgtgaaccacaaaacatagctgcctatgataagacgggatgatgttgcttttcttcagagatcagtatgtaaaactgaggcatggtgtcctatttaattcgtgtttaactttttaagctgttctccttccacaggcatatcacatattgctgcctgtgttagccaaatggagaacgaccagtgttttaatgctaagctattgtctcactgagagtctaactattatatttgccactaatatatcaatttttattgatt

SEQ ID NO: 8205 - DNA, 313 bp, Lotus japonicus
gtaactacaccatgtcgttgaggcgtttcctaggccattctgagggtgaggtcatgaggtcggacgcaaaaccttgttccaagttaatgcgacacacagctggaatttgtagtgttggtggagcattaggagtttggatcctttgccgattgcactatggtcatcggattacaattcctaggagtcttcgttgggcagcgtgtggagctgtaactatgagctcaagcacagctttgcgggttcgtttgtttagtcctaaacgtgagccccagaatatagctgcctatgacacaaaaaagtagcactgataaat

SEQ ID NO: 8206 - DNA, 711 bp, Olea europaea
cttatgcacggccgacataacgacgagacctcagcgcaaaatctccgttccaccatcaaaattataaaattactcattttcgcggtgtaaagaaatcatctcaaaaacccgtcgaagatcaaagcagacaagaatttctgaaggggacagcaaaatggcattaaggcgcgtgcttggattttcggatggggaacttatgaggtcagatgcaaaaccttgctccagattgatgaggcaaactgccggcatttttagcgttggaggggcattaggattttggatcctctgccgcttgcattacggtcccagaatcacagttcctcgaagtcttaggtgggctacttgtggtgctgtctcgactagcgcaaccacggctttactggttcgcctgtttagtcctgaatgtgaaccgcaaaatatagctgcgtatgacaagaaaaagtagtaaaggttataactaaaactttgtcgtgtaccttggggcttgtttgaggattgttgttatcataagattcattcgttgagttgttataatctataaaaccattcctattatttgtgatattggtcttatggatctctcaatgcaaatacattgtaattcttgattctcagtagtagtataaaagacgacgtactattattagtttgtactgctgattcttcatggaagtcttatggttgcaattaattttttccaaaaatgagcct

SEQ ID NO: 8207 - DNA, 520 bp, Citrus sinensis
gggatttataaatggcattgaggcggttttttggtttttctgatggtgagctgatgaggtcggatgcaaagccttgttccagactaatgaggcagacggctggcatttttactgttggaggagcacttgggttctgggttctttgcagactccattatggtcctagagttactgttcctagaagtcttcgatgggcaggctgcggtgcagtttctgtgagctcaaccaccgctctgctggttcgcctatttagtcctgaatgtgagcctcagaatatagctgcttatgataggggaaagtagtgattagctggcacatggacgttgcacattgctgtcctaaatgttctattaatactctttactcgctatttagcagtgtccttattatcactagatgtccaggactgggtttgtgcaatgccattttctccgcaaacagatatactcattgtgtacgagaattattttccttggatatcccttgctcgtatattatatatggtttttaggacacaaga

SEQ ID NO: 8208 - DNA, 652 bp, Vaccinium corymbosum
ccacgcctaatcactcccaccgacttatcttcttccttcatctctcatcgatccggcagcagtcgtgtatctctctcgatataaacacacagcgaactccaagtctctctctcgatcaaaccctctgaagaaaaacccgcagataaaacgaagttccccccgcctcagtccgacgactgtcgctggaggccagccatcgtccattctctctttcctaggatcatccaagtttcagtgggtgttagatcgaaacctttggctctttaaggagattggtacatggcattgaggcgttttctcggattttctgatggcgagctgatgaggtcagacgcaaaaccctgtactaggttaatgaggcaaactgctgggatttttagtgttggaggagcactcgggttttggattctctgtcgtttgcattatggtcctagaattacaattccgaggagccttaggtgggcaggttgtggagccgtttctgttagttcaaccactgctttgctggtccgccttttcagtcccgaatgtgaaccccagaatataactgcttatgaccataagaatgatgtctttttgtttgtttactacaccttgattttgaagaatgaaatgacatgaagaatctcgaggggtgttgtttttccactct

SEQ ID NO: 8209 - DNA, 786 bp, Sarracenia psittacina
cacccgccgcatctcacttctcagtgttttcttctccacccaacgtagctacgccttctcctcgacgatttcaaatcggaaatcgcctcagtcgcctgaatcgatttcgtcttctcctcgacgatttcgtcttcttctccgcctctgaatcgatttcgtttcgtcttctcctcgacctcgacgtttcggtcttctcctcgacccgacgattttgtctgcgactgaattgatttcgtccgttgcctccgttcgccgcttgtctcgccgctcgtctgagagagggcaagcatctggctattgggttgaaatttattgctcgtaaggagattgatacatggcattgaggcgctttttcgggttttctgatggtgagctgatgagatcagatgcaaaaccttgttcccggttaacgaggcacactgctgggatttttactgttggaggagcattgggattttgggttctctgtcgtttgcattatggtcctagaattacagttccgaggagccttaggtgggcaggttgtggagccgtctctgtaagttcgacctctgctttgctcgtgcgccttttcagtcccgaatgcgaaccccagaatatagctgcttatgacaataaaagtgatggttaattgatttcttagttaactcaaatgaatttgatgtatgaaatgacctgtagtccctccacggaggagaatgctattctcatattctccttgtattggttactctttgaatgtagtctttaccaaatcaccagattattgaaaatctctatttgagc

SEQ ID NO: 8210 - DNA, 791 bp, Cichorium intybus
gcttttgaacagaagcttttcatccggtaaatggaatcatctcttcactgctctctttcgtattcagatcgattcaacctccatattctccggccaatcgccgccatctccttcgtactttccttgcttgttttcggttggttcttggcctggaaactacttctcgttcacgtccctttggtccaggagatattcggtcttaagaagaaacaatttcttcccaaaccctcaaatcgtcgccgcttctcacgtttctacaataatctcactcttaatcacaccgataactccgacgtctctggttgattcaatctcaatttgtggaatcttattgatttgaccaatttaaaatctttctagaagactttcattaaaacaatggcattaaggcggttttttggtttttctgatggtgagctaatgagatctgattcaaaaccttgttcaagattaatgagacacactgctggagtttttagtgttggaggtgctttagggttttggattttatgtcgtcttcattacggtccaagagtacatgttcctagaagtctgaggtgggcaagtacaggggcggttacagtaagtgctgggacggctttactggtcagactttttagtccagaatgtgaacctcaaaacatagaggcatatgacaagaaaaaataaccgcctctattttatttatttattattattatttttttccatttgtctggataaagtgcatcatcatgtatgtctttgaggattgattttgtaagaaattaagtgtggatttctttgtgtga

SEQ ID NO: 8211 - DNA, 902 bp, Citrus clementina
gccgcacacagaccctgccgccgttcgtgccactgctcttgcccagtcgctgtttgtgctgctgtgcgtgccgctactcgtgcgttgtttgtggtgctgctcgtgactataagccgctgctgatttgatttctggtggttgctaaattttcttgccgatccagattatgagaaattaacttgcggatctctaccatagtgattgtaagaaatgatctccaccgtagcttctggtcttgacggagcaaagcaagcaggagtacagttttggctttaaaactttgagctgtatcgtgttctgtatctggagagggttttataaatggcattgaggcggttttttggtttttctgatggtgagctgatgagatcagatgcaaagccttgttccagactaatgaggcagacggctggcatttttactgttggaggggcactcgggttctgggttctttgcaggcttcattatggtcctagggttactgttcctagaagtcttcgatgggcaggctgcggtgctgtttctgtgagctcaaccactgctctgctggtttgcctatttagtcctgaatgtgagcctcagaatatagctgcttatgatagggggaagtagtaattagctggcacatggccattgcacattgctgtcctaaatgctctattaatactctttactggctatttagcagtgtccttattatcactagatgtccaggactagatttgtgcaatgcctttttgtccacagacagatatactcattttgtaccagaattttattccttcaatgtcccttgctcatatattatatatggcttttaggacacaagatatgactatatttaaaaaaatatgtttttatattttattcacgcatctaataaagcttgaattttgcacctg

SEQ ID NO: 8212 - DNA, 1009 bp, Lippia dulcis
ctctatagtgctaatcttctggactcggtgggaataactacagcattagggggtaattcatctgagagactagctattaattcgtcactgagtttactagtgaaagctgacattgcccaacaacagaagaattttttccgaaggcatagatttagaaagagtgagaaaatggctttgaggcgaatgctaggattttctgatggagagttgatgcggtcggatgcaaaaccctgttcccgacttatgaggcaaactgctggaattttctcggttggtggagcactaggcttttgggtcctctgtcgcttgcattatggtcctcgaattacggttcctcgaagtcttaggtgggctacttgcggggctatctgtatgagctcgaccacagctttgctggtacgtttatttagtcctgaatgtgaaccccaaaacattgctgcttacgaccagaaaaaataattaaagtacgctatttcctgaggaaattgaactagaagtgaatgcattggatgcaatgtaacgatcttgctgtgaaaaggcaaatgtagcattgtttatgagatttttgaaaattattggtctccttccttgattgtaagtaattctaagttgcatatttcatataaatatgtattttataattgagttttatataaatattattattttcttaagatggtgaaagaaatatagtgtatccaacattccctagaaatccctacagcatatgatccagttgaactctaccttttgttttttctttttcttctttgagatatttttaaatgatatttcctgaatcgaaaaacttaagtcagttagagaggagtatcattaaatatttaaacatttcactcgccctctcgtatacaggcaggtcggcagtaccattacatatgcaaatatctcagcttgccccattacacgcagacaaacttcttttgatatttaaacctctcagcattccccctcacgtacaaggggacttctctcggtcacacccttgcac

SEQ ID NO: 8213 - DNA, 535 bp, Actinidia deliciosa
caataattctggtgacaaggagagtgagaaatggctctgaggcggttcttagggttttctgatggcgagctgatgcgatcagacgcgaaaccttgttccaggctaacgagacatactgctgggatttgtacctttggaggggcattagggttttgggtcctctgccgtttgcactatggccctagaatcacaattcccaggagccttaggtgggcgggttgtggagcggtctctgtgagctcgacgggtgctttgctggtccgcctttttagtcccgaatgtgaacctcagaacatagctgcttatgacagcaaaaaaagataatgtttgcttctttccaagtattgaaatttgatgtgtgaaatgacctgtacaccccttcagaaggttgatcttattcccatttcccagatgatcataacatgtacttggcattttaattgttctctcctgtactcggattagttcgattgtcaaatgatctctttctctctctctatgtgatcaggtcggctttcttttcaaaaaaaaaaaa

SEQ ID NO: 8214 - DNA, 461 bp, Ocimum basilicum
acggcgggccgatcccgactttctttagattatttttagctcattcttcctcagcatccacaccgttcttcttggaacttccccaccggcagctgtcttcagtacttgtccgtacaaatcaaggatagtgaacaatggctctaaggcgtatgcttggattctctgacggagagctgatgagatcggattcaaaaccgtgttcgcggttgatgaggcacactgctggcatttgttcagttggaggagcactgggcttctggacactctgccgcttgtattatggtcctagaatcacagttcctcgaactcttaggtgggctgcttgtggtgctgtctctatgagcacaaccacggctttgctagttcgtctgttcagccctgaatgcgaaccccaaaatatagctgcctacgatcagaagaagtaaagttgctggctgcactgggaattatagaaacggacg

SEQ ID NO: 8215 - DNA, 849 bp, Malus domestica
gaatcataatatcccagttaaaaaaatgaaaaaaggaaagacaaatgaaagaaaagtacactcccctcccggcctaagccacttcaagctgagcccatttcccagcccggccatggcagcacatccataaagtgtggaccttcacacgcagcctcctcttcagttcttccttttttttggtttttcgtctctcacattcagtaccagaccgagagtcccccactttgtcgatcaatcttcagccttgtcttcctcccgaaggtccaaaaaggctgttacaattttcagtgggttaaggccaatagcattactaggtgtgagaaagaaggtctgaattgtagcataaagttgtagaaccgatggcgttgaggcaggttttagggttctcggatggcgagttgatgaggtcggattgcaaaccttgttccagattgatgagacagactgccggtattttcactgttggcggatcattgggattctggatcctttgccgattgcattacggtccgagaattacagttccgaggagtcttcggtgggcagcttgtggagcggtatctgtgagctcttccactgctttgctggttcggttgtttagtccagagtgcgagccccaaaacatagctacttatgacaagggaaagtagcactagattcatgaaggttgtatcgtcgttctaagtaagttatgtcggatttgttaatcgttacagaggagtgattccatgatggatatttcgattgatgtaagatatgccttgaaatggacgtaaacatttcgagtatcgaattaacaggactaagaatcctgcttttgttgcataaaagtttatcgtctttcttata

SEQ ID NO: 8216 - DNA, 418 bp, Arnica chamissonis
ggaagttggttacttattagtagaggatctaatttctatgtggaagacctttgattaaagcaagcataatggcgttgaggcgtttgtttggtttttctgatggtgagctaatgagatctgattcaaaaccttgttcgaggttgatgaggcatactgctggggtttttagtgttggtggtgccttaggattttggattctctgtcgtttgcattacggtcctagagtgaacgttccacgaagtctgaggtgggcaggtactggggccgttactgtaagtgcaaccacagctttgctggtccgcctttttagccccgaatgtgaacctcagaacattgaggcctatgacaagaaaaaataatcatatatgtccgaattgtatcgttcgtatcgagtatccgatgcacaattgcgatattg

SEQ ID NO: 8217 - DNA, 874 bp, Artemisia annua
tcagggatttgttagcagaagattttacttctggtgaatggaatcatctgttggctgctctcttgaatattcggatcgtctaaacctctttattctccgtccaatcattgccatcttctttgtactttcgttgcttgttttcggttggctgttggcgtggaaactactattggttcacgtccctttggtccaagagatatttggtcttaagaagaaacattttcttcctaaacctgtagaccgtcgtcgcttctcacgtttttacaatacccttagccttaatcataacaacgcctcttcttcttagtttctggttgatccaagtatcctgtacaagttcattattagtggtgtttaatcatcagtaaactatctggaaggcttttcttcagagaaatggcgttgagacgttttttaggcttttctgatggtgagctaatgagatctgattcaaaaccttgttcgagattgatgaggcatactgctggtgttttcagtgttggaggagccttagggttttggattctctgtcgtctgcactacggtccacgagtgaatgttcctcgaagtcttaggtgggcaggtgctggagccatcactgtaagcgcaagcacagctttactggttcgcctttttagtcctgaatgtgaacctcaaaacatagaggcctatgacaagaaaaaatgatcacatcttggacatttcaaatttaatttttgttaagattgtgcaaactagcgtctttcagattgatgactacaaggttctttaaccactctttgattcaattggaagatttgtacgatattaagtcttacgtttctgtatgtatctgtaccgtacctagactctggatgaattgttgcttaaatgc

SEQ ID NO: 8218 - DNA, 703 bp, Beta vulgaris
tcttgtgaagtattatagtaaagggctgagaagacgaaatttttaggagaaagaaacaagcaattggttgggtttcgaagaagcagtaaattaatggcgttgagacgtgctcttgggtggtctgatggtgagctcatgcgatcggatgcgaagccatgctcaagattaatgaggcaaacagctgggatttttacagttggtggagcaatgggtttttggatcttgtgtagactacactatggaccaagagttacaattcccagaagtcttagatgggcagcttgtggaggtgtatccgttagctcaaccacggctcttctggttcgccttttcagccccgaatgtgaacctcagaacatagctgcttatgacaataaaagatgaacccctagttcatattcccattctaagacctcctcccccaccccctcttctattttaagacgagcaatttaagatgtatggtattggtatccctttatacagagtcatgtaaaaatggtcatccttggatttgaatgaagtttgatggggattttctcaagctagtaatccctttatctagaatgagttgtcagattttcgcctttaaggctacttgagctctcatcaagatgaaataggcaaacaaaatgcagttttaatagtgagatttcgaataccgatcaaatttcggaattcttgatctactaatggtttcaca

SEQ ID NO: 8219 - DNA, 590 bp, Manihot esculenta
gaaatcacactggttttggttactcttggtagccataggaggcattgttgcaaaaccactacttgctcagttggaaaactcaaatctcttagcttcctcgctgaatcttgcatacccatttactcagttttctttgagattaacagatggctttgaggcgcttccttgggttctcagatggtgagctgatgaggtcagatgctaaaccttgttccagactaatgaggcagacagctggaatttttactgttggaggagcgttaggattctgggttctctgtaggttgcactatggtcctagaattacagttcctaggagccttcgctgggctacttgtggagctatttctgtgagttcaaccactgctctcctggtccgccttttcagtcctgaatgtgaaccccagaatatagctgcttatgacaaaataaattagtgatacattactattaatgttgaaactatcatgtattaaatgagcccatctatccttcttttgtggagacatagatcctattgcagttttcctttgttgaccaccaaaaacttgttgatgtggatatggtgcctttgtgtataacttgatgtg

SEQ ID NO: 8220 - DNA, 1078 bp, Ricinus communis
ccatttcgcccctgcatccccatgttaaagtgaacacggcaagaagttggaagcaaactcgaagagctttcactccgtttcttttcttgagattcaagtgtttaaaaggcattgaattggattactagagtcaatagatggcattgaggcgcttctttgggttttcggatggtgagctgatgaggtcagattgtaaaccctgctctagattaatgaggcaaacagcaggggttttttctgttggaggagcactgggtttctggattctttgtagattgcattatggtccaagaattacagttcctaggagccttcggtgggctacttgcggagctatttctacgagttcaacaactgctctcctggtccgcctcttcagtcctgaatgcgaacctcagaacatagctgcttttgacagagcaaaatagtataatacattgttcatcaagcttgagattatcatgctttaaacgagctcatatattagtcttttgccgggatctgaatcctaaatgaatttcctgttttgaccactacgaactcattttaattgcgcctcttgtgtataaaagaaattgatgcgtgtagagccatctcaagaagccttttgagaacagttggtctggtcttgtttgtttctccttttgtttttctttattttgtcttgttgattcttgagacgaaagttagtggattcttgcaactgtgttgtattgcagagccacaaaatgggctaaaagactaaagagtgcgattgaagctgaaggaaatgttctaaattctgtatattggacagcgatgcctattcagtgggagttaaagccatgaatctgatcctccattccttattgtcagcccatttctctacttgcccattactccttttttttccttttcaattttcttttctttgagaatattgaattgttgtgcttgattcagtgaaatgaaagaaaaactcattagaagttctgaatttattgaatttttattaatagctcttcaattaaagtgtacactatttttaataagcttttttatttttctattttcatgttcgacgttattagtaatttaa

SEQ ID NO: 8221 - DNA, 740 bp, Euonymus alatus
tcatccactgcaagccgaaggaaacgttgttctgccgctcttgttcgagaaaagatagaaagcagtgatttcgtgattcattcaagtgagaaaaagctcgaagctcttctccaaagcagatagagtttggcttcggcggagagagattaaaagaaagtggtgtcctcttctcctgtttcaggaagtgtgagacagtgagagtgacagaaaatggcattgagacgattctttgggttctctgatggcgagctaatgaggtcagatgcaaaaccttgctcgacattgatgaggcaaacagcagctattttcagcgtcggaggggcgttgggattttgggtcctctgtcgattgcactatggtcctagaattacaactcctaggagtttgcggtgggcaacttgtggcgcggtttccatgagcacaactactgctttactggttcgcctatttagtcctgaatgtgaaccccagaacatagcggcttatgacagagtgaagtagtcgtggattagacatttataaataatgggatcttctaatacatatagtcgatggactactaggaagaatctgcttgctgttagatttgtaaagaaattaatgtgatgaatttcagtttgagaagtgaggagggctgatggaaatgcttgatttcccaggaaaattgctgcatttgataaagtatggtcattggattttgctatctttgtttcttggtcttcataataaacggaaaacac

SEQ ID NO: 8222 - DNA, 862 bp, Euonymus alatus
tcatccactgcaagccgaaggaaacgttgttctgccgctcttgttcgagaaaagatagaaagcagtgattgcgtgattcattcaagtgagaaaaagctcgaagctcttctccaaagcagatagagtttggcttcggcggagagagattaaaagaaagtggagtcctcttctcctgtttcaggaattcgcagaagtgtgagacagtgagagtgacagaaaatggcattgagacgattctttgggttctctgatggcgagctaatgaggtcagatgcaaaaccttgctcgacattgatgaggcaaacagcagctattttcagcgttggaggggcgttgggattttgggtcctctgtcgattgcactatggtcctagaattacaactcctaggagtttgcggtgggcaacttgtggcgcggtttccatgagcacaactactgctttactggttcgcctttttagtcctgaatgtgaaccccagaacatagcggcttatgacagagtaaagtagtcgtggatgagacatttataaatgatgggatcttctaatacatatagtcgatggactactaggaagaatctgcttgctgttaggtttgtaaagaaattaaagtgagatgaatttcagtttgagaagtgagaagggctgatggaaatgcttgatttcccaggagaattgctgcatttgataaagtatggtcattggattttgctatctttgtttcttggtcttcataataaacggaaaacacattcaagccaattcatatcttggaacatttttgtgttacatttgggtgttcggatcagaattaaattcgtgccgtgccgtgctttgctcatggggtggctatcccgagttt

SEQ ID NO: 8223 - DNA, 766 bp, Vitis vinifera
gttttatcagactgggctcacaaatgggctggcttattgggacagaaccggtcgagctttaaagcaaaccgtcaaattcatagtgacagtcacagacaacaaacaggaaaaccctaagggacattgaagagtggaaacccatttgcccaaagacataccagggttttctacagaaagctttgaattatatcattgaggggttaaatggctttgaggcgtctctttgggttttctgatggggagcttatgaggtcagatgccaaaccttgttctagattaatgaaacagaccgctggactttttactgttggtgggggattcgcattctggattctttgtcggttgcattacggtcctagaattacagtgcccagaagtcttcggtgggcagcttgtggagcagtatctgtgagctcgagcagtgctttgctagtccgcctctttagtcctgcatgtgagccgcagaatatagcagcttatgacaacaaaaaataatgctagattactaagaggtattcaaactggaacgggaatgagtactcttctatttgtctcgtgtgggaaaatgattttattttgtatttcctccacagaataccagggctaatttcatgtaactactactggtgctcagtgtgtgggctagtatctgttaactgaaaataaatttcctgttagtttacattgtgattatgctaatggaaatgtagtgtttgagatgtttttgctcttttcttttaggggaatgaaggattcggcatttagg

SEQ ID NO: 8224 - DNA, 482 bp, Carpinus betulus
tcttcaactcggatagtctttgacccggccaacagctctatgccccattggcataccacatcttaccattcttgtactgagaactcaatctgtaacttggtataaagccatccacagaatcgatcaaagccctacaaggaaagtgctagatggcattgaggcggttctttgggttttcggatggggaactgatgcggtcagatgcaaaaccttgttccagattgatgagacagactgctgggatttttaccgttggaggaggattagcattttggattctttgtagattgcactatggtcccagaattacggttcctaggactcttaggtgggcaacttgtggagcagtatctgttagctcaacctctgctttacttgttcgcttatttagtcctgaatgtgaaccccagaacatagctgcttatgacaagggaaaatagtagctataggttgttacatagaaggttaaagacttgtcttaa

SEQ ID NO: 8225 - DNA, 778 bp, Nicotiana benthamiana
ctatgttgaattgacttctctcccctacttaacatttgataagtcttctatgaaagaacactgtagttctcgagacaacaagaagtttggaaggaataccatcttcgcccaacataagctgtgtacttgagaacgataattggttttttcagtagcattatagtctcctttagtagctgcaacagcgtctcacgcctatttcggattcaattgaggattggtgattttgaggttttcggataatggctttgaggcgtatgctggggtattcggatggagagttaatgagatcagatgcaaaaccctgctcaaggcttatgagacaaacggctggcattttttccgttggaggagcattaggattttgggttctttgccgattgcactatggtcctagaatcacagttcctagaagtcttagatgggcaacttgtggggctatttctatgagctcaagcacagctttgctagttcgtctatttagtcctgaatgtgaaccacaaaacatagctgcctacgacaagaagggatgatgttacttttcttccgaaatcagtctataaaactgaagaatgatgtcctatttgattcgtgtgtaactttttaagaattccccttccacaagcagcacaaatacggcagcccctgttagccaaggttgaaggaccagcatttaaattctaaattattttctcagtgaaggcctatcttgttcgttactaactgttatataaatttctcttttgtaaaaatgctacaaccactcatgaagtgatgc

SEQ ID NO: 8226 - DNA, 683 bp, Nicotiana benthamiana
ctgtgcaaaaaaaaaaaagaagatattcttccctctacgtaagcggtgtactcgagaacgataattgattttttcagtagcattatagtctctttcagtggctgcaacagcgtctcacgactgtttcggattcaattgaggattggtgattttgaggctctggataatggctttgaggcgtatgctcgggtattcggatggcgagttaatgagatccgatgcaaaaccctgctcaaggcttatgagacaaacggctggcattttttccgttggtggagcattaggattttgggttctttgccgattgcactatggtcctagaatcacagttcctagaagtcttagatgggcaacttgtggggctatttctatgagctcaagcacagctttgctagttcgtctatttagtcctgaatgtgaaccacaaaacatagctgcctacgacaagaagggatgatgttacttttcttccgaaatcagtctataagcctgaagaattatgtcctatttaattcgtgtgtaagtttttaaggattccccttcatttatgctaaaatattttctcactgagggcctatcttgttcgctactaactgttatatcaatttttgttgtgtaaaaatgctacaagcactcgtgaagtgatacttaatctatctaagttttctccttctaacagccaa

SEQ ID NO: 8227 - DNA, 939 bp, Quercus alba
cacacacagaaacgatccaaaactcgtactatcgaatctaatggctgcgttctgatctgcctcctcgtcagccagaggagtgttcgctctttcgccgtggctaagattcagttagagaggacacgtatttgtctcatgtatttgtgaaatttacccttattttattaatatctcatgtatttgtctctcttctcaacactctctcgcactctgactgtttgtagttgtactccacgtctctcctccctcctcaactctttgctgcctctccagtcttctccctaactctctgcttctctcgtatcccaaaccccgacactcacacacggtggcaaggtgatatcgtcagcagcaacatcggctcaacaatagagctagtcggctcgaagccatctataatctatagaatcaatcaaagctcaacaagggaagtgctagatggcgttgaggcggttccttgggttttctgatggtgagttgatgaggtcggattcaaaaccttgttccagactaatgagacagacggctggaatttttaccgttggaggaggattaggattttggattctttgtagattgcactatggtccaagaattacggtgcctaggagccttcggtgggcagcttgtggagcagcatctgttagctctacgactgctttactggttcgcttatttagtcctgaatgtgaaccacagaacatagctgcttatgacaagggaagttagttttaactactagagtttggtttggtttttgtttctctgtctgtaggtttgaagcttgtcttggatctattttctcatcaataatgcaagaccaatattattactcattcctaacatggactcccactgatataaacttagtggcatgctaactcactttctatttactaggatgaacaggaatactgaaatagttggttctcgcaagag

SEQ ID NO: 8228 - DNA, 1174 bp, Populus trichocarpa
gacatttaaaccctccaagcccaacaggcaaaatactcaaacgaatcagctagacccatttcataattctgctaacctctctatctcagactggcacggaagaagaaatcccaaacttgtaacatacaacttccccttgtcgtaattcaattcaatcaaactccctgctcagttcccagtatattgcaggttttgaagggagattggctgtttgttacagatggcattaaggcgcttatgtgggttctcagatggggagttgatgaggtcagattgtaagccttgctctagattgatgaggcaaacagctggaatttttagtgttggaggagcatttggtttctggattctctgtaggttgcattatggtccaagaattacaaatcctaggagtcttcggtgggctgcttgtggagctattgcttggagttcaacttctgctctgctggtccgcctttttagccctgaatgtgaaccccagaatatagctgcttatgacaaagtaaaatagcaataggttacccatgaaggttgaaattatgttgtggcaaattagctatccgctggtcttttatatagagaccataaattttctaggttgaccaccaggactggattcttgtattgccttattgtccagtagtgtgatttttatcaaatgactgatttgagttttgagtcagctccttctgagaggctggagtcggcagggactgtacttttagaatggattcgagacagagcagagccataactcttgtcaatgcacggaaaagtaagattgcagtgattatcctctattaagcgttgccatggatgtgtatctccagcccagttgctgtacttgtccccttagtgggagctatacttgtcttgctctggcaagacaagagtcccattgatcaaattccttctgattgtgaattacattcagggtttgtggcatgatttgaggataggggtgtttggtgcagcgaaggaagtttctgtacttgctggttaaatcaatcaataatgccggaggaaactccaaaaccatgcatggaacaactgttttgtcccttgcatactatttgggacctaaagccattgatgttgaactgtcttgttcactctatacttaattaagaatggagaagatccaactgttctttataatttatgttaaaagtat

SEQ ID NO: 8229 - DNA, 732 bp, Prunus mume
ccaagcacttctagctgagcccaatatccagcccagcccatgcagccttcttctttacttcttccttcgcctctcacgatcattaatcattatcagtctcacacccactccgaaagtcccacactttgtcgctctatcttcagacttgttttgcttccccaaaaggccaaaagtggaacatcctaggtgggaaagaagctttaaattgtagcacaaagatatacagatggcgttgaggcgctttttagggttttcggatggcgagctgatgaggtcggatgcaaaaccttgttctagattgatgagacagactgccggtattttcagtgttggcggagcattgggattctggatcctttgtggactgcattatggacccagaattacagttcctaggactcttcgttgggcagcatgtggtgcagtttctatgagctcaaccactgctttgctggttcgcttatttagtccagagtgtgagccccaaaacatagctacttatgacaaaggaaattagcactaagttcatgaaagttgtaatgctattctaagcgagttcggttgggtttgttaatcgtcatataggagtgattcaaatatagatatttggttttatgctacatgttttttccttgaaatgaatgcaccatttgattatgaaatgaacagattcacaagatctttgcaccttactagttcaacatgtttccaaactattgagaacatcaacaa

SEQ ID NO: 8230 - DNA, 858 bp, Nicotiana tabacum
gtggtctccatttttctgtgttgccttcattttccgatctactcgattttctcagttgcttctcttgtcagaaagaacactgcagtctttgcgacaagaaaaggtttggaaggaatacctgcttcccccgacgtaagtggtgtactcgagaacgataattgattctttcagtagcattatagtctccttcagtggctggaacagcgttcacgcctgtttcggattgaatttaggattggcgattttgaggcttctggataatggctttgaggcgtatgctcgggtattcagatggagagttaatgagatcagatgcaaaaccctgctcaaggcttatgagacaaacagctggcattttttccgttggaggagcattaggattttgggttctttgccgattgcactatggtcctagaatcacagttcctagaagtcttagatgggcaacttgtggagctatttctatgagctcaagcacagctttgctagttcgtctatttagtcctgaatgtgaaccacaaaacatagctgcctacgacaagaagggatgatgttacttttcttccgaaatcagtctgtaaaactgaagaatgatgtcctatttaattcgtgtgtaactttttaaggattccctttccacaagcatcacagatacggctgcccgtgttagccagggagaaaaaccagcatttaaatgctaaagtattttctcacagagggcctatcttgttcgctactaactgttatatcaatttttgttatgttaaaatgctacaagcactcgtgaagtgctgcctaatctgtgtaagttatctccttctgacagccaattctatgtcatattctacaaagcagaaa

SEQ ID NO: 8231 - DNA, 958 bp, Flaveria ramosissima
cttttcacgggacctctgtctgcttggctttgatgcttttgcttactttcacttttgatttatggcctagttgcacacttgcacgccccgaattgtgccaaattacgctcaactcgggttactttttcaggggtttgttagcagaaggtttacctctggtaaatggaatcatcaatcggctgctctcttgcgtattcagaccgcttgaatctctttgttgtccgtccattcattgccttgtcatttgtactttcgtttcttattcttggttggtgtttggcttggaagcttttactggttcacatccctttggtccaggagatatttgctcttaagaagaaacttcatcttcctaaacccttaactcgccatcgattctcacatttttacaacaaccttagtcataataataacattagttccaacgtccctgcaccttagtagctggttctggaagttcgtgattaacatcgtagaatcatttattagcagaccacctgattgttgtgtggaaggcctttgattaaagcaatggcgttgaggcgtatgcttggtttttctgatggtgagctaatgagatctgatgcaaaaccttgttcgaggttgatgaggcatactgctggtgttttcagtgttggtggagccttaggattttggattctctgtcgattgcactacggccctagagtgaatgttcctcgcagtctgaggtgggctggtaccggggctatcactgtaagtgcaagcacagctttactggtccgtcttttttagtccagaatgtgaaccccagaacatagaggcctatgacaagaaaaaagaatcatctacttgtcttttaattcttactttctttttctttaatttgggtaactcgtaccaacagtctctatttggattaaagactaaaaggttacattgttcgtcgttgttagtgttcgtactatagtttatgtac

SEQ ID NO: 8232 - DNA, 626 bp, Fraxinus spp
cggccgggggaaggagaggcaaaaaaggaagatatattcatcacccttggcactcatttatcccgcgttgcagcgatttctactgaacttcttcgtcaccgaacttggaagtttttgtagtgctttggtggggaaaattgaatatttagaagagcacagcaaaaatggcattaaggcgcatgcttggattttcagatggggaacttatgaggtcagatgcaaaatgttgctccaggttgacacggcaaactgctggcattttcagtgttaggaggtgcattgggattttggatcctttgtcgcttgcattatggtcctagaatcacagttcctcgaagtctaaggtgggctgcttgtggtgctgcctcgatgagcgctaaccacagctttgctggttcgcttgtttagtcctgaatgtgaaccgcaaaatatagctgcatatgacaagaaaaagcagtaaaggttatacctacaactttgtcgtgtactccatatccttggggcagcgaaggaacacatcttattcttttctttgcttttccttcaattgattcctacacaggctgtgtagaaacgaaaagattccatgtaatgtaagactggctacccaacgtctgtgtatttag

SEQ ID NO: 8233 - DNA, 477 bp, Vinca minor
gcattgaggcggcttcttgggttttctgatggagagttaatgagatcagatgcaaagccctgtccaggttgacgagacaaactgctggaatttttacagtaggtggagcattagggttttgggttctctgtcgcttgcactatggtcctagaatcacagttcctcggagtctaaggtgggcagcttgtggagcaattactacatcctcatcgacggctctgcttgttcgcctattcagtccagaatgtgaaccacaaaatatagctgcttatgacacaaaaaagtaacaataatttcttcatcttccaatttctcatctgtattaggaatctgggtggaaatgacaggatctatctctagttgtatactatgctagatggaaaaattcgctatgggacggtccttgtgcccacctgtgagacatgaaggcctgcgggacttagcctgtaggtgggtcctgtctaaaattaaattatg

SEQ ID NO: 8234 - DNA, 514 bp, Tabernaemontana elegans
caaattttgcataccatccagctaaaaatttcgatatagggagaactagtctcctcattattgcattgacttttcaaggctctcaaatttagtggtggaagctgagttttagggccaatagctacttaaaacttgtttacagctatggctttgaggaggcttcttgggttctctgatggggagttaatgaggtcagatgcaaaaaccttgttccagattgatgaaacaaactgctgaaatttttacagtaggtggagcattaggattctgggttctctgtcggttgcactatggccctagaatcacagttcctcgaagtctaaggtgggcagcttgtggagcagtcactacaagcacaacaacagctctgcttgtacgcctatttagtccagaatgtgaaccacaaaatatagctgcttttgacacgaaaaagtaataggtactctgggttccaacttttcatctgtaaaaggaatcctggtggacaggacaggatcaattttcaattgtataa

SEQ ID NO: 8235 - DNA, 762 bp, Vitis vinifera
cgccgggttttatcagactgggctcacaaatgggctggcttattggggcagaaccggtcgagctttaaagcaaaccgtcaaattcatagtgacagtcacagacaacaaacaggaaaaccctaagggacattgaagagtggaaacccatttgcccaaagacctaccagggttttctacagaaagctttgaattatatcattgaggggttaaatggctttgaggcatctctttgggttttctgatggggagcttatgaggtcagatgccaaaccttgttctagattaatgaaacagaccgctggactttttactgttggtgggggattcgcattctggattctttgtcggttgcattacggtcctagaattacagtgcccagaagtcttcggtgggcagcttgtggagcagtatctgtgagctcgagcagtgctttgctagtccgcctctttagtcctgcatgtgagccgcagaatatagcagcttatgacaacaaaaaataatgctagattactaagagatattcaaactgaaacgtgaatgactactcttctatttgcctcgtatgggaaaatgattttattttgtatttcctccacggaatatcaggactaatttcatgtaactactactggtgctcagtgtgcgggctagtatctgttaactgaataaatttcctgttagtttacgttgtgattatgctgatggaaatgtaatgtttgagatgtttttgctcttttcttttaggggaatgaaggattcgg

SEQ ID NO: 8236 - DNA, 733 bp, Amborella trichopoda
gcaaggacctctctcagtagtattcagtgctcaaggacccccatccctctataaagaagctgttttcttattacggcaatcaaagaaggccagttaatctgccatttccacaaaaccagaagaaaccctaaatactttgaactgctgaagttctttagaggtttacagtgatggctctgaggcgtttatttggattttctgatggtgagctgtcgagatctgatgcaaaaccgtgttctcgactaatgaggcacacagctgctatttttagtgttggtggcgctttagggttctggaccctttgtagactacattatggtcccagaataacagttccaaggtctctaaggtgggcaggttctggagcaatcggcgtaagctcaaccactgcacttctggtccgcctttttagtcctgagtgtgaacctcaaaacattgctgcctatgaaaagaaataatgagacgacgtatgtttttatgttctgttaactagtctttgtaaggatttcaagtttatatgtagtttttatgatctctattaaattacaatattaccatagaagagggttggatgggtatggtgccatggagtctctaaattaatctattggaaaagtttctgatactaatttttctttctctctttctttctttctttaatcttgtttccaatgtgttgttttgtatataccagttgctcatctgtaatgtgcgatcgggactgatcaaatgc

SEQ ID NO: 8237 - DNA, 732 bp, Taraxacum officinale
gcttcttagcaaattttttgctccggtaaatggaatcatctgtcgactgctctctttcatatatagatcgctttaacctccttattctccgaccaatcctcgccgtctcttttgtacttaccttgcttgttttcggttggtttttggcgtggaaactgctacttgttcacgtccctttggtccaggagatatttggacttaagaagaaaccttgtgttcccaaacccttaacccgccaccgattctcacgtttctacaataccctcacacttaatcacaacgataattccaacatctcaggttgattcgattaaattagtgttttaaagtaagaaaagaatggcattaaggaggtttttggggttttctgatggtgaattaatgagatctgactcaaaaccttgttcaagattgatgaggcatacagctggcgtttttactgttggaggagccttaggcttttggatcctttgtcgtcttcattacggtccaagagtgaatgttccccggagtcttcggtgggcaagtacgggagcagttacagtaagtgcggggacggctttattggtccgcctttttagtcccgaatgtgaaccacagaacatagaggcatatgacaagaaaaaataaccattaagtgtgtctgtttctattaagatatttactattaagtcgataattcgtaagaaacgttgatgggattgaatttgtatgaaatttcaatttgggttt

SEQ ID NO: 8238 - DNA, 737 bp, Mimulus guttatus
atcggaaatttgtcaaattttcagaaaatccgttcttcttcaacaaaaacccccaccgcaaaacccatttccccggccatctgaactgcaactccggtgacattcgcttcgccggaatcgattaagaatcgacatttttccacgacaaaaaaaggttttgataagaaggcaaagtatttgaaggagaaaaaaagaccatgtctttgaggcaaatgcttggattctccgatggagagttgatgcggtcagatgcaaaaccgtgtacgagattgatgaggcaaactgctggcattttttcagtgggaggtggattagggttttgggttctctgccgcttgcattatggtactagaatcacagttcctcgaagtctaaggtgggctgcttgtggggccgtctctacgagcgcaaccacagcgttgttggttcgtttattcagtcccgaatgtgaaccccaaaacatagctgcgtatgatcacaagaagtaattaattcttggttagcatccacatcttttggcatgccctatgaaaactcgagcttttgtttttgattgattttcgaaactatggaattagagaattcatgaaatcaaatgtaatttgttaatctgggtttataaacacaataatgtcatgtatgggattaccagttaataatcaccgggtgttgcatcacacaaacctaattttaggctatgtttcatagggtctatgagatgctacaccgcgttaaat

SEQ ID NO: 8239 - DNA, 869 bp, Carica papaya
aacagagagttcggattccagaaacattaggtaatccaggagatttttttgggttcgtgaaggaggagcttcaaagtctgctcacccttcggtttgctgtgcttttctccttaggtataacttgaacttggaatagacatgcttgttgattaatcatgtggtgaggattcggtattgagctatctgtttgggatacttttgatcaagtcaggaggactggaatttgtgagtaatgtgtttgggtccttttattccagtatcatccgatcttctttggtcattttaaccaaaagcaggttctctctgtctcgaaagcctgtaagtggattagaaactgagctgcatagctaagcactgcattgggagattaggaaaaaaaaaatggcattgaggcgacttttggggttttctgatggtgaactgatgaggtcggatgcaaaaccttgctccagattgatgaggcagacagctgcaatattcaccgtaggtggagcattaggattttgggtgctctgtagactacactatggtcctagaattacagttcccagaagtcttaggtgggcaggttgtggagccatttctgtaagctcaacaactgctttgctggttcgcctgttcagccctgaatgtgagccccagaacatagctgcttatgacaaaggaaaataactcttactctccgattcataagaatgtggattgccgataagtatgcgatactactttgtttagcagttttcggaaaagaaagagacaattttgatttcaagtcatttatgccatgacagacttgttgcagattgtgattgtggatgatgggttctatgccatgggatctctaggcttattatattagccacagcttt

SEQ ID NO: 8240 - DNA, 790 bp, Sesamum indicum
atttggaactccttttgggctgagacgaaacttctgcttcaaggcccgggaactccaatcacatagcccaggccatcattgtatatcaactggcgcaatcgattcctgaaagtagaatagctgagctaccatcaaagtttcaacttccagtttttcgcagttacaaatcacgagagccttgagattgatcaatcaccatatagctcaacacacaggtcagaggttgtcagccattctctaaatgaagacagacattgcctgccaaccaaaagtattcataacgaaggcaaagtagttgaaggatactagacgatggcgctaaggcgtatgcttggattctctgatggagaattgatgaggtcagatgcaaaaccctgttcccgactgatgaggcaaactgctggcatttttacagtgggaggaggactgggcttttgggtcctctgccgcttgcactatggtcctagaatcacagttcctagaagtcttaggtgggctgcttgtggcgccatctctacaagtacaaccacagctctgctagttcgtctattcagtcctgaatgtgaaccccaaaacatagctgcttatgaccggaaaaagtaatgttggttcttgcaaattctatttgtgtgctacagaaactggagaatcaatttcaaaacaatcagactagagaatgcatgagctacattgtattgctctgggtttaaaaagacgatgttgtcatctataagattaatcgacttacattaactctatgctcattattgctgagtcctttgcccgcaca

SEQ ID NO: 8241 - DNA, 717 bp, Helianthus annuus
gttaggtttatggaaggctgctcacttgctgcctatttgaacctgtttgttgttcgtccggtcctcgctttctcatttgtagtttccttgcttgttcttggttggtttttggcttggaagcttctgttggttcacgtccccttggtccaggagatatttggtcttaaaaagaagcatcatcttcccaaacccttaactcgcggccgcttttcacgtttttacaatacccttcttaattccaacgtctctgcttcttcttagtgcctgcctgataggataatggcgttgaggcgtatgcttgggttctctgatggtgagctaatgagatctgatgcaaaaccttgctcgaggttgatgaggcatactgctggggtttttagtgttggtggagccttaggattttggattctctgtcgtttgcattacggtcctagagtgaatgttcctcgaagtctgaggtgggcagggaccggggcaatcactgtaagcgctggcacagctttactggttcgcctttttagccctgagtgtgaaccccagaacattgaggcttatgacaagaaaaaataaaatttacatctctctcagataatggctaaacggtaccagtttatggattatgtcaatgtggtttgattttgtaaaatactaagcatggattcctgtgtaattgtgctttgttttttgctttggaatatggccatgaacttgtatgat

SEQ ID NO: 8242 - DNA, 779 bp, Helianthus annuus
gttaggtttatggaaggctgctcacttgctacatatttgaacctgtttgttgttcgtccggtcctcgctttctcatttgtggtttccttgcttgttcttggttggtttttggcttggaagcttctgctggttcacgtccccttggtccaggagatatttggtcttaaaaagaaacatcatcttcccaaacccttaactcgcggccgcttttcacgtttttacaatacccttcttaattccaacgtctccgcttcttcttagtgcctgcctgcctgcctgatagcataatggcgttgaggcgtatgcttgggttctctgatggtgagctaatgagatctgatgcaaaaccttgctcgaggttgatgaggcatactgctggggtttttagtgttggtggagccttaggattttggattctctgtcgtttgcattacggtcctagagtgaatgttcctcgaagtctgaggtgggcagggaccggggccatcactgtaagcgctggcacagctttactggttcgcctttttagccctgagtgtgaaccccagaacattgaggcttatgacaagaaaaaataaaatttacatctctctcagatcatgactaaacggtaccagtttatggattatgtcaatgtggtttgattttgtaaaatactaagcatggatttctgtgtacgtgtgctttgttttttgctttggaatatggccatgaacttgtatgatacacacttcggttgtgtatgtgtcaattgcgtacgtgaaaaccaaatttaggat

SEQ ID NO: 8243 - DNA, 738 bp, Helianthus annuus
gcgtgcttgtgattgtcggccactgaattgaatcggttaggtttatggaagtctgctcacttgctgcatatttgaacctgtttgttgttcgtccggtcctcgctttctcattcgtactttccttgcttgttcttggttggtttttggcttggaagcttctgctggttcacgtccccttggtccaggagatatttggtcttaaaaagaaacatcatcttcccaaacccttaactcgcggccgcttttcacgtttttacaatacccttcttaattccaacgtctctgctccctgatagcataatggcgttgaggcgtatgcttgggttctctgatggtgagctaatgagatctgatgcaaaaccttgctcgaggttgatgaggcatactgctggggtttttagtgttggtggagccttaggattttggattctctgtcgtttgcattacggtcctagagtgaatgttcctcgaagtctgaggtgggcagggaccggggccatcactgtaagcgcgggcacagctttactggttcgcctttttagccccgagtgtgaaccccagaacattgaggcttatgacaagaaaaaataaaatatacatctctctcagatcatgactaaacggtaccagtttatggattatgtcaatgtggtttgattttgtaaaatactaagcatggatttctgtctacttgtgctttgttttttgctttggaatggccatgaacttgtatgatac

SEQ ID NO: 8244 - DNA, 999 bp, Tripterygium wilfordii
cacgccccttacgcaagtcgcgaccaccgagcaccaagggaccaactgctccttctccttctccttctccttctccagttatactttgttcgccagtgggttgatgctaaacttcgaaagcatcattagagcttttaacggatcacgcctgaaactattggtataaattagaagactgaaagtgaagataaaaaatggcattgagacggttctttgggttctcggatggcgagctaatgaggtcggatgcaaaaccttgctccacattaacgaggcaaacagcagcgattttcagcgtcggaggggcgttgggattctgggtcctctgcagattgcactatggtcctagaattacaactcctaggagtctgcggtgggctgcttgtggagctgtttctgtgagcacaactactgcttcactggttcgcctatttagtcctgagtgcgaaccccagaacatcgatgcttacgacagagaaaagtagtcaatagttcatcaattcaattatatgaactatcagttcgacaaggaccggcggaactgtttgtctcgcaagaatacttggtgcatttagttatttaatatggtcattggattttggcattctttctccggcaggtttccatgataaaccgctgcagaatcaagaatctctacatgggctagttttcagctaagcccatgtgatattgggctttctttaaaacaaaaggtaagacttttctggccctgtttaacaggccttcttcccatccaatagtggatttgattgggcccaccacctttgattgatgcggatgcattgtctgacttcagtattagacacggccgaagacattatgtcgcctaaaatgtatgattatgtcaactgatattggtgtgaagtcgaaagatttgacaagtcattttctattatttggcatttatgcagagcatcagcatgcggatccaaatgcatgcacttgatagatgcgccctagaagctttttcacgttttc

SEQ ID NO: 8245 - DNA, 846 bp, Centaurea maculosa
agagctcagggttcaagcaatcgtcaatcatcaatactcagggatttattattagaagaaagcagccttgaatgtggtaaatggaatcatctcttgactgctctcttgcatattccgatcgattcaaccttcttgttcttcgtccaatccttgccgtctcctttgtgctttccttgcttcttttgggttggttcttggcttggaagctgctattggttcacgtccctttggtccaggagatatttggtcttaagaagaaaccttctcttcccaagccctcaactcgccaccgcttctcgcgtttttacaacactcttcgaccttagtttttacgataagtttcgcttttctgctcctcgtggctggtttttctgagtttacttcctcgaaattagcattgttgaatcattagtagaccgacctaactattctctggaaggttaagtttttcattaaagtaatggcgctgaggcgtttctttggtttttctgatggtgagttgatgagatctgatgcaaaaccttgttcgagattgatgaggcatactgctggggttttcagcgttggaggggccttaggattttggattctctgtcgtttgcattacggtcctagagtgaatattccccgaagtctgaggtgggcaggtaccggagctgtgaccgtaagtgcaagcacagctttactggttcgccttttcagtgccgagtgtgaaccccaaaacatagaagcctttgacaagaagaggaagaaatgacaccccatcaatgactaaaaaccataacgattataaggtcaacagttgttacaaaatattggttgtaagatatcattcgtgtttgcttt

SEQ ID NO: 8246 - DNA, 885 bp, Centaurea maculosa
ctcaaattacttatattttcagggaatttgttattagcagaaagcagttttgaatgttgttgtaaatggaatcatctcttgactgctctcttgcgtattccgatcgcttcaacctccttgttcttcgtccgatccttgccgtctcctttgtgctttccttgcttcttctgggttggttcttggcctggaagctactgttggttcacgtccctttggtccaggagatatttggtcttaagaagaaaccttctcttcccaagccctcaactcgtcaccggttctcgcgtttttacaacactcttcgaccttagttttacgttttttgcttctagtggctggttgttttgagtttactttctcgaaattagcattgttgaatcattagtcgaccgacctaactattctctggaaggtttttcattaaagcaatggcactgaggcgtttctttggtttttctgatggtgagctgatgagatctgatgcaaaaccttgttcgagattgatgaggcatactgctggcgttttcagcgttggaggggccttgggattttggattctttgtcgtttgcattacggtcctagagtgaatattccccgaagtctgaggtgggcaagtaccggagctgttactgtaagtgcaagtacagctttactggttcgacttttcagtgctgagtgtgaaccccaaaacatagaagcttttgacaagaagaggaagaaataacatgcgattgatgactaaaaccataacaactataaagtcgatagttgagacaaaatattgattgtaagatatcattcgtgtttgctttgtacgattgaagtttattacaggcttaccgccctcttagatgatgctaaaaaagaaaaaaataccgactgcg

SEQ ID NO: 8247 - DNA, 748 bp, Centaurea maculosa
ttcagcaatcgtcaatcatcaataatcagggattttgttattagcagaaagcagttttgaatgttgttgtaaatggaatcatctcttgactgctctcttgcgtattccgatcgattcaacctccttgttcttcgtccgatccttgccgtctcctttgtgctttccttgcttcttttgggttggttcttggcctggaagctactgttggttcacgttcctttggttcaggagatatttggtcttaagaagaaaccttctcttcccaagccctcaactcggcaccggttctcgcgtttttacaacactcttagaccttagttttacgataaatttcgcgtttctgctccgagtggctgcaatggcgctgaggcgtttctttggtttttctgatggtgagctgatgagatctgatgcaaaaccttgttcgagattgatgaggcatactgctggcgttttcagcgttggaggggccttgggattttggattctttgtcgtttgcattacggtcctagagtgaatattccccgaagtctgaggtgggcaagtaccggagctgttactgtaagtgcaagtacggctttactggttcgacttttcagtgctgagtgtgaaccccaaaacatagaagcctttgacaagaagaggaagaaataacatccgattgatgactaaaaccataacgactattaagtcggtagttgtgacaaaatattgattgtaagatatcattcgtgtttgctttgtacg

SEQ ID NO: 8248 - DNA, 846 bp, Centaurea maculosa
  misc_feature (10)..(10): n is a, c, g, or t
  misc_feature (373)..(373): n is a, c, g, or t
  misc_feature (389)..(389): n is a, c, g, or t
  misc_feature (415)..(415): n is a, c, g, or t
  misc_feature (434)..(434): n is a, c, g, or t
  misc_feature (440)..(440): n is a, c, g, or t
  misc_feature (451)..(451): n is a, c, g, or t
gagctcgggnttcagcaatcgtcaatcatcaataatcagggattttgttattagcagaaagcagttttgaatgttgttgtaaatggaatcatctcttgactgctctcttgcgtattccgatcgattcaacctccttgttcttcgtccgatccttgccgtctcctttgtgctttccttgcttcttttgggttggttcttggcctggaagctactgttggttcacgttcctttggttcaggagatatttggtcttaagaagaaaccttctcttcccaagccctcaactcggcaccggttctcgcgtttttacaacactcttagaccttagttttacgataaatttcgcgtttctgctccgagtggctggttgttntgagtttacttcctcnaaattagcattgttgaatcattagtngaccgacctaactattctntggaangtttttcattnaagcaatggcgctgaggcgtttctttggtttttctgatggtgagctgatgagatctgatgcaaaaccttgttcgagattgatgaggcatactgctggcgttttcagcgttggaggggccttgggattttggattctttgtcgtttgcattacggtcctagagtgaatattccccgaagtctgaggtgggcaagtaccggagctgttactgtaagtgcaagtacggctttactggttcgacttttcagtgctgagtgtgaaccccaaaacatagaagcctttgacaagaagaggaagaaataacatccgattgatgactaaaaccataacgactattaagtcggtagttgtgacaaaatattgattgtaagatatcattcgtgtttgctttgtacg

SEQ ID NO: 8249 - DNA, 919 bp, Centaurea maculosa
atcagagcaagtagtaattgtgaatcatcaatactcagggattttgttattagcagaaagcagcattgaatgttgttgtaaatggaatcatcatctcttgactgctctcttgcgtattccgatcgattcaacctccttgttctccgtccgatccttgccgtctcctttgtgctttccttgcttcttctgggttggttcttggcctggaagctactgttggttcacgttcctttggttcaggagatatttggtcttaagaagaaaccttctcttcccaagccctcaactcgccaccggttctcgcgtttttacaacactcttcgaccttagttttacgataagtttcgcgtttgtgcttctcgtggctggttgttttgagtttacttcctcgaaattatcattgttgaatcattagtcgaccgacctaactattctctggaaggtttttcattaaagcaatggcgctgaggcgtttctttggtttttctgatggtgagctgatgagatctgatgcaaaaccttgttcgagattgatgaggcatactgctggcgttttcagcgttggaggggctttgggattttggattctttgtcgtttgcattacggtcctagagtgaatattccccgaagtcttaggtgggcaagtaccggagctgttactgtaagtgcaagtacggctttactggttcgacttttcagtgccgagtgtgaaccccaaaacatagaagcctttgacaagaagaggaagaaataacatccgattgatgactaaaaccataacgactataaagtcgatagttgtgacaaaatattgattgtaagatatcattcgtgtttgctttgtacgattgaagtttattacaagcttaccgtcctcttagatgatgctaatctgggaagctaagggagggttactac

SEQ ID NO: 8250 - DNA, 778 bp, Centaurea maculosa
  misc_feature (757)..(757): n is a, c, g, or t
gtaattgtgaatcatcatactcagggattttgttattagcagaaagcagcattgaatgttgttgtaaatggaatcatctcttgactgctctcttgcgtattccgatcgattcaacctccttgttctccgtccgatccttgccgtctcctttgtgctttctttgcttcttctgggttggttcttggcctggaagctactgttggttcacgttcctttggttcaggagatacttggtcttaagaagaaaccttctcttcccaagccctcaactcgtcaccggttctcgcgtttttacaacactcttcaaccttagttttacgataaatttcacgtttctgctccgggtggctggttgttttgagtttacttcctcgaaattagcattgttgaatcattagtcgaccgacctaactattttctggaaggtttttcattaaagcaatggcgctgaggcgtttctttggtttttctgatggtgagctgatgagatctgatgcaaaaccttgttcgagattgatgaggcatactgctggcgttttcagcgttggaggggccttgggattttggattctttgtcgtttgcattacggtcctagagtgaatattccccgaagtctgaggtgggcaagtaccggagctgttactgtaagtgcaagtacagctttactggttcgacttttcagtgctgagtgtgaaccccaaaacatagaagcctttgacaagaagaggaagaaataacatccgattgatgactaanaccataacgactataaagtcg

SEQ ID NO: 8251 - DNA, 743 bp, Cirsium arvense
tcagggattttgttattagcagaaagcagcattgaatgttgttgtaaatggaatcatctcttgactgctctcttgcgtattccgatcgattcaacctccttgttctccgtccgatccttgccgtctcctttgtgctttccttgcttcttctgggttggttcttggcctggaagctactgttggttcacgtccctttggttcaggagatatttggtcttaagaagaaaccttctcttcccaagccctcaactcgtcaccggttctcgcgtttttacaacactcttcgaccttagttttacgataaatttcacgtttttgcttctagtggctggtttttcattaaagcaatggcgctgaggcgtttctttggtttttctgatggtgagctgatgagatctgatgcaaaaccttgttcgagattgatgaggcatactgctggcgttttcagcgttggaggggccttgggattttggattctttgtcgtttgcattacggtcctagagtgaatattccccgaagtctgaggtgggcaagtaccggagctgttactgtaagtgcaagtacggctttactggttcgacttttcagtgctgagtgtgaaccccaaaacatagaagcctttgacaagaagaggaagaaataacatccgattgatgactaaaaccataacgactataaagtcgatagttgtgacaaaatattgattgtaagatatcattcgtgtttgctttgtacgattgaa

SEQ ID NO: 8252 - DNA, 940 bp, Carthamus tinctorius
  misc_feature (829)..(829): n is a, c, g, or t
  misc_feature (835)..(835): n is a, c, g, or t
ggcgggggaccgacggaaatcacatcgttatttcttcttctccccttctgattaaccctaatcgccaatcatcagagctcagagttcaagcaatcgtcgtcattgtcaatcatcaatactcagggatttattagcagaagtagccttgaatgtaaatggaatcatctcttgactgctctcttgcatattcagatcgcttcaacctccttgttcttcgtccaatccttgctatctcgtttgtgctttccttgcttcttctgggttggttcttggcctggaagctactattggttcacgtccctttggtccaggagatatttggtcttaagaagaaaccttctcttcccaagccctcaactcgccaccggttctcacgtttttacaacactcttcgaccttagttttacgataaatttcacatttctgctccaagtggctggttgttctgagtttacttcctcgaaattagcattgctgaatcattagtaaaccgacttaactattctttggaaggtttttcattaaagcaaatggcgctgaggcgtttctttggtttttctgatggtgagctgatgagatctgatgcaaaaccttgttcaagattgatgaggcatactgctggggttttcagcgttggaggggccttaggattttggattctctgtcgtttgcattacggtcctagagtgaatattccccgaagtctgaggtgggcaagtaccggagctgtgactgtaagtgcaagcacagctttactggttcgccttttcagtgccgagtgtgaaccccaaaacatagaagcctttgacaagaagaggaagaaataacncctcgncaatgactaaaaccataacgattttaaggtcaacagtggtgacaaaatattgattgtaagatatcattcgtgtttgctttgtacgattgaagtttattacatgcg

SEQ ID NO: 8253 - DNA, 833 bp, Gossypium raimondii
tttgggatatttaaacataataatacagatactgcatttattacaccctaatatataccatcatcttcctcctaccatcgtgcatctctactctctctcgtctctgcaaatcagtttatttttctttttattctcttctcatctcagttctcacccaccgccgtgtctgctggttttttccggatctgacgcgtgtaccgtgttggatcgcgtcgacacgggtacggcaccccaaattgccgagtccgggtaacgaaggcgaagacagagtaagcagagaagacgattttgtgtgggttcgatagcattaggtaacatcgaacaagcgttgagagatggcgttgaggcgtgcgcttggctggtcggatggtgaattgatgagatcagatgcaaagccttgttccaggttaatgagacaaacggctgggatttttacggtcggaggagctctagggttttgggttctctgtagattgcattacggccctagaattactgttccaagaagtcttcggtgggctgcctgtggagctgtgtctgtcagctcggcatctgctttgttggttcgcctattcagccctgaatgtgaatcccaaaatatagctgcttatgacaaaaggaaagagtagcaataagggtgtctaaattcattgaatgaccagtgtgtaacagtatctttcgttttgttgtattgttctgggatctttgccacccctatgtttatcaattttctagtacatgaatcataagcattgtaagggttgctgtttatacgcttttgtgccatttgctgtaagaatagctcaatagtagcaaacatagaccatacacaa

SEQ ID NO: 8254 - DNA, 744 bp, Gossypium hirsutum
ctctctcgtctctgcaaatcagtttatttttctttttattctcttctcatctcagttctcacccaccgccgtgtccgctggttttttccggatctgacgcgtgtccggtggttggatcgcgtcgacacgggtacggcacccctaattgccgagtccgggtaacgaaggcgaagacagagtaagcaaagaagacgattttgtgtgagttcgataacataacatcgaacaagcgttgagagatggcgttgaggcgtgcgcttggctggtcggatggtgaattgatgagatcagatgcaaagccttgttccaggttaatgagacagacggctgggatttttactgtcggaggagctctaggattttgggttctctgtagattgcattacggccctagaattactgttccaagaagtcttcggtgggctgcctgtggagctgtgtctgtcagctcagcatctgctttgttggttcgcctattcagccctgaatgtgaatcccaaaatatagctgcttatgacaaaaggaaagagtagcaataagggtgtctaaattcattgaatgaccagtctgtgacagtatcttttgttttgttgtattgttctcagatctttgccacccatatttttatcaattttctggtacatgaatcataagcattgtaagggttgctgtttatacgcttttgtgccatttgctgtaagaatagctcaatagtagcaaacatggaccatacacaaaaaagaa

SEQ ID NO: 8255 - DNA, 596 bp, Gossypium hirsutum
ctctctcgtctctgcaaatcagtttatttttctttttattctcttctcatctctgttctcacccaccgccgtgtctgctggttttttccggatctgacgcgtgtaccgtgttggatcgcgtcgacacgggtacggcaccccaaattgccgagtccgggtaacgaaggcgaagacagagtaagcaaagaagacgattttgtgtgggttcgatagcattaggtaacatcgaacaagcgttgacagatggcgttgaggcgtgcgcttggctggtcggatggtgaattgatgagatcagatgcaaagccttgttccaggttaatgagacaaacggctgggatttttacggtcggaggagctctagggttttgggttctctgtagattgcattacggccctagaattactgttccaagaagtcttcggtgggctgcctgtggagctgtgtctgtcagctcggcatctgctttgttggttcgcctattcagccctgaatgtgaatcccaaaatatagctgcttatgacaaaaggaaagagtagcaataagggtgtctaaattcattgaatgaccagtgtgtaacagtatctttcgttttgtt

SEQ ID NO: 8256 - DNA, 1293 bp, Gossypium raimondii
acataataatacagatactgcatttattacaccctaatatataccatcatcttcctcctaccatcgtgcatctctactctctctcgtctctgcaaatcagtttatttttctttttattctcttctcatctcagttctcacccaccgccgtgtctgctggttttttccggatctgacgcgtgtaccgtgttggatcgcgtcgacacgggtacggcaccccaaattgccgagtccgggtaacgaaggcgaagacagagtaagcaaagaagacgattttgtgtgggttcgatagcattaggtaacatcgaacaagcgttgagagatggcgttgaggcgtgcgcttggctggtcggatggtgaattgatgagatcagatgcaaagccttgttccaggttaatgagacaaacggctgggatttttacggtcggaggagctctagggttttgggttctctgtagattgcattacggccctagaattactgttccaagaagtcttcggtgggctgcctgtggagctgtgtctgtcagctcggcatctgctttgttggttcgcctattcagccctgaatgtgaatcccaaaatatagctgcttatgacaaaaggaaagagtagcaataagggtgtctaaattcattgaatgaccagtgtgtaacagtatcttttgttttgttgtattgttctgggatctttgccacccctatgtttatcaattttctagtacatgaatcataagcattgtaagggttgctgtttatacgcttttgtgccatttgctgtaagaatagctcaatagtagcaaacatagaccatacacaacaaattcatgacaattgaaagagaataacaaatgaattggcagcaccaaagtattaatgaatcagagttcattacttcccacagttaaaacattcatcaatcatattttaacataaaacaagcctgaaaagttaaactgtacccttctttcaatagggaaaggtatgacaggatattgaccctacataacatcctaagactttcattgtaaaggcaagccaaatcactggtgatggattataagaggataaaggggcctaaaaactatcaaggtcagctttgataaaatttaaacatgctatgcaaaataaaaaccttctgtagctaatttggttaggttgtgctcctggatgaggcatgaaacagggtatatgaaacctagtgactaccctgcacaatctctgtttgttcatcttcatttctatgttggtcattcctaccagacttcagatcctcgtgcccagggatttcccc

SEQ ID NO: 8257 - DNA, 557 bp, Euonymus alatus
gggccggtccggcgagatcgccagtcttccacagtttcacttgttcatcgttctctccgctgtcgcagtgggttgaggcttaacttcgaaagctgatatcattagagcttttattggatcaaacttgaaactattggaataaattggaagattgaaagtgaccggaaaaaatggcattgagacggttcttagggttctcggatggtgagttaatgaggtcagattcaaaaccttgctctatattgacgaggcaaacagcggggattttcagcgttggaggggcattgggattttgggtcctctgcagattgcactatggtccaagaattacaactcctaggagtctgcggtgggctgcttgtggagctgtttctgtgagcacaactactgctttactggtccgcctattgagtcctgagtgtgagccccagaacattgctgcttttgatggagaaaagtagttaatggttcatcaattatattatccatatgcttgatgaactatcagttcgacaaaactagctgcatttgattattttatatggtcattggatttt

SEQ ID NO: 8258 - DNA, 435 bp, Orobanche aegyptiaca
ctcttcttcgcgacccgaccatcatcaacaaaatttttttcggcggccagcactgcaccaccagaaaggcaaggtaatcgaaggagactactacgtcatggcactcaggcgtatgcttggattctccgatggagaattgatgaggtcggatgcaaaaccctgttcgcggttgatgagtcaaactgctaccattttttcattcggaggggcactgggcttttgggtcctctgccgcttgcattacggtcccagaatcacgactcctcgaagtctgaggtgggctgcttgtggagctgtatctatgagcgcaaccacagctctgctagttcgtttatttagtcctgaatgtgagccccaaaatgtcgctgcttatgaccagaaaaagtgatgctgctttggtcttgatgtgggccgtggatactttttttgagaatc

SEQ ID NO: 8259 - DNA, 992 bp, Cynara scolymus
  misc_feature (10)..(10): n is a, c, g, or t
  misc_feature (49)..(49): n is a, c, g, or t
  misc_feature (94)..(94): n is a, c, g, or t
  misc_feature (753)..(753): n is a, c, g, or t
  misc_feature (879)..(879): n is a, c, g, or t
gcgggggatntgatggcatttgtttcaacccggatcgacccgacggaancaacatcgttatttcctcttctccgtttcaattctaaccctaatngtcaatcgtcagagttcaagtaatcgtcttcattggcaatcatcaatactcagggatttattagcagaagaagccttaaatgtaaatggaatcgtctcttgactgctctcttgcatattcagatcgcttcaacctccttgttcttcgtccaatccttgctatctcctttgtgctttccttgcttcttctgggttggttcttggcctggaagctactattggttcacgtccctctggtccaggagatatttggtcttaagaagaaaccatctcttcccaagcccttaacccgccaccggttctcacgtttttacaacacccttcaacattaattttacgataattttcacgtctctgctccgtagtggctggttgatctgagtttacttcttggaaattagcattgttgaatcattagtagaccgacctaactattctctgcaaggctttccagtaaagcaatggcgctgaggcgtttctttggtttttctgatggtgagctgatgagatctgatgcaaaaccttgttcgagattgatgaggcatactgctggggtttttagcgttggaggagctctaggattttggattctctgtcgtttgcattacggtcctagagtgaacgttcctcgaagtctgaggtgggcaggtaccggagccntgactgtaagtgcaagcacagctttactggttcgccttttcagtgccgagtgtgaaccccaaaacatagaagcctttgacagaagaggaaaaaataacggtcagtgactaaaacatagcgactatnaggttgacagttgctacaaaatgtcgattacttttgtaagatattatttgtgtttgctttaaatgacccaagcatgtacgatatgaagtaaaaggttgtttattacatgctaa

SEQ ID NO: 8260 - DNA, 641 bp, Fraxinus spp
ggtctgtcaggtgagaaattggcttatccatggcccacctaacggttaaacttcagcgcaaaatctccgttccaccatcaaaattttaaaatttctcatttctgcagtgtaaggaaatcatctcaaaaacccgtcgaggatcaaatcagacaagaattcctgaagaggacagcaaaattgcactaaggcgcatgcttggattttcggatggggaacttatgaggtcagatgcaaaaccttgctccagattgacaaggcaaactgctggcatttttagtgttggaggggcattaggattttggatcctctgccgcttgcattacggtcctagaatcacggttcctcgaagccttaggtgggctgcttgtggtgctgcctcgactagtgcaaccacagctttactggttcgcctgtttagttctgaatgtgaaccgcaaaatatagttgcgtatgacaagaaaaagcagtaaaggttataactaaaactttgtcatgtactccatatcctaggggcttttttgaggatcaaggttatcagaatattcagccgctgagttgttataatctttagaaccattcgtattgtttgtgctattgatcttatggacctctcaatgcaaatgtgttaattcttgattctt

SEQ ID NO: 8261 - DNA, 865 bp, Helianthus annuus
gcggtctgttaggcccactaacgagacagaagaaagcgtgcacaggaggactttttaaatctactacattccgatgaacaagaacgcgtgcttgtgattgtcggccgctgaattgaatcggttaggtttatggaaggctgctcacttgctgcatatttgaacctgtttgttgttcgtccggtcctcgctttctcatttgtagtttccttgcttgttcttggttggtttttggcttggaagcttctgctggttcacgtccccctggtccaggagatatttggtcttaaaaagaaacatcatcttcccaaacccttaactcgcggccgcttttcacgcttttacaatacccttcttcattccaacgtctctgcttcttcttagtgcctgcctgatagcataatggcgttgaggcgtatgcttgggttctctgatggtgagctaatgagatctgatgcaaaaccttgctcgaggttgatgaggcatactgctggggtttttagtgttggtggagccttaggattttggattctctgtcgtttgcattacggtcctagagtgaatgttcctcgaagtctgaggtgggcagggaccggggccatcactgtaagcgctggcacagctttactggttcgcctttttagccctgagtgtgaaccccagaacattgaggcttatgacaagaaaaataaaatatacatctctctcagatcatgactaaacggtaccagtttatggattatgtcaatgtggtttgattttgtaaaatactaagcatggatttctgtctacttttgctatgttttctgctttggaatggccatgaacttgtatgatacacactttggttgtgtgtgtgtcaattgca

SEQ ID NO: 8262 - DNA, 908 bp, Cirsium arvense
aatcgtcgatttcagagttcaagtaatcgtcttcactgtcaatcgtcaaaatactcagggatttattagcagaagaagctttgaatgtaaatggaatcatctcttgactgctctcttgcatattcagatcgcttcaatcttcttgttcttcgtccaatcgttgctatctcctttgtgctttccttgcttcttctgggttggtttttggcctggaagctactattggttcacgttcctttggtccaggagatatttggtcttaagaagaaaccttctcttcccaagcccctaacccgccaccgcttttcacgtttttacaacacccttcgacaataattttacgataattgtcacgtctctgctctttagtggctggttgatctgagtttacttcttggaaattaggattgttgaatcattagtagaccgacttaactactctctggaaggttttcattaaagcaatggcgctaaggcgtttctttggtttttctgatggtgagctgatgagatccgatgcaaaaccttgttcgagattgatgaggcatactgctggcgtttttagcgttggaggagctttaggattttggattctctgtcgtttgcattacggtcctagagtgaatattcctcgaagcctgaggtgggctggtactggagctctgactgtaagtgcaagcacagctttactggttcgccttttcagtgctgaatgtgaaccccaaaacatagaagcctttgacaagaagaggaagaaataacggttttctttcagataaaaccgacaattgttacaaattattgattacgtttgtaagatattattcgtgtttgcttcgattgacctaagcttgtacgatacatgaaagtaaattaccgccctcttaccgggtaagaggcgtttctca

SEQ ID NO: 8263 - DNA, 469 bp, Amsonia hubrichtii
ttcggtaagtaaggttaggtacgtttaaaacttagggtttaagttagtcgtattggtcgtttgtaggtcgggcgttcgtttgggttttcgttgtagtggagaggttaatgaggtcagatgcaaacccttgttccagattgatgagacaaactgctggaatttttacagtaggtggagcattaggatttgggttctctgtcgcttgcactatggccctagaatcacagttcctcgaagtctaaggtgggcagcttgtggagcaatcactacaagctcaacgacagctctgcttgtacgcctatttagtccagaatgtgaacctcaaaatatagctgcttatgacacaaaaaagtaatagtaatttctttaggttccaatttctcatctgtaaaaggaatccgggtggacatgacaggatcagttcagttgtataatatcttagacactattaatgtctcattttcatcag

SEQ ID NO: 8264 - DNA, 549 bp, Amorphophallus konjac
agaacgacagcgtggagagcgcgagagaggagaggagaggggggggggataggtgggtggtagtggtgggggcggaatggcgctgcggcgggctcggggggttgtcggatggggagatgatgaggtcggacgccaagccctgctcgaggctgatgaggcacaccgccgccatctacaccgtcggcggcgccctcggtttctgggtcctctgccgcctccactacggtccaaggataactgtgccgaggagtctgaggtgggcaacctgtggagcgatatcaatgggttcaaccacggccttgttggttcgcctcttcagtccagagtgtgagccacagaatatagccgcatttgacaaggtgaaataaaaaccattgttttggtgaaattggtgtatcttcccacttcttgctgatgtatgatgtgtattatgcttcatcccactcagtaattttatgaagaatatttgtagggagtttaccttctctaaaggacctgacagaaggcctgtatggaactggtacctggattagtcttttttaaaaaaac

SEQ ID NO: 8265 - DNA, 649 bp, Gossypium hirsutum
ctcatctcagttctcacccaccgccgtgtccgctggttttttccggatctgacgcgtgtccggtggttggatcgcgtcgacacgggtacggcacccctaattgccgagtccgggtaacgaaggcgaagacacagtaagcaaagaagacgattttgtgtgggttcgatagcataacatcgaacaagcgttgagagatggcgttgaggcgtgcgcttggctggtcggatggtgaattgatgagatcagatgcaaagccttgttccaggttaatgagacagacggctgggatttttactgtcggaggagctctaggattttgggttctctgtagattgcattacggccctagaattactgttccagaagtcttcgtgggctgcctgtggagctgtgtctgtcagctcggcatctgctttgttggttcgcctattcagccctgaatgtgaatcccaaaatatagctgcttatgacaaaaggaaagagtagcaataagggtgtctaaattcattgaatgaccagtgtgtaacagtatctttcgttttgttgtattgttctgggatctttgccacccctatgtttatcaattttctagtacatgaatcataagcattgtaagggttgctgtttatacgcttttgtgccatttgct

SEQ ID NO: 8266 - DNA, 1014 bp, Flaveria ramosissima
ttgaagtctctaaagcagggctgtttgaggcccattaatgacacctgaagcgtgaagtgaaggataaaaaatcgacatcaatgaaagtgaaacctgtgcttgtgattgtcgctgcaattccgatcgcctgaaatcttgaccttgaagaatccaatcagattctcgctggtcaagtaagaaagggacattgcagcgtaatctgatccgcagaagggattaagtagcagaaggttttacctctggtaaatggaatcatcggttggctgctcacttgcatattcagaccgattgaatctctttgttctccgcccagtccttgctttctcgtttgtactttctttgcttgttcttggttggtttttggcttggaagcttctactggttcacgtgcctttggtccaggagatatttggtcttaaaaagaaaaaccatcttcccaaaccgttaactcgacaccgtttttcacgtttttataataccctaagtcttaataacaacaacgtctcggcttcgtaaggctgaggaccttatttctttgtggaaggtgttcaattaaagcataatggcattgaggcgcttgtttggcttttctgatggtgaactaatgagatctgattcaaaaccttgtttaaggttgatgaggcatactgctgggatttttagtgttggtggagccttgggattttggatcctctgtcgtttgcattatggtcctagagtgaatgttcctcgaagtctgaggtgggcaggtacgggggccatcactgcaagcgcgagcacagctttattggtcaacctttttagccctgaatgtgaaccccagaacattgaagcttatgacaagaaaaatagtcatttacgtgttttctaaatttaatccttctttgttgttttgattcattgaaatttgtcttcatccagattcatgactaaaacagtaatctagtttatgtgttatattatgaactatagtgatgcaccatgtagattatgtcaatggattgaatttaaagt

SEQ ID NO: 8267 - DNA, 741 bp, Theobroma cacao
gaacaaaaacagaaacaaaggaaaagttttgcctccgtgaagtgtaaacccccgcgtctctcccactccatctgtcaccgtcgtagctcctccgccgcctccgttttcgaggtggagaaagctggcgtgctttctaaggagttgatagaatggcgttgaggcgtctccttggctggtcggatggtgagttgatgagatcagatgcaaagccttgttccagattaatgaggcagacggctgggattttcactgttggaggagctttgggattttgggttctctgcagattgcaacatggtccaaggattacggttccaagaagtctccggtgggcagcttgtggagctgtgtctgtgagctcaacatctgccttattggtccgcctattcagtcctgaatgtgaaccccaaaacgtagctgcttatgacatgggaaagtagcactgggttccttgtgcttgtcaaaattcattgctggttttctattgattgaccagtttggtgacagtgtcttttgtttagtatggccctgggatctttggcaatgcctattgttttatcaattttccagtatggcatggagcaactgttgctgtaggatatagacatgtgtgaacttatttggttgcaaccactcgtttttttttttcttttttttgttggtggaatttagctagtttgtggttgtaaatactgtcatgaaaacaatcgctcgcgttagataaccctaataataaaaatt

SEQ ID NO: 8268 - DNA, 739 bp, Triphysaria pusilla
ttcttccggcccaaagaaggaagtgtcggacctggctcttgcgtcaacaagtgaagtgcgcctctcttatcagtccaactctgcacctatttctggaattattgaagaattactgttcgagaaaggaaaaagattagggtttgagcttaaggagattcaaaagtatcttcgggcagggtattagataatggcactcaggcgtatgctggggttttcggatggagagttgatgaggtcagatgcaaaaccatgttcgcgtctaatgagccaaactgctaccattttttcattcggaggatccttgggcttttgggtcctttgccgcttgcattacggtccaagaatcacgactcctcgaagtctgaggtgggctgcttgtggagctgtgtctatgagcgcaactacagctttgctcgttcgtctattcagtcctgaatgtgagccccaaaatgttgctgcttatgatcagaaaaagtgatgttctatttcggttttgtgctatgagacctcgatgcttctttgagatatgtaatttatttatctcttttggtgtggaaagacgaatagtgtcgtctatgagattaatcaacttgtgaaactttgtgttcatggatgatgcagttgtgttgtttgcctgcgaaaaaacgatctcttttgaataatcagttcctatcgaccagattatgttttacaagttgtctgttgaaggtctgttatattcaacagacaatcttttgaa

SEQ ID NO: 8269 - DNA, 698 bp, Triphysaria pusilla
gacgacccgaattacctcaccgctcaccatctagacattgtcggccctggctcttgctgaacaaaacgccggcgagaacaagtgaggtgtgcctctcttatcagtccaactctgcacctatctccgaaattattgaagaattactgttcgagaaaggaaaaaagattagggtttgagcttacggagaatcaaaattatcttttggggtattaaatcatggcactccggcgtatgcttggattttcggatggagagttgatgaggtcagatgcaaaaccatgttcgcgtctaatgagccaaactgctaccattttttcattgggaggatccttgggcttttgggtcctttgccgcttgcattatggtccaagaatcacgattcctcgaagtctgaggtgggctgcttgtggagctgtgtctatgagcgcaactacagctttgctcgttcgtctattcagtcctgaatgtgagccccaaaatgttgctgcttacgatcagaaaaagtgatgttgctattttggttttgtgctatgagacctcgatggttctttgagatacgtaatttattaatctcttttggtgtgaaaagatgattagtgtcgtctgtgagattaatcaacttgtgaaactttgtgttcatggatgatgcagttgtgttttttgcctgcgaaaaacgatctcttttgaataatcagttc

SEQ ID NO: 8270 - DNA, 1767 bp, Aristolochia fimbriata
atatccggcaaatatccggatcgcgattcgggaacctcacattacgcgccgaaaatttccgtcctagtcgccttatatataaccggctgctggttctcccgttcgagcttggagcttcttttttggtctttcaggtgtgattctataagaaagagacgaaatcgcgggggtgttaccatggcgttgagacgtttctttggacttacggatggggaactcatgagatcagatgcgaaaccctgtacgaggcttatgagacacacagccgggatttacagtgtgggtggtggcctcgcgttttgggttctctgcagattgcattacggccctagaataacagttccaagaactctgaggtgggctgcttgcgggtgcataactatgagttcaacatctgctctactggttcgcctctttagtccagaatgtgaacctcagaatatagctgcttatgacaagcacggatgactccggccattgatgtttcagacaggataacatcttctttggatgggcatgaacactttacaaagggagaagcctgccaagtgcttcaatatgtgtgttctataaacataaaattaactggttttgcatttgtattcttaagaagctctctgtctatttggtcattcaccgttttggttagctataatggctgaagaattacaatttggagttattttacatagctatgatgtttaatgaatgacgaatttaatttacattgctatgatatctgaagaatgacaaaatttatatagctatgatgtctgaagaatgacaaatttgaccatttggtctctcgaagtactgtattgcaaatatatttagtgcaaaattctagtaatgccatgatgtgaaattttatataaatgtcactgacccttgtattatctttctgtttattttagagtgtcaccgttggagataaatcacttcacattcattttttccggaaacccatggtgcgaactccaaagctaagagtgaaactgatagtttcatgaaccctgttgatggctattgatattgttggaacttttctcctcctttctgttaattttattctacaggaagatcagcaaaaggagacatttgccaagcctttatagatattttctctagctatcagttgaagctcttgttatctatttttaggtttgtcaaccgtggtttacaaacatgcaagacctgacctgaggatgtacttttgtaactcaaaatatcaaagattgaatccactaaatcatattctcattaaatgacagcacaaacttacaaaatcaaagaacatgttttgaaagatcttacaaacccaatatgcaactttctgtcagcagagcacttccccattttgggaagcttctgttatatcgatgaaggtgtatatgcatcagatgtcattcccaggtttacttccaccattgcagagcattatacactgttgtcatcttcgttgtggcgctaacaacctggtttcctggcgaaagaccaggtattgaatcactcggcaagtaacaaactgaagagtcctgtattctttctctgagaggctcacagggctgaggagtcaccttgtcagagtacccttgaatcatcgaacatttccgtgggcgtttagatgttactccaagcgagatgttggaaaaagaaataccttctaggatgccagcaactctgatattgcttccactgacatctttaaaggtaatcctgtttatggtaggcagtagcggttggatcatacttacatcttggtattgt

SEQ ID NO: 8271 - DNA, 291 bp, Musa acuminata
atggcgctgaggcgggcgctgggatggtcggatggggaactgatgcggtcggacgcgaagccgtgcacccgcctgatgcgccaaaccgccggcatcttcagcgtcggtggggcccttgctttctgggtcctctgtcgcctccactatggtccgaggataacaaacccacggagtctacgttgggcttcatgcggagcaatatcagtaagctccacttccgctttacttgtccgcctttttagtccggaatgtgagcctcaaaatatagctgcttttgacaagcccaaatga

SEQ ID NO: 8272 - DNA, 835 bp, Theobroma cacao
attttaatgggctttgataatagtaagcccaaaatagccaagtaggcaatattgcctttgtaagactacctttcagaaaaagaacaaaaacagaaacaaaggaaaagttttgcctccgtgaagtgtaaacccccgcgtctctcccactccatctgtcaccgtcgtagctcctccgccgcctccgttttcgaggtggagaaagctggcgtgctttctaaggagttgatagaatggcgttgaggcgtctccttggctggtcggatggtgagttgatgagatcagatgcaaagccttgttccagattaatgaggcagacggctgggattttcactgttggaggagctttgggattttgggttctctgcagattgcaacatggtccaaggattacggttccaagaagtctccggtgggcagcttgtggagctgtgtctgtgagctcaacatctgccttattggtccgcctattcagtcctgaatgtgaaccccaaaacgtagctgcttatgacatgggaaagtagcactgggttccttgtgcttgtcaaaattcattgctggttttctattgattgaccagtttggtgacagtgtcttttgtttagtatggccctgggatctttggcaatgcctattgttttatcaattttccagtatggcatggagcaactgttgctgtaggatatagacatgtgtgaacttatttggttgcaaccactcgtttttttttttcttttttttgttggtggaatttagctagtttgtggttgtaaatactgtcatgaaaacaatcgctcgcgttagataaccctaataataaaaattcccaatatagtcc

SEQ ID NO: 8273 - DNA, 878 bp, Ipomoea nil
ggcacttctacgctccgccttctgcccctccacaccataccttcaccttctcgacttctcgttgactcctttactcgttcagcaagccggcaacgccaacactcccgcagccttgcgcctcagcagcgactgctgcccgttgccccgttgtcagcactcagcagacagcgattcgtcgtcagtggccggtgcccggtgcccgtcgtctactcgtccggaaagcggcactttccctagcccttgatcaaaacgcggtcgtctggtgcacagccgttaccctccttcgaaacggtgtcgttccacttaatgcccaacggctctcaccttcccccttcatgcgacgtcgtttacctgctgaggtatttgatgcatgaggtcatttagttctgattggtcttgtagaattaaggtgcaccatggcattgaggcaattgtgtggattttctgatggggaggtgatgagatcagattgtaagacttgttccagattgacgagacagactgctgcaatattctcagttggaggagcattaggcttttgggtgctgtgccgcttgcactacggccctagaatcacaaatcctcgaagttttaggtggggagcttgtggagcagtctctacaagctctaccaccgcattgctggttcgcctgtttagtccagaatgtgaacctcaaaatatagctgcttatgacaaaaaaggatagtgctgcctattcacaagctttgactatcctatgatggcaattggggtcttgcacttggagttatggagcttgtattgctgcctttgaataatatgagatagataatagctttgttactgactgctgataatgtatttgttcatgacttcatgcactacttcaatgttattc

SEQ ID NO: 8274 - DNA, 1015 bp, Tropaeolum majus
acggggggctctcttttctttgttagttgttgccctaacttcttttagaaaccgcttctcccattctcatcgggacgacgcaaccacgggtcacagtttcttcaacctcacaggattcgaagtcttcttgtcatctgagccccagtctctgctactagcctccatacctcgccgagttttacttcctccatagctctcactcggctactaccttaacttcgttttagaaaccgcttctcccattctcctttggacgacgcagccacgggtcaaagtttcttcaacctcgggattcgaggtcttctcgtcatctgggctccaggctaaaacttttaacggattcacgaagcaacacaagagctggtggttttcatttagtattggagaacattgatttggaacctttgctagaaggatgtcgttgagacggtgttgcggttattcagatggtgagctgatgaggtctgatgcaaaaccttgttccagattgatgaggcagaccgcaggaatcttcactgtgggaggagccataggattttgggttctttgtagattgcattatggaccaagagttaacaaaccgagaattctccgctgggcagcttgcggagctgtttctgtgagctctacaacggcattactggtgcggctctttagtcctgagtgtgaaccccagaatatagctgcttatgacaaaggaaggtagtgtagtggttaacatttttacaagacttgcacgtatccgtggccctttgttgctagtttgatgctgtcgtctgtaattgtacgtatcgtaatcgttgtgaatatgctgattttggatgtaactgcaccctcgagtggcatacccatgaaattttatgatgacggttccttaactctaggaaaaaagtgaccgtagcgaagttgtcagcgtagggcacaagacctaggtgggttaccatgtatttcgcacgttggacttggtttctcacccaattacatactaaactacaaatagaaaacgaaaaaaaaa

SEQ ID NO: 8275 - DNA, 565 bp, Rhizophora mangle
tggcattgagttacatttagaaatttgcgagtagatggcatcgagacgtttctttggattctctgatggggagttaatgaggtctgattgcaagccttgctcgagactgatgaggcaaacagcaggagtttttagcgttggaggaactttgggattttggattctctgtaggctgcattatggtcctagaattacacttccaaggagtcttcgatgggctacctgtggagctatttctgttggttcaacctctgcattgctagtccgactcttcagtcctgagtgtgagccacagaatatagctgcttatgacaagtgactgtagcaccaaggtgtttgtgaaggttgaaatgcttaaaactatttttctaccacccttaagactagctatttgtgaaggttgaaatgcttaaactatttattaaactggcctagtttattgccatatcatactgatttctctttagcagctacctacttagatcagaatcgtcatttttctattgatttaattgtcaatgatgcagcaacttgtcaatatggcatacaattcaaattcttattg

SEQ ID NO: 8276 - DNA, 951 bp, Triphysaria pusilla
taacaccaagaacacctctattttgacagaaaatcatcagttctgaaataaaaatcggatctttacactattacagtgtgagctacagtagtgtagtagctgcacatggactcaaagtccttaagattcataacccaccaatcctttttctcggccgtccgatctgattattgaagaacaagtgaagtgtgcctctcttatcagtccaactctgcacctatctccgaaattattgaagaattactgttcgagaaaggaaaaaagattagggtttgagcttacggagaatcaaaattatcttttgggcagggtattaaatcatggcactccggcgtatgcttggattttcggatggagagttgatgaggtcagatgcaaaaccatgttcgcgtctaatgagccaaactgctaccattttttcattcggaggatccttgggcttttgggtcctttgccgcttgcattacggcccaagaatcacgactcctcgaagtctgaggtgggctgcttgtggagctgtgtctatgagcgcaactacagctttgctcgttcgtctattcagtcctgaatgtgagccccaaaatgttgctgcttacgatcagaaaaagtgatgttctatttcggttttgtgctatgagacctcgatgcttctttgagatatgtaatttatttatctcttttggtgtggaaagacgaatagtgtcgtctgtgagattaatcaacttgtgaaactttgtgttcatggatgatgcagttgtgttgtttgcctgcgaaaaaacgatctcttttgaataatcagttcctatcgaccagattatgttttacaagttgtctgttgaaggtctgttatattcaacagacaatcttttgaataatcaaatatctacacatcttatatattcttaagaagttaatgaacgagttttgtaactgcgaagttgagcgtttgtc

SEQ ID NO: 8277 - DNA, 1125 bp, Echinacea purpurea
cggccgggggatccaaacaccccgtaagtctccctttgaaaacacggtgtaagtgaagtcgggaacaaagcgttattctattccaaaagagaatgccgtctaatacaccccaaccctagattcttaaataataatacgcctcttgctctcatctctccaagaactgaacggtttcatcctccgtcagtcactatatgccgaaaccctaatcgagctcgtcaatctctataaatcacacctgcttcatcttcattctcgtcgagcagtcttcatcctcgtcacaccgaaaccctaatcgccaccaggacttaaatctacattccatccaacgacgcaaaagaatgcctgcttgtgatcgtcgctgaagtagcagaaattctattcggattgactagctctggttgatggaatcatctgttggctgctcacttgcatattcagaccgattgaatctctttgttctccgtccggtccttgctttcttatttgtagttttcttgcttgttcttggttggttcttggcttggaagcttctactcgttcacattcctttggtccaggagatagttggtctcaaaaagaaacatcatcttcccaaacccttaactcgcgcccgcttttcacgtttttacaatacccttaatcttgataaacaacaataattcctacgtctctgcttcttagtggcagattgatttctgtggaaggtggtctttgattaaagaaagcataatggcgttgaggcgtttgcttggcttctctgatggtgagctaatgagatctgattcaaaaccttgctcgaggttgatgaggcatactgctggagttttcagtgttggtggagccttaggattttggattctctgtcgtttgcattatggtcccagagtgaatgttcctagaagtctgcggtgggcaggtactggggccatcacagtaagcgctggcacagctttactggtccgtctttttagccctgagtgtgaaccccaaaacattgaggcttatgataagaaaagcaagtaatcatatatttactttgctgtattctacccccttggtcctttagctgcttgctaatggctgggtgtacggatcttgtggtgggttatatattctctgttt

SEQ ID NO: 8278 - DNA, 688 bp, Cucumis sativus
cgccgacgaagacttgtggtcatcgcctcaacaattcatctgtgttttttctcgcccccattttctttcggaaattagcagatggcacttagacgattgttaggcttttcagatggtgagatcatgagatcagatgctaagccttgttcacagttgatgaaacagactgctgggttatgttctgttgaaggagcacttgggttctggattctttgtagattacattatggtccaagaattacagtacgtaggagtcttcgttgggcagcttgtggagcagcatcgatgagtgcaacctcggctttgcttgtccgattgtttagtccagaatgtgaaccccagaatatagctgcttatgacaatagaaagttgtaaggtaattgacatttatagattaataatcttattgtatcattaaaaagtattattcagatgtttccttattaggagctaactgatgtaattagttttggttagtttatgctcttgttattgttatgtcttgttgactcttatcaaagccaagatccatgtttagattgtatgtgtggcttcatgccataaaactaaaaaggagccttaggtctacctttgtattttgtttttctcaataaaagttagtttatgagtagaaaaaaagcttttagtcatgtaacaaagaccaaattttctaattttattgaattgg

SEQ ID NO: 8279 - DNA, 591 bp, Citrullus lanatus
gcataagcaacggttgttctaagcttagtttgtgaaattgccaattttgatctggtccaggaaattagaagatggcacttagacgattcttaggcttttcagatggtgagctcatgagatcagatgctaagccttgttcacagttgatgaaacagacagctgggttatgtactgttggaggaggacttgcgttctggattctttgtagattacattatggtccgagaattacagtacctaggagtcttcgttgggcagcttgtggagcagtatcgatgagtgcaacctcggctttgcttgtccgattgtttagtccagaatgtgaaccccagaatatagctgcttatgacaaaaggaaagttgtaaggtaattgacattcgtagagcaataatcttactgtatcgttaaatgctgttattcagatgtttccttaataggagctaactgatgtaactagttttggttaggttatgttgttgctattgatatgtcttgttgactcttatcaaggcaaggcccatgtctagattgtatgtgtggcttcaggccataaaactaaaaaggggttctaggcctaccttttttttttt

SEQ ID NO: 8280 - DNA, 844 bp, Silene vulgaris
tcattggtattggccgtcataactatatcagttaagctaatgtctatctcatagtgatagagttgataaatggggtggagtcagtaaatatggttaatgtgtgatagctaatgagttgtcgttcttgggttgagtacaatagcttggttaacaatagttctgagagactagattcaggctgctttggttttgtagaagcaacagattgatggctttgagacgcgcacttggctggtctgagggtgatcttatgcgatcagattgtaagccttgcacgagattaatgagacaaaccgctgggatttttacagtgggaggagcattgggcttctgggtcttgtgtaggctgcactatggatcaagggtaacgatacctagaagtctgagatgggcagcgtgtggagcggcaacagtgagctcaagtacggctctactggtccgccttctcagccctgaatgtgaacctcagaacattgcagcttatgacaacataaaatgacgtcgtttcattgtccaatttaagctaaagcatgctgagctcaaaaccagttattgatggctgctggctgcattactagttcttccatctcgcaaactttcctgctgcagaagattgccaacagtactgtagagaaagaggcatgtattgtctatgcagtttcttacatttatttaaagcttcccgaaattacaaaagcaaatttaaagaaaccaattgaggatagtcccctagctattgcatttgttgtctgttgatttcgtttgttggtgaatagcatttaactcgattaacttacgagaagtattatttagttatgcagtttgtataatggcggaatttgga

SEQ ID NO: 8281 - DNA, 559 bp, Fragaria vesca
ctcattctcagagtcgcccaaagggcttgtttggcacagaagtgggataagtccattaacttctcctgggtgtgtgaagaaagtgcagagttatagcaaaaagttattaaagatggcattgaggcgctacttggggttttcagatggtgagctgatgaggtcagattgcaaaccgtgttccagattgatgagacagactgccgggattttcacagttggaggggcatttggattctggattctttgtagattgcattatggtcccagaattacagtccctagagctcttcggtggggagcttgtggagctttatctgtgagctcgtccactgctttgttagttcgcttgcttagtccagaatgcgagccccaaaacatagaaacttacgacaagggaaagtagcacctaatcatgaagtgtactgctgtcttgagtatgttctgatggattgatatgtaggactgcgagttatagatggaactctacttaaagctagatattttgctccgaaatggatgtaccatttaggcatttatatgaaatgaactgtgattaaag

SEQ ID NO: 8282 - DNA, 1456 bp, Glycine max
atcctttccgtgccagagtggcattttgtgttttgtcactttttctgtgtcttcttttcttttctattctcttttgtgtgggtagtgattttcagtttcaatcttggaaagccaacctttgcaattttcaacccgaaatcgtcgatttcttctaaaatatatactgtgcattggtctccttttcgaattgtggttgagggattaaagtaccgttattggtagagatggcatgtagggggtgctgggagtgccttttgaagctgtttaacttcatactgaccctcactggtctggccattgtgggctacggaatctatctttttgttgaattctctaaagcttcggatgatgacaacacgcctgcaatttctcccgtcagtgatgattctgctctgattcaacttggccggcctgtgcttatggccgtgtctctatccaacgacttttttgataacttgccccgtgcctggtttatttacttatttattggtattggagtggttctctttcttatttcttgttttggttgtattggagctgcaacacgaaatggatgctgcctgagctgttattcaattttggtggcattattgatcttggtagagcttggatgtgcagcctttatattctttgacaaaaactggaaagaagaaattccaacagacaaaactggagattttgatgcgatatatggatttctgattgagaattggaatatcgtgaaatgggttgctcttggaattgttatctttgaggcccttcttttcctgttagcccttattgttagggctgcaaataggccagcagattatgatagcgatgaggagttcattaatccaaggcagcaagtacgacagccattgctcaacagaccagcagcaagcccagcaacagggttaccggttgctggaacaatggaccagcgtccaagcagaaatgatgcatggagcacacggatgagggagaagtatgggcttgatacttcggaatttacttacaacccatctgagtcgaacaggttccagcaagtaaactcgcagccaactgaagaaaagagccgctgcactataatgtgatatattttgcagagtttgtgtacacaattcttgctgtactgcatcactccatggcatggcaacatcttcatgatagtgtgtaatattgtgctgagacgtcaaaaatttactctggtgttgcttatgttcatagttaggggaagtgagtagtgaagtcgttagatgccccattttatcgctttgaagccaatgtcttctttctcccatgtttttaagtgaccatcactcggtagttgggaaaactatgatttagtccttaaaagttctgattgacattaatttgatttacattactattaccatcaatttaattttctaaaaaaagttgactttagtttagtcttttaataataaaaaactagcatcaatttagtccctta

SEQ ID NO: 8283 - DNA, 1367 bp, Glycine max
ttttctattctcttttgtgtgggtagtgattttcagtttcaatcttggaaagccaacctttgcaattttcaacccgaaatcgtcgatttcttctaaaatatatactgtgcattggtctccttttcgaattgtggttgagggattaaagtaccgttattggtagagatggcatgtagggggtgctgggagtgccttttgaagctgtttaacttcatactgaccctcactggtctggccattgtgggctacggaatctatctttttgttgaattctctaaagcttcggatgatgacaacacgcctgcaatttctcccgtcagtgatgattctgctctgattcaacttggccggcctgtgcttatggccgtgtctctatccaacgacttttttgataacttgccccgtgcctggtttatttacttatttattggtattggagtggttctctttcttatttcttgttttggttgtattggagctgcaacacgaaatggatgctgcctgagctgttattcaattttggtggcattattgatcttggtagagctgggatgtgcagcctttatattctttgacaaaaactggaaagaagaaattccaacagacaaaactggagattttgatgcgatatatggatttctgattgagaattggaatatcgtgaaatgggttgctcttggaattgttatctttgaggcccttcttttcctgttagcccttattgttagggctgcaaataggccagcagattatgatagcgatgaggagttcattaatccaaggcagcaagtacgacagccattgctcaacagaccagcagcaagcccagcaacagggttaccggttgctggaacaatggaccagcgtccaagcagaaatgatgcatggagcacacggatgagggagaagtatgggcttgatacttcggaatttacttacaacccatctgagtcgaacaggttccagcaagtaaactcgcagccaactgaagaaaagagccgctgcactataatgtgatatattttgcagagtttgtgtacacaattcttgctgtactgcatcactccatggcatggcaacatcttcatgatagtgtgtaatattgtgctgagacgtcaaaaatttactctggtgttgcttatgttcatagttaggggaagtgagtagtgaagtcgttagatgccccattttatcgctttgaagccaatgtcttctttctcccatgtttttaagtgaccatcactcggtagttgggaaaactatgatttagtccttaaaagttctgattgacattaatttgatttacattactattaccatcaatttaattttctaaaaaaagttgactttagtttagtcttttaata

SEQ ID NO: 8284 - DNA, 1442 bp, Phaseolus vulgaris
ctctttcgtgtgagtaacttaattttgaatttggaatttgcaattcgaaatcgtctatttcttctaaaatatatatagggcacagactctaaagtaccgttataggtaaaggatggcatgcagggggtgctgggagtgccttttgaagcttttgaacttcatattgagcatcactggtctggccatagtgggctatggaatttatctttttgtcgaattctccaaagtttcagatgatgacactccggatatttctcctgtcagtgatgattacgctctgattcaactaggccggcccatgcttatggctgtgtctctatcagacagcttttttgataacttgcccagggcttggtttattttcttatttattggtgtgggagtagttctctttcttatttcttgttttggttgtattggagctgcaacaaggaatggatgctgcctgagcttttattcaattttggtggcattattgatcttgatagagttgggatgtgcagccttcatattctttgacaaaaactggaaagaagaaattccaaaagataaaacaggagattttgatgcaatatatggatttctgagtgagaattggaatattgtgagatgggttgccctcggaattggcatctttcaggcccttcttttcctgttagccctcattgttagggctgcaaataggccagcagattatgatagtgatgaggagtttattaatccaagacagcaagtgcggcagccactactcaacagaccagcagcgggctcaacaacaacaggtttaccagttagtgggactattgaccagcgcccaagcagaagtgatgcatggagtgcacggatgagggagaagtatggactcgatacttcggaatttacgtacaacccatctgagtcgagcaggttccagcaagtaaactcacagccaactgaagaaaagagccgctgcaccataatgtgatctcttttgattttatgttcacgactcgtgctgtgctggatcacaccatgacatgaccaacatcatatattcatgtttttttatacatagccttcatgttagtgtggaatattgtgctgagacatcaaaatttacagtggtgttacttgtgttcacagattagggggctgtgttgtctcaccaaaatattctcccttctttcttcaaggtgtgaattgtgattgtgggaaaaaaaatagtgggaacacttctctttgattaagcagagacacagaaaaataaaaatgcagaagatgtaccaaaagaaaatgatacagggtcgaaaatgagtgtccgaaagaagaaccaaatttgtttgagtttataagttctgccgttaaattcgtcttttgattatgaattaattaactatttgtgaagaaggctctataatacgagtttttctagaaagaagtttatccacataacagacaattgc

SEQ ID NO: 8285 - DNA, 1342 bp, Phaseolus vulgaris
ctctttcgtgtgagtaacttaattttgaatttggaatttgcaattcgaaatcgtctatttcttctaaaatatatatagggcacagactctaaagtaccgttataggtaaaggatggcatgcagggggtgctgggagtgccttttgaagcttttgaacttcatattgagcatcactggtctggccatagtgggctatggaatttatctttttgtcgaattctccaaagtttcagatgatgacactccggatatttctcctgtcagtgatgattacgctctgattcaactaggccggcccatgcttatggctgtgtctctatcagacagcttttttgataacttgcccagggcttggtttattttcttatttattggtgtgggagtagttctctttcttatttcttgttttggttgtattggagctgcaacaaggaatggatgctgcctgagcttttattcaattttggtggcattattgatcttgatagagttgggatgtgcagccttcatattctttgacaaaaactggaaagaagaaattccaaaagataaaacaggagattttgatgcaatatatggatttctgagtgagaattggaatattgtgagatgggttgccctcggaattggcatctttcaggcccttcttttcctgttagccctcattgttagggctgcaaataggccagcagattatgatagtgatgaggagtttattaatccaagacagcaagtgcggcagccactactcaacagaccagcagcgggctcaacaacaacaggtttaccagttagtgggactattgaccagcgcccaagcagaagtgatgcatggagtgcacggatgagggagaagtatggactcgatacttcggaatttacgtacaacccatctgagtcgagcaggttccagcaagtaaactcacagccaactgaagaaaagagccgctgcaccataatgtgatctcttttgattttatgttcacgactcgtgctgtgctggatcacaccatgacatgaccaacatcatatattcatgtttttttatacatagccttcatgttagtgtggaatattgtgctgagacatcaaaatttacagtggtgttacttgtgttcacagattagggggctgtgttgtctcaccaaaatattctcccttctttcttcaaggtgtgaattgtgattgtgggaaaaaaaatagtgggaacacttctctttgattaagcagagacacagaaaaataaaaatgcagaagatgtaccaaaagaaaatgatacagggtcgaaaatgagtgtccgaaagaagaaccaaatttgtttgagtttataagttctgccgtt

SEQ ID NO: 8286 - DNA, 1296 bp, Phaseolus vulgaris
gagttccattttaatttcaatttctgaaagaagcattcacaatttgcaactcgaaatcgtcaatttattctatcagagggttgtgaacatcggcttgggacctgcagaagtacttttaactccaaaggaagtgcctgtctgtttctgctgaaaaaatatataaggcattggtctactttttgaactgtggtggagggattgaagtacagttataggtagaggatggcatgtaggggatgctgggagtgccttttgaagcttttgaacttcatattgagcctcactggtctggccatagtgggctatggaatctatctttttgttgaattctctaaagcttcagatggcgaaactctgacgacttctcctgtcagtgatgattctgctttgattcaacttggccggccagtgcttatgactgtctccctatccaacagttttttggataacctgcccagtgcttggtttatttttgtatttattggtattggagtagttctctttcttatttcttgttttggttgtattggagctgcaacacgaaatggatgctgcctgagctgttattcaattctggtggtattactgatcttgatagagctgggatgtgcagcctttatattcttcgacaaaaactggaaagaagaaatcccaacagacaaaactggagattttgatgcgatatatgaatttctgagtgagaattggaatattgtgagatgggttgctcttggaattgttgtctttgaggccctacttttcttgttagcccttattgttagggctgtaaacaagccagcagattatgatagtgatgaggagttcattaatccaaggcagcaaccattgctcaacagaccagctgcagccccagtaacagggttaccggttgctgggactattgaccagcgtccaagcagaaatgatgcatggagtgcacggatgagggagaagtatggacttgatacttcggaattcacatacaacccatctgagtcgagcaggttccagcaagtaaactcacagtcaactgaagaaaagagccgttgcactataatgtgatctcttttgctgcatttgtgttcacaactcaagttgcactggattactccatgacatggccaacatcatcttcatatttgtgtgtaatatttgtgctgagacgtcaaaatttacagtggcgttgctgtaaataaaacctttaaaaatgattccaattgtttgtttgttgtgtgtggattttctgctttaaaacagttcaatttggagttaattaaaccacggcatttttctgtt

SEQ ID NO: 8287 - DNA, 1421 bp, Phaseolus vulgaris
caatttgtgatttgtcgctttttctgtgtcgtcttctctgttttcttctctctgagttccattttaatttcaatttctgaaagaagcattcacaatttgcaactcgaaatcgtcaatttattctatcagagggttgtgaacatcggcttgggacctgcagaagtacttttaactccaaaggaagtgcctgtctgtttctgctgaaaaaatatataaggcattggtctactttttgaactgtggtggagggattgaagtacagttataggtagaggatggcatgtaggggatgctgggagtgccttttgaagcttttgaacttcatattgagcctcactggtctggccatagtgggctatggaatctatctttttgttgaattctctaaagcttcagatggcgaaactctgacgacttctcctgtcagtgatgattctgctttgattcaacttggccggccagtgcttatgactgtctccctatccaacagttttttggataacctgcccagtgcttggtttatttttgtatttattggtattggagtagttctctttcttatttcttgttttggttgtattggagctgcaacacgaaatggatgctgcctgagctgttattcaattctggtggtattactgatcttgatagagctgggatgtgcagcctttatattcttcgacaaaaactggaaagaagaaatcccaacagacaaaactggagattttgatgcgatatatgaatttctgagtgagaattggaatattgtgagatgggttgctcttggaattgttgtctttgaggccctacttttcttgttagcccttattgttagggctgtaaacaagccagcagattatgatagtgatgaggagttcattaatccaaggcagcaaccattgctcaacagaccagctgcagccccagtaacagggttaccggttgctgggactattgaccagcgtccaagcagaaatgatgcatggagtgcacggatgagggagaagtatggacttgatacttcggaattcacatacaacccatctgagtcgagcaggttccagcaagtaaactcacagtcaactgaagaaaagagccgttgcactataatgtgatctcttttgctgcatttgtgttcacaactcaagttgcactggattactccatgacatggccaacatcatcttcatatttgtgtgtaatatttgtgctgagacgtcaaaatttacagtggcgttgctgtaaataaaacctttaaaaatgattccaattgtttgtttgttgtgtgtggattttctgctttaaaacagttcaatttggagttaattaaaccacggcatttttctgtttataaacttaccttgaactgcattacagtgcaatatgatcgactgatggaaactagggaaacttctggagcc

SEQ ID NO: 8288 - DNA, 1672 bp, Glycine max
atccaatctactattaagccataggatcaaatcctttgtggctgtgtgtcagatttagaatttgaatttttttataacacaaagacacccagcgcgtctcccaaacttggaataattaaattactattttggacaattgtcatcaaactgaagaggttggaaagccaaccttggcaaatttcaacccgaaatcgtcgatttcttctaaaatatatacagggcattggtctcctttttgaattgtggttgagggattaaagtactgttattggtagagatggcatgtaggggatgctgggaatgccttttgaagctttttaacttcatattgaccctcactggtcttgccattgtgggctatggaatctatctttttgttgaattctctaaagcttcagatgatgacaacatgccggcaatttctcctgtaagcgatgattcttctctgattcaacttggccggcctgtgcttatggccgtgtctctatccaacgacttttttgataacttgccccgtgcttggtttatttacttatttattggtattggagtggttctctttcttatttcttgttttggttgtattggagctgcagcacgaaatggatgctgcctgagctgttattcaattttggtggcattattgatcttggtagagctgggatgtgcagcctttatattctttgacaaaaactggaaagaacaaataccaactgacaaaactggagagtttgatgcgatatatggatttctgattgagaattggaatatcatgaaatgggttgctcttggaattgttatctttgaggcccttcttttcctgttagcccttattgttagggctgcaaataggccagcagattatgatagtgatgaggagttcattaatccaaggcagcaagtacaacagccattgctcaacagactaccagcaggcccagcaacagggataccggttgctggaacaattgaccagcgtccaagcagaaatgatgcatggagtacacggatgagggagaagtatgggcttgatacttcagaatttacatacaacccatctgagtctaacaggttccaacaagtaaactcacagccaactgaagaaaagagccgctgcgctataatgtgatctctttcgctgagtttgtgtacacaactcgcactgtactggttcactctatgacatggccaacaccatcttcatgttagtgtgcagtattgtgctgagacgtcaaaatttactgtggtgttgcttatgttcatagttagggggagtgagtagtgaagtcgttgatgcccccatattgttgcttcaaagccaatgtcttctttggcccatgttttgcccgtggtcattactcgcttgttgggaaaactatgatttagtccttaaaggttctgattgagattaacttgatttacatcattatcaccatcaatttaattttctaaaaacattgattagtttagtcttttaatattaaaaaaatagcatcaatttagtcccttaattatagaaaattggaattgtctatttgagaaaggctaggaacatattttataattgaagggttaaattgtatcttttataggacaaaaaaagttaatccaatcttttcagaagttgcattaatgtaaatgtttatttttggttagtgattttatgagggga

SEQ ID NO: 8289 - DNA, 1645 bp, Glycine max
caaatcctttgtggctgtgtgtcagatttagaatttgaatttttttataacacaaagacacccagcgcgtctcccaaacttggaataattaaattactattttggacaattgtcatcaaactgaagaggttggaaagccaaccttggcaaatttcaacccgaaatcgtcgatttcttctaaaatatatacagggcattggtctcctttttgaattgtggttgagggattaaagtactgttattggtagagatggcatgtaggggatgctgggaatgccttttgaagctttttaacttcatattgaccctcactggtcttgccattgtgggctatggaatctatctttttgttgaattctctaaagcttcagatgatgacaacatgccggcaatttctcctgtaagcgatgattcttctctgattcaacttggccggcctgtgcttatggccgtgtctctatccaacgacttttttgataacttgccccgtgcttggtttatttacttatttattggtattggagtggttctctttcttatttcttgttttggttgtattggagctgcagcacgaaatggatgctgcctgagctgttattcaattttggtggcattattgatcttggtagagctgggatgtgcagcctttatattctttgacaaaaactggaaagaacaaataccaactgacaaaactggagagtttgatgcgatatatggatttctgattgagaattggaatatcatgaaatgggttgctcttggaattgttatctttgaggcccttcttttcctgttagcccttattgttagggctgcaaataggccagcagattatgatagtgatgaggagttcattaatccaaggcagcaagtacaacagccattgctcaacagactaccagcaggcccagcaacagggataccggttgctggaacaattgaccagcgtccaagcagaaatgatgcatggagtacacggatgagggagaagtatgggcttgatacttcagaatttacatacaacccatctgagtctaacaggttccaacaagtaaactcacagccaactgaagaaaagagccgctgcgctataatgtgatctctttcgctgagtttgtgtacacaactcgcactgtactggttcactctatgacatggccaacaccatcttcatgttagtgtgcagtattgtgctgagacgtcaaaatttactgtggtgttgcttatgttcatagttagggggagtgagtagtgaagtcgttgatgcccccatattgttgcttcaaagccaatgtcttctttggcccatgttttgcccgtggtcattactcgcttgttgggaaaactatgatttagtccttaaaggttctgattgagattaacttgatttacatcattatcaccatcaatttaattttctaaaaacattgattagtttagtcttttaatattaaaaaaatagcatcaatttagtcccttaattatagaaaattggaattgtctatttgagaaaggctaggaacatattttataattgaagggttaaattgtatcttttataggacaaaaaaagttaatccaatcttttcagaagttgcattaatgtaaatgtttatttttggttagtgattttatgagggga

SEQ ID NO: 8290 - DNA, 1251 bp, Vigna unguiculata
ggggacgctgcagaggatccagccaatgccagagtggcattttgtgttctgtgattttttttccgtcttcttttctcatctcttctcttccctgtgaataacttaatttgaattcggatttcgcaattcataatcgtccatttcttctaaaatatatatagggcacaggtcctgaagtaccgttataggtagaggatggcatgtaggggatgctgggagtgccttttgaagcttttgaacttcatattgagcctcactggtcttgccatagtgggctatggaatctatctttttgttgaattctctaaagcttcagatgataacagtccagatatttctcctgtcagtgatgattctgctctgattcaactaggccgccccatgcttatggccgtgtctctatcagacagctttcttgataacttgcctagggcttggtttattttcttatttattggtgtgggagtagttctctttcttatttcttgttttggatgtattggagctgcaacaaggaatggatgctgcctgagctgttattcaattttggtggcattgttgatcttgatagagctgggatgtgcagcctttatattctttgacaaaaactggaaagaagaaattccgaaagataaaacaggagattttgatgaaatatatggatttcttagtgacaattggaatattgtgagatgggttgccctcggaattggcatctttcaggtccttcttttcctgttagccctcattgttagggctgcaaatcggccagcagattatgatagtgatgaggaatttattaatccaagacagcaagtgcggcagccattgctcaacagaccaacagcgggcccaacaacaggggtaccagttactgggacaattgacccgcgttcaagcagaagtgatgcatggagcgcacggatgagggagaagtatggactcgatacttcggaatttacgtacaacccatctgagtcgagcaggttccagcaagtaaacccacagccaactgaagaaaagagccgttgcaccataatgtgatttcttttgagtttatgttcagaactcgtgctgtgctggatcataccatgacatgaccaacatcatatattcatgttttttttatacgtagtcttcatgttagtgtggaatattgtgctgagacatcaaaatttacagtggtgttacttgtgttcatggattaggtggctctgttgtctcaccaaaatatttctcccttctttcttc

SEQ ID NO: 8291 - DNA, 1437 bp, Cajanus cajan
tatggtggctgtagacgatactgtccatgccagagtggcatttttcactttttctgtgtcttcgtttctcttctctgtggctgatttcaatttcaatttggaagccaactttcgcaatctgcaactccaaatcgtcgattcctttcaaaatatatacagggcattattggtgttgtttttgaattgtggttgagggattgaagtagagttataggtagagaggatggcatgtaggggatgctgggagtgccttttgaagcttttgaacttcatactgaccctggctggtctgggcattgtgggctatggaatctatctttttgtggaattctctaaagctgcggatgatgacattccggatatttctcctgtcagtgatgattcttctctgattcaacttggccggcctatgcttctggccgtgtctctatccaacagcttctttgataacttacccaatgcatggtttatttacttatttattggcattggagtagttctctttgttatttcttgttttggttgtattggagctgcaacacgaaatggatgctgcctgagctgttattcaattttggtggtattgttgatcttggtagagctgggatgtgcagcctttatattctttgacaaaaactggaaagaagaaattccaacagacaaaactggagattttgatgtgatatatggatttctgagagagaattggaatattgtgaaatggtttgctcttggaattgttatctttcaggccattcttttcctgttagcccttattgttagggctgcaaataggccagcagattatgatagtgatgaggagttcattaatccaaggcagcaagcacggcaaccattgctcaacagaccagcaggcacagcaacgggggtaccggttgctgggacagttgaccagcgtccaagcagaaatgatgcatggagtacacggatgagggagaagtatgggcttgatacttcggaatttacatacaacccatctgagtcacacaggttccagcaagtaaattcacagcaaactgaggaaaagagccgctgcaccataatgtgatctcttttgctgagtttgtgtatacatacaactaactcactctgttctggatcactccataacatgaccaacatcatcttcgtgttagtgtgtaatattgtgatgagacgtcaaagtttactgtggcgttgcttatgttcatagttagggggagaagtgaagtcattagatgcccatgttgctgctttcaaagccaatgtctttcgtctcccttgatttgaagtggcccttggccatcactggccagttgggaaaactatgatttggtccttaaaagatttgatcgtcattaatttgattcctacatgatcattaacatcgatttaattttctaaaaaaaaatttgacgtcacttcagtcttttaata

SEQ ID NO: 8292 - DNA, 1398 bp, Lotus japonicus
cacaactcagcacgttgcgaatgccagagtggctctctctttctctttctctgtgacgttatctctctctcatcttgttctattctcttcccttccctgtgtcaattttgtaaacccaatcaatcattcgcaactgtagaatcgtcgattccttccttctcaaactaaaattacatagggttttggcctctgtttccgaattctggtagaggatggcgtgtagggggttttgggagtgccttttgaagctttttaacttcataatgaccttgattggtctcaccatggtgggatatgggatctatctgctggttgaattcatcaaagcttcaggtagtgatgatgacacaccggcggtttctccggctagcgatgatcaagccctaattcaacttggtcgaccgatgcttttggcggtgtctctatctgagagcatttttgataagttgcccaaggcttggtttatttacttatttattggtattggagtagttctctttgttatttcttgttttggttgtattggagcggggatgcggaatggatgctgcttgtgctgttattcgattcttgtggcgttgttgatcttagtcgagctgggatgtgcagcctttatattctttgacaaaagctggaaagaagtagttccatcagacaaaactggagattttgatacgatatatgaatttctgagagagaattggaatattgtgaaatgggttgctcttgggattgttgtctttgaggtccttcttttcttgttagcccttattgttagggcctcaaatagaccagcagattatgatagtgatgaagagttcatcaatccaaggcagcaagctcggcagccattgctcaaccgaccagcaggtccagcaacaggccccccagcttctgggacacttgatcagcgcccaagcagaaatgatgcatggagtacaaggatgagggagaagtatgggcttgatacttcagaatttacatacaacccatccgagtcacaaaggttccagcaagtaaatgcacctccaactgaagaaaggagtcgctgtaccatcatgtaatcactttgtggatgctattcaaagccatggcagattgactttctattattatttttgtggtcaatgcctttgagactggaaatttgttggaaaaaatctctgttgctgagtttttgtacaactcgcatattactggataatatgacattggcaacatcatgttcattttatattgggtgtaatattgtgttgtgtcatctgggtttattttggcgttgcttatgttgtttaggattaggtgatagggggtgatgatggttagaatctccatttaagaagacatggattcaaatttacatggacagtaatttttttttgtcaagatttattatcg

SEQ ID NO: 8293 - DNA, 1293 bp, Arachis hypogaea
gggttgatcccaacttcaattcatttttcaaagacttgaaagctttgcaggtccaaaattgctagctgtacaagatcgttaatttccttctagaagatattgggggcattgacctccctcttggaattctggtttaggggttgaactacaatttgtaggtgtagcctgtagaggatggcgtgtaggggattctgggagtgccttttgaagcttttgaacttcttcctgaccctcaccggtctggccatggttggctatgggatctatctgttggttgaattccttcaagctccggatgatgcagtttcccctgtcagtgatgatagttctctgattcaacttggtcgacccatgcttacggctgtgtctctatcgaacagcttctttgatgatttgcctaaggcttggttcatttatatattcattggcattggagtagttctctttgctatttcttgttttggttgtattgcaacgtcaatgcgaaacggatgctgccttagctgttactcagttttgttggtactactgatcttgatagagctgggatgtgcagcctttattttctttgacaaaagctggaaagaagaaattccaactgataaaactggagattttgatatgatatatgaatttttgagagagaattggagcattgtgaaatgggttgcacttggaattgttatctttgaggcccttcttttcttgttagtacttgttgttaaggctgcaaatagaccagcagattatgatagtgacgaggagttcattaacccaaggcaccaagctcgacaaccattgctcaacagaacagcaggcccagcaacaggggtaccagttgctgggacccttgaccatcgtccaagcagaaatgatgcatggagtacacgcatgagggagaagtatgggcttgatacatcggaatttacatacaacccatcggagtcaaaccgattccagcaaccaaactcacagccaacggaagagaggagccgctgcaccatcatgtgatctcactttgtggatggtgtaccaaagctatggcaggttggtgtagaaggttctaagagaaatatctttcgtttgcagagtttgtgtacaattacaggttacaaaatcactctaggaccttgcaacattatctttttcttcttgtgtgtattgttgtgatgacatcataacttgtggggttcactttgctcatgaggtgcccatcactgatttcaatcccacagattacttgtttctatttttgttgtatgttatggcccaagtatttatttatattgtgag

SEQ ID NO: 8294 - DNA, 1487 bp, Arachis hypogaea
ttttttttcactttgatgataaattaattaattaggggttaattatgattgtactgtgtgtctatgtctattcctgtgggctgtgggttgatcccaacttcaattcatttttcaaagacttgaaagctttgcaggtccaaaattgctagctgtacaagatcgttaatttccttctagaagatattgggggcattgacctccctcttggaattctggtttaggggttgaactacaatttgtaggtgtagcctgtagaggatggcgtgtaggggattctgggagtgccttttgaagcttttgaacttcttcctgaccctcaccggtctggccatggttggctatgggatctatctgttggttgaattccttcaagctccggatgatgcagtttcccctgtcagtgatgatagttctctgattcaacttggtcgacccatgcttacggctgtgtctctatcgaacagcttctttgatgatttgcctaaggcttggttcatttatatattcattggcattggagtagttctctttgctatttcttgttttggttgtattgcaacgtcaatgcgaaacggatgctgccttagctgttactcagttttgttggtactactgatcttgatagagctgggatgtgcagcctttattttctttgacaaaagctggaaagaagaaattccaactgataaaactggagattttgatatgatatatgaatttttgagagagaattggagcattgtgaaatgggttgcacttggaattgttatctttgaggcccttcttttcttgttagtacttgttgttaaggctgcaaatagaccagcagattatgatagtgacgaggagttcattaacccaaggcaccaagctcgacaaccattgctcaacagaacagcaggcccagcaacaggggtaccagttgctgggacccttgaccatcgtccaagcagaaatgatgcatggagtacacgcatgagggagaagtatgggcttgatacatcggaatttacatacaacccatcggagtcaaaccgattccagcaaccaaactcacagccaacggaagagaggagccgctgcaccatcatgtgatctcactttgtggatggtgtaccaaagctatggcaggttggtgtagaaggttctaagagaaatatctttcgtttgcagagtttgtgtacaattacaggttacaaaatcactctaggaccttgcaacattatctttttcttcttgtgtgtattgttgtgatgacatcataacttgtggggttcactttgctcatgaggtgcccatcactgatttcaatcccacagattacttgtttctatttttgttgtatgttatggcccaagtatttatttatattgtgagtaagatctttcttggttatttatggggtagaaaaatgctttaattattttgaaatgatttttggtaaaatttaaactaaattgttttttgattgagtaggttttctgaat

SEQ ID NO: 8295 - DNA, 1907 bp, Cicer arietinum
ggttcagcaacgatggacggtttcttgtccaatgctggtagtagtggtagatgtgtgtcgacctaggataatatattttatatttcataaaaacaaaaacatgtcatgagaaaaacacactgccatagtattatcgtttattaaatactcactcctatattttgtagtttatatatatatatataaaaaagagcgttactgaaaatatggaaataagataaaataacagcaaaaatgtcaataacatattttagaattttaaaatgtcaacaaaaattataataacaaattccagtggcacgtacgtaccacacactttagaattttcgtttgtacctcgaattttattttcttctcttctgttcttggtgggtggttcatttgaattttgtacacagagaacgaagcttcgcaattcgctaaactccaaatcccttgtacaaataatcgattccttctaaaacatatagagagggcattaacctcccttttaaattctggttgagagatttgtaggttgaggaggatggcgtgtaggggcttttgggagtgccttttgaaacttttaaacttcatactaacactgactggtttagccatggtgggttatgggatctatttgtttgttggattcactaaagcttctgatgacgacataccggaaatttctccggtcagcgatgacagtgctctaattcaactcggccgaccgatgcttttggccatgtctctatctgacagcctttttgacaaattgcctaaagcttggtttatttacttatttattggcgtcggagctgttctcttcgttgtttcctgttttggttgtattggagctaagacacggaacggttgctgcctgatttgttattcaattttggtggcactgctgatcttggtagagctgggatgtgcagcctttctattttttgacaaaagctggaaacaagaaattccaacagataaaactggagattttgatatgatatatgggtttctgagagagaattggaatattgtgagatgggttgctcttgggattgtcatctttgaggctcttcttttcttgttagcccttattgttagggctgtaaataggccagtagattatgatagtgatgatgagctcattattcaaaggcagcaagttcggcagccattgatcaatagacaaacaggtccaccaacaggattaccagttgctgggacaacggaccagcgccctaacagaaatgatgcatggagtacacggatgagggagaagtatgggcttgatacttcagaatttacatacaacccgtcagagtcacaaagattccagcaagtaaactcacagccaactgaggagaagagccgctgcaccataatgtgatcacttcatggatgctattcaaagccatggcactggcaggttgacttccaattattgtttttgtagtcactgaatggtgttgagactggaagtttgagagaaatatatcttatgtggtgtttgtgttcaactctcactttatgggattattccttgacatggcaaaatcatgtttcattttggtgttaatattgtgctgaggcatcagaatttactgtggcgttgcttctgttcatagtttaagatagtcgtaaattgttaggtactgatataattgcttctgatgcctctcccttgttgtattggtaagttgagttaaaaattttatcttgttctcttaaagattgagttaatttttttagtttttatagtaatagcaacaaaaaaggatagttcttcatttctaaaaagttgtcattagtttagtttcttgatcgcaggagggttttccgatgtcaaaaagatgtgttttatgtcatatttatttttcaggtattagactgatgtgatatcttattttagttttaatcctttg

SEQ ID NO: 8296 - DNA, 1552 bp, Cicer arietinum
gaacgtggtattgttgtaataaacgcgtaccggataagggtattaatatcatttaggtattccattacagtgacacacattccatttccaggtcaccgttttcttttttccttcctctttctgtttggttttcggtggttgggttgagtgatcccaacacaacaaacaaacaccctcacaaatcttctacttcgctattcgatcattccattctatctatctagaaaaaatattgtgcattggacacccttttcaattttgattgaaggattcaagtgagattgtgagtagaggaggatggcttgtaggggtttctgggagtgtcttttaaagcttttgaacttcttactcaccgttactggtctggcaatggtgggatacgggatttatttgctggttgaattcagcaaagcttcggatagctctctgaatgtttctactgtcagtgacggtcaaactctagttcaacttggtcgaccgttgcttatggctgtgcctctgtccgacagcttttttgatgatttgcctaaagcttggtttatttacttgttcattggagttggggcagttctctttgtcatttcttgttttggttgtattgcatctgtgacacggaatgggtgctgcctgagctgttattcagtattagtggtcttgttgatcttagtagagctcggatgtgcagcctttgtattttttgacaaaaactggaaagaagaaattccaagggacaaatctggagattttgatatgctatatcaatttctaagagcgaactggaatattgtgaaatgggttgctcttgggattgttatctttgaggctcttcttttcatcctagctcttattgttcgggctgcaaataggccagcagattacgatagtgatgaagagttcattaatccaaggcagcaagctcgtcagcctttgctcaatagacctgcaggcccggcaccaggtgtaccagttactggcccagttgatcagcgttccagcagaaatgatgcatggagtactaggatgagggagaagtacgggctggatacatcggaattcacatacaacccatccgagtcacacaggttccagcaagtaaactcacaaccaactgaagagaggagccgctgtaccataatgtgatcattttagattgctccaaagtcacagctggctgaatttcgaagattgttattgtgggcaatgaagttgaagctagaaatttgtcaaaaaaatgtcttttgcttaatttgtctatcaatcccactatactggatctccatcgcttttttccatgacatgaaaacacatcttcattttgttgtgtgtaacagtttgctgagtgagaaatcataatttattatgtcgtcatagtttaggggagtaaatgaagttgttacttgttaatcctaatgttgtcaatatttttgggtccgaaccattgctttatatcgccctaaaatacatcatctgcattctggtgtttatttttgtgtgctcaaatctagtggtaaaaatcaggttaggtgtgagatgtaacgtgtaatataatcag

SEQ ID NO: 8297 - DNA, 1267 bp, Medicago truncatula
agtcatcatcgtttctttttcctgtttgattttcttttcactcatcccaaaaatttcaacaatcgtagaaatcatccattctaatttagaaaaaaatattgtgcattggaaactgtttcgattttaattgaaggattcaagtgacattgtgagtagaggaggatggcttgtaggggttgctgggaatgtctattgaagcttttgaacttcattctgaccattacgggtctggcaatggtgggatatgggatttatctgctggttgaattcagtagagcttcggataattctatgatgctttctgctcccagtgatgatcaaactctagttcaacttggccgacctatgcttatggctttgcctctttctgataacatttttgataatttgcctaaggcttggtttatttacttattcattggagttggggcagttctctttgtcatttcttgttttggttgtattgcatctatgacacggaatggttgctgcctgagctgttattcaattttggtggtcttgttgatcttagtagagcttggatgtgcagcctttatattttttgacaaaagctggaaagaggagattccaagggacaaaactggagattttgatatggtatataactttctgagagagaactggactattgtgaaatgggttgctcttgggattgttatctttgaggcacttctgttcatcttagcccttattgtccgggctgcaaataggccagtagattacgatagtgatgaagagttcattaacccaaggcagcaagcccgtcagcctttgctcaatagaccagcaggacctgcaccaggtgtaccagttacaggcacaactgatccacgttccaacagaaatgatgcatggagtacaaggatgagggagaagtatgggctggatacatcggaattcacatacaatccatccgagtcacagaggttccagcaagtaaactcacaaccagctgaagagaggagccgttgtaccataatgtgagcactccatagccacagctggctgaatttcaaagattgttgttgtgggcaatgaatttgaggctagaagtttttcaaaaaaatgtattttgcttaacttgtctatcattcacactactgtggatctccatcactttttttccatgacatgaaaacacatcttcattttgttgtgtgtaacattctgttgagttgagaaaacatcaccatagtttagggagtaaatgaagatgttaaacgcagtgttgtcagtaatttggggt

SEQ ID NO: 8298 - DNA, 1368 bp, Medicago truncatula
cgctcgcacacattcttttccagacagtcatcatcgtttctttttcctgtttgattttcttttcactcatcccaaaaatttcaacaatcgtagaaatcatccattctaatttagaaaaaaatattgtgcattggaaactgtttcgattttaattgaaggattcaagtgacattgtgagtagaggaggatggcttgtaggggttgctgggaatgtctattgaagcttttgaacttcattctgaccattacgggtctggcaatggtgggatatgggatttatctgctggttgaattcagtagagcttcggataattctatgatgctttctgctcccagtgatgatcaaactctagttcaacttggccgacctatgcttatggctttgcctctttctgataacatttttgataatttgcctaaggcttggtttatttacttattcattggagttggggcagttctctttgtcatttcttgttttggttgtattgcatctatgacacggaatggttgctgcctgagctgttattcaattttggtggtcttgttgatcttagtagagcttggatgtgcagcctttatattttttgacaaaagctggaaagaggagattccaagggacaaaactggagattttgatatggtatataactttctgagagagaactggactattgtgaaatgggttgctcttgggattgttatctttgaggcacttcttttcatcttagcccttattgtccgggctgcaaataggccagtagattacgatagtgatgaagagttcattaacccaaggcagcaagcccgtcagcctttgctcaatagaccagcaggacctgcaccaggtgtaccagttacaggcacaactgatccacgttccaacagaaatgatgcatggagtacaaggatgagggagaagtatgggctggatacatcggaattcacatacaatccatccgagtcacagaggttccagcaagtaaactcacaaccagctgaagagaggagccgttgtaccataatgtgagcactccatagccacagctggctgaatttcaaagattgttgttgtgggcaatgaatttgaggctagaagtttttcaaaaaaatgtattttgcttaacttgtctatcattcacactactgtggatctccatcactttttttccatgacatgaaaacacatcttcattttgttgtgtgtaacattctgttgagttgagaaaacatcaccatagtttagggagtaaatgaagatgttaaacgcagtgttgtcagtaatttggggtcgaaatcggtgctttatgttgccctaaatttgagttgaatgtatctatgtaaagctactacctcacaatttaaaat

SEQ ID NO: 8299 - DNA, 1265 bp, Lotus japonicus
tttttcttcccctttctatttggctttcggtgatcccaaagggtatcgatcactgtacaaatcttcgattctctctagaacatattgggcattggccaatctggttgagggattgaagtggaattataggtagaggaggatggcttgtgcttgtaggggttgctgggagtgccttttgaagcttttgaacttcttattgacccttgttggtctggccatggtgggctatgggatttacctgctggttgaattcagtaaagcttcagataacactctcagtgtttctactgtcagtgatgatcaaactctagttcaacttggccgccccatgcttatggctgtgtctctgtccaacagtttctttgatgatttgcccaaggcctggtttatttacttattcattggaataggggtagttctctttgtcatttcttgttttggttgtattggagctatgacgcggagtggctgctgcctgagctgttttgctgttttagtggtattgttgatcttggcagagctgggatgtgcagcctttatattttttgacaaaagctggaaaaaggcaagctccgctggcaatgaaattccgacagacaaaactggaaattttgatatgatatatgaatttctcagagagaactggaatattgtgagatgggtcgctcttggaattgttatatttgaggctcttctttttgtgttagcccttattgttcgggctgcaaataggccagctgactatgacagtgatgaagaattcattaatcctaggcagcaagcccgtcagcctttgctcaacagaccagcagctccagcatcaggtgtaccagttgcgggcacaattgatcagcgtccaagcagaaatgatgcatggagtacaaggatgagggagaagtatgggttagatacatcagaattcacatacaacccatccgagtcacaaaggttccagcaagtgaactcacagccaactgaagaaaggagccgctgcgctataatgtgatcactttggattgttctaagactacatcaggttgaatttcaaggattgcttttgtggagacgttgaggctagaagtatgtcagaaaaaacttcttcttttgcttaatttgtgtaccattcacccacttcactggatcttcatcactttcaataacatcttcattttgttgtgtgtaacattctgctgagtacatcaaaatttattgtgttgcttctgttcatagttatgggtagtaaatgcagtggttaatcctgtgat

SEQ ID NO: 8300 - DNA, 1238 bp, Medicago truncatula
aaagaaaagaaaggaaaaagggtcatcgattcgttctgtagagaaagatggtgtgctgtagaggcttttgggagtgccttttgaagcttttaaacttcatattgaccgtgactggtttagctattgtgggttatgggatctatttgctggttgcattcgctaaagcctctgatgacgataaacccgacatttctccaacgccagatatttctccggtcagtggtgatagtgctctaattcagtttgggcggccgatgcttatggctgtctctctatccgacaacatttttgacaagttgcctaaggcttggtttatttacttatttattggtgtcggagctgttctctttgttgtttcttgttttggttgtattggagctacgacacggaatggttgctgcctgatttgttattcaattttagtggcactgttgatcttggtagagctgggatgtgcagcctttctattctttgacaaaagctggaaagaggaaattccaacagataaaactggagattttgatatgatatatgggtttctcagagagaattgggatattgtgagatgggttgctcttgggattgttatctttgaggctcttcttttcttgttagcccttattgttagggctgtaaataggccagcagattatgatagtgatgatgagctcattaatccaaggcaacaagttcggcagccattgctcaataatagacaagcaggtccaccatcagggttaccagttgcagggacaacggaccagcgcccaaacagaaatgatgcatggagtacacggatgagggagaagtatgggcttgatacttcagaatttacgtacaatccatccgagtcacaaaggttccagcaagcaaactctcagccaaccgaagaaaagagccgctgcaccatcatgtaatcgcttcatggctgctattctaaaccatgtcacatggcattgatagaaatatatcttttgtggagtttgtgtacaaatctcactttaaagggttatttcttgacaattgacatgacaaaatcttgtttatttttgtgttaatattgtgctgtgagagtgagacatcataaattcaatgtgggctgtggtgttatttatgttcatagtttaggatagtagtaaagtcattagatgctgatatcattatcttggtcttcgaaagattgagttaatttttctagtctctgcagtaacaaaaaatctagtccaattctaaaaagc

SEQ ID NO: 8301 - DNA, 1571 bp, Medicago truncatula
tgttttcatataagctattttcagaaatgatccctgagagtttatggaaataagccgaaaacagtttatggaattttcataagctgttttcatacgttctctaagacagtgtcaaaagtgcttatactagaatataagattaaataagctaatcctcacaaattctgctgaaaagttgcacaagtgcctatctcataagtccaaataaacaaaaacatatatagagggcattgaactccattttaaattttggttgagggattaaaccacagttatttgtaggtagagaaagatggtgtgctgtagaggcttttgggagtgccttttgaagcttttaaacttcatattgaccgtgactggtttagctattgtgggttatgggatctatttgctggttgcattcgctaaagcctctgatgacgataaacccgacatttctccaacgccagatatttctccggtcagtggtgatagtgctctaattcagtttgggcggccgatgcttatggctgtctctctatccgacaacatttttgacaagttgcctaaggcttggtttatttacttatttattggtgtcggagctgttctctttgttgtttcttgttttggttgtattggagctacgacacggaatggttgctgcctgatttgttattcaattttagtggcactgttgatcttggtagagctgggatgtgcagcctttctattctttgacaaaagctggaaagaggaaattccaacagataaaactggagattttgatatgatatatgggtttctcagagagaattgggatattgtgagatgggttgctcttgggattgttatctttgaggctcttcttttcttgttagcccttattgttagggctgtaaataggccagcagattatgatagtgatgatgagctcattaatccaaggcaacaagttcggcagccattgctcaataatagacaagcaggtccaccatcagggttaccagttgcagggacaacggaccagcgcccaaacagaaatgatgcatggagtacacggatgagggagaagtatgggcttgatacttcagaatttacgtacaatccatccgagtcacaaaggttccagcaagcaaactctcagccaaccgaagaaaagagccgctgcaccatcatgtaatcgcttcatggctgctattctaaaccatgtcacatggcattgataggttggcctccaattattatttctgtggtcaatggtgttgagactggaagtttcagagaaatatatcttttgtggagtttgtgtacaaatctcactttaaagggttatttcttgacaattgacatgacaaaatcttgtttatttttgtgttaatattgtgctgtgagagtgagacatcataaattcaatgtgggctgtggtgttatttatgttcatagtttaggatagtagtaaagtcattagatgctgatatcattatcttggtcttcgaaagattgagttaatttttctagtctctgcagtaacaaaaaatctagtccaattctaaaaagctgtggcattaatttagtttctttgatctatc

SEQ ID NO: 8302 - DNA, 1616 bp, Glycine max
cagagaagggcattaatgtcatttacgtttctattttccatttcttcttttctgttcagtgagtcagcgttacctttatgcgttggtttcggtgggtgaatgatcatccgaagaggctcaggaaaaggacaacttcgcaactcgtgaatcgattactgtagaaatcgtcgattctatcttaaaacgtattgggcactggccgccattttgaattctggttgagggattgaagtgcgattataggtggaggaggatggcttgtaggggatgctgggaatgccttttgaagcttttgaacttcatattgacccttgctggtctggccatggtcggctatgggatttatctgtttgttgaatacaataaaactccggataatactctcactgtcggtgatgatcaaactctagttcaacttggccgacccatgctagtggctgtgtctctgtccaacagttttttagatgatttgcccaaggcttggtttatttacttatttattggaattggtgcagtcctctttgtcatttcttgtttcggttgtattgcagctctgacacggaatgggtgctgcctgagcttttattctgttttagtgttgttgttgatcttagtggagctgggatgtgcagcctttatattttttgacaaaagctggaaagaagaaattcctacggacaaaactggagattttgatatgatatatggattcctgagagagaactggaatattgtgagatgggttgctcttggaattgtcatctttgaggctcttctttttgtattagctcttattgtcagggctgcaaataggccaacagagtatgatagcgatgaagagtacattaatccaaggcagcaagctcgtcagcctttgctcaacagaccagcaggcccagtatcaggtgcaccagcaactggcacacttgatcagcgtccaagcagaaatgatgcttggagtacacggatgagggagaagtacgggctggatacttcagaatttacgtacaacccatcagaatcacacaggtaccagcaagtaaactctcagccaactgaagaaggaagccgctgtgccatcatgtgatcactttgcatttctccaaaaccacagcagattgaatttcaatgattgtttttgtgggaaaatggctcgagtctaagtttgtcagaaaacactcttccttttgcttagtttgtgtatcattcacactttactggatctccttcacttttttttcatgacatggcagcaacatcttcattgtgttgtgtgtaacattctgccgagtgaacataagaatttatttctctttgttatgttcataatgtattggagtaaatgaagttgtttttggttatggtgtgatgtcattattcttggctggaaaccagtgctttttgttttccttattttgaattggtgtcaattgatggttgtgtcgtgtgtatgtctatgggaatattggataacaaattcaaatataccaacaacaaaccacagtaccacctgcatcctgatgtttttgtgtgcaagtctagtggctttaaactggtgtagggtagtgtgagatgtaaataacgtacagtacatgatcagaaagtttatctaacta

SEQ ID NO: 8303 - DNA, 1573 bp, Glycine max
cttcttttctgttcagtgagtcagcgttacctttatgcgttggtttcggtgggtgaatgatcatccgaagaggctcaggaaaaggacaacttcgcaactcgtgaatcgattactgtagaaatcgtcgattctatcttaaaacgtattgggcactggccgccattttgaattctggttgagggattgaagtgcgattataggtggaggaggatggcttgtaggggatgctgggaatgccttttgaagcttttgaacttcatattgacccttgctggtctggccatggtcggctatgggatttatctgtttgttgaatacaataaaactccggataatactctcactgtcggtgatgatcaaactctagttcaacttggccgacccatgctagtggctgtgtctctgtccaacagttttttagatgatttgcccaaggcttggtttatttacttatttattggaattggtgcagtcctctttgtcatttcttgtttcggttgtattgcagctctgacacggaatgggtgctgcctgagcttttattctgttttagtgttgttgttgatcttagtggagctgggatgtgcagcctttatattttttgacaaaagctggaaagaagaaattcctacggacaaaactggagattttgatatgatatatggattcctgagagagaactggaatattgtgagatgggttgctcttggaattgtcatctttgaggctcttctttttgtattagctcttattgtcagggctgcaaataggccaacagagtatgatagcgatgaagagtacattaatccaaggcagcaagctcgtcagcctttgctcaacagaccagcaggcccagtatcaggtgcaccagcaactggcacacttgatcagcgtccaagcagaaatgatgcttggagtacacggatgagggagaagtacgggctggatacttcagaatttacgtacaacccatcagaatcacacaggtaccagcaagtaaactctcagccaactgaagaaggaagccgctgtgccatcatgtgatcactttgcatttctccaaaaccacagcagattgaatttcaatgattgtttttgtgggaaaatggctcgagtctaagtttgtcagaaaacactcttccttttgcttagtttgtgtatcattcacactttactggatctccttcacttttttttcatgacatggcagcaacatcttcattgtgttgtgtgtaacattctgccgagtgaacataagaatttatttctctttgttatgttcataatgtattggagtaaatgaagttgtttttggttatggtgtgatgtcattattcttggctggaaaccagtgctttttgttttccttattttgaattggtgtcaattgatggttgtgtcgtgtgtatgtctatgggaatattggataacaaattcaaatataccaacaacaaaccacagtaccacctgcatcctgatgtttttgtgtgcaagtctagtggctttaaactggtgtagggtagtgtgagatgtaaataacgtacagtacatgatcagaaagtttatctaacta

SEQ ID NO: 8304 - DNA, 1081 bp, Lupinus angustifolius
tttcttctcctttttcatttttcctttttccttttttctttgctgattacaattttctataccgctctcgaacttcttcgcctttcgcaattacatatccgtacaaaatcttcgattctttctaaaatatattgtacatcgctgctttggcctaatttttgggttgtggttgaggcatttaactagaatcgtaagtggaggatggcgtgttgttgtaaggggttttgggagtgccttttgaagcttttgaacttcatactgaccctcactggtctggccatagtgggctatgggatctatctgctagttgtattcactaaagcttcgggtgacactccagcaattcctcctgtcagtgatgaccgtgatctaattcgacttggtcgacccatgctaatggccgtgtctctatcagacagtattcttgataagttgcccaaggcttggtttatttacgtattcattggtattggagtagtcctgtttgttatttcttgttttggttgtattggagctgtgacacggagtggatgctgcctaagcttttattcagttttggtggtattattgatattggcagagctgggaagtgcagcctttatattctttgataaaagctggaaagaagaaattccagtggacaaaactggagcttttgatttgatatatggatttctaagagagaattggaatcttgtgaaatgggttgctcttggaattgttatctttgaggcacttcttttctttttagcccttgttgttagggccgcaaataggccagctgattatgacagcgatgatgagtacattaatccaaggcagcaagcccgacagccattgctcaacaaaccagcaggtccggcaacaggggtaccagttgctgggacaattgaccagcgtccaagcagaaatgatgcatggagtacacgaatgagggagaagtatggacttgatacttccgaatttacatacaacccgtctgagtcacagaggttccagcaagtgaactctcagccaactgaagaaaggagccgctgcaccatcatgtgatcagtttatatggatgctgtccaaaactatg

SEQ ID NO: 8305 - DNA, 1395 bp, Trigonella foenum-graecum
atcgatgacgtcaaattcagggtctttggctggccggtggaaataacgaatcccagagtgtgaaggaacgatcgaacgaagcttcgtagtagaaaataaatcatcgattcgattccttctagaacatatagagggcattgacctctacaattataggtagagaaggatggtatgttgtaggggattctgggaatgtcttttgaagcttttgaacttcatactaaccgtcactggtttggccattgtgggttatgggatctatttgctggttggattcactaaagcttctgatgacgacagaccggacatttccccggcgccagagatttctccgctcagtgatgatagtgctctaattcagtttgggcggccgatgcttatggcggtgtctctgtccgacaacatttttgacaagttgcctaaggcttggtttatttacttatttattggtgttggagctgttctcttcattgtttcttgttttggttgtattggagctacgacacggaatgggtgctgcttggtttgttattcaattttggtggcactgttgatcttggtagagctgggatgtgcagcctttctattttttgacaaaagctggaaagaagaaattccgacagataaaactggagattttgatatgatatatgggtttctgagagagaattgggatattgtgagatgggttgctcttgggattgtcatctttgaggctcttcttttcttgttagcccttattgttagggctgtaaataggccagcagattatgatagtgatgatgagctcattaatccaaggcagcaagttcggcagccattgctgaataatagacaaacaggtccaccagcagggttaccagttgctgggacaacggaccagcgcccaaacagaaatgatgcatggagtacacggatgagggagaagtatgggcttgatacttcagaatttacgtacaacccatccgagtcacaaaggttccagcaagcaaactcacagccaaatgaagaaaggagccggtgcaccatcatgtaatccttcatgtatgctattcaaagccatggcacatggcattgacaggctgacttctaattatttatgtgatcaatggtgttgagactggaagtttgagagaagtacatcttttgtggagtttgtgtatacctttcactttacaggattattcgttgacatggcaaaatcatattccttttggtgttaatattgtgctgagagacatcagaatttattgtggcgttgtttatgtttcatagtttaagatagttcatagtagtaaagttgttaaatgatgatattattgcctaagatgcctctcccttgttgtatttagttgagttaaaattattatattgatctttgaaagattgagttaa

SEQ ID NO: 8306 - DNA, 654 bp, Sorghum bicolor
tctcccgcggcggcgcgtgcgagacccatccgccgccacgccatggccaagttcaacgtggtgcagaagaacaggcgccagtggaagcaggaccgcaagcgcgccgcgcatggggagcccggcaccggcaagctcaagcagcgtaccgcgcccgtctccatgtccggcaagcggaagcgcaagctcgagcgccgcctcaaccgggagcagaaagaggctgcgatgattaaggcgctggagaacatgggggatgtcgacatggtctctgctgaagagtcttcagaggctgcaaagggcaagtctcaagtgaagttcagtgtgaagaaaaactcaagaatacagatcaagagattgaagggcaaaggcaggaagaaagccaaaaatgcaaaaccacctgcgaaggagaaagttgatgccatggtagaatgacggacaatactgcatcactggaattatgatatgaaccttgtatgttttctcagagcttgcagcaagggctgcagggactgacctcagggaacactggagcttgaactgcctcttgcatctactactgcctgaatgttcattagaagctacttaggtctggtgttagtgtatcgaacttcaaacatgaatgtacctttaatagtggaatattcatgttttcattca

SEQ ID NO: 8307 - DNA, 759 bp, Cenchrus ciliaris
cctccccatcctctcccgcggcggcgcctgcgagacccacccgccgccacgccatggccaagttcaacgtggtgcagaagaacaagcgccagtggaagcaggatcgcaagcgcgccgcgcatggggagcccggcaccggcaagctcaagcagcggaccgcgcccgtctccatgtccggcaagcggaagcggaagctcgaacgacgcctcaaccgggagcagaaagaggctgcgatgattaaggcgctggagaacaacatgggggatgttgacatggtctctgctgaagactcttcagaagctgcaaagggcaagtctcaagtgaagttcagtgttaagaaaaactccaggatacagatcaaaagattaaaaggcaaaggtagaaagaaagccaaaaatgcaaagccacctacaaaggacaaagttgataccatggtagaatgaaggacaggactgaatgtgagtatggtgaagcctctgtacttttgctgagacgaccagcaaggattgcagatactgacctcgtcaaagtatgggagggtgaactaccctgtgccactaccgcctgaatgttaggatctactaaagtctagtgttcatgtatcgaacttcaaacaagaatcaagttttgtaatagttgagtatgcttgttttttctcatgttcgtgtttgttgcctggaggtgttttgtcgtgaattggtgcccgtcatcttcaatgggcagcaagtttcagtttgtgaggctctgtcagagcactgt

SEQ ID NO: 8308 - DNA, 747 bp, Cenchrus ciliaris
ctcccgcggcggcgcctgcgagacccatccggcgccacgccatggccaagttcaacgtggtgcagaagaacaagcgccagtggaagcaggaccgcaagcgcgcagcgcatggggagcccggcaccggcaagctaaagcagcggaccgcccccgtctccatgtccggcaagcggaagcgcaagatcgagcgccgcctcaaccgggagcagaaagaggctgcgatgattaaggcgctcgagaacaacatgggcgatgtcgacatggtctctgctgaagactcttcagaagctgcaaagggcaagtctcaagtgaagttcaatgttaagaaaaactccaggatacagatcaaaagattaaaaggcaaaggtagaaagaaagccaaaaatgcaaagccacctacaaaggacaaagttgatgccatggtagaatgaaggacaggactgaatgttagtatggtgaagcctctgtacttttgctgagacgaccagcaaggattgcagatactgacctcgtcaaagtatgggagggtgaactaccctgtgccactaccgcctgaatgttaggatctactaaagtctggtgttaatgtatcgaacttcaaacaagaatcaagttttgtaatagttgagtatgcttgttttttctcatgttcgtgtttgttgcctggaggtgttttctcctgaattggtgcccgtcatcttcaatgggcggcaaatttcaggttgcgaggctctgtcagagcactgt

SEQ ID NO: 8309 - DNA, 819 bp, Setaria italica
aaaggccgcggccgaagggtttgctcggcttcctctctccctcccccttccctcccgcggcggcgcctgcgagacccatccgccgccacgccatggccaagttcaacgtggtgcagaagaacaagcgccagtggaagcaggaccgcaagcgcgccgcgcatggggagcccggcaccggcaagctcaagcagcggaccgcgcccatctccatgtccggcaagcggaagcgcaagatcgagcgccgcctcaaccgggatcagaaagaggctgcgatgattaaggctctcgagaacaacatgggggatgtcgacatggtctctgctgaagagtcttcagaagctgcaaagggcaagtctcaagtgaaggtcagtgtgaagaaaagctccaggatacagatcaaaagattaaaaggcaaaggtagaaagaaagccaaaaatgcaaagccgcctacaaagggcaaagttgacgccatggtagaatgaaggataggtactgcgaagcctttgtacgtttgctgagaaccagcaaggattgcagagactgacctcgccaaagtggggagcgtgaactaccttgcggcttgtgccactaccgcctgaatgttcattaggaactacttagatctggtgttaatgtatcgaacttcaaacatgaatcaagttttgtaatagttgagtatgcatgggttttttttcatgttcttgttgggtttgtgtttgtggagatgttttgttgtgaattggcgcccgtcatctgttgcagtcaggaataaccgatctgcagtgcagcaaaacattactatccgttcctggtttgggc

SEQ ID NO: 8310 - DNA, 906 bp, Panicum virgatum
acgagccccctgttcggaaacgcgagagcatgtccgggtggcacctgtgcgcccgaatctcgaggcggtgagggaatcagccgcgtttccttgcgcagttgcactgatcttgaggcagcagagggtaaagggtttggccgcgtcccaagggtttgcttggcttactctctctctctctctctctcggtctctcccctcctctcccgcggcggcgcctgcgaacccgaacccatccgccgccacgccatggccaagttcaacgtggtgcagaagaacaagcgccagtggaagcaggaccgcaagcgcgccgcgcatggggagcccggcaccggcaagctcaagcagaggaccgcgcccgtctccatgtccggcaagcggaagcgcaagctcgatcgccgcctcaaccgggagcagaaagaggctgcgatgattaaggcgctggagaacaacatgggggatgtcgacatggtctctgctgaagagtcttcagaagctgcaaagggcaagcctcaagtgaagctcactgtgaagaaaaactccagggtacagatcaaaagattaaaaggcaaaggtagaaagaaagccaaaaatgcaaaaccgcccacaaaggacaaagttgactccatggtagagtgaaggacaggacccaatcgccagtactgtgaaacctttgtacgtttgctgagaaccagcaaggactgcggagactgaccttggccgaacactgggcttgaatgttcattagggactacttagatctggtgttaatgtatcgaacttcaaacatgaatcaagttttgtaatagttgagtatgcatggttttttcccagttcctgttggttgtggagatgtcttgttctgaatatgcgcacgtcagtttttatgatcaacaggtttcgtggttg

SEQ ID NO: 8311 - DNA, 679 bp, Oryza sativa
ctctctcgtttttgcggcggcgcccccgagcgaagcagccgagcacccacccgccgccgccgccgtcgccgattcatggccaagttcaacgtggtgcagaagaacaggcgcgagtggaagcaggaccgcaagcgccaggcccatggcgaccccaagaccggcaagctcaagcagcgcacggcgcccgtctccgtctccggcaagcgccagcgcaagctcctgcgccgcctcagccgggagcagaaggaggctgtgatggccaaggcgctggagaacaacatgggcgacgtcgagatggtatctgcggaaggctcttcagaagctgcaaaggacaagtcacaactgaagtttaatgtgaaaaagaactcaagagtacagatcaaaagattaaaaggcaaaggcagaaagaaagccaagaatgcaaagccgccgacaaaggacaaagttgacgccatggtggagtgactggatgtggttgataacactcagcttctacattgttgaagggatccgcaaggattgaaaataccatgagctatcaaagcatctttactgtcttaatgtttagtacaagctagttagctttctaatcaatgtatcctactaaatacgatgatcaagacctgagaggttaaatgcatggtttttggaatatttgtatgaaagcctgatttgcatg

SEQ ID NO: 8312 - DNA, 1870 bp, Zea mays
gaaaaaacgcaggtgtcgaaacacattttcttgctccagagaatttaaaccgctgcgaattcaattcgaaagccccaagagagcatccatggcttccgctaccacctccatctcgtcgcaccccgccgccctccgcgacgtcaaagctgcgaggattggcgggctgaggcagcagcaggcgagcgtggccccgtcggcggcggcagcgcgtggccagcgcgctcgggcggtgcgatcgctgcgcgcggcggagcctgcgaggcagccggtggcggcttccgcggccgcggcggcgccggccgcgcccgtggccgacgaggcggcggcccttgcggccgtggactacgaggccctggcgcgtgagctggagggcgcgtcgccgctggagatcatggatcgggcgctggccatgttcggctccgaaatcgccatcgccttcagcggcgcggaggacgtggcgctgatcgagtacgccaagctgacggggcgtccgttccgggtgttcagcctggacacggggcgtctgaacccggagacgtaccagctattcgacaaggtggagaagcactacggcatccgcatcgagtacatgttcccggacgcgagcgaggtgcaggagctggtgcgcaccaagggcctcttctccttctacgaggacggccaccaggagtgctgccgggtgcgcaaggtgcggcccctgcgcagggcgctcaaggggctcagggcgtggatcaccggccagaggaaggaccagtcccccggcaccagggccagcatcccccttgtccaggttgatccttccttcgaaggcctggatggcggggctggtagcttggtcaagtggaaccccgtggccaacgtcgacggcaaggacatctggactttcctgcggaccatggacgtacctgtcaacaccctgcatgctcagggctacgtgtccatcgggtgcgagccgtgcaccaggcccgtcctgccggggcagcacgagcgtgaaggccggtggtggtgggaggacgccaaggccaaggagtgcggcctccacaagggcaacatcgacaaggacgcccaggcggcggcccccaggtccgccaacggcaacggctcggcgggcgccccggacatcttcgagagccccgccgtggtgtccctcacccgcaccgggatcgagaacctgctgcgcctggagaaccgcgccgagccgtggctcgtggtgctgtacgcgccctggtgcccgttctgccaggccatggaggcctcctacgtggagctggccgagaagctggcggggtccggggtgaaggtggccaagttccgcgcggacggcgagcagaagccgttcgcgcaggccgagctgcagctgcagagctttcccaccgtgctcctgttcccgggccgcaccgccaggcccatcaagtacccgtcggagaagagggacgtcgactcgctcctcgccttcgtcaacagcctccggtgagagacgacctccagtgagcgagaaccatcgttctctgtcagtctgtatgatcttatgttggtctttatgagtttatctaggttcgtagagagggaggtggaggggactgggtttggtagagacacaggaaggaacgagggttcaggggggaaaaatcaggtgtagcttttgtaactgcaaaatgattgcagcatgtatacctgaagtctgagcttctgaggccctgtgcttggtagctgagggagaggttacttgtgtgtgcttatagtcagtggcgagtgcctactataaggttcaccggtcatctaaagcactgttgtaaactgtattatttgtagagtggagttttaatataggcataagaatgggtaagtcgctggagatagtctaagaaaa

SEQ ID NO: 8313 - DNA, 1861 bp, Setaria italica
cagaaaaaacgcaggagtcaaaaacacatttgctccagagaagaaatattaccagctgcgaatttttttcaaagccccaagagagcttccaatggcttccgccaccgcctccatctcgtcgcaccccgccgcgctccgcgacgtcaaagccgcgaggattggcgccgtgaggcagcaggtggccgtggccccgtcagcggcggcgcggggccagcgcgctcgggcggtgcgcccgctgcgcgcggcggagcaggggaggcagccggtgtcggcctccgcggcgtcggcggcgccggtggcgcccgtggccgacgaggccgcggcccccgccgcggtggactacgaggccctggcgcgtgagctggagggcgcgtcgccgctgcaggtcatggatcgggcgctggccatgttcggatccgagatcgccatcgcgttcagtggcgcggaggacgtggcgctgatcgagtacgcgaagctgacggggcgccccttccgggtgttcagcctggacacgggccgcctgaacccggagacctaccagttcttcgacaaggtggagaagcactacggcatccgcatcgagtacatgttcccggacgccggcgaggtgcaggagctggtgcggaccaagggcctcttctccttctacgaggacggccaccaggagtgctgccgggtgcgcaaggtgcggccgctgcgcagggccctcaagggcctcagggcctggatcaccggccagaggaaggaccagtcccctggcaccagggcaagcatccccgtcgttcaggttgatccttcatttgagggccaggatggcggagctggtagcttgatcaagtggaaccccgtggccaacgtcgacggcaaggacatctggacattcctgaggaccatggacgtccctgtcaacaccctgcacgctcaaggttacgtgtcaattggttgcgagccgtgcaccaggccggtcctgccggggcagcacgagcgtgaaggccggtggtggtgggaggacgccaaggccaaggagtgcggccttcacaagggcaacatcgaaaaggacgggcaggcggcgcccaagtccgccaacggcaacggctcggcgggcgccccggacatcttcgagagccccgccgtggtgtccctgacccggaccgggatcgagaacctgctgggcctggagaaccgcgcggagccgtggctcgtggtgctgtacgcgccgtggtgccccttctgccaggccatggaggcctcctacgtggagctggcggagaagctggcggattccggtgtgaaggtggccaggttccgcgccgacggcgagcagaagccgttcgcgcaggcggagctgcagctgcagagcttccccaccgtgctcctgttcccgagccgcaccgccaggcccatcaagtacccgtccgagaagagggacgtcgactcgctcctcgccttcgtcaacagcctccggtgagaggccgccagggagcgagagtcatcgttctctgtctgtgtctgtccatggtggtggtgttggcgattggtgtcgttggtccgtctagcattgtacttagagagggaggagaggtatcagagagagggaattggggacgataggaacagagggaggggttcagaaatacttcagatgcagatgattgatgcatctctagcttttgtcactgcaaatgattgcaggtaaacctgaaggtccggtggtgtagggcagaaggtcgaggttatttatgtacttatagctagtgggtgagttggtgacagaggattgtaagggtaaaatcaaataagaaaaatcagttttggtagttctttattgttcatgcgttagaaacttggaataacgagcagg

SEQ ID NO: 8314 - DNA, 1832 bp, Zea mays
acgccacaggaaggggaaaaaaaacgcaggtgcccaaaacacgttcgccccagagaattgaaaacttaccactgcgaattcaattcgaaagcctcagacccagagagcttcccatggcatccgctaccacctccatctcgtcgcaccctgccgccctccgcgacgtcaaagctgcgaggattggtggcgcgctgaggcaggtgggcgtggcggcgcgtggccagcgcgctcgggcggtgcccccgctgcgcgcggcggagcctgcgaggcggccggtggcggcctccgcggccgcggcgccgccggccgcgcccgtggccgacgaggcggcggtggactacgaggccctggcgcgcgagcttgagggcgcgtcgccgctggagatcatggatcgggcgctggccatgttcggctccgaaatcgccatcgccttcagcggcgcggaggacgtggcgctgatcgagtacgcgaagctgacggggcgtcccttccgggtgttcagcctggacacggggcggctcaacccggagacgtaccagctcttcgacagggtggagaagcactacggcatccgcatcgagtacatgttcccggacgcgagcgaggtgcaggagctggtgcggaccaagggcctcttctccttctacgaggacggccaccaggagtgctgccgcgtgcgcaaggtgcggcccctgcgcagggcgctcagggggctcagggcgtggatcaccggccagaggaaggaccagtcccccggcaccagggccagcatccctctggtccaggttgacccttccttcgaaggcctggacggcggggctggtagcttggtcaagtggaaccccgtggccaacgtcgacggcaaggacatctggactttcctgcggaccatggacgtccctgtcaacgccctgcatgctcagggctacgtgtccatcgggtgcgagccgtgcaccaggcctgtcctgccggggcagcacgagcgggaaggccggtggtggtgggaggacgccaaggccaaggagtgcggcctccacaagggcaacatcgacaaggacggccaggcggcggcggcggcggcggcccccaggactgccaacggcaacggctcggcgggcgccccggacatcttcgagagccccgccgtcgtgtccctcacccgcgccggggtcgagaacctgctgcgcctggagagccgcgccgagccgtggctcgtggtgctgtacgcgccctggtgcccgttctgccaggccatggaggcctcctacgtggagctggccgagaggctggcggggtccggcggcgtgaaggtggcccggttccgcgccgacggcgagcagaagccgttcgcgcaggccgagctgcagctgcagagcttccccaccgtgctcctgttccccagccgcaccgcccggcccatcaagtacccgtcggagaagagggacgtcgactcgctcctcgccttcgtcaacagcctccggtgaggcccgccagtgagcgagaaccatcgttctctgtcagtatgtactgtattacatgttggtatccatctaggtgcgctgtacgtagagagggaggcggagggaactgggatgctagaaaaaacagatgcaggtgttgcttgtaactgcagaatgatggtaggtatgcatgaagtctgaggtcctgtgttatttggcagctgagggagagatttgtgcgtgcttgtagttgtagctagtggcgatggagtattctaaggaaaatcaaataagaatcgaagttttgagagttcttgtttgttcatgttggctgtcgactatatagacagtagaaagcgaagatttttattt

SEQ ID NO: 8315 - DNA, 1723 bp, Panicum virgatum
tggccgtgcagccgcgaggattggagccatgaggcagcaggtggccgtggctccggcggcggcggcggcgcggggccagcgcgctcgggcggtgcgcccgctgcgcgcggcggagcaggggaggcagccggtgtcggcctcggcggcctcggcggcgccggcggcgcccgtggccgacgaggtggcggcccccgcggcggtggactacgaggccctggcgcgcgagctggagggtgcgtcgccgctggaggtcatggaccgggcgctggccatgttcggatccgagatcgccatcgccttcagtggggcggaggacgtggcgctgatcgagtacgcgaagctgacggggcgccccttccgggtgttcagcctggacacggggcggctgaacccggagacgtaccagttcttcgacaaggtggagaagcactacggcatccgcatcgagtacatgttcccggacgccggcgaggtgcaggagctggtgcggaccaagggcctcttctccttctacgaggacggccaccaggagtgctgccgggtgcgcaaggtgcggccgctgcgcagggcgctcagggggctcagggcatggatcaccggccagaggaaggaccagtcccccggcaccagggccagcattcccgtcgttcaggtcgacccttcgtttgaaggcctggatggcggagctggtagcttgatcaagtggaaccccgtggccaatgtcgacggcaaggacatctggacattcctgaggaccatggatgtccctgtcaactccctgcatgctcaagggttcgtgtccatcggttgcgagccgtgcaccaggccggtcctgcccgggcagcacgagcgtgaaggccggtggtggtgggaggacgccaaggccaaggagtgcggcctgcacaagggcaacatcgacaaggacggccaggcggcggcgcccaagcccgccaacggcaacggcgcggcgggtgccccggacatcttcgagagccccgccgtggtgtccctcacccgcgccgggatcgagaacctgctgcgcctggagaagcgcgcggagccctggctcgtggtgctgtacgcgccctggtgccccttctgccaggccatggaggcctcctacgtggagctggccgacaagctggccggggccggcgtgaaggtggccaagttccgcgccgacggcgagcagaagccgttcgcgcaagcggagctgcagctgcagagcttccccaccgtgctcctgttcccgacccgcaccgctaggcccatcaagtacccatccgagaagagggacgtcgactcgctcctcgccttcgtcaacagcctccggtgagagtgagagaccgcccgccagggagcgagaaccatcgttctctgtcagaattgtacttagagagggaggaggtatctgagagagggaactggggatgataggaagagagggatggggttcagaaatacttcagatggagatcatgcatctctagctcttgtcactgcaaactgttgcaggtaaaaacccgaagcctgaggtccggtgttataaggcaaaaggtcgaggttatttgtgtgtacttatagctagtggtgagttggtgacagagaattgtaagggtaaaatcaaataagaaaatcagttttggcagttctttattgtccattctggttgtgaattttaaccatttgaagaaggcaaaattggctaggggacactcaaaaa

SEQ ID NO: 8316 - DNA, 1754 bp, Panicum virgatum
cggaattcatctgcacttggagcaagagtttgtaattgctctgaaaattcatctctctcttttggccgtgcagccgcgaggattggagccgtgaggcagcatgtggccgtggctccggcggcgcggggccagcgcgctcgggcggtgcgcccgctgcgcgcggtggagcaggggaggcagccggtgacggcctccgcggcctcggcggcgccggcggcgcccgtggccgacgaggtggcggcccccgcggcggtggactacgaggccctggcgcgcgagctggagggcgcgtcgccgctggaggtcatggatcgggcgctggccatgttcggatccgagatcgccatcgccttcagtggcgcggaggacgtggcgctgatcgagtacgcgaagctgacggggcgccccttccgggtgttcagcctggacacggggcggctgaacccggagacgtaccagttcttcgacaaggtggagaagcattacggcatccgcatcgagtacatgttcccggacgccggcgaggtgcaggagctggtgcggaccaagggcctcttctccttctacgaggacggccaccaggagtgctgccgggtgcgcaaggtgcggccgctgcgcagggcgctcagggggctcagggcatggatcaccggccagaggaaggaccagtcccccggcaccagggccagcatccccgtcgttcaggtcgacccctcctttgaaggcctggatggcggagctggtagcttgatcaagtggaaccccgtggccaatgtcgacggcaaggacatctggacattcctgaggaccatggatgtccctgtcaactccctgcatgctcaagggttcgtgtccattggttgcgagccgtgcaccaggccggtcctgccggggcagcacgagcgtgaaggccggtggtggtgggaggacgccaaggccaaggagtgcggcctgcacaagggcaacatcgagaaggacggccaggcggcggcgcccaagcccgccaacggcaacggcaacggcgcggcgggcgccccggacatcttcgagagccccgccgtggtgtccctcacccgcgccgggatcgagaacctgctgcgcctggagaaccgcgcggagccgtggctcgtggtgctgtacgcgccctggtgccccttctgccaggccatggaggcctcctacgtggagctggccgagaagctggccggggccggcgtgaaggtggccaagttccgcgccgacggcgagcagaagccgttcgcgcaggcggagctgcagctgcagagcttccccaccgtgctcctgttcccgacccgcaccgccaggcccatcaagtacccgtccgagaagagggacgtcgactcgctcctcgccttcgtcaacagcctccggtgagacgccgccagggagcgagaaccatcgttctctgcctgtgtcggcatgatggtggtgctggcgtcgctccgtctagaattgtacttagagagggaagaggtatctgagagagggaattggggatgataggaagagagggatggggttcggaaatacttcagatggagatcttgcatctctagctcttgtcactgcaaacggttgcaggtaaacctgaagcctgaggtccggtgttatagggcaaaaggtcgaggttatttgcgtgtacttatagctagtggtgagttggtgacagaggattgtaatgtaaggttaacatcaaataagaaaatcagttttggcagttctttattgttcat

SEQ ID NO: 8317 - DNA, 1751 bp, Brachypodium distachyon
cagcagtcaaacaaaaacatttgccaaccaggagcatcataatcctcggaattcgagaggcggaggagaagggcttctgaggagtaataatcaatggcttccgctactgcttccatctcgtcgcacgcgatcgccctccgcgatctcaaagccgcgaggattggtgccgtgaggcagcaagtggccgcggccccggcggccccggcggtgaggtcccagcgcgcgagggcggtgcgcccgctgtgcgcggcggagccggcgaggaagccgctgtcggcgtccgcggccgcggcgccggtggcgccagtgttggtggaggaggaggcatcggccgtccccgcggccgtggactacgaggccctggcgcaggagctgcagggcgcgtcgccgctggagatcatggatcgggcgctctccatgttcggatccgaaatcgccatcgccttcagtggagccgaggacgtggcgctgatcgaatacgcgaagctgacagggcggcccttcagggtgttcagcctggacacggggcggctgaacccggagacgtaccagctgttcgacaaggtggagaagcactacgggatccacatcgagtacatgttcccggaggccgccgaggtgcaggagctggtgaggaacaaaggcctcttctccttctacgaggacggccaccaggagtgctgccgggtgaggaaggtgcggccgctgaggagggccctcaagggcctcaaggcctggatcaccggccagaggaaggaccagtcccctggcaccagagccagcatccccgttgttcaggttgatccgtcttttgaagggctggatggtggagctggtagcttgattaagtggaaccctgtggccaatgtggagggcaaggacatctggaccttcctcaggaccatggatgtccctgtgaacaccctgcatgctcaaggatacgtctccattgggtgcgagccgtgcaccaggcccgtcttgccggggcagcacgagagggaagggaggtggtggtgggaggacgccacggccaaggagtgcggcctccacaaaggcaacatcgagaaggaaggccaggcacccaaggtcggcgtcaacggcaacggctcggccgaggccagcgccccggacatcttccagagccaggccgtcgtcagcctcacccgccccgggatcgagaacctattgaagctcgagaaccgcaccgagccctggctcaccgtcctctacgctccatggtgcccgtactgccaggcgatggaggcttcctaccttgagctggcagagaagctgagcgggtcgggcgtcaaggtggccaagttccgcgccgacggcgagcagaagccgttcgcgcaggcggagctgcagctgcagagcttcccgacgatcctgctgttccccagccgcaccgcgaggcccatcaagtacccgtccgagaagagggacgtcgagtcgctcctcgcattcgtcaacagcctcagatgagtgggcagagaacaggagaaccatcgttctctgctgcattgcactcgtgcaattgtactccgtatttaggaagtagaggatggttcaaaacatcacacgggattgagggggtccgtcgaatgcagcggctgcaaaagctgtatcctgaaactgaaacccctccattataatggggtggggactttgtagttgtagttagcataagagaggattgtaaggataattccaataagagaatagttttggaaattttgatcatatgctcg

SEQ ID NO: 8318 - DNA, 1893 bp, Oryza sativa
gtacgccacagaaaactcgcagaagtgagggaaaaccaagaaaaaaaaacatttcctgcttccaaattttgtcggaattttgaagggaagaggaaggattcggaggtggtgatggcttccgctaccgcttccatctcgtcccactccgtcgccctccgcgacctcaaagctgcgaggattggagccgtgaagcagcaggtggccgcggccccggcggcgggcacggcggcggcgagggcccagcgcgcgagggcggtgcgcccgctgcgcgcggcggagccggcgaggcagcccgtctccgcctccgcggcggcggcgccggccgccgcgcccgtggcggaggacgccgccgccgccgccgtcgacgcccctgctccggccgtggactacgaggccctggcccaggagctgcagggcgcgtcgccgctggagatcatggatcgggcgctcgccatgttcggatccgacatcgccatcgccttcagcggggcggaggacgtggcgctgatcgagtacgcgaagctgacggggcgtccgttccgcgtgttcagcctggacacggggcggctgaacccggagacgtaccagctgttcgacaaggtggagaagcactacgggatccggatcgagtacatgttcccggacgccggcgaggtgcaggcgctggtgcgcgccaagggcctcttctccttctacgaggacggccaccaggagtgctgccgcgcccgcaaggtgcgcccgctccgccgcgcgctccgcggcctcagggcctggatcaccggccagcgcaaggaccagtccccgggcacccgcgccgccatccccgtcgtccaggtcgacccctccttcgagggcctcgccggcggcgccggcagcctcgtcaagtggaaccccgtcgccaacgtcgacggcaaggacgtgtggaccttcctccgcgccatggatgtccccgtcaacgccctgcacgcccaggggtacgtctcgatcgggtgcgagccgtgcaccaggcccgtgcttcccggccagcacgagcgggaagggcggtggtggtgggaggacgccaaggccaaggagtgcggcctccacaaggggaacatcgacgaccagggtggggcggcggcggcggcggcgcacaaggccggcggcgccaacggcaacgggtcggccggcgcgccggacatcttcgagagcagcggcgtggtgagcctcacccgcgccggcgtcgagaacctgctccgcctggagagccgcgcggagccgtggctggtggtgctgtacgcgccgtggtgccccttctgccaggccatggaggcgtcctacctggagctcgccgagaggctgggcggcgcgggcggcggcgtgaaggtgggcaagttccgcgccgacggcgagcagaaggcgttcgcgcagcaggagctgcagctgcagagcttcccgaccatcctcctcttcccgagccgcaccgcgaggccgatcaagtacccgtcggagaagcgggacgtcgactcgctcctcgccttcgtcaacagcctccgatgagggagagacccgatcggcacagccatcatttgttcttggcatccaatggcaatcgacttggcgacgaccatgatccggtgtattagtattagggtgagatgggttaagttgggaatcggggaggtcagaggaaggggtcggggtcagggttcagatgcagttgctgcatctatagcttttgctgctactgcgggttaatcctggaaagcttctcttctttcggaggaagagggtaatttgggtcgtcgtgtgtacttgtagctagtaataacagaggattgtaagggtaaatttaaataaaaaattttggttatggagctttttgtcatgttataattgtggataggtgctggc

SEQ ID NO: 8319 - DNA, 1675 bp, Panicum virgatum
gctctgcagcttcttctgttccgttcttctatccgcagctaccgctttgcatccccacctctcgtgctcctccccggcctcaccacctcaacaaacatggaggccttcctcgccggcttcttcagggcgcctccccgctgcggacccgcggctcgggctgctccgcctatccccggcctccctctctttcacggcaggcggcgcaggaggccctcctcctccgtggtctgcatggcggagccgtatctcatagcgaagctggattccgcggagaaggcctggaaagaaatgtcggttaggttagcagatcctgacattgtctcagatcctagcgaataccaaaaacttgcacagtctgttgctgaactggatcaggttgtgactacatacaggcagtttaaggattgtgaaaagcaaattgaagagacaaaagctttggaaaaagagaatgaagatgatccggatatgggtgagatgatagcttcagagttggaggctttatctaatcagcttgcagagcttgaggaaaaattgaagttactactgcttccgagtgatcctctagattcacgcaacatcttacttgaagtaagagcaggtgctggcggtgatgaagctggaatttgggctggtgaccttgtacgcatgtatcagaaatattgtgagcgcaacaattggaagtttaagccggtttcttgctcggaagcagaaatgggtggatacaagacatatgtgatggaggttaagggcaaacaagtctatagtaaattgaagtttgagtcaggtgtgcaccgtgttcaacgtgttccccagacagagactatgggacgtgttcatacatcaacagcgactgtagctattatgccagaggctgacgaagtcgatgtggttattgatccaaaagatattgagcttaaaacggcaagatctggtggagctggagggcagaatgttaacaaagtggagacagctgttgatcttattcacaaacctacgggaatacggatattctgtacagaagagagatcacagcttcaaaaccgagagcgggcatttcaattgttgagagcaaaactttacgagataaaattaagggagcaacaagagtcaataagaaaccagaggaaattgcaggttggtactggtgctcgatctgagaagataaggacatacaattacaaggataatagagtgacagatcatcggctgaagatgaattttgaactgactagcttccttttaggagacatcgaatcggctgttcagtcctgtgctacaatggagcagcaggagctcttggaggaaatggccgcttctgtgggcgtggcgaaagtatgatctgcagaattggcccctcagaaacaggtcatcaaattggtgatgtgttcaaatggatgatgattgatggataagttgtacatgaagaattttgacaaaatcaactcagcataggcacagttttttgtagttcatggtcatggtcatgagtcatgactaatgtcaaagtaccaatgcatttcagcttctctgctggtagcagacttttttagtagtaatacacatgctatatacaattcaactgctctgattttcccaattcaatatgcttcaaatgcattgtttcggtgaagtaattgtgtgctgaatttgcaattttttctgaatcatttatttt

SEQ ID NO: 8320 - DNA, 2113 bp, Sorghum bicolor
agctaccttatcttcttcccagcctcccgtcccctgtgcacagtgcctccttcccgaccgccctccccggcgcgaccccgcccggcagcccctctccagctgcggcgcgcccccctcctcggctctaccccgccctgcacacgctccttggtgctccgccgctggtgcctggtgcttctcatccccacctcactcgtgctccgcgcccgtttcaccgcctgaacagagatggaggccttcctcgccggcctcttcagggcgcctccacgcgccgtcgccggccctcggggcacgcctctctccggccttcctctctttcacggcaggcgccgcaggcgaccgtcctcgtccgtggtctgcatggcggagccctatctgattgccaagctggattctgcggagaaggcctggaaagaaatgtcggttaggttggcagatccggacattgtctcagatccaagcgaataccaaaaactcgcgcagtctgtttctgaactggatcaggtcgtgaccacatacaggcaattcaaggattgtgagaggcaacttgaagagacaaaagctctggaaaaagagaatgaagatgaccctgatatgtcagagatgatagcttctgagctggaggctctatctaaccagcttgcagagcttgaagaaaaattgaagttactactgcttcccagtgatcctctagattcacgcaacatcttacttgaagtaagagcaggtgctggtggtgacgaagctggaatttgggctggtgaccttgtacgcatgtatcagaaatactgtgagcgcaacaattggaagtttaagccagtttcttgctcagaagcagacatgggtggatacaagacatatgtgatggaggtgaaggggaaacaagtctatagtaaattgaagtttgagtcaggtgtacaccgtgttcagcgtgttcccctgacagagactatgggtcgtgttcatacgtcaacagcaactgtagctattatgccagaggctgatgaagttgatgtggttattgatccaaaagatattgagcttaaaacagcacgatctggtggagctggagggcagaatgttaacaaggtggagacggctgttgatcttattcacaagcctacaggaataaggatattctgtactgaagagagatcacagctacagaacaaagagcgggcatttcaattgttgagagcaaaactttacgagataaaattaagggagcaacaagagtcaataagaaaccagaggaaaatgcaggttggtactggtgctcgatctgagaagataaggacatacaattacaaggataacagagtgacagaccatcgattaaagatgaactatgaactgaccggcttccttttaggagacatcgaatcggctgttcagtcttgtgctacactggagcagcaggagctcttggaggaaatggccagttccgtgggcgcagtgaacgtatgattcaggcaattcggcgttgagatcaggtcatcaaatagaatcaagaaactcatgatgtgttcaaaaccgatgaagatgattgatagttgtacaagaaactgacaaaatgaactccacataggaaatttttctgtagtccacatggtcatgagttcatgactaataccatagaacacacccatgcatctcagcttccttaacggcagcagattttttagtttagaaaatatacatggtatgtataattcaactgctccagtattcacagtttaatgcattttaggtttgttgttctgtgaaattcttttgttcccaatgtgtaattcttcaagaaaaataattgcaaatacccatttataaagacgctatagccatgtgctgagttaagtgaccagttctccctttccccatccctgtgtcttgtgctgagttaagtggactaccagttcttcctttccccatccctgtcttaatgaaaaacgtagcacgttctggcttacaaaattgttttcacagttataaaaaagactcttgtttttggcattcatagcaaaaattcagttcagctttggggagttaagcttggattgcaagttcacaacctagattttattatacaaaaatttcttccattctgagatgagca

SEQ ID NO: 8321 - DNA, 1648 bp, Oryza sativa
tgctactgctcctcttctcatcgccacgctacctctcaatggaggccttcctcgccggcttccgggcgccgcggccgcgggtcccggccgtctccgccgccgcccggagcctccctcccaacacctccttcttctccggcggaaggcggcgcaggaggcttctttcctcatcggtggtctgcatggcggagccctatctcatagcaaagttggattctgcagagaaggcttggaaggaaatgtcggttagattggctgatcctgatatagtttcggatcccagcgagtaccaaaaacttgcacaatcagttgctgaactagatcaggttgtgagtacgtacaggcagtttaaggactgtgagaagcaaattgaagaaacaaaagttttgcaaaaagagaatgaagatgacccagatatggcagagatgattgattcagagatggagtctctatctaaccagcttgaagagcttgaggaaaaactgaagttactactgcttcccaatgatcctcttgatgcacgcaacatcttacttgaagtaagagcaggtgctggtggtgatgaagctggaatttgggctggtgaccttgtgcgtatgtatcaaaaatactgtgagcgcaactcctggaagttcaaaccagtttccagctcagaagcagaaaagggtgggttcaagacatatgtgatggaggtgaagggcaaacaagtctacagtaaactgaagtttgagtcaggtgtacaccgtgttcagcgcgttcctcagacagagactatgggccgtgttcacacatcaacagcaactgtagctattatgccagaggctgatgaagttgatgtggttatcgatccgaaagatattgaactcaaaactgcaagatctggtggagctggagggcagaatgttaacaaggtggaaactgctgttgatcttattcacaaacctacaggaattcggatattctgtacagaagaaaggtcacaactccaaaatagagaacgcgcattccaattgttgagagcaaagctttacgagataaaattacgggagcagcaggaatctataagaaaccagaggaaactgcaggttggaactggtgctcgttctgagaagataaggacgtacaattataaggacaacagagtgacagatcaccggttgaagatgaactttgaactcactggtttcctcatgggagatatcgagtcggctgtgcagtcctgttcttcaatggagcagaaggaactcctggaggagatggccacatctgtgggcgcagcgaaggtatgatcagcgcgatcgatctgtctgcagtcctccttccacctgagtaccagaccatcagatagaaatcatccaatggacattgtgttgaaacgggtggtgatcaatggacaaatgtacatgaaaaaatccgaagatacatatacatatgcttccgttgctcatgagcatgactaatgtcagaaaacacactgatgcattttcagttcctcttacagttacaaattttgagtagttggatatatgcaatgtgtacatctcaacagttgcatagctacaatatgcattatgcacaattcaacctgttaatagatgggaatgaattatggtgatttgtcaatgtgttcaattgaaatgaatgtgtt

SEQ ID NO: 8322 - DNA, 1998 bp, Brachypodium distachyon
cacaaacggacggtgcacgaggaacacacgaatctcgaggcagatggctagcagaagcagagcagctcttcttcagtttccaccttccgcttcctgtactcggctgttctatcctcagctcgccatcaccacctctcgtcctcccccccgctgcaagaaaagatggaagctttcctcgccggcttccgggcgccgcctcgggctccgaccgcatccaccgcccggagcccgcctcccagccccttcttcctcggctccaagcggcggaggaagccctcctcctccgtggtctgcatggcggagccccatctcatatcgaagctggaatctacggagaaggcatggaaagaaatgtcggctagattgggtgaccctgacattgtctcagatccgagcgaataccaaaaacttgcacagtctgttgctgatctgggcgaggttgtgagtgcatatagacaatttaaggagtgtgagaggcagattgaagaaacaaaagctttgcaaaaagagaatggagatgaccctgacatggcagagatgatagcttcagagctggagtctctctctaaccagctcgcagagctcgaggaaaaactgacggtactgctgcttcccagcgatcctcttaattcacgcaacatcttgcttgaagtaagagcaggcaccggcggtgatgaagctggaatttgggctggtgaccttgtgcgcatgtatcaaaaatattgtgagctcaacaattggaagtttaaaccagtttcttgctcagaagcagaaaaaggtggatataagacgtatgtgatggaggtgaagggcaaacaagtctacagcaaactgaagtttgagtcaggcgtgcaccgtgttcaacgtgttccacagacagagactatgggccgtgtccacacgtcaaccgcaactgtagctattatgccagaggccgatgaagttgatgtggttattgatccaaaagacattgaacttaaaaccgcaagatctggtggagctggagggcagaatgttaacaaggtggaaacagccattgatcttattcataagcctacgggaattaggatattctgtacagaagaaaggtcacaacttcaaaataaagaacgtgcattccaattactgagagcaaaactatacgagattaagttaagggaacaacaagagtcgataagaacccagaggttactgcaggttggtaccggcgctcgttcggagaagatacggacgtacaattataaggacaacagagtaactgaccatcggctgaagatgaatttcgtattgtctagcttccttataggagatatcgagtcggctgttcagtcctgtgctgcgatggagcaaaaggaactcttggaggaaatggctacttcttctgcagtgaaggcatgatcagccaattattccttttgcttcaagcagaccctgtaaaaggacacccaaggacattttacaaccgacagagatcgtgaccaagaccaagttgtacacgaagcaactcggcgattggatttcctcacatacacgcttattgttttgttcatgataactttgcatatacactaatatcgtgagacataatgctacacttgaagagatctctggtggcagcagattttgactagttggaagtagacatgctgtgtacaactgaaaatagacatgggttgcatactgttgatttttcttatgggtcagcagattttgactagttggattttttattaaatccatcatgatacatatcttatacttatttatacatttttctataaatttgatcaaactttaaaaagtttgaattaggacctaactagaacaccttatatctagaaacaaaaggtattagtacctccttaatcatacatgctagcccctgtatcgattttactccctctgttcctaaatgtacgtactgattttgtacgtagttaaactttgaccaaacatatcgaaaaatctgccaacatatatgactctaaattagtttta

SEQ ID NO: 8323 - DNA, 2262 bp, Zea mays
cagatgagttaagtaaatacaaaatttattgatgagaagccgataagtgcttgaggataattgaaagtaaaataagtgtaaaacaatatgataggaatctggggaaagaactcctgttgttgctgcaaatataacttggttgatttgatttgaggaagaaatcgtatttacttggggataagaatgcgatttagtgagctggattcaggttaaggaataagattgctcctagtttttttctattctatttttcagactggcagtcatcctcctagtttttttcttttctatttttcagctaaccttatcttcttcccgcgtcctttccagcctcccgtcccgtgtggcgtctggcgtgtgcgcacgcacctccccaggccccagtgccaccttccctcctcggctcgacccgcccggcgctccgccgcagctggctcatcccaatcccctcgtacagtcgtgctccgcgcccgcttcaccgcctgaacaaagatggaggccttcctagccggcctcttcagggcgcctccacgggccgtccccgcccctcggggcacgcctctccccagccttcctctcttctacggcaggcgccgcaggaggccgtcctcctccgtggtctgcatggcggagccctatctgattgccaagctggactctgcggagaaggcctggaaagaaatgtcggttaggttggcagatcctgacattgtctcggatccaagcgaataccaaaaaatcgcgcagtctgtttctgaactggatcaggtcgtgaccacatacaggcaattcaaggattgtgagaggcaacttgaagcgacaaaagctctggaaaaagagaacgaaggtgaccccgatatgttagagatgatagcttctgagttggaggctctatctaaccagctcgcagagcttgaagaaaaaatgaagtttctactgcttcccagcgatcctctagattcacgcaacatcttacttgaagtaagagcaggtgctggtggtgatgaagctgggatttgggctggtgaccttgttcgcatgtaccagagatactgtgagcgcaacaattggaagtttaagccagtttcttgctcagaagcagaaatgggtgggtacaagacatacgtgatggaggtcaaggggaaacaagtctatagtaaactgaagtttgagtcaggtgtacaccgtgttcagcgtgttcccttgacagaggctatgggtcgtgttcatacgtcaacagcaactgtagctattatgccagaggctgatgaagttgatgtggttattgatccgaaagatattgagcttaaaacagcaagatctggtggagctggagggcagaatgttaacaaggtggagacggctgttgatcttattcacaagccgacaggaatacggatattctgtacggaagagagatcacagctacagaacagagagcgggcatttcaattgttgagagcaaaactttacgagataaaattaagggagcaacaagaatcattaagaaaccagaggaaattgcaggttggtactggtgcccgatccgagaagataaggacgtacaactacaaggataacagagtgacagaccatcgcttaaagatgaactttgagctgacaagcttccttttaggagacatcgaatcggctattcagtcttgtgctacgatggagcagcaggagctgttggaggaaatggccagttccgtgggcgcagtaaacgtatgattcaggcaaattcggcgttgaggccaggccatcaaactgaaccgcgaaactcatgacgtgctcggactcggtgaagatgattgatagctgtacatgaagaaaactgacaagatgaactccccccataggaactttttccccccctgtagtccgcagggtacaacacacacccacccatgcatctcagcttccttgacggcagcagagttactagtagaaaatatacatggtttgtgcagttcaacgcttcaactgctccagtattcacagtttaatgcattttaggtatgttgctccagtttctcaacaattcactgcttgcaattaaatctacagagcaaagttctcagctagctacatttgaaccaatcaatcaaccacttttctttttgaaacgagattttaatctgtttttaagaaaagcatataacagtgttcgtcatccacactactcacagtcacagacaccaaatcactgggcatggcagtttacaaacagcgcaaatcaccaaaagacctgaccaaccgaac

SEQ ID NO: 8324 - DNA, 2145 bp, Setaria italica
cagccattggccctccgatatggactactgcctgcacgaatcttgacgaggcaactgaacaagcaaagacgctctgcagcttcttcagttctttctatcctcagctgctgctgctgctttgcatccccacctctcgtgctcctcctcctcctcctcccccgcctcaccaccatggaggccttcctcgccggcttcttcagggcccctccccgctgcggccccgccgctcgcgctgctccgaccttctccggccttcctctcttccacggcaggcggcgcaggcggccctcctcctccgtggtctgcatggcggagccgtatctcatagcgaagctggattctgcggagaaggcctggaaagaaatgtcggttaggttagcagatcctgacattgtctcagatcctagcgagtaccaaaaacttgcgcagtctgttgctgaactggatcaggttgtgactacatacaggcagtttaaggattgtgagaggaacctcgaagagacaaaagctttggaaaaggagaatgaagaggaccctgatatggctgagatgatagcttcagagctagaggctctatctaaccagcttgcagagcttgaggaaaaattgaagttactactgattcccagcgatcctctagatgcacgcaacatcttacttgaagtaagagcaggcgctggtggtgatgaagctggaatttgggctggtgaccttgtacgcatgtatcagagatattgtgagcggaataattggaagttcaagccggtttcttgctcggaagcagagatgggtggatacaagacatatgtgatggaggtcaagggaaaacaagtctatagtaaattgaagtttgagtcaggcgtgcaccgtgttcagcgtgttcctcagacagagactatgggacgtgttcatacgtcaacagcaactgtagctattatgccagaggctgatgaagttgatgtggttattgatccaaaagatattgagcttaaaacggcaagatctggtggagctggagggcagaatgttaacaaggtggaaacggctgttgatcttattcacaaacctacgggaatacgtatattctgtacagaagagagatcacaacttcaaaacagggagcgggcatttcaattgttgcgagcaaaactctacgagataaaattaagggagcaacaagagtcaataagaaaccagagaaaattgcaggttggtactggtgctcgatctgagaagataaggacgtacaattacaaggacaaccgagtgacagaccatcggttgaagatgaattttgaactgactagcttccttttaggagacattgaatcggctgttcagtcttgtgctacattggagcagcaggagctcttggaggaaatggccagttctgtgggcgtggcgaaggtatgatttgcggaattggcccctgagaaataggtcatcaaactgatggtgtgtttaaacggatgaaaattggtgtataagctgtagatgaagaaatccgacaaaactccacataggcacattttttcagtagttcatgatcatggtcatgactaatgtgacagaacatagcaatgcatctcagcttccctgctggtggcaggtttttgagtagtagaaaatagacatgcttgtacaattcgactgctccggttttcataattcaatatacttcaaatatgctgttcgtgtgaaaaaaattcttgtgttctgaatgggtacatttttctacatcgcttatttccggttcctcctttggtttaaatacgtaaaacaaatgcaaatatctttttatgaagatagttgtacccatgtgccaggctaagtagatgactaattctacagtctcttccctgtatcataatccaagaatgtcgcccgttccggttaacaaattcacagctctgtttttgggattcaaagataattcagctcaccgtacaaaatggacaaactcggtttgagagtaggagagtaagagactcttagcttagcaaaggtctgaagacttcataaacaccggcatgtcggcgaacagcaccggcagctgccgccatggctgctgccaagtccctgctcgccgctgcattctctgacggcggcagccacctcccgttcacgctcctccccgacgatccc

SEQ ID NO: 8325 - DNA, 1713 bp, Lolium multiflorum
cgcgtcgagctcccgccgtccccgccactcggagccctccaccgagccccttcttcctcggcacgcgccgcaggaagccctcctcctccgcctccgtggtctgcatggcggagccccatctcatctcgaagctggagtctacagagaaggcatggaaagaaatgtcggttagattgggtgaccctgacattgtctcagatccgagcgaataccaaaaacttgcacagtctgttgccgatctagaggaggttgtgacagcatataggcaatttaaggaatgtgagaggcagattgaagaaacaaaagctttgcaaaaagagaacggagatgaccctgatatggcagagatgatagcttcagaactggagtctctctctaacgagcttgcagaactcgaggaaagactcacggtacttctgcttcccagcgaccctctaaattcacgcaacatcttacttgaagtaagagcaggtactggcggcgatgaagctggaatttgggctggtgaccttgtacgcctgtatcaaaaatattgtgagctcaacaattggaagtttaaaccagtttcgtgctcagaggcagaaaagggtggatacaagacatatgtgatggaggtgaagggcaaacaagtgtacagtaaactgaagtttgaatcaggtgtgcaccgtgttcagcgtgtaccgcagacagagactatgggccgtgttcacacgtcaacagctactgtagctattatgccagaggccgacgaagtcgatgtggttattgatccaaaagatatagaacttaaagctgcaagatctggtggagctggagggcagaatgttaacaaggtggaaacggctattgatcttattcataagcctacaggaataaggatattttgtacagaagaaaggtcacaacttcaaaataaagcacgcgcgttccaattattgagagcaaaactatatgagataaagttaagggagcaacaagagtccttaagaacccagaggttactgcaggttggcactggcgcacggtctgagaagatacggacgtacaattacaaggacaacagagtgactgaccatcggttgaagatgaatttcgtattgtctagcttccttttaggagacatcgaggcagctgttcagtcttgcgctgcgttggagcaaaaggaactcttggaggaactggccacttcttctgcggtgaaggcatgatcagttcagccatcccttttgcttctggccatatcgtaaaaaggaaacatccaatggcaatattacagtcgatggcgattgacgaccaagttgtacatgaagaagctctgcgattcaaattctgttgttcatggtcattttgcatatatacactaatgtctctaaacagatcggtgcacttgagttgccctgatggtatcagttttgagtagctgaaaatagacatttctacagcaaagcgtcattactggtaatatgtgaggatggactccgtgcaccttattattttgttcacagctgcaggcatctatagtttttacaattaatctgcaggtatctagttcatacttattatggctaggagggagtagaaaattttaaaaaggacacatattgtttctggtgacacctgcgtggctctcgggggtgggggaactccgccaggttaacggcaatcggcggtccctcgtctccctgtttcacgcaccgaagatctctggcttgg

SEQ ID NO: 8326 - DNA, 627 bp, Setaria italica
ccacaacggcctggcccaacccgagagtctagtacacacaccgtctcgccttctctccccttccttcctcaccgagtctccaaaacctagctattctcttcctcgagcagcggcggcggccatggacaagagcatgctcggcgacctggacggcctccccgaggaggacaagatgcgcatggccgccatgatcgaccagctccagatccgtgacagtctgagaatgtacaattccctggtggagagatgcttcacggactgcgtggacacgttccgccgcaagaccctggacaaacaagaggagtcgtgcgtccgccgctgtgccgagaagttcctgaagcactccatgagggttggcatgagatttgctgagcttaaccagggtgtggccacacctgactaaacgtgctggtttgttgcccctgccaagtttctaaccttggggattttgtcagcatcgatttgtaatcctaaaaagattttagcactcgttgagatatgcaactcagttaggttgcctcttgaaccaactgctgctgggtatgaaattgaataaaattaccttgaatcattgaccaatggcacatcgtgcttaactctatccattgatacatgatagctgccgag

SEQ ID NO: 8327 - DNA, 591 bp, Zea mays
ctccgactcacccctctgtcctcgcaagccgccgccggccaagtcctgtccctctcccttgtctggttcggatcgtcgttgctagccaggtgctggatccgtagcggcggcggcggccatggacaagagcatgctcggcgacctggacggcctccccgaggaggacaagatgcggatggccgccatgatcgaccagctccagatccgcgacagcctgagaatgtacaattcgctggtggagaggtgcttcacggactgcgtggacacgttccggcgcaagaacctggacaagcaagaggagtcgtgcgtccgccggtgcgcggagaagttcctgaagcactccatgagggtcggcatgaggttcgccgagcttaaccagggtgtggccacgccggactaagaaacacgctgccgctggctggctgctctcgttgcgcgcccgccgccaggtttctggctttgctggcacagatttgtagccgacaaaaggatttcagcacttccgctgcctgagatatatgcgtcttagagccgaacgctgggtgtcagattgaataaaaactgccttgagaagtgttgtatttcgtttca

SEQ ID NO: 8328 - DNA, 645 bp, Oryza sativa
ggttttagatctcgcttcctctcctctcttcctccaaaaccctagccttcctcctcctctcccggcggcggcggcggcgatggacaagagcatgctcggcgacctcgacggtctcccggaggaggacaagatgcgcatggcggccatggtcgaccagctccagatccgcgacagtttgagaatgtacaactccctcgtggaacgatgcttcacagactgcgtggacactttccgccggaagaccctcgacaagcaagaggaatcctgcgtccgccgctgcgctgagaagttcctgaagcactccatgagggttggcatgagatttgctgagcttaaccagggtgttgccacacctgactaatcaattgggtttggtttctaacgttggcaattttgtcagcataaaatctgtaatccttaaatatttgagtacttgaggatacgagagacatcatgttttcctcttaaaccgatgggcgactgctgggtatcaagttgaataaatttatattaaattcccatattggtagctattgagaagagccatatttctgaatatttttatggtatatcgtgtaatctaattctgttatgtctaatttcatatcctgaggttacaggaaccttaagtacatttttttacca

SEQ ID NO: 8329 - DNA, 1204 bp, Sorghum bicolor
gaacgaaaatattggatctcgtcacctctcccctttcctctccgaggctccaaaaccctagcgttcttgttccctgggcggcggcggccatggacaagagcatgctgggcgacctggacggcctccccgaggaggacaagatgcgcatggccgccatggtcgagcagctccagatccgagacagtctaagaatgtacaattccctggtggagaggtgcttcacagactgtgtggacacgttccgccgcaagaccctggacaagcaagaggagtcatgtgtccgccgctgcgccgagaagttcctgaagcactccatgagggttggcatgagattcgctgagcttaaccagggcgtggccacgcctgactaatcgtgacggtttcattgctcctgcaaagtatctaaccttggggattttgtcagcaccaatttgtagtagtcctaaaagtattttagcactttctgagatatgcggccaaagttaggttgctttgctcttatatcgaataattcaccttgaatcattgtatccatgggtacgtgctgcgtatattgttgctaattctgtatccatccattgatcggttggtgagaagtgtttgttccatactcaatccagcagtttttttttagccacatgaagtgcaaactattgctgctatgttcagatattctttgtagtgtactagacatcatgttacaagatctgtaaaggcacctttcttcatgccgtctcttgatacatctgctttctttgacagcaaagaatgcaggaccattgcacatgagctcatcatgccatgaactgatgcactttgaattggaatttaggaagcccaaaagggagctgtggatccagcacatgtgtctacaccagattgcgctccgggatggcacacgggctggctctgctgcctaacccaagcagctggaggttgaagatggttgcgggagtttgggcatgatcagcttggcatttggtggtttggagcttgtccatggggcaatgtgggcaggttggcccttgtgcccaccacctgctgtgctctccccaagttgccgtgttgttttctcatgtgggggttggacagacatggcctggcttgttgttttctcttgtgggtacagactacagtggcgccgtggtgccatggagaagctgcagcacggcggcagatctcgggctgctgcatggcatgtcgg

SEQ ID NO: 8330 - DNA, 891 bp, Panicum virgatum
gatgtatagaattccccatttattcattccccaagcagaagcaggcaagcagcgggggacgcacaaccaaatcttggcccaagtatcgaaagaataacaaatcttggcccgctgtacagtttatggagcccagcccagttccccagcgtgggcgagacgagcacgcttggacgacgggacggagttgtgggccgcggtgggccgtgcgacatattttctttcgcttcttttccgggaggacaagattggttctcgccctctcccattcctccccgaggctccaaaacctagctctcctcttcctcgggcggcggcggcggcggcggccatggacaagagcatgctcggcgacctggatggcctccccgaggaggacaagatgcgcatggccgccatgatcgagcagctccagatccgtgacagtctgagaatgtacaataacctggtggagagatgcttcacagactgcgtggacacgttccgccgcaagaccctggacaagcaagaggagtcatgcgtccgccgctgcgctgaaaagttcctgaagcactccatgagggttggcatgagatttgctgagcttaaccagggtgtggccacacctgactaaacatgctggttttgttgcccttgccaagttcctaactgtggggattttgtcagcatctatttgtaatcctaaaaagcttttagcactccttgagaaatgcaactcggtaaggttgcctattgaaccaactgctgggtatgacattgaataaaattacctagaatcattgtatccaatggtacattcttcatatcgtggttaacgctgtatccattgatacctgatagctgctgagaagagtttggattctcgtttcgtacttgaatcagcagattttgagc

SEQ ID NO: 8331 - DNA, 1272 bp, Setaria italica
aaaaaaatggatctcaccttcttctctccccttcctctccgagactccaaaacctctccctcttcctcgggcggcggcggcggcggcgcggcggccatggacaagagcttgctcggcgacctggacggcctcccggaggaggacaagatgcgcatggccgccatggtagaccagctccagatccgtgacagtctgagaatgtacaattccctggtggagaggtgctttacagactgcgtggacacgttccgccgcaagaccctggacaagcaagaggagtcgtgcgtccaccgctgcgccgagaagttcctgaagcactccatgagggtcggcatgaggtttgccgagcttaaccagggcgtggccacccccgattaatcgtgtgggtttcatcgcccctaccaagtttctaaccttgaggattttgtcagcattgatttgtgtaatcctaaaaagatttcagcactccttgagatacacaactcggtgtcagctaggttgcttcttgaaccagctgctgggtaaggaattgaataaacttacagatcttgagccacataggtgcatattatctcgttgctatattcaggtattgtttgtagggctagacagcatggtgcaagatctgtaaaggtgcctttcttcttgccctctcataagacatctgccttctttgacagcaaagagtgctggaccatgcacatgagctcatcatgccatgaactgatgcacttggaattggaatttgggaggccaaaagggggtctggatcaaccatcagatcacaatggtttggacgtgatcgcctttggcatcatctcatggcttggagctttggccatgggcgatgtgggcaggttggcccccggccaccttgtgcccactacctgctgtgtcgccgtccaagttggcatgttgttttctcgtgtggagccagagcgaagctgcaggacagatctcgtttggtgttgcgtggcatgggcatgtcggtgctgtagcactgtagctgtagcctgccctactgattcactgaagctgctgctgctcgttctagcgtgtagcgtgtgtgtgattcagagcaaacgagagggaggcgtcagtggtcagtacttgcattgtttgggcattgaggcgtcatgatggcatgatgtgtatagtgtccttttgagcttgctccttgagctttcacactgttttttttatggctctttgatcactggtacagtgttgttggcataagaatcacaggttgtcattgaactagaatcacat

SEQ ID NO: 8332 - DNA, 596 bp, Lolium multiflorum
ccaatatagacgtgcccagcacggtgctctggaggttttagatctcgtctcccctttcctccccaagcccgtcctcccttcttcccccaaaccctagctttcctcgccgtgcggcggcggcggcggcagccatggacaagagtatgctcggcgacctcgacaacctccccgaggaggacaagatgcgcatggccgtcatggtcgaccagctccaagtccgcgacagtctacggatgtacaacaacctggtggagaggtgcttcacggactgcgttgagacattccgccgcaagaccctggacaagcaagaggagtcatgtgtccgccgctgcgccgagaagttcctgaagcactccatgagggtcggcatgcgattcgctgagcttaaccagggcgttgccacacccgactaaccgaatgatgtgtccttgtgtccttgaagtttctaacattggatgtttggtcaggatcagtttgtaatccttgaaaggttttcaagtacttcgtgaacccactgctgctggttatcaagttaaataaagtttatcttgaattatggtatcgaaggcttcttgctgttatgttgcacattgttg

SEQ ID NO: 8333 - DNA, 582 bp, Brachypodium distachyon
ccgaggttttagatctcgtcgtctccccttcctctccaaagccctagctttcctctcctcccccctccttgtgcggcggcggcggcagccatggacaagggcatgggcatgctcggcgacctcgacaacctcccggatgaggacaagatgcgcatggcctccatggtcgaccagctccagatccgtgacagtttgagaatgtacaattccctggtcgagaggtgcttcacggactgcgtggacacattccgtcggaagaccttggacaagcaagaggagtcctgcgtccgtcgctgtgccgagaagttcctgaagcactctatgagggttggcatgcgattcgctgagcttaaccagggcgttgccacacccgactaatcaaaagatgtctccttgccccgtcaagtttctaacattgcgtgttcgatcagcatcagtttgtaatccttgaaagtttccagtacttatgaacccatagccggttgtcaagttgaataaaatcacgttgaattattgtatccaaggtttattcctgtcttgctatatggtttgacacacctttgatatctcaaagagaagagt

SEQ ID NO: 8334 - DNA, 577 bp, Cenchrus ciliaris
tcggcgacctggacggcctccccgaggaggacaagatgcgcatggccgccatgatcgaccagctccagatccgtgacagtctgagaatgtataattccctggtggagagatgcttcaccgactgtgtggatacattccgccgcaagaccttggacaaacaagaggagtcgtgtgtccgccgctgtgccgagaagttcctgaagcactccatgagggttggcatgagatttgctgagcttaaccagggtgtggccacacctgactaaatgtgttggtttgatgcccctgccaagtttttaaccttggggattttgttagcatcgatttgtaatcctaagaagattttagcacaacttgagattcgcaactcagttaggttgcctcttgaatcaactgctgatgggtatgaaattgaataaaattacctagaatcattgtatccaatggcatattgtggttaactctgaatccattgatacgtgatggatgccgagaggagtttggatggcatattgtggttaactcagtatccattgatacttgatggatgcggagaggagtttggattcttgtttac

SEQ ID NO: 8335 - DNA, 406 bp, Echinacea purpurea
gtgtttctagggttttagaagaagtactctcccaaaccctagcagaatcgtactccggtaagcttcggttgtacgttgaaggaagtcaccgacaatggacaaaagcatgcttggagatttggacgctcttcctgaggaagataagctccgaatgtcatccatgattgaccagctccaaatccgcgacagtttgaggatgtataatacactggtggaaagatgtttcactgactgtgttgacacattccgacgcaaaaccctagataagcaagaagagacttgtgtccgcagatgtgcagagaagttcttgaagcattctatgcgcgttggcatgagatttgccgagctgaaccaaggcgctgccacaccagactaagatgcgcttgctgcccttttccgttttgta

SEQ ID NO: 8336 - DNA, 659 bp, Triphysaria pusilla
atttagagtcaaccctttgctttgcattagggtttaagagaacagtgagaaccttttccagagttgtatcgttcagttacctagttgtaccttcaacaataacaacaaaagaatcgtctcgaaatggacaaaagcatgctcggggatttggatgctcttccagaagaagataagcagcgaatgtcagccatgatagatcagctccaaatccgtgacagtttgagaatgtataattcactggtagaaagatgtttcacggattgcgtagatacatttcggcgtaaaactctggataagcaagaagagacgtgtgtccgtagatgtgctgagaagttcttgaagcattcgatgcgtgttggcatgagatttgctgagctgaaccaaggagctcctacacccgactaatatgtcattttgatgtattgatgttacatcatcacataaagaggcctttttcatgttccttgtttcagaacacgcaaaactcttttgcatttctcttcacatatatttctttaacttggtgatgtatcattattttagtttctaataatttccttggagtttttaacttttgttcgtgtgtttggagaaaacaaggtaagatgattattggtttgcttgcatatttatatggagttattattttgtttcttaac

SEQ ID NO: 8337 - DNA, 614 bp, Olea europaea
atagcagaagctcttcgagcataatttctttgaagcaatcaaagatggacaagagcatgcttggagacttggattctctgcccgaggaagataagctacggatgtcctctatgattgaccagctccaaatccgtgacagtttgaggatgtataattcactggtggaaagatgtttcactgattgtgtagacacctttcgacgcaaatctctagacaagcaagaggagacttgtgtgcgccgctgtgctgagaagttcctgaagcactcaatgcgtgttggcatgagatttgccgagctcaaccaaggtgctgctacaccagattaagaaagcctctaattgcattggcaatcatgttttggcacatctaatcgtgtttttatgatagtaatttccagttataaattatgatttattgcagaatttgtgacgtgcttttattcaatcaacaatgactacgaggttcctttggagttttaaagattttgtattactagttgggttaaatccacctatggacactcaattttatatttagtgttactatggccactcagtttgaattagtttaattatggccatccaaattcatatttaatgtcaacttggtctccc

SEQ ID NO: 8338 - DNA, 537 bp, Ocimum basilicum
cgaatgcagggggcaacactgtggacctgtttgcttcactagggctttagaagcagtaatctcaaaccctcgtgtagtcgaagctgtactccgcggagccttggttgtacgttgaagaacatcgtctcgtcgacaatggacaaaagcatgcttggtgatttggatgctcttcccgaggaagacaagctccgaatgactgccatgatcgaccagctccaaatccgtgacagtttaaggatgtataatacactggtggaaagatgtttcaccaactgtgtagacacgtttcggcgcaaaactctagataagcaagaagagacttgtgtgcgcagatgtgcggagaagttcttgaagcactctatgcgcgttggcatgagattcgcggagctgaatcaaggagctgccactccagattaagatggggttgtttctagttgagttgagggcatacattacttcatagatttttggagatctgtttggaattctaacttttacaataaggtaagatggtgatcagtttttatcccttcccct

SEQ ID NO: 8339 - DNA, 266 bp, Cenchrus ciliaris
tcggcgacctggacggcctcccggaggaggacaagatgcgcatggccgccatgatcgaccagctccagatccgcgacagtctgagaatgtacaattctctggtggagaagtgcttcactgactgcgtggacacattccgccgcaagaccctggacaagcaagaggagtcgtgcgtccgccgatgcgccgagaagttcctgaagcactccatgagggttggcatgaggttcgcggagcttaaccagggcgtggccacccccgactaa

SEQ ID NO: 8340 - DNA, 431 bp, Olea europaea
caaattatcgccctcaaacccttctactcgcttattagggttttacagaactgatcttatagcattagtaacttgtgcatagcaactggtacaatcagtcgaagatggataagagcatgcttggagacttggactctctgcccgaggacgataagctccgaatgtcctccatgattgaccagctccaaatccgtgacagtttaaggatgtacaactcactggtggaaagatgtttcacagattgtgtagacacctttagacgcaaatctctagacaagcaagaggagacttgtgtacgccgctgtgctgagaagtttctgaagcactcgatgcgtgttggtatgagatttgctgagctcaaccaaggtgcagctacaccagattaagatacctgagatttacatttgcaatcatgttctggcacatctaat

SEQ ID NO: 8341 - DNA, 289 bp, Cenchrus ciliaris
tcggcgacctggacggcctcccggaggaggacaagatgcgcatggccgccatgatcgaccagctccagatccgggacagtctgagaatgtacaattccctggtggagaagtgcttcacggactgcgtggacacgttccgccgcaagacccttgacaagcaagaggagtcgtgcgtccgctgctgcgccgagaagttcctgaagcactccatgagggttggcatgaggtttgcggagcttaaccagggcgtggccacccccgactaatcacgcgggtttcgccacccctg

SEQ ID NO: 8342 - DNA, 675 bp, Mimulus guttatus
ccttgttcatcaattcttccacacaaaacctctgcaaaaatggacaagagcatgcttggagatctggacgctcttccagaggaagataagctccgtatgtccgccatgatcgaccagcttcaagttcgcgacagtttaaggatgtataattcattggtggaaagatgtttcactgattgtgtggactcgttccggcgcaaatctctcgataagcaagaggagacttgtgttcgtagatgtgctgagaagttcctgaagcattccatgcgtgttggcatgagatttgcagagctcaaccaaggtgctgctacaccagattaacgagatctgtcataatcttattcttcaatagcatttgcattgaaaagttgaagttgaaacaaaacactattttttgggttttttggtattattttctttttttttttgggagaaaaaaataagatgaaaacggtcctcttgttttgttttttttccgtggcaaaaaaatgcattgctatttgctagtgcttttatagcttatgcttactgagattgaagttgcaacagacatcaacgatgttgtactgatcaatttttttcttaacctaacagctgtatgtagttgaagtaatgttctgctttttcgcctttatacaagtgctaaataccctgattaaattatgttactttccc

SEQ ID NO: 8343 - DNA, 693 bp, Nicotiana benthamiana
agtagctgcaattggtctggttctctccccaaaacactagcagtagtgttggatcagatttaagaatcaagatggacaagagtatgattggagatttggattcactacctgaagaagataagcttaaaatggccgccatgattgaccagctccaaatccgtgacagcttgagaatgtacaattccctggttgaaagatgtttcacggattgtgtagacactttcaaacgcaaaactttggacaaacaggaggagacctgtgtcaggcgatgtgctgagaagttcttgaagcattctatgcgtgtgggtatgagatttgcagagcttaaccaaggcgcaccaacaccagattaaaatgcttctagtttatgcctgcagttcagctcctcattaccgtaggcattgtctattgcgtgttagttaagtaggaaaaggaggtagaagttccatgcatatccttcgtttttggatcaacagctttcctcgtcagatcaattagtatactgtactttttacttctcaatcccaaaatatttcagagtgaaaaatattagaaactcgaacagtagaactggactagattggtcatttgctgttaccatagcattcttttgtggcagcattcaggaaaataatttggtattcaatttcgtcaagaatgcatttatacctttttcgctgtttattctattta

SEQ ID NO: 8344 - DNA, 587 bp, Vitis vinifera
aacccctaaaccctaaccctaatttgagatcagtcaatcatggacaagagcatgctaggagatctggactctcttcctgaggaagataagcttcgaatgtctgtcatgatcgaccagcttcagatccgcgacagtcttagaatgtataattcactggtggagagatgttttagtgactgtgtggagagcttcaggcgcaaatcccttgacaagcaagaagagacctgcgtccggcgatgtgctgagaagttcttgaagcattcgatgcgtgtgggtatgagatttgcagagctcaaccaagggacagcaacaccagattaaaagcccttaagcaaccatgggtgcaaaacatgttcaaacttgccccaggaggatttagtggttgttacaaaaatggaaatgtttctgttcttagtttacatacgtttcttcccccagtgcagtacaatgggtgcaactacaggaatttcctcgttaggaataagcctcaagcaaattatacccctgtagctttccagaagattgatgaatgactttcagtaactgaattttgattcatgcagattttggatatttgagcattttaa

SEQ ID NO: 8345 - DNA, 574 bp, Chenopodium quinoa
gcaaaaatggacaagaacatgctaggagacctcgacaatcttcccgaagaagataagatgaaaatggccgccatgatcgaccagctccagattcgcgacagtctaaggatgtacaattctctggtggagagatgcttcacagactgcgttgactccttccgacgtaaaactcttgacaaacaggaggagacatgtgtccggaggtgcgctgagaaattcctgaagcactctatgcgtgtgggtctgagatttgcagagcttaaccagggcgctcctacccaagattaatcatatgcgcttgtgcataactgataccaagtccatagcattgattgtttttagtatcttccagcattagtgggaattttgcctttgtttgacctctgataagctggattgttcctcatttatcgaggatgatgatacatctaagtatgcaggtcaaatgcaattttggggtattttcatactgacgataggatgacttgattcagaaactgtgattacagctgaaattttagccttggcttaaaaatctctgcttaaatttctagacatctttctcctaaaacct

SEQ ID NO: 8346 - DNA, 779 bp, Mimulus guttatus
tagtagtataggggtgcaatttatttttaaccctagttttatcaaatgttaatttcttgcgactcgagaaaggatccgaaccgttaatcaccagtattgaatctatagctagggttttagggttcttcgttgagatacagtgtttgattttgtttccgttgcagcactttggcgaaaacattgaaaatggacaagagcatgcttggagatctcgattctcttcccgaggaagataagctccgtatgtccgccatgatcgaccagcttcaagtccgcgacagtttaaggatgtacaattcattggtggagagatgtttcaccgactgtgtggaaagtttccggcgcaaaaccctagacaagcaagaggagacttgtgtccgtcgatgtgctgagaagtttctgaagcattcgatgcgtgttggcatgagatttgcagagctcaaccaaggtgccccaaccccagattaagtcgttttttttccacctatatgaagcaatcttcggtcaatgtgattccattcctcagaagttcgattttttattcggattttaggagaaactgaaaaataagatgaaagatgctcctcttcttgttaaatcagatatttacttttcctagacgaaaaatgcatttattttatttcttatcgagattgaaggtgcagttggaggtttgttaaaagacaacaacattgtgctgatcaaatttgtcttcacagctacatatttttgtttctcatttcaaagttatcagtatatattattttcaaaaatcacaa

SEQ ID NO: 8347 - DNA, 602 bp, Panax ginseng
aaggttgaatagagatcatccctggtctaaagtctaaaggtttcccttcacaatctggagaatctctttgtcaggaatttttcctgtgccgtatgtgtctacgaaaacggacaaaggctcgggaacacgaagcagtggtatcaacgcagagtacaggggggaaattcgaagatggacaagaatatgcttggggacttggattctcttcccgaagaagataaagtgagaatggcttccatgatcgaccagcttcaaatccgtgacagtttgaggatgtataactcgctggttgaaagatgtttcactgattgtgttgacaccttccgacgcaaatcccttgataaacaagaggagacatgtgttcgccggtgtgctgagaagttcttgaagcattcgatgcgcgttggcatgagatttgctgagcttaaccaaggtgcacctgcacaagattcctaaaatacattaggaagggacttatgtaacagatgtagtagtatagacgagtgatcttattaatagttttggaatactgtcacctttctggcaggagtacataattttttaagtctgatccgtacgagggagagatctaataaattgga

SEQ ID NO: 8348 - DNA, 519 bp, Chenopodium quinoa
agctgtggtgatagaaacacgaataagagaggcacaacattcagcaaaggttttagatagagaattgtagcctgcaactctgcaaaaatggacaagaacatgctcggagacctcgacaatcttcctgaagaagataagatgaaaatggccgccatgatcgaccagctccagattcgcgacagtctaaggatgtacaattctctggtggagagatgcttcactgactgcgttgactccttccgacgtaaaactcttgacaagcacgaggagacatgtgtccggaggtgtgctgagaaattcctgaagcactctatgcgtgtgggtctgagatttgcagagcttaaccagggcgctcctacccaagattaagcatatgcgcttgtgcataactgatgccaagtccatagccattgattgtttttagtatcttccagtattagcggggaattttgcctttgttggacctctgataaagtgataagctggattgttcctcatttatcgaggatgatgatgcat

SEQ ID NO: 8349 - DNA, 580 bp, Chenopodium quinoa
agctgtggtgatagaaacacgaataagagaggcacaacattcagcaaaggttttagatagagaattgtagccggcaactctgcaaaaatggacaagaacatgctcggagacctcgacaatcttcctgaagaagataagatgaaaatggctgccatgatcgaccagctccagattcgcgacagtctaaggatgtacaattctctggtggagagatgcttcactgactgcgttgactccttccgacgtaaaactcttgacaagcacgaggagacatgtgtccggaggtgtgctgagaaattcctgaagcactctatgcgtgtgggtctgagatttgcagagcttaaccagggcgctcctacccaagattaagcatatgcccttgtgcataactaatgccaagtccatagcattgattgtttttagtatcttccagtattagcggggaattttgcctttgttggacctctgataaagtgataagctggattgttcctcatttatcgaggatgatgatgcatttgtgtttgcaggtccaatgcaattttggggtgttttcataatgacaataggatgacttgat

SEQ ID NO: 8350 - DNA, 765 bp, Vitis vinifera
ccgatgggcaacgatttcgttgagagttggcttgtgtatatgaagcatggcctggtagttggttggactgttgtaagtcagtagggttttagggtttggggttttgggaaagaggaggaggaggagtccaaaacctcattgttccataaggcggtgaagatggataaaagcatgctaggagacttggactctcttcccgaggaagctaagctccgaatgtctgctatgatcgaccagctccagatccgcgacagtctaaggatgtacaattcattggtggagagatgtttcaccgattgtgttgatagcttcccgcggaaatccctagacaagcaggaagaaacatgtgttcgcaggtgtgctgagaagttcctgaagcactcaatgcgtgttggcatgagatttgcagagcttaaccaaggaacagctacacaggattaagtgttagctcatcaactttttgcaatggaaaaccaatcggaaaatgttgaaatggtttatcattggagtatgggtttaggatgggttttgttattttgttatacgtctgcatttgtgattaaatctgataaccttgtttaaggtagcattatatactgggacggaaatgaattaaaaacttcattttgagtgtcttgtttctcattgaaaggattagggagacttgttgtcatgattaatttgtcatgacttatgaatcttgatagatgttgtagaaacatcatggttagccattttttgtaatggagacgaggcagaatatgg

SEQ ID NO: 8351 - DNA, 812 bp, Prunus mume
atagcatgctcaaatccaacggccactatcaccttactacgactcagaagacagagctaacaaacggcgccgtatcatatccgtctcctcgaaatctagggttttaactcggtatataggggaagcgatctgctacaacgatcttggtccataaaccccaacttcgtgattttccagagagagtaactaatttagcaaaaatcctgaaatagttgataaatccaagtatggacaagagcatgataggagatttggattcccttccagaggaagacaagctcagaatggccactatgatcgatcagctccagatccgcgacagtttgaggatgtataactcacttgttgagagatgcttcactgattgcgtcgataccttcaagcacaaatcgttgcagaagcaagaggaaacctgtgtcaggcgatgtgctgagaagttcctaaagcattcaatgcgtgttggcatgaggtttgcagagctcaaccagggagctgcaacacaagattagtcatcaaatcacaagaggatgcggtcacaccatcttggtctttcctttctttgtttttcttggagagtctccccctttttcttatttgaaaaaacgtaacggacaaatagtggttgtacccatttttcacgatttcacttttttggtcaagggaaaacagcaaattgtattctgtagatacttgggatctgaagttgctgtcagataagaatttttactgttactaatccaagcaatgtagcaatccatgacttccttaatgtgatgaataaattgctttgttcttatatttatcgtgacaga

SEQ ID NO: 8352 - DNA, 443 bp, Zostera marina
tatattaaagccctaaaaaactatcgcaacgacaaatcgacaccggcgaaattgagagaagatggacaagagtttattgggtgatttggattctttaccggagggtgataagattcggatgtcgcagatgattgaccaacttcagatccgagacagtttgaggatgtacaattcactggtcgaaagatgtttcactgactgcgtagacacttttcgaagaaaaaccctagataagcaggaggatacttgtgttcgccgatgcgcagagaaatttttgaagcattccatgagagttggtttgagattcgccgagctcaatcaaggagcaccgacaccagattaaactatttcccatgtttcctccacagaaggaagcagtctcatgtgttggcataaactacattcaattcaggctgttaattttggtttcattgagatactac

SEQ ID NO: 8353 - DNA, 780 bp, Panax ginseng
aagcagtggtatcaacgcagagtacgcggggaattaacagaagacgtgggactttaccaatctcagactgttacctagggttgtagacagacaaattgttgttcggaagagaagacgaaagagggcagagagaagtagccgaagatggataagaatatgcttggggatttggactcacttccagaagcagataagttgagaatggcctccatgatcgaccagcttcaaatccgtgacagtttgagaatgtacaactcgctggtggaaagatgtttcactgattgcgttgataccttccgtcgcaaatcccttgataaacaagaggagacgtgtgttcgccggtgtgctgagaagttcttgaagtactcgatgcgcgttggcatgagattcgctgagctcaaccaaggtgcacctacacaagattcctaacttttgtgacgcatgtagttacaacaagcaatctttattaattttggattactgtcacttttgtggtacccatatctaggaccccagaatctttgaagttctgatgcatatgagagatttaataaattggagtgagatagaatttaattcgtgtatcttgcaaagatgaatgaaattaccattagatatgacttctcaaagaagtggctgtgtttcttctcttttggttggtatcaaaattcaaaactcactcctctagttaactaggttgaaattaaatactggatgagcttgtggaattgaaattgtagcgtcaaaaaataaataaataaattattactgttctaaaaa

SEQ ID NO: 8354 - DNA, 732 bp, Panax ginseng
agacagacaaattgttgatcggaagagaagacgaaagagggcagagagaagttgtcgaagatggataagaatatgcttggggatttggactcacttccagaagcagataagttgagaatggcctccatgatcgaccagcttcaaatccgtgacagtttgagaatgtacaactcgctggtggaaagatgtttcactgattgcgttgacaacttccgtcgcaaatcccttgataaacaagaggagacgtgtgttcgccggtgtgctgagaagttcttgaagcactcgatgcgcgttggcatgagatttgctgagctcaaccaaggtgcacctacacaagattcctaacttttgtgacgcatgtagttacaacaagcaatctttattaattttggattactgtcagttttgtggtacccatatttaggaccgcagaatctttgaagttctgatgcatatgagagatctaataaattggagtgagatagaatttaattcgtgtatcttgcaaagatgaatgaaatcaccattagatatgacttctcaaagaagtggcagtgttgcttctcttttggttggtatcaaaactccctcctctagttaactaggttgaaattgaatactggatgagcttgtggaattgaaattgtagcatttacccccattggttccaatcctcataattggcgtcaaaatctccctatcaaataaataaataaattattactgttcaac

SEQ ID NO: 8355 - DNA, 796 bp, Panax ginseng
ccgggctgctggagttgctctaatgagagggagttataagggtgagggtgcaattaatacaaaaatgaggatcaaagacgagcgaatcccacgagggtttgaattgtttttgttccaaagagaataaaaggaaaggggagattagagagagtacataaattcgaagatggacaagaatatgcttggggacttggattctcttcccgaagaagataaagtgagaatggcttccatgatcgaccagcttcaaatccgtgacagtttgaggatgtataactcgctggttgaaagatgtttcgctgattgtgttgactccttccgacgcaaatcccttgataaacaagaggaggcatgtgttcgccggtgtgctgagaagttcttgaagcattcaatgcgtgttggcatgagatttgctgagcttaaccaaggtgcacctacacaagattcctaaaatacatttaggaagggacttttgtaacagatgtagtagtatagacgagtgatcttattaatagttttggaatactgtcacctttctggcaggagtacagaaatttttaagttctgatccatacgagggagatctaataaattggattaatgaaatgaaaggaatttcccatctagtcaaaactaggctgcagttgaggtgctggatgagcttatggaattggaactgccagcaacttattctgcatatgccctcttcttgcatagcaatttttatcaggtgatgtgataagtgttttaatagcgaatcctgatccaacttctcctctaaaaaaaaaaaaaataa

SEQ ID NO: 8356 - DNA, 665 bp, Nicotiana benthamiana
aaggtaaaaacaactgctgtttttggttatagttcagccctagcagaaataaagagctcaaaaaatggataaaagcatgttaggtgatttggataatcttcctgaagcagacaagcttaaaatggcttctatgattgaccagctccaaatccgtgacagcttgagaatgtataattccctggtggaaagatgtttcacgggatgtgtagacactttcaaacgtaaaactttagacaaacaagaggagacctgtattacgcgatgtgctgagaagttcttgaagcattcaatgcgtgttggtatgaggttcgcagagcttaaccaaggtgcagcaacacaagattaagatgatgcaatccaaattcttcattacctcaagtatttatcttctttaaagagtttcttgacaaggaacaagagcagaagttcctaacacaacctttatttttttatatttaacacatttcctagcaaagaggtattactgaaatgttcttttgtttctcaaatccaggaattctggagttagaatgagtttttagtaacttgaatttagtctcgtgtccatattgaagagtacttgcgaattgcgattaaaattgcattctttttgtggctgtgtttgagaaaatgcccacaggctactcagagacctttgttccttc

SEQ ID NO: 8357 - DNA, 785 bp, Nicotiana benthamiana
gtagctggtattgatctggctctctcaccaaaacacaagcagtagttgaatatagtgttggatcagatttaggaatcaagatggacaagagtatgattggagatttggattcactacctgaagcagaaaagcttaaaattgccgccatgattgaccagctccaaatccgtgacagcttgagaatgtacaattccctggttgaaagatgtttcacggattgtgtagacactttcaaacgcaaaactttggacaaacaggaggagacttgtgtcaggcgatgtgctgagaagttcttgaagcattctatgcgtgtgggtatgagatttgctgagcttaaccaaggcgcaccaacaccagattaaaatgcttctagtttatgcctgcaattcaactcctcattaccgtaggcatttgtctattgcgggttagttagttaaggaaaaggaggtggaagttccatgcatatccttcgtttttggatcaacagctttcctcgtcagatcaattagtatactgtactttttaattttgaatcccaaaatatttcagagtgaaaaatattagaaacttgaacagtagaactggactagattgcaggtcatttgctgttaccatagcattcttttgtggcagcattcaggaaaataatgtggtattcaatttcgtcaagaatgcatttatgttgcctttttcgtttttttatgctatttaatgaacttgaagttgatagagctcaattattaactaaaaaaataagaatttgatatactttagtggaaattgtt

SEQ ID NO: 8358 - DNA, 1022 bp, Panax ginseng
aggttcatatcaagtttctgcattcaaaatgataagccatagatgaatccagtgatcccatatatggattataatacaaattgggatgatcaaatggtcaattaacagaagaagtgggactttaccaatcttagactgttacctagggttgtagacagacaaattgttgatcggaagagaagacgaaagagggcagagagaagtagtcgaagatggataagaatatgcttggggatttggactcacttccagaagcagataagttgagaatggcctccatgatcgaccagcttcaaatccgtgacagtttgagaatgtacaactcgctggtggaaagatgtttcactgattgcgttgacaacttccgtcgcaaatcccttgataaacaagaggagacgtgtgttcgccggtgtgctgagaagttcttgaagcactcgatgcgcgttggcatgagatttgctgagcttaaccaaggtgcacctgcacaagattcctaaaatacattaggaagggacttatgtaacagatgtagtagtatagacgagtgatcttattaatagttttggaatactgtcacctttctggcaggagtacataattttttaagttctgatccgtacgagggagagatctaataaattggattaatgaaatgaaaggaatttcacatctagtcaaaattaatggtgggaattttttgttttatctcatttccttctgcaattaactaggctgcagttgaggtactggatgtgagcttatggaattggaattggaattggaattgccagtctgccagcaacgtattttgcatatgccctctctcttgcagcaaacaatatagcaatttttatcaggtgatgtgataagtgttttaatagtgaatcctgatccaacttctcctctcttcggtcagtcagttcaaaaataataataataatagatacttaaaaattaaaaaaaaaaaaaaacaaaaaaaataaattgagaactacgaccaaaggacacaacgagggagtagc

SEQ ID NO: 8359 - DNA, 627 bp, Prunus mume
taaaaccccaaaactgttggaatcaaagacgaagatggacaagggcatgctggcagcggacttggagggtcttcctgaagaagataagcatagaatggccaccttgatcgaccagcttcagattcgtgacagcctgaggatgtacaattcattggtggagagatgctttacagactgtgtagacacctttcagcgcaaagccctgaccaagcaagaggattcttgtgttcgtaggtgcgccgaaaagttccttaagcattcgatgcgcgttggcatgagatttgcagagcttaaccaaggagcagcaactcaagattaagctaagctccatatgaatcatctttggcatggaaatcttataaaccttttgaattggtttatgacaggtgcaattggtttacccttggttttagaattatgcttcttacattgattggatttgtacccttataaagaagaaacttcttgtcaggttttacagtttagctggatatgaatcagttgctaacttattacatataaattttgttccatttccatatgttcttggaaaggcatgaacaaaaacttttgcccattttccatatcagattgtgtgactttacaataagagaagctgtgtaacta

SEQ ID NO: 8360 - DNA, 2129 bp, Centaurea maculosa
gagttgacaattgcttggttcaacgagatttggatctggtttgctgttcttccccttttcgatccaatatttgccctaattttgcaatcccttatttctagaccctaaacaatcgattgcattaatttcatagcgattgaaagatcgatactgccagatctgtttcaaatttcgcctaattttcattcaattcgaaggaaatcaaacaatcgagcaacaataagtgtgtgtgtgtgtgtgtgattagaggttgtgatttgtgttacagagagcattgccattagaaagaatggggtgctctttctcaggacttaacgctctatacgattctgctgccagtgatgtttggatcaacgaaactcggtataaaatcgttcgtcagctcggtgaaggtggttttgcgtttgtgtttttagttaaggaggtgatcaatgagtcctccgatggtggcttatcgaagaaattcaaagatccgtctcacatatctgatgatggaacttatgctatgaagaaagtcttagttcagaataatgaacagttgcaattcgtgaaggaggagattcggatctcgtctctgtttaaccacccgaatctgcttcctttacttgatcatgccattatttcagtgaagggcacaccagaacaaacttggacacacgaagcatatctattattccctgcccatttggatgggacattgctggaccatgcaaaaactatgaaagctaagaaggagtccttttctacctctgatgttcttgaaattttccgtcagctttgtgcaggacttaagcatatgcataatcttgaaactccatatgcgcataacgatgtgaagcccggaaatgtccttttaacacatcgtaaaggacagccaccattggctgtgttgatggatttcggaagtgcccgtcctgctagaaggcaaatccgttctcgatcagaggcacttcagctacaggaatgggcagctgagcatgtttcagcacctttccgatctcctgaattgtgggattgcccgagccaagcagacattgatgaaaggactgatgtatggtctttaggttgcactttgtatgctataatgtatggtgtttctccatttgagtatgcactaggggaatcaggaggaagcttgcagctggctatcgtaaatgcacagataaaatggccaacaacccctaaaccatcgtatccggaagccctccatcagttcatttcgtggatggtccagccccaagcgaccgttcggcctcgcatagacgacatcctcatccacgttgacaagttgatcaccaaattctccaattaaaaccctacttcgctccatttgtatcctttcgttagtggttatacatccactttatagataccatcagtcttaaatttgaagtaagaaatgtgaacaacaagatgtgagttgagttgctagtttattgtcattagataatgtttttggtgtaccattttggttagaaatattgaagttgcagttgtttatgtaatatttatgggatgggagtactatttaaaataatatattcaaagtggtttgtttgtgtaacataaaaacataacatcatatataataaaccagtaaatttcgagtacttgtgtcaagagctacaaaacaggggagaagccaaagatgcgtgcaatcgttaacgaaaagacgtttatataaaaaaaactagcaatcgcatctaaacatatttatggtgtttacttgaagactaaagcaattctattacctcaaagcaaaagagggcggccattttaagcatattagttgtaaaaaactgattttagtcttgggtagcggcaccttggttgagttcagcaaatctcaatccaacacgcattgaatgcttcaaaaacttctcagcacatctgcgcacacacgtctcctcttgcttatctaacgttttgcgtctgaatgtgtccacacaatctgtaaagcatcgctccacaaggttgttgtacatcctcaggctgtcacggacttggagctggtcgatcatggtggccattcgagcctgatcttccgctggaagatttcccaaatctccgagcatttttgtccattttcggctattctttgatttcgatctccttctgtctcccccgcc

SEQ ID NO: 8361 - DNA, 668 bp, Festuca arundinacea
agtggtatcaacgcagagtacgggggggtacgtttgttccttagtcacggcgccctggtatctggaggttttagatctcgccgtcttccctttcctcacccaaacccgtccccagttcctcccccaaaccctagctttcctcgccgtgcggcggcggcagccatggacaagagtatgctcggcgacatggagaacctcccccaggaggaccagatgcgcatggccgtcatggtcgaccagctccaagtccgcgacagtctacggatgtacaataacctggtggagaggtgcttcacggactgcgttgagacattccgccgcaagaccctggacaagcaagaggagtcgtgtgtcaagcgctgcgccgagaagttcctgaagcactccatgagggttggcatgcgattcgctgagctcaaccaaggtgctcccacacccgactaaccaagtgatgtctccttgcctttcaagtttctaacattcgacgtttggtcaggatcagtttgtaatccttgaaaggtttttcagtacttcgtgaacctgctgctggttatcaagtaaaataaaattacgttgaactattgtagcgaagtcttcttcatgtaatgatgctacacattgttgctcagtagattgttatgtcctttgatatcttactgagaagcgtt

SEQ ID NO: 8362 - DNA, 675 bp, Panax ginseng
aagttgaaagagacctcagagcataaaaccctagttcgcaagttcaaaaattttacccgagaaatctaggaaaagttggctaggagagaagatggacaaaaacatgctaggagacctttcatctcttcctcaagaagatcaggctaaaatggcttccatgatcgaccagctccaaatccgcgacagcctgaggatgtataattcccttgtggagacatgttttactgattgtgtggacatgttcagacgcaaaaccttggacaagcaagaggaaacatgtgtaaggcgatgtgcagagaagttcttaaagcattcgatgcgggttggcatgagatttgcagaactcaaccaaggagccgccacccaagattaagcaattgcacttgaaatttataatttgaccacccaagatttttgtagtgaaacaatttctaattcttatgttatcattgtcaattgtggtcatgatgaaaaatagatagcaagttatatccatcaacgaagttcctttttcctaatagtaaccttaggcaggaagcctccaaggtgcttttcacatgacttgttttgtttgtaatttcttgaaccaatctttggagttgtaaacatggtgatatctataccatgtagctgtactgtcatattaatgtgctatacgtgtcagaaaataatgtt

SEQ ID NO: 8363 - DNA, 750 bp, Solanum lycopersicum
gattagggttttagatataagaatcccattttcccctataacagtggctgcttatacctctgttcttccccaattacaaccaaagttgctgaatcaaattgagggatcaagatggataagagtatgatcggagacttggattcacttcctgaagcagataagatcagaatggcagccatgattgagcagctccaagttcgtgacagcttgagaatgtataattctctggtcgaaagatgtttcacggactgtgtagacagtttcaaacgcaaaactttagacaaacaagaggagacctgtgtccgacgatgtgctgagaagttcttgaagcattctatgcgtgtaggactgagatttgcagagcttaaccaaggtgcaccaacaccagactaagacgcttctgttatgtgcctgcaattcaatttctcattattgtttattgtgggttaatcaacaaggacaagtagtggaagttccttattttggaaagtcaacagctctcctcgtcgttattggtaaaatgtacttctacagttaaattattagaaacttgaatagtagaactggatcctgtaactgattgcaggccacttgctgttacgatagcattcttttgttgtgacgttctagtaaaataatgtggtattcaacttcatcaaggagatatatctgttgccttttctgttatgataacaatttttgaacttgaagttgagaaatggatttttgctgaaatgattaatcttttgt

SEQ ID NO: 8364 - DNA, 634 bp, Echinacea purpurea
gttttcgtttcagctgaacacaatcgcagtcgaaaatggacaaaagtatgctcggagatttgggcactcttccaccggaagatcaagctcgcatgtcgacgatgatcgatcagctccaaattcgtgacagtctaaggatgtacaacacgcttgtggaaagatgctttacggattgtgtggattcattcaggcgcaaaactttagacaaacaagaggaaacatgtgtgaagagatgtgctgagaaattcttgaagcattcaatgcgggtcgggatgagattcgctgaactcaaccaaggggctgccactcaagatgaatagatattaaaccaaggttatattttctatttttgtttggaagcgttctctgagataattttgctttaggttttttatttaatagtacaattatcaagtgatgtatgtgcttgctgatattcataaatgtagttttgtttatcaaagattctgtcgacagtacaaccttaaaaaatgattcctcattcttgtgatgtatgctatgtgtggtggttgtcatgaccttggtttaaagatgcatgatgcgtgatgagcctgatgcattggtgaaacacattgttgctgttgatgtgctccgaattcatgatgcacaggtg

SEQ ID NO: 8365 - DNA, 544 bp, Centaurea maculosa
aggagatcgaaatcaaaagaatagccgaaaatggacaaaaatatgctcggagatttgggaaatcttccagcggaagatcaggctcgaatggccaccatgatcgaccagctccaagttcgcgacagcctgaggatgtataacacacttgtggagcgatgctttacagattgtgtggacacattcagacgcaaaacgttagataagcaagaggagacgtgtgtgcgcagatgtgctgagaagttcttgaagcattcaatgcgcgttgggttgagatttgctgaactcaaccaaaatgccgctacttctgactaaaatcgtgtttttacacctattatgcttaaaatgaccaccctcttttgttttgaggtaatagaattgctttagtcttcaagtaaacaccataaatatgcttagatgcgattgctagtttaaaaaacgtattttcgttaacgattgcatgcatctttcgcttctccttctttttgtagcttttgacacaagcacttgattttactggtttattatatatgattgatatcttttt

SEQ ID NO: 8366 - DNA, 725 bp, Lupinus angustifolius
gggttttaccttcaacggcagaacaaagttgcaacacaatttatcaaatcccattgtgaagtgatttatcaattgaacaagtatggataagagcatgttaggggatctggattctcttccagaagcagataagcaaagaatgtctaccatgatcgatcagctccaaatccgtgacagtctgagaatgtacaattcattggtggagagatgctttaccgattgtgttgacacatttaagcataaatccctgacaaagcaggaggaaacctgtatccgaagatgtgctgagaaatttctaaagcattccatgcgtgttggcttgaggtttgctgagctcaaccaaggagctgcaacacaagattgatgtctgttagcatcttcccatggaaaactgttgatttttttaagattcagtttgtctaattatatttttgcccttgagaaaatgagacagtatgaaattttttagttgctatgtgtactaaagaattattgctaaataagctcagaaagctctgcataatccttcatgtagtgcccaatttgactctaatctctgtcaagcctgcattggaatatgcaaagcacaaactttgatttggatttgaatagttgaactggtttaactataggagatgtaccttgtactttaacctaccagaaaatttccgtttttgatttttctttcctggtggtatcaaattgaagagtgaaagagtttttgt

SEQ ID NO: 8367 - DNA, 544 bp, Centaurea maculosa
aggagatcgaaatcaaaagaatagccgaaaatggacaaaaatatgctcggggatttgggaaatcttccagcggaagatcaggctcgaatggccaccatgatcgaccagctccaagttcgcgacagcctgaggatgtacaacacacttgtggagcgatgctttacagattgtgtggacacattcagacgcaaaacgttagataagcaagaggagacgtgtgtgcgcagatgtgctgagaagttcttgaagcattcaatgcgcgttgggttgagatttgctgaactcaaccaaaatgccgctacttctgactaaaatcatgtttttacacctattattcttaaaatgggcaccctcttttgttttgaggtaatagaattgctttagtcttcaagtaaacaccataaatatgtttagatgcgattgctagtttaaaaaacgtattttcgttaacgattgcacgcatctttcgcttctcctcctttttgtagcttttgacaaaaacacttgattttactggtttattatatatgattgatatcttttt

SEQ ID NO: 8368 - DNA, 751 bp, Glycine max
gatacgtgcaacgatgcgtttaatttagatctcaaaccctgaatattggttaagtggcaactggtggtgtgacctatatataccatcttgttcaactacagaattagggtttggtttcaaccgcagaacaaaatcacagtttctggcaaaacccttttcgaaggtgaccaatcggtggatcaaacatggacaagagcatgttagcggatttggattcgcttcctgaggctgataagcaaagaatgactgtcatgatcgatcagctccaaattcgtgacagtctgagaatgtataattcactggttgagagatgcttcagtgattgtgttgacacatttaagcataaatccctgcaaaagcaagaggaaacctgtgttcgaagatgtgcagagaaatttctgaagcattctatgcgggttggcatgaggtttgccgagctcaaccaaggagctgcaacacaagattgatttctgttaacttcttccaaaagaaaactgtcaatttattgttgttattattttgaatacagttcgtttacttacatttttggccttgaaaaatgagacactgtagagaatactaatttgctatgggtacgcaataattcgcgctaaataaattcatgatgatgcaatcacactgaatcctgattgggtggtttatttgctacctaaggtccattccaggcataactgctccattctgctgtgtaaaaggaaccaaatttaagcagagaactttagccaccaac

SEQ ID NO: 8369 - DNA, 738 bp, Glycine max
gatacgtgcaacgatgcgtttaatttagatctcaaaccctgaatattggttaagtggcaactggtggtgtgacctatatataccatcttgttcaactacagaaaaagggtttggtttcaaccgcagaacaaaatcacagtttctggcaaaacccttttcgaaggtgaccaatcggtggatcaaacatggacaagagcatgttagcggatttggattcgcttcctgaggctgataagcaaagaatgactgtcatgatcgatcagctccaaattcgtgacagtctgagaatgtataattcactggttgagagatgcttcagtgattgtgttgacacatttaagcataaatccctgcaaaagcaagaggaaacctgtgttcgaagatgtgcagagaaatttctgaagcattctatgcgggttggcatgaggtttgccgagctcaaccaaggagctgcaacacaagattgatttctgttaacttcttccaaaagaaaactgtcaatttattgttgttattattttgaatacagttcgtttacttacatttttggccttgaaaaatgagacactgtagagaatactaatttgctatgggtacgcaataattcgcgctaaataaattcatgatgatgcaatcacactgaatcctgattgggtggtttatttgctacctaaggtccattccaggcataactgctccattctgctgtgtaaaaggaaccaaatttaagcagagaac

SEQ ID NO: 8370 - DNA, 718 bp, Glycine max
ggttaagtggcaactggtggtgtgacctatatataccatcttgttccacttccgagttagggtttggtttctaccgcatatcgcagtttcttccttcatttcatactctctggcaaaaccctcgtcgacggtgaccaatcggtggatcaaacatggacaagagcatgctagcggatttggattcgctccctgaggctgataagcaaagaatgactgtcatgatcgatcagctccaaatccgtgacagtctgagaatgtataattcactggttgagagatgctttaatgattgtgttgacacatttaagcataaatccctgcaaaagcaagaggaaacctgtgttcgaagatgtgcagagaaatttctcaagcattctatgcgggttggcatgaggtttgccgagctcaaccaaggagctgctacacaagattaatttctgtttaacttcttccaatggaaaactgttaatttattattgttattattttgaatgcagttcgtttacttgcatttttgatcctgaaaaatgagactgtagagaattctaatttgctattggtacacaataatttgtgctaaataatttcatcattatgcaataacagtgtttctgaatcctgatttgattgagtttatttgctacccaaggtccattacgaactacccctcaccttccataactccattccagttctgttgtgtaaaagcaaccaaatc

SEQ ID NO: 8371 - DNA, 609 bp, Glycine max
ataccatcttgttccacttccgagttagggtttggtttctaccgcatatcgcagtttcttccttcatttcatactctctggcaaaaccctcgtcgacggtgaccaatcggtggatcaaacatggacaagagcatgctagcggatttggattcgctccctgaggctgataagcaaagaatgactgtcatgatcgatcagctccaaatccgtgacagtctgagaatgtataattcactggttgagagatgctttaatgattgtgttgacacatttaagcataaatccctgcaaaagcaagaggaaacctgtgttcgaagatgtgcagagaaatttctcaagcattctatgcgggttggcatgaggtttgccgagctcaaccaaggagctgctacacaagattaatttctgtttaacttcttccaatggaaaactgttaatttattattgttattattttgaatgcagttcgtttacttgcatttttgatcctgaaaaatgagactgtagagaattctaatttgctattggtacacaataatttgtgctaaataatttcatcattatgcaataacagtgtttctgaatcctgatttgattgagtttatttgc

SEQ ID NO: 8372 - DNA, 699 bp, Lupinus angustifolius
actacaactttctttaattaaaaaatacagggtaaaaacgactgtggaagggtgcgttttagtggcgtgacctctactaaattagggttttaccttcagcgatacaacaccatcgtaatagcatacataattttaattaggtttcgcacaatcaaatccgttttcgttgatcaatcagttgaaaaactatggacaagagcatgttaggggatctcgattctcttccagaggcagataagcaaagaatgtctaccatgattgaacagctccaaatgcgtgacagtctgagaatgtacaattcattggtggagagatgctttactgattgtgttgacacatttaagcacaaatccctgacgaagcaggaggaaacctgtattcgaagatgcgctgagaaatttctgaagcattccatgcgtgttggcatgaggtttgctgagcttaaccaaggggctgctacacaagattgatgtatgttagcatctaccatgtaaacttttgaattttttggttcaaaatattcaattagtttaattatatttttgctcttgaagaaatgaggcatgataaagacatggttttcttggttggtttgtgtaactcttgctaaattacaataaactcagaaagatgcaacaactgtgcctgtgccttatacttataatccttatgcatgattgtcattaacttccccttctc

SEQ ID NO: 8373 - DNA, 1264 bp, Cicer arietinum
gtgcgacagtgtagtagttatgacctatatatatatcatcttcttcagccttataagttagggtttatttctacggcaaaaaaacccaatctccaaaaccctagacggcgattaatcgttcgatccaaaatggacaaaagcatgattgcggatatggaatcccttccagaagcagataagctaagaatggctggcatgatcgaacagctccaaatccgtgacagtctgagaatgtataattccctggtggagaaatgctttaatgattgtgttgatacatttaagcataaatcccttcaaaagcaagaggagacctgtgttcgaagatgtgctgagaaatttctgaagcattctatgcgtgttggtatgaggtttgctgagctcaaccaaggagctgcaactcaagattgaagtttgctaacattggaaaactgttctttttgtcttgaatacaatttgtttaaattatattttttctatttaaaagtgagatactgtagaggcatgaatttcttcagctgctttgaatgcacaaatggatgctaatatctaaataaattcatgaagatgtaatcattatgctttagaaccttgatccttaattgacattattcagtattagtactcagttttcttccttccttccaaataaggtccatttcaggataaatagcttgattctgttggagtaaagttctgaattgaactgggagaatctctagccacccagttctcagcaccagaagttgctacctggagtgcagaagtatcttttatttatctaatcagactcagtcagttagtaatgataattaaaagcagattaccaatggcttaaatctcccatggtgtttaagtgcttgtaggttcaccccccctcccccttctttgctgtggccactgagccatttttccacccctcaaccttgaccatcactagaacctgaaagcacacatggtttgcatgcaaaatggtcatataggccataagtaggcttctttcagtacctcaatcatctgaaattgcctaacaatgtttcctgggattgtttggtgaatacccaataacaatgtcaaaataatacatttttcctgcattgtgaggaaattgatgtgattagtcctttaagtgtaagtcataaaatgtgtacattgtcacactttttcgtccaattctgttaaaaagtgtttatatggcctttttatgttgagatgataattataaataataaaaggatgtgcccttgcacacttttttagaaag

SEQ ID NO: 8374 - DNA, 456 bp, Ocimum basilicum
gaagaagacaagctccgaatgtctgccatgatcgatcagcttcaagttcgcgacagtttaagaatgtataattcattggttgaaagatgtttcaccgactgtgtggacactttccgacgtaaaaccttagacaaacaagaggagacgtgtgttcgtagatgtgctgagaagttcctgaagcactcgatgcgtgttggcatgagatttgcggagctgaaccaaggtgttgcaactccagattaatttgctgcctgccttttcaccgattttgttctagaacaaccaattgtgctctgcctcattagaatgaagatgaaaagttatgtgataccaacactggcttccattacttatagtagggcatgtttctttctgtttaagattatttgtgttagtttttcaactcctaaataagatgaatcactgaattacttaaacaagaacattattgctggc

SEQ ID NO: 8375 - DNA, 565 bp, Panicum virgatum
aaaacgacttcattccccaagcagcggggggagggcgcgcacaaccaaaatcttggcccaagtatgaaaagaattaaaagtattggcccgctgtacagtttccggagcccagcccagtctcctagcggggacgagcacgcttggacgacgggacagagctgtgggccgcggtgggccgtgcgacatatttgcttcgcttctttccacattggatgactgggtctcgccatctctccctttcctccccgaggctccaaaacctagctcttcccttttcctcgggcggcggcggcggcggcggcagccatggacaagagcatgctcggcgacctggacggcctccccgaggaggacaagatgcgcatggcctccatgatcgagcagctccagatccgtgacagtctgagaatgtacaattccctggtggagagatgcttcacggactgcgtggacacgttccgccgcaagaccctggacaagcaagaggagtcatgcgtccgccgctgcgctgagaagttcctgaagcactccatgaggttggcatgagatttgctgagcttaacca

SEQ ID NO: 8376 - DNA, 60 bp, Zea mays
aggctactcatgcagctcgcacgccgccaccaccaccaactgccgcactgacgtgcatgc

SEQ ID NO: 8377 - DNA, 60 bp, Sorghum bicolor
cctccacctcctcccgctcactcctcttcctcctctcaccccctcctctctccctctccc

SEQ ID NO: 8378 - DNA, 60 bp, Panicum virgatum
gcgagcccgtcgcctcccccactcactcccctcttccggagacccgatcatggagctcgc

SEQ ID NO: 8379 - DNA, 60 bp, Setaria italica
gatatggagagcgcgatggagaaggtatgggagtcggggcggcggatgagccggagcatc

SEQ ID NO: 8380 - DNA, 60 bp, Setaria italica
ctccctcccctcccctcccctccctctgtaactacgccacacgcagggagagattccaga

SEQ ID NO: 8381 - DNA, 60 bp, Oryza sativa
cccgcctctctttctcatttcataaaccccaaaaaagaaaaagaaaaaaacaacccccac

SEQ ID NO: 8382 - DNA, 60 bp, Oryza sativa
tctctccaccactcccacccccgcgccgccccggccgccgccgccgccgccgctcgccgg

SEQ ID NO: 8383 - DNA, 60 bp, Brachypodium distachyon
cgcggggaatatagtcaccagccaaattaaaccccccacgcgcacgatgctgcatataaa

SEQ ID NO: 8384 - DNA, 60 bp, Brachypodium distachyon
ctcgccgtgagctaaaaggccgccaaagctgctgcctccccatggcactcgcgcaacacc

SEQ ID NO: 8385 - DNA, 60 bp, Panicum virgatum
aaacatctctgccgcagggtgggcatcgagctgccgacggtggaggtgcggttcgagcag

SEQ ID NO: 8386 - DNA, 60 bp, Triticum aestivum
cggccgccgcggccgccgcctcgccaactgacggggcggcagaaggcaaggagcagtaca

SEQ ID NO: 8387 - DNA, 1597 bp, Gossypium raimondii
cagccaaaatttagtttccctcgaaaaaaataggcttcttcgttcttttcctctgtcactgccgccaccccatccttgctccgccgctgattccaccgccccactgccagtgactttgaagctgtttatattcaattagaatggcttcttcaccattattttctatgagcacgatgaaaagggattcgtttgttatgaaaacgataacttcgaacaaagagttcaagtttaatgtttcgaattccttcgataagctacctgttacgagtcctacattgttgttaaccggtgagaactcgttgaaatggggacaaaacgagagtcttttaaggaatcgaatgcaatgctgtgcagtggaagtcaagaacatgcctgggtatccaatggggaagaagtttgaactcgatgatgtgattgaagctcaacaattcgatagggaaactttaaatgctatatttgaagttgcgaaagagatggagaatatcaaaaagaactcacccggaagtcaaattctcaaaggttacctgatggccacccttttttatgaaccttcaactagaactaggctttcattcgagtcggccatgaaacgattgggtggtgaagttttaacaactgaaaatgctcgagaattttcttcggcagccaaaggggagacccttgaagatactattagaactgttgaagggtattctgatataattgtgatgcgacactttgaaagcggtgctgctaaacgagcggcagctaccgcaggcattcccatcattaatgctggtgatggtccgggtcaacatcctacccaggcccttttagatgtctacaccatagaaagagagatcggaaaactagatggcatcagagttgggcttgtcggagatcttgccaatgggagaaccgtccgttctcttgcctacttacttgcagagtaccaagatgtgaagatatactttgtttcccccgacgtcgttaaaatgaaggacgacattaaaaagtatctaacacggaggggtgtcgagtgggaagaaagtggtgatttaatggaagtggcgtctaagtgcgatgtggtataccaaactcgtattcaacgagaacggtttggagaaaggatcaatctttatgaagaagctcgtggtaagtatatagtggatgagaatgtgttgaaggtaatgcagagtcatgctgtggtaatgcatcctctcccgaggcttgatgagattaccgtcgatgttgatgccgatccgagagctgcttattttagacaagcaaagaatggtctttatataaggatggctcttttaaaattgttgcttgttggatggtgaggagaagaaggggctatttttggatttattttgggaaatttggcatcttttaattcagcttgattagggtaatcattgtgcttttgagaaactgaagcaaataactaaaaaaaggatcaatttcttaatatttcctttatgttaagttggattgagcctttctgattagaatttcggaattagatcatgtaatcattttttatatttaataaatttcgagtctggaattgaaattcgatttgattattatcaatttgagctcaagttgaaat

SEQ ID NO: 8388 - DNA, 1622 bp, Gossypium raimondii
attctttcatttttttttatctttttcagccaaaatttagtttccctcgaaaaaataggcttcttcgttcttttcctctgtcactgccgccaccccatccttgctccgccgctgattccaccgccccacttccagtgactttgaagctgtttatattcaattagaatggcttcttcaccattattttctatgagcacgatgaaaagggattcgtttgttatgaaaacgataacttcgaacaaagagttcaagtttaatgtttcgaatcccttcgataagctacctgttacgagtcctacattgttgttaaccggtgagaactcgttgaaatggggacaaaacgagagtcttttaaggaatcgaatgcaatgctgtgcagtggaagtcaagaacatgcctaggtatacaatggggaagaagtttgaactcgatgatgtgattgaagctcaacaattcgatagggaaactttaaatgctatatttgaagttgcgaaagagatggagaatatcaaaaagaactcacccggaagtcaaattctcaaaggttacctgatggccacccttttttatgaaccttcaactagaactaggctttcattcgagtcggccatgaaacgattgggtggtgaagttttaacaactgaaaatgctcgagaattttcttcggcagccaaaggggagacccttgaagatactattagaactgttgaagggtattctgatataattgtgatgcgacactttgaaagcggtgctgctaaacgagcggcagctaccgcaggcattcccatcattaatgctggtgatggtccgggtcaacatcctactcaggcccttttagatgtctacaccatagaaagagagatcggaaaactagatggcatcagagtcgggcttgtcggagatcttgccaatgggagaactgtccgttctcttgcctacttacttgcaaagtaccaagatgtgaagatatactttgtctcccccgacattgttaaaatgaaggatgacattaaagattatctaacatcgaggggtgtcgagtgggaagaaagtggtgatttaatggaagtggcgtctaaatgcgatgtggtgtaccaaactcgtattcaacgagaacggtttggagaaaggatcgatctttatgaagaagctcgtggtaagtatatagtggatgagaatgtgttgaaggtaatgcagaaacatgctgtggtaatgcatcctctcccgaggcttgatgagattaccgtcgatgttgatgccgatccgagagctgcttattttagacaagcaaagaatggtctctatataaggatggctcttttaaaattgttgcttgttggatggtgaggagaagaaggggctatttttggatttattttgggaaatttggcatcttttaattcagcttgattagggtaatcattgtgcttttgagaaactgaagcaaataactaaaaaaaggatcaatttcttaatatttcctttatgttaagttggattgagcctttctgattagaatttcggaattagatcatgtaatcattttttatatttaataaatttcgagtctggaattgaaattcgatttgattattatcaatttgagctcaagttgaaat

SEQ ID NO: 8389 - DNA, 1321 bp, Gossypium hirsutum
aagtttagtttccctcgaaaaaataggcttcttcgttcttttcctctgtcactgccgccaccccatccttgctccgccgctgattccaccgccccacttccagtgactttgaagctgtttatattcaattagaatggcttcttcaccattattttctatgagcacgatgaaaagggattcgtttgttatgaaaacgataacttcgaacaaagagttcaagtttaatgtttcgaatcccttcgataagctacctgttacgagtcctacattgttgttaaccggtgagaactcgttgaaatggggacaaaacgagagtcttttaaggaatcgaatgcaatgccgtgcagtggaagtcaagaacatgcctaggtatacaatggggaagaagtttgaactcgatgatgtgattgaagctcaacaatttgatagagaaactttaaatgctatatttgaagttgcgaaagagatggagaatattgaaaagaactcacccggaagtcaaattctcaaaggttacctaatggccacccttttttatgaaccttcaactagaactaggctttcattcgagtcggccatgaaacgattgggtggtgaagttttaacaactgaaaatgctcgagaattttcttcggcagccaaaggagagacccttgaagatactattagaactgttgaagggtattccgatataattgtgatgcgacactttgaaagcggtgctgctaaacgagcggcagctactgcaggcattcccatcattaatgctggtgatggtccgggtcaacatcctactcaggcccttttagatgtctacaccatagaaagagagatcggaaaactagatggcatcagagtcgggcttgtcggagatcttgccaatgggagaactgtccgttctcttgcctacttacttgcaaagtaccaagatgtgaagatatactttgtctcccccgacattgttaaaatgaaggatgacattaaagattatctaacatcgaggggtgtcgagtgggaagaaagtggtgatttaatggaagtggcgtctaaatgcgatgtggtgtaccaaactcgtattcaacgagaacggtttggagaaaggatcgatctttatgaagaagctcgtggtaagtatatagtggatgagaatgtgttgaaggtaatgcagaaacatgctgtggtaatgcatcctctcccgaggcttgatgagattaccgtcaatgttgatgccgatccgagagctgcttattttagacaagcaaagaatggtctctatataaggatggctcttttaaaattgttgcttgttggatggtgagga

SEQ ID NO: 8390 - DNA, 2438 bp, Theobroma cacao
gccaaagagcagccacaacgggcaactgctggctcatcatcatcttcctcaccatcgtgaccaaccggatgcaggtttagggtatggatatgcagacagggacagcatccaaccaacagctccaatgtggtgctgtaggaaccattgtgttgatgttgcctctgatgttaatcaccatggtttatgtgggattagatgccaatttagctggcaatgctgttggggattctgtattagtacaaacattagtcccttcaactgtggcagattcagaaatagatttccttgggggagcctgtgcttctaattctatggcatgtctgcatttgcacaacctttgccaccatggccttttccatgaccccctcggccaccaccattgccttcccctcctagactgcctagtcaccggcctcagcgtccatcgaagagcagcctggaagtattgcctagtcactggctttagcgtccatagaagagcaacctcaaagtatttgattcagtaatcggtgtttgattattttactcaaagaacagaattcaaataaaaaataaacaaaatatattagaaaagaaggtgagcaacaaattagaaaagagggtgagaaatactgatcaacttaatctcaaccgtcggatcatttgaactggcctcacattgcaaactcttaattttcacccggacacagaagacaaactcttttaagtacatattttccgccaaagatcttgagattgttttgggacgcataacaagacacaaactcagccctgagttttcactcatcccaaagatcccatttcttcttcctttcactttcatcacttttcactatttaatatcttcaaaaggcaacaacaaaaataaaaaacgctatctttctctcctttttcccagcatccaaacaccaactttttctttctttctccattcctggaaaatttcccagggactctgaagctgcttttattcgagtagaatggcatcttcatcatcattttctacatgcacactgaataggggctcgtttgctacaaaagcaataaatttcaataaagtgttcaagtgcaatttctcaagtctccctaatagactccctgttagtgctaagttatctgctgactttacctgttcaaggttgttaaccagtgagaaatctctgaaattggatcaaagccaaaggctttcaaggaatgggatgcagtgctgtgcgttggaagtcgaggatgtacctacatttttggtggggaagaagtttcaacttgatgatgtgattgaagctcaacaatttgatagagatattctaaatgctatatttgaagttgcacgtgagatggagaatattgagaagaaatcgcctggaagtcaaattctcaaaggttacctgatggccacccttttctatgagccctcaactagaactagactttcatttgagtctgccatgaagcggctaggtggtgaagttctgacaaccgaaaatgcacgagagttttcgtcagcagcaaaaggagagacacttgaagatactataagaacgattgaagggtactctgatataattgtgatgcgacactttgaaagcggtgctgctagaagagcagcagctactgcaggcattcctattatcaatgctggtgatggtcctggacaacatcccacccaggcccttttagatgtctacaccatagaaagagagataggaaaactggatggcatcagagttgggcttgtaggagatctcgccaatggaagaacagttcgttctcttgcctacttgctggcaaagtaccaagatgtgaagatctactttgtctcccctgatgttgttaaaatgaaggatgacattaaagattatttgacatcattgggtgtggagtgggaagaaagtgctgacttaatggaagtggcctctaagtgtgatgtggtgtatcaaactcgtattcaacgagaacggttcggagagagaattgatctttacgaagaagctcgaggtaagtatatagtggacaaggaagtgctaaaggtgatgcagaagcatgctgtggtcatgcatcctctcccaaggctcgatgagatcaccgtggatgttgatgcagatccaagggctgcctattttagacaggcaaagaatggtctttatatccggatggctcttttaaaactattacttgttgggtggtgacggaagtgctattttttcccctccaaattttgccatctattatcgcagcttgcttggttccttcatgtgaatctatgaacaacatttgacaagtaaaatgaaaagtttggcttgaatttccaaagattttttgtattttggctagtttccaaatgttaagatcataaaatgatcggctttgttgttgccatagtttgacattctgtttgtttggattagcctggctggcatgacaatgaggttgaatatagg

SEQ ID NO: 8391 - DNA, 1727 bp, Theobroma cacao
ctgatcaacttaatctcaaccgtcggatcatttgaactggcctcacattgcaaactcttaattttcacccggacacagaagacaaactcttttaagtacatattttccgccaaagatcttgagattgttttgggacgcataacaagacacaaactcagccctgagttttcactcatcccaaagatcccatttcttcttcctttcactttcatcacttttcactatttaatatcttcaaaaggcaacaacaaaaataaaaaacgctatctttctctcctttttcccagcatccaaacaccaactttttctttctttctccattcctggaaaatttcccagggactctgaagctgcttttattcgagtagaatggcatcttcatcatcattttctacatgcacactgaataggggctcgtttgctacaaaagcaataaatttcaataaagtgttcaagtgcaatttctcaagtctccctaatagactccctgttagtgctaagttatctgctgactttacctgttcaaggttgttaaccagtgagaaatctctgaaattggatcaaagccaaaggctttcaaggaatgggatgcagtgctgtgcgttggaagtcgaggatgtacctacatttttggtggggaagaagtttcaacttgatgatgtgattgaagctcaacaatttgatagagatattctaaatgctatatttgaagttgcacgtgagatggagaatattgagaagaaatcgcctggaagtcaaattctcaaaggttacctgatggccacccttttctatgagccctcaactagaactagactttcatttgagtctgccatgaagcggctaggtggtgaagttctgacaaccgaaaatgcacgagagttttcgtcagcagcaaaaggagagacacttgaaggcaattttctttaccttttcgttatgattcttagaaatactataagaacgattgaagggtactctgatataattgtgatgcgacactttgaaagcggtgctgctagaagagcagcagctactgcaggcattcctattatcaatgctggtgatggtcctggacaacatcccacccaggcccttttagatgtctacaccatagaaagagagataggaaaactggatggcatcagagttgggcttgtaggagatctcgccaatggaagaacagttcgttctcttgcctacttgctggcaaagtaccaagatgtgaatatctactttgtctcccctgatgttgttaaaatgaaggatgacattaaagattatttgacatcgttgggtgtggagtgggaagaaagtgctgacttaatggaagtggcctctaagtgtgatgtggtgtatcaaactcgtattcaacgagaacggttcggagagagaattgatctttacgaagaagctcgaggtaagtatatagtggacaaggaagtgctaaaggtgatgcagaagcatgctgtggtcatgcatcctctcccaaggctcgatgagatcaccgtggatgttgatgcagatccaagggctgcctattttagacaggcaaagaatggtctttatatccggatggctcttttaaaactattacttgttgggtggtgacggaagtgctattttttcccctccaaattttgccatctattatcgcagcttgcttggttccttcatgtgaatctatgaacaacatttgacaagtaaaatgaaaagtttggcttgaa

SEQ ID NO: 8392 - DNA, 908 bp, Arabidopsis lyrata
aaaaaaaaattaaaaacaatttccttatttcctaaagttgcgaatgactttttaacaatcgaccgactttatcaaaattagggatttttttatatatatatatatagagacgcttctctttatttccttcatcgcttctcaaaattttcttcaaagaacaaatctcttctcccaaatctaaatcttcttctctcttcgtttccataaagatgtcttcgaagaagattgtgttgaagagttccgatggtgaatctttcgaggttgaagaggcggtggctctcgagtcacagaccatagcccacatggttgaagacgactgcgtcgacaacggagtccctcttcccaacgtcacgagcaagatccttgcgaaggtgatcgagtattgcaagaagcacgtcgaggttgctgccgccaagagcgaggccgtcgatggtgctacctccgatgaagacctcaaggcctgggacactgagtttatgaagatcgatcaggctacgctctttgaactcattctggctgctaattacctgaacatcaagaacttgcttgacctcacatgtcagacagtggcggacatgatcaaagggaagactccagaagagatccgcacaacgttcaacatcaagaacgacttcacacccgaggaagaggaagaggtgcgcagagagaaccaatgggcttttgaatgatgatcttgagagagaatcaaaaagcagcaagcaaccagtttcttcttccttatgtttattgccgttttcaagtgttgcttttaatattcatgactatgttctcttcctcctctttgctttcttttattatcaagaactaatgttttttactcttttgttggatggataatttgtgcttttagaaaatcttaaaagagtgatgttggtttgtcttgcaaa

SEQ ID NO: 8393 - DNA, 814 bp, Brassica juncea
aaagatgtcgacgaagaagattgtgttgaaaagctccgacggcgagtccttcgaggtcgacgaggccgtggccctcgagtctcagaccatcgctcacatggtcgaagacgactgcgtcgacaacggaatccctcttcccaacgtcaccagcaagatcctcgcgaaggtgattgagtactgcaagaagcacgtcgacgccgccgcctccaagaccgaggccgtcgacggcggggcttcctccgacgatgacctcaaggcgtgggacgccgagttcatgaagatcgatcaagctaccctcttcgagctcatcctggcggctaactatctgaacattaagaacctgcttgacctgacgtgccagacggttgctgatatgatcaagggcaagactccagaggagattcgcacgaccttcaacatcaagaacgacttcactcctgaggaagaggaggaggtgcgcagagagaaccaatgggcttttgaatgatcaaagagttgtcattgaagcaaaccctctttatgttattgtctttctcttctctgtggatgatgatgacttggtttttatttattttcgtcctctttatttaatattaagaacctatggttgctctttgctgggatttttatgattgaatcggtcttaaagggtgatgttagtttgctttgcaaatatcttttatcttgttcatctgcttcgtcctatgttccagtgtaacattgtttactggtcggtctgtttggatgactacattggcctgtttttaccaaaagatgagtatctgaatcactcagtctaggtttctcttattac

SEQ ID NO: 8394 - DNA, 779 bp, Raphanus sativus
  misc_feature (49)..(49): n is a, c, g, or t
  misc_feature (60)..(60): n is a, c, g, or t
aaaaaaaaaaactaggatctcatcatctcatcgcttctctcaaatcttntctttgcgttntccccacacaatcatgtcgacgaagaagatcgtgttgaagagctccgatggcgagtctttcgaggtggacgaggcggttgccctcgagtctcagaccatagcccacatggtcgaagacgactgcgtcgacaacggtgtccctcttcccaacgtcacgagcaagatcctcgccaaggtgatcgagtactgcaagaagcacgtcgacgctgccgcttccaagagcgaggccgtcgacggtggcggttcctccgacgatgacctcaaggcctgggatgctgagttcatgaagatcgatcaagccaccctcttcgaactcatcctggctgctaattatttgaacatcaagaacctgcttgaccttacatgccagactgtggctgatatgatcaagggcaagactccggaagagattcgcacgaccttcaacatcaagaacgactttacacccgaggaagaagaggaggtgcgcagggagaaccaatgggcttttgaatgatgtgtgtgagagagaggtcgttgaagcaaaccaaccagtttcttgctttttatgttgttgctttttttttcttctgtggatgatcggtgtggatgatgatgactttgctattttccttttgtaattcatgacctatgttcgtcttgaaggaccaatgctggatgtttgcttttaatgtcttaaaagagtgatgttggtttgccttgcaaatatcttgatttgc

SEQ ID NO: 8395 - DNA, 778 bp, Raphanus sativus
ggaatccacttataaaaaaaaaaaaaaaactagggatctcatcatctcatcgcttctctcaaatcttctctttgcgttttccccacacaatcatgtcgacgaagaagatcgtgttgaagagctccgatggcgagtctttcgaggtcgacgaggcggttgccctcgagtctcagaccatagcccacatggtcgaagacgactgcgtcgacaacggggtccctcttcccaacgtcacgagcaagatcctcgccaaggtgatcgagtactgcaagaagcacgtcgacgccgccgcttccaagaccgaggccgtcgacggtggcggttcctccgacgatgacctcaaggcctgggatgcggagttcatgaagatcgatcaagccaccctcttcgaactcatcctggctgctaattatttgaacatcaagaacctgcttgaccttacatgccagactgtggcggatatgatcaagggaaagactccggaagagattcgcacgaccttcaacatcaagaacgattttacacccgaggaagaggaggaggtgcgcagggagaaccaatgggcttttgaatgatgtgtgagagagaggtcgttgaggcaaaccaaccagtttcttgctttttatgttgttgttttttttttctgtggatgatcagtgtggatgatgatgactttgctactttccttttgtaattcatgacctatgttcgtcttgaagaaccaatgctggatgtttgcttttaatgtcttaaaagagtgatgttggtttgccttgca

SEQ ID NO: 8396 - DNA, 767 bp, Raphanus sativus
  misc_feature (70)..(70): n is a, c, g, or t
  misc_feature (192)..(192): n is a, c, g, or t
  misc_feature (647)..(647): n is a, c, g, or t
  misc_feature (666)..(666): n is a, c, g, or t
  misc_feature (675)..(675): n is a, c, g, or t
aaaaaattaaaaaactagggatctcatcatctcatcgcttctctcaaatcttctctttgcgttttccccncaacaatcatgtcgacgaagaagatcgtgttgaagagctccgatggcgagtctttcgaggtcgacgaggcggtggccctcgagtcccagaccatagcccacatggtcgaagacgactgcgtngacaacggggtcccgcttcccaacgtcacgagcaagatcctcgccaaggtgatcgagtactgcaagaagcacgtcgacgccgccgcttccaagaccgaggccgtcgacggtggcggttcctccgacgatgacctcaaggcctgggatgctgagtttatgaagatcgatcaagccaccctcttcgaactcatcctggctgctaattatttgaacatcaagaacctgcttgaccttacatgccagacagtggctgatatgatcaagggaaagactccggaagagattcgcacgaccttcaacatcaagaacgactttacacccgaggaagaagaggaggtgcgcagggagaaccaatgggcttttgaatgatgtgtgagagagataggtcgttgaagcaaaccaaccagtttcttgctttttatgttgttgcttttttttttttctgtggatgatcngtgtggatgatgactcttnctattttcnttttgtaattcatgacctatgttcgtcttgaagaaccaatgctggatgtttgcttttaatgtcttaaaagagtgatgttggtttgccttgca

SEQ ID NO: 8397 - DNA, 873 bp, Eutrema parvulum
aaaaaataaaaaaatttcgttattcctcatctctttcgataataatcgaccgactcatcaaaaaattagggatttttttatatatagagagacgcgtaccttcatacctttatttccttcatcggttctcaaatcagaaaaaaaaagtctcccgaatcttcttctctccgtttccttagcccgcaaagatgtcgttgaagaagattgttttgaagagctccgatggcgagtctttcgaggttgacgaggcggtggctctcgagtcgcagaccatagcgcacatggttgaagacgactgcgtcgacaacggagtcccgcttccgaacgtcacgagcaagatcctcgcgaaggtgatcgagtactgcaagaagcacgtcgatgctgctgcttccaagagcgaggctgtcgatggtggttcctccgatgatgacctcaaggcctgggatgccgaattcatgaagatcgatcaggctactctcttcgaactcatcctggctgctaattatctgaacattaagaaccttcttgacctcacatgccagacagtggctgatatgatcaaaggcaaaactccagaagagatccgcacgaccttcaacattaagaacgacttcacacctgaggaagaagaagaggtgcgcagggagaaccaatgggcttttgaatgattaagagaagcctttgtgtgggagaggtcgtcgaagcaaaccaaccagtttcttatgttattgccttttcttagagtctgatcaatgtggatgatacgacttggtttctcgttcattatcttatcttccatttgaaaaattcatgactatgttcgtccttgtcgtgctttttttttgtactacaattaagaaccaatgcttgctc

SEQ ID NO: 8398 - DNA, 766 bp, Brassica juncea
cctctcgaaatcaaaactctcaaagatgtcgacgaagaagattgtgttgaaaagctccgacggcgagtctttcgaggtcgatgaggccgttgctctcgagtctcagaccatagcgcacatggtcgaagacgactgcgtcgacaacgggatccctcttcccaacgtcacgagcaagatcctcgcgaaggtgattgagtactgcaagaaacacgtcgacgccgccgcttccaagacagaggccgtcgatggtggcgcttcctccgacgatgacctcaaggcgtgggacgccgagttcatgaagatcgatcaagctaccctcttcgaactcatcctggcggctaactatttgaacatcaagaaccttcttgacttgacatgccagacggtggctgatatgatcaaggggaagactccagaggagattcgcacgaccttcaacatcaagaacgactttactgccgaggaagaggaggaggtgcgcagggagaaccaatgggcttttgaatgatcaagagagataagtctttgtcgtgttgaagcaaacccacccagtttcttcctttacgttatttgtcgatgacttcgggttcctttttattttcgtgttgaaatttgtgactgttcgtcctctttatttataatcgagaacctatgtttgcgctttgatttatctttaaagggtgatgttggtttgctttgcaaatatctttgatcttgttcatctacttcgtcattgatataataaagcgcaaacataggttctaga

SEQ ID NO: 8399 - DNA, 828 bp, Brassica juncea
cgatgactttctaacaatcaacccacttataaaaaagaaaattagggatctccttatctcctccacttcatctcgcttctctcaaatctcctctcaccttttctcacaatcatgtcgacgaagaagatcgtgttgaagagctccgatggcgagtctttcgaggtcgacgaggccgtggctctcgagtctcagaccatagcccacatggtcgaagacgactgcgtcgacaacggagtcccgcttcccaacgtcacgagcaagatcctcgccaaggtgattgagtactgcaagaagcacgtcgatgccgctgcttccaagagcgaggccgtcgatggcggtggctcctccgacgatgacctcaaggcttgggatgctgagtttatgaagatcgatcaagctaccctctttgagctcatcctggctgctaattatttgaacatcaagaaccttctcgacctgacatgccagacagtggctgatatgatcaagggcaagactccggaggagattcgcacgaccttcaacatcaagaacgacttttcaccagaggaagaagaggaggtgcgcagggagaaccaatgggcttttgaatgatgcttgagagagtgggagagatcgttgaagcaaaccaaccagtttcttgctttatgttgttgcctttttttttttttttatctctgtggatgatcagtgtggatgatgactttgtttctctgctattttccttttgaacttcatgactattaagtaccaatgttggatttgtgcttttcatgtcttaaagattgaggttggtttgccttgcaaatatcttgatcttgttccttt

SEQ ID NO: 8400 - DNA, 796 bp, Brassica juncea
gacccccactttatatattataaaaattagggatctcccttatctccccttcatcgcttctctcaaatattttctcttgacgtttttctcacaatcatgtcgacgaagaagatcgtgttgaagagctccgatggcgagtctttcgaggtcgacgaggcggtcgccctcgagtctcagaccatagcccacatggttgaagacgactgcgtcgacaacggtgtccctcttcccaacgtcacgagcaagatcctcgccaaggtgattgagtactgcaagaagcacgtcgacgctgctgcttccaagagcgaggccgtcgacggtggtggttcctcagacgacgacctcaaggcttgggatgctgagtttatgaagatcgatcaagctaccctcttcgaactcatcctggctgctaattatctgaacatcaagaacctgctggacctcacatgccagacagtggctgatatgatcaagggcaagactccggaagagattcgcacgacctttaacatcaagaacgacttttcacccgaggaagaagaggaggtgcgcagggagaaccaatgggcttttgaatgatacgtgagagagcctttgtgtgggagaggtcgttgaagcaaaccaaccagtttcttgcttttatgttgttgcctttttttctgtggatgatcagtgcggatgatgatgacttggtttctctctgttgttttccttttgttattcatgactatgctcgtcctccccgtgctggatatttgcttttaatgtctttacgagtggtgttggtttgccttgc

SEQ ID NO: 8401 - DNA, 802 bp, Brassica juncea
tagttcgttatcaatggcgtctgttacttcttctccaaccactctcatcgcttctcaaatcttctcttacgttttctcacaaacatgtcgacgaggaagatcgtgttgaagagctccgatggcgagtctttcgaggttgacgaggcggttgctctcgagtctcagaccatagcccacatggttgaagacgactgcgtcgacaacggtgtcccgcttcccaacgtcaccagcaagatcctcgccaaggtgattgagtactgcaagaagcacgtcgacgctgctgcttccaagagcgaggccgtcgatggtggtggctcctccgacgatgatctcaaggcttgggatgctgagtttatgaagatcgatcaagctaccctcttcgaactcatcctggctgctaattatttgaacatcaagaacctgcttgacctgacatgccagacagtggctgatatgataaagggcaagactccagaagagatacgcacgaccttcaacatcaagaacgactttacacctgaggaagaagaggaggtgcgcagggagaaccaatgggcttttgaatgatgtgtgtgagagcctttgtgtgggagaggtcgttgaagcaaaccaaacagtttcttgctttatgttgttgcctttttctgtggatgatcagtgtggacttggtttctctgttgttttccttttgttattcatgactctgttcgtcctccacgtgctttattttacgattaagaaccaaatgttggatgtgtgcttttaatgtcttaaagagtgatgttggtttgcattgcaaata

SEQ ID NO: 8402 - DNA, 786 bp, Brassica nigra
ggatctcccttatctccccttcatcgcttctatcaaatcctctcttgacgtttttgtccaatcatgtcgacgaagaagatcgtgttgaagagctccgatggcgagtctttcgaggttgacgaggcggtggccctcgagtctcagaccatagcccacatggttgaagacgactgcgtcgacaacggtgtccctcttcccaacgtcacgagcaagatcctcgcaaaggtgatcgagtactgcaagaagcacgtcgacgctgctgcttccaagagcgaggccgtcgacggtggtggctcctcagacgacgacctcaaggcctgggatgctgagtttatgaagatcgatcaagctaccctcttcgaactcatcctggctgctaattatctgaacatcaagaacctgcttgacctcacatgccagacagtggctgatatgatcaagggcaagactccggaagagattcgcaccacctttaacatcaagaacgacttttcacctgaggaagaagaggaggtgcgcagggagaaccaatgggcttttgaatgatgtgtgagagagcctttgtgtgggagaggtcgttgaagcaaaccaaccagtttcttgcttttatgttggtgcctttttttctgtggatgatcagtgtggatgatgatgacttggtttctctctgttgttttccttttgttattcatgactatgttcgtcctccccgtgctggatgctggatgtttgcttttaatgtctttaagagtggtgttggtttgccttgcaaaaaaaaaaaaaaaa

SEQ ID NO: 8403 - DNA, 805 bp, Brassica oleracea
aggatgactttgtaacaatcgacccacttataaagaaaaattagggatctcctccacttcatcccttctctcaaatctcctctcgcgttttctcacaaacatgtcgacgaagaagatcgtgttgaagagctccgatggcgagtctttcgaggtcgacgaggcggtggctctcgagtctcagaccatagcccacatggttgaagacgactgcgtcgacaacggagtccctcttcccaacgtcacgagcaagatcctcgccaaggtgattgagtactgcaagaagcacgtcgacgctgctgcttccaagagcgaggccgtcgatggcggtggctcctccgacgatgacctcaaggcttgggatgctgagtttatgaagatcgatcaagctaccctcttcgaactcatcctggctgctaattatctgaacatcaagaacctgctcgaccttacatgccagacagtggctgacatgatcaagggcaagactccggaagagattcgcacgaccttcaacatcaagaacgacttttcaccagaggaagaagaggaggtgcgcagggagaaccaatgggcttttgaatgatgcgtgagagtgggagagatcgttgaagcaaaccaaccagtttcttgctttatgttgttgcctttttatctctgtggatgatcagtgtggatgatgactttgtgtcttctctgttattttccttttgaatttcatgactattaagaaccaaatgttggatttatgcttttcatgtcttaaagagtgaggttggtttgccttgcaaatatcttgatcttgttc

SEQ ID NO: 8404 - DNA, 860 bp, Brassica rapa
accactagtataaaaataaattagggatttctatatataaaacaagtaagacgcttccctcgaataccttcatcgctcctctcgaaatcaaaactctcaaagatgtcgacgaagaagattgtgttgaaaagctccgacggcgagtctttcgaggtcgacgaggccgtggctctcgagtctcagaccatagcgcacatggtcgaagacgactgcgtcgacaacgggatccctcttcccaacgtcacgagcaagatcctcgcgaaggtgattgagtactgcaagaaacacgtcgacgccgccgcttctaagaccgaggccgtcgatggcggcgcttcctccgacgatgacctcaaggcctgggacgccgagttcatgaagatcgatcaagctaccctcttcgaactcatcctggcggctaactatttgaacatcaagaaccttcttgacttgacatgccagacggtggctgatatgatcaaggggaagactccagaggagattcgcacgaccttcaacatcaagaacgactttactgccgaggaagaggaggaggtgcgcagggagaaccaatgggcttttgaatgatcaagagaagatagtctttgtcgtgttgaagcaaaccacccagtttcttcctttacgttatttgtcgatgacttcgggttcctttttattttcgtgtttaaatttgtgactgttcgtcctctttatttataatcgagaacctatgtttgcgctttgatttatcttaaagggtgatgttggtttgctttgcaaatatcttttatcttgttcatctgcttcgtcattcatgcgaattactgatcgctctgtttcggtggcttccatgctacttaaac

SEQ ID NO: 8405 - DNA, 893 bp, Brassica rapa
taatctcgcgatgactttctaacaatcgacccacttataaaaaagaaaattagggatctccttatctcctccacttcatctcgcttctctcaaatctcctctcgcctttcctcacaaacatgtcgacgaagaagatcgtgttgaagagctccgatggcgagtctttcgaggtcgacgaggcggtggctctcgagtctcagaccatagcccacatggtcgaagacgactgcgtcgacaacggagtcccgcttcccaacgtcacgagcaagatcctcgccaaggtgattgagtactgcaagaagcacgtcgatgccgctgcttccaagagcgaggccgtcgatggcggtggctcctccgacgatgacctcaaggcttgggatgctgagtttatgaagatcgatcaagctaccctcttcgaactcatcctggctgctaattatctgaacatcaagaaccttctcgacctgacatgccagacagtggctgacatgatcaagggcaagactccggaggagattcgcacgaccttcaacatcaagaacgacttttcaccagaggaagaagaggaggtgcgcagggagaaccaatgggcttttgaatgatgcgtgagagagtgggagagatcgttgaagcaaaccaaccagtttctcgctttatgttgttgccttttttttttttatctccgtggatgatcagtgtggatgatgatgactttgtttctctgctattttccttttgaacttcatgactattaagtaccaatgttggatttgtgcttttcatttcttaaagagtgaggttggtttgccttgcaaatatcatgatcttgttcatttcatctcccgtcttacacatgtttctttgttgatctgatttactgctcattttgtgac

SEQ ID NO: 8406 - DNA, 769 bp, Brassica napus
aaaaaagaaaattagggatctccttatctcctccacttcatctcgcttctctcaaatctcctctcaccttttctcacaatcatgtcgacgaagaagatcgtgttgaagagctccgatggcgagtctttcgaggtcgacgaggccgtggctctcgagtctcagaccatagcccacatggtcgaagacgactgcgtcgacaacggagtcccgcttcccaacgtcacgagcaagatcctcgccaaggtgattgagtactgcaagaagcacgtcgatgccgctgcttccaagagcgaggccgtcgatggcggtggctcctccgacgatgacctcaaggcttgggatgctgagtttatgaagatcgatcaagctaccctctttgagctcatcctggctgctaattatctgaacatcaagaaccttctcgacctgacatgccagacagtggctgacatgatcaagggcaagactccggaggagattcgcacgaccttcaacatcaagaacgacttttcaccagaggaagaagaggaggtgcgcagggagaaccaatgggcttttgaatgatgcttgagagagtgggagagatcgttgaagcaaaccaaccagtttcttgctttatgttgttgcctttttttttttttatctctgtggatgatcagtgtggatgatgatgactttgtttctctgctattttccttttgaacttcatgactatcaagtaccaatgttggatttgtgcttttcatgttttaaagattgaggttggttt

SEQ ID NO: 8407 - DNA, 822 bp, Brassica napus
gacccacttataaagaaaaattagggatctcctccacttcatcccttctctcaaatctcctctcgcgttttctcacaaacatgtcgacgaagaagatcgtgttgaagagctccgatggcgagtctttcgaggtcgacgaggcggtggctctcgagtctcagaccatagcccacatggttgaagacgactgcgtcgacaacggagtccctcttcccaacgtcacgagcaagatcctcgccaaggtgattgagtactgcaagaagcacgtcgacgctgctgcttccaagagcgaggccgtcgatggcggtggctcctccgacgatgacctcaaggcttgggatgctgagtttatgaagatcgatcaagctaccctcttcgaactcatcctggctgctaattatctgaacatcaagaacctgctcgaccttacatgccagacagtggctgacatgatcaagggcaagactccggaagagattcgcacgaccttcaacatcaagaacgacttttcaccagaggaagaagaggaggtgcgcagggagaaccaatgggcttttgaatgatgcgtgagagagtgggagagatcgttgaagcaaaccaaccagtttcttgctttatgttgttgcctttttatttctgtggatgatcagtgtggatgatgactttgtgtcttctctgttattttccttttgaatttcatgactattaagaaccaaatgttggatttatgcttttcatgtcttaaaagagtgaggttggtttgccttgcaaatatcttgatcttgttcctttcctctcccgtcatacacacattgtttcttt

SEQ ID NO: 8408 - DNA, 780 bp, Brassica napus
cttataaaaaagacaattagggatctccttatctcctccacttcatctcgcttctctcaaatctcctctcgcctttcctcacaaacatgtcgacgaagaagatcgtgttgaagagctccgatggcgagtctttcgaggtcgacgaggccgtggctctcgagtctcagaccatagcccacatggtcgaagacgactgcgtcgacaacggagtcccgcttcccaacgtcacgagcaagatcctcgccaaggtgattgagtactgcaagaagcacgtcgacgctgctgcttccaagagcgaggccgtcgatggcggtggctcctccgacgatgacctcaaggcttgggatgctgagtttatgaagatcgatcaagctaccctctttgagctcatcctggctgctaattatctgaacatcaagaaccttctcgacctgacatgccagacagtggctgacatgatcaagggcaagactccggaggagattcgcacgaccttcaacatcaagaacgacttttcaccagaggaagaagaggaggtgcgcagggagaaccaatgggcttttgaatgatgcgtgagagagtgggagagatcgttgaagcaaaccaaccagtttcttgctttatgttgttgtcctttttttttttttatctctgtggatgatcagtgtggatgatgatgactttgtttctctgctattttccttttgaacttcatgactatcaagtaccaatgttggatttgtgcttttcatgttttaaagattgaggttggtttgcctt

SEQ ID NO: 8409 - DNA, 752 bp, Brassica napus
ccttgaataccttcatcgcttctctcgaaatcaaaactctcaaagatgtcgacgaagaagattgtgttgaaaagctccgacggcgagtctttcgaggtcgatgaggccgtggctctcgagtctcagaccatagcgcacatggtcgaagacgactgcgtcgacaacgggatccctcttcccaacgtcacgagcaagatcctcgcgaaggtgattgagtactgcaagaaacacgtcgacgccgccgcttctaagaccgaggccgtcgatggcggcgcttcctccgacgatgacctcaaggcctgggacgccgagttcatgaagatcgatcaagctaccctcttcgaactcatcctggcggctaactatttgaacatcaagaaccttcttgacttgacatgccagacggtggctgatatgatcaaggggaagactccagaggagattcgcacgaccttcaacatcaagaacgactttactgccgaggaagaggaggaggtgcgcagggagaaccaatgggcttttgaatgatcaagagaagcaaaccacccagtttcttcctttacgttgttgtcttcttttctctgtggatgatatgatgatgacttcgggttcctttttatcttcgttttgaaatttgtgactgttcgtcctctttatttataatcgagaacctatgtttgcgctttgatttatcttaaagggtgatgttgttggtttgctttgcaattatctttgatcttgttcatctgctt

SEQ ID NO: 8410 - DNA, 813 bp, Brassica napus
ggatctccttatctcctccacttcatctcgcttctctcaaatctcctctcacctttcctcacaaacatgtcgacgaagaagatcgtgttgaagagctccgatggcgagtctttcgaggtcgacgaggccgtggctctcgagtctcagaccatagcccacatggtcgaagacgactgcgtcgacaacggagtcccgcttcccaacgtcacgagcaagatcctcgccaaggtgattgagtactgcaagaagcacgtcgatgccgctgcttccaagagcgaggccgtcgatggcggtggctcctccgacgatgacctcaaggcttgggatgctgagtttatgaagatcgatcaagctaccctcttcgaactcatcctggctgctaattatctgaacatcaagaaccttctcgacctgacatgccagacagtggctgacatgatcaagggcaagactccggaggagattcgcacgaccttcaacatcaagaacgacttttcaccagaggaagaagaggaggtgcgcagggagaaccaatgggcttttgaatgatgcgtgagagagtgggagagatcgttgaagcaaaccaaccagtttctcgctttatgttgttgcctttttttttttatctccgtggatgatcagtgtggatgatgatgactttgtttctctgctattttccttttgaacttcatgactattaagtaccaatgttggatttgtgtcttttcatttcttaaagagtgaggttggttgcttgcaatctactatgtatcttgtctgagctgcctaaggcacacgtagggaatggtccca

SEQ ID NO: 8411 - DNA, 783 bp, Eutrema halophilum
tccatcgcttcttctcaaatctcctcaaaagcaaaaaacaaatctcccaaatctctcctctttttctccacagagatgtcgtcgaagaagattgtgttgaagagctccgatggcgagtctttcgaggttgacgaggcggtggctctcgagtcccagaccatagcgcacatggttgaagacgactgcgtcgacaacggagtccctcttcccaacgtcacgagcaagatccttgccaaggtgatcgagtactgcaagaagcacgttgattccgctgcttccaagagcgaggccgtcgatggtgcttcctccgacgaagacctcaaagcctgggataccgagttcatgaagatcgatcaggctaccctcttcgaactcatcctggctgctaattatctgaacatcaagaaccttcttgacctaacatgccagacagtggctgatatgatcaaaggcaaaactccagaagagattcgcacgaccttcaacatcaaaaacgacttcacacccgaggaagaagaggaggtgcgcagagagaatcaatgggcttttgaatgagcgtttgttcgaggaaggtgtcgaatcaaaagagcaaccatttcttctttatgttattgtcgttcgttttcagtgtctattgcctctgtttttttttgtttcttttgaaaaattcatgaagacttgatcctcctcctcgtgctttttctttttttcttttgacaattatgaactaatgtttgctctttgttggatatttgtgctttagtgatgttggtttgccttgca

SEQ ID NO: 8412 - DNA, 707 bp, Eutrema parvulum
catcggttctcaaaagcaaaaaacaaatctcccaaatctctcctctttttctccacagagatgtcgtcgaagaagattgtgttgaagagctccgatggcgagtctttcgaggttgacgaggcggtggctctcgagtcccagaccatagcgcacatggttgaagacgactgcgtcgacaacggagtccctcttcccaacgtcacgagcaagatccttgccaaggtgatcgagtactgcaagaagcacgttgattccgctgcttccaagagcgaggccgtcgatggtgcttcctccgacgaagacctcaaagcctgggataccgagttcatgaagatcgatcaggctaccctcttcgaactcatcctggctgctaattatctgaacatcaagaaccttcttgacctaacatgccagacagtggctgatatgatcaaaggcaaaactccagaagagatccgcacgaccttcaacattaagaacgacttcacacctgaggaagaagaagaggtgcgcagggagaaccaatgggcttttgaatgattaagagaagcctttgtgtgggagaggtcgtcgaagcaaaccaaccagtttcttatgttattgccttttcttagagtctgatcaatgtggatgatacgacttggtttctcgttcattatcttatcttccatttgaaaaattcatgactatgttcgtccttgtcgtgc

SEQ ID NO: 8413 - DNA, 731 bp, Brassica napus
agaggaagacgcttcccttcttcaaaaccttcatcgctgctctcgaaatcaaaactctcaaagatgtcgacgaagaagattgtgttgaaaagctccgacggcgagtctttcgaggtcgacgaggccgtggctctcgagtctcagaccatagcgcacatggtggaagacgactgcgtcgacaacgggatcccgcttcccaacgtcacgagcaagatcctcgcgaaggtgattgagtactgcaagaaacacgtcgacgctgccgcttccaagaccgatgccgtcgatggtggagcttcctccgacgatgacctcaaggcgtgggacgccgagttcatgaagatcgatcaagctaccctcttcgaactcatcctggctgctaactatttgaacatcaagaaccttcttgacttgacatgccagacggtggctgatatgatcaaggggaagactccagaggagattcgcacgaccttcaacatcaagaacgactttactgccgaggaagaggaggaggtgcgcagggagaaccaatgggcttttgaatgatcaagagagataacaagtctttgtcgttgaagcaaaccacccagtttcttcctttacgttatttgtcttcttttcatctgtgggatgatgatcatgacttggttcctttttattttatttgtgactgctcgtcctctttatttataatcgagaacctatgtttgcgcttttgatttatctttaaa

SEQ ID NO: 8414 - DNA, 745 bp, Brassica napus
gacccacttataaaaaagacaattaggcatctccttatctcctccacttcatctcgcttctctcaaatctcctctcgcctttcctcacaaacatgtcgacgaagaagatcgtgttgaagagctccgatggcgagtctttcgaggtcgacgaggccgtggctctcgagtctcagaccatagcccacatggtcgaagacgactgcgtcgacaacggagtcccgcttcccaacgtcacgagcaagatcctcgccaaggtgattgagtactgcaagaagcacgtcgacgctgctgcttccaagagcgaggccgtcgatggcgggggctcttccgacgatgacctcaaggcttgggatgctgagtttatgaagatcgatcaagctaccctctttgagctcatcctggctgctaattatctgaacatcaagaaccttctcgacctgacatgccagacagtggctgacatgatcaagggcaagactccggaggagattcgcacgaccttcaacatcaagaacgacttttcaccagaggaagaagaggaggtgcgcagggagaaccaatgggctttggaatgatgcgtgagagagtgggagaggatcgttggaagcaaaccaaccagttcttgcttatgttgttgtcctttttttttaatcttctgtggtatgtatctagtgtggagtgagtgtatgtacttgttctctgtctatttctttgtacttctatgtactatctaagtacaagttgg

SEQ ID NO: 8415 - DNA, 768 bp, Raphanus sativus
ggatagagatagagacgcagccccttcccttccttaccctaaccttgaacgcttctctcagatctcttctagaaatcaaaaccatctcacaaaagatgtcgacgaagaagatcgtgttgaaaagctccgacggcgagtccttcgaggtggacgaggccgtggctctcgagtctcagaccatagcccacatggtcgaagacgactgcgtcgacaacgggatccctctccccaacgtcacgagcaagatcctcgccaaggtgattgagtactgcaagaagcacgtcgacgccgccgcttccaagaccgaggccgtcgacggtggcgcttcctccgacgatgacctcaaggcgtgggacggcgagttcatgaagatcgatcaggccaccctcttcgagctcatcctggctgctaactatttgaacatcaagaaccttcttgacctgacatgccagacggttgctgatatgatcaagggcaagactccagaggagattcgccagaccttcaacatcaagaacgactttacacccgaggaagaggaggaggtgcgcagagagaaccagtgggcttttgaatgatcaatggcctgtcattggaagcaaaacccccttttatgttattgtccttctcttttactctgtggatgatgatagacttggttttctttctattttcgctttgcaattcatgactattttcgtccttatttattaaatattaagaacctatgcttgctcaatcggtcctgaagggtaatgttggtttgct

SEQ ID NO: 8416 - DNA, 854 bp, Eutrema halophilum
aaaagaataataaacattttccttattttcctaatccttcgatgacttcttaacaatcgaccgactatcaaaattagggatatatatacatacacagagagacgcatacctttatttccatcatccatcgcttcttctcaaatctcctcaaaagcaaaaaacaaatctcccaaatctctcctctttttctccacagagatgtcgtcgaagaagattgtgttgaagagctccgatggcgagtctttcgaggttgacgaggcggtggctctcgagtcccagaccatagcgcacatggttgaagacgactgcgtcgacaacggagtccctcttcccaacgtcacgagcaagatccttgccaaggtgatcgagtactgcaagaagcacgttgattccgctgcttccaagagcgaggccgtcgatggtgcttcctccgacgaagacctcaaagcctgggataccgagttcatgaagatcgatcaggctaccctcttcgaactcatcctggctgctaattatctgaacatcaagaaccttcttgacctaacatgccagacagtggctgatatgatcaaaggcaaaactccagaagagattcgcacgaccttcaacatcaaaaacgacttcacacccgaggaagaagaggaggtgcgcagagagaatcaatgggcttttgaatgagcgtttgttcgaggaaggtgtcgaatcaaaagagcaaccatttcttctttatgttattgtcgttcgttttcagtgtctattgcctctgttttttttttgtttcttttgaaaaattcatgaagacttgatcctcctcctcgtgctttttctttttttcttttgacaattatgaacta

SEQ ID NO: 8417 - DNA, 861 bp, Brassica juncea
gattcatcgcttctctgaaaaacaaatctctcaaaaatcgaaaaaagatgtcgacgaagaagatcgtgttgaagagctccgatggcgagtctttcgaggtcgacgaggctgtggctcgcgagtctcagaccctagctcacatggtcgaagacgactgcatcgagaacggtatccctctccctaacgtcacgagcaagatcctcgccaaggtcatcgagtactgcaagaagcacgtcgacgccgctgctgccaagaccgagggggccgtcgatggtgctgcttcatccgacgatgacctcaaggcgtgggataccgagttcatgaagatcgatcaagcaaccctcttcgaactcatcctggctgctaattacctgaacatcaagaaccttcttgacctcacgtgccagacggtggctgatatgattaaaggcaagactccagaagagattcgcacgaccttcaacatcaagaacgacttctcacccgaggaagaggaggaggtgcgcagggagaatcaatgggcttttgaataatgatcaaagcgaggtcgtggaagtagttataaacctaccaagtttcttccctttatgttaattcgcgtctttatcttaagatcggtgtttggttctcgttcttcttctatctaatctacaagtactcttaaataacaaacaaaaataacaaacaagtgaagtagatgatatcctaacagaatgcagattcataaactatgttctcccctgctctgctcttagcttggattaacactgtataccagtgagctgtaaaagaaacacatgtatccttttaactgagagtctgagacacatcttagagaacatgtatccttttaactgagag

SEQ ID NO: 8418 - DNA, 759 bp, Raphanus sativus
ggattcatcgcttctctaaaaaaaaaacaaatctctctcaaaaatcaaaaaagatgtcgacgaagaagatcgtgttgaagagctctgatggcgagtccttcgaggttgacgaggccgtggctcgcgagtctcagaccttagctcacatggtcgaagacgactgcatcgagaacggtatccctctccccaacgtcacgagcaagatcctcgccaaggtgatcgagtactgcaagaagcacgtcgacgccgctgctgccaagaccgaggccgtcgatggcggtgcttcctccgacgatgacctcaaggcgtgggacgttgagttcatgaagatcgatcaagctaccctcttcgaactcatcctggctgctaattatctgaacatcaagaaccttcttgaccttacgtgccagacggtggctgatatgatcaaaggcaagactccagaggagattcgcgcgaccttcaacatcaagaacgacttcacacccgaggaggaagaggaggtgcgcagggagaaccagtgggcttttgaatgaagacaaagagagccttgttgaagcaaacccaccaagcttctttcttttttttatcttattttcgttttttatgttcttaggaaaaaaaattaatgacttgtgttggtcctactagtgcttttcttatttgcgattaagaaccaatgatttgaataatttgtgcttatatcagtcttggtatcttgtttctcttctatctaatctacaagttatgcattcaaaa

SEQ ID NO: 8419 - DNA, 652 bp, Brassica oleracea
gatcgcttccctcaaaaacaaataaaaatctctaaaatcaaaaaagatgtcgacgaagaagattgtgttgaagagctccgacaacgagtctttcgaggttgacgaggccgtggctcgcgagtctcagaccctagctcacatggtcgaagacgactgcaccgacaacggcatccctcttcccaacgtcaccggcaagatcctcgccaaggtgatcgagtactgcaagaagcacgtcgacgccgctgctgccaagaccgaggcggccgccgatggtggcgcttcctccgacgatgacctcaaggcttgggatgccgagttcatgaagatcgatcaggctaccctcttcgaactcatcctggctgctaactatctgaacatcaagaaccttctcgacctcacgtgccagacggtggctgatatgatcaaaggcaagactccagatgagattcgcacgaccttcaacatcaagaacgacttctcgcctgaggaggaagaggaggtgcgcagggagaaccaatgggcttttgaatgatcaccaaagagaagccttgttgaagctatagcagaacctgcaaagcttcttcctttatcttatttgcgtctttatgttgttaggaaaaattaatgacttatgttggttccgttcttccta

SEQ ID NO: 8420 - DNA, 841 bp, Brassica napus
tcatcgcttccctcaaaaacaaataaaaatctctaaaatcaaaaaagatgtcgacgaagaagattgtgttgaagagctccgacaacgagtctttcgaggttgacgaggccgtggctcgcgagtctcagaccctagctcacatggtcgaagacgactgcaccgacaacggcatccctcttcccaacgtcaccggcaagatcctcgccaaggtgatcgagtactgcaagaagcacgtcgacgccgctgctgccaagaccgaggcggccgccgatggtggcgcttcctccgacgatgacctcaaggcttgggatgccgagttcatgaagatcgatcaggctaccctcttcgaactcatcctggctgctaactatctgaacatcaagaaccttctcgacctcacgtgccagacggtggctgatatgatcaaaggcaagactccagatgagattcgcacgaccttcaacatcaagaacgacttctcgcctgaggaggaagaggaggtgcgcagggagaaccaatgggcttttgaatgatctcaccaaagagaagccttgttgaagctatagcagaacctgcaaagctttcttcctttatcttatttgcgtctttatgttcttaggaaaaattaatgacttatgttggttccgttcctcctagtgcttttctatttaccgattaagaaccaattgttggataatttgtggttataatcagtctttggttatcttgtttctgttttatccaatctacgagtatgcaagatgcatttaaataacattagtctataaatgactctagaactgaactctggctttctttcttccttcgcgtcactcactcg

SEQ ID NO: 8421 - DNA, 2303 bp, Arabidopsis lyrata
aaagttgcgaatgactttttaacaatcgaccgactttatcaaaattagggatttttttatatatatatatatagagacgcttctctttatttccttcatcgcttctcaaaattttcttcaaagaacaaatctcttctcccaaatctaaatcttcttctctcttcgtttccataaagatgtcttcgaagaagattgtgttgaagagttccgatggtgaatctttcgaggttgaagaggcggtggctctcgagtcacagaccatagcccacatggttgaagacgactgcgtcgacaacggagtccctcttcccaacgtcacgagcaagatccttgcgaaggtgatcgagtattgcaagaagcacgtcgaggttgctgccgccaagagcgaggccgtcgatggtgctacctccgatgaagacctcaaggcctgggacactgagtttatgaagatcgatcaggctacgctctttgaactcattctggctgctaattacctgaacatcaagaacttgcttgacctcacatgtcagacagtggcggacatgatcaaagggaagactccagaagagatccgcacaacgttcaacatcaagaacgacttcacacccgaggaagaggaagagcatcacattgtggtcactcgacaagagctaaagaaaatggagggattgaagccaagtgccgcaaactcgtcaccgttaactccgttaggctttcttgagagggcagccaccgtgtatggagactttacctccatcgtttacggcaactccaccgtgtacacttggcaggaaacgaatctccgttgcctccgcgtcgcgtctgctctgtcttccattggaattggaagatccgacgttgtctctgtcctatctgctaacactccggagatgtacgagctccagttcgccgttccgatgtgtggcgcaatccttaacaacctcaacacgcgtcttgatgcgcaaaccgtctctgttcttctccgccattgcgagtctaagctgcttttcgtcgacgtgttttactccgatctcgtcgtagaagcgatcgcgacgttgctcaatccgccgattctcgtcctaatcgctgaccaggaggagggagcagctgtagtgacggagcgttcaaaattctgttacttgtacagtgatctagtcaagagaggcaatccggattttaaatggatccgacccgaaagcgaatgggacccgattgtggtcaactacacatccggtacgacgtcgtctcctaaaggagtggttcattgccataggggtattttcgtcatggcgcttgattctttaactgattgggccgtaccgaaaaatccggtttacttatggaccttacccatatttcacgctaacggttggacctatccatggggaatcgctgccgtcggaggaactaacgtctgtgtgcgtaaactccacgcgccgttactctaccgtctaatccgtgatcacggcgtgactcacatgtgtggcgcaccaatattgcttcagattctatcggcaagtcaagaatctgaacagcctcttaagaacccggtcaaattcttaaccgccggttcggctccgccggctacggtgctcctccgcgccgaatctctaggtttcatcgttagccacggttacggattaacggagacagccggtgtgatcgtctcctgcgcgtggaacccaaagtggaatcgattaccggcgagtgaccaagcgagattgaaatcacggcaaggagtgagaaccgtcggatttagcgaaatcgatgtagtggatccagaatcgggtcggagagtggagagagatggagcaacgttcggagaaatagtgatgagagggagttcaatcatgctcggatacttgaaagatccgatcggaactcaaaaatcgtttaagaacgggtggttcttcaccggagacgtcggtgtgattcacggagatggttacttagagattaaagatagatcgaaagatgtgattatttcaggaggagagaacgtgagcagtgtggaagtggaggcagtgttgtacacgaatccggcggtgaatgaagcggcggtggtggctagacctgatgagttttggggagagacgccgtgtgctttcgtgagtttaaaacccgggttgacccggaaacccacggataaggagattattgagtattgcaagaagaagatgccacgttacatggtgcctaaaacggtgtcgtttcttgaagagttgccaaagagttctacaggaaagattacaaagttattgcttaaagagattgccaaaaaaatgtaaaagaatttgcaaaaa

SEQ ID NO: 8422 - DNA, 877 bp, Brassica rapa
aacttaatcaaaattagtataaatagagatacgcatcccttcatattctcctcatcgcttccctcaaatctctcaaaaacaaatcaaaaagatgtcgacgaagaagattgtgttgaagagctccgacgccgagtctttcgaggttgacgaggccgtggctcgcgagtctcagaccctagctcacatggtcgaagacgactgcaccgacaacggcatccctcttcccaacgtcaccggcaagatcctcgccaaggtcatcgagtattgcaagaagcacgtcgacgccgctgctgccaagacagaggccaccgccgatggtggcgctccctccgacgaggacctcaaggcttgggatgccgagttcatgaatatcgatcaagctaccctcttcgaactcatcctggctgctaactatcttaacatcaagaaccttcttgaccttacgtgccagacggtggctgatatgatcaaaggcaagactccagacgagattcgcacgaccttcaacatcaagaacgacttctcgcctgaggaggaagaggaggtgcgcagggagaaccaatgggcttttgaatgatgatcaaagagaagccttgttccttgttgaagctagctactagacctgcaaagcttcttccttttatcttatttgcgtctttatgttcttaggaaaatataatgatttatgttggttcctcctagtgcttttccatttaccgattaagaaccgatgattggataatttgtggttataatcagtctttggttatgttgctatcttgtttatgctttatctaatctacgagtatgcaagatgatgcatttaaacaacaactgagatagattatcctataattactcaagaactgaacactga

SEQ ID NO: 8423 - DNA, 794 bp, Brassica napus
cttccctcaaatctctcaaaaacaaatcaaaaagatgtcgacgaagaagattgtgttgaagagctccgacgccgagtctttcgaggttgacgaggccgtggctcgcgagtctcagaccctagctcacatggtcgaagacgactgcaccgacaacggcatccctcttcccaacgtcaccggcaagatcctcgccaaggtcatcgagtattgcaagaagcacgtcgacgccgctgctgccaagacagaggccaccgccgatggtggcgctccctccgacgaggacctcaaggcttgggatgccgagttcatgaatatcgatcaagctaccctcttcgaactcatcctggctgctaactatctgaacatcaagaaccttcttgaccttacgtgccagacggtggctgatatgatcaaaggcaagactccagacgagattcgcacgaccttcaacatcaagaacgacttctcgcctgaggaggaagaggaggtgcgcagggagaaccaatgggcttttgaatgatgatcaaagagaagccttgttccttgttgaagctagctactagacctgcaaagcttcttccttttatcttatttgcgtctttatgttcttaggaaaatataatgatttatgttggttcctcctagtgcttttccatttaccgattaagaaccgatgattggataatttgtggttataatcagtctttggttatgttgctatcttgtttatgctttatctaatctacgagtatgcaagatgatgcatttaaacaacaactgagatagattatccc

SEQ ID NO: 8424 - DNA, 738 bp, Brassica juncea
gtcgacgaagaagattgtgttgaagagctccgacgacgagtctttcgaggttgacgaggccgtggctcgcgagtctcagaccctagctcacatggtcgaagacgactgcaccgacaacggcatccctcttcccaacgtcaccggcaagatcctcgccaaggtcatcgagtattgcaagaagcacgtcgacgccgctgctgccaagacagaggccaccgccgatggtggcgctccctccgacgaggacctcaaggcttgggatgccgagttcatgaatatcgatcaagctaccctcttcgaactcatcctggctgctaactatctgaacatcaagaaccttcttgaccttacgtgccagacggtggctgatatgatcaaaggcaagactccagacgagattcgcacgaccttcaacatcaagaacgacttctcgcctgaggaggaagaggaggtgcgcagggagaaccaatgggcttttgaatgatgatcaaagagaagccttgttccttgttgaagctagctactagacctgcaaagcttcttccttttatcttatttgcgtctttatgttcttaggaaaatataatgatttatgttggttcctcctagtgcttttccatttaccgattaagaaccgatgattggataatttgtggttataatcagtctttggttatgttgctatcttgtttatgctttatctaatctacgagtatgcaagatgatgcatttaaacaa

SEQ ID NO: 8425 - DNA, 686 bp, Euphorbia peplus
ccgtcgaacaatcctgtgtcgttttccgattaccttgaaacgatgtcgtctaagaagatcgtcttgaagagcagcgacggagagtcgttcgaggtggaggaggcggttgccgttgaatcgcaaacgatcaaacatatgatcgaggatgattgcgccgataacggaatcccccttcctaatgttacgagcaagatcttggctaaggtgattgagtattgtaagaagcatgtcgagtccggcgccgctaaggctgaagatcgttcttctgcctcctctgatgatgatcttaagacatgggatgctgatttcgtcaaagttgaccaggctaccctcttcgatcttattctggctgctaactacttgaacatcaagggactgcttgatctgacatgccagactgttgctgacatgatcaaagggaagacaccagaggagattaggaagacatttaacatcaagaatgacttcactgctgaggaggaagaggaggttcgtcgtgagaaccagtgggcatttgagtgaagtgttctaccatggtttatgaagtaatagttttcaagtcaggctgtttagttttaccgcaaacaatttattttggcaatttagcttagatcagttgttagagtttcatcctttcaattgcggtttcggatttattgctatattatgtaaataatatttgcatt

SEQ ID NO: 8426 - DNA, 631 bp, Brassica napus
gatgtcgacaaagaagattgtgttgaagagctccgacaacgagtctttcgaggttgacgaggccgtggctcgcgagtctcagaccctagctcacatgatcgaagacgactgcaccgacaacggcatccctcttcccaacgtcaccggcaagatcctcgccaaggtgatcgagtactgcaagaagcacgtcgacgccgctgcctgccaagaccgaggccggccgccgatggtggcgcttcctccgacgatgacctcaaggcttgggatgccgagttcatgaagatcgatcaggctaccctcttcgaactcatcctggctgctaactatctgaacatcaagaaccttctcgacctcacgtgccagacggtggctgatatgatcaaaggcaagactccagatgagattcgcacgaccttcaacatcaagaacgacttctcgcctgaggaggaagaggaggtgcgcagggagaaccaatgggcttttgaatgatctcaccaaagagaagccttgttgaagctatagcagaacctgcaaagctttcttcctttatcttatttgcgtctttatgttcttaggaaaaattaatgacttatgttggttccgttcctcctagtgcttttctatttaccga

SEQ ID NO: 8427 - DNA, 785 bp, Cyamopsis tetragonoloba
cacgaggcaattgagaaaaagttagggttagggatttctccttttctcaccgattctaatcgaagtccaaccatgtctacgacgaagaagatcactctcaagagttccgatggcgaggcgtttgaggttgaagaagtggtggcgctggaatcgcagacgataaagcacatgattgaagacgattgcgccgacagtggaattcctctgcccaacgtcaacagcaagatcctggcgaaggtcatcgaatactgcaagaagcacgtcgaagccgctgcttctgaagcggagaaggcctccgaggatgacctcaaggcttgggacgctgatttcgtcaaggtcgatcaggccacgctcttcgatctcatcctggctgccaactacttgaacatcaagagcttgttggaccttacttgccagactgtagcagacatgatcaaagggaaaactcctgaggaaattcgcaagaccttcaatattaagaatgatttcactcccgaggaagaggaagaagtccgtagggaaaatcaatgggcatttgaatgattttattaagcttgtgaagtctcaatcaaagatcttacatgtggatttatgctatgtttgctttctttatcaaagatctgctatgtagatttatctatgctatagttgatttcgagtttggactatttatgttgactatctttatggtttattttcgtttattgactttaagggcatcttaaattgtaagtaaaagttaaatatgttgaattgcctggtcactggggccttttgaatccaaa

SEQ ID NO: 8428 - DNA, 796 bp, Ipomoea batatas
ggcggggactgcgttttcagcttctattgctctatatatcgttctccttgtttctctctcttagggttacgattaagaatctagatccattctcatcgcccggaattggagatgtcttcctcaaagatgatcgttttgaagagttccgacggtgaaactttcgaggtcgaagaggcggtggcgctcgagtctcagacgatcaagcacatgattgaggacgactgcgctgatactgttatccccctccctaatgtcactagcaagatcttggctaaggttatagagtactgtaagcgccatgttgaggcggctgcgaagtctgaggataagcccggtgatgatgatctcaagacctttgacgccgatttcgtcaaagttgaccaggcaacgctctttgatcttattttggctgccaattacctcaacatcaagagcttgctggatcttacctgtcaaactgttgctgatatgatcaaggggaagacgccagaggagatccgcaaaacattcaacatcaaaaatgacttcacacccgaggaggaggaagaggtccgaagggagaatgcttgggcatttgagtgaagtgaagtttgaagtctgttaattgccgccacgctttaaccatgtttgctatatatcctagtagatgctaaggacaatcgtgatggtagtagtagtatatatatatatgtctggtatgttattttgcgcagaacatgacattgtctgataagatgctacccttctatgttttgaattcgccttattttgcaatgcaatttatttgttgccgatc

SEQ ID NO: 8429 - DNA, 855 bp, Prunus persica
ttcgtctatttgttattttcttgcgaaagcaaaatcactcactaaccagaaacacaaagcggtctctctctcgccttcgagttttctagggatatccaagaccggtgctgtttcgaaacccatcaatcgtcataaccatcatgtcgtcgtcgtcgaagaagatcaccctgaagagctctgatggcgaatcgttcgaggttgaagaagcggtggctcttgagtcgcagaccatcaagcatatgatcgaggacgattgcgccgacaacggcattcctctgcccaacgtgacgagcaagatcttggccaaggtcatcgagtactgcaagaagcacgtcgacgctgccaagcctgatgagaagatctccgaggatgatctcaaggcttgggatcaggactttgtcaaagttgaccaggcaaccctatttgatctcattctggctgcaaactacttgaacatcaagctcctgctggacctgacatgccagactgttgcggacatgatcaaggggaagaccccggaggagatccgaaagaccttcaatatcaagaacgacttcaccccggaggaggaggaggaagttcgtcgcgagaaccagtgggcatttgaatgaagttattgtgatggtgtttatttagttggaacttaaaacagtggcataccctatcatgtattctagttaatcaactgacttcttatcattctctggtatttaagtactttttatggaagttgtgagtccttttaaattgtagataaaacttggattctggtattgatagtggttcgtttcgttctgctgtcaatcctactgtcagtactattatgaatcaaatcttttgctgccattaagttga

SEQ ID NO: 8430 - DNA, 1085 bp, Glycine max
atccccaatcagagagaaaagttagggttcacaacttttccttttccttttgcttgcgaatctgaatcaaataatcaatcatccattcattattcatcatgtcgtcggcgaagaaaatcacgctgaagagttcggacggcgaggctttcgaggtggaggaggcggtggcgctggagtcgcagacgataaagcacatgatcgaggacgactgcgccgacagcggcatccctctgccgaacgtgacgagcaagatcctggcgaaggttatcgagtactgcaagaagcacgtcgaggccgcgaatcccgaagacaaaccctccgaggacgatctcaaggcctgggacgctgaattcgtcaaggtcgaccaggccacgctcttcgatctcatcctggctgctaactacttgaacatcaagagcctgctggaccttacatgtcaaactgtagccgacatgatcaaggggaagactccagaggaaattcgcaagacctttaacattaagaatgacttcacccctgaggaggaagaggaagttcgtcgggaaaaccaatgggcatttgaatgattttgttaatctcaaaaaatctgaatcaaagatctgccatgtggatttatgctatgcttgtttgtttatcaaagatctctcttgtagatttgcctatgctatatacttgtttgttttatattcaagactatttccgttgactgtgttcactacaactagtcataagaattatcttccttcatgaacttaagagcactttgaattgtaagtaatagttatgatgagggatgcgttgattctgacacgagggttattgagttcaataacagccaacccttggctccatatttttcatcccgtgaactacgtgataatgtgtatatgcacctttgtaaaggggaggtgcagaaacaagattcggagaccatttgatcatgtttgccaaggtggtaggtagctccatgtttcatggtcgattcatattacttttcatcacgtctcactaatctacattaatgtgttactttcagactttgtcattcatgtctaagaagtaagagaacattccaagtatcttat

SEQ ID NO: 8431 - DNA, 765 bp, Ipomoea nil
gtttagcgttttcactcttcaccttctattgctcaatatatcgttctccttgtttctctctcttagggttaagattctagatccattctcatcgcccggaattgaagaagatgtcttcctcaaagatgatcgttttgaagagttccgacggtgaaactttcgaggtcgaagaggcggtagcgctcgagtctcagacgatcaagcacatgattgaggacgactgcgctgataccgtcatcccactccctaatgtcactagcaagatcttggctaaggttatagagtactgtaaacgccatgttgaggctgcttccaagactgaggagaagcccggtgaagatgatcttaagacctttgacgccgatttcgtcaaagttgaccaggcaacgctctttgatcttattttggctgccaattacctcaacatcaagagcttgctggatcttacctgtcaaactgtcgctgatatgatcaaggggaagacgccagaggagatccgcaaaacattcaacatcaaaaatgacttcacacccgaggaggaagaagaggtccggagggagaatgcttgggcatttgagtgaagtgaagcttgaagtctgttaattgccaccatgctttaaccatgtttgctatatatcctagtagatgctaagggcaattgttatggtagtagtatatatatatatgtctggaatgttattttgcgcagaacatgacattgtctgataagatgctacccttctatgttttgaattcaccttattt

SEQ ID NO: 8432 - DNA, 830 bp, Lotus japonicus
gttcacatcacacaattatccaaccaacaaaaagttagggttagggatttcactttttctatctgcgaaaagggggaagaagaaagaacgaaattctcattctcatccaaaatccatccaaccaccatgtcttcagcgaagaagatcacgctcaagagttccgacggcgaggccttcgaggtcgacgaggcggtggcgctcgagtcacagacgatcaagcatatggttgaggacgactgcgccgacagcggcatccctctgcccaacgtcaccagcaagatcttggccaaggtgatcgagtattgcaagaagcacgttgaggctgcgaatcccgatgagaaacccaccgaggatgagcttaaggcttgggatgctgatttcgtcaaggttgatcaggccacgctgttcgatctcatcctggctgcgaactatttgaacatcaagagcctgttggaccttacatgccagactgtagctgacatgatcaaggggaagacacccgaggagattcgcaagacctttaacatcaagaatgacttcacccctgaggaagaggaggaagttcgtagggaaaaccaatgggcatttgaatgattttgttaaagcttgaaaacttataagttaatatgtgttatgtggatccatgctatgtttgttttttgttttaatcaaaggtctgcatgtagagtatctgtgcaacgaacctcgtctatcttttggattatttctgttgactatgttcactggtcagaactatcttcatgaacttaatgagcattttgaaatgtaagtaatagtgaattatgaattgacgaggggatgcgtttatt

SEQ ID NO: 8433 - DNA, 900 bp, Quercus alba
tagtatcagcgttctagatcgcgattaattaacttttttttttttctgcgcataaaagagaagactccagggccaacttctcgcttggctttctagggttttcctattccctttcgttattctctgcaggttaggcgaacaaaactccgtcgtttcatcgatcggaaccatgtcgtcgtcgaagaagatcaccctgaagagctctgacggtgaggctttcgaagtggaggaggcggtggcgcttgagtctcagacgatcaagcacatgattgaggacgattgcgccgacaacggaatccccctcccgaacgtgacgagcaagatcttggccaaggtcatcgagtactgtaagaagcacgtcgaggccacctgtgccgacgagcgcacctccgacgaagatctcaaggcttgggacaccgagttcgtcagggttgaccaggccaccctcttcgatctcattctggctgcaaactatttgaacatcaagagccttttggatttgacatgccagaccgtagcggacatgatcaagggtaagacaccagaggagatccgcaagacctttaacatcaagaatgacttcacccctgaggaagaggaagaggttcgtagggagaatcagtgggcatttgaatgatgtactggttgattatgtggagttgaactcaaacaaaaatgtgtttttatggtgtattatgtgggtttatattacattagtaatagttattctctgactctctctttttgtctgttttaagtactctctcgtttgaaattgtgagcgctttaaagtgtaaataatattcagattttgatgggggcattggtagcagttgtcctgctatcaattccactatcatttcaatgctttatatcgatttgttgtgaaaaaaaaaaaaa

SEQ ID NO: 8434 - DNA, 1053 bp, Glycine max
aagaaaatgtcccggtagccctataaataaagcccaagcgttgtatttagcttttcatcccaatcagaaaaagttagggtttgtaactttgtcttttgcttgcgaatctgaatcgaataataatcaatcaatcatcatgtcgtcggcgaagaagatcacactgaagagttcggacggcgaggctttcgaggtggacgaggcggtggcgctggagtctcagacgataaagcacatgatcgaggacgactgcgccgacagcggcatccctctgccgaacgtgacgagcaagatcctggcgaaggtgatcgagtactgcaagaagcacgtcgaggccgcgaatcccgaagacaaaccctccgaggacgatctcaaagcctgggacgccgatttcgtcaaggtcgaccaggccacgctcttcgatcttatcctggctgcgaactacttgaacatcaagagcctgctggaccttacatgccaaactgtagccgacatgatcaaggggaagactcccgaggaaattcgcaagacctttaacattaagaatgacttcacccctgaggaagaagaggaagttcgtcgggaaaatcaatgggcatttgaatgattttgttgagctcataaaatatgaatcaaagatctgccatgtggatttatgctatgcttgtttgtttatcaaagatcttccttgtagatttgcctatgctatatacttgcttgttttatatttaagactatttctgttgtcagaattatcttccttcatgaacttaagagcactttgaactgtaagtaatagttatgatgaggggtgcgttgattctgacacgagggttattgagctcaataacagccaacttttggctccaaatttctcatcccgtatattaataataacgtgtatgccccaaaaagtggtgcagcaaaacaagattcggagaccgtttgatttaccaaggtggtagctccatgtttcatggtcggttcatatattattttgatcacgaatcatgtttacgtttatgtctaagaagaagctacagagaagtgaaagaa

SEQ ID NO: 8435 - DNA, 1209 bp, Glycine max
ctaatggataaacaaaacgatatatttatttttatttttttaaaaaaaagaagtccctttagtcctataaataaagcccaagcgatatatttggtctttcatccccaatcagagagaaaagttagggttcacaacttttccttttccttttgcttgcgaatctgaatcaaataatcaatcatccattcattattcatcatgtcgtcggcgaagaaaatcacgctgaagagttcggacggcgaggctttcgaggtggaggaggcggtggcgctggagtcgcagacgataaagcacatgatcgaggacgactgcgccgacagcggcatccctctgccgaacgtgacgagcaagatcctggcgaaggttatcgagtactgcaagaagcacgtcgaggccgcgaatcccgaagacaaaccctccgaggacgatctcaaggcctgggacgctgaattcgtcaaggtcgaccaggccacgctcttcgatctcatcctggctgctaactacttgaacatcaagagcctgctggaccttacatgtcaaactgtagccgacatgatcaaggggaagactccagaggaaattcgcaagacctttaacattaagaatgacttcacccctgaggaggaagaggaagttcgtcgggaaaaccaatgggcatttgaatgattttgttaatctcaaaaaatctgaatcaaagatctgccatgtggatttatgctatgcttgtttgtttatcaaagatctctcttgtagatttgcctatgctatatacttgtttgttttatattcaagactatttccgttgactgtgttcactacaactagtcataagaattatcttccttcatgaacttaagagcactttgaattgtaagtaatagttatgatgagggatgcgttgattctgacacgagggttattgagttcaataacagccaacccttggctccatatttttcatcccgtgaactacgtgataatgtgtatatgcacctttgtaaaggggaggtgcagaaacaagattcggagaccatttgatcatgtttgccaaggtggtaggtagctccatgtttcatggtcgattcatattacttttcatcacgtctcactaatctacattaatgtgttactttcagactttgtcattcatgtctaagaagtaagagaacattccaagtatcttataatattccagtatatttatgctct

SEQ ID NO: 8436 - DNA, 852 bp, Glycine max
catcccaatcagaaaaagttagggtttgtaactttgtcttttgcttgcgaatctgaatcgaataataatcaatcaatcatcatgtcgtcggcgaagaagatcacactgaagagttcggacggcgaggctttcgaggtggacgaggcggtggcgctggagtctcagacgataaagcacatgatcgaggacgactgcgccgacagcggcatccctctgccgaacgtgacgagcaagatcctggcgaaggtgatcgagtactgcaagaagcacgtcgaggccgcgaatcccgaagacaaaccctccgaggacgatctcaaagcctgggacgccgatttcgtcaaggtcgaccaggccacgctcttcgatcttatcctggctgcgaactacttgaacatcaagagcctgctggaccttacatgccaaactgtagccgacatgatcaaggggaagactcccgaggaaattcgcaagacctttaacattaagaatgacttcacccctgaggaagaagaggaagttcgtcgggaaaatcaatgggcatttgaatgattttgttgagctcataaaatatgaatcaaagatctgccatgtggatttatgctatgcttgtttgtttatcaaagatcttccttgtagatttgcctatgctatatacttgcttgttttatatttaagactatttctgttgtcagaattatcttccttcatgaacttaagagcactttgaactgtaagtaatagttatgatgaggggtgcgttgattctgacacgagggttattgagctcaataacagccaacttttggctccaaatttctcatcccgtatattaataataacgtgtatgcccca

SEQ ID NO: 8437 - DNA, 610 bp, Glycine max
aaacaagcatagcataaatccacatggcagatctttgattcatattttatgagctcaacaaaatcattcaaatgcccattgattttcccgacgaacttcctcttcttcctcaggggtgaagtcattcttaatgttaaaggtcttgcgaatttcctcgggagtcttccccttgatcatgtcggctacagtttggcatgtaaggtccagcaggctcttgatgttcaagtagttcgcaaccaggataagatcgaagagcgtggcctggtcgaccttgacgaaatcggcgtcccaggctttgagatcgtcctcggagggtttgtcttcgggattcgcggcctcgacgtgcttcttgcagtactcgatcaccttcgccaggatcttgctcgtcacgttcggcagagggatgccgctgtcggcgcagtcgtcctcgatcatgtgctttatcgtctgagactccagcgccaccgcctcgtccacctcgaaagcctcgccgtccgaactcttcagtgtgatcttcttcgccgacgacatgatgattgattgattattattcgattcagattcgcaagcaaaagacaaagttacaaaccctaactttttctgattggga

SEQ ID NO: 8438 - DNA, 1094 bp, Cicer arietinum
tgaaccaaaaaataaaaaagattgaaacaatgttttcatgacacgttgaagagtagtatcataatacattggataatcaaaagtgacatctacgaaaataatttaaaattaaaaaaatatccgattataaatacccttgcctcctttgtttttttttccattcacaatttcaagatcacaattttccaattaagaaaaagttagggttagggatttcgcaccttttcccaaaatctcatcaaaatcaaatcactatgtcttcaacgaaaaagatcacccttaagagttccgatggagaggcctttgaggtcgatgaagcggtggctttggagtcacagacgattaagcacatgattgaagatgattgtgccgacagtggaattcctcttcctaacgtgacaagcaagatcttggcgaaggtaatcgagtattgtaagaaacatgttgaggctgcgagttctgatgataaacctactgaggatgatcttaaggcttgggatgctgattttgttaaggttgaccaggctacgctcttcgatctcatacggctgcaaactacttgaacatcaagagccttcttgatcttacctgccagacagttgcagacatgattaaggggaagacacctgaagaaattcgcaagacttttaacatcaagaatgacttcacacctgaggaagaggaggaagttcgtagggagaatcaatgggcatttgaatgatgtgtttcaaatctcacacagagatttgcaaagtggattaatggctattatgtttgttttattcaccaaaaatcctcaatgtagatttatctatgctatgtactctgtttgtctatgggattattcgtgctgagtgttaactatattcactggacagcgttatcttatgtcatgaacttaagggaagtctgaattgtaagtaaagtaatagttgtttatgagcatatgggttgatttggatggttattaaattcaataattgttaccctttggttcctaatttttcattatattaaatgtgtatgcattgtcattaataaattacgttctgttggtcatgcaactaaagcgcattagagatgagatttcatgc

SEQ ID NO: 8439 - DNA, 2770 bp, Malus domestica
tcgttctgattatatttttcccgtgtgcgaaatcaaaagtccctcactacgaccacaaaccaaaagctttcgctatctctatctaacacccttcgagttttcaaagccgtcgtcgtttcgagaccttcgttatcaccgtcaccatgtcgtcgtcgtcgaagaagatcaccctgaagagctccgacggcgagtcgttcgaggtcgaggaggcggtggcgctggagtcacagaccattaagcacatgatcgaggacgactgcgccgacaacggtattcctttgcccaacgtcaccagcaagatcttggccaaggtcatcgagtactgcaagaggcacgtcgacgccgccaagcccgacgagaagatctccgaggacgatctcaaggcctgggatcaggagttcgtaaaggtggaccaggctacgctgtttgatctcattctggctgcaaactacttgaacatcaagagccttttggacctgacatgccagacagttgcagacatgatcaagggtaagactccagaagagatcagaaagaccttcaacatcaataacgacttcaccccggaggaagaggaggaagttcgtcgtgagaaccagtgggcgtttgaatgaagtttctcggtgatggtctttttacttggaacttagtgctggcatacctatcatgtattctagttaatcagcttacttctttatcattctctgtttttaagtgcttttatcggagttgcaagtcctttcaaattgtagataaaagttggattctgatgttggtagtggttcttctactactgtcaatgccattgccagttttactatttctgaagcaaaatcttctacttccattaagttgtttctcacgtggtttgaatcaagcttgctgttcatctcccaacttcataatcgactgcaaatcttcacaatcaaaccacaaagcaaggaagagattgaaaatttaggagttgggagcgggttgcatgtgcgattggcccaaaggagtataaggtgtaaggtgaaaatgggcacaggaaacttggttgattcaattaggaaagggactttggtagtggagactaagagaggaactaggtacataccaggtgtcatgattgtacctggtttagatgagaaccttctcagtgtaggccaaatggctatggttgaactacaaactgctcacaagttgaagaagctcagaagtgacaaaggaggagagtatacatatccctggaatttgagaactgaaattagaaagaaactacttgaagaagaaggtgaagaaacccggaagcagaaaatggagcacgataaagttgttggctgtgtacagttcggcatgctcgaccccaaagaaattatagcagaggaagcgaagagggaaggtctgagtgaccctcggctgggtgcaattgcccgaaatgtcaactgggagacttgtggcggagacgtgcacagctgccctggccattttggtcacattgtattggcccaaccattctaccacgtcttgttcaccaagacggtgttctcggtattggaatccgtatgcttccgctgttcaccaattctgcccaagctctatctggagggcagtagcgtactcaaagatccgatgcacccgcagactaataaaagaaagagaaaagacgaccctgaacctggacctgcaccggcacctgtacaaaaagtgcccgttactgcacaaaaggctcttgctattctgcagaagatacacactgagccatgccgtcagttggggttcaaccttacatttgctcgtccggattggatgatcatacaagttcttccaattcctccacctcacgtgaggcccttcatgagggcggattcttgccgcatttaccaggatgatctcactttccagctctacaggattattcgcctcaataatcatctcaatgctaggaaagtgcgttcccttcatggtgagcgcctgttggagctttacatatcccaatattataacaagttgcctggacaaccaagggctacgacagatgcagggatgcctattagatcaatatgctgcaggcttaatggaagggaaggtcttattagagagcatttgatggaagagcaagtttttgagtcagcacaagcaatggtggagcgccatttgaaggatggggacattgtcgtcttgaaccgtcagcgtagtctccataaaatgtctattatggggcatagagtcaaggtcgtgccaggttcaacttttcggttgaatccgtccatcacttcagctgattttggcggggatcctatgaggatgcatgttcctcagtcattagaaacaaggacggaagtgctagaatgcgtgatggtgcccaaatgcatgttttcccctcagtcaaatcggcttgaagtgggactttccaaagattccctattaggttgttgtaagatcagcaagatgggcaccttcattgagaagaatggtccagatgcagcctgcaaatttttgggcaatgcccagttgcttgcgcactattggtttttgcataatgccttttcgattggaattggagatatggttgttgatctggcaacaacggaaaaaatcaagcagacaatttctgaggcaaaagatgaggtggaagggcttgttagtaaagcccggtccaagcagctggaggctgaacctggacgaactttggtggactcgtttgaaaacaaagtgaaccaggtgcattaatggattgtctgcaatttattcttgtttagcttcctactgttagtaatgtatctgg

SEQ ID NO: 8440 - DNA, 972 bp, Malus domestica
tttttattattttttcccgtgcgaaatcaaattctctcactacaaccagaaccaaatctctctccaaccccttcgagtttttaaagcggcgtcgtttggagaccatcgtcatcaccgtcaccaaccatgtcgtcgtcgtcgaagaagatcaccctcaagagctcggacggcgagtcgttcgaggtcgaggaggcggtggcgctggagtcgcagaccatcaagcacatgatcgaggacgattgcgcagacaatggcattcctctgcccaatgtcaccagcaagattttggccaaggtcatcgagtactgcaagaagcacgtcgacgccgccaagcccgacgagaagatctccgaggacgatctcaaggcctgggatcaggaattcgtcaaggtcgaccaagctacgctctttgacctcattctggctgcaaactacttgaacatcaagacccttttggacctgacttgccagacggttgcagacatgatcaagggtaagactccggaagagatcagaaagaccttcaacatcaagaacgacttcaccccggaggaagaggaggaagttcgtcgtgagaaccagtgggcgtttgaatgaagttctcggtgatgtctctttagtggggaacttcaagagctggcatacctattgtgtattttagtttatcagctgacttctttattattctgtgtttttaagtgctttatcggagtcgttaagtccttgaattgtagataaaagttggattctggtgttggtggttgttcttactgctgtcaatgccagtcagttttactctttctgaattacaatattctacttccattaagtggtttctcatgtggtttgaatcaagcttggtgtgtgtgccttagttgtgttcttttctagcttaatggggatattcatttgatcgcaactggtgtgctgctcatgaatttttgtgaattttcgaatccttgttccgaaaga

SEQ ID NO: 8441 - DNA, 536 bp, Malus domestica
agtttttaaagcggcgtcgtttggagaccatcgtcatcaccgtcaccaaccatgtcgtcgtcgtcgaagaagatcaccctcaagagctcggacggcgagtcgttcgaggtcgaggaggcggtggcgctggagtcgcagaccatcaagcacatgatcgaggacgattgcgcagacaatggcattcctctgcccaatgtcaccagcaagattttggccaaggtcatcgagtactgcaagaagcacgtcgacgccgccaagcccgacgagaagatctccgaggacgatctcaaggcctgggatcaggaattcgtcaaggtcgaccaagctacgctctttgacctcattctggctgcaaactacttgaacatcaagacccttttggacctgacttgccagacggttgcagacatgatcaagggtaagactccggaagagatcagaaagaccttcaacatcaagaacgacttcaccccggaggaagaggaggaagttcgtcgtgagaaccagtgggcgtttgaatgaagttctcggtgatg

SEQ ID NO: 8442 - DNA, 790 bp, Rosa hybrid cultivar
ataaatttgctgaaactctctttttgccatcattattgcttccaataccaatcactccaaaggcgaaacccccaaaacgctgtcgtttcgaaaccatgtcgtcgtcggcgaagaagatcaccctgaagagctccgacggcgagtccttcgaggtcgaagaggccgtcgcgctggagtcgcagacgatcaagcacatgatcgaggacgactgcgccgataacggaattcctcttcccaacgtcaccagcaagatcttggccaaggtcatcgagtactgtaagaaacacgtcgacgctgctaagcccgacgagaaggtcaccgaggaagagctcaagatttgggaccaggatttcgttaaggttgaccaggccacgctcttcgatctaatcttggctgcaaactacttgaatatcaagaatctgctggacctgacatgccagactgttgcggacatgatcaaggggaagaccccagaggagatcaggaagaccttcaatatcaagaatgacttcaccccggaggaagaggaggaggtgcgtcgtgagaaccaatgggcattcgaatagatggagatgatctcagtggtgttttgttgtttatggcatgatacctactactatgtactctagctaagcaattgacttatgtcattttatgttttgaagtacactttattcaagtcgtgaatcctttgaattgtagataaatcttcgaagtctggtattggtagtggtttgttccattatcaatcctgccggtcaatttactgtactactgaatgcttttggtt

SEQ ID NO: 8443 - DNA, 801 bp, Fragaria vesca
acattattattgtgttcacctccccgataccaaatccactcaaacccttttctttgaaacgctgccgtttcaagaaaccatgtcgtcgtcggcgaagaagatcaccctgaagagctcggacggcgagtcgttcgaggtcgaggaggccgtggcgctggagtcgcagacgatcaagcacatgatcgaggacgactgcgccgataacggaatccctctgcccaacgtcaccagcaagatcttggccaaggtcatcgagtactgtaagaaacacgtcgacgctgctaagcccgacgagaaggtcaccgaggaggagctcaaggtctgggaccaggatttcgtcaaggttgaccaggccaccctcttcgatctaatcttggctgcaaactacttgaatatcaagaatctgctggacctgacatgccagactgttgcggatatgatcaagggaaagacacctgaggagatcaggaagaccttcaatatcaagaatgacttcaccccggaggaagaggaggaggtgcgtcgtgagaaccaatgggcattcgaatagagatggagatatgatctcggtggtgttttgttgtttaatggcataatacctactactatgtactctagctaagcaattgacttctatcattttatgttttggagaacgctatgctttattcaagtcgtgagtcctttgaattgtagataaatcttcgaagtctggtgttggtagtggtttgttccattatcaatcctgctggtcaatttactctactgctgaatgctttcggtttgattttcctctgcgcc

SEQ ID NO: 8444 - DNA, 1097 bp, Ricinus communis
gtttatgcctaattgcctatgaatatccacagaaatgcgttcttagcgctaaaagtctaaaatgatgattaaatgttagaacttacaagaattagtcggggaggcagagactcaaggtgtagacgagcacactggatcatttcccaatttcaatatagtgatctccaccgtgcattatgtccaagtccatgatctaggaggttcgtctctatcaataaaatctctgcccttatctgtccacaggatcagcctaccaggggttctcgacgaatactggaagcagcaacaggataaaaaaaaaaaaaaaaaaaaattctaagaagaagaagaagaagaagaaaaaatgtcagcagggaagaaaataacgctaaaaagctcagatggagagacatttgaggtggaggagttggtggcgctggaatcgcagacgataaagcacatgatagaggacgattgcgccgatagcggaatccctctgcctaatgtaacaagcaagatcctttctaaggtaatcgagtactgcaagaagcacgtcgagactcctaaatccgaagatcgtccttcttctgctgatgatgaccttaaagcctgggacgctgaattcgtcaaagttgatcaggctactctcttcgatcttatcctggctgccaattatctgaacatcaagagcttgctggatctaacttgtcagacagtggcagacatgatcaagggaaaaactccagaggagatccgcaaaactttcaacatcaagaatgactttactcccgaggaagaggaggaagttcgcagagagaaccagtgggcatttgagtaaaagaccaggaaaacgtgtctgtattcctagtttctttctgatgttggacatggatgtttaaggattattgccctgcaagtgcttgttattttactgctccatttcctatccagaacagtcaccaactctgatatctggttgtaatcctttcattatgtcaatatggtatatactgttcatttatggaaactttgtgcttaaatatctaatgttgactctgttatccactttgcttgttatgacatggtgcatttctgcaacacttgattgcggtttcatt

SEQ ID NO: 8445 - DNA, 821 bp, Glycyrrhiza uralensis
ggtagattcagatcacaattatccacttaagaaaaattagggttagggattttaccaccactcggtggaaaagaggaagaagaaaatctcatccaaatcaaaatcccaaatccaatcatcatgtcttcaacaaagaaaatcaccctgaagagttccgacggcgaggcattcgaggtggacgaggcggtggcgcttgagtcgcagacgatcaagcacatgatcgaggacgattgtgccgatagtggaatccctctgcctaacgtcaccagtaagatccttgcgaaggtaatcgagtattgtaagaagcacgtggaggccgcgaattccgacgagaaaccctccgaggatgaactcaaggcatgggacgctgatttcgtcaaagtcgaccaggctacgctcttcgatctcatcctggctgcaaactacttgaacatcaagagtctgctggaccttacgtgccagactgtagctgacatgatcaaagggaagacaccagaggaaattcgcaagacctttaacattaagaatgacttcactcccgaggaagaggaggaagttcgtcgggagaaccaatgggcttttgaatgattttgttaagctcttaaatctcaaagaaagatttgcaatgtggatttgttcttatttttgtgttttgttcatcaaagatctgcaatgtagatttatgtatgctatgtacttgttcatctatctgactatttctgttgactatgttcaccggtccgcgttatcttccttgataaacataagggcagtttgaattgtaagtaatagttgaatgtgatgagggaatttgttgagtc

SEQ ID NO: 8446 - DNA, 818 bp, Glycyrrhiza uralensis
gccagtttccattcagatttaacgattaagaaaaagccagggttagggattgtaccttttcctcgtgcgaaaagggggaataagaaaaatcccttccaaaatcaaaaatcgaatcatcatgtcttcaacaaagaagatcacactgaagagttccgatggagaggccttcgaggttgacgaggcggtggcgcttgagtcgcagacgatcaagcacatgatcgaggacgattgtgccgacagtggaatccctctgccaaacgtcactagtaagatccttgcgaaggtaatcgaatactgtaagaagcacgttgaggcggcgaattccgacgagaaaccctccgaggatgaactcaaggcatgggacgccgatttcgtgaaggtcgaccaggctacgctcttcgatctcatcctggctgcaaattatttgaacatcaagagcctgctggaccttacatgtcagactgtggcggacatgatcaaggggaagacacctgaggaaattcgcaagactttcaacattaagaatgacttcactcctgaggaagaggaggaagttcgtcgggaaaaccaatgggcatttgaatgatttttgttaagctcttcaaatctcaatcaaatatctctaatgtggatttatgttatgcttcttatgtttaccaaagatctgcaatgtagatttactatgttatatgcactcttttatctttttgactatttctgttgagtacatccctggatcagaattatcttaagggcatcttgaatgtaagtaattgttgaatatggtgtgctaatgctttatggtacgaggcttgttg

SEQ ID NO: 8447 - DNA, 861 bp, Nicotiana benthamiana
tagagttatagacccaaaactaatagaattccactactttttctctctctagcgtctgttttgtttctctcgtttaacaatcctagggtgtacgtttttgtttgctctgttcaatcgaaccatgtctacttcaaaaatgattgtgttgaagagttccgacggcgaaactttcgaggtggaggaggcggtggcgttggaatcacagaccataaaacacatgatcgaagacgattgtgctgataccagtatccctctccctaatgttacgagcaagatcttggccaaggttattgagtactgtaagcgccacgtcgatgctgttgctaagactgatgataaagcctctgaggatgatttgaaaagctttgatgctgactttgtcaaagttgatcaggctactctctttgatcttatcttggctgctaactatttgaacatcaagagcctgcttgatctcacttgccagactgtggcggacatgatcaaggggaaaactccggaggagatccgcaagaccttcaacatcaagaatgacttcacacccgaggaagaggaggaagttaggagggagaatgcctgggcctttgagtgaatctgatgtctattaagtttccatattctggtgatagatttgaatatatcagtagatgctattaagaatctcgtatattagtaatagatatgccgtgctgtttgtttggtactttttaactcgttgttcaaccaagacagttaacctctttttgctatatatatttacttggtttatctttagagtattagatattttcaaaattgaaatgctgttgaattgtgttaaatctgttatgtttttgttgatatattgccggttgtttgttc

SEQ ID NO: 8448 - DNA, 1057 bp, Prunus mume
aaagctactcctcggacttgttaaattaacctcctctctctatcaaatcccaaaatcatctctcttttggctttctagggttaaggcaccgatctgaacgatgtcgtcagagaggaagataacactgaaaagctcggacggcgagacgttcgaggtggacgaggcggtggccttggagtctcagacgataaagcacatggtcgaggatgattgtgcggacaatgggatcccacttcccaacgtcaccagcaagatcttggccaaggtcatcgagtactgcaagaagcacgtcgacgctgctaagcccgacgaccgcccttccaacgatgaggacctcaaggcctgggacaccgactttgtaaagatcgaccaggccaccctcttcgatctcatactggctgcaaactatttgaacataaagagcttgctggacctgacttgccaaacggtggcggacatgatcaagggcaaaacacctgaggagattcgcaagacgttcaacattaagaacgactttacgcccgaggaagaggaggaggtccgcagggagaaccaatgggctttcgagtgaagacctagagatgaagaaacctgtttttgtggtttgttgctctttttgagctcgtggccgtggaatgctgtttctatctattatctgaaaattttctttacttggttaagtacttttgtttggatatttgttcttctgcagatgacaatcattttcgtccaccttaccccctgctcttctagatctacaaactgtgatgttttcgggttctcttttgttgtatgttaatatgataaaaatgtgcttcttattatgtggtcattcttgtttattttaagttgattgatccctgcctttaggcataaggaatttccaatatgctctgaattattagatcttacctctagattattgcatctttaagttagatgtagagattgtaatattttccaatacgactggagaaactgccatttgcaaggcctgattgtgatgaaatcatattgtgtaggttatggtgattagggaagaaaaattattgaaata

SEQ ID NO: 8449 - DNA, 804 bp, Prunus persica
gccccctctctctatcaaatcccaaaatcatatctcttttgggtttccagggttaaggcaccgatctgaacgatgtcgtcagagaggaagataacactgaaaagctcggacggcgagacgttcgaggtggacgaggcggtggccttggagtctcagacgataaagcacatggtcgaggacgattgtgcggacaatgggatcccacttcccaacgtcaccagcaagatcttggccaaggtcatcgagtactgcaagaagcacgtcgacgctgctaagcccgacgaccgcccttccaacgatgaggacctcaaggcctgggacaccgactttgtcaagatcgaccaggccaccctcttcgatctcatactggctgcaaactatttgaacataaagagcttgctggacctgacttgccaaacggtggcggacatgatcaagggcaaaactcctgaggagattcgcaagacgttcaacattaagaacgactttacgcccgaggaagaggaggaggtccgcagggagaaccaatgggcttttgagtgaagacctagagatgaagaaacctgtttttgtggtttgttgctctttttgagccagtggctgtggaatgctgtttctatctattatctgaaaattttctttacttagtgaagtacttttgtttggatatttgttcttctgcagatgacaatcattttcttccaccttaccccctgctcttctagacctacaaactgtgatgttttctggttctcttttgttatatgttaatatggtaaaaatgtgcttcttattatgtggtca

SEQ ID NO: 8450 - DNA, 611 bp, Glycine max
atcccaatcagaaaaagttagggtttgtaactttgtcttttgcttgcgaatctgaatcgaataataatcaatcaatcatcatgtcgtcggcgaagaagatcacactgaagagttcggacggcgaggctttcgaggtggacgaggcggtggcgctggagtctcagacgataaagcacatgatcgaggacgactgcgccgacagcggcatccctctgccgaacgtgacgagcaagatcctggcgaaggtgatcgagtactgcaagaagcacgtcgaggccgcgaatcccgaagacaaaccctccgaggacgatctcaaagcctgggacgccgatttcgtcaaggtcgaccaggccacgctcttcgatcttatcctggttgcgaactacttgaacatcaagagcctgctggaccttacatgccaaactgtagccgacatgatcaaggggaagactcccgaggaaattcgcaagacctttaacattaagaatgacttcacccctgaggaagaagaggaagttcgtcgggaaaatcaatgggcatttgaatgattttgttgagctcataaaatatgaatcaaagatctgccatgtggatttatgctatgcttgttt

SEQ ID NO: 8451 - DNA, 856 bp, Nicotiana tabacum
  misc_feature (11)..(11): n is a, c, g, or t
cggccgcgggnggaattagatttccactactttttctctctctagtctctaccgtctgctttgtttctctcgtttaacaaacctagggtttgcgtttttgtttgctctgttcaatcgaaccatgtctacttcaaagatgattgtgttgaagagttccgacggcgaaactttcgaggtggaagaggcggtggcgttggaatcacagactataaaacacatgattgaagacgattgtgctgataccagtatccctctccctaatgttacgagcaagatcttggctaaggttattgagtactgtaagcgccacgtcgatgctgttgctaagactgatgataaagcctccgaggatgatttgaaaagctttgatgctgactttgtcaaagttgatcaggctactctctttgatcttatcttggctgctaactatttgaacatcaagagtctgcttgatctcacttgtcagactgtggcagacatgatcaaggggaaaactccggaggagatccgcaagaccttcaacatcaagaatgacttcacacctgaggaagaggaggaagttaggagggagaatgcctgggcctttgagtgaatctgatgtctattaactttctatattctggtgatagatttgaatatattagtagatgctattaagaatctcttatattatatatgtcgtgctgtttgtttggtactttttaacttcgttgttcaaccaagacagttaacctctttttgctatatatatttacttggtttacctttagagtattagatagtttcaaaattgaaatgctgttgaatcgtgttaaatctgttacatctttgttgatatattgttggttgtttgttc

SEQ ID NO: 8452 - DNA, 898 bp, Panax ginseng
tcatatatgccttcaatactatcatctttcatgcaaatcaagaagcagctactcaactaccaagaataggaagcagtggtatcaacgcagagtacatggggctctctcctcaatcaaagcctaggccctagggtttcttatctcttcaactgaaccatgtcgtcgacgaagatcacactgaagagctccgacggcgaggttttcgaggtcgaccaggccgtagctttagagtcacagacgataaagcacatgatcgaagacgattgcgctgataacgggattccgctacccaacgtcaccagcaagatcttgtcgaaggtgatcgagtattgcaaaaagcacgtagacgctcctgccgcagaggatcgtgctgttacagcagatgatgacctcaagactttcgatgctgattttgtcaaagtcgatcaggctactctattcgatctaattttggctgctaattatctgaacatcaagagccttcttgatcttacatgccagactgtggctgacatgattaaggggaaaactccagaggaaattcgcaagactttcaacatcaagaatgacttcacaccagaggaagaagaagaggtccgtagggagaatcagtgggcgtttgaatgaaagatctaaaaagagtagtctgttaatcaggcggcttctatggtttttggtaccagaactttgtacttggtaaaaaactgaggggcgctattgtttttctaaagaaattcattttgctactcataattttaatgctactcatcttattaagtgattccattttgaaaaaaaaaaaaaaaaaaaaaaaaaaaaaaaaaaaaaaaaaaaaaaaaaaaaaaaaaaaaaaacaaaaaaaaaaaaaaaaaaaaaaactaaaaaaaaaaaaaaaaaa

SEQ ID NO: 8453 - DNA, 873 bp, Liriodendron tulipifera
  misc_feature (605)..(605): n is a, c, g, or t
  misc_feature (652)..(652): n is a, c, g, or t
ttcttcatctagggtttccaggcttttcgatctgatccatttcgatggcttcgaagaaggtgaccctgaagagctcggacggcgaggagttcgtgatcgacgaggcggtggccctcgaatcgcagacgatcaagcacatgatcgaggatgactgcgcggacaacggcatcccgcttcccaacgtcaccagcaagatcctctccaaggtcatcgagtactgcaagaagcacgtcgaggcggctgccggaaagaaccccgatgaccgcgccagcgacgacgagctcaagacctgggatgcggacttcgtcaaggtcgatcaggccaccctcttcgatcttatcctggcagcaaactatctgaacataaagagcttgctggacctgacttgccaaacggtggctgacatgataaagggaaagactccagaagagatccgccggacattcaacatcaagaatgatttcacccccgaggaagaggaagaggtccgacgggagaaccaatgggcctttgagtaaagaaatcccccggccaccgcttctcatgtgatgagcatacatacatatacatgatggaggtggtggtggtggggaagtacaggaggnggtggtggtggtaagtacagagtcattaaattagtagggttggcgtnttagtagttttaagtgtatagaggggttggttgcaggcagactatggatactcgcttccaacctcagatttgctttctttccccgttaaatcctttgcattctacacttgtgttttggaccttgtttctaagtttctcatgcttcggattcttttcccatttggtttagactgatttgttttgctattgtttgggtattttgatgatttccatttctctat

SEQ ID NO: 8454 - DNA, 990 bp, Cajanus cajan
gtggggcccacagtacaggcttctagtagcactataaatagaggagccatcgaagctgtaacacacattacaagtcgcgtttcacttcagaaaacgaagcgaacccaatcgaatagagggaaaaagttagggttagggatttgcgatttggggcatggcgtcgaagaagatcacgctcaagagttccgacggcgaggccttcgaggtggaggaggcggtggcgctggagtcgcagacgattaagcacatgatcgaggacgattgcgccgacagtggaatccctcttcccaatgttaccagcaagattctcgccaaggtcatcgagtactgcaagaagcacgttgaggccaccaataacgatgagaagcccactgatgacgagcttaaggcctgggatgctgattttgttaaggtcgatcaggccacgctcttcgatcttattttggctgcaaactacttgaacatcaagagcctattggaccttacttgccagactgtagcagacatgattaaggggaagacacctgaggaaattcgcaagacattcaacatcaagaatgacttcaccccagaggaagaggaagaagttcgccgggaaaaccaatgggcgtttgaatgagttttcaaattccaatgttgtttaagtcatctatagttgctagttatgttactgactattttgtttgtgttgacttatgttcgcgtatcagacttgtgtttcttgttgaacttaaggggcaatcgtgaaattgtaagtaatagttgaatatggtgggcatgcttttgagtctggtatgagggtaattcattgtcaaatgcttgttcctagtaattggtctctcttatattaattgaatagtcgtgtttgttctttcgtaactcgtacctttttgtttgatctttcgtaactcgtaccttcttgcgtgcatagttgtctttacttggaactgtttcaaatctcgctttcgtcaccactgacatgaatgagag

SEQ ID NO: 8455 - DNA, 759 bp, Theobroma cacao
ataagaaaagtgtctgatttctggcaaataaaggaaggaaaagcccctgctagttgatcctttctttttccttctttttgtcgaaagaattcgatagcgaaaacgatgtcgtcttcggggaggaagatcactctgaagagctcggacggcgaatcgttcgaggtggatgaagcagtggcgttggaatcgcagacgataaagcacatgatcgaggacgattgcgccgataacggcataccgttgcccaacgtcacgagtaagatcctggcgaaggtgatcgagtattgcaaaaagcacgtggaggctcctaagacggaagatcgaaccgccgaggacgagcttaaaaattgggacgctgactttgtcaaggtcgatcaagccactctcttcgatctcattctggcagcaaactacttgaacatcaagggtttgttggaccttacttgccaaactgttgctgacatgatcaagggaaagacccctgaggagatcagaaagacttttaacatcaagaatgatttcacccctgaggaggaggaagaggttcgtcgggagaatcagtgggcatttgaatgaagaattggcctattttgatgctgtgaagtggcaaaattatatcaagcttctgtattagatgtagttaattgctctgacttttccatctttctttgttgtcatcagtactttggattctgtgagctgttttaagtattcaagtgacttctatattgctgcctgtccatacaatttcaccagaac

SEQ ID NO: 8456 - DNA, 1742 bp, Theobroma cacao
tttcttttctccataagaaaagtgtctgatttctggcaaataaaggaaggaaaagcccctgctagttgatcctttctttttccttctttttgtcgaaagaattcgatagcgaaaacgatgtcgtcttcggggaggaagatcactctgaagagctcggacggcgaatcgttcgaggtggatgaagcagtggcgttggaatcgcagacgataaagcacatgatcgaggacgattgcgccgataacggcataccgttgcccaacgtcacgagtaagatcctggcgaaggtgatcgagtattgcaaaaagcacgtggaggctcctaagacggaagatcgaaccgccgaggacgagcttaaaaattgggacgctgactttgtcaaggtcgatcaagccactctcttcgatctcattctggcagcaaactacttgaacatcaagggtttgttggaccttacttgccaaactgttgctgacatgatcaagggaaagacccctgaggagatcagaaagacttttaacatcaagaatgatttcacccctgaggaggaggaagaggttcgtcgggagaatcagtgggcatttgaatgaagaattggcctattttgatgctgtgaagtggcaaaattatatcaagcttctgtattagatgtagttaattgctctgacttttccatctttctttgttgtcatcagtactttggattctgtgagctgttttaagtattcaagtgacttctatattgctgcctgtccatacaatttcaccagaaccagtctgttgtatttatttctgttcatggcttttgatgtgaatgggtctgcttgtgtaaactctgtttaccacatggagtgaggcccctgtttctccattgtcttagttcatttatgttaaaatgcccttacaaattgaaagttaactgtataagagaaaaagttaaatctaggtttagtgaggaaacagcttctcttatcagtgattctattggcgtctcttttcctataaaagatgggatcccatgtttggtgccaagagatgggaagatacttgatattgatgatacgatgaatgatgctgctgcggattcagctagaacaaataaggaattggcaggaagtggggatcctttcatcttgctctttccatgctgctaacaatcttctctttccattcaattgcagtggtgttcctgcaggaaaatatggaagaccaaagctgttcttctttgtaaactgctgatattaagacttaatttttctgatttgctgttcaggaaacacaacctttcattgcatgtaatgaaaaaccatttcaggaatgatcagggcaagtctttttgtttgtttctgaaaattgcactgttaaatttatgcattgaaattctttggaatatgttttacagctacccctgtatgcactgaggcatagcttgaactagattctacctgtaaaccacattagaaattaatcaggtttcttcaggactgaggaatcagtatagattcctactttctgtcattgtcttgctttccttcgaagcatgctgcccaatcctccataagatgatgttacaggatattttgctcattacctaatggatactgttaacatcctgattacaattcatgtttcaatcttatgttaactgtcatataatgtattacacattaactgaatttcttttgtcctttaattcagttttaatcgaactatactcacccctaaataaccatttacacaacaa

SEQ ID NO: 8457 - DNA, 815 bp, Fagus grandifolia
tcaatactttttacgctacgcagaaacaaactcctctaagaaaaaggtcaaaagtaatcgaccaccgttagggttttcctatacgcttctttctttttttgcgtttcatcaaaccatgtcttcgtcgaagaagattaccctcaagagctccgatggcgaggctttcgaagttgaagaggccgtggcgttggagtcccagacaatcaagcacatgatcgaggatgagtgcgccgacaacggaatccctctccctaacgtgacgagcaagatcttggccaaggtcatcgagtactgtaagaaacacgtcgaggccaccaaccccgacgaacgcacctccgacgaggatctcaaggcctgggacgccgagttcgtcaaagttgaccaggccaccctctttgatctcattctggctgcgaactatttgaacatcaagagccttttggatttgacatgccagaccgtagcagacatgatcaagggtaagaccccagaggagatccgcaagacctttaacatcaagaatgacttcaccgcggaggaagaggacgaggttcgtagggagaaccagtgggcatttgaatgatgtttcggttgatgatatggagtataacttacaaacaaaaatgtgtttttatggtgtattatgtgggtttatattagtcaatagttattctgactctatctttctctgttttaagtactctctcttgaaattgtgtgcactttaaagtgtaaataatattcagattctgatggggcattggtagtagttggtcctgctatcaattccaatgtcattttaatgctttacttca

SEQ ID NO: 8458 - DNA, 990 bp, Catharanthus roseus
acgacctgacatcttcgattgcggatttcgacttgaagattttcgatttccttcttgctccgaaagtgatgagtgggtgagagttgctgatttccctttctctctcgcttagggttagggtttggttttctcgatcgatttgcttgcaatatctgttgaccgagaagcatgtcttcatcaaagatgatcgtcctcaagagttcagacggtgagactttcgaggtcgacgaggcggtggctctggagtcgcagacgattaagcatatgattgaggacaactgtgccgacaccagtattcctcttcccaacgttaccagcaagatcttggccaaggttatcgaatactgcaagcgtcacgttgaggcctccaagtcgtccgacggtgagaagtcttccgacgaggatctcaaggccttcgatgctgacttcgtcaaagttgaccaagccaccctcttcgatcttattttggctgcaaattacctcaacataaagagccttctggaccttacttgtcaaactgtggctgatatgatcaagggtaagactcctgaggagatccgcaagacattcaacatcaagaatgattttacccctgaagaggaggaggaggttcgcagggagaatgcctgggcttttgagtgaagatttggagttttatatgttcatatccattgccgagacatgttaaagtagtcgtttaaatgtagtgtatatcgtcgatcatgttgctttggattgtttatttgctgctgcttcgaatgaaattggatgaagttgaaccttatatgttgtcaaatattcaactgctttaaatctgagcggtgtcatctgaatcttttgctctagtgtgtctctatttttctttgagatacaaaattagacttgccaatgttctttgcagtgtacaccacagcacatatgtccatacgcttgcctttgtggagcagaggttattagtaagagatggtttgatgtgatcaactagcgcgt

SEQ ID NO: 8459 - DNA, 824 bp, Castanea mollissima
ccagagccatcatctcgcttggctttttagggttttcctattcccctatcgttattaactgcaggttaggtgaaccaaaactccgtcgtttcatcgatcggaaccatgtcgtcgtcgaagaagatcaccctgaagagctctgacggtgaggctttcgaagtggaggaggcggtggcgctcgagtctcagacgatcaagcacatgatcgaggacgattgcgccgacaacggaatccccctcccgaacgtgacgagcaagatcttggccaaggtcatcgagtactgtaagaagcacgttgagtccaccagttccgatgagcgcacctccgacgaagatctcaaggcttgggacaccgagttcgtcagggttgaccaggccaccctcttcgatctcattctggctgcaaactatttgaacatcaagagccttttggatttgacatgccagaccgtagcagacatgatcaagggtaagacaccagaggagatccgcaaaacctttaacatcaagaatgacttcacccctgaggaagaggaagaggttcgtagggagaatcagtgggcatttgagtgatgtactggttgataatttggagtcaaagctcaaacagaaatgtgcttttattgtgtattatgtgggtttatattatattagtaatagttattcggactctctctttctctgttttaagtactctcttgcttgaaattgtgagcactttaaagtgtaaataatattcagattttgatgggggcattggtagcggttggtcctgctatcaatcccacaatcaattcaatgctttatattgatttgttgtcaag

SEQ ID NO: 8460 - DNA, 680 bp, Nicotiana benthamiana
tagaattccactactttttctctctctagcgtccgctttgtttctctcgtttaacaatcctagggtttacatttttgtttgctccgttcaatcgactatgtctacttcaaagatgattgtgttgaagagttccgacggcgaaactttcgaggtggaagaggcggtggcgttggaatcacagaccataaaacacatgatcgaagatgattgtgctaataccagtatccctctccctaatgttacgagcaagatcttggccaaggttatagagtactgtaagcgccacgtcgatgctgttgctaagactgatgataaagcctctgaggatgatttgaaaagctttgatgctgactttgtcaaagttgatcaggctactctctttgatcttatcttggctgctaactatttgaacatcaagagtctgcttgatctcacttgtcagactgtggcggacatgatcaaggggaaaactccggaggagatccgcaagaccttcaacatcaagaatgacttcacacctgaggaagaggaggaagttaggagggagaatgcctgggcctttgagtgaatcagatgtctattaagtttccatattctggtgttagatttgaatatattagtagatgctattaacaatctcgtatagtaatagatatgtcgtgctgtttgtttggtacttt

SEQ ID NO: 8461 - DNA, 1034 bp, Cajanus cajan
cggtataaataaggcaatccctttattatttacacctttttcaccccaatcagagaaaagctagggtttgcgactttcccttttccgaatccaaatcagaatccaatcaatcggcgatgtcgtcggcgaagaagatcaccctgaagagctcggacggcgaggcgttcgaggtggaggaggcggtggcgctggagtcgcagacaatcaagcacatgatcgaggacgattgcgccgacagcggaatccctctccctaacgtcaccagcaagatcctggccaaggtaatcgagtactgcaaaaagcacgtcgacgccgccaaccccgacgacaaaccctccgaagaggatctcaaggcttgggacacggatttcgtcaaggtcgaccaggccacgctcttcgatctcatcctggctgcgaactacttgaatatcaagagcctgctggaccttacatgccagactgtagcagacatgatcaaggggaagactccagaggaaattcgcaagacctttaatatcaagaatgactttactccagaggaagaagaggaagttcgtcgggaaaaccaatgggcatttgaatgattttgttaagctcataaaatctgaatcaaagatctgccatgtggatttatgctatatgcttgtttgtttatcaaagatcgtccatgtagatttacctatgctatatacttgtttattttatatttcagactctttctgttgactgtgtttatgggtcagaattatctttcttcatgaacttaagagcactttgaattgtaacttgtaagtaatagttatgatgaagggatgcggtgattctgacacaagggttatcgatttcaataatagccaaccattggttcttaatttcccatcccatatattaggaatatcgatttcaataataatgtagtgtggtaatgtaaaggtggtgcagcaaatcaagattaggaaatcgttttaacatatttactcaggtggtagctccatgttttaggttctgttcatacctcaaattatttttcttac

SEQ ID NO: 8462 - DNA, 855 bp, Populus trichocarpa
gtataaaaaatcttctgcttcctcgagaaggctaacaataatttcttgtcgctgtagcttctattttctctcaatcaaagagaaaaataatgtcgacgggccggaaatttattctgaaaagctcagacggagagtcatttgaggtcgaagaagctgtagccgttgaatcgcagactataaaacacatgattgaagatgattgcgctgataacggtatccccttacctaacgtcacaagcaaggttcttgctaaggtgatcgagtactgcaaaaagcacgttgagtcccctaaatcggacgatcgtccttcttctgctgctgatgatcttaaagcttgggatgctgaattcgtcaaagttgaccaggccactctcttcgatctcatcctggctgccaattatctgaacatcaagaacttgctggacctcacttgtcagagagtggctgatatgatcaagggcaagactccagaagagatccgcaagacattcaacatcaagaatgactttacaccagaggaagaggaggaggttcggagagagaaccagtgggcatttgagtagaaggaaagaagttcaacctgtatttctaattgccttctgtgttggacatggatggatgttaaggttttaatgctttgcaaacaatttccattttgtttccatgtcccttatctctccacgtcagtttcaatgtgttgatatggtatatgtccttgccttgtgatttctttgtgttttagattacctaattatgccatctgttatatactatcgttgtttcaccatatgatgctctactaccagttctttggcacctcacatgtttggaacctgcaagcaagttttatgtgat

SEQ ID NO: 8463 - DNA, 794 bp, Juglans hindsii x Juglans regia
  misc_feature (593)..(593): n is a, c, g, or t
ggggattcgcagcaaaaggaaagcgtacgaaaagtcgagtgttttctgcactttttatttcttcttctttctttgtttgcaggatagcgaacgccccgtttcgatatcatgtcgtcgtcgaagaagatcaccctgaagagttccgatggcgagtccttcgaggtcgacgaggccgtgactctcgagtctcagaccatcaagcacatgatcgaggacgattgcgccgacaacggcatccctctccccaacgtgacgagcaagatcttggccaaggtcatcgagtactgcaagaagcacgtcgaaccggccaactctgaggaccgcacctccgaagatgatctgaaggcttgggacatggagttcgtcagggttgaccaggccactctcttcgatctcattctggctgcaaactatttgaacatcaaaagcctcctggatctgacatgccagactgtggcggacatgatcaagggaaagaccccagaggagatccgcaagacctttaacatcaagaatgactttaccccagaggaagaggaagaggttcgtcgggagaaccagtgggcatttgaatgatgtattgagtgataatnttgagtggaacttggaaacaaaaatgtgatttacaaacaacttggtttaagggttactatgtgggtttatatgttaggcatagttgttctggctttatcttcctctgttttaaactcttgctttattgaaatcgtaagctctttgaactgtaaataatattcagattctgatggggggcactggtagtagctgatcctgtg

SEQ ID NO: 8464 - DNA, 932 bp, Lupinus angustifolius
atctataaatagagcccctaacccttcttttccttttcaattcaattgtgaaaaagttagggttagggattttacaattctcaaagcaagaaagttgaagaaatttctcaatctcatcaaatttcaacatgtcaacatcaccaaagaagattaccctcaagagttctgatggagaagccttcgaagttgatgaagtagtggcgattgagtcacaaaccatcaagcatatgatcgaagacgattgcgctgatagcggtatccctcttcctaacgtcaccagcaagatccttgcgaaggttatagagtactgcaagaaacatgttgatgccgcggcttctgaggagaagccaaacgatgatgatctcaaggcttgggacgctgatttcgtcaaggttgaccaatccacgctgttcgatctcattctggctgcaaattacttgaacatcaaaagcctgctagaccttacatgccagactgtggcagacatgataaagggaaagactccggaggaaattcgcaagaccttcaacatcaagaatgatttcacccctgaggaagaggaggaagttcgtagggaaaaccaatgggcatttgaatgatttcaaattctctattaaggcatgtcttgaggattttatgtggattgtctatgctatatacttgctttatttttttctcttgctttctatgttcactgttcagacttatctttcatgaattcaactccgttttaatttgtaagtaatatttgaatatggtgaaattctgctgatgttacgtggaatgatttgcgactctgtggcctagaatgtgttccatctccttcaagatgtgtttgttattttccatttccaattaatgtaacattgctcactcacctgagtacaactaacaagtatattatatcgttaatgtatcatttacaaatccaa

SEQ ID NO: 8465 - DNA, 818 bp, Cleome gynandra
tcggggtacatatacgcattcaagttaaattcagaataagcctagttttctctcactcgctcgaagcttcttcttctcctttctaatctctttggatcagaaacaatgtcgggaaggaaaatcacgctgaaaagctccgatggtgagacctttgaggttgacgaagccgtcgctttggagtcgcaaaccatcaagcacatgatcgaagacgactgcgctgataatggaatccctctccccaacgtcaccagcaagatcctctcaaggtgatagagtactgtaagaagcacgtcgatgctgctgcttcagtcgatgacgatctcaagaactgggacgccgagttcgtcaaagtggaccaggccactctattcgatctcatcctggctgctaactttttgaacatcaagggcctcttggacttgacgtgtcagactgtagccgacatgatcaaaggtaaaactccagaagagatccgcaagacattcaacataaaaaatgacttcaccccggaggaagaagaggaagtgcgtcgtgagaaccaatgggcatttgagtaaagagaaaaatctgccgcgaaaacagagaaaaaaaaagagggataggaaccctctagtcctctgttccggtctgtgattctctatcactgcggttttagttctcttcgaacctgcaagactttcctctagtatctatgtgttcctcgtctttcatcgcttttcttaacgtctctgttgattagctgtttctctcatctgtgtcatatctcggttaagaattgatgcttctactgtcatgctatgaatgttaatatgattggt

SEQ ID NO: 8466 - DNA, 917 bp, Humulus lupulus
ggacaccagatcacaaccctataaataaactcaagtgctcctccctcgctctatcgttcccaaagcttcattgttaagattctggctcttctgctctcgttgaaaagaaaaggtaactcttcgcttcgccggagaagagcatcgtttagagtttttctatacatcgaaacgcaaggaaactctgtttcagtcatgtcttcgtcctcaaagaagatcatcctcaagagctctgacggcgagtcgtttgaggtcgaagaggcggttgcgcttcagtcccagacgatcaagcatatgatcgaagacgattgtgctgataatggcattcctctgcctaacgtgacaagcaaaattcttgctaaggtcatcgagtactgtaggaagcacgttgattcccccaaccctgatgagcgcgtcgccgacgacgatcttaagtcttgggatgcagagttcgtcaaggttgaccaggccacgctctttgaccttattctgtctgcaaactaccttaacatcaagaacctgcttgacttgacatgccaaactgtggctgatatgatcaaaggaaagactccagaggagatcaggaagacattcaacatcaagaatgatttcactccagaggaagaggaagaggttcgccgggagaaccagtgggcttttgaatgattattatatataactaagtggggattattattttgaattgaaatggttgaaaatatgttctagtggggggcttctagttttacgttagtcttagttggttagcttttctcctcacctttctctagtactccttttatctttttgttatcttaattttgtcgtcgtttgatttctgaaacttcttttgggccctctaattgtaaagaattgctggatactggttggtattatggtggtggtttgtcttgcttatc

SEQ ID NO: 8467 - DNA, 851 bp, Humulus lupulus
attctgtctcttctgctctcgttgaaaagaaaaggtaactcttcgcttcgccggagacgagcatcgtttagagtttttctatacatcgaaacgcaaggaaactctgtttcagtcatgtcttcgtcctcaaagaagatcatcctcaagagctctgacggcgagtcgtttgaggtcgaagaggcggttgcgcttcagtcccagacgatcaagcatatgatcgaagacgattgtgctgataacggcattcctctgcctaacgtgacaagcaaaattcttgctaaggtcatcgagtactgtaggaagcacgttgattcccccaaccctgatgagcgcgtcgccgacgacgatcttaagtcttgggatgcagagttcgtcaaggttgaccaggccacgctctttgaccttattctgtctgcaaactaccttaacatcaagaacctgcttgacttgacatgccaaactgtggctgatatgatcaaaggaaagactccagaggagatcaggaagacattcaacatcaagaatgatttcactccagaggaagaggaagaggtccgccgggagaaccagtgggcttttgaatgattattatatgtaactaagtggggattattattttgaattgaaatggttgaaaatattttctagtggggggcttctagttttacgttagtcttagttggttagcttttctcctcacctttctctagtactcctttaatctttttgttgtcttaattttgtcgtcgtttgatttctgaaacttcttttgagccctctaattgtaaagaattgctggatactggatggtattatgatggtggtttgtcttgcttatcaatttatgttat

SEQ ID NO: 8468 - DNA, 906 bp, Humulus lupulus
aaagcttcattgttaagattctgtctcttctgctctcgttgaaaagaaaaggtaactcttcgcttcgccggagacgagcatcgtttagagtttttctatacatcgaaacgcaaggaaactctgtttcagtcatgtcttcgtcctcaaagaagatcatcctcaagagctctgacggcgagtcgtttgaggtcgaagaggcggttgcgcttcagtcccagacgatcaagcatatgatcgaagacgattgtgctgataacggcattcctctgcctaacgtgacaagcaaaattcttgctaaggtcatcgagtactgtaggaagcacgttgattcccccaaccctgatgagcgcgtcgccgacgacgatcttaagtcttgggatgcagagttcgtcaaggttgaccaggccacgctctttgaccttattctgtctgcaaactaccttaacatcaagaacctgcttgacttgacatgccaaactgtggctgatatgatcaaaggaaagactccagaggagatcaggaagacattcaacatcaagaatgatttcactccagaggaagaggaagaggtccgccgggagaaccagtgggcttttgaatgattattatatgtaactaagtggggattattattttgaattgaaatggttgaaaatattttctagtgggggcgttctagtttacgtttagtcttagttggttagctttcttcctcacctttcttctagtactcctttaacttacttttgtttgtcttaattttagttcgtcgtttgtatttcttgaaacttcttttgtagccctcctaattgtaaagaaattgtctggatactggatggtagttaattgatggtgggtttggttcttgtcttattcaatttaattgttattgaaatactagttttt

SEQ ID NO: 8469 - DNA, 876 bp, Panax ginseng
ctctcctcaatcaaagcctaggccctagggtttctttatctcttcaactgaaccatgtcgtcgacgaagatcacactgaagagctccgacggcgaggttttcgaggtcgaccaggccgtagctttagagtcacagacgataaagcacatgatcgaagacgattgcgctgataacgggattccgctacccaacgtcagcagcaagatcttgtcgaaggtgatcgagtattgcaaaaagcacgtagacgctcctgccgcagaggatcgtgctgttacagcagatgatgacctcaagactttcgatgctgattttgtcaaagtcgatcaggctactctattcgatctaattttggctgctaattatctgaacatcaagagccttcttgatcttacatgccagactgtggctgacatgattaaggggaaaactccagaggaaattcgcaagactttcaacatcaagaatgacttcacaccagaggaagaagaagaggtccgtagggagaatcagtgggcgtttgaatgaaagatactaaaaagagtagtctgttaatcaggcggcttctatggtttttggtaccagaactttgtacctaggtaaaaaactgaggggcgctatttgtttttctaaagaaattcattttgctactcataattttaatgctactcatcttataacgtgaattccattttgaatcctagttaaaaaaaaaaaaaacaaaaaaaaacaaaaaaaaaacaaaaaaaaaacaaaaaaaacaaaaaaaacaaaaaaacaaaaaaaaaaaacaaaaaaacaaaaaacaaaaacaaaacaataagagaagaagacagacacgagagagaccacaccacagagacacaccccccccccccc

SEQ ID NO: 8470 - DNA, 755 bp, Panax ginseng
gaagcctaggccctagggttcttatctcttcaactgaaccatgacatccacgaagatcacactgaagagctccgatggcgaggttttcgaggtcgaccaggccgtagctttagagtcacagacgataaagcacatgatcgaagacgattgcgctgataacgggattccgctacccaacgtcaccagcaagatcttgtcgaaggtgatcgagtattgcaaaaagcacgtagacgctcctgccgcagaggatcgtgctgttacagcagatgatgacctcaagactttcgatgctgattttgtcaaagtcgatcaggctactctattcgatctaattttggctgctaattatctgaacatcaagagccttcttgatcttacatgccagactgtggctgacatgattaaggggaaaactccagaggaaattcgcaagactttcaacatcaagaatgacttcacaccagaggaagaagaagaggtccgtcgggagaatcagtgggcgtttgaatgaaagatctaaaaagagtagtctgttaatcaggcggcttctatggtttttggtaccagaactttgtacttggtaaaaaactgaggggcgctattgtttttctaaagaaattcattttgctactcataattttaatgctactcatcttattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 8471 - DNA, 691 bp, Acacia harpophylla
gagatcggaaaactatttgcatccggaactagggttagggatttgttcgcccttcgtcttgttgtgacgactgcagaatcttacgcacaccatacccatcgatcatgtcgaagaagatcaccttgaagagctctgatggcgagccttttgaagttgacgaggcagtggcgcttgagtcccagaccatcaagcacatgatcgaggacgattgtgccgacagtggcatccctctgcctaatgtgaccagcaagatcctggctaaggtaatcgaatactgcaagaagcacgttgatgctgccaattctgaggagaaaatctccgaagaagatctcaggacttgggatgcggatttcgtcagggttgaccaggccacgctcttcgatctcattctggccgctaactacttgaacatcaagagccttctggacctcacatgccagactgtagcggacatgatcaaaggaaagactcctgaggagattcgcaagaccttcaatattaagaacgactttactcctgaggaggaagaggaagttcgccgtgaaaaccaatgggcatttgaatgagtggtcatgtattaagctttctgaagtttcaataacctgctatgttgctttatgttatacttagtttattttgctgcatctatgtatctgattgctattttctcgtctcagacatatcttccttc

SEQ ID NO: 8472 - DNA, 686 bp, Panax ginseng
ctctctcctcaatcaaagcctaggccctagggtttctttatctcttcaactgaaccatgtcgtcgacgaagatcacactgaagagctccgacggcgaggttttcgaggtcgaccaggccgtagctttagagtcacagacgataaagcacatgatcgaagacgattgcgctgataacgggattccgctacccaacgtcagcagcaagatcttgtcgaaggtgatcgagtattgcaaaaagcacgtagacgctcctgccgcagaggatcgtgctgttacagcagatgatgacctcaagactttcgatgctgattttgtcaaagtcgatcaggctactctattcgatctaattttggctgctaattatctgaacatcaagagccttcttgatcttacatgccagactgtggctgacatgattaaggggaaaactccagaggaaattcgcaagactttcaacatcaagaatgacttcacaccagaggaagaagaagaggtccgtagggagaatcagtgggcgtttgaatgaaagatctaaaaagagtagtctgttaatcaggcggcttctgtggtttttggtaccagaactttgtacttggtaaaaaactgaggggcgctattgtttttctaaagaaattcattttgctactcataattttaatgctactcatcttattaagtgattccg

SEQ ID NO: 8473 - DNA, 960 bp, Silene vulgaris
atcaatctcagtttctctctcctagggtttccgcaaaatcaaaacacaaaatcaatcaatggcgtcagagaagaagatcacgcttcgaagctccgatggcgagaccttcgaggtggaggagatagtagctatggagtctcagaccataaagcacatggttgaagatgattgcgctgataatgtcatccctcttcctaatgttaccagcaagattctcgctaaggttattgagtactgcaagaaacatgtcgatgccgaggcgaacaagtctgccgaagccaccactgttaccgctgctgctggtgatgatgagcttaagaactgggatactgagtttgttaaagttgatcaggctactcttttcgatctcatccttgctgccaattacctgaacattaagagcttgctggacttgacctgccaaactgtggccgacatgattaagggaaagacacctgaggagataaggaagactttcaacatcaagaatgatttcacacctgaggaggaagaggaggtccgccgtgagaaccaatgggcctttgaatgattgattgtctggagaattgcgggaacctgttatctgatgatcttatgttgtgttgcgtctcgtagctgttaaactcttgttgctttgtccttgtcttatttgcttttaatggtacaatgtggtcttgtaaataacagtagagctcatggaaggttgcagcttgagggtgaatatcccccattttcgcactttcctgtatcttctgtcttaattaagtcgagtagttggtctcttatgactatctcgtatcagctggggaaaaaagacttatcaatatatgtgggattaagcactactcttctgtctttcgttttgttttctgaatgttcatcatctctttagaatggttcggggtcttgcaaatctagtacatgagcttcgaaccagcttaccaatacagaacttcgaca

SEQ ID NO: 8474 - DNA, 820 bp, Nicotiana benthamiana
agctttctccttctctcggctctattcgctttgtctctgtgttagggtttgttaatctggtcagcaattcagaattcctctttcctcaaagatgaagatgatcgtgctaaggagttccgacggcgagactttcgaggtagaagagtcagttgcccttgagtcgcagacaatcaagcatatgatcgaagacgactgcgccgacaccagcatccctttacctaacgtgacgagcaagatcttagctaaggtgattgagtactgcaagcgccacgtagacgccgcctctaagactgaagataaggccgtcgaggacgatctcaaggctttcgatgctgattttgtcaaagttgaccagagtaccctcttcgatctcatcctggctgccaactatttgaacataaagagattgcttgatctgacatgccagacagttgcagacatgatcaaagggaagaccccggaggagatccgtaagacatttaacattaaaaatgacttcactcctgaggaagaggaagaagtcaggagggagaacgcctgggccttcgagtgaatttgagtctgttaagcgtcaatattgtgctgatagatttgcaatatcttagtagatgttataaacaatcttgtatattagtaaatatgtgagtatgttgtttctgggatctttgactttgtcagttgaagggagacagttgaacctcttttgccttttatgcatggtttcttgtgctctaaatcaaattgaagataaaatcatgtcggtaactgatctccattgtccttgatctattattgcaaattcatattgttttctgtgttt

SEQ ID NO: 8475 - DNA, 795 bp, Nicotiana tabacum
ctctcggctctcttcgcttcgtctcggtgttagggtttgttaatctggtcagcaattcacaattcctctttcctccaaaatgaagatgatcgtattgaggagttccgacggcgaaaccttcgaggtagaagagtcagttgccctagagtcgcagacaatcaagcatatgatcgaagacgactgcgccgacaccagcatccctttacctaacgtgacgagcaagatcttagctaaggtgattgagtactgcaagcgccacgtggacgccgcctctaagacggaagataaggccgtcgaggacgatctcaaggctttcgatgctgactttgtcaaagttgaccagagtaccctcttcgatctcatcctggctgccaactatttgaacataaagagcttgcttgatctgacatgtcagacagttgcagacatgatcaaagggaagacccctgaggagatccgtaagacattcaacattaagaatgacttcactccggaggaagaggaagaagttaggagggagaatgcttgggcttttgagtgaatttgagtctgttaagcgtcaatatgctgctgatacatttgcaatatcttagtagatgctataaacaacttatatattagtaaatatgtgactatgttttctgtctttgtcagttgaaggagacagttgaacctctttgctctttcataccatggtttcttgtgttctaaatagcaattgaagatgaaatcctgtcgatagctgatctccgttttcttgatctataattggaaattcatattgtttcttgtgtt

SEQ ID NO: 8476 - DNA, 787 bp, Gossypium raimondii
aataagaaaagaaacctttgattatttaattcccgttttctaatctttttgggaaatcggtagcaaaaaatgtcgtcgtcggggaggaagatcacccttaagagctcagacggcgaatcattcgaggttgatgaagcggtggcgttggagtcgcagacgattaagcatatgatcgaggacgattgcgctgataacgggataccgttgcctaatgttacgagcaagatcttagcgaaggtgatcgagtactgcaagaaacacgtcgaggctcctaagacagacgatcgatccgccgatgacgagctcaagagttgggacgctgactttgtcaaggtcgatcaagccactctctttgatctcattctggcagcgaactatttgaacatcaagggtttgctggatctcacttgccaaactgttgctgacatgatcaagggaaagaccccagaagagatcaggaagactttcaatatcaagaatgacttcaccccggaagaggaagaagaggttcgtcgggagaaccagtgggcattcgaatgaagggtcaatttcgagtgccggttcaattgtatcaaactcatctatatataaaaatgtagtttgttgctctgacttttcatctgtactcttggatattctgtgagctcttttgaaactcttcaaagtgtcttcttctatgttctttgcctgtcttcactaaaaaccagtctgttgtatccaagtaatgtcctttaatcgtggtctgtgatatgaatgagaatggttgtctaaattatgcttgccattt

SEQ ID NO: 8477 - DNA, 1054 bp, Cannabis sativa
acacccgatcacagcacctataaataaacccaaaagccatgagtccattctctcattcccaaactttgcttattcagattctgtctcttctgcttccgctgaagaaagaaaagataactcttcgccttcgccggagaaaaacgtcgttttgggtgttcttacaccgtcgaaaaggaactaagcgccgtcgttttaaccatgtcttcatcagccaagaagatcatcctcaagagctcagacggtgaatcgtttgaggtggaagaggcggttgcgctccagtctcagacgatcaagcacatgattgaagacgattgcgctgataatggcattcctttgcctaacgttaccagcaagattcttgctaaggtcatcgagtactgcaggaagcatgttgattccccaaaccctgatgagcgcgtcgctgatgacgatctcaaatcctgggacgccgagttcgtcaaggttgatcaggccacgcttttcgacctgattctgtctgcaaactacctgaacatcaagaatctgcttgacttgacatgccaaactgtggctgatatgatcaagggaaagaccccagaggagatcaggaagacattcaacatcaagaatgatttcactccagaggaagaggaagaggttcgcagggagaaccagtgggcttttgaatgacttttacatatatcaatagctattattttgaatggaacaatgtctgaaaatattttctagtggtggggggttcttagtttttaatttagtcttagttgggtagccttttgttctcactttaagtactactctcttcttctcttttaagtttctctctgttgttttgagttatgaaactccttttgggccctccagttgtaaagaattgctgaatactggtattatggtggtggtttgtcatgcttatcaatttatgaatttatgttatgaaacctagttttttacatcggctgagttttcattcactttgaaatttatgttatgatcttgctgctcgttctttacatggggttcttgggtttttatgtctctaaacaaagatata

SEQ ID NO: 8478 - DNA, 1086 bp, Gossypium hirsutum
acgtgtccaatcacaaccgttccataaaaaaccgaacccaatcccaataccacccatcactcatcctctataacaatccctaatttattgtcagtacgaaaagaaacctttgattatttaattcccgttttctaatctttttgggaaatcggtagcgaaaaatgtcgtcgtcggggaggaagatcacccttaagagctcagacggcgaatcattcgaggttgatgaagcggtggcgttggagtcgcagacgattaagcatatgatcgaggacgattgcgctgataacgggataccgttgcctaatgttacgagcaagatcttagcgaaggtgatcgagtactgcaagaaacacgtcgaggctcctaagacagacgatcgatccgccgatgacgagctcaagagttgggacgctgactttgtcaaggtcgatcaagctactctctttgatctcattctggcagcgaactatttgaacatcaagggcttgctggatctcacttgccaaactgttgctgacatgatcaagggaaagaccccagaagagatcaggaagactttcaatatcaagaatgacttcaccccggaagaggaagaagaggttcgtcgggagaaccagtgggcattcgaatgaagggtcaatttcgagtgccggttcaattgtatcaaactcatctatatataaaaatgtagtttgttgctctgacttttcatctgtactcttggatattctgtgagctcttttgaaactcttcaaagtgtcttcttctatgttctttgcctgtcttcactaaaaaccagtctgttgtatccaagtaatgtcctttaatcgtggtctgtgatatgaatgagaatggttgtctaaattatgcttgccatttactatccatctattgctatatgccccaagttttaattgacttaaccgatcaataggctaagttgatgaaattgattttacttcttctcgttgtcatcttagcatgggaaataaaacatgaatggaagtgtctcaagtctgtcaaggctacccattttggttggttatgaaaattcataattgatatttgactgccaaaaaaaaaact

SEQ ID NO: 8479 - DNA, 1216 bp, Gossypium raimondii
aatctagaatcagagaaaaacttttgggatgcttaatgcaattaacccaaattaaaacgttgaaaataccttttctattgtgttaaacgtgtctacaatgtaatggttcgatgagaatccaaaacaacaacttggcgccacgtgtcaaatcacaaccgttccataaaaaaaccgaacccaatcccaataccacccatcactcaccctctataaaaatccctaatttattgtcaataagaaaagaaacctttgattatttaattcccgttttctaatctttttgggaaatcggtagcgaaaaatgtcgtcgtcggggaggaagatcacccttaagagctcagacggcgaatcattcgaggttgatgaagcggtggcgttggagtcgcagacgattaagcatatgatcgaggacgattgcgctgataacgggataccgttgcctaatgttacgagcaagatcttagcgaaggtgatcgagtactgcaagaaacacgtcgaggctcctaagacagacgatcgatccgccgatgacgagctcaagagttgggacgctgactttgtcaaggtcgatcaagctactctctttgatctcattctggcagcgaactatttgaacatcaagggcttgctggatctcacttgccaaactgttgctgacatgatcaagggaaagaccccagaagagatcaggaagactttcaatatcaagaatgacttcaccccggaagaggaagaagaggttcgtcgggagaaccagtgggcattcgaatgaagggtcaatttcgagtgccggttcaattgtatcaaactcatctatatataaaaatgtagtttgttgctctgacttttcatctgtactcttggatattctgtgagctcttttgaaactcttcaaagtgtcttcttctatgttctttgcctgtcttcactaaaaaccagtctgttgtatccaagtaatgtcctttaatcgtggtctgtgatatgaatgagaatggttgtctaaattatgcttgccatttactatccatctattgctatatgccccaagttttaattgacttaaccgatcaataggctaagttgatgaaattgattttacttcttctcgttgtcttcttagcatgggaaataaaacatgaatagaagtgtttcaagtctgtcaaggctactaccattttggttggttatgaaaattcataattgatatttgactgcc

SEQ ID NO: 8480 - DNA, 724 bp, Antirrhinum majus
ctaaaacgatgtcgtcttcagttgaaaacgcgacgaagaagataaccctaaggagctccgacggcgaggttttcgaggtcgaggaatctttggcgttggaatctcagacgatcaagcacatgatcgaggacgattgtgccgataacgttattcccctcccaaacgtcaccggcaaaatcctctcgaaagtgatcgaatactgcaagcgccacgtggacgccgccgccgctaaggccgatgataagctcgcgtcgaccggaacctccgatgacgagctcaaggcgtttgacgccgatttcgtcaaagtcgatcaggctacactattcgatcttattctggctgctaactacctcaacatcaagacccttctggatctgacctgccagaccgttgctgacatgattaagggaaaaactccagaggagattcggaaaaccttcaatattaagaacgacttcacgcctgaagaggaagaggaggtccgaagagagaatcagtgggctttcgagtaaaaataactgtgaatgagtatctattcactgcttaattaagtgttaatggtttgcttctgatattgtgacgatttcagactattattatgaaatgtactgttaagtcgtaaattgggagactttattgttttactttctaagtctgtctattttggtttgatcgtctatgtgaataagatatgctgctttcctttcaattctgtggctttcag

SEQ ID NO: 8481 - DNA, 803 bp, Antirrhinum majus
  misc_feature (718)..(718): n is a, c, g, or t
  misc_feature (722)..(722): n is a, c, g, or t
  misc_feature (724)..(724): n is a, c, g, or t
acttctctcacacacaaaaccaaaaaatccccaaattcccattccaaaaccctagaaaaaaatgtcgtcctccgataacgcgagcaagaagataactctccggagctccgacggcgaggttttcgaggtcgacgaggcgatcgccttgttgtctcaaacgatcaagcacatgatcgaggacgattgcgccgacaacgtgatccccttgcctaacgtcaccggcaaaatcctctccaaagtcatcgagtactgcaagcgccacgtggacgccgacgccgctaaatcggaggagaaagtcgccgccgccgctgccggagatgacgatctcaaggcgttcgatgcggatttcgtgaaagtcgatcaggcgacgctttttgatcttatattggccgctaactacctgaacatcaagacccttctggatctgacttgccagacagttgctgatatgattaagggaaaaactcccgaggagattaggaagacgttcaacatcaagaacgacttcacacctgaagaggaagaggaagttagaagagagaaccagtgggcgttcgagtaatataaccgcaaatgagttaatgttagctggtcgattatgtgttacttttgcatgtgatgttaaagattctctgacttctattatgtactgtgattattattattattaccgtggctacataatatgaaactctgctaagtattaattcccaaaatntggntnttaccagtttcagtggttcatctttgtgagttctgtatattgttatgcttctcatttgatgcacacttttgcttcagtg

SEQ ID NO: 8482 - DNA, 1004 bp, Phaseolus vulgaris
gagagttggtcttcttgcagtataaataaggcccgagcgcgttaattgccttttcatcccaatcagagaaaagttagggttcgtgactttcccttttctttcgattctttcgttcggaatcagcagcatcatcatcatcgtctacgtatcatcatgtcatcggcgaggaagatcaccctgaagagttcggacggggaggcgttcgaggtggacgaggcggtggcgttggagtcgcagacgataaagcatatgattgaggacgactgcgccgacagcggcatccctctccccaacgtcaccagcaagatcctcgccaaagttatcgagtactgcaaaaaacacgtcgacgccgccaatcccgacgacaaaccctctgaggaagatctcaaggcctgggacgcggatttcgtcaaggtcgatcaggccacgctctttgatctcatcctggctgcgaactacctgaacatcaagagcctgctggatcttacatgccagactgtagcagacatgatcaaggggaagactccagaggaaattcgcaagacctttaacattaagaatgacttcacccctgaggaagaagaggaagttcgtcgggaaaatcaatgggcctttgaatgattttgttgaggtcataaaatctgaatcaaagatctgccttgtggttttatgctatgcttgtctgtttttcaaagatcttccttgtagatttacctatgctatatacttgtttgttttctatttcagactatttttgttgactgcgttcgcgagtcagaattatcttccttcatgaacgttaagagcgcttgaattgtaagtaatagttatgatgaggggaagcgattattctgacacgaaggttattgagttcaataatctttggctcctaaattatcatcccgtattggtaataagtgtaagcacctaaatgagtgctaagaccactgtatgcttactaatgtaaaggtgttgcagctaagcaagatttggagacaccattt

SEQ ID NO: 8483 - DNA, 948 bp, Vitis vinifera
caactgttctgggagtcattcggaggcttagagggtaagtaaatttattttccctttttcatataaaaatatatatatatatttttttattgcattttaattttgttttctataaatagaggcgcctagggataatcacactttcttattcttcccttaccttacctctctgagaaatctagggttagggtttcgtttgcaagaacggatcatgtcgtcgtcgaggaagatcactctgaagagctccgacggcgaggctttcgacgtcgatgaagccgtagcattggaatcgcagacgatcaagcacatgatcgaggacgactgcgcggacaacggcattccgttgccgaacgtcaccagcaagatcttgtcgaaggtgatcgaatactgcaaaaagcacgtggaagcgccgaagcccgaggagcgtagtggcgtcgatgaggaactcaaggcttgggatgctgattttgttaaagttgatcaggccaccctatttgatctcattctggcagcaaactatctgaacatcaagagtctcctggatcttacttgtcagactgtggctgacatgataaagggcaagactccagaggagattcgcaaaactttcaatatcaaaaatgattttacaccggaggaagaggaggaggtgcggcgggagaaccagtgggcctttgagtgaagggtcaaaataaacaaagtgtttctgtggtaatttagttctgtggtggggaaccaggggtggttgtttcctcctgtagttgaacctctaaactttatagtttatgctctgcttgtagtgtctaggagttatgtttctttgtgaacgattacttgaactgtaacgtttccatgaatctcttatgttcatagcctaaatgtggtttctttttcatgtaatatgtgtattgtcttcttggaatggctgcgcaatgctcaatacgttct

SEQ ID NO: 8484 - DNA, 850 bp, Arachis hypogaea
ctcttttcgttctctcttcaattaggagaaaaaagaaagggggaaaaagaacaacgaaattagggttaggattttagccctctttcttcttcgtgtaaatctaattcagcaaagaatctctcttttcttcttcaatcgataataaatggcgtcaacgaagaagatcactttgaaaagttccgatggcgaggcgtttgaggttgacgaggcagtggctctcgaatcgcagacgatcaagcacatgatcgaagacgattgcgctgacagtggaattcctcttccaaacgtcaccagcaagatccttgcgaaggtgattgagtattgcaagaagcacgtcgatgctgctgcttccgaggagaagccatccgaggaggatctcaagatgtgggatgctgaattcgttaaggtcgatcaggccacgctcttcgatcttattctggctgcaaactacttgaacatcaagagcctcttggaccttacttgccagacagtggcagacatgatcaagggcaagactccggaggagattcgcaagacgttcaatatcaagaatgacttcacgccggaggaggaggaggaggtccgccgcgaaaaccagtgggcatttgaatgatgatgatctgctgcttctcctgctgcatgcttagcttctcagattggtgccctgtggttccatttatgctatagttgctagttttactttgatggtttatcttgttttccctatttttgttatgtcaatgttggtgacttggtgacaagactttctcttatttggatcttgaaattgtaagtatttggttatggtggaggaatgatttgtttctgggtaccatgttttaatgttcaa

SEQ ID NO: 8485 - DNA, 756 bp, Amsonia hubrichtii
atcacttctgtttggcttctccctctagggttagggttctctggatcgattttcggcaagcatctgtagagttataaccatgtcttcatcaaagatgatcgtcttgaagagttcggacggtgagactttcgaggttgaagaggcggtggctctggagtcgcagacgatcaagcacatgatcgaggacaactgcgctgataacagtattcctttgcccaacgttacaagcaagatcctggccaaggtcatcgagtactgcaagcgccacgtagaggcctctaaatcttctgatggcgagaagtcgtccgaggaagatctaaaaggtttcgacgctgacttcgtcaaagtcgaccagggcacactcttcgatcttatcctggctgcaaattacctcaacataaagagccttctggaccttacttgccaaactgttgctgacatgatcaaaggcaagactcctgaggagatccgcaagacattcaacatcaagaatgatttcacccctgaggaagaagaggaggtccgtagggagaatgcctgggcttttgagtgaagaatgatagtttgatatgtttatatatatcactgcttggacatgttttaagtagtagtttcaagtgtagtaaatatcaaaatcttattgcttttaagtgttttttaagtttctgtgggacacaattggacagagttgaacctcttctgttgtctaatattctactgctcttaattgaaagggtttattcgaatggtttgtgt

SEQ ID NO: 8486 - DNA, 1215 bp, Phaseolus vulgaris
gttggagagacacgagggcgtgatgatgatcttatggataaatcaaacctaactaacgatagagagagagagttggtcttcttgcagtataaataaggcccgagcgcgttaattgccttttcatcccaatcagagaaaagttagggttcgtgactttcccttttctttcgattctttcgttcggaatcagcagcatcatcatcatcgtctacgtatcatcatgtcatcggcgaggaagatcaccctgaagagttcggacggggaggcgttcgaggtggacgaggcggtggcgttggagtcgcagacgataaagcatatgattgaggacgactgcgccgacagcggcatccctctccccaacgtcaccagcaagatcctcgccaaagttatcgagtactgcaaaaaacacgtcgacgccgccaatcccgacgacaaaccctctgaggaagatctcaaggcctgggacgcggatttcgtcaaggtcgatcaggccacgctctttgatctcatcctggctgcgaactacctgaacatcaagagcctgctggatcttacatgccagactgtagcagacatgatcaaggggaagactccagaggaaattcgcaagacctttaacattaagaatgacttcacccctgaggaagaagaggaagttcgtcgggaaaatcaatgggcctttgaatgattttgttgaggtcataaaatctgaatcaaagatctgccttgtggttttatgctatgcttgtctgtttttcaaagatcttccttgtagatttacctatgctatatacttgtttgttttctatttcagactatttttgttgactgcgttcgcgagtcagaattatcttccttcatgaacgttaagagcgcttgaattgtaagtaatagttatgatgaggggaagcgattattctgacacgaaggttattgagttcaataatctttggctcctaaattatcatcccgtattggtaataagtgtaagcacctaaatgagtgctaagaccactgtatgcttactaatgtaaaggtgttgcagctaagcaagatttggagacaccatttcatgatcgacttttctaagaaggttcttagactgctatcacagaacattccgaatatcatgtcggaattatattcttgataactgcattcaaaatctagagcgtactggagatgaatttatatatatacactaacatggaagaa

SEQ ID NO: 8487 - DNA, 1073 bp, Cicer arietinum
cgactgctcgccacgtcgttagacacccaagttacattccttctatcatcactataaatagagtactcaacccccatagttttccccacaattttctaatttagataaatacaaatcaagggttagggatttcacttttcgaaacacgaagaaaattcccaaatcaaaaccaaatcatcatcaccatgtcttcaacaaggaaattcaccctcaagagttctgacggagaggcctttgaggtcgatgaagcggtggctgtggagtcgcagacaatcaagcacatgatcgaggacgattgtgccggcaatggaattcctcttccgaacgtaacaagcaagatcttggcgaaggtaatcgagtattgtaagaaacatgttgaggctgcgacctctgatgataaacctactgaggatgatctcaaggcttgggattctgatttcgttaaggttgaccaggctacgctctttgaactcatactggctgcaaactacttaaacatcaagaacctgctggaccttacatgcatgactgtggcagacatgatcaaggggaagacacctgaggaaattcgcaagaccttcaacattaagaatgacttcacacctgaggaagaggaggaagttcgtagggaaaaccaatgggcatttgaatgattatatgttacaatattagatactcagtgaagggtctgtcatgtgggtttatgttatgcttatttagcgcatcaaaggacccaatatagatttatctatgcttagaacttgtttatctttcggtttatttttgttgagtctggtcatgaatcttcataatcttacttcaaatattttagagcatcgtgaattgtaagtaatagttgattatgattggcagatgcgtttagtctcgtataattttcaattcttggtcataatattttttcttatttttttaagttttacttattattaaatttaccgttttattgttttttttttatttccgaaggttgtagttaaaaaagttttaagacaaaaaatagtgttacattaattaactgtgtttttagtttatatataagtttttgggaattc

SEQ ID NO: 8488 - DNA, 942 bp, Vigna unguiculata
agagaaaagttagggttcgtgactttcccttttctttcgtttctttcgttcggaatcataatcatcatcgtcgacatatcatcatgtcatcggcgaggaagatcaccctgaagagttccgacggggaggcgttcgaggtggacgaggcggtggcgctggagtcgcagaccataaagcacatgattgaggacgactgcgccgacagcggcatccctctcccaaacgttaccagcaagatcctcgccaaagttatcgagtactgcaaaaaacacgtcgatgccgccaatcccgacgacaaaccttctgaggaagatctcaaggcctgggacgctgatttcgtcaaggtcgaccaagccacgctcttcgatctcatcctggctgcgaactacctgaacatcaagagcctgctggatcttacatgccagactgtagcagacatgatcaaggggaagactccagaggaaattcgcaagacctttaacattaagaatgacttcacccctgaggaagaagaggaagttcgtcgggaaaatcaatgggcatttgaatgattttgttaagctcaaaaaatctgaatcaaagatctgccatgtggttttatgctatgcttgtctgtttttcaaagatcttccttgtagatttacctatgctatatacttgtttgttttctatttcagactaattatgttgactgcgttctcgagtcagaattatcttccttcatgaacgttaagagcgcttgaattgtaagtaatagttgtgatgagtggaagcgattattctgaaacgagggttattgagttcaataatgtcctgccttttgctcctaaattatcatcatcccgtatgttacatgataataagtgtaagcacctaaaatggtgccacagtgctaagaccacactatattggttattaatatgtaaagatgttgcagttgag

SEQ ID NO: 8489 - DNA, 853 bp, Vigna unguiculata
tttagaaatagaatcgctcgaacaagagagaaaaaggggttagggttagggatttgttcatggcatcaacaaagaagatcacgctcaagagttcggacggtgaggcgttcgaagtggatgagattgtagctctggaatctcagacgataaagcatatgatagaagatgattgtgccgacagtggaattccccttcccaatgtcacaagcaagattcttgcaaaggtaatcgagtactgtaagaagcacgttgaggccactagcgctgatgaaaaacctactgaggatgaactcaaggcttgggatgctgatttcgtcaaggttgatcaggccacacttttcgatctcattctggctgcaaactacctgaatatcaagaaccttttggaccttacatgccagactgtagctgacatgataaaggggaagactcctgaggaaattcgcaagacttttaacattaagaatgacttcacccctgaggaagaagaggaagttcgtcgggaaaatcaatgggcgtttgaatgaattattttgaaatgccaatgaaagcagtggatgggattaatgatagttgctagttattctgttactgttttgtttatgtttgatatgttggcgtaaaagactttttctttgttgaaccctgtgggcaatcttgaaatttgtaagtaatagttgaatttggtaatgcttttgagtctctagtatatgaagtttgattcattatcaaactgtgtgtctcgtaattgttttcatctatgtttactaatacggttccttctcgcgacttattcgtttgattgatgttgtgattttttaattcccagaaacgtaagaatgttaggctgttt

SEQ ID NO: 8490 - DNA, 709 bp, Fagopyrum esculentum
aacccaccgagttgaatatccattatctctctctctgctcttcgcgatttcaattctagggttagggtttcgtttcagaaagaaaatcaatggcctctcctaagaagattaccttgaagagttccgatggcgagacctttgaagtcgaggagtctgttgcggttgagtcccagacgatcaagcacatgattgaagatgactgcgccgacaatgttattcctctcccgaacgtcaccagcaagatccttgctaaggttattgagtactgcaagaagcatgttgataccccaaagagtgaagatcgcgccactgaagatgaccttaaggcctgggatgctgagtttgtcaaggtcgaccaggccactcttttcgatctcatccttgctgcaaactacctgaacatcaagaccttattggacctgacctgccagacagttgctgacatgatcaaggggaagaccccagaggagatccgcaagacgttcaacatcaagaatgacttcacacctgaagaagaggaagaggtccgcagggagaaccaatgggcatttgagtaaagagaataagcaagtatagattgtgtgcgttttattatcatacttaatgcagaactattactactatgtagttgcatgttgttttctttgtatgatgactttgaacttatatatgttctgttaatttggttgtttagttaatgcctttgggt

SEQ ID NO: 8491 - DNA, 1061 bp, Vitis vinifera
gcggtggctaggctcctcatacagtcatacaggatagatgcagccaactgttctgggagtcattcggaggcttagagggtaagtaaatttattttccctttttcatataaaaatatatatatatatttttttattgcattttaattttgttttctataaatagaggcgcctagggataatcacactttcttattcttcccttaccttacctctctgagaaatctagggttagggtttcgtttgcaagaacggatcatgtcgtcgtcgaggaagatcactctgaagagctccgacggcgaggctttcgacgtcgatgaagccgtagcattggaatcgcagacgatcaagcacatgatcgaggacgactgcgcggacaacggcattccgttgccgaacgtcaccagcaagatcttgtcgaaggtgatcgaatactgcaaaaagcacgtggaagcgccgaagcccgaggagcgtagtggcgtcgatgaggaactcaaggcttgggatgctgattttgttaaagttgatcaggccaccctatttgatctcattctggcagcaaactatctgaacatcaagagtctcctggatcttacttgtcagactgtggctgacatgataaagggcaagactccagaggagattcgcaaaactttcaatatcaaaaatgattttacaccggaggaagaggaggaggtgcggcgggagaaccagtgggcctttgagtgaagggtcaaaataaacaaagtgtttctgtggtaatttagttctgtggtggggaaccaggggtggttgtttcctcctgtagttgaacctctaaactttatagtttatgctctgcttgtagtgtctaggagttatgtttctttgtgaacgattacttgaactgtaacgtttccatgaatctcttatgttcatagcctaaatgtggtttctttttcatgtaatatgtgtattgtcttcttggaatggctgcgcaatgctcaatacgttcttcaaaagttatctatgattggtatggctacttaaattctatacagattaaatcatcatcttcatttgct

SEQ ID NO: 8492 - DNA, 1042 bp, Nicotiana benthamiana
acaatttcaatttttgttttgcttttggaacgaaagaatagtttctttagggaaaagtaaggaaatctttttttgggtagcgttgggtggggtcggctgtaaatgactcggtgagcggtaaaggtaaatatgagtaacctcgcggtaaatcgaaaattaccaagatcccgaaccttctataaaggccttcccacacacaactctctcattctttcagcatccattatctctctctctctctctctctcaatatatctcaaaaaatctcaattctagggttagtgttgctacgatgtcgtcctctaagatgatcgtattgaagagctcgaacggcgagactttcgaggtggaggaagcggtggctttggaatctcagacgataaagcatatgattgaagatgattgcgccgacaccagcatcccccttcctaatgtgaccagcaagatcttggctaaggttatcgagtattgcaagcgccatgttgatgctaccaaagctgaggataaggcttctgaggatgagcttaaggcctttgattctgattttgttaaagttgaccaggccaccctctttgatctcatcttggctgccaactacttgaacatcaagagcctgcttgatctcacatgtcaaactgtggctgacatgattaaagggaagacaccagaggagatccggaagacctttaacatcaagaatgacttcactccagaggaagaagaggaggttaggagggagaatgcttgggcatttgagtgaactttaaatctcataatctggggataaatttggaatatatcttactagatcgtatgaacaatcttttgtgttggtaaatttgtgagtatggtatttgcttttggacccctgactttgttattcgatgaagtggcttgaacctccttttgctgttatgaagtcttggtttaatgtgaagctctcgtaacttgatgcaaaaatgctggaagtctttttgaagcacttatcttttcttttcttttattttatttatttatctattgttgttgatcttattatttt

SEQ ID NO: 8493 - DNA, 865 bp, Arachis hypogaea
aattagagataagggccgaaaacgaaaataaaaagctagggttagggattttaccttttcacagcgaaagggaacgagaaagagaaaagaggatcaatctctgatatcattccaatcatgtcgtcgacgaggaagatcaccctcaagagctcggacggagaggcgttcgaggtggacgaggcggtggcgctggaatcgcagacgatcaagcacatgatcgaggacgattgcgccgacagcggcatccctctccccaacgtcaccagcaagatccttgcgaaggtcatcgagtactgcaagaagcacgtcgaggctgcgaacgccgaagagaggcccaacgaggaagacctcaagacctgggacgcagatttcgtcaaggttgaccaggccaccctcttcgatctcatcctggctgcgaactacttgaacatcaagagccttctggacctcacatgccaaactgtggcagacatgatcaaggggaagactcccgaggaaattcgtaagaccttcaacatcaagaatgatttcactccggaggaagaggaggaagttcgtcgggaaaaccaatgggcatttgaatgatttgttaagctttttaacattgtctttcaaatctctgcctgtgcttttgttttgcttgtcaaagatctgccatgtgcattgatcctatgcttatggttgtttgccttctatctatctgactatttttgttgactgttcacggatcagacgtatctttgttgatgaaccttaggggacgttttgaatatgtaagtaaatagttgaatctggttaaggtaattggtgaattctggttgattctgcttattgataatttaatcattggcaacatatggtttct

SEQ ID NO: 8494 - DNA, 863 bp, Arachis hypogaea
cgagaattagagataaggggccgaaaacgaaaataaaaagctagggttagggattttaccttttcacagcgaaagggaacgagaaagagaaaagaggatcaatctctgatatcattccaatcatgtcgtcgacgaggaagatcaccctcaagagctcggacggagaggcgttcgaggtggacgaggcggtggcgctggaatcgcagacgatcaagcacatgatcgaggacgattgcgccgacagcggcatccctctccccaacgtcaccagcaagatccttgcgaaggtcatcgagtactgcaagaagcacgtcgaggctgcgaacgccgaagagaggcccaacgaggaagacctcaagacctgggacgcagatttcgtcaaggttgaccaggccaccctcttcgatctcatcctggctgcgaactacttgaacatcaagagccttctggacctcacatgccaaactgtggcagacatgatcaaggggaagactcccgaggaaattcgtaagaccttcaacatcaagaatgatttcactccggaggaagaggaggaagttcgtcgggaaaaccaatgggcatttgaatgatttgttaagctttttaacattgtctttcaaatctctgcctgtgcttttgttttgcttgtcaaagatctgccatgtgcattgatcctatgcttatggttgtttgccttctatctatctgactatttttgttgactgttcacggatcagacgtatctttgttgatgaaccttaggggacgttttgaatatgtaagtaaatagttgaatctggttaaggtaattggtgaattctggttgattctaaaaaaaaaaaaaaacaaaagtactctgcgtt

SEQ ID NO: 8495 - DNA, 926 bp, Arachis hypogaea
tctcttcaattagaagaaaaaagaaagggaaaaagaacgaaattagggttaggattttagccctctttcttcttcgtgtaaatctaattcagcaaagaatctctcttttcttcttcaatcgataataaatggcgtcaacgaagaagatcactttgaaaagttccgatggcgaggcgtttgaggttgacgaggcagtggctctcgaatcgcagacgatcaagcacatgatcgaagacgattgcgctgacagtggaattcctcttccaaacgtcaccagcaagatccttgcgaaggtgattgagtattgcaagaagcacgtcgatgctgctgcttccgaggagaagccatccgaggaggatctcaagatgtgggatgctgaattcgttaaggtcgatcaggccacgctcttcgatctaattctggctgcaaactacttgaacatcaagagcctgttggaccttacttgccagacagtggcagacatgatcaagggcaagactccggaggagattcgcaagacattcaatatcaagaacgacttcacgccggaggaggaggaggaggtccgccgcgaaaaccagtgggcgtttgaatgatgatgatctgctgcttctcctgctgcatgcatagcttctgagattgggtgccctgtggttccatttatgctatagttgctagttttactttgatggtttatcttgttttccctatttttgttatgtcaatgttggtgacttggtgacaagactttctcttatttggatcttgaaattgtaagtatttgattatggtggaggaatgatttgtttctgggtaccatgttttaatgttcaattctttgccaagcttttttcttctgagaaaagaattactttcttattcgtgttgcttgctttgaatacataacaccgaaaactatcattaac

SEQ ID NO: 8496 - DNA, 942 bp, Arachis hypogaea
ccccctatccctgtgtgccttggcagtctcagaagcagtggtatcaacgcagagtacggggggatcgttttctaaaacgctcttttcgttctcttcaattagaagaaaaaagaaagggaaaaagaacgaaattagggttaggattttagccctctttcttcttcctgtacaactaattcagcaaagaatctctcttttcttcttcaatcgataataaatggcgtcaacgaagaagatcactttgaaaagttccgacggcgaggcgtttgaggttgacgaggcagtggctctcgaatcgcagacgatcaagcacatgatcgaagacgattgcgctgacagtggaattcctcttccaaacgtcaccagcaagatccttgcgaaggtgattgagtattgcaagaagcacgtcgatgctgctgcttccgaggagaagccatccgaggaggatctcaagatgtgggatgctgaattcgttaaggtcgatcaggccacgctcttcgatctaattctggctgcaaactacttgaacatcaagagcctgttggaccttacttgccagacagtggcagacatgatcaagggcaagactccggaggagattcgcaagacattcaatatcaagaacgacttcacgccggaggaggaggaggaggtccgccgcgaaaaccagtgggcgtttgaatgatgatgatctgctgcttctcctgctgcatgcatagcttctgagattgggtgccctgtggttccatttatgctatagttgctagttttactttgatggtttatcttgttttccctatttttgttatgtcaatgttggtgacttggtgacaagactttctcttatttggatcttgaaattgtaagtatttgattatggtggaggaatgatttgtttctgggtaccatgttttaatgttcaattctttgccaagctttttt

SEQ ID NO: 8497 - DNA, 1018 bp, Glycine max
cttaatattaaagatgaggagaacgtactagaagaggtttacgaaatggaggggttgggcccacactgcacacagtgaagcctcccagtgcataaatagaggagccaggccacaccttgtacctacaaaaatccattctcaattgagaaagcgaaacgcatagaatcgaaagaggggaaaagaaaaagaaaagttagggttagggattttgagagatggcatcgactaagaagatcaccctgaagagttcggacggtgaggccttcgaggtggaggaggcggtggcgctggagtcgcagacgatcaagcacatgatcgaggacgactgcgccgacagtggaatccctctccccaatgtcaccagcaagattctggcgaaggttatcgagtactgcaagaagcacgttgaggcgaacagtgctgatgagaagcccagtgaggatgtgctcaaggcttgggacgtggatttcgtcaacgttgatcaggccactctcttcgatctcattctggctgcaaactacttgaacatcaagagccttttggaccttacttgccagacagtagcagacatgatcaagggaaagactcctgaggaaattcgcaagacattcaacatcaagaatgacttcacccctgaggaagaggaggaagttcgtagggaaaaccaatgggcgtttgaataagttttatgattctgctgcttttgaaatttcaatgaaaagatatgccctatagtttctagtttatgtttctgactattttgtttgttttatttatgtttcgcgtatcaaacttgtcttcttttttgaacttgggcaatcttgaaattgtaagtaatagttgaatatggtgggaggaatgcttttgaatctggtatctcagctttattgttaattcattgtcaaacacttctgatcctcctagatatccatcctttaaagtggagaaaaagaacttttgaacttcaagtgtgaagatctcattcttaattcttttcaactttcactttttagcaaaa

SEQ ID NO: 8498 - DNA, 931 bp, Glycine max
ggtttacgaaatggaggggttgggcccacactgcacacagtgaagcctcccagtgcataaatagaggagccaggccacaccttgtacctacaaaaatccattctcaattgagaaagcgaaacgcatagaatcgaaagaggggaaaagaaaaagaaaagttagggttagggattttgagagatggcatcgactaagaagatcaccctgaagagttcggacggtgaggccttcgaggtggaggaggcggtggcgctggagtcgcagacgatcaagcacatgatcgaggacgactgcgccgacagtggaatccctctccccaatgtcaccagcaagattctggcgaaggttatcgagtactgcaagaagcacgttgaggcgaacagtgctgatgagaagcccagtgaggatgtgctcaaggcttgggacgtggatttcgtcaacgttgatcaggccactctcttcgatctcattctggctgcaaactacttgaacatcaagagccttttggaccttacttgccagacagtagcagacatgatcaagggaaagactcctgaggaaattcgcaagacattcaacatcaagaatgacttcacccctgaggaagaggaggaagttcgtagggaaaaccaatgggcgtttgaataagttttatgattctgctgcttttgaaatttcaatgaaaagatatgccctatagtttctagtttatgtttctgactattttgtttgttttatttatgtttcgcgtatcaaacttgtcttcttttttgaacttgggcaatcttgaaattgtaagtaatagttgaatatggtgggaggaatgcttttgaatctggtatctcagctttattgttaattcattgtcaaacacttctgatcctcctagatatccatcctttaaagtggagaaaaagaacttttgaacttc

SEQ ID NO: 8499 - DNA, 816 bp, Tabernaemontana elegans
gctcacaccctatttccgcagttaatttctgaccaatttatcggttcgtaattgttctcctcctagggttagggttttctcgatcgattatcggcaaacctctgttgagcgataaccatgtcttcatcaaagatgatcgtcttgaagagttccgacggcgagactttcgaggtggaggaggcggttgccctggagtcgcagacaatcaagcacatgatcgaggacaactgcgccgacagcagcattcccctccccaacgttacgagcaagatcttggcaaaagtcatcgagtactgcaagcgccatgttgatgcctccaagtcgtccgacggtgagaagtccgccgacgaggatctcaaggctttcgacgctgactttgtcaaaatcgatcagggcactctctttgatcttatcctggctgcaaattatctcaacataaagagccttctggacctcacttgtcagactgttgctgacatgatcaagggcaagactcctgaggagatccgcaagacattcaacatcaagaacgatttcactccagaagaagaggaggaggtccgtagggagaatgcctgggcatttgagtgaagaataatagtttgatatgttcatatcattgctgggacatgtagtgtttaagtgtagtaaatatcttaaatctttctataaaattcctttttgttgcttctgtggaacgaaggtggacaaagttgaatctccttttttatgtctaatatgctactgctttttagtgaaagggttcattcgaatggttttgtgaaaatcttttatatttctggaaactaaagtttt

SEQ ID NO: 8500 - DNA, 499 bp, Glycine max
ttttttgagattaacaaaatcattcaaatgcccattggttttcccgacgaacttcctcttcctcctcaggggtgaagtcattcttaatgttaaaggtcttgcgaatttcctctggagtcttccccttgatcatgtcggctacagtttgacatgtaaggtccagcaggctcttgatgttcaagtagatgagatcgaagagcgtggcctggtcgaccttgacgaattcagcgtcccaggccttgagatcgtcctcggagggtttgtcttcgggattcgcggcctcgacgtgcttcttgcagtactcgataaccttcgccaggatcttgctcgtcacgttcggcagagggatgccgctgtcggcgcagtcgtcctcgatcatgtgctttatcgtctgcgactccagcgccaccgcctcctccacctcgaaagcctcgccgtccgaactcttcagcgtgattttcttcgccgacgacatgatgaataatgaatggatgattga

SEQ ID NO: 8501 - DNA, 807 bp, Glycine max
acctcaaaaaacaaaaatcattcccttagagaaaacaaaagcacagaatcgaaagaagagttcttttttgagagagattgggatggcttcgacgaagaagatcacactgaagagttcggacggcgaggccttcgaggtggaggaggcggtggcggtggagtcccagacgatcaagcacatgatcgaggacaactgcgccgacagcggaattcctctccccaatgttaccagcaagattctggccaaggttatcgagtattgcaagaagcacgttgaggccaattgcgctgatgagaagcccagtgaggatgaactcaaggcttgggacgctgatttcgtcaaggttgatcaggccacactctttgatctcattctggctgcaaattacttgaatatcaagagccttttggaccttacttgccagacagtagcagacatgatcaagggaaagactcctgaggaaattcgcaagacattcaacatcaagaatgacttcacccctgaggaagaggaggaagttcgtagggaaaaccaatgggcctttgaatgagtttataattctgctactttttaaatttcaatgaaaagatatgccctatagttgctagtttatttgtgttttatgtttcgcgtttctgacttgtcttttttttttttaacttgtgggggcaatcttgaaattgtaagtaatagttgaatatggtgggaggaatgctcttgagtctggtatctcagctttactgttaattcattgtccaactcttctgttgctctcgtattaattaaatgttagtgtttgttctttcg

SEQ ID NO: 8502 - DNA, 823 bp, Phaseolus vulgaris
ctcaccaatagcgtttcgcttcagaaatagaatagcacggaacagagagaaaaaggggttagggttagggatttgtgaatggcatcgacaaagaagatcacgctcaagagttccgatggtgaggccttcgaagtggatgagattgtcgctctcgagtcgcagacgataaagcatatgatagaggacgattgcgccgacagtgggatccctcttcccaacgtcacaagcaagattctcgccaaggtcatcgagtactgcaagaagcacgttgaggccaatagcgccgatgaaaagcctaccgaggatgaactcaaggcctgggatgctgaatttgtcaaggttgatcaggccacgctcttcgatctcattctggctgcaaactacttgaacatcaagaaccttttggatcttacttgccagactgtagcagacatgataaaggggaagactcctgaggaaattcgcaagacttttaacattaagaatgacttcacccccgaggaagaagaggaagttcgtcgggaaaaccaatgggcgtttgaatgagttactttgaaatggcaatgaagacagtgggtgggattaagtcatagttgctagttatgatgttactattttgttttatgtttgatatgttggcgtaaaagacattttctttgttgaacctcgtgggcaatcttgaaatttgtaagtaatagttgaatttggtaatgcttttgagtctctagtatatggagtttgattcattgtcaaactttgtgtgcctctttactgctttcattgatgtttagtaaataataggttccttctcaagtttttgttc

SEQ ID NO: 8503 - DNA, 814 bp, Phaseolus vulgaris
accaatagcgtttcgcttcagaaatagaatagcacggaacagagagaaaaaggggttagggttagggatttgtgaatggcatcgacaaagaagatcacgctcaagagttccgatggtgaggccttcgaagtggatgagattgtcgctctcgagtcgcagacgataaagcatatgatagaggacgattgcgccgacagtgggatccctcttcccaacgtcacaagcaagattctcgccaaggtcatcgagtactgcaagaagcacgttgaggccaatagcgccgatgaaaagcctaccgaggatgaactcaaggcctgggatgctgaatttgtcaaggttgatcaggccacgctcttcgatctcattctggctgcaaactacttgaacatcaagaaccttttggatcttacttgccagactgtagcagacatgataaaggggaagactcctgaggaaattcgcaagacttttaacattaagaatgacttcacccccgaggaagaagaggaagttcgtcgggaaaaccaatgggcgtttgaatgagttactttgaaatggcaatgaagacagtgggtgggattaagtcatagttgctagttatgatgttactattttgttttatgtttgatatgttggcgtaaaagacattttctttgttgaacctcgtgggcaatcttgaaatttgtaagtaatagttgaatttggtaatgcttttgagtctctagtatatggagtttgattcattgtcaaactttgtgtgcctctttactgctttcattgatgtttagtaaataataggttccttctcaagttt

SEQ ID NO: 8504 - DNA, 829 bp, Fagopyrum esculentum
cccctatcaaaccaccgaattgaacatccatttcctctcttctcttcgcgatttcaattctagggttagggtttcgtctcagaaagaaaatcaatggcctctcctaagaagattaccttgaagagttccgacggcgagacctttgaggtcgaggagtccgttgcggttgagtcccagacgatcaagcacatgattgaagacgactgcgccgacaatgttattcctctcccgaacgtcaccagcaagatcctcgccaaggttattgagtactgtaagaagcatgttgataccccaaagagtgaagatcgcgcagccgaagatgaccttaaggcctgggatgctgagtttgtcaaggtcgaccaggccactcttttcgatctcatccttgctgcaaactacctgaacatcaagagcttattggacctgacctgccagacagttgcggacatgataaaggggaagaccccagaggagatccgcaagacgttcaacatcaagaatgacttcacccctgaagaagaggaagaggtccgcagggagaaccaatgggcatttgagtaaagaggataaacaagtacaggatgtgtgcgttttattatcatacttgatgcagaactactactactactactactacacttgtggtggttgcatgttgctttctttgtataatgacttataacttagcattctggatggatgtttctgttaatttggttgtttagttcatgcctttgggttatcaagctaattcttgtttcttcatactatctatgagtcatttggagctatgattttgcatgcatgataaggaggctgtgtgaatgac

SEQ ID NO: 8505 - DNA, 649 bp, Momordica charantia
gtcgtcgtccaagaagatcatcctcaagagctctgatggcgagcctttcgaagtcgacgaggccgtggcgctcgagtcccagaccatccgccacatgatcgaggacgattgcgccgataacggcatccctctccccaacgtctccagcaagatcttggccaaggtcatcgagtattgccgcaagcacgtcgacgcttccaactccgagccgcgcgcctctgaagaagacctcaaggcctgggaccgggacttcgttaatgttgatcaagctactctcttcgatctcattctggctgcaaattatctgaacatcaagaacttgttagacctaacatgccagactgttgctgatatgatcaaggggaagaccccagaggagatccggaagacctttaacatcaagaacgacttcacaccggaggaagaggaggaagttcgcagggagaatcagtgggcttttgaatgattttaagcctcataagagtgatcaaagatattgatctgtatggctgtacatagtactagtagcatgtatgcacttctttttagttcttttgggtgtatttaagcactgtggtattcacattgagtttgaaatggtaccttttgaacctaatcatcattgtataattttttttctaatgatcaa

SEQ ID NO: 8506 - DNA, 974 bp, Tropaeolum majus
gtaatattttacaattaacttaatgggtaagaaagcacggcacttgatttcctccgtgacacagattttattttatttgtatatatatagcaaataagtctgtcaccactattatttctgttcaatagatatttctttctttcgctctccaatcttagggtttgttgtccgatactagagttggatagcgatttgaaggatgtcatcggccggaaagaaaatcacgctcaagagctccgatggtgagactttcgaggtggacgaggcggtggctcttgaatcccaaaccatcaagcacatgatcgaggatgactgtgccgacaacggaattcctcttccaaacgtcaccagcaagatcctctccaaggttatcgagtactgcaggaaacacgttgaggcccctaaaactgaagatcgtgctgctcctgaagaggacctcaaagcttgggatgctgacttcgttaaagtcgaccaggcgaccctctttgatcttattctggctgcgaattatctgaacatcaagagcttgttagacttgacatgccagactgtggcagacatgataaaaggcaagaccccagaggagatccgcaagacgttcaatatcaagaatgatttcactccagaggaagaagaggaggttcgtcgtgagaaccagtgggccttcgagtgaaggattcaacatgggagaacccgtttattttcttttatcgtttgcattgagagtcttgtatggttaatggctgactgtacctccatctattacctgtgaaaagttgttctatgggaactatcgtttttgttgagagcactgtatggttaatggttgtttgtactccatctattatcctatgaacaatagttgttattttagaattcttttagttagcaaagtattggtcatatatttcattacacatgttattttcgtatcacatttctcaggtttcttttgtcaactattatgtcggagt

SEQ ID NO: 8507 - DNA, 844 bp, Carica papaya
ataatacaaagacccagtgtgtgagagagaaaatcgataccgattaaccgctagggtttgttttcggaaaggaacaaattcgccgaaagcgatggcttcgaccaggaagatcgtgttgaagagctccgatggagaggctttcgaggttgatgaagcggtggcgctcgaatcgcagacgattaagcacatgatagaggatgattgcgccgataacggcatccctttgcccaacgtgaccagcaagatcctctccaaggtggtcgagtactgcaagaaacacgtcgagtcccccaaggccgacgaccgcaccgcagacgaggagctcaagaactgggacgccgattttgtcaaagttgaccaggccaccctcttcgatctaattctcgcagcgaactatttgaacatcaagggtttgcttgaccttacctgccagacagttgcagacatgatcaagggaaagacacctgaagagatccgcaagacttttaacatcaagaatgacttcacaccagaggaggaggaagaggttcgtcgtgagaatcagtgggcttttgagtgaagaacctgttgagatgtattgttaagttgataagatgtaattgacttaagttgttttagtattattatcattattattagttgagtagttatgtttttatattgtagctgtagggaattggtctcccatgtttggacttatgaaatgtaaatcacagttgcattttgggtaggatggatagcagtttgaacagctttaagcctgctatcggtgcccttaactgttttattaatttggtgatataagcccttgtttgcctaaatccacttgtctgttgctcaccga

SEQ ID NO: 8508 - DNA, 1071 bp, Glycine max
aaaaaaatcatatcatctaatttttaagaaagtaaaaaatattaatattaaagatatgattaccatgaaacgcaataaaaaacggcgtttaccaggttcacactaaacactacacactgaaggctccgagtcccagctaggctataaataaggagaagccagtcacacaccttttacctcaaaaaacaaaaatcattcccttagagaaaacaaaagcacagaatcgaaagaagagttattttttgagagagattgggatggcttcgacgaagaagatcacactgaagagttcggacggcgaggccttcgaggtggaggaggcggtggcggtggagtcccagacgatcaagcacatgatcgaggacaactgcgccgacagcggaattcctctccccaatgttaccagcaagattctggccaaggttatcgagtattgcaagaagcacgttgaggccaattgcgctgatgagaagcccagtgaggatgaactcaaggcttgggacgctgatttcgtcaaggttgatcaggccacactctttgatctcattctggctgcaaattacttgaatatcaagagccttttggaccttacttgccagacagtagcagacatgatcaagggaaagactcctgaggaaattcgcaagacattcaacatcaagaatgacttcacccctgaggaagaggaggaagttcgtagggaaaaccaatgggcctttgaatgagtttataattctgctactttttaaatttcaatgaaaagatatgccctatagttgctagtttatttgtgttttatgtttcgcgtttctgacttgtcttttttttttttaacttgtgggggcaatcttgaaattgtaagtaatagttgaatatggtgggaggaatgctcttgagtctggtatctcagctttactgttaattcattgtccaactcttctgttgctctcgtattaattaaatgttagtgtttgttctttcgttagtgttttttctttagttgttatccctctataattcgaaaacatctcttttgtccttataaaatgaacaaatttaattttgtttcca

SEQ ID NO: 8509 - DNA, 814 bp, Trigonella foenum-graecum
tttgacattcagaaaaaaatcccaaattaagagttagggttttcacctcacgaaaaatcaatttccaaaatcaaaacctaatcacgatgtcttcaacaagaaagatcactctcaagagttccgatggcgagactttcgaggtcgatgaagcggttgctttggaatctcagacgatcaagcatatgatcgaagacgattgcgccgacagtggaatccctcttcccaacgttacgagcaagatcttggcgaaggttattgagtactgcaagaagcacgttgaagccgcagctgctgaagaaaaaccttctgaggatgagactaaggcttgggatgctgagttcgttaaggttgatcaggcaacgcttttcgatcttatcttggctgctaactatttgaatatcaagaacctgctggaccttacatgccagactgtggcagacatgataaaggggaagacaccagaggagattcgcaagaccttcaacattaagaatgacttctctccagaggaagaggaagaagtccgtagggagaaccaatgggcatttgaatgatcatatatgtttaacttgttagcatctaagtcaaggatctgccatgttggttttttgttctgctttttttcttattcatcaaagaactccaatgtagagattcatctatgcttagtacttgtttatctttcggttttatttctgttgagtgcggtcatgaatcttcattatccttcaaaggattgttgggcgtcgtgaattgtaaagtaatagttgattatgattggctgatgcgttggtacgaggctttttgagctcaa

SEQ ID NO: 8510 - DNA, 1408 bp, Glycine max
gcactataaataagttcccactctagccataacgactcgtgcaattgaaagagagatttgatagcctcaactcaagtaagggttttctctttgagaaaatcgtatcttacaccttttggtgaccactttgagtgagagaagagaaattaagagagatactcaaattagattcaagagagatggccatcaaccatgaaacttgggctttcattttcggtcttctaggcaacgtgatctcctttatggtgttcctcgctccattaccaactttttaccaaatctacaagaaaaaatctacggatgggtttcaatcactaccttatattgttgcactattcagttcaatgctctggatttattacgcactcgtcaaaaaggatgctagcctccttctcattactattaactcctttggatgtgtgatagagacgatataccttgcaatcttcctaatttacgccccaagcaaaaccaggctttggaccatcaagcttcttctcatgttgaatgtttttggattcggagcaatgcttctttcaaccctctaccttacaacgggttccaaacgtctttctgtgataggatggatttgccttgttctcaacataagcgtttttgctgctcctctttgcatcatgaaacgtgtcataaagacgaagagtgtggaattcatgcctttcagtttgtccttctttttgaccataaatgctgtcatgtggttcttctatggccttctcctcaaggactactacatcgcactcccaaatactcttgggtttctattcggcataatccagatggtgctgtatttgatttatagaaacgccaagccacaaggattagaggagccaacgaaggttcaggaactaaatggccatattattgacgttgtgaagccgaatcatgtaacaaaaaatggtcctgtgcctgtgattgagacagctagcaatgtgtgaactagaagcaataatgtaccaagtccaaagagaaagaaggaaaggaaaaaaaaaatgaggtcccaaaatatttaatctaaaagtacaattactttaattactttgccaagtggggcctcattcaacgcaagaacgtacgtacgtgtaatttggtattaatatttaagggttcttcttttgattaacgtatttgcctgaacgggtagctgtaatatgttaggttttcaattgtgttagcatgagagtctctctttggccttttccatcactctctcattgtagtaaaacgtgtaacaacgtatcttctctatcttctttttcagtgtgtaccctcagtcaaactcctcaattcttgtacgcgtaatatatgttcatgtgatggaattaattaattattattttactaattatgcaatccatgagactaaagagcacacttttatttgttttca

SEQ ID NO: 8511 - DNA, 1582 bp, Glycine max
gttaaagtaaatagtgttttttgggtggtggaacaacaactggaaagtactcttaaactaaagctacatacattattatgataccacgcaacttgcctttgccatacttctcttttgagcactataaataagttcccactctagccataacgactcgtgcaattgaaagagagatttgatagcctcaactcaagtaagggttttctctttgagaaaatcgtatcttacaccttttggtgaccactttgagtgagagaagagaaattaagagagatactcaaattagattcaagagagatggccatcaaccatgaaacttgggctttcattttcggtcttctaggcaacgtgatctcctttatggtgttcctcgctccattaccaactttttaccaaatctacaagaaaaaatctacggatgggtttcaatcactaccttatattgttgcactattcagttcaatgctctggatttattacgcactcgtcaaaaaggatgctagcctccttctcattactattaactcctttggatgtgtgatagagacgatataccttgcaatcttcctaatttacgccccaagcaaaaccaggctttggaccatcaagcttcttctcatgttgaatgtttttggattcggagcaatgcttctttcaaccctctaccttacaacgggttccaaacgtctttctgtgataggatggatttgccttgttctcaacataagcgtttttgctgctcctctttgcatcatgaaacgtgtcataaagacgaagagtgtggaattcatgcctttcagtttgtccttctttttgaccataaatgctgtcatgtggttcttctatggccttctcctcaaggactactacatcgcactcccaaatactcttgggtttctattcggcataatccagatggtgctgtatttgatttatagaaacgccaagccacaaggattggaggagccaacgaaggttcaggaactaaatggccatattattgacgttgtgaagccgaatcatgtaacaaaaaatggtcctgtgcctgtgattgagacagctagcaatgtgtgaactagaagcaataatgtaccaagtccaaagagaaagaaggaaaggaaaaaaaaaatgaggtcccaaaatatttaatctaaaagtacaattactttaattactttgccaagtggggcctcattcaacgcaagaacgtacgtacgtgtaatttggtattaatatttaagggttcttcttttgattaacgtatttgcctgaacgggtagctgtaatatgttaggttttcaattgtgttagcatgagagtctctctttggccttttccatcactctctcattgtagtaaaacgtgtaacaacgtatcttctctatcttctttttcagtgtgtaccctcagtcaaactcctcaattcttgtacgcgtaatatatgttcatgtgatggaattaattaattattattttactaattatgcaatccatgagactaaagagcacacttttatttgttttcatatgctacaatcatcgttatcctaatgttgatgaattttatattgctattggtaaa

SEQ ID NO: 8512 - DNA, 1298 bp, Phaseolus vulgaris
gtgcaatcgaaagagagaaagagataacctcaactgaggcttctcactttcacacaatcttttcgtcaccactcagtgagagatattacattcaacacaccacaccagaatggccattcaccatgaaacttgggctttcgttttcggccttctaggcaacgtcatctccttcatggtgttccttgctccattaccaacgttttaccaaatctacaagaagaaaactgcagaaggatttcaatcactgccttatgttgttgcactgttcagttcaatgctctggatttattacgcactcgtcaagaaggatgctagcctccttcttattaccattaactcctttggatgtgtgatagagtcaatttaccttgccatcttcctactttacgccccgagtaaaaccaggctttgtaccatcaagcttcttctcttgttgaatgtttttgggttcggagccatgcttctttcaaccctctactttacaacagggtccaaacgtctttctgtgattggatggatttgcctcgttttcaacataagcgtatttgctgctcctctctgcattatgaaacgtgtgataaagacgaagagcgtggaatacatgccattcagtttgtccttctttttaaccataaacgctgttatgtggttcttctatggccttcttctcaaggactactacatcgctctcccaaatacgcttggatttctgtttgggataattcagatgatgctgtatttggtttatagaaacgcgaaaccaaagacattggaggagccaactaagttacaggaacttaatggtcatattgttgacgttgtgaaattgggcacaatggcaccctctgagccgaatcatgtcacaaaaagtggcgctgtgactgagacagctaccaatgtgtgatgaacaaccaagtactgaacaagtccaaagagaaagaaaagaaaatgaggtctcaaaatatttaaccaaaaaagtataactattttactttgccaagtggggcctcatctgaacgcaagaagaaaagtacgtgtagtttggtgtttagggttcttctcttgttaggtggtgaattatgttagctagcatgaacgtctctttggcttcttcttccatcactctcactgtagtaaacgtgtagcatagtagtgtgttgtcttctttcgatgtgtacctcagtcaaactcgtcaaattctctctttccttgtacgcgtaatctatgttcatgtgatgggaattaattagtttacgggttttgaaatctatgactttggctcacttttatttattttc

SEQ ID NO: 8513 - DNA, 1290 bp, Phaseolus vulgaris
gtgcaatcgaaagagagaaagagataacctcaactgaggcttctcactttcacacaatcttttcgtcaccactcagtgagagatattacattcaacacaccacaccagaatggccattcaccatgaaacttgggctttcgttttcggccttctaggcaacgtcatctccttcatggtgttccttgctccattaccaacgttttaccaaatctacaagaagaaaactgcagaaggatttcaatcactgccttatgttgttgcactgttcagttcaatgctctggatttattacgcactcgtcaagaaggatgctagcctccttcttattaccattaactcctttggatgtgtgatagagtcaatttaccttgccatcttcctactttacgccccgagtaaaaccaggctttgtaccatcaagcttcttctcttgttgaatgtttttgggttcggagccatgcttctttcaaccctctactttacaacagggtccaaacgtctttctgtgattggatggatttgcctcgttttcaacataagcgtatttgctgctcctctctgcattatgaaacgtgtgataaagacgaagagcgtggaatacatgccattcagtttgtccttctttttaaccataaacgctgttatgtggttcttctatggccttcttctcaaggactactacatcgctctcccaaatacgcttggatttctgtttgggataattcagatgatgctgtatttggtttatagaaacgcgaaaccaaagacattggaggagccaactaagttacaggaacttaatggtcatattgttgacgttgtgaaattgggcacaatggcaccctctgagccgaatcatgtcacaaaaagtggcgctgtgactgagacagctaccaatgtgtgatgaacaaccaagtactgaacaagtccaaagagaaagaaaagaaaatgaggtctcaaaatatttaaccaaaaaagtataactattttactttgccaagtggggcctcatctgaacgcaagaagaaaagtacgtgtagtttggtgtttagggttcttctcttgttaggtggtgaattatgttagctagcatgaacgtctctttggcttcttcttccatcactctcactgtagtaaacgtgtagcatagtagtgtgttgtcttctttcgatgtgtacctcagtcaaactcgtcaaattctctctttccttgtacgcgtaatctatgttcatgtgatgggaattaattagtttacgggttttgaaatctatgactttggctcacttttat

SEQ ID NO: 8514 - DNA, 1324 bp, Vigna unguiculata
aaagagataacctcaactgaggcttctcactttcacacaatcctatctacaccttttcgtcaccactcagtgagtgatagagaagagatattagattccacccaccacaccaaaatggccattcaccatgaaacttgggcttttgttttcggccttctaggcaacgtcatctccttcatggtgttccttgctccattaccaacattttaccaaatctacaagaaaaaaactgcagaaggatttcaatcactgccttatgttgttgcactgtttagctccatgctctggatttattacgcaatggtcaagaaggatgctagcctccttcttattaccattaactcctttggatgtgtgattgagtcaatttaccttctcatcttcctaatttatgctccaagtaaaaccaggctttcgaccatcaagcttcttctcttgttgaatgtttttgggttcggagccatgcttctttcaaccctctactttacgacaggaaccaaacgtctttctgtgattggatggatttgccttgttttcaacataagtgtgtttgctgctcctctctgcattatgaaacgtgtgataaagaccaagagcgtggaattcatgcctttcagtttgtccttctttttgaccgtaaatgctgtcatgtggttcttctatggccttcttctcaaggactactacatcgctctcccaaatacgcttggatttgtgtttgggataattcagatggtgctgtatttggtttatagaaacgcaaagccaaagacattggaggagccaaccaagttacaggaactaaatggccatattgttgacgtggtgaagttgggcacagtgacaccctcagagccgaatcatgtcacaaaaagtggtgctgtgacggagacagctagcaacgtgtgatgaaccatgcaatgaacaagtccaaagaaggaaaagaagatgaggtcccaaaatattaacctaaaagtgaaaccattttagtttgtcaaatggggtctcatctgaacgcaagaacaacagtacgtgtagtttggtgtttagggttcttcttttgttaggtggtgaattatgttagctagcttgaaagtctctttggcctcttcttccatcactctcactgtagtaaaatgtgtagcatagtagtgtcttgtcttctttcggtgtgtacctcactccaactcgtcaaattctctctttcctttgtacgcgtcatctatgttcatgttatgggaatttattattttacgggttatgaaatctatgactatttgccacacttttatttattttcatatgctacaaaaaaaagaaaaaa

SEQ ID NO: 8515 - DNA, 1340 bp, Glycine max
gtggaattgaaaagagagattagatagcctcaactgaggggcttctctttgagagaatcgtatctcacaccaattagattccaattagattcaagagacatggccattaaccatgaaacttgggctttcgttttcggccttctaggcaacgtgatctcctttatggtgttcctcgctccattaccgactttttaccaaatctacaagaagaaatctacagaagagttccaatcactaccttatgttgttgcattgttcagttcaatgctttggatctattacgcactcgtcaaaaaggatgctagcctccttctcattactattaactcctttggatgtgtgatagagacgatataccttgcaatcttcctaatttacgccccaagcaaaaccaggctttggaccatcaagcttcttctcatgttgaatgtttttggattcggagcgatgcttctttcaaccctctaccttacaacaggatccaaacgtcttactgtgataggatggatttgccttgttttcaacataagcgtttttgctgctcctctatgcattataaaacgtgtcataaagacgaagagcgtggaattcatgcctttcagtttgtccttctttttgactataaatgctgtcatgtggttcttctatggccttctcctcaaggactattacgtcgctctaccaaatacgcttgggtttctattcagcataattcagatggtgttgtatttgatttatagaaacgccaagacacctgatctgccaatgaaattgcaagaactaaatagtcatactattgacgttgggaagctgagcagaatggaaccctctgagccgaatcatctaacaaaaaatggtactttaactgaaagagaaatctgaagaacatcatgaattccgctggcaatgtgtgattaattaaccaatgaacaagtccaaagagcaagaaagaaaaaaaaacaaaaaaaagggatgcaaaaatatttaacctaaaagtacaatcactctacttggtcaagtggggcctcttctcaacccaagaacagtacgtgtactttggagtttagggttcttcttttaattaatgtatttgcatcagtttgtagctgtaatattttaagtggttagttattatgttagcattatcatctctttggcctcttccatcatattcagactttagtaaaacgtgaaacattagtatcttcaattctcttgtttcagtgtgtcgctcagtcaacctcataataaattttctcttttcgttgtacgcgtaatctatgatcatgtagtgggaattaaatattttataactaatgagcacacttttatttgtttcc

SEQ ID NO: 8516 - DNA, 1313 bp, Glycine max
tgaaaagagagattagatagcctcaactgaggggcttctctttgagagaatcgtatctcacaccaattagattccaattagattcaagagacatggccattaaccatgaaacttgggctttcgttttcggccttctaggcaacgtgatctcctttatggtgttcctcgctccattaccgactttttaccaaatctacaagaagaaatctacagaagagttccaatcactaccttatgttgttgcattgttcagttcaatgctttggatctattacgcactcgtcaaaaaggatgctagcctccttctcattactattaactcctttggatgtgtgatagagacgatataccttgcaatcttcctaatttacgccccaagcaaaaccaggctttggaccatcaagcttcttctcatgttgaatgtttttggattcggagcgatgcttctttcaaccctctaccttacaacaggatccaaacgtcttactgtgataggatggatttgccttgttttcaacataagcgtttttgctgctcctctatgcattataaaacgtgtcataaagacgaagagcgtggaattcatgcctttcagtttgtccttctttttgaccataaatgctgtcatgtggttcttctatggccttctcctcaaggactattacgtcgctctaccaaatacgcttgggtttctattcagcataattcagatggtgttgtatttgatttatagaaacgccaagacacctgatctgccaatgaaattgcaagaactaaatagtcatactattgacgttgggaagctgagcagaatggaaccctctgagccgaatcatgtaacaaaaaatggtactttaactgaaagagaaatctgaagaacatcatgaattccgctggcaatgtgtgattaattaaccaatgaacaagtccaaagagcaagaaagaaaaaaaaaacaaaaaaaagggatgcaaaaatatttaacctaaaagtacaatcactctacttggtcaagtggggcctcttctcaacccaagaacagtacgtgtactttggagtttagggttcttcttttaattaatgtatttgcatcagtttgtagctgtaatattttaagtggttagttattatgttagcattatcatctctttggcctcttccatcatattcagactttagtaaaacgtgaaacattagtatcttcaattctcttgtttcagtgtgtcgctcagtcaacctcataataaattttctcttttcgttgtacgcgtaatctatgatcatgtagtgggaattaaatattttataactaatg

SEQ ID NO: 8517 - DNA, 1307 bp, Cajanus cajan
gtgccattgaaagagagattagatagccttaactcacttggagagaagaggatcgttctacaccttttcgtgaccaccgagagtgatccaacaaaaatcaagagggagaatccaattagatttaacttcaagagagatcatggccatccaccacgaaacttgggctttcatttttggccttctaggcaacgtaatctcctttatggtcttccttgctccattacctactttttaccaaatctacaagaagaaatccacggaagggtttcaatcactgccttatattgttgcactgtttagttcaatgttgtggatatattacgcactcgtcaaaaaggatgctagcctccttctcattaccattaacacttttggatgtgtgattgaaacaatttaccttgtaatctttctagtttacgccccaaacaaaaccaggctattgaccatcaagcttcttctgttgttgaatgtgtttgggttcggagcgatgcttctttcgacactctaccttacaacaggatccaaacgtctttctatcataggatggatttgcctggtttttaacataagcgtttttgctgctcctctctgcatcatgaaacgtgttatcaagacgaagagcgtggaattcatgcctttcagtttatccttctttttgaccttaaatgctgtcatgtggttcttctatggtcttcttctcaaggactactacatcgctctcccaaatacacttggatttgtattcggcataattcagatggtgctgtatttgatttatagaaacgctaagataccggaaccaacaaagttgcaggaactaaatggaggtcatattattgacgttgtgaaaatgagcacaatggtaccctccgagccaaatcatgttgcaagaagtgatgttgtgactgaaacagttagcaatgtgtgattagttaagcaatgaacaagtccaaagagagagggaaaaaaaatgaagtgccatgatattaaaccttagagtacaattactttaattactttgccaagtggggcctcttttcaacgtagtttggtgtttagggttcttcttttgatcaatgtattgctgtattatgtttttatgagtctatttaattggcctcttccatcactctcactagtgaaacgtgtagtatctcctcttctttctgtgttccaaagtcaaactcgtcaattctctctttccttgtacgcgtaatctttgttcatgttaagggaattgattatttttactgattacgcaatctatgacttatgagcacacttttgtttattttcatgtgctacaa

SEQ ID NO: 8518 - DNA, 1406 bp, Glycine max
tcgtgcaattgaaagagagagagatagcctgaagtgagggttttcacttggtggtgaccacctagagtgagggaactgaaatttagagagactccaattagattcaagagagatggccattcaccacgaaacttgggctttcgttttcggtcttctaggcaacgtgatctcctttatggtgttccttgctccattaccaactttttaccaaatctacaagaagaaatcatccgaagggtttcaatcactaccttatgttgttgcactgttcagttcaatgctctggatctattatgcatttgtcaaaaaggatgctagcctccttctcattactattaactcctttggatgtgtgatagagacaatttacctagccatcttccttgtttacgccccaagtaaaaccaggctttggaccatcaagcttcttctcatgttgaatgtttttgggttcggagcgatgcttctttcaaccctataccttacaacgggttccaaacgtcttactgtgataggatggatttgtcttgttttcaacataagcgtttttgctgctcctctttgcattatgaaacgtgtcataaagacgaagagcgtggaatttatgcccttcagtttgtccttctctttgaccataaatgctgttatgtggttcttctatggccttctcctcaaggactactacatcgctctaccaaatacgcttgggtttctattcggcataattcagatggtgttgtatttgatttatagaaacgccaagaaagatgagccaatgaaattggaggaactaaatagtcatattattaacgttgggaagctgagcagaatggaaccctctgagccgaatcatgcaacaaaaaatggtactgtgactgagataactattgaggatccaaatggaaaagaaacagaagagggaaacttgaagaacatcatgaattcggctagcaatgtgtgattaattaaccaatgaacaagtccaaagagaaagaaagaaaaaagcaaaaaaaaaaaaaaatgaggtcaaaaaatattttaacataaaagtacaatcactctacttggccaagtggggcctcttctcaacccaagaacagtacgagtactttggagtttaattagggttcttcttttgattaatgcatttgccttaatttgtagttgtcatatgttagctggtcatatgttagcatgagcatctctctttggcctcttccatcgctctcactgtagtaaaacgtgtaacaacgaatgtatcttctcttctttcattgtattcctcagtcaaactcgtcaattctctctttcctttgaacgcgtaataatatatgttcatgtgatgggctgataaaaaaaaatgttcaagtgatggaaatggaaattaattattttactaattatat

SEQ ID NO: 8519 - DNA, 1399 bp, Glycine max
gtgcaattgaaagagagagagatagcctgaagtgagggttttcacttggtggtgaccacctagagtgagggaactgaaatttagagagactccaattagattcaagagagatggccattcaccacgaaacttgggctttcgttttcggtcttctaggcaacgtgatctcctttatggtgttccttgctccattaccaactttttaccaaatctacaagaagaaatcatccgaagggtttcaatcactaccttatgttgttgcactgttcagttcaatgctctggatctattatgcatttgtcaaaaaggatgctagcctccttctcattactattaactcctttggatgtgtgatagagacaatttacctagccatcttccttgtttacgccccaagtaaaaccaggctttggaccatcaagcttcttctcatgttgaatgtttttgggttcggagcgatgcttctttcaaccctataccttacaacgggttccaaacgtcttactgtgataggatggatttgtcttgttttcaacataagcgtttttgctgctcctctttgcattatgaaacgtgtcataaagacgaagagcgtggaatttatgcccttcagtttgtccttctctttgaccataaatgctgttatgtggttcttctatggccttctcctcaaggactactacatcgctctaccaaatacgcttgggtttctattcggcataattcagatggtgttgtatttgatttatagaaacgccaagaaagatgagccaatgaaattggaggaactaaatagtcatattattaacgttgggaagctgagcagaatggaaccctctgagccgaatcatgcaacaaaaaatggtactgtgactgagataactattgaggatccaaatggaaaagaaacagaagagggaaacttgaagaacatcatgaattcggctagcaatgtgtgattaattaaccaatgaacaagtccaaagagaaagaaagaaaaaagcaaaaaaaaaaaaaaatgaggtcaaaaaatattttaacataaaagtacaatcactctacttggccaagtggggcctcttctcaacccaagaacagtacgagtactttggagtttaattagggttcttcttttgattaatgcatttgccttaatttgtagttgtcatatgttagctggtcatatgttagcatgagcatctctctttggcctcttccatcgctctcactgtagtaaaacgtgtaacaacgaatgtatcttctcttctttcattgtattcctcagtcaaactcgtcaattctctctttcctttgaacgcgtaataatatatgttcatgtgatgggctgataaaaaaaaatgttcaagtgatggaaatggaaattaattattttactaat

SEQ ID NO: 8520 - DNA, 1088 bp, Trigonella foenum-graecum
gaggggaatttctgcaaccctaatttcattgctaaaccctgattgtttcagcattcctctctaaatcctttctcatttttctcgggggaaaaactctccagatccaaataaatattacagctatggttttctgggtttttggttatggttcacttgtatggaaccctggattttgattatgacgaaaaattattgggttcattaaggactacagacgcgtgtttgatttagcatgtattgatcatagaggaacacctgaaaaccctgcaagaacttgcactttggaggagaaagaaggggaactttgctggggagttgcttattgtgttcgaggaggccctgaaaaggaaaaattggctatgcagtatttagagcggcgagaatgtgagtatgatcacaagactcttgtaaacttctacaaggaaggagattcactgcatcctgctcttactggagttattgttttcacgtctacgccagacaaagaaaacaacatatactatctgggacctgctccgctggaggacatggctaggcaaatagcaaccgctaatggcccctgtggaaacaatagggactatctttttcttctggaaaaggctatgcataatcttggtcatgaggacgacttagtgatagaacttgctaatgaagtgaggaaagtacttggagtgggcaatgcagtgccaattgacaagaaattggttggaccagcacaacttcaacaccagccacatgtacccatttcaacccttcagttgcacccgctcccagaacctattgctttggatagttgagaagagctggagattactaaaaattgatgctgagttcttcatctaaactgatttactgtggaccctgctaacccatcaatcaatttttaaataatatcatatagttgttcacttcttctggttttagctgctttttcacccattttcttaagatgttgcttagattatgtgagacacaatgttctgaattggaatgtgagcggacattttagatccacagtactgattaaaaaggattacttatatttagccaatggcaatcttgtataacctgaaatgaattctattgag

SEQ ID NO: 8521 - DNA, 1673 bp, Cicer arietinum
aaattgtaattagacagcacaagaaagggatcaatgagaggcacgtgacagaaaagttggtgggggtgaagccgttaaattcgcgtagcttctcaccccataaataccaaccttttctcatcgcaataccccacgccttacccgagagaaatagaaagaaacaatagagaaaagaggggaatttctgtaaccctaatttcattgataaaccctaattgttcagcattcctctctattctcccatcttcgccacaaattctttctcacttttctcgggaattttcaaataaattctacagccatggttttctgggtttttggttatggttcactggtatggaacccaggatttgattacgatgaaaagattattggtttcattaaagactacagacgtgtctttgatttagcatgtattgatcacagaggaacacctgaaaaccctgcaagaacttgcactttggagctgaaagaaggggcaatttgctggggagctgcgtattgtgttcgaggaggccctgaaaaggaaaaacaggctatgcagtatttggagcggcgggaatgtgagtacgatcataagacccttgtaaacttctacaaggaaggagaatcattgcaccctacactcaccggagttattgtattcacatctactccagacaaggaaaacaacaaatactatctgggtcctgctccgctggaggacatggctaggcaaatagcaactgctaatggcccttgtggaaacaatagggactatctttttcttctggaaaaggctatgcataatatcggccatgaggacgacttagtgatagagcttgctaatgaagtgaggaaagttcttgaagttgtgaatgtagtgccaaacgacaaaatattggttggaccaacacaacttcaacacccatcgcacctacccatttcaacccttcagttgcacccattgccagaacctattgctttggatagttgaggagctggagattactaaacactgatggtgagttcagcatataagctgattcactgtggaccctgctaacccatgaaatcaatcattttttaaataaaatcatatagttgaaaacttctgcaagttttagctgcttgtttcagccattctcttgagatgttgcttagattcagagagagtcacaatgttctgaataggaatgtgcgcggaaattttacacctgcagttaattgaatactactagaatatcttcctatttagccaatgtcaatcctactttagctgaaatgaattattatgttttgagcatcacttttgtctatttggtgtatggtttctcaattgctttgaccatatgtatgttgcggtgaatttaacttggaacaaacgctgttatgctacaatggtagatcatactaagatagattttgattctttgcgattgatacatataccaaagttgcataaaatttaagttataggtaattgtaacaagtaccctcgccaaaggcaaaaatcaaaaaagaaaatttaacttttggaaattgtacattttaacattttgaaaaagagtttgttgggacttttttttttcagttttaacaactttgacattgttagtacatttattttttttttcagttttaagaactttgacggtgatgttttcaatatattatattaatttgaattaaaa

SEQ ID NO: 8522 - DNA, 1206 bp, Glycine max
tttctcaagccagagaaagagaaggaaccaacaacaaagagcagagagaaagagaggaccattccaaccctaatttctctgctaaaccctagttgtttggcatttcctctcttctccctcgtaaatcttctcccattccctccggtagctttccagatccaaataaatcatggttttctgggtttttggctacggttcactggtgtggaaccctggattcgattacgacgagaagattattggtttcatcaaggactacagacgcgtgtttgatttagcgtgcattgatcaccggggaacgcctgaaaacccagcgagaacttgcacattggaggagaaagaaggggctatttgctggggagctgcttattgtgttcgaggaggccctgaaaaggaaaaattggctatgcagtatttggagcgacgggaatgtgaatatgacagaaagactcttgtaaacttcttcaaggaaggagattcactgcatcctactttaactgatgtaatagtattcacatctactccagacaaagtgaacaacaaatactacctgggacctgctccacttgaagacatggctaggcaaatagcaactgcatacggcccttgcggaaacaacagggattacattttccttctagaaaaggccatgcatgatattggccatgaggatgacttggtgatagagcttgccaatgaagtgaagaaagtacttggagtgggaaatgtagtaccaaaggagaagaaacaggttggagcagcacaacttccacaccctcctcatgtgccaatccctacccttcaactgctcccgctgccagaacctattgctttggatagctgacgcggaaactgacgctgagttcggcaactaaactgatttactgcggaccctactaaccctaattcaaattttaaataacatcacatatattcctcttcgcctagttttagcggcttcttcagccattcccttgagatattgcttaaattcagtgaggcgcaatattttgaattggaatgaatgttcgcagatgttataattgaaaaagttcaatttttctatttatttcgtttacggcaatcttacagagttttttttttccaccagttctgcatcccaatcttacggagttatttatagcttttaattgctggtacttcgaaatgaataatattacttctgttttgagcaaagttcttttc

SEQ ID NO: 8523 - DNA, 1191 bp, Glycine max
aagccagagaaagagaaggaaccaacaacaaagagcagagagaaagagaggaccattccaaccctaatttctctgctaaaccctagttgtttggcatttcctctcttctccctcgtaaatcttctcccattccctccggtagctttccagatccaaataaatcatggttttctgggtttttggctacggttcactggtgtggaaccctggattcgattacgacgagaagattattggtttcatcaaggactacagacgcgtgtttgatttagcgtgcattgatcaccggggaacgcctgaaaacccagcgagaacttgcacattggaggagaaagaaggggctatttgctggggagctgcttattgtgttcgaggaggccctgaaaaggaaaaattggctatgcagtatttggagcgacgggaatgtgaatatgacagaaagactcttgtaaacttcttcaaggaaggagattcactgcatcctactttaactgatgtaatagtattcacatctactccagacaaagtgaacaacaaatactacctgggacctgctccacttgaagacatggctaggcaaatagcaactgcatacggcccttgcggaaacaacagggattacattttccttctagaaaaggccatgcatgatattggccatgaggatgacttggtgatagagcttgccaatgaagtgaagaaagtacttggagtgggaaatgtagtaccaaaggagaagaaacaggttggagcagcacaacttccacaccctcctcatgtgccaatccctacccttcaactgctcccgctgccagaacctattgctttggatagctgacgcggaaactgacgctgagttcggcaactaaactgatttactgcggaccctactaaccctaattcaaattttaaataacatcacatatattcctcttcgcctagttttagcggcttcttcagccattcccttgagatattgcttaaattcagtgaggcgcaatattttgaattggaatgaatgttcgcagatgttataattgaaaaagttcaatttttctatttatttcgtttacggcaatcttacagagttttttttttccaccagttctgcatcccaatcttacggagttatttatagcttttaattgctggtacttcgaaatgaataatattacttctgttttgagcaaa

SEQ ID NO: 8524 - DNA, 1298 bp, Glycine max
atctttcgtgtgtgttatttctcacgccttctcagactcagaaaagagaagaaacaaaacaaaaaagagcagagagagagaggaaccatcaccaaccctaatttcttagctaaaccctattcgtttagcatttcctctcttttctcccactcgtaaatcctctcccaaacttttcagatccaaataaatcatggttttctgggtttttggctacggttcactggtgtggaaccctggattcgattacaatgagaagattataggtttcattaaggactacagacgcgtgtttgatttagcgtgcattgatcaccggggaacacctgaaaacccagcaagaacttgcacgttggaggagaaggaaggggctatttgctggggagctgcttattgtgttcgaggaggccctgaaaaggaaaaactggctatgcagtatttggagcgacgggaatgtgaatatgacagaaagactcttgtaaacttcttcaaggaaggagattcactgcaccctactttaactgatgtaatagtattcacatctactccagacaaagtgaacaacaaatactacctgggacctgctccacttgaagacatggctaggcaaatagcaactgcatatggcccttgcggaaacaacagggattacattttccttctagaaaaggccatgtatgatattggccatgaggatgacttagtgatagagcttgccaatgaagtgaggaaagtacttggaatgggaaatgtagtaccaaaggagaagaaactggttggagcagcacaacttccacaccctcctcatgtaacaatccctacccttcaactgcacccactgccagaacctattgcaatggatatatagctgaggggggagatgaccaaaaactgacgctgagttcggctactaaactgatttcctgctaaccctcattcaaatttaaataacatcacatatctattcctcttcgcctacttttagcggctttccagccattcccttgagatattgcttaaattcagtgaggcgcaatattttgaattggaatgttcgcggatattttacttctgcagactgcagtgttattattgaaaaagtttcattttttttatttatttcgtttacggcgatcttacacagttttttttatatcagttctgcattcaatcttaccgagttaatagctagctagtacttcgaaatgaataatacttctgttttgagcaagttcttgtctatttgtgtttcgtgtattcgcgtttggttaaaatataattttttttcttatttttttaaa

SEQ ID NO: 8525 - DNA, 1200 bp, Glycine max
ttctcagactcagaaaagagaagaaacaaaacaaaaaagagcagagagagagaggaaccatcaccaaccctaatttcttagctaaaccctattcgtttagcatttcctctcttttctcccactcgtaaatcctctcccaaacttttcagatccaaataaatcatggttttctgggtttttggctacggttcactggtgtggaaccctggattcgattacaatgagaagattataggtttcattaaggactacagacgcgtgtttgatttagcgtgcattgatcaccggggaacacctgaaaacccagcaagaacttgcacgttggaggagaaggaaggggctatttgctggggagctgcttattgtgttcgaggaggccctgaaaaggaaaaactggctatgcagtatttggagcgacgggaatgtgaatatgacagaaagactcttgtaaacttcttcaaggaaggagattcactgcaccctactttaactgatgtaatagtattcacatctactccagacaaagtgaacaacaaatactacctgggacctgctccacttgaagacatggctaggcaaatagcaactgcatatggcccttgcggaaacaacagggattacattttccttctagaaaaggccatgtatgatattggccatgaggatgacttagtgatagagcttgccaatgaagtgaggaaagtacttggaatgggaaatgtagtaccaaaggagaagaaactggttggagcagcacaacttccacaccctcctcatgtaacaatccctacccttcaactgcacccactgccagaacctattgcaatggatatatagctgaggggggagatgaccaaaaactgacgctgagttcggctactaaactgatttcctgctaaccctcattcaaatttaaataacatcacatatctattcctcttcgcctacttttagcggctttccagccattcccttgagatattgcttaaattcagtgaggcgcaatattttgaattggaatgttcgcggatattttacttctgcagactgcagtgttattattgaaaaagtttcattttttttatttatttcgtttacggcgatcttacacagttttttttatatcagttctgcattcaatcttaccgagttaatagctagctagtacttcgaaatgaataatacttctgttttgagcaa

SEQ ID NO: 8526 - DNA, 915 bp, Cyamopsis tetragonoloba
cacgagggaaagagttaagagaaaacgagagagagagagagagagagagagagagagagagaggatcgaaaccattctgccctaatttccattgctaaaccctaaatcgtttagcatttcctctctttcttctctcatctgctttcttcctcctatattccttctccttttctcgggaaactttccggatctcaataaatcatacagctatggttttctgggtttttggctatggttcactggtgtggaaccctggatttgaatacgaggagaaaattattggtttcatcaaggactacagacgtgtgtttgatttagcatgcattgatcacagaggaacccctgaaaaccctgccagaacttgcacgttggagctgaaagaaggcacaatctgctggggagcggcttaccgtttcggtggaggccctgaaaaggagaaactggctatgcagtatttggagcggagggaatgtgaatatgatcgaaagacccttgtaaacttttacaaggaaggggattcactgcaacctgctttaactggagtaatagtattcacatctactccagacaaagaaaacaacaaatactacctgggacctgctccgcttgatgacatggctaggcaaatagcatttgctcatggcccttgtggaaacaacagggattatctttttcttctagagaaggccatgcatgatcttggccatgaggacgacttagtgatagagcttgctaatgaagtgcggaaagtacttggagttgggaatgtagtaccaaaggacaagaaattggttggagcgggacaacttcatcacactcctcatgtacccatccctacccttcaactgcaccctctgccagaacctattgctttggcatagttgagctgctgcacacgactgaaaaatgatgctc

SEQ ID NO: 8527 - DNA, 1390 bp, Cajanus cajan
actgagagcagggcacgtgagaatgatgttgtgttgctggagcacagcaaggcgaggccgttgaatccgcgtgccaggcttacaccataaataccaatctttctaatgcggaatgcctcacgcctttatccgagacaaagagggaacaagagcagatagaaagagaggaggaaccattgtaaccctaatttatttgctaaaccctaagcgtttagcatttccttttcctctctttttacctctcttctccctcctaatcctaacctaaaaagcctttccattctcatttgcccgctcggatcccaataaaccatggttttctgggtttttggctacggttcactggtgtggaacccagggtttgatttcgatgagaagattgtcggtttcattaaggattacagacgcgtctttgatttagcgtgcattgatcaccggggaacccctgaaaaacctgcaagaacttgcacattagaacagaaagaaggggctatttgctggggagctgcttattgtgttcgaggaggtcctgaaaaggaaaagctggctatgcagtatttggagcgacgggaatgtgaatatgaccaaaagactatcgtaagcttcttcaaggaaggagattcactgcaccctactttaactgacgtaatagtattcacatctactccagacaaagttaacaacaaatattacttgggacctgcccctctggatgacatggcctggcaaatagcaactgcttatggtccttgcggaaacaacagagactaccttttccttctagaaaaggccatgtatgatatcggccatgaggacgacctagtgatagagcttgccaatgaagttaggaaagtacttggtgtgggaaatgtagtatcaaaggagaagaaatcggttggaccagcacaacttgctcaccctcctcacgtaccgattccttctcgtcaactgcacccaatgccagaacctattgcattggatagttgaggagccggatttgacaaaaactgacggacgctgagttctgcgactaaactgatttactgcggatcctgctaaccctcattcaattttcgatacatcatacagctatctcacttatcctagctttagcggctgcttccattcccatgagacattgcttgaattcagtgagacgaattggaatgttgactgattttgcactatgttataattgaaaaattaagttctgttttgagtaagttcttgtctattatcaattggtgtcgccttggtcatatggacggtggaattaatttattgtttgctatgttacgatggtaaatctgtgtttggggatcatgatatttttggaatacttgcaataagtcaatcatggttcactcccttagttctctattgcaaattt

SEQ ID NO: 8528 - DNA, 1297 bp, Phaseolus vulgaris
cagaaagaagaaaagagaagaagaagaaagagcagagagaaagagaggaaccattgcaaccctaatatcttagctaaaccctaatcgtttagcttttcctctctttttccctctcttcttccttctcccttctccatcgttaatattctctcattttcctcgccagaccttccagatcccaataaatcatggttttctgggtttttggctatggttcactggtgtggaacccagggttcgattacgatgagaagatgattggtttcattaaggattacagacgcgtgttcgatttagcctgcattgaccacaggggaacaccagaaagcccagcaagaacttgcacattggaggagaaagaaggagccatttgctggggaactgcttattgtgttcgaggaggccctgaaaaggaaaaattggctatgcagtatttggagcgacgggaatgtgaatatgacagaaaaactcttgtgaccttcttcaaggaaggagattcacagcaccctgctttgactgacgtaatagtattcacatcgactccagacaaagtaaacaacaaatactacctgggacctgccccactggaagacatggctaggcaaatagcaactgcgtatggtccttgcggaaacaacagggactatcttttccttctagaaaaggccatgtatgagattggccatgaggatgacttagtgatagagcttgccaatgaagtgaggaaagcacttggagtgggaaaggtactaccaaatgttggagcagctcaacttccacaccctcctcatgtctccatacctagccgtcaactgcagccactgccagaacctattgctatggatggttgagttttgagagggttggagatgaccgaagaaaactgacgctgatttactgtggaccctgctaaccctcattcaattttcaaataacatcatatagttaatccccacttttcagccattcccggagatattgcttaaattcagcgagggcaatattttgaattggagtgttcggagacttttgactcaataatattgagaaaggctaatctttgtatttattttgttcactgcaatcctaccgagttaatagctatttcgagcaagtttttacctgtttgtgtttcgtctatttctttatcgagtgggctcaggatttaatttgtttcaatgccatcatggtcatgatatatttggaagcgtgtaaaattttaaaagctttatcgtgtaagttggctagaagttaatgaaaccatgacaatctacaactaaattacaattggaggcaa

SEQ ID NO: 8529 - DNA, 1177 bp, Phaseolus vulgaris
cagaaagaagaaaagagaagaagaagaaagagcagagagaaagagaggaaccattgcaaccctaatatcttagctaaaccctaatcgtttagcttttcctctctttttccctctcttcttccttctcccttctccatcgttaatattctctcattttcctcgccagaccttccagatcccaataaatcatggttttctgggtttttggctatggttcactggtgtggaacccagggttcgattacgatgagaagatgattggtttcattaaggattacagacgcgtgttcgatttagcctgcattgaccacaggggaacaccagaaagcccagcaagaacttgcacattggaggagaaagaaggagccatttgctggggaactgcttattgtgttcgaggaggccctgaaaaggaaaaattggctatgcagtatttggagcgacgggaatgtgaatatgacagaaaaactcttgtgaccttcttcaaggaaggagattcacagcaccctgctttgactgacgtaatagtattcacatcgactccagacaaagtaaacaacaaatactacctgggacctgccccactggaagacatggctaggcaaatagcaactgcgtatggtccttgcggaaacaacagggactatcttttccttctagaaaaggccatgtatgagattggccatgaggatgacttagtgatagagcttgccaatgaagtgaggaaagcacttggagtgggaaaggtactaccaaatgttggagcagctcaacttccacaccctcctcatgtctccatacctagccgtcaactgcagccactgccagaacctattgctatggatggttgagttttgagagggttggagatgaccgaagaaaactgacgctgatttactgtggaccctgctaaccctcattcaattttcaaataacatcatatagttaatccccacttttcagccattcccggagatattgcttaaattcagcgagggcaatattttgaattggagtgttcggagacttttgactcaataatattgagaaaggctaatctttgtatttattttgttcactgcaatcctaccgagttaatagctatttcgagcaagtttttacctgtttgtgtttcgtctatttctttatcgagtgggctcaggatttaatttgtttc

SEQ ID NO: 8530 - DNA, 1267 bp, Lotus japonicus
cctcacacaccttcttgatcacccgagagagaaagaggaagagtattatagagagagaaagtgctagagagagaaacagagagaggaagatctgaaaccctaataaaccctattcattcatcgatttcctctcgttttcccacactctcttgtgcttttccaccgttaattcttcctcgttttctcgggaaagtttccagatcctcataagtaagattcagccatggttttctgggtttttggatatggttcactggtgtggaacccaggatttgagtatgatgagaaggttattggttacataaaggattacagacgtgtgtttgatttagcgtgcattgatcacagaggtacacctgaacaccctgctagaacttgcacattggaggagaaagaaggagaaatttgctggggagcagtttattgtgttcgaggaggccctgagaaggaaaaattggttatgcagtatttggagcgacgagaatgtgagtatgatcataagactctggtagacttctacaaggaaggagattcatcacaccctgctcttactggagtcatagtattcacatctactccagacaaagttaacaacaaatactacctgggacctgctccactggatgtcatggctaggcaaatagcaactgctcatggcccttgtggaaacaacagggactaccttttccttcttgaaaaggccatgcataatattggccatgaggacgatatggtgatagaacttgcccatgaagtgaggaaagtacttggagtggggaatgtacttccaaacgacaaaaaattgtccggaccagtgcaaattcaacactctcctcatgcacccatcccagcccttcaattgctcccaatgccggaacctattgctttggatagttgagacttgagaggctaagatgactggaatctgatgcagactttgacaactaaactgtttcactgtggaacctgctaacccattcattacttgaataaaaacatagatgtttcactacccctagttttgacggctttgtcagtcattccctgagatgttacttagcttcagtgagagaaacgatgtattgagttggaatgtatgctgatattttacaccatagaagttaaaaatgttggttctttctatctagttaacagcaatgcaactgaattgcgcaacacatacttttgttgagtaaattttaagttgttctttctatctagttaacggcaatgctactgaattgcactatgcgtacttttgttgagt

SEQ ID NO: 8531 - DNA, 1097 bp, Vigna unguiculata
gagccattgcaaccctaacatcttagctaaaccctaatcgtttagcttttcctctcttttttttcccctctcttcttttcttcccccttgttaatcctctctcattctcctcgccaaacgttccagatccaaataaatcatggttttctgggtgtttggctacggttcactggtgtggaacccggggtttgattacgatgagaagattgttggtttcattaaggattacagacgcgtgttcgatttagcgtgcattgatcaccggggaaccccagaaaacccagcaagaacctgcacgttggaggagaaagaaggagctatttgctggggagctgcttattgtgttcgaggaggccttgaaagagaaaaattggctatgcagtatttggagagacgggaatgtgaatatgacagaaaaactctcgtaaccttcttcaaggaaggagactcacagcaccctgctttgactgacgtaatagtattcacatcaaccccagacaaagtgaacaacaaatactacctgggacctgccccactggaagacatggctaggcaaatagcaactgcgtatggtccttgcggaaacaacagggactatctttttcttctagagaaggccatgtatgatattggccatgaggatgacttagtgatagagcttgcgaatgaagtgaggaaagcacttggagtgggaaatgtgctaccaaatgttgcaacagctcaacttccacaccctcctcatgtatccatacctagccgtcaattgcaaccactgccagaacctattgctttggatggttgagttttgagggggatggagatgaccggagaaaactgacgatgagttcggcaactacactgatttagcggaccctgctaaccctcattcaattttcaagtaacatcatatagttagtccccactttttcagccattccctggagatatcccttaaattcagggaaggcaatattttgaatttgaatgttgagacttttgacatctacactcttataattttgagaaaggttaatgtttctagttatttcgttcactgcaatcccacaatcctacctggtttaatagctattccgaaa

SEQ ID NO: 8532 - DNA, 1322 bp, Arachis hypogaea
cccccccccccccccccccctataccctcgtcgtgccgtcgtcgagtacgtcacgaagacgagtaggtatcaacgcagagtacgggggagctgaaagaagaggagaagcgaagagaagagagggggagagagaaagaagggatttagagagagaaaacacaggaaaaattcgaaaccctaattcccaaagctaagccctaatcctttctatcattcctctcgtcgcttctcttcatccaatcgccaccgctaaatccattctttctcactcatcttcatctcaattaaaattaagccatggttttctgggtttttggctacggttcacttgtgtggaacccaggattcgaattcgatgagaaaattatcggctacattaaggattacagacgtgtatttgatttagcatgcattgatcaccggggtacacctgaaagccctgcaagaacttgcacgttagaggagaaagaaggagcaatttgctggggtgctgcttattgtgttaaaggtggcgctgagaaggaaaaatttgctatgcagtatttggaaaggcgagaatgtgaatatgatcaaaagactctcgtaaacttctacaaggaaggagagacactgcaacctgctttaacgggagtgatagtatttacatctacgccggataaaattaacaacaaatactacctgggacctgcccctcttgaagacatggctaggcaaatagcaactgcctatggtccttgcggaaacaacagggattatcttttccttttggagaaggccatgtacgatattggccacgaagatgactatgtaatagagctagctaatgaagtaaggaaagtacttggaatggggaaggcactaccaaaggacaaaaagttggttggagcaccatcacaacttcaacaccctcctcatgtacctattccaacccttcagcttcatcctcttccagaacccattgctttggatagctgatatgaccagaggttactgaaagatgatgctgaattatggactaagctaattcaccctggatcctgctaaatgctaaccccattcaaattcttctactaccctttatttctcaaaagaaaagcataagaaatatataactgttctacctgttatgactagttttagaggcactcttttaagcctttctacggaggtacttctcaggtttggtgagacaaaataagaccatgttttgaattagaaggaatttgaggatactttacacctgcagtgcgattattgaaaatgttccgaggcatgtaatacttgagttagtaatgtatacttgactacttgagcttttgttc

SEQ ID NO: 8533 - DNA, 1373 bp, Arachis hypogaea
cgggggagctgaaagaagaggagaagcgaagagaagagagggggagagagaaagaagggatttagagagagaaaacacaggaaaaattcgaaaccctaattcccaaagctaagccctaatcgtttctctcattcctctcgtcgtttctcttcatccaatcgccaccgcttaatccattctttctcactcatcttcatctcaattaaaattcagccatggttttctgggtttttggctacggttcacttgtgtggaacccaggattcgaattcgatgagaaaattatcggctacattaaggattacagacgtgtatttgatttagcatgcattgatcaccggggtacacctgaaagccctgcaagaacttgcacgttagaggagaaagaaggagcaatttgctggggtgctgcttattgtgttaaaggtggcgctgagaaggaaaaatttgctatgcagtatttggaaaggcgagaatgtgaatatgatcaaaagactctcgtaaacttctacaaggaaggagagacactgcaacctgctttaacgggagtgatagtatttacatctacgccggataaaattaacaacaaatactacctgggacctgcccctcttgaagacatggctaggcaaatagcaactgcctatggtccttgcggaaacaacagggattatcttttccttttggagaaggccatgtacgatattgcccacgaagatgactatgtaatagagctagctaatgaagtaaggaaagtacttggaatggggaaggcactaccaaaggacaaaaagttggttggagcaacatcacaacttcaacaccctcctcatgtacctattccaacccttcagcttcatcctcttccagaacccattgctttggatagctgatatgaccagaggttactgaaagatgatgctgaattatggactaaactaattcaccctggatcctgctaaatgctaaccccattcaaattcttctagtaccctttatttctcaaaagaaaagcataagaaatatataactgttctacctgttttgactagttttagaggcactcttttaagcccttctacggaggtacttctcaggtttggtgagacaaaataagaccatgttttgaattagaaggaatttgaggatactttacacctgcagtgcgattattgaaaatgttccgaggcatgtaatacttgagttagtaatgtatacttgactacttgagcttttgttcaattaacttgacttttctttgtcttgtctacttggatgtactgcgtattttatcttattgtttcgggttgtaacttgagagtggattattttcttattgatggagtttgcaattgaagttacgtaaaaaaaaa

SEQ ID NO: 8534 - DNA, 1349 bp, Fagus grandifolia
ccaacttttttgtacaaagttgtccccgacgatcaaagacaaaacacagagagagaaacaaagggaaaccctaatcgctgaaagctaaacccatatagtgtttggctttgtttctctctctctgccaccattcaacaagggaaatccgattttctaagcactttctctctcgttttttctcgggaaaacaaacacacaatccgcgatcttatttgtgttacacaaccatggttttctgggtttttggatatggttcactggtatggaacccaggatttgattacgatgagaaagtgatagggttcattaaggactacaggcgtgtttttgatcttgcatgcattgatcacagaggcacacctgagcatcctgcgcgcacttgcacgctggaacaaaaagaaggagacatatgctggggtgctgcttattgtgttcggggaggccctgaaagggaaagactagcaatggagtatttggagcggagggaatgtgaatatgatgaaaagactctagtaaacttctacaaggaaggggattccttgcagcctgcattaacaggagttatagttttcacatccactccagacaaagaatcaaacaagtactatttggggcctgcaccattggaggaaatggcaaggcaaattgcaactgcttatggaccctgcgggaacaatagagactatatcttccagttagagaaggccatgtctgctattggccatgaggatgacatggtgatagagcttgcaaacgaggtgaggaaggtacttggaattgaaggaattccgaaggagaggaagttggttgggccatcccacatcccactcacgtcccatattcccacccttcaactgcatccacttccagaagccattgccatggactcctcctaactaaagaatttgcataagctgaggagcctgctaacccatttattactatcttgtttcggcgcatatttaatcttttccttctagagagcagtttctttttttctttttaatagcaccctttttgcctttcgaaactcttagctcattaatctcgtctagcttaggtttgaggcgctgcaagaaagtggtttgggattgaaaggagtgactaacaattttccacacaatacaagatttagaaaacgatgatgatgctattttcagtttgcaaccaagagaaatcaattgttacttccatgcgaattacagttatgtttggtattcatgtattgctttttcaaagacgtcttgttttattttttaatataaatttttgttcttaagaatgtattagaagatgattattggatcaaattttattacacttcatgttcttataacaaaatcagcaag

SEQ ID NO: 8535 - DNA, 2873 bp, Sorghum bicolor
acaccgaaacgctcgggacccgtgcctcctcatgctcgcccgcccggacacgcgtgccgctcgcacgcgcggcgccgtgggctcccccgcgcgcatggtgcctgcgggggcgcacgagcgtgctgcgtgcctgcggatgccgcatgcggtctgcgcggcagcgtttacgtgacagtttgacacgcacaggcgtttaagaggggaggagattacggaaagcaaagcgcagcctcgatcgatctctggctgtcgactctgcaggcgtcgcgcctacctataaagccctaacctgcgacgacttcaccatgtgtcatcggagcgagctcctctccctcgtgctgtaccaaccagccatggtcgacaccgtcgccggcgccaccgactaccgcggccagccggcctctcgtgccgccaccggcggctggaaaccgtcggttttcgtcatggcgatggagatcgcggagcggttcgcgtacaagggcgtggccgcgaacctgatcacgtacctgacggggccactggggcagccgatggcgcgcgccgccgcgtccatcgacgcgtggaagggcgtctcccagatgctgccgctgccgctcgcgtgcgtcgccgacgcctggctcggccggtaccgggccatcgtcctcgcctccctcatcttcgtcgtgagcatgggctccctgtcgctgtcggcggcgttgccggccttgcgcggcggccacgtggccatcttctacgtggcgctgtacctggtggctctcggcgagggcgcgcacaagccgtgcgcgcaggcgttcgcggcggaccagtacgacgagaaggaccccaaggagagcgtggcgcggagctcgttcttcaactggtggtacttcggcatgtgcgccggcaccgctgtcaccaccatggtctccagttacgtgcaggacaacgtcggctggggcctcggcttcggcatcccctgcatcgtcatcgtcgcctcgctcgccctgttcttgctcgggaccaggtcgtaccggttctacaccaccacggaggccagccccttctctcgcgtcgggaacgcgttgctggcgttgatccacagctgggcgcccaagcatcgcaccagaaaattaggcgatggcgacgaggacaacgccgtcgccgtcgaggaagtgaagagcgtgctccgcctgctgcccatatgggcgtcgtgcataatctacgcgatcatcttctcccagacgtcgacgttcttcacgaagcaggccgcgacgctggaccgccggatcggcgcgaggttcaaggtgccgccggcggcgctgcagacgttcatcagcgtgagcatcgtcgtcttcatccctgtgtacgacaggctcttcgtgcccctggcgcgacgctacacgggaaggccgacggggatcaccatgctgcagagggtcggcgccggcctggcgctctccctcgtcgccgtggccctgtccgcgctcgtcgagatgaaacgactccgtgtcgcgacggaagccggcctggtgaacaccccgaaggcgcagctccctatgacgctctggtggatggtcccgcagtacatcctcatcggcgtcgccgacgtgttcgccatgatcgggctgcaggagttcttctacgaccaggtccccgacgcggtgcggagccttgggctggccctgttcctgagcatcttcggggtcggccacctcctcagcagcttgctcatctccgtcattgacaagacgacagcgaggagcgggacgagctggttctctaacaacctcaaccgcgcccacctcgactacttttactggctgctcactggcctctgcgccgtggagctcgtcgcctttgtgctcttctctcgagtgtatgcttacaagagaaagagtggcaatgatggtggcagtggtgatctcgtgtgatacatatgcagtttgagccgtactgatcactttgaggggtgcctgtagctgtagttgtttgtagagagccagccctctacggagtacggagttgctacgggattctggtgttaacacactacttttccccttatctcttgatttatgattccaaaatgggctagggaagaggacacttggtttaagtttccaaatgggctagttgaggctatatattctcaaatgggccatccccatattattttgggagttggcaaataacaaaatttgcaaaactattagagttgctataaggggatcttcaattgccaactttaaactagtattagatgccatgtggagtagagagaaaacacagatttttaagctagcgggaagagaagagctagttttttgagatataatatataaataaaaacactttacatatgaagcgtacaaataatatgagatgacatctagtatactattggaggtgtccttgttgcctgaaaaaaaaaagaatgtgtagcctctggacctctagatatcatctttggaaaacatatgtttttagaaggacttcaaaatgttgccgcaagtatattactaagaggagaataatgtgccattgcagctccaacattgtcttaggccttgtttagttcgcgaaaatttttggctttggctactgtagcactttcgtttgtttgtgacaattattatccaattatggagtaactaggctcaaaagattcgtctcgcaaattacagataaactgtacaattagtttttatttttatctatatttaatgttttatgcatgtgtacaaagattcgatgtgatgggaaatcttgaaaatttttggaaactaaacaaggccttaagagcgcgctagctcataggatattttactcaataaggagagacaatagtaattaagctagctctttatgaagagctaagctaagctcatacacta

SEQ ID NO: 8536 - DNA, 1884 bp, Zea mays
cgattgtgccggcgccgcggcctacctataaaaccctaacgaccttcgacgacggcaggcaccatgtgtcatcggactagcaagggtcctctccctcgcgctgtgcagtgtcaacaagccatggtcgacaccgtcgccggcgccaccgactaccgcggtcagccagcctcgcgggccgccaccggcggctggaaaccgtcggttttcgtcatggcgatggagatcgcggagcggttcgcgtacaagggcgtggccgcgaacctcatcacgtacctgacggggccgctggggcagccgatggcgcgcgccgccgcgtccatcgacgcctggaagggcgtctcccagatgctgcctctgccgctcgcgtgcgtcgccgacgcctggctcggccggtaccgggccatcgtcctcgcctccctcatcttcgccgtgagcatgggcgcgctgtcgctgtcgtcggcgctcccggcgctgcgcggcggccacgtggccatcttctacgtggcgctgtacctggtggccctcggcgagggcgcgcacaagccgtgcgcgcaggcgttcgcggcggaccagttcgacgagaaggaccccagggagagcgtggcgcggagctccttcttcaactggtggtacttcggcatgtgcgccggcaccgccgtcaccaccatggtctccagctacgtgcaggacaacgtcggctggggcctcggcttcggcatcccctgcatcgtcatcgtcgcctcgctcgccctgttcctgctcgggaccaggtcgtaccgcttctacacgaccgcggcggccagccccttctctcgcgtcgggaaggcgttgctggcgttggtccagagctgggcgccgaagcatcgcaccagaaaactaggcgacagcgacggcgacgccgtcgccgtcgaggaagtgaagagcgtgctccgcctgctgcccatatgggcgtcgtgcataatctacgcgatcatcttctcccagacatcgacgttcttcacgaagcaggccgcgacgctggaccgccggatcggcgcgaggttcaaggtgccggcggcggcgctgcagacgttcatcagcgtcagcatcgtcgtcttcatcccggtgtacgaccggctcttcgtgcccctggcgcggcgctacacggggaggccgacggggatcaccatgctgcagagggtcggcgccggcctggcgctcgccctcgtcgccgtggccctgtcggcgctcgtggagatgaagcggctccgggttgcggcggaagccggcctggtgaatacccccaaggcgcagctccccatggcgctctggtggatggtcccgcagtacgtcctcatcggcgtcgccgacgtgttcgccatgatcgggctgcaggagttcttctacgaccaggtccccaacgcggtgcggagccttgggctggccctgttcctgagcatcttcggaatcggccacctcctcagcagcttcctcatctccgtcattgacaagacgacagcaaagagcgggacgagctggttctctaacaacctcaaccgcgcccacctcgactacttctactggcttctcactgggctctgcgccgtggagctcgtcgcctttgtgatcttctcgcgagtgtatgtttacaagagaaaggttggcaatgatggcggcaatggtgatttcgtataatagtatatgcaatttgagccgtactgatcacttgaggggtgccggtagctgtagttgtttgtacagtacccgtcttggaaaaaaacgtacgaagtaaggtgtgaccgtgtgactacgggattctgtgttaacgcatattttttcatcttcgactggttctatcttagacctttgaatgcatggggatcagaggagattagaccttgttta

SEQ ID NO: 8537 - DNA, 1963 bp, Zea mays
gcaaagtgcagtcagccacctggatcgacctgagctgtcgattgtgccggcgccgcggcctacctataaaaccctaacgaccttcgacgacggcaggcaccatgtgtcatcggactagcaagggtcctctccctcgcgctgtgcagtgtcaacaagccatggtcgacaccgtcgccggcgccaccgactaccgcggtcagccagcctcgcgggccgccaccggcggctggaaaccgtcggttttcgtcatggcgatggagatcgcggagcggttcgcgtacaagggcgtggccgcgaacctcatcacgtacctgacggggccgctggggcagccgatggcgcgcgccgccgcgtccatcgacgcctggaagggcgtctcccagatgctgcctctgccgctcgcgtgcgtcgccgacgcctggctcggccggtaccgggccatcgtcctcgcctccctcatcttcgccgtgagcatgggcgcgctgtcgctgtcgtcggcgctcccggcgctgcgcggcggccacgtggccatcttctacgtggcgctgtacctggtggccctcggcgagggcgcgcacaagccgtgcgcgcaggcgttcgcggcggaccagttcgacgagaaggaccccagggagagcgtggcgcggagctccttcttcaactggtggtacttcggcatgtgcgccggcaccgccgtcaccaccatggtctccagctacgtgcaggacaacgtcggctggggcctcggcttcggcatcccctgcatcgtcatcgtcgcctcgctcgccctgttcctgctcgggaccaggtcgtaccgcttctacacgaccgcggcggccagccccttctctcgcgtcgggaaggcgttgctggcgttggtccagagctgggcgccgaagcatcgcaccagaaaactaggcgacagcgacggcgacgccgtcgccgtcgaggaagtgaagagcgtgctccgcctgctgcccatatgggcgtcgtgcataatctacgcgatcatcttctcccagacatcgacgttcttcacgaagcaggccgcgacgctggaccgccggatcggcgcgaggttcaaggtgccggcggcggcgctgcagacgttcatcagcgtcagcatcgtcgtcttcatcccggtgtacgaccggctcttcgtgcccctggcgcggcgctacacggggaggccgacggggatcaccatgctgcagagggtcggcgccggcctggcgctcgccctcgtcgccgtggccctgtcggcgctcgtggagatgaagcggctccgggttgcggcggaagccggcctggtgaatacccccaaggcgcagctccccatggcgctctggtggatggtcccgcagtacgtcctcatcggcgtcgccgacgtgttcgccatgatcgggctgcaggagttcttctacgaccaggtccccaacgcggtgcggagccttgggctggccctgttcctgagcatcttcggaatcggccacctcctcagcagcttcctcatctccgtcattgacaagacgacagcaaagagcgggacgagctggttctctaacaacctcaaccgcgcccacctcgactacttctactggcttctcactgggctctgcgccgtggagctcgtcgcctttgtgatcttctcgcgagtgtatgtttacaagagaaaggttggcaatgatggcggcaatggtgatttcgtataatagtatatgcaatttgagccgtactgatcacttgaggggtgccggtagctgtagttgtttgtacagtacccgtcttggaaaaaaacgtacgaagtaaggtgtgaccgtgtgactacgggattctgtgttaacgcatattttttcatcttcgactggttctatcttagacctttgaatgcatggggatcaaaggagattaggccttgtttaaataacctagtattcatctcaattcatatgtactatcaaac

SEQ ID NO: 8538 - DNA, 1867 bp, Setaria italica
ggaaagcaaagcgcgatcagccatctctgattctctagcgggccgcgcctgtgcataaaagcctgccctaacctgcgacggcaccatgtgccatcggagtgaactcctctccctcgtgctgatccaaccggccatggctgacaacgtcgccggcgccgccgactaccgcggccagccggcctcccgcgccgccacgggaggctggaaatcgtcggtcttcgtcatggcgatggagatcgcggagcggttcgcgtacaagggcgtggccgcgaacctgatcacgtacctgacgggcccgctggggcagcccatggcgcgcgccgccgcgtccatcgacgcgtggaagggcgtctcccagatgctgccgctgccgctcgcctgcgtcgccgacgcctggatcggccgctacagggccatcgtcctcgcctccctcatcttcgtcgtgagcatgggcgcgctgtcggtgtcgtcggcgttcccggccttccggggcggccacgtggccatcttctacgtcgcgttgtacctggtggcgctgggggagggcgcgcacaagccgtgcgcgcaggcgttcgcggcggaccagttcgacgagaaggaccccgaggagagcgtggcgcggagctccttcttcaactggtggtacttcggcatgtgcgccggcaccgccgccacgaccatgatctccagctacgtgcaggataacgtcggctggggcctcggcttcggcatcccctgcatcgtcatcgccgcctcgctcgccgtgttcctgctcgggagccggtcgtaccggtactacaccaccagcgaggccagacccttctcccgcgtcggcaaggcgttcttggcgttggtcgagagctggacgccaaatcgtcgcgtcagaagcaaaggagaaggcaacgccgccgccgtcgaggaggtcaagagcgtgctccggctgctcccgatatgggcgtcgtgcataatctacgcgatcatcttctcccagacgtcgacattcttcacgaagcaggccgcgacgctggaccgccggatcggcgcgcggttcaaggtgccgccggcggcgctgcagacgttcatcagcctcagcatcgtcgtcttcatcccggcgtacgaccggctcttcgtgcccctcgcgcggcgctacacggggaggccgacgggcatcaccatgttgcagaggatcggcgccggcctggccctctccctcgccgccgtggccctgtccgcgctcatcgagatgagacggctcggcgtcgcgagggacgccggcctggtgagcaccccgaaggcccagctccccatgagcctctggtggatggtcccgcagtacgtcctcatcggcgtcgccgacgtgttcgccatgatcgggctgcaggagttcttctacgaccaggtccccgacgcggcgcgcagccttgggctagccctgttcctgagcatcttcggggtcgggcacctcctcagcagcctcctcatctccgtcattgacaaggcgacggcgaagagcgggacgagctggttctcgaacaacctgaaccgcgctcacctcgactacttctactggctgctcaccgggctctgcgccgtggatctcgtcgcctttgtgttcttcgcgcgagtgtatgtttacaagagaaagggtggcgatggcgatggcgatggtgatgccgtgtagcatgctgagtttgagccgcgttgatttcttgggggtgcttgtattgtagttgtttgtagggagattctgtcggttctgaaaagcatgcctcacggagtcactattgagttctcaggttttgttgtgcaacgattttattcttcttggagtgtgaagatattctttgggagtcgagggcttgagcta

SEQ ID NO: 8539 - DNA, 1825 bp, Setaria italica
gcgggccgcgcctgtgcataaaagcctgccctaacctgcgacggcaccatgtgccatcggagtgaactcctctccctcgtgctgatccaaccggccatggctgacaacgtcgccggcgccgccgactaccgcggccagccggcctcccgcgccgccacgggaggctggaaatcgtcggtcttcgtcatggcgatggagatcgcggagcggttcgcgtacaagggcgtggccgcgaacctgatcacgtacctgacgggcccgctggggcagcccatggcgcgcgccgccgcgtccatcgacgcgtggaagggcgtctcccagatgctgccgctgccgctcgcctgcgtcgccgacgcctggatcggccgctacagggccatcgtcctcgcctccctcatcttcgtcgtgagcatgggcgcgctgtcggtgtcgtcggcgttcccggccttccggggcggccacgtggccatcttctacgtcgcgttgtacctggtggcgctgggggagggcgcgcacaagccgtgcgcgcaggcgttcgcggcggaccagttcgacgagaaggaccccgaggagagcgtggcgcggagctccttcttcaactggtggtacttcggcatgtgcgccggcaccgccgccacgaccatgatctccagctacgtgcaggataacgtcggctggggcctcggcttcggcatcccctgcatcgtcatcgccgcctcgctcgccgtgttcctgctcgggagccggtcgtaccggtactacaccaccagcgaggccagacccttctcccgcgtcggcaaggcgttcttggcgttggtcgagagctggacgccaaatcgtcgcgtcagaagcaaaggagaaggcaacgccgccgccgtcgaggaggtcaagagcgtgctccggctgctcccgatatgggcgtcgtgcataatctacgcgatcatcttctcccagacgtcgacattcttcacgaagcaggccgcgacgctagaccgccggatcggcgcgcggttcaaggtgccgccggcggcgctgcagacgttcatcagcctcagcatcgtcgtcttcatcccggcgtacgaccggctcttcgtgcccctcgcgcggcgctacacggggaggccgacgggcatcaccatgttgcagaggatcggcgccggcctggccctctccctcgccgccgtggccctgtcccgcgctcatcgagatgagacggctcggcgtcgcgagggacgccggcctggtgagcaccccgaaggcccagctccccatgagcctctggtggatggtcccgcagtacgtcctcatcggcgtcgccgacgtgttcgccatgatcgggctgcaggagttcttctacgaccaggtccccgacgcggcgcgcagccttgggctagccctgttcctgagcatcttcggggtcgggcacctcctcagcagcctcctcatctccgtcattgacaaggcgacggcgaagagcgggacgagctggttctcgaacaacctgaaccgcgctcacctcgactacttctactggctgctcaccgggctctgcgccgtggatctcgtcgcctttgtgttcttcgcgcgagtgtatgtttacaagagaaagggtggcgatggcgatggcgatggtgatgccgtgtagcatgccgagtttgagccgcgttgatttcttgggggtgcttgtattgtagttgtttgtagggagattctgtcggttctgaaaagcatgcctcacggagtcactattgagttctcaggttttgttgtgcaacgattttattcttcttggagtgtgaagatattctttgggagtcgagggctt

SEQ ID NO: 8540 - DNA, 2669 bp, Panicum virgatum
cgggccctgcttgccaacacctcccatccgttgcttttctcagcagagtcctccgaagcaacccgtttggcaaatcgaggcgagaactcgtagtgtctctcccataaatgctaggcgcatcacagccagccgtccgtgatcgggcggcctcgctccggcggccacaacgaaaccatcagggcccgtgcctccccaagctcgagcgccggtggacacgcgcgcggggctctccgtacgcgtgccgttcgcgcgcgcggcgccgtcgctgcagcgctgcacgagcgtgccctgcggagggcgcatgcggcaacgtttcacccggcaactcaacacgccgaggcgtgtactagaggaaagcgaagcgcaatcagccatccctaattctctagctgtcgcgagtccgccgcgcctacataaaagcagccctaacctgcctgcggcggcaagcatgccgcatgcctgatcggagtgagctcgtctccctcgtgctgatccaaccggccatggcggacaccgtcgccggcgccgccgactaccggggaaagccggcctcccgctccaccacgggaggatggaaatcatcggccttcgtcatggcgatggagatcgcggagcggttcgcgtacaagggcgtggccgcgaacctgatcacgtacctgacggggccgctggggcagcccgtggcgcgcgccgccacgtccatcgacgcgtggaagggcgtctcccagatgctgccgctgccgctcgcgtgcctcgccgacgcctggatcggccggtaccgggccatcgtcctcgcctccctcatcttcgtcgtgagcatgggcgcgctgtctgtgtcgtcggcgttcccggccttccgcggcggccacgtggccatcttctacgtcgcgctgtacctggtggccctcggggagggcgcgcacaagccgtgcgcgcaggcgttcgcggcggaccagttcgacgagaaggaccccagggagagcgtggcgcgttgctccttcttcaactggtggtacttcggcatgtgcgccggcaccgccgtcaccaccatggtctccagctacgtgcaggacaacgtcggctggggtctcggcttcggcatcccctgcatcgtcatcgccgcctcgctcgccgtgttcctgctcgggagccggtcgtaccggtactacaccaccaccgaggcgagccccttctcccgcgtcggcaaggcgttcatggcgttgatcgagagcaggacgaatcgtcgcaccagtagtatcagcaaaggagacggcaacgccgccgccgccgtcgaggaggtcaagagcgtgctccggctgctcccgatatgggcgtcgtgcataatctacgccatcatcttctcccagacctcgacgttcttcacgaagcaggccgccacgctggaccgccggatcggcgcgaggttcaaggtgccgccggcggcgctgcagacattcatcagtgtcagcatcgtcgtcttcatcccggtgtacgaccggctcttcgtgcccctcgcgcggcgctgcacggggaggccgacgggcatcaccatgctgcagaggatcggcgccggcctggccctctcgctcgtcgccgtggccttgtccgcgctcgtggagatgaaacggctcggcgtcgcgagggacgccggcctggtgaacaccgcaaaggcgcagctcccgatgagcctctggtggatggtcccgcagtacgtcctcatcggcgtggccgacgtgttcgccatgatcgggctgcaggagttcttctacgaccaggtccccgacgcggcgcgcagcctcgggctggccctgttcctgagcatcttcggggtcgggcacctcctcagcagcctcctcatctccgtcattgacaaggccacggcgaagagcgggacgagctggttctcgaacaacctgaaccgcgctcacctcgattacttttactggctgctcaccgggctctgcgccgtggagctcgtcgcctttgtgttcttctcgcgagtgtatgtttacaagaggaagagtggcaatgatgatgccggcaatggcgatggcgatttcgtgtaacaatccggagttagatcctggcgtgcttgtagtagtttgtagggagatttagtcagttcagaaaaagcatgcttcacggggattcaagggtttgttgttgtgcagcagttttttcaattcttggaggaactgacgatactcttttggggactaaaaaaaaagacgatactcttttgggattcaagggttcgaggctttgagctaagtacaagaatagagcaagggctgaatcgagtgatttttggtttttgtttcagtcgaaaattttccccataaagtcatgccacctagtagtatttggtgaaggaaatttagtgaggggaaaaccaatctcagtcgatttttgggaagagtaaaatacacggccgctcctcgaacttgtcagggtatgtcagcccggtcccccaacttataatatcagaaattcagatccttaaacttgttacagtgtgtcatccaggtctctaaacttagaaaaccaggaatccggatctatgcatgttggggattggatcttcggttcaagccctcatcctcagaaatgctccctaacctatttgcagggccgcaacgaaatggagccaagcatacccgaaggtatcg

SEQ ID NO: 8541 - DNA, 2439 bp, Panicum virgatum
aatttttagtttaaaattacataaaattaaagcccagcccttttaaaatccggctcttagattttctaatttaaaatattaaaccttttaccacccctaggcgcatcacagccagccgtccgtgatcgggcggcctcgctccggcggccgcaacgaaacgatcagggcccgtgcctccccatgctcgcgcggccgcggacacgcgcgcggggctctccgcacgcgtgccgttcgcgctcgcggcgccgtggctgcagcgctgcacgcgcgcgcacggccctcgcggccgcgccggcacgagcgtgccctgcggacggcgcacgcggcaacgttcacccggcgagccatctctaattctctagctgtcgcgattccgccgcgcctacataaaagcagccctaaacctgcggcggcaagcatgccgcatgcgttttgcgtgatcggagtgagcttctctcctccctcgcgctgatccaactggccatggcggacaccgtcgccggcgccgccgactaccggggacagccggcgtcccgcgccgccacgggagggtggaaatcatcggccttcgtcatggcgatggagatcgcggagaggttcgcgtacaagggcgtggccgcgaacctgatcacgtacctgacggggccgctggggcagcccgtggcgcgcgccgccgcgtccatcgacgcgtggaagggcgtctcccagatgctgccgctgccgctcgcgtgcctcgccgacgcctggatcggccggtaccgggttatcgtcctcgcctccctcatcttcgtcgtgagcatgggcgcgctgtctgtgtcgtcggcgttcccggtcttccgcggcggccacgtggccatcttctacgtcgcgctgtacctggtggccctgggggaaggcgcacacaagccgtgcgcgcaggcgttcgcggcggatcagttcgacgagaaggaccccagggagagcgtggcgcggagctccttcttcaactggtggtacttcggcatgtgcgccggcaccgccgtcacgaccatggtctccagctacgtgcaggataacgttggctggggcctcggcttcggcatcccctgcatcgtcatcgccgcctcgctcgccgtgttcctgctcgggagcaggtcctaccggtactacaccaccaccgaggccagccccttctcccgcgtcgggaaggcgttcatggcgttgatcgagagctggacgccaaatcgtcgcgaaagtatcaggaaaggcgacggcgacagcgccgccgtcgaggaggtcaagagcgtgctccggctgctcccgatatgggcgtcgtgcataatctacgccatcatcttctcccagacgtcgacgttcttcacgaagcaggccgcgacgctggaccgccggatcggcgcgaggttcaaggtgccgccggcggcgctgcagacattcatcagtgtcagcatcgtcgtcttcatcccggtgtacgaccggctctttgtgcccctcgcgcggcgctgcacggggaggccggcgggcatcaccatgctgcagaggatcggcgccggcctggccctctcgctcgtcgccgtggccctgtccgcgctcgtggagatgaaacggctcggcgtcgcgagggacgccggcctggtgaacaccccaaaggcacatctcccgatgagcctctggtggatggtcccgcagtacgtcctcatcggcgtggccgacgtgttcgccatgatcgggctgcaggagttcttctacgaccaggtccccggcgcggcgcgcagcctcgggctggccctgttcctgagcatcttcggggtcgggcacctcctcagcagcctcctcatctccgtcattgacaaggcgacagcgaagagcgggatgacctggttctcgaacaacctgaaccgcgctcacctcgactacttctactggctgctcaccgggctctgcgccgtggagctcgtcgcctttgtgttcttctcgcgagtttatgtttacaagacgaagagtggcaatgatgatgccggcgattgcgatggttatttcgtgtgacatccggagtttgaacctataccctctagcgtgcttgcagtagttgtttgtaaggagattcagtcagttcagaaaaagcatatgcttcacggggtcactattgacttctcaggttttgttgttgtgcagcagttttttcaattcttggaggaactgacgatgctcgtttgggatttgggggttttgagctaaggacaagaatagagcaagggcgtgactacataacattcgagtgaattttggtttttgtttcagtcgaatttgagtgaggggaaaaccaatttcagccgattttttagaacatgcagaagttgccgtcactcacatatgttccgtcccggtcaacggccccttgttcatgaggtgggcgtgatgttggcgaaaccaacagggaag

SEQ ID NO: 8542 - DNA, 1967 bp, Oryza sativa
cgcgtgtcgatttcggtttcgtataaagccctaacaagctgtaccatggccgatcaccggagcaagctggtgtctcacctcttggactccggcatggcggacaccgtcgccggagccgtcgattaccgtggccggccggcctcccgcgccgccaccggcggctggaagtcgtcggtgttcgtcatggccatggagatcgcggagaggttcgcgtacaagggcgtggcggcgaacctgatcacgtacctgaccgggccgctggggcagccgatggcgcgcgccgccgcgtccatcgacgcgtggaagggcgtctcccagatgctgccgctgccgctcgcctgcgtcgccgacgcctggctcggccgctaccgcgccatcgtcctcgcctccgtcatcttcgtcctgagcatgggcacgctgtcgatgtcgtcggcgttcccggtgtcgcgcgccggccacgtcgccgtcttctacgtggcgctgtacatggtggcgctgggcgagggcgcgcacaagccgtgcgcgcaggcgttcgcggcggaccagttcgacgagaaggacggcggggagtgcgccgcccggagctccttcttcaactggtggtacttcggcatgtgcgccggcaccgccgtcaccaccatggtgtccagctacgtgcaggacaacgtcggctggggcctcggcttcggcatcccctgcatcgtcatcgtcgtctccctcgccgcgttcctcctcggcacccgctcgtacaggttctacacagccaggacggccagccccgtcgcccgcgtcgccaaggcgttcttgacattgatcaagagctggagatcaaaccgtcgcaccaatccggcgagcggcggcaaaggagacggcgacggcgacgccggtgacctcgtggaggaggtgaagagcgtgctccggctgctgccgatatgggcgtcgtgcataatctacgcgataatcttctcccagacgtcgacgttcttcaccaagcaggcggcgacgctggaccggcggatcggccggagcttcaacgtgccgccggcggcgctgcagacgttcatcagcgtcagcatcgtcgtcttcatcccggtgtacgaccgcctcttcgtgccgctcgcccgccgctacacggggaggccgtcggggatcaccatgctgcagagggtgggcgccggcctcgccctctccctcgtcgccgtcgtcctgtccgcgctcgtggagacgcggcgcctccgcgtcgccgccggcgccggcatggcggacgcccccaaggcgcggctcccgatgagcctgtggtggatggtgccgcagtacgttctcgtcggcgtcgccgacgtgttcgccatgatcggcctgcaggagttcttctacgaccaggtccccgacgccgtgcgcagcctcggcctcgcgctgttcctcagcatcttcggcgtcggccacctcctcagcagcctcctcatctcggtgatcgacggcgcgacggcgaggcgcgccggcggcagctggttcgccaacaacctcaaccgcgcccacctcgactacttctactggctcctcgccggcctctgtgccgtcgagctcgtcgccttcttcctcttctcgcgggtgtacacctacaagaagaagggcaacgatgctgatggcaattgtgattacaggggagttgatgatgatggcatctgcgtgtaaacctccgatttgtgctctgttgcttcattgctcgcgagtgtacacaaaaaaatctcgaattgttgtagtgcgttatcatatactctgatgatcaagtgatcagtaatcagagcaaagatggcgagctgatgagcatggtggaccgaggtgaacaaaattcatcggatgggcctgcgaacacattctcttcatgttgttgaacaatattccctccagtttcattttaattgacgttttgaacaatgacacggactacaaaatatatctttgacctt

SEQ ID NO: 8543 - DNA, 2154 bp, Brachypodium distachyon
actgaatttataattcgtgttgctatgtatctgctgttacaaatggaacccattaatgctgtccatcgattattgcctcgggttggcacttggcacgctgtttccgcctgcaatcagctgtacccgtctcgatcggcttgcacgcaatcctgcccatccttcctacataaagccctggccttccgtgtcatgcttcaccggagcctgttgacacccaaccccggccaccactttggagacatcaccatgggggacactgtctctggcgccgccgactaccgcggccagcccgcctcccgtgccgccaccggcggctggaagtcttcgattttcgtcatggcaatggagattgcggagaggttcgcgtacaagggcgtggcgtcgaacctgatccagtacctgacggggccgctggggcagccgatggcgcgcgcggcggcgtccatcgacgcgtggaagggcgtctcccagatgctgccgctgccgctcgcctgcatcgccgacgcctggctcggccgctaccgcgccatcgtcctcgcctccatcctcttcatcctgagcatgggcacgttgtctctgtcgtcggcggtccgcatcttcggggccggcgggcacgtcgccgtcttctacgtggcgctgtacctggtggcgctgggcgagggcgcgcacaagccgtgcgcgcaggcgttcgccgccgaccagttcgacgacaaggaccccaaggagtccgtggcgcggagctccttcttcaactggtggtacctgggcatgtgctccggcaccgccgtcaccatcatggtctccagctacgtccaggacaacgtcggctggggcctcggcttcggcatcccctgcatcgtcatcgccgtctccctcgccgtcttcctcctgggcacccgctcctaccgctactacaccaccaaggagcccagccccgtcgcccgcgtcggcaaggcgttcttcacattgatcaagagctggagatcgaaacatcgcaccaacccggcgagcagtgccaaagtcgagggcggcgacagcgccgaggatctcgtcgaggaagtgaagagcgtcttccgcctgctgccaatctgggcgtcctgcataatctacgccatcatcttctcccagacgtcgacgttcttcaccaagcaggcggcgacgctggaccggcggatcgggcccagcttcaaggtgccgcccgcggcgctgcagacgttcatcagcatcagcatcgtcgtcttcatcccggtgtacgaccggctcttcgtccctttggcccggcgctacacggggaggccgtcggggatcaccatgctgcagagggtcggcgtcgggctggcgctctccctggccgccgtcgtcctctctgctctcgtcgagatgaagcggctccgcgtcgcgtctgcagccggcctcgtgaacaccccgaagacgcagctcccgatgacgctgtggtggatggtcccgcagtacatcctcatcggcgtgtccgacgtgttcgccatgatcgggctgcaggagttcttctacgaccaggtgcccgacgccgtgcgcagcctcgggctcgcgctgttcctcagcatcttcggcgtcggacacctcctcagcagcttcctcatatcggtcatcgacggcgccaccaagaagaacggggccagctggttctccaacaacctcaacaaggcgcacctcgactacttctactggctcctcgccgggctctgcgccgtggagctcgttgccttcttgttcttctcgcgactttatgtctacaagaaaaaggccggcgatggtgattacaggggagatgatcctgatgctatcgtagtgtgaccctgatggtgattacagttcttgttactctcccactgcttaattggagggagattttgtctcttcactcttcagggaagcaccacgcctagccagtgagtgcaaaattttcaggttgctgtagcgtacatacagatacaatacaactgagatagtacaatgccatttcagcatcctaacgatttagctgtgctaaccgtcataaattccggaattggccgtatctctggcctcttttagttttcactggatactaaaatagctgtaccaaacagtcatgaaattgcacaattggtcatttgtctagcctaaaaacctgaa

SEQ ID NO: 8544 - DNA, 2023 bp, Brachypodium distachyon
cctgcaatcagctgtacccgtctcgatcggcttgcacgcaatcctgcccatccttcctacataaagccctggccttccgtgtcatgcttcaccggagcctgttgacacccaaccccggccaccactttggagacatcaccatgggggacactgtctctggcgccgccgactaccgcggccagcccgcctcccgtgccgccaccggcggctggaagtcttcgattttcgtcatggcaatggagattgcggagaggttcgcgtacaagggcgtggcgtcgaacctgatccagtacctgacggggccgctggggcagccgatggcgcgcgcggcggcgtccatcgacgcgtggaagggcgtctcccagatgctgccgctgccgctcgcctgcatcgccgacgcctggctcggccgctaccgcgccatcgtcctcgcctccatcctcttcatcctgagcatgggcacgttgtctctgtcgtcggcggtccgcatcttcggggccggcgggcacgtcgccgtcttctacgtggcgctgtacctggtggcgctgggcgagggcgcgcacaagccgtgcgcgcaggcgttcgccgccgaccagttcgacgacaaggaccccaaggagtccgtggcgcggagctccttcttcaactggtggtacctgggcatgtgctccggcaccgccgtcaccatcatggtctccagctacgtccaggacaacgtcggctggggcctcggcttcggcatcccctgcatcgtcatcgccgtctccctcgccgtcttcctcctgggcacccgctcctaccgctactacaccaccaaggagcccagccccgtcgcccgcgtcggcaaggcgttcttcacattgatcaagagctggagatcgaaacatcgcaccaacccggcgagcagtgccaaagtcgagggcggcgacagcgccgaggatctcgtcgaggaagtgaagagcgtcttccgcctgctgccaatctgggcgtcctgcataatctacgccatcatcttctcccagacgtcgacgttcttcaccaagcaggcggcgacgctggaccggcggatcgggcccagcttcaaggtgccgcccgcggcgctgcagacgttcatcagcatcagcatcgtcgtcttcatcccggtgtacgaccggctcttcgtccctttggcccggcgctacacggggaggccgtcggggatcaccatgctgcagagggtcggcgtcgggctggcgctctccctggccgccgtcgtcctctctgctctcgtcgagatgaagcggctccgcgtcgcgtctgcagccggcctcgtgaacaccccgaagacgcagctcccgatgacgctgtggtggatggtcccgcagtacatcctcatcggcgtgtccgacgtgttcgccatgatcgggctgcaggagttcttctacgaccaggtgcccgacgccgtgcgcagcctcgggctcgcgctgttcctcagcatcttcggcgtcggacacctcctcagcagcttcctcatatcggtcatcgacggcgccaccaagaagaacggggccagctggttctccaacaacctcaacaaggcgcacctcgactacttctactggctcctcgccgggctctgcgccgtggagctcgttgccttcttgttcttctcgcgactttatgtctacaagaaaaaggccggcgatggtgattacaggggagatgatcctgatgctatcgtagtgtgaccctgatggtgattacagttcttgttactctcccactgcttaattggagggagattttgtctcttcactcttcagggaagcaccacgcctagccagtgagtgcaaaattttcaggttgctgtagcgtacatacagatacaatacaactgagatagtacaatgccatttcagcatcctaacgatttagctgtgctaaccgtcataaattccggaattggccgtatctctggcctcttttagttttcactggatactaaaatagctgtaccaaacagtcatgaaattgcacaattggt

SEQ ID NO: 8545 - DNA, 1919 bp, Oryza sativa
atggccgatcaccggagcaagctggtgtctcacctcttggactccggcatggcggacaccgtcgccggagccgtcgattaccgtggccggccggcctcccgcgccgccaccggcggctggaagtcgtcggtgttcgtcatggccatggagatcgcggagaggttcgcgtacaagggcgtggcggcgaacctgatcacgtacctgaccgggccgctggggcagccgatggcgcgcgccgccgcgtccatcgacgcgtggaagggcgtctcccagatgctgccgctgccgctcgcctgcgtcgccgacgcctggctcggccgctaccgcgccatcgtcctcgcctccgtcatcttcgtcctgagcatgggcacgctgtcgatgtcgtcggcgttcccggtgtcgcgcgccggccacgtcgccgtcttctacgtggcgctgtacatggtggcgctgggcgagggcgcgcacaagccgtgcgcgcaggcgttcgcggcggaccagttcgacgagaaggacggcggggagtgcgccgcccggagctccttcttcaactggtggtacttcggcatgtgcgccggcaccgccgtcaccaccatggtgtccagctacgtgcaggacaacgtcggctggggcctcggcttcggcatcccctgcatcgtcatcgtcgtctccctcgccgcgttcctcctcggcacccgctcgtacaggttctacacagccaggacggccagccccgtcgcccgcgtcgccaaggcgttcttgacattgatcaagagctggagatcaaaccgtcgcaccaatccggcgagcggcggcaaaggagacggcgacggcgacgccggtgacctcgtggaggaggtgaagagcgtgctccggctgctgccgatatgggcgtcgtgcataatctacgcgataatcttctcccagacgtcgacgttcttcaccaagcaggcggcgacgctggaccggcggatcggccggagcttcaacgtgccgccggcggcgctgcagacgttcatcagcgtcagcatcgtcgtcttcatcccggtgtacgaccgcctcttcgtgccgctcgcccgccgctacacggggaggccgtcggggatcaccatgctgcagagggtgggcgccggcctcgccctctccctcgtcgccgtcgtcctgtccgcgctcgtggagacgcggcgcctccgcgtcgccgccggcgccggcatggcggacgcccccaaggcgcggctcccgatgagcctgtggtggatggtgccgcagtacgttctcgtcggcgtcgccgacgtgttcgccatgatcggcctgcaggagttcttctacgaccaggtccccgacgccgtgcgcagcctcggcctcgcgctgttcctcagcatcttcggcgtcggccacctcctcagcagcctcctcatctcggtgatcgacggcgcgacggcgaggcgcgccggcggcagctggttcgccaacaacctcaaccgcgcccacctcgactacttctactggctcctcgccggcctctgtgccgtcgagctcgtcgccttcttcctcttctcgcgggtgtacacctacaagaagaagggcaacgatgctgatggcaattgtgattacaggggagttgatgatgatggcatctgcgtgtaaacctccgatttgtgctctgttgcttcattgctcgcgagtgtacacaaaaaaatctcgaattgttgtagtgcgttatcatatactctgatgatcaagtgatcagtaatcagagcaaagatggcgagctgatgagcatggtggaccgaggtgaacaaaattcatcggatgggcctgcgaacacattctcttcatgttgttgaacaatattccctccagtttcattttaattgacgttttgaacaatgacacggactacaaaatatatctttgac

SEQ ID NO: 8546 - DNA, 1610 bp, Zea mays
gccgcaacggccgccggtcgtcgttggccacgtcacccgatcccggcatccccagcccgaagcatcacaacctgatcctcctcccccacacggccacaccacaattctcagaaaaaatccctcccgctcccaccaccgccgcagccctctcctcctccgcctccgcatcacattccacttccattcccgcggcccgcgccgccatcatggccaccgcctccctcctcgaggccactcgcctcctttccaccccgcgcccgccccgccgcagcctccacacccacctcctcaggaccccgcgcctctccgctctccgcgctcacctccaccgttccgcaactctcgacgcgcaggagccgacggcgaggcctggcgcgctcctggtcctcgacgcgctcaggaggtccgtggtcgactccctcgcggcgctcaagcggcccgcgctcgcgctcctgctggccggcgcgctgctcgccgcggcgtcaatgggcgggccgcacgccgcggcgctggccgcttcgggcgggcgcgtcggcgggtccgccttctcctcccgctcctcctcacctccgtcctacggctacagcgcgccggcgcccaggggcgggtacacggccgcgccctactactcgccttcgcccttcgtgtccttcggcccggccgtcggcatcggcttcgggggatcgggtttcctcgtgaccctcattggcttcgcggcattcctctatctcgccgggttcctgtccgactcgtcaggcggtaccagtgtgcttacagagacggataagaccaccgtcctcaagctacaggttggcttgctgggcatggcacgatcatttcagaaggagcttgaccaaatagctgagaaagcagatacatctactccggctggcttgagctatgtgttgacagagacaacattagcattacttcggcatccggattgttgtatctcagcttactcttcggtggatgtgaaacgtagcgtggatgatggtgagaaacgtttcaatcagctttcaattgaggagaggggcaagtttgatgaagagacacttgtcaacgtgaacagcatcaagaggaataaaggaggcagccaaagatcaagtggttttagcaacgagtacattgtgataaccatattggttgctgctgagggagtacataagctgccggttataaatagcagcaatgacttaaagacagctctacaaaagatgggtgccataccatcaagcaaaatactggcagtcgaggtcctgtggactccgcaaaatgagaatgacacattgtccgagcgagagctccttgaagattacccgctcttaaggcctctgtagaaagataaaagttacagattgcccgtgcaaaggaagaacacgccgtagattcagttttggcggttttcttattagttatagcacagatcctgcgtttgtataataagtgtataataatttgtaattggcgtctctgatagccttcatttcagaacatggaacgtgcaaatctgcaattgtctgtcagtagtcttgttcaatcttcctgacacaataacacaaaattgtaaatagattgttcagagaaaaaataaaacaggacatgctgca

SEQ ID NO: 8547 - DNA, 1504 bp, Zea mays
cacaattctcagaaaaaatccctcccgctcccaccaccgccgcagccctctcctcctccgcctccgcatcacattccacttccattcccgcggcccgcgccgccatcatggccaccgcctccctcctcgaggccactcgcctcctttccaccccgcgcccgccccgccgcagcctccacacccacctcctcaggaccccgcgcctctccgctctccgcgctcacctccaccgttccgcaactctcgacgcgcaggagccgacggcgaggcctggcgcgctcctggtcctcgacgcgctcaggaggtccgtggtcgactccctcgcggcgctcaagcggcccgcgctcgcgctcctgctggccggcgcgctgctcgccgcggcgtcaatgggcgggccgcacgccgcggcgctggccgcttcgggcgggcgcgtcggcgggtccgccttctcctcccgctcctcctcacctccgtcctacggctacagcgcgccggcgcccaggggcgggtacacggccgcgccctactactcgccttcgcccttcgtgtccttcggcccggccgtcggcatcggcttcgggggatcgggtttcctcgtgaccctcattggcttcgcggcattcctctatctcgccgggttcctgtccgactcgtcaggcggtaccagtgtgcttacagagacggataagaccaccgtcctcaagctacaggttggcttgctgggcatggcacgatcatttcagaaggagcttgaccaaatagctgagaaagcagatacatctactccggctggcttgagctatgtgttgacagagacaacattagcattacttcggcatccggattgttgtatctcagcttactcttcggtggatgtgaaacgtagcgtggatgatggtgagaaacgtttcaatcagctttcaattgaggagaggggcaagtttgatgaagagacacttgtcaacgtgaacagcatcaagaggaataaaggaggcagccaaagatcaagtggttttagcaacgagtacattgtgataaccatattggttgctgctgagggagtacataagctgccggttataaatagcagcaatgacttaaagacagctctacaaaagatgggtgccataccatcaagcaaaatactggcagtcgaggtcctgtggactccgcaaaatgagaatgacacattgtccgagcgagagctccttgaagattacccgctcttaaggcctctgtagaaagataaaagttacagattgcccgtgcaaaggaagaacacgccgtagattcagttttggcggttttcttattagttatagcacagatcctgcgtttgtataataagtgtataataatttgtaattggcgtctctgatagccttcatttcagaacatggaacgtgcaaatctgcaattgtctgtcagtagtcttgttcaatcttcctgacacaataacacaaaattgtaaatagattgttcagagaaaaaataaaacaggaca

SEQ ID NO: 8548 - DNA, 1623 bp, Sorghum bicolor
cacttctcaaaaaaatccctcccgctcccaccaccgccggttcgccgccctctcctcctccgcctccgcatcacattccatttccactcccgcggcccgcggcgctgccatcatggccgccgcctccctcctcgaggccactcgcctcctctccaccccgcgcccgctccctctcccgccccgccgcggcctccagccccaccaccaccacaggaccccgccgcgcgtctccgctcttcgcgcccacctccaccgccccgctgctcctctcgacgcgcagcagcaggagcagctggcggcgaggaggccaggcgcgctgctggtcctcgacgcgctcaggaggtccgtgctcgacgccctcgtggcgctcaagcggcccgcgctcgcgctcctgctggccggcgcgctgctcgccgcgtcggcgggcgggccgcacgccgcggcgctggccgcctcgggcggccgcgtcggcgggtccgccttctcctcctcgcgctcctcctcctcgcattcgtcctacgggtacagcgcgccggcgcccaggggcggcgggtacagggccgctcccttctactcgccttcgcccttcgtgtccgtcggcccggccatcggcatcggcttcgggggatcggggttcctcttcacactcattggcttcgcggctttcctctacctcgccgggttcctgtccgactcatccggtggtgctagtgtgctcacagagacggagaagaccaccgtcctcaagctacaggttggcttgctgggcatggcacgatcatttcagaaggagcttgatcaaatagctgagaaatcagatacatctacccctgctgggttgagctatgtgttgacagagacaacattggcattacttcggcatccggattgttgtatctcagcttactcatcggtggatgtgaaacgaagcatggatgatggtgagaaacgtttcaatcagctttcaattgaggagagaggcaagtttgatgaagagacacttgtgaatgtgaacagcatcaagaggaataaaggaggcagccaaagatcaagtggttttagcaatgagtacattgtgataaccatattggttgctgctgagggagtacataagcttccagttataaatagcagcaatgacttaaagacagctctacaaaagatgggtgccataccatcaagcaaaatactggcagtcgaggtcctatggactccacaaaatgagaatgacacattgtcagagcgagagctccttgaagattacccgctcttaaggcctctgtagaaaagataatgttacagattgcccctgcaaagaaagaacaggctgtagattcagttttggcggttttcttattaaatagcgcagatcttgcgtttgtataagaagtatataatttgtaattgacgtcactattagccttcatttcagaatatgtagcgcactgcagtgcaaatctgcaattgtatgtcgataatcttgtttactgttcctaacacaataacacaaatttgtaaatagattgttctgaaagaacactagagtctgcacttttgtgtgtacccgttctgatatggatatttctttttacaaaaagtaaaagaattgatgaaatattgcat

SEQ ID NO: 8549 - DNA, 1804 bp, Sorghum bicolor
gctacggccgccggtcgttgttggccacgtcacccgatcccggcatcccgagcccggagcctcacaaccagatcctcctcccccacacacttctcaaaaaaatccctcccgctcccaccaccgccggttcgccgccctctcctcctccgcctccgcatcacattccatttccactcccgcggcccgcggcgctgccatcatggccgccgcctccctcctcgaggccactcgcctcctctccaccccgcgcccgctccctctcccgccccgccgcggcctccagccccaccaccaccacaggaccccgccgcgcgtctccgctcttcgcgcccacctccaccgccccgctgctcctctcgacgcgcagcagcaggagcagctggcggcgaggaggccaggagcgctgctggtcctcgacgcgctcaggaggtccgtgctcgacgccctcgtggcgctcaagcggcccgcgctcgcgctcctgctggccggcgcgctgctcgccgcgtcggcgggcgggccgcacgccgcggcgctggccgcctcgggcggccgcgtcggcgggtcctccttctcctcctcgcgctcctcctcctcgcattcgtcctacgggtacagcgcgccggcgcccaggggcggcgggtacagggccgcgcccttctactcgccttcgcccttcgtgtccgtcggcccggccatcggcatcggcttcgggggatcggggttcctcttcaccctcattggcttcgcggctttcctctacctcgccgggttcttgtccgactcatccggtggtgccagtgtgctcacagagacggagaagaccaccgtcctcaagctacaggttggcttgctgggcatggcacggtcatttcagaaggagcttgatcaaatagctgagaaagcagatacatctaccccggctggcttgagctatgtgttgacagagacaacattggcattacttcggcatccggattgttgtatctcagcttactcatcggtggatgtgaaacgaagcatggatgatggtgagaaacgtttcaatcagctttcaattgaggagaggggcaagtttgatgaagagacacttgtgaacgtgaacagcatcaagaggaataaaggaggcagccaaagatcaagtggttttagcaacgagtacattgtgataaccatattggttgctgctgagggagtacataagctgccagttataaatagcagcaatgacttaaagacagctctgcaaaagatggctgccataccatcaagaaaaatactggcagtcgaggtcctatggactccacaaaatgagaatgacacgttgtcagagcgagaactccttgaagattacccactcttaaggcctctgtagaaagataaagttacagattgcccctgcaaagaaagaacaggctgtagattcagttttggcggttttattattaactatagcgcagatcttgcgtttgtataagaagtatataacttgtaattgacgtcactgttagccttcatttcagaacatgtagcgcactgcagtgcaaatctgcaattgtatgtggatagtcttgttcactgttctggacacaataacacaaatttgtaaatagattgttctgaaagaacactagagtctgcacttttgtgtgtacccgttctgatatggatatttctttttacaaaaagtaaaagaattgatgaaatattgcatgccagttccgacttcaacttcgaacctcaaggtccacggtctacggtctccatggttgcagtgtgtgagatcactgtgggccaccatttcttg

SEQ ID NO: 8550 - DNA, 1696 bp, Setaria italica
ccgccgcccgccgccggtcgtcggccacgtcggcatccccagcccgcagcctcaacctgaacctgatcctcctcccccacacacttctcaaaaaaatccctcccgctccccacccaacctcctccgcctccgcatcatcacattcacgcgacccgcgccgccgctgacaccgccatggccgccgcctccctcctcgaggccacgcgcctcctctcgtcccctctcccgcgcccgcgcccgccccttctcccgccccaccgcggcctccgcctcctcctcgggcccgcgcgcctccccgccctccgcgcccaccaccgcctcccgcctcccgccgccgcggaggaggacgaaccagcgaggccccagccccagccgctcctcgccctcgacgcgctcaggaggtccgtgctcgactccctcgcggcgctcaagcggcccgcgctcgcgctcctgctggccggcgcgctgctcgccgcggcgccggcggtggtcgggccgcacgccgcggcgctggcggcatcgggcgggcgcgtcggcgggtccgccttctcctcgcgctcatcctcgccgccctcctacgggtacagcgcgccggtgcccaggggcgggtacacctccgcgcccttctactcgccctcgcccttcgtttccgtcggcccggccgtcggcatcggcttcgggggctccgggttcctcatggccctcatgggcttcgccgcgttcctctacctcgccgggttcctgtcggattcgcccggcaacgggagcgtgctcaccgagacgcagaagaccaccgtcctcaagctacaggttggcttgctgggtatggcccgatcatttcagaaggagcttgatcaaatagctgagaaagcagatacatccaccccggctgggttgagctatgtgttgacagagacaacattggcattgcttcggcatccagattgctgtatctcagcttactcatcagtggatgtgaaacgaagtatggacgatggggagaaacgtttcaatcaactatcaattgaggagaggggcaagtttgatgaagagacgcttgtgaacgtgaacagcatcaagaggaataaagcaggcagccaaagatcaagtggcttcagcaatgagtacattgtgataaccatactggttgctgccgagggagtatataagctacctgttataaatagcagcaatgacttgaagacagctctgcaaaatcttggtggcataccatcaagcaaaatactggcagtcgaggtcctatggactccacaaaatgagaacgacacattgtcagaacgagagctccttgaagattacccgcttttgaggcctctgtagaaagaaaaggttgcggattggccctgtggagaaagaacaaattgtagattcagttttggcggttttctcattaactatagcacagatcttgtatttgtaaaaaaaatataattgtaattgacgtcactgttagaaggcaacataaagttggcatatgtagccgacggcaatgcaaatgagcaactgtacgtcggtagacttgtgcagtattcctgacacagtcacacgactttgtaaatagattgtcctcaaagaacatgtgagtctgcatttgtgtgttgtcttgtgcgctgcaagactgggttcagtttaagaaacatggatgatttttgttcaaaaaatagaaagatttgac

SEQ ID NO: 8551 - DNA, 1607 bp, Setaria italica
aaaaaaatccctcccgctccccacccaacctcctccgcctccgcatcatcacattcacgcgacccgcgccgccgctgacaccgccatggccgccgcctccctcctcgaggccacgcgcctcctctcgtcccctctcccgcgcccgcgcccgccccttctcccgccccaccgcggcctccgcctcctcctcgggcccgcgcgcctccccgccctccgcgcccaccaccgcctcccgcctcccgccgccgcggaggaggacgaaccagcgaggccccagccccagccgctcctcgccctcgacgcgctcaggaggtccgtgctcgactccctcgcggcgctcaagcggcccgcgctcgcgctcctgctggccggcgcgctgctcgccgcggcgccggcggtggtcgggccgcacgccgcggcgctggcggcatcgggcgggcgcgtcggcgggtccgccttctcctcgcgctcatcctcgccgccctcctacgggtacagcgcgccggtgcccaggggcgggtacacctccgcgcccttctactcgccctcgcccttcgtttccgtcggcccggccgtcggcatcggcttcgggggctccgggttcctcatggccctcatgggcttcgccgcgttcctctacctcgccgggttcctgtcggattcgcccggcaacgggagcgtgctcaccgagacgcagaagaccaccgtcctcaagctacaggttggcttgctgggtatggcccgatcatttcagaaggagcttgatcaaatagctgagaaagcagatacatccaccccggctgggttgagctatgtgttgacagagacaacattggcattgcttcggcatccagattgctgtatctcagcttactcatcagtggatgtgaaacgaagtatggacgatggggagaaacgtttcaatcaactatcaattgaggagaggggcaagtttgatgaagagacgcttgtgaacgtgaacagcatcaagaggaataaagcaggcagccaaagatcaagtggcttcagcaatgagtacattgtgataaccatactggttgctgccgagggagtatataagctacctgttataaatagcagcaatgacttgaagacagctctgcaaaatcttggtggcataccatcaagcaaaatactggcagtcgaggtcctatggactccacaaaatgagaacgacacattgtcagaacgagagctccttgaagattacccgcttttgaggcctctgtagaaagaaaaggttgcggattggccctgtggagaaagaacaaattgtagattcagttttggcggttttctcattaactatagcacagatcttgtatttgtaaaaaaaatataattgtaattgacgtcactgttagaaggcaacataaagttggcatatgtagccgacggcaatgcaaatgagcaactgtacgtcggtagacttgtgcagtattcctgacacagtcacacgactttgtaaatagattgtcctcaaagaacatgtgagtctgcatttgtgtgttgtcttgtgcgctgcaagactgggttcagtttaagaaacatggatgatttttgttcaaaaaatagaaagatttgac

SEQ ID NO: 8552 - DNA, 1860 bp, Brachypodium distachyon
cggcaacattttacggtacgcgtggccttcctgccgtgccgcggaagaagacagacggaagctttccgccgccggtcatccacggcgccgcagccccagcctcacatcctcaattcctgatcctcctcccccacacacttctcaaaaaaataatatcgcccctcccgctccgctcctcctccccccgaactttgcacggccattccaccacacctcctccgcatcgcgcgccaccggccgccatggccgccgcctccctcctcgaatccacgcgcttcctctccctgccacccccgcgctcgctcccgccccgccgcggcctgcacctcctcagcccctcctcgcccctccccgagcgtgacctcgccccgcggctgcgcgacccgctgctcgacgcgctcaagaagtccctctccgacactctcgcggcgctcaagaagcccgcgctggcgctcctcctcgccggcgcgctgctcgcggccgcgggtccccaccacgcggcgctggctgcctctgggggccgcgtcggcgggtccgccttctcctcgcgatcgtcgaggtcctcgccgtcctacgggtacaccgcgccggcgcccaggggtgggtactcggccgcgccgttctactcgccctcgccgttcgtgtccgtcggcccagccgttggcatagggttcggggggtctggattcctcttgacgctggtggggttcgcggcgtttctatacctcgctgggttcctctccgactcgtccgggggcggaagcgtgctcaccgagacgcagaagaccaccgtcctcaagctgcaggttggattgttgggcatggcccgatcatttcagaaagagcttgatcaaatagccgagaaagcagatacgtctaccccatctgggttgagctatgtgctgacagagacaacattggcattacttcggcatccagattgctgtatatcagcttactcaacagttgatgtcaagcgaagcatagatgatggagagaaacgtttcaatcaactgtcaattgaggaacggggcaagtttgatgaagaaacactcgtgaatgtgaacagtataaagaggcaaaaggcaggcagtcaaagatcaagtggttttagcaatgagtacattgtgataaccatattggttgctgctgagggagttcacaagttgcctactataaatagcagctctgacttgaagacagctctacaaaagcttggtgctgtaccctcaagcaaaatactggcggttgaggtcttatggactccacaaaatgagaatgatacattgtcagagcgagaactccttgaagattacccacttttgagaccgctatagaaggattaagatgtagattgcccctaaaagatcaagttgtcgattcatttttgacagttaactttattaactttagctcagttttttggtttgtaagaatataattgtaaatgaagtcactcttagcatgtacatggaagtttgctcaatgcaacgatgctgtgttgcagattctgtcaatagtatggtaatcttgatcagtgtgcctgacacggctcaagtttgtaaataaattgttctgaatgaacattttactatagttgtatgtttaatagtatatgaacatgtgttttaatagtatggacatgttgcactggctgtggtttcctgtatttatatcgttccagttatcaggataagagaacattcctgaacaagaaattgcaggatccttgcattagaagagtagcattcctaagcgaaaaatgtctgatgagtaaaagacagagccaatggctaatggctttgcctctagcggccgcgcaattgacctgcaaggggttgcacgtgggcgctggggagc

SEQ ID NO: 8553 - DNA, 2119 bp, Arabidopsis thaliana
aacttagaaatgtgtatatacacacatttgcatcgataataactcaccaacactctctctgtctccatcgaatgtttcctctaactctcaacaaaaatgcgcaaacaatttgtttttcttctgcctttcttgtcacgtctctaccatgtagttatagccggaggagaacggttaactaacggcggtttttcaccggagataaatccgttcacacccaaagcgtctttagtacgttactggaacaaacagatccatcaccaatcacccggctcagcctttctcctctccaaggcttcaccacttaccgccgtcgcctccgccaccttcgccaaactcgcctccgaaaacgctcttccggatcgcctccccgacttctgctccgccgcaaacctcttctgttttccagatttaggtccaaccctcgagaaacacagcaacgacgttaaattctctgtttacgaccaacgaaacttcaccaactacggcacgattcaccccggcggtgctgactcgttcaagaaatattcacaaaacggtaacgcagtaaccgactctttccggcgatacagccgagacgccgccggtcacgaagataaattcacaggctacgctgataacagcaacgtcgtcgaggaaaaattcaattcttacggcacatcagccaccggcggctccggcgattttaaaaactatcaatccggtgttaacaatccgacgactcgtttcaaggcctattccgacgaaggaaatggccgtgctcagacgtttaaaacctatactcacgaagccaactccggaccgggtcaatctttcaccagttacggcaaaaacggtaacggagctccaaacgagttctcttcttacggtgtctcctctaacgtaatcggatctgatttctcaaactacggtgaaaacggtaacgcagccaacgacactttcaaaggctacggtggtgacggcaatgttcctcagaataacttcaaaagctacggtgcctccgggaacgctgccgttgacacgttcttgaattatagagacaatgctaacgttggtgatgattcgttctcgtcgtatgccaagaactcaaacttcgagaaggttgatttcgtaaattacggcaaatctattaacccgggttcagagtcgtttagtggttatggtaaaggagctgagggaaacaaaattgatttcaaaacgtatactcagaactctacgttcaaggactacacgaaaaccggagtcgaatttgcgaaatataaccggagtagtctcggtggtggcaaaacggtaaataagtgggtggagcctggcaagttctttagagagtcgatgcttaaagaaggtacattgatttggatgcctgacattaaggataaaatgccgaaaaggtcgtttctacctcgtagcattgtctcgaaactaccgttttctacatcgaaaatcgcggaaatcaagcgtgttttccacgctaacgataactcgacgatggaagggataattactgatgcggtaagggaatgtgagagaccgccgacagtcagcgagactaaacgatgtgtcggatcagcggaggatatgatcgatttcgcgacatctgtgcttggtcgaagtgtggtactccggacgacagagagtgtagccggatcaaaggagaaagtcatgatcggtaaagtcaatggaatcaacggtggaagagtgacaaaatcagtgtcgtgtcaccaaagtttgtacccttacttactctactactgtcactctgtgcctaaagttcgggtgtacgagtcagatcttttggatcccaagagtaaagccaagatcaaccatggtattgctatatgtcacatggacacatcagcttggggtgcgaaccatggagccttcatgttgcttgggtcccggccaggtcagatcgaagtatgccattggatctttgagaatgatatgaattgggccatcgccgattaaccatgttgtagcaaaatgaataatgaatgttaatgttttgtatctctatatttcagtaacgatacaaacttactatcttcctcatattctgttaactaaatatgttgtatcaggattatgtaaacattctaaagcaatgaagttaaaaaaaaat

SEQ ID NO: 8554 - DNA, 2156 bp, Arabidopsis thaliana
aaactatataagccttggttccaacttccaacttccaacttagaaatgtgtatatacacacatttgcatcgataataactcaccaacactctctctgtctccatcgaatgtttcctctaactctcaacaaaaatgcgcaaacaatttgtttttcttctgcctttcttgtcacgtctctaccatgtagttatagccggaggagaacggttaactaacggcggtttttcaccggagataaatccgttcacacccaaagcgtctttagtacgttactggaacaaacagatccatcaccaatcacccggctcagcctttctcctctccaaggcttcaccacttaccgccgtcgcctccgccaccttcgccaaactcgcctccgaaaacgctcttccggatcgcctccccgacttctgctccgccgcaaacctcttctgttttccagatttaggtccaaccctcgagaaacacagcaacgacgttaaattctctgtttacgaccaacgaaacttcaccaactacggcacgattcaccccggcggtgctgactcgttcaagaaatattcacaaaacggtaacgcagtaaccgactctttccggcgatacagccgagacgccgccggtcacgaagataaattcacaggctacgctgataacagcaacgtcgtcgaggaaaaattcaattcttacggcacatcagccaccggcggctccggcgattttaaaaactatcaatccggtgttaacaatccgacgactcgtttcaaggcctattccgacgaaggaaatggccgtgctcagacgtttaaaacctatactcacgaagccaactccggaccgggtcaatctttcaccagttacggcaaaaacggtaacggagctccaaacgagttctcttcttacggtgtctcctctaacgtaatcggatctgatttctcaaactacggtgaaaacggtaacgcagccaacgacactttcaaaggctacggtggtgacggcaatgttcctcagaataacttcaaaagctacggtgcctccgggaacgctgccgttgacacgttcttgaattatagagacaatgctaacgttggtgatgattcgttctcgtcgtatgccaagaactcaaacttcgagaaggttgatttcgtaaattacggcaaatctattaacccgggttcagagtcgtttagtggttatggtaaaggagctgagggaaacaaaattgatttcaaaacgtatactcagaactctacgttcaaggactacacgaaaaccggagtcgaatttgcgaaatataaccggagtagtctcggtggtggcaaaacggtaaataagtgggtggagcctggcaagttctttagagagtcgatgcttaaagaaggtacattgatttggatgcctgacattaaggataaaatgccgaaaaggtcgtttctacctcgtagcattgtctcgaaactaccgttttctacatcgaaaatcgcggaaatcaagcgtgttttccacgctaacgataactcgacgatggaagggataattactgatgcggtaagggaatgtgagagaccgccgacagtcagcgagactaaacgatgtgtcggatcagcggaggatatgatcgatttcgcgacatctgtgcttggtcgaagtgtggtactccggacgacagagagtgtagccggatcaaaggagaaagtcatgatcggtaaagtcaatggaatcaacggtggaagagtgacaaaatcagtgtcgtgtcaccaaagtttgtacccttacttactctactactgtcactctgtgcctaaagttcgggtgtacgagtcagatcttttggatcccaagagtaaagccaagatcaaccatggtattgctatatgtcacatggacacatcagcttggggtgcgaaccatggagccttcatgttgcttgggtcccggccaggtcagatcgaagtatgccattggatctttgagaatgatatgaattgggccatcgccgattaaccatgttgtagcaaaatgaataatgaatgttaatgttttgtatctctatatttcagtaacgatacaaacttactatcttcctcatattctgttaactaaatatgttgtatcaggattatgtaaacattctaaagcaatgaagttaaaaaaaaata

SEQ ID NO: 8555 - DNA, 2045 bp, Brassica napus
tccttattcttctgtcttcttctatgttgttttcgtcggtaggtacggttaattggtcggtcggtttctcggcagaggagaatccattcactccaaaagcatctctagttcgttactggaacaaagagatcagtgccgacaaatctctcagatcagaattcctaatctccaaggcgtcaccgcttaacgccgtagactcagccactttcgccaaactcgccgcccaaaactcactcccaacccgtctccccgacttctgctccgccgcgaacctcttctgcttcccggacctgaccccgagcctcgagaagcacgacgacaacgtcaagttctccgtctacgaccagaaaaacttcaccagctacggcaacgcacgtgccgccggcgccgactcgttcaaaacctactcaaaaggcaacaacggcgccttcgactctttccggagatacagccgcaacgcggcgggtcacgaggataagttcaccgtctacggcgagagaggcaacgttgacgagaaggacttcaactcctacggaaccttcgctgccggcggcgccggagacttcaccaactaccaaaacgacgttaacgacccgatgagtcgattcacggcgtactccgacggtggaaccggaaggtcccagactttcaaaacctacacgcacgacgccaacgccggcaatggccagtcgttcacgagctacagcaaaaagggaaacacgtcgccgaacgagttcgcctcgtacggcgactcatccaacgtgatcggctctgatttcaagaactacggcgaggaagaaaacgccgccaaagataccttcaccagctacgcgagcggcggcaacgtaccgcttaacaacttcaaaactacggcgagtccgttaacgccgccaacgattccttcactaactacggaggagacggcgggaatgtaccgcagaacaacttcaaaagctacggcgtctccggtaacgatgccgtcgacactttcgcgaactacagagataaagccaacgtaggcgatgactcgttctccggttacgcgaaagattcgaattccggtacggttaaattcacaaattacggtcagtcttacaatcccggttcggaatcgttcaccagttatgggaaaggaagcgaaggacagaagatcagtttcaaaacgtacacaccgaactccaccttcaaggactacgctaaaaacggcgtcgctttcgccaagtataatgtgtcatccatcggggatggcaaaaccgtgaataagtggatagagccgggtaaattctttagagagtcaacgcttaaagaaggcacagtgattgctatgcctgacattaaggataaaatgcctaaaaggtcgtttttgccccggagcatcgtctctaagctaccgttctcgacctccaagctcgccgaggttaagacgatcttccacgccggagataactcgtcgatggagaagatcatctccgacgcggtgacggaatgcgagaggccaccgagcgcgggagagacgaagcggtgtgttggatcagcggaggatatgatcgatttcgccacgtcggtgcttggtcgtagcgtggtgctaagaacgacggagaatgtggcggggtcaaagcaaaaggtggtgatcgggaaagtcaacggaatcaacggggggaagttgacgaaagctgtttcgtgtcaccagagtttgtacccgtatctgttgtattactgccactcggttcctaaggttcgggtctacgaagcggatcttcttgagttgaatagtaagactaagatcaaccatgggattgccatctgtcatgttgacacgtcatcatggagtcccacacatggagctttcttagctctcgggtcgaaaccgggtcggattgaggtttgtcattggatatttgagaacgacatgaactgggctatcgccgattagaaccggttcggttccaaagtcttatcgccaagatttgaatagaggaatgttaatcttcagtaacagtaaagcttgttactgatttgtgtgtgatggtaagaataataataat

SEQ ID NO: 8556 - DNA, 1990 bp, Arabidopsis lyrata
ataacccaccaacactctctctgtccctcaacaaaaatgctcaaaaattttgtctttctcctacccttcttgtcgcgtctcttccatgtagttatggccggaggagaacggttaactaacggcggtttttcgccggagatgaatccgttcacacccaaagcatctttagtacgttactggaacaaacagatccaacaccaatcaccaggctcagcctttctcctctccaaggcttcaccacttaccgctgtcgcctccgccactttcgcaaaactcgcctctgaaaacgctcttccggatcgcctaccggacttttgctccgcggcaaacctcttctgttttccagatttaggtccaaccctcgagaaacacagcaacgacgttaaattctctgtttatgatcaacgaaacttcaccaactacggcggcacgattcaccccggcggtgctgattcgttcaagaaatattcacaaaacggcaacgtagtaaccgactctttccggcgatacagccgtgacgccgccggtcacgaagataagttcacaggctacgccgataacagcaacgtcgttgaggaaaactttaattcttacggcacgtcagccaccggtggctccggcgattttaaaaactatcaatccggtgtcaacaatccgactagtcgtttcaaggcttattccgacgacggaaacggccgggctcagacgtttaagacctatactcacgaagccaacgccggaccgggtcaatctttcaccagttatggcaaaaacggtaacggagctccgaacgagttctcttcttacggcgtctcctctaacgttatcggatcggatttctcaaactacggcgagaacagtaacgcagccaacgacactttcaaaggctacggtggcgacggtaatgttcctcggaataacttcaaaagctacggtgcctctgggaatgccgccgttgacacattcttgaattatagagacaaggctaacgttggggacgattcgtttgcgtcgtatgccaagaactcaaacttcgagaaggtcgacttcgtgaattacggcaaatctattaatcccggttcggaatcatttaccggttatggtaaaggagctgagggaaacaaaattggtttcaaaacgtatactcagaactcaaccttcaaggactacgcgaaaaccggagtcgaatttgcgaaatataatcagagtagactcggtggtggcaaaactgtgaataagtgggtggagcctggcaagttctttagagaatcgctgcttaaagaaagttcattgatttggatgcctgacattaaagataaaatgccgaaaaggtcgtttctgcctcgtaacattgtctcgaaactaccgttttcgacatcaaaaatcgcggaaatcaagcgtgtcttccacgctaaggataactcgacaatggcagggataattactgatgccgtaacagaatgtgagagatcgccgacaattggcgagactaaaagatgtgtcggatcagcggaggatatgatcgatttcgcgacatctgtgcttggtcgaaacgtggtactccggactacagagagtgtagccggatcaaagcaaaaagtcatgatcggaaaagtcaaaggaatcaacggtggaagagtgacgaaatcagtgtcatgtcaccaaagtttgtacccttacttactctactactgtcactctgtgcctaaagttcgaatatacgagtcagatcttttggatcccaagagtaaagccaagatcaaccatggtattgctatatgtcacatggacacatcagcttggggtgcgaaccatggagccttcatgtcgcttgggtcccggccgggtcagatcgaggtttgccattggatctttgagaatgatatgaattgggccatcgccgattaaccatgtcgtagcaaattaataatgaatgttaatcgtttgtatctttatattccagttaaataaatatgtaaacattcgaaag

SEQ ID NO: 8557 - DNA, 1382 bp, Eutrema parvulum
gtttgggtttcttcttcatcggcccgatcagagaatcgccgtcgccgattaggaaaaaatggcgtccgtgatttctctctctctcacaagcggaacaacgcgtttgagatcgaactcgctccacaagtctaagctcactccacaacatcttcggcatatctcgtgttctaggcattcttactcttcctcgactcgcgagatttctctcaaatcgcgttcgagtttcgaccgagctactactgttcctatttcgtgtaggccaagtgttgacttttttcctcgttgcggcatttcgtctaacgactttcctactgagagaaagaagagcttcggggagtgggttgggttcgtgggagaggcggtctcgacggcgtttccgttatgggtttctctgggatgcttgttgggcctgatgaaaccaagtgccttcaattgggtcactcccaaatggagcattataggtcttacgatcactatgctcggaatggggatgactttgaccctcgatgaacttcgtggcgcgttaaagatgcccaaagagctcttcgccggctttgcgttgcagtactcggtcatgccattatcagcatttctagtgagtaaactcttgaatttgccaccaccttatgcagccggtctcatattggttggttgctgtccaggcggtacggcaagtaatattgtcacatacattgcacgtggaaatgtcgcactatcagtgttgatgacagcagctagtactctttcagctgtgatcatgactccacttcttacggctaagcttgccaaacaatatgtcgcagttgatgctcttggattagtaatgtcaacactacaggtgattcttctcccagtgttggctggtgcatttctgaatcagtactttcaaagcgtggtgaaatttgtttctcctcttatgcctccaattgcggttggaacagttgcgattctgtgcgggactgctattggccagaatgcatctgcgatactcacgtctgggacccaagtagtcctggcttcaatccttcttcacgtctctggatttctctttgggtatctgttttcaagatttctcagaattgatgtggcatcttccagaactatctctatcgaagttggcatgcagaactcggtgcttggacttgtgcttgcggcacagcattttgggaatccgctcactgcagtaccgtgtgctgtttctagcgtctgtcactccatcatcggtagcgccttggctggaatttggagacgcagtggcccaaaacaatttgaagacttaaaagaaacgaaagttgggatttcaccgagtcaggaccatttagtttaagtttgttgcacaacaaagtgaacaaaaagattcgtcttgtggagctacgaaaatt

SEQ ID NO: 8558 - DNA, 1562 bp, Eutrema parvulum
gtttgggtttcttcttcatcggcccgatcagagaatcgccgtcgccgattaggaaaaaatggcgtccgtgatttctctctctctcacaagcggaacaacgcgtttgagatcgaactcgctccacaagtctaagctcactccacaacatcttcggcatatctcgtgttctaggcattcttactcttcctcgactcgcgagatttctctcaaatcgcgttcgagtttcgaccgagctactactgttcctatttcgtgtaggccaagtgttgacttttttcctcgttgcggcatttcgtctaacgactttcctactgagagaaagaagagcttcggggagtgggttgggttcgtgggagaggcggtctcgacggcgtttccgttatgggtttctctgggatgcttgttgggcctgatgaaaccaagtgccttcaattgggtcactcccaaatggagcattataggtcttacgatcactatgctcggaatggggatgactttgaccctcgatgaacttcgtggcgcgttaaagatgcccaaagagctcttcgccggctttgcgttgcagtactcggtcatgccattatcagcatttctagtgagtaaactcttgaatttgccaccaccttatgcagccggtctcatattggttggttgctgtccaggcggtacggcaagtaatattgtcacatacattgcacgtggaaatgtcgcactatcagtgttgatgacagcagctagtactctttcagctgtgatcatgactccacttcttacggctaagcttgccaaacaatatgtcgcagttgatgctcttggattagtaatgtcaacactacaggtgattcttctcccagtgttggccggggcatttctgaaccaatactttaaaaagctggtgaattttgtttcccctgtgatgcctccaattgcggttgggaccgttgcaattctatgtgggtatgctattggtcagaacgcgtctgcaatactcatgtctgggaaacaggtagtactggcttctacgcttcttcacgtctctggatttctctttgggtatctgttttcaagattacttggaatcgatgtggcatcgtccagaactatctcaatcgaagttggcatgcagaactcggtgcttggagttgttcttgcgacacaacattttgggaatccgctcactgcagtaccgtgtgctgtttctagcgtctgtcactcgatcatcggtagcgccttggctggaatttggagacgcagtggcccaaaacaatttgaagacttaaaagaaacgaaagttgggatttcaccgagtcaggaccatttagtttaagtttgttgcacaacaaagtgaacaaaaagattcgtcttgtggagctacgaaaattgtagttagtcctggtttggtctgctttggcaaaacagacccgtttatgtcggtcttgttacggcagggtgaaataatctttgaataatcattggtatttattcaaaggctcttgagctctaaacatcaatcattttggtgtggacttgtaagtgatgagttgaaaaggttactgtgtaat

SEQ ID NO: 8559 - DNA, 1507 bp, Arabidopsis thaliana
gttttggtttcttcttcatcggtccgatcagagagagagaatcgccggtgagaaaagaaaatggcgtcggcgatttctctttctctcttaaacggagcaacgcctttgaaatcgaattcgctccacaaatctagactcactccacttcatcttcgaactatctcttgttctagactatcttactctccctcgagtcgcgaaatttctctcaaaactcaatctactgttcctatttcgtgtaggcgtagtaggtttgacttcgttcctcgttgcggcatttcgtcgaacgatttgcctactgagaaaaagaagagctttggggagtgggttgagtttgtgggagaggcggtttcgacggcgtttccgatatgggtttctctgggatgcttgttgggactgatgagaccaagtactttcaattgggttactccaaattggaccattgtaggtcttacgatcactatgcttggaatgggaatgactttgacccttgatgatcttcgtggcgctttatcgatgcccaaggagctcttcgctggctttctgttgcagtattcggtcatgccactatcagcattttttgtgagtaaactcttaaatttgccaccacattacgcagccggtctcatattggttggttgctgtccaggcggcacggctagtaatattgtcacatacatcgcgcgtggaaatgttgcgctatcagtgttgatgacagcagctagcactgtttcagctgtgattatgacaccgcttcttacggcgaagcttgccaagcagtatatcacagttgatgctcttggattactaatgtcaacactacaggtggttcttctcccagtgttggctggtgcatttcttaaccaatactttaaaaagctggtgaaattcgtctctcctgtgatgcctccaattgcggttggaacagttgcaatcctgtgtgggtatgctatcggtcagaacgcatctgcaatactcatgtctgggaaacaagtagtcttggcttcatgccttcttcacatctctggatttctctttgggtatctgttttcaagaatactcggaattgatgtggcatcatcgagaactatctctatcgaagttggcatgcagaactcggtgcttggagttgttcttgcgacacagcattttgggaatccactcactgcagtaccgtgcgctgtttctagcgtctgtcactcaatcctcggtagcgtcttggctggaatttggagacgcagtgccccaaaacagcttgaagactaaaaagaaagcaaaggaaagttcatgaagtcctcactgtgttactcaatttcaacatctttcaggaccatttagttaagtttgttgaacaaatgaaccaaaacgggttatgtcttgtaaagctttggaagatttttttttttttttctatgtctgagatttctcttgttattcttcaaagaattttgtgaattcgaaacatgaaaatcatattttgttcatcgtgaatcaagtgatgaggttg

SEQ ID NO: 8560 - DNA, 1471 bp, Arabidopsis thaliana
cttcatcggtccgatcagagagagagaatcgccggtgagaaaagaaaatggcgtcggcgatttctctttctctcttaaacggagcaacgcctttgaaatcgaattcgctccacaaatctagactcactccacttcatcttcgaactatctcttgttctagactatcttactctccctcgagtcgcgaaatttctctcaaaactcaatctactgttcctatttcgtgtaggcgtagtaggtttgacttcgttcctcgttgcggcatttcgtcgaacgatttgcctactgagaaaaagaagagctttggggagtgggttgagtttgtgggagaggcggtttcgacggcgtttccgatatgggtttctctgggatgcttgttgggactgatgagaccaagtactttcaattgggttactccaaattggaccattgtaggtcttacgatcactatgcttggaatgggaatgactttgacccttgatgatcttcgtggcgctttatcgatgcccaaggagctcttcgctggctttctgttgcagtattcggtcatgccactatcagcattttttgtgagtaaactcttaaatttgccaccacattacgcagccggtctcatattggttggttgctgtccaggcggcacggctagtaatattgtcacatacatcgcgcgtggaaatgttgcgctatcagtgttgatgacagcagctagcactgtttcagctgtgattatgacaccgcttcttacggcgaagcttgccaagcagtatatcacagttgatgctcttggattactaatgtcaacactacaggtggttcttctcccagtgttggctggtgcatttcttaaccaatactttaaaaagctggtgaaattcgtctctcctgtgatgcctccaattgcggttggaacagttgcaatcctgtgtgggtatgctatcggtcagaacgcatctgcaatactcatgtctgggaaacaagtagtcttggcttcatgccttcttcacatctctggatttctctttgggtatctgttttcaagaatactcggaattgatgtggcatcatcgagaactatctctatcgaagttggcatgcagaactcggtgcttggagttgttcttgcgacacagcattttgggaatccactcactgcagtaccgtgcgctgtttctagcgtctgtcactcaatcctcggtagcgtcttggctggaatttggagacgcagtgccccaaaacagcttgaagactaaaaagaaagcaaaggaaagttcatgaagtcctcactgtgttactcaatttcaacatctttcaggaccatttagttaagtttgttgaacaaatgaaccaaaacgggttatgtcttgtaaagctttggaagatttttttttttttttctatgtctgagatttctcttgttattcttcaaagaattttgtgaattcgaaacatgaaaatcatattttgttca

SEQ ID NO: 8561 - DNA, 1427 bp, Arabidopsis lyrata
gttttggtttcttcttcatcggttcgatcagtcagagagagaatcgccggtgagaaaattatggcggcgatttccctctctctcgtgaacggagcaacgcctttgaaatcgaattcgctccacaaatctaaactcactccactccaccttcgaactatctctttttctagactttcttactcttcctcgagtcgcgaaatttctctcaaaacccaatctactgttcctatttcgtgtaggcgtaggtttgacttcgttcctcgttccggcatttcttcgaacgatttgcctactgagaaaaagaagagctttggcgaatgggttgagtttgtgggagaggcggtttcgacggcgtttccgatatgggtttctctgggatgcttgttgggactgatgagaccaagtactttcaattgggtcactccaaattggaccattgcaggtcttacgatcactatgcttggaatgggaatgactttgacctttgacgatcttcgtggcgctttctcgatgcccaaggagctcttcgctggctttgtgttgcaatactcggtgatgccactatcagcattttttgtgagtaaactcttaaatttgccaccacattacgcagccggtctcattttggttggttgctgtccaggaggtacggcaagtaatattgtcacctacattgcacgtggaaatgttgcgctatcagtgttgatgacagcagctagcactgtttcagctgtgattatgacaccgcttcttacggcgaagcttgccaagcaatatatcacagttgatgctcttggattactaatgtcaactctacaggtggttcttctcccagtgttggctggtgcatttctgaaccaatactttcaaaagctggtgaaatttgtttctcctgtgatgcctccagttgcggttggaaccgttgcaattctgtgtgggtatgctataggtcagaacgcatctgcaatactcaggtctgggaaacaagtagtcctggcttcatgtcttcttcacatctctggatttctctttgggtatctgttttcaagattactcggaattgatgtggcatcatcgagaactatctctatcgaagttggcatgcagaactcggtacttggagttgttcttgcgacacagcattttgggaatccgctcactgcagtaccttgcgctgtttctagcgtctgtcactcaatcctcggtagtgccttggctggaatatggagacgtagtgcccccaaacagattgaagactgaaaagaaagcaaaggaactttcatgaagtctctcactgttactcaaactggacatttttcaggaccatttagttaagtttgttgaacaaatgaaccaaaagggttatgtcttgtaaagctttggatgaaattatctgttttctaagtctgagatttctcttgtttatt

SEQ ID NO: 8562 - DNA, 1453 bp, Arabidopsis lyrata
gttttggtttcttcttcatcggttcgatcagtcagagagagaatcgccggtgagaaaattatggcggcgatttccctctctctcgtgaacggagcaacgcctttgaaatcgaattcgctccacaaatctaaactcactccactccaccttcgaactatctctttttctagactttcttactcttcctcgagtcgcgaaatttctctcaaaacccaatctactgttcctatttcgtgtaggcgtaggtttgacttcgttcctcgttccggcatttcttcgaacgatttgcctactgagaaaaagaagagctttggcgaatgggttgagtttgtgggagaggcggtttcgacggcgtttccgatatgggtttctctgggatgcttgttgggactgatgagaccaagtactttcaattgggtcactccaaattggaccattgcaggtcttacgatcactatgcttggaatgggaatgactttgacctttgacgatcttcgtggcgctttctcgatgcccaaggagctcttcgctggctttgtgttgcaatactcggtgatgccactatcagcattttttgtgagtaaactcttaaatttgccaccacattacgcagccggtctcattttggttggttgctgtccaggaggtacggcaagtaatattgtcacctacattgcacgtggaaatgttgcgctatcagtgttgatgacagcagctagcactgtttcagctgtgattatgacaccgcttcttacggcgaagcttgccaagcaatatatcacagttgatgctcttggattactaatgtcaactctacaggtggttcttctcccagtgttggctggtgcatttctgaaccaatactttcaaaagctggtgaaatttgtttctcctgtgatgcctccagttgcggttggaaccgttgcaattctgtgtgggtatgctataggtcagaacgcatctgcaatactcaggtctgggaaacaagtagtcctggcttcatgtcttcttcacatctctggatttctctttgggtatctgttttcaagattactcggaattgatgtggcatcatcgagaactatctctatcgaagttggcatgcagaactcggtacttggagttgttcttgcgacacagcattttgggaatccgctcactgcagtaccttgcgctgtttctagcgtctgtcactcaatcctcggtagtgccttggctggaatatggagacgtagtgcccccaaacagattgaagactgaaaagaaagcaaaggaactttcatgaagtctctcactgttactcaaactggacatttttcaggaccatttagttaagtttgttgaacaaatgaaccaaaagggttatgtcttgtaaagctttggatgaaattatctgttttctaagtctgagatttctcttgtttattaattcgaaacatgaaatcatattttg

SEQ ID NO: 8563 - DNA, 1349 bp, Eutrema halophilum
gtttgggtttcatgtttcaccggcccgatcagagaatcgctgagaagaaaaaatggcgtccgcgatttatctctctctctcaaatgtaacaacgcctttgaaatcgacctcgctccacaagtctaaactcactccactacatcttcgtcttatctcttcctcttatgcttcctcgaatcgcgaaacttctctcggattgcgttccagtttcgaccgagctacagttcctgtttcgtgtaggcgccggtttgacttcctccctcgttgcggcatttcgtcgaacgactttcctgcggagagaaagaagagcttcggcgagtgggttgagtttgtgggagaggcggtctcgactgcgtttccggtatgggtttctctgggatgcttgttggggcttatgagaccaagtactttcaattgggtcactcccaattggaccattgtaggtcttacgatcacgatgctcggaatgggaatgactttgaccctcgacgatcttcgtggcgcgttaaagatgcccaaacagctcttcgctggctttctcttgcagtactcggtcatgccattatcagcatttctagtgagtaagctcttgaatttgccatcgcattacgcagctggtctcatattggttggttgctgtccaggcggtacggcaagtaatattgtcacgtacattgcgcgtggaaatgtcgcactatcagtgttgatgacagcagctagcactgtttcagctgtgattatgacaccgcttcttacggccaagcttgccaagcaatatatcacagttgatgcccttggattactaatgtcgacactacaggtggttcttctcccagttttggccggggcatttctgaaccaatactttaaaaagctggtgaattttgtttcccctgtgatgcctccaattgcggttgggaccgttgcaattctatgtgggtatgctattggtcagaacgcgtctgcaatactcatgtctgggaaacaggtagtactggcttctacgcttcttcacgtctctggatttctctttgggtatctgttttcaagattacttggaatcgatgtggcatcgtccagaactatctcaatcgaagttggcatgcagaactcggtgcttggagttgttcttgcgacacaacattttgggaatccgctcactgcagtaccgtgtgctgtttctagcgtctgtcactcgatccttggtagcatgttggctggagtttggagacgcagtgcaccaaagcagattgaaaactgaaaagagaaaaaaatgggtacttcatggagtttctcactgttgctcaaattcgacagtgatattaaaggtttctgaataaaaggattat

SEQ ID NO: 8564 - DNA, 1557 bp, Eutrema halophilum
gtttgggtttcatgtttcaccggcccgatcagagaatcgctgagaagaaaaaatggcgtccgcgatttatctctctctctcaaatgtaacaacgcctttgaaatcgacctcgctccacaagtctaaactcactccactacatcttcgtcttatctcttcctcttatgcttcctcgaatcgcgaaacttctctcggattgcgttccagtttcgaccgagctacagttcctgtttcgtgtaggcgccggtttgacttcctccctcgttgcggcatttcgtcgaacgactttcctgcggagagaaagaagagcttcggcgagtgggttgagtttgtgggagaggcggtctcgactgcgtttccggtatgggtttctctgggatgcttgttggggcttatgagaccaagtactttcaattgggtcactcccaattggaccattgtaggtcttacgatcacgatgctcggaatgggaatgactttgaccctcgacgatcttcgtggcgcgttaaagatgcccaaacagctcttcgctggctttctcttgcagtactcggtcatgccattatcagcatttctagtgagtaagctcttgaatttgccatcgcattacgcagctggtctcatattggttggttgctgtccaggcggtacggcaagtaatattgtcacgtacattgcgcgtggaaatgtcgcactatcagtgttgatgacagcagctagcactgtttcagctgtgattatgacaccgcttcttacggccaagcttgccaagcaatatatcacagttgatgcccttggattactaatgtcgacactacaggtggttcttctcccagttttggccggggcatttctgaaccaatactttaaaaagctggtgaattttgtttcccctgtgatgcctccaattgcggttgggaccgttgcaattctatgtgggtatgctattggtcagaacgcgtctgcaatactcatgtctgggaaacaggtagtactggcttctacgcttcttcacgtctctggatttctctttgggtatctgttttcaagattacttggaatcgatgtggcatcgtccagaactatctcaatcgaagttggcatgcagaactcggtgcttggagttgttcttgcgacacaacattttgggaatccgctcactgcagtaccgtgtgctgtttctagcgtctgtcactcgatccttggtagcatgttggctggagtttggagacgcagtgcaccaaagcagattgaaaactgaaaagagaaaaaaatgggtacttcatggagtttctcactgttgctcaaattcgacagtgatattaaaggtttctgaataaaaggattatgtcgtgttttgttccgatatggtgaaattaccttggaatgttttgttttcttaagtatcaagatgtcttcgtgatctatgaacaataatcattttgttgtagcaaagcaacgaggttaaaaaaggctattttgtaatttcgagtattcttggagtgtattattggtattttcagaggattaaagactttaaaggtcgtcttctccaaa

SEQ ID NO: 8565 - DNA, 1885 bp, Theobroma cacao
agactgtgtacaagtacaaccatcaggtcatcaaatacctgatagagttgggtaacaaacggcacaaatagacccaacttgcagtgtcaagctccaatcagtcagaagtaatgtaaatttgtcatacatttattagttatgtctgaatagacacaacaaaatgcactttctaattaaatcaaatgtcaatggtaatgagtgtatattgggattgcatttgctattgggtatgggtgaaggtgccaagttgacaagccggaatagagaggtttcttttggtaatttagttgcaattgacaatgaaaggacagaggaacattgtcctttctcttgtcctaaccattggttggtcccaacataaaagaagctgttgacaattttcttgacttgtcctaagcttcttgctgctgctgttcttctataacttgtctattcaaaagcccaaaaaggacagaaaaaaggaagcagagagaaatgcagtcctcactttcatgccctcaagcaacaacaaacttcaaatttcaactgaaatcaagaaccatttcgacttacgaaccaccacatcaacatctcttcatttcatttcccaaaccttccaattcatcaccttttgacttaacacttagatcccaatcccatgaaccacccaaaagaaccgccacttctttgacttcaaaacgttttcaactccagtgcagtatttcatcagagagttacaatcttaacaacgagaaaagtttcggagattgggttgagtggctcggtgaagtgatttccactgcatttccgatatgggtttctttgggatgtttgtttgggttactgaagccgacttctttcagttgggttacgcccaggtggaacatttttggccttactcttactatgcttggtatgggcatgactcttactctagatgatcttcgtggtgccctcgctatgcctaaagagttgatctcgggttttgttctccaatactcggtgatgcccttgtcagggttccttgtgagcaagctcttaaatttgccatctcactatgcggctggtttaatattggttggttgctgccctggtggtacagcaagtaacattgtcacatatattgcccgaggaaatgtggcactttccgtgttgatgactgcagcaagcactttgtcagccgtgattatgaccccctttctcacagccaagctggctgggcaatatgttgcagtagatgcagctggactgctaatctcaacactgcaggttgttcttcttcctgtattggctggtgcattcctaaatcagtatttccagggcctggttaaatttgtttctcctttgatgccacccattgctgtgggaactgttgctattctgtgtggaaatgcaattgcccagagtgcttcagcaattcttgcatctggtcaacaagttgtgctagcttcatcccttcttcatgcatctggatttttctttggctatattctttcaagggtgctagggcttgaggtggcatcatcacgaaccatctctattgaggttggcatgcagaactcggttcttggacttgttcttgcttctcagcacttccaaaatccactgactgcagtaccatgtgcagtttccagcgtatgccactcaatttttggtagtatattggcaggaatttggagacgcactgtgccgaagcagaagcaggagtgatacgtcatttctactttggatggacattaatgctttggtggtgttctttgaaatgtacatgtattttatggacatttcatagcttagcagatacatggctagatcgagatgagtatctagagtttgtcatggttatcttgagacactggataatgtaatttgcctgaatcgaaaataataaagacaggaacttgga

SEQ ID NO: 8566 - DNA, 2575 bp, Prunus persica
gagccagactccatgaccaggagcctctcctaaagagtcttatagcgctcaaacttccgaaaggtttgattactgaaacgtgcttggttgatactttgaaaaaatattttcatagctgagtctttgagtgaaagaaaatcatgtctggaagaaatcgtggaccgcctcatgctggacttcccccccaggtccatgaaccatttggaagaggacttgggccgatgccccatccagcattactcgaggaaatgagagaatcccaacttggaatgggtcccagaccacttccccctcaccctgcgataattgaggagcatcttgcggctcaacatcaagatatccaaggtcttctagttggtaaccaaaggctggctgcaacccatgttgcactaaagcaggaattggaagctgcccaatatgagttgcagcggatggcttaccatgttgattcactgcgggcagacaaggatgttcaaatgagagatttgtatgagaagtctgttcgtttggaagtggatcttcgcggagtggaggctatgcgagctgagcttcttcaggttcgtgctgatatcaaggagctcactgcagcgaggcaggagctctcgggccaggcacaagcaatgacacaagatttggctagaatcactgctgatttgcaacaggcaccagctttgagagcagaaattgaagctatgaaacaggaattgcaacgtgctagagctgccattgagtatgaaaagaaaggatatgcagagaattatgagcatggccaggtgatggaaaagaatttgatatcgatggctagggagctagagaaacttcgtgcagaaattgcgaatactgagaaaagagcgcgagctgcagctgctgttggaaatccaggtgtaggttataattcaaattatggaaaccctgaagcaggatatgcaggaaatccctatcctgccagctatggcatgaatcccgtatgttttgctctctttcatgatttaataaaaggcgcgcgtgtgtgcatgcctgatttaagtaatgatgtttcttttgtatgtgtctttgcgttattgcatatctttgtaagctgcaactgcttgctattatgtatgcatcatttttttctaaatgcctggatatgttaaagttcctccctcgattttcagagagcgagagagagaatatgcggtcgtcactctcacatccccatggaaatacaggcttcaaattccattcaaaccccatttctaaccagtcaccactaacagctatatcattcccattctctcactacaccaagacatctccttccccatctgcttctattcaactcactctaagatctcaatatgacttacgagcacaatttcctagcaaacccacatggcttctaccctcagtttcctttccacccactttagcaaccaagactggaagatcactggctccacttcagtgtggcattttgtcgaacagctgtagcaccgacgatggcaagaggagtttcagggattgggttgaggtggttggtgaggccgtatcaactgcatttcccatatgggttgctttgggatgcctgttggggctcatcaagccgagttccttcaattgggtcacacccaacttgaccatcttaggcataacactgaccatgcttggcatgggcatgaccctcactttcaacgaccttcgtggggcgttggccatgcccaaggaattacttgctggctttgttcttcagtactcggtgatgcctttatcaggatatgctgtgagcaagcttttgaatttgccgtcctattatgcagctggtttgatattggttggttgctgccctggtggaacagcaagtaacatagtaacttatattgcacgtggaaatgtggcactttcggttttaatgacagcagcgagcaccttatcagccgtgatcatgaccccctttctcactgccaaacttgctggtcaatatgttgcagtagatgcagctgggctattattctcaacattgcaggttgtgcttctccctgtattggcgggtgcatttctgaatcaatatttccaaggcctggttaaatttgtgtcccccttgatgccacccattgctgtgggaactgtagctgttctttgtgggaatgcaattgcccagagttcttctgcaatccttatgtctggtaaacaagtggtgctagctgccgctcttcttcatgcatctggatttttctttggttacatactttcaaggatacttgggattgatgtgtcatcatcaaggactatctccatcgaggttggcatgcagaattcggtgcttggagttgttctagccagccagcacttcggaaatcctctaactgcggtaccatgcgctgtttccagcgtttgtcattcaatccttggtagtgccttggcaggaatttggagacagagtgtgccaacgcaaaagcaagattgaaatgtcacgtagaagctttagacaatcagtataaaactttaaaacaatccttttgtaatcatatgagctgctagttgtgggaatttcattgcacattagcgagctatggagcacttggatttgcaattt

SEQ ID NO: 8567 - DNA, 1822 bp, Prunus mume
aaaaaaaattgaatgtttattgtatttcttggcaccttgcaaaatgccaaaatgcatatgacgtactatagtttggaaagcagttcacgatacaaaaacacctgaaagtgaaaacaagtagcgagagagcgagagagcgagagagagagaatatgccgtcgtcgctctcacatccccatggaaatacaggcttcaaattccaatcaaaccccatttctaaccagtcaccgctaacagctatatcattcccattcgctcactacaccaagacatctccttacccctctgcttttattcaactcactctaagatctcaatatgacttacgaccacaatttcccagcaaacccacatggcttctaccctcagtttcctttccacccacattagcaaccaagactggaagatcatcactagctccacttcagtgtggcattttgtcgaacagctgtagcgccaacgatggcaagaggagtttcagggattgggttgaggtggttggtgaggctgtatcaactgcatttcccatatgggttgctttgggatgcctgttggggctcatcaagccgagttccttcaattgggtcacacccaacttgaccatcttaggcataacactgaccatgcttggcatgggcatgaccctcactttcgacgaccttcgtggggcgttggctatgcccaaggaattacttgctggctttgttcttcagtactcggtgatgcctttatcaggatatgctgtgagcatgcttttgaatttgccgtcctattatgcagctggtttgatattggttggttgctgccctggtggaacagcaagtaacatagtaacttatattgcacgtggaaatgtggcactttcagttttaatgacagcagcgagcactttatcagccgtgatcatgaccccctttctcactgccaaacttgctggtcaatatgttgcagtagatgcagctgggctattattctcaacattgcaggttgtgcttctccctgtattggcgggtgcatttctgaatcaatatttccaaggcctggttaaatttgtgtcccccttgatgccacccattgctgtggcaactgtagctgttctttgtgggaatgcaattgcccagagttcttctgcaatccttatgtctggtaaacaagtggtgctagctgccgctcttcttcatgcatctggatttttctttggttacgtactttcaaggatacttgggattgatgtgtcatcatcaaggactatctccatcgaggttggcatgcagaattcggtgcttggagttgttctagctagccagcacttcggaaatcctctaactgcggtaccatgcgctgtttccagcgtttgtcattcaatccttggtagtgccttggcaggaatttggagacagagtgtgccaacgcaaaagcaagattgaaatgtcacgtagaagctttagacaagcagtataaaactttaaaacaatccttctgtaattatatgagctgctagttgtgggaatttcattgcacattagctagctatggagcacttggatttgcaattttggtgcttgtcttgtctgtgaacaatttgaacttgaacatttaacttgcgtttcaatgtgcttcctttcgatatgatttttaactcaatatttcacatacaaaataatttgttcatgaaattacaattatcaacgtaaaatatatcatgagagagagagagagagagagagagagagagagagctgacaactaactaatgataaatttgaccatacaaaaacaacagcaagccaaaataggaaaaattcttcacgtaatcttggga

SEQ ID NO: 8568 - DNA, 2066 bp, Ricinus communis
ttgagatgagagaatgaaatatatattttaattaaagatcttaaatctaatatttcaactaaatttaataaaagattagtgcttttcctttacttaattaaacatttagcctgctagaatctagtcatttagcattgttctaaatataacaattatagttaatttccatttacttaattttagaattgcaattaattgtcatttttaaattttgaacttaagcaaaatgatgaaatgaaacagattgccatgataataatagaatggtttatctttttaagttcagtgcccattaatgagctttttaagctgagatctgttggttaagagcgttatttccattaaataccaattcaagtttcagtattactgctttttaattaagtagaaagtgatcatagagagaagatggcgtcgtcacttccattttctcctgtaggaacatgcagtttcagttccagaccaaaaagctatgcaccaacaactaaacttcatcccttccttttcgcttcctctgtcaaatccatctcaaaacttcaacttcagtctaaccaaatacaagccgcaccaagtaaacccaactggatcttgctttcggcaacgaaaagggcagcccaacttcttcactgtggcatttcatcaaacgatttaagcgcaaacactgataagagttttagggattggattgtggtgattggtgaggcaatatctacagcatttcccttatgggtatctttgggttgcatattggcactcataaaacccacttctttcaattgggtcactccaaaatggaccattcttggcatatcccttaccatgcttggtatgggtatgacacttagctttgacgatcttaaagccgctttagctatgcctaaagagattttctccggttttgtgcttcaatactcggtgatgccgctctcaggatttctggtaagcaagatcttgaatctgccatcacattatgcagctggtctaattttggttggttgctgccccggtggaaccgcaagtaacatcgtgacttacattgcacgtggaaatgtggcgctctcagtattgatgacagcagcaagcactctaacagcagtggtcatgaccccatttcttacagccaaactggctgggcaatatgttgccgtagatgcagttggactgctaatgtcaaccttacaggttgtgcttcttccagttctagctggtgcgtttctaaatcaatatttccagggcctggttaaatttgtatcacctgtgatgccgcccattgctgtgggaactgttgctattctatgtggaaatgcaattgcacagagtgcttcagcaatcctcatgtctggtcaacaagtggtgcttgctgcttctctacttcatgcatctggctttttcttcggatatacacttgcgagaatgcttggacttgatgtggcatcttcacgaaccatctccatcgaggttggaatgcagaactctgtgcttggagtggttctagcaactcagcactttggaaacccactgactgccgtaccatgtgcagtttccagcgtatgtcactcggtctttggcagtctactggctggagtttggaggcgaagtctgcctacccaaaataaggattgacatgtggtgtggaagctagaaattcaaacttataacgtcctggcttcagaaatgacatggtaatcacatctgataatcctgttctgatatgtactgaaaatgtaacaaagctttatgccttttcattcatgtctacaaggtagtagtgaacttagctaagctgaattcagcaaacctgtaaacctaataatgaacttgctgtgatgttttatgtgggcatcatataaaggatcacagttgcatttggtgcaaattagttgatggatagataactggagcttagtattttaagtttcagattactccctccgccgcagcgccccaatgaacggttattttggcccctcctaaattatagtctacttttcttttcttttcttttctaattattagtttatgttcattattatttaattataaaataattgtaagttgccttatta

SEQ ID NO: 8569 - DNA, 557 bp, Eutrema parvulum
aatttgagagattttttttttatcaaggaagcaaaatgggctgcataggtattgtcaatgtaacaaacatcaatccttatcggccggtgctcacaagaagagcaaaccaacttcacaactcaagaggaccatctatggctgcgattcgagctgagtcaatggctactgagaaattagggattacaatcgagaagaatccatccgagtccaaactcacccaactcggtgttcgtaaatggcccaagtggggttgtcctccaagcaagtttccatggacttacgatgcaaaggagacttgttatctgctagaggggaaagtgaaagtgtatcctgatggatacgatgaaggcgtagagatcgaagcaggcgactttgttgttttccctaaagggatgagctgcacttgggatgtctctgttgccgttgataaacactatcaattcgagtgaatgccttcacaatctttgctctgcatattgatgaactcgatagagcttcttgactcatctttgtatatttggatacttaatgttctcgttcctgtataactttgattg

SEQ ID NO: 8570 - DNA, 565 bp, Eutrema parvulum
aattagaatttgagagattttttttttatcaaggaagcaaaatgggctgcataggtattgtcaatgtaacaaacatcaatccttatcggccggtgctcacaagaagagcaaaccaacttcacaactcaagaggaccatctatggctgcgattcgagctgagtcaatggctactgagaaattagggattacaatcgagaagaatccatccgagtccaaactcacccaactcggtgttcgtaaatggcccaagtggggttgtcctccaagcaagtttccatggacttacgatgcaaaggagacttgttatctgctagaggggaaagtgaaagtgtatcctgatggatacgatgaaggcgtagagatcgaagcaggcgactttgttgttttccctaaagggatgagctgcacttgggatgtctctgttgccgttgataaacactatcaattcgagtgaatgccttcacaatctttgctctgcatattgatgaactcgatagagcttcttgactcatctttgtatatttggatacttaatgttctcgttcctgtataactttgattggc

SEQ ID NO: 8571 - DNA, 4159 bp, Cajanus cajan
aaatgattttgtttctgttttcaaggacataatggagctgggaaaagcacgacaatctcaatgcttgttggtctgcttcctcctacttctggggatgctttggtgtttggaaagaacattgtatcagatattgatgagatacggaaggttttgggtgtctgcccacaacatgatatactctttcctgaattaacagttagagagcatttagaactgtttgccatattaaagggtgtggaagaacactcattggacaatgttgttactaatatggctgatgaggtgggcctggctgataaaatcaacagtattgtgagaactctttctggtggcatgaagaggaagttgtctcttggaattgcattgattggaaacagtaaggttatagtccttgatgaacccactagcggaatggatccatactcgatgcgcttgacttggcaattaataaaaaaaattaagaagggcagaataattttgctcactacacattctatggatgaagcagaagaactaggtgaccggatagctatcatggccaatggttctttgaaatgctgtggaagctcccttttcttgaagcatcattatggagttggttatactctaactcttgtgaagtcagcccctactgcttctatagctggtgatatagtataccgtcatgttccatcagcaacatgtataagcgaggttggaactgagatttctttcagacttcctatggcatcctcatcagcttttgaggggatgtttagggaaattgaaggttacatgaaaaaaccaatttcaaacatggaattgagtggcaatggtgacaaagacagtcttggtattgaaagctatggtatatctgtaactaccctggaggaggtatttttgagagttgcaggatgtgactatgatgaagttgaatgctttgaagaaaataaccattcccttatatcagactccgtggcttctcttcctactaatgatcatccatccacaaaaacaagttgccttaaaatttttggaaattataagaagattcttggtttcatgtctaccatgttgggaagagcttgtggcttaatttttgctacagttattagttttatcaacttcttgggtatgcagtgctgtagctgttgtctcatcactaggtcaacattttggcaacattttaaagccttattcattaaaagggcaatatctgctcgaagagaccacaaaacaattattttccagctaatgattcctactctcttcttgtttattggtcttctatttctcaagctcaagccacatcctgatcagcaatcactgaccctttcaacttctcattttaatcctctattgagtggtgggggtggaggaggtccaattccatttaatctatctttgccaattgctgaaaaggtagcacaaaatgtcaaaggagggtggattcagagattcaagccaagctcatacagattccctaattcagaaaaggcattggctgatgcagtggaagcagcagggccagctctggggcctgctctactttcaatgagtgaatatttaatgtctagctttaatgaatcctaccaatctaggtatggggcaattgtgatggatgatcagaataatgatggaagcttaggatacactgtattgcacaactgttcttgtcaacatgctgctcccacctttatcaatttgatgaattctgcaattcttaggcttgcaaccatggacatgaatatgacaattcagacacgcaaccatcctctaccaacaacacaaagccagcacttacaacgtcatgacttggatgccttctctgctgcaattattgtcaatattgctttctcttttatacctgcctcatttgccgtttcaattgttaaggaacgtgaagtgaaagctaagcagcagcaactaatcagtggggtttccgtcctatcatattgggcttctacatttatttgggactttgtgagcttcttgtttcctgcctcttttgccatagttctcttttacatctttggtctggatcagtttgttggaggggtttctttgttaccaacaatcctcatgcttttggaatatggactcgcaattgcatcatcaacttattgcctaacatttttcttttttgaccataccttgtctcacagaacgtggttctcctgattcactttttcaccggattgattctaatggttatctcatttattatgggactcatgccatcaacaatgagtgcaaattctttacttaagaattttttcagaatatctcctggattttgttttgctgatggtcttgcttcattagctcttctgcggcaaggaatgaaagataaaacaagtgatggggtttttgattggaatgttaccggtggttccatctgttatcttgctgttgagagctttagttactttctgttgacacttgcacttgaaattttcccttctctcaaattgacttcattcatgatcaagaagtggtggagagatgttaatattttccggcgtgatactccttatttggaacctctgttagaaccttcatctgaaactgttgcaatgaacttcaatgaagatgtagatgtgaaaacagaaagagatagagtactttccggttcccttgacaattccattatctacctgcacaatcttcgtaaggtatattttgaggagaagcatcatgcgaaaaaggttgcagtagattcattaactttctcagttcaggaaggagaatgtttcggatttttaggaacaaatggagctggaaagaccacaacactttctatgctatgtggggaagaatctccgtctgatgggactgcctttatttttggcaaagatatatgttcccatcccaaggctgctcgtcgatacattggatattgtccacaatttgatgctctgttggaatacttaactgtccaagagcatcttgagctctatgctagaataaaaggtgttccagattttgcactagaaaatgttgttatggaaaagttggcagagtttgacttattgaagcatgctaataaaccatcattttcacttagtggagggaataaaagaaaactctctgttgcaattgcaatgattggagatcctcctattgtcattcttgatgaaccatccacaggtatggatcccattgccaaaaggttcatgtgggatgtaatatctaggatatccacaagacgaggaaagactgcagtaattcttactacccacagcatgaatgaagctcaagccttatctaccagaatagggataatggttggtggacgattacgatgcattggaagtccacagcacctaaaaactagatttgggaatcatctggaactagaggtaaagcccactgaagtgagttctgtggacttgcaaactctctgccaagctattcaagaaagactgcttgatgtcccttctcatcctagaagcttacttaatgaccttgaaatttgcattgggggcactgactctgtcacatcaggaaatacctccattgcagagattagcttgacacgagaaatgataggcttaattgggcgctggcttgacaatgaagaaagagtgaaaacactaatctcttgtacacctgtctgtgatggaggttctcaggaacagttatcagaacaactgtttcgagatggtggtattcctttgccagtattttctgagtggtggctgtctaaacaaaagttctctgaaattgattcattttttctatcttcctttcgtggagcaagatgtcaagggtgcaatggtttaagcatcagatatcagttaccatataatgaggatttttctctggcagatgtttttggacttcttgaaaaaaacagaaatagattagggattgcggagtacagcatcagccaatcaactcttgagacgatattcaatcattttgcagctaatccatgatgtgtccttattttacaattcctttcataaaatgctgcttgttggttataatgtgttaattgtatcaaaatgatgacattataaggccatgtatattgtacagtcaattattatagtgccgaattgtaaatagatttgtagtactaagacccttaaatcaatctaactgctctagaagcattcgatttcttgaggatagtacctgttaggactatcttcaatttatcttgttccgtaat

SEQ ID NO: 8572 - DNA, 7006 bp, Medicago truncatula
tcaccaccttccctcactctccatccaccaaacgcaaacactttgacatgagttcaacaacgtgaacattacgattcttctttcactttcttccatcgcttccatttcatagggtttctgcaaccatgggaaccgcttcacgccagttaaaggttatgctcagaaaaaactaccttctcaaaattcgtcaccctttcgttactgctgctgagattttgctccctgcgattgttttgatgctattagcagctgtaagaacacaagtggatacacaaattcatccagctcaatcagtgaaggtagcacctataatagaaaagatgttggaaaataggcttaggtggtttggggatgtagagagaagacctatagattttgtaacagggagagtagatcatatggagaatagtcagatcactagaggcttggttgttgttgttgtattgagagaatggatgcacattcagaaagatatgtttgtagaagtggggaaaggtgtatcccctaactttcaacaagttttggaatccttgttggataagagagagtatttagcttttgtaccagacaccaatgaaacaaggatgatgatagacgtggtgtccatcaaatttccgattttgaagcatgttagtattgtatacaacgatgagttagagttggaaacatacatccggtcagatgcttatggtacctgcaatgatgtaaggaattgttcgaatcccaaaattaaaggagcagttgtatttcacgaacaaggtcctcagtcatttgattatagcatacgtctcaatcatacatgggctttctccggttttccggatgttacaacaataatggatacaaatggcccttttcttaatgacttagaacttggtgttagtgctgtaccaacaatgcaatacagcttgagtgggtttttgacagattcagttcccaacatcatcatcaccgatataatgatatcatctgcacagacaagtgggacagtgagtttaccttctgagctccccgagtcataccatcgacactatggcatgtataaatcttccaaaccaaaaatggagagattgcttcacaacaagctccagcaaatggttgattcattcataataataattgctcaacaacatgaattaaacttgagtgccgaaactgtaaatcttcctcttctaggatttcatgacactgatttctcgcgaaaagttccatggacccagtttaaccctactaacatacgaatagctccatttcccactcgagagtacaccgatgaccagttccaggcaatagtaaaagaagtcatgggaatattgtatttattggggtttctctatccagtttctcgcctgataagttattctgtgtttgagaaggaacaaaagatcaaagaaggactctatatgatgggcttaaatgacagcatatttcatctctcttggtttgtcacatatgctttccagtttgcaatttcttctgcggtcattacagcttgcacgatggataatatattcaagtatagtgataagacactggtgtttgcgtacttcttcatttttgggcttagtgcaatcatgctgtcattttttatatcaacgtttttcaaaagggccaaaacagctgtagctgttggaactctgtcatttcttggtacctttttgccgtattactctgtcaacgatgagggagtctctatgatcttgaaggttctcgcttctctgctttcacctacggcatttgctctgggttctatcaactttgctgattacgagcgcgctcatgttgggctccgctggagcaacatatggcgggagtcttctggagtgaacttttctgcatgtcttctgatgatgatacttgatacactgctctattgtgcaattggactgtatttcgataaggttcttccaagggagtatggactgcgatatccatggaactttatttttaaaaaggatttgtggagaaagagatcctccagttctaaaattaaatttactggcaagagttctgagtcagaagggaatcttttggggcgaggtattttcaatcctgctctagaagcaataagcttagacatgaaacaacaggagcttgatgtaaaatatgatacattgtctctttcttatagatttttttccaaaacttttaggtgcattcaaatcaggaatttgcataaagtgtatgctactaaaaaaggagattgctgtgctgttaactcattacagctgacattatatgaaaatcagattcttgctcttttagagagagagttctcttactctattttgggcttgagtcttgaatatattctagtgatagaaggggacaaattgagtattggtagtagtagccttcagtgtaagcttttcaaaggaacaaagatggcccatgtcgaatgtgtcaagaaaatagagaagaaaattcattataaatatgtagtatccctttccgagacaccgccaaccaacttcggacataatggagctgggaaaagcacgacgatatcaatgcttgttggtcttcttcctcctacttctggggatgctttgatttttggaaagaacattgtctctgatattgatgagatacggaaggttttgggtgtctgcccacaacatgatatactatttcccgaattgactgtgagagagcatttagaactatttgccatattaaagggtgttgacgaagacacattggagagcgttgttataaatatggccgatgaggtgggcctggctgataaaatcaacactgttgtgagatctctttctgggggcatgaagaggaaattgtcccttggaatcgcattgattggaaatagtaaggttataattcttgatgagcctacaagtggaatggatccatactcaatgcgtttgacttggcagttaataaaaaaaattaagaagggcaggataattttgctaacaacacactctatggatgaagcagatgaactaggtgaccggatagctatcatggccaatggttctctgaaatgctgcggaaggttaattccattttcatatttttcttacatattatacacgcatttgccacggccaaaactgccgcgatggcctccggaagaaccacctaaagttagagaattgttactgattgaactgcggaggaaagttctaattggacgtgagatctctcttttcttgaagcatcattatggagtcggttacactctaactcttgtaaagtctgctcctactgcttctattgctggtgatattgtataccgatatgttccgacagcaacctgtataagtgaggttggaactgaaatttccttcagactccctatggcatcctcctcaacctttgagaggatgttcagggaaattgaaagttgtatgaaaaagcctgtttcgagcatggaaataagcggcaattgtgaaaaagacagtcacggtattgaaagctatggtatatctgtaacaaccttggaggaggtattcttgagagttgctggatgtgactatgatgaagatgaatgctttgaagaaaataaccgttcgcttatatcagaagctgtggtttctcttccttctaatgatcgtccatccacaaaaatatgttattataaagtttgtggaaattacaagaagattcttggtttcatgtctaccatggtggggagagcttgtggtttaatttttgctacagttattagctttgtcaacttcataagcctacagtgttgtagctgttgtctcattactacgtccactttttggcaacactcgaaagccttaattattaagagggcgatatctgcacggagagatcacaaaacaattatttttcagttaatgattcctgctatcttcttgtttattggtcttctatttctggagctcaagccgcatcctgatcagatttcactgactctttcaacttcttattttaatcctctattgagcggtgggggtgggggtggtccaattccgtttaacctatcttttccaattgctgaagaggtagcacaaaatgttaaaggaggttggattcaaaggtgtaactcaagctcatacaaattccccaattcagaaaaggcattagttgatgcagtggaagcagcagggccagctttgggacctgctctacttaacatgagtgaatatttgatgtctagctttaatgaatcctaccaatctaggtatggggcaattgtgatggatgatcagaacaccgatggaagtttaggctacactgtattacataacttttcttgtcaacatgctgctcccacctttatcaatttgatgaattcggcgattcttaggcttgctactcataatgtgaatgcgacaattcagacacgcaaccaccctctaccaatgacacaaagccagcacttacaacgccatgacctggatgccttctctgctgctatcattgtcaatatagccttctctttcattcctgcttcatttgctgtttcaattgttaaggaacgtgaagtgaaagctaagcaccaacaactaatcagtggggtttctgtcctttcatactggatctctacatttatttgggacttcgtgagcttcttgtttcctgcctcttttgccattgttctcttttacatctttgttttcaatgataacacttgcctattgaatactgttataggtctagatcagtttgttggaggagtttctttgataccaacaattatcatgcttttggaatacggacttgcaattgcatcatcgacttattgccttacatttttcttttttgaccataccgtggcacagaacgtggttctcctggtccactttttttctggattgatactaatggttatctcattcattatggggctcctcccatccacaataagtgccaattcttttcttaagaactttttcagaatatctcctggattttgttttgccgacggtcttgcttcattagctcttctgcggcaaggaatgaaagataaaacaagtgatggagtgtatgactggaatgttacgggtgcctccatctgttatcttgctgtcgagagcttcatttattttttattgacactcgggcttgaaatatatccttcgctcaaattaactccattcaagatcaagaagtggtgggggaaaattaatatcttcccacataatactagttatctggaacctttattagaatcttccccagaaacttttgttacggacctcaatgaagacgtggatgtgaaaacagaaaggaatagagtactttcaggttccattgacaatgccattatctacttgcgcaatcttcgcaaggtgtattctgaagagaagaatcatgggaaaaaggttgcagtagattcattaaccttctcagttcaggaaggagaatgttttggttttttaggaacaaatggagctggaaagaccacaacgctttccatgttatgcggggaagaatctccttctgatgggactgcttttatttttggcaaagacatatgttcccatcccaaggctgctcgtaaatatattggatattgtccacaatttgatgctctgttggaattcttaactgtcaaagagcatcttgagctctatgctagaataaaaagtgttccagactacacaatagacaatgttgttatggaaaagctggtggagtttgacttattgaagcatgctaataaaccatcattttcacttagtggagggaataaaagaaaactatctgttgcaattgcaatgattggagatcctcctattgtcattcttgatgagccgtccacaggaatggatcccattgcaaaaaggttcatgtgggatgtaatatctagaatctcaactagacgaggcaagactgcagttattcttactacccatagcatgaatgaagctcaagccttgtgcaccagaatagggattatggttggtggacaactaagatgcattggaagtccgcagcatctaaaaacaagatttggcaatcatctagaactagaggtaaaacctactgaagtgagctctgtggacttgcaaacactctgccaaactattcaggaaatactttttgatgtcccttctcaacctagaagcttacttaatgaccttgaaatttgcattgggggtgctgattccgtcacctcaggaaatacctccattgcagaaattagcttgacatcagagatgataggcttaattggacgctggcttggcaacgaagaaagagtaaaaactctaacgtgctgtacacctgtctatgatggggcctctcaggaacagttgtccgaacaattacttcgagatggtggtattccattgcccgtgttttctgagtggtggttgtccaaacaaaaattctcagaaattgactcatttattctctgttcatttcgtggagcaaaatgccagggatacaatggtttaagcatcagataccagttaccttgtgatgaggacttttccctggcagatgtttttggacttctggaagcaagcagagataagttagggattgcagagtacagcctcagccaatcaactcttgagacaatatttaaccattttgcagctaattcatgagatgcccgtatttcatccttttctttcataaaatgatgcatgctggttgcaatgtgtttgaatgtatcaaagttataatattttcttaacttttactagtagtgaaatccaacagagggccctgggtgagattctaaggccttgtatattgtagagtccgtcattatagtgccatttaattgtaaatagattcccagttattaaatcttgaatctgactgtttcaccaacttttggagtagtttaggataatccatattaggattatctttaacttttcttgtggttctgctccaatgcttgttggaggaaagcgaaggggagtttggtagcagtcgttttaatgtttcttctttgcttgatggtttttattaattgatcaaatgaccctgtgacaatcatgaagtatatgcacttcttatggaatcaaacaacattttcttttcctgcctc

SEQ ID NO: 8573 - DNA, 1623 bp, Medicago truncatula
aaaaaactcgcaacaattttcttcacacgtgtcgatttcttacctgtcctttcttctccttttatcgtctcttctttttccctccccctctctctttctcacttaatcactgctccgttatggaacctttggacgattcagattcgaaactcgaacgagtcgactctgatcagacttcaactagctccgcttcaggcatttcctccgttttcagcactgacgatttccgtaacggcgacatttcctctatcagtagcggttcaggcgaaattccaacgtgcacggtgaaccgagtgattcttgcacctccgttgatagctatgtccaatgaagcggacaaaaacgaacctgccgcgccggaggaggtggtggtgacggctgtgacaagggagaagtgcgtaggaatgaataacaagggagtgagttggggacatacttcggtgattggaagacggagagagatggaagacgccgtcgctgttattccgggattcatgtcacgcacttgcgatcacgtcggcggttgtactgctcctggttctagatcctccggcgagatcagtcctattcatttcttcggcgtttacgacggccacggtggcgctcaggttgctaaattttgtgcaaagcgaatgcacaatgttatagcagaggagtgggagcaagaaatagcaggtggcgctgaatggcagaaaaggtgggaggccgtatttgctaatggatttgagaggactgacagtgaaattgaatcagacgaagttgccccagaaatggttggatctactgcctctgtggttgttctatctggttgccagattattacatccaactgtggtgactcaagggtggttctttgccgcaggactcaaacagtcccattgactgtggatcagaagcctgacagagaagatgaactcttgagaattgaaggagaaggaggaaaagtcataaactggaatggagctagggtttttggtgttcttgccatgtccagggccataggtgatcggtacttgagaccatggattattccagtgccagaggtaacttttacagctagaactgacgaggatgaatgtttgattttggcaagtgatggactttgggatgtaatgacgaatgaggaggtgggagaagtagcgcggagcattctaagaaggcgccgcagatccttatcatcaacagaggaaatatctccaacacaagttgttgctgatagcctcactgaaattgcgattggtagaaatagtacagataacgtttcaatcatagttgttgatctgaaatcaaagagaaaacgtgtgcaaaggcctccttcaatttcctaagaatacaactgattctcttctatagttttcaaccatgagaaggtaatgaagctcctagagttgatttacaatataaacagaacaaatccattgtcatgatggttctcagttatcacttcaacaattgtgtttctcctaacctcctgtatatacagaattgactggcaaaaagaagttgcttcatgacaagtaacaactagctaggccttgtttgttacagtgaagtgttgatcgataccccattttacccctttggtccttgacaagggcaaatagaatgaatttaccaattcat

SEQ ID NO: 8574 - DNA, 1992 bp, Medicago truncatula
ggtccaatcataagcaaactgtggcttttaaaattcgcagatcaaaccatgtgcgaagccagataatcaaaaacgtggaagtgatacaatcatacgcaagagatacgtttgaaaaggtggagtcacagcataaggcaggtgagtgcgagtacagacaattacttgcctcgtttctattccctgctcaacaaatcaattacaaattcacaatggatgcgtgtgccatcaaaaaaactcgcaacaattttcctcacacgtgtcactttcttacctgtcctttcttctccttttatcgtctcttctttttccctccccctctctctttctcacttaatcactgctccgttatggaacctttggacgattcagattcgaaactcgaacgagtcgactctgatcagacttcaactagctccgcttcaggcatttcctccgttttcagcactgacgatttccgtaacggcgacatttcctctatcagtagcggttcaggcgaaattccaacgtgcacggtgaaccgagtgattcttgcacctccgttgatagctatgtccaatgaagcggacaaaaacgaacctgccgcgccggaggaggtggtggtgacggctgtgacaagggagaagtgcgtaggaatgaataacaagggagtgagttggggacatacttcggtgattggaagacggagagagatggaagacgccgtcgctgttattccgggattcatgtcacgcacttgcgatcacgtcggcggttgtactgctcctggttctagatcctccggcgagatcagtcctattcatttcttcggcgtttacgacggccacggtggcgctcaggttgctaaattttgtgcaaagcgaatgcacaatgttatagcagaggagtgggagcaagaaatagcaggtggcgctgaatggcagaaaaggtgggaggccgtatttgctaatggatttgagaggactgacagtgaaattgaatcagacgaagttgccccagaaatggttggatctactgcctctgtggttgttctatctggttgccagattattacatccaactgtggtgactcaagggtggttctttgccgcaggactcaaacagtcccattgactgtggatcagaagcctgacagagaagatgaactcttgagaattgaaggagaaggaggaaaagtcataaactggaatggagctagggtttttggtgttcttgccatgtccagggccataggtgaccggtacttgagaccatggattattccagtgccagaggtaacttttacagctagaactgacgaggatgaatgtttgattttggcaagtgatggactttgggatgtaatgacgaatgaggaggtgggagaagtagcgcggagcattctaagaaggcgccgcagatccttatcatcaacagaggaaatatctccaacacaagttgttgctgatagcctcactgaaattgcgattggtagaaatagtacagataacgtttcaatcatagttgttgatctgaaatcaaagagaaaacgtgtgcaaaggcctccttcaatttcctaagaatacaactgattctcttctatagttttcaaccatgagaaggtaatgaagctcctagagttgatttacaatataaacagaacaaatccattgtcatgatggttctcagttatcacttcaacaattgtgtttctcctaacctcctgtatatacagaattgactggcaaaaagaagttgcttcatgacaagtaacaactagctaggccttgtttgttacagtgaagtgttgatcgacaccccattttatccttttggtccttgacaagggcaaatagaatgaatttaccaattcgtttgttgaacttctaaaaactaatactaatggaatgaaatatgatattgtcagtacaaaaatatcttctttctaacttggaggtataggataaccatatttcattcagactggaaaaatatcatgccattcaaatgttcagc

SEQ ID NO: 8575 - DNA, 2699 bp, Glycine max
agatttctcacaaaaataaaataaaataaataaaaaaatctcattcccgcaagcgcggttatcctcaactcactcttccaaccacgctcactcccgcgtcctcttcgatggccagcaccgcaaatcactgtctccaactcgccggcgccaccgagtcaactcgtcgctggagaatctccatttcgtgcaagaagaagtcggacaagttagcattcaaggaaacgaaggaaggcttcgtggactacgacagaggccagcacgaggtctccacgaaaatatccggcctccgcaaggacgacatcgccgcccgatatcgcctccgcgtcgccggaaaccgcttccagatggactggacggtgtcggaggtcgccgaacttgtcctctccctcaacctctccgacgacgacgacgtcgacggcctgctcaaccgctgggttggccgcttcgcgcgcaagaatttccccttccttatcaaggagttgacgcagcgagggtccattgaacactgtaaccgcgtgttccggtggttgaagaaccagaagaactaccgtgcgcgcaatgatatatacaatatgatgattaggttgcacgccaggcacaatcgaacggaccaggcgcgtggattgttttttgagatgcaggaatggaggtgtaaacctgatgtcgagacttacaatgctattattaatgcgcatggtcgggctggacagtggcgttgggctatgaatatcatggatgacatgctgcgtgcagctattccaccaagtcggtcaacttataacaacttaataaacgcttgtggatctagtgggaattggaaagaagcacttaatgtttgcaagaaaatgacagagaatggtgttgggcctgatcttgttactcacaatattattctatctgcatttaaaagtggggctcagtattcaaaagctttgtcttattttgaactaatgaagggaactcatattcgtcctgacacaactacacttaatattgttatccattgtctagtaaaacttaggcaatatgacaaagctattgaaatttttaattccatgagggagaagaagtcggaatgtacccctgatgttgttacattcactagtatcattcacctgtattctgtgtgtgggcaagttgaaaattgtgaggctgcatttaatatgatgattgcagaagggctgaaacctaatatagtctcatataatgcactcataggtgcatatgctgctcgtggtatggacaatgaggcgcatttgtttttcaatgagataaaacaaaatggcttccgccctgatattgtatcgtatacatctctccttaatgcttatggaaggtcacaaaagccccataaagctagacaaatatttgataggatgaagagaaacaagttgaagccaaatcttgtcagttacaatgcgctgattgatgcctatggatctaatggtttgctggcagatgcaattaaaatcttgcgagaaatggaacaagaaggaattcagccaaatgttgtctcaatatgcacactcttggctgcctgtggacgatgcagtcgaaaggtgaagattgacacagtgctaacagcagctgagatgcgaggaattaaattaaacacagttgcatataatgcagctataggaagctgtatgaatgtaggggaatatgacaaagctataggcttgtataaatctatgaggaagaaaaaaattaaaactgattctgttacttacactgtgttgataagtggttgttgtaagatgtcaaaatacggcgaagccctatcttttatggaagaaattatgcatctaaaacttcctttgtccaaagaggtctactcatccgccatatgcgcctatagcaaacagggccaaattgtagaggcagagtctacattcaacttgatgaaatcatctggttgctaccctgatgtggttacatacaccgccatgcttgatgcgtacaatgcagctgagaattgggagaaagcttatgcactctttgaagaaatggaagcaagcagcatcaagctagatactattgcctgtgcagctctaatgagatcttttaataaaggtggccaaccaggaagggttcttagtcttgcagaaagtatgagagaaaaagaaattcctttcagtgataccatattttttgaaatggtatctgcctgtagcatattacaagattggaggacagctgttgatatgatcaagtacatagagccctcacttcctgtaatttcatccggatgtttgaatcagttcctgcattctttaggaaaaagtggaaagattgaaactatgttgaagttattcttcaaaatgttggcatcaggtgccgatgttaacttaaacacttactctatattattgaagaaccttttatcatctggaaattggaggaagtatttagaggtattgcaatggatggaggatgccggaattcatccatcaaaagaaatgtaccatgatatatcctccttttcacaaaaatgctgtggcaatgaaaatgctgctgtcataagagaaagacttggtatgaatatttatgttgtattgaggattgtgtttccttatgttcatatgcatgcgctttcattcttttaataaactctgctatttgaatatttgaagaggtttacattatttaatcaacctgtgtgattttgcttaggcatgtaccaggttttttttttttgt

SEQ ID NO: 8576 - DNA, 3159 bp, Lupinus angustifolius
aaaaactgaaataaatatcgaatttctgaaagaacggttatcatctttctccatgtccaccacaacacttcactccacttataacctcaaactcaccgattcaactcgccctcacatcacttgcaaacgcaaaccgaacgagttaacattcaaggagactcagcaaggtttcgttgactacgacaatggccaccacgacgtttccaacaaggtcaccggaatcctcaaggacggaatccccgcccgttaccgaatccgagtcgccggaaaccgattccagaaggattggaccgtttctgaggtggttgaattggttctcaacctcgaccttcgtgatgatattgacggtttactcaaccgctgggtaggacgcttcgcacgcaagaatttcccttaccttattaaggagttgagtcagagagggaatattgaacattgtaactccgttttcgagtggatgaagaagcaaaagaattactgtgctcgaaatgatatatacaatatgatgataaggttgcacgcaaggcataatcgagtagaccaggcacgtggcttattttttgagatgcaaaagtggaggtgcaagcctgatgttgagacttataatgcaattatcaatgcacatggtcgagctggacaatggcgttgggctaagaatatcatggaagacatgctacgtgcagctatagcaccaagtcggtcaacttataacaacttgataaatgcctgtggatctagtggaaattggaaagaagcgcttaatatttgcaagaaaatgacagacaatggagttgggcctgatcttgttactcacaatattgtgttatctgcatttaaaagtggggctcagtattccaaagctctgtcttattttgaactaatgaagggaactcatattcgtccagacacaactacgcataatatcatcatccattgtctagtgaagcttggacaacatgacaaagccattgatatttttaattccatgagggaaaagaagtcagaatgccatcctgatgttgtaactttcactagtatcatccacttgtattctgtatgtggacaagttgaaaattgtggggctgcgttcagtatgatgcttgcagaagggctgaaaccaaatatagtctcatataacacactaataggtgcgtatgctgctcgtgggatggacaaggaagcattttctgtttttagtgaaataaatcagaatggtttacgcccagatattgtatcctatacatccttgcttaatgcttatggaagatcacaaaagccccaaaaatcaagggaagtatttgaaatgataaagaggaacaagttgaagccaaacgttgtcagctacaatgcactgattgatgcatatggatctaatggtttgttagctgaggcaattgaaatcttgcgtgagatggagcaagatgggatttatccaaatgtggtctcaatatgcactctcttggctgcctgcggacgatgcagtaagaaggtgaagattgaaacagtgctatcagcagcagagatgcgaggcattaaattgaatacatttgcatataattcagctatagggagctatatgaatgtcggggaatacgacaaagctataggcttgtataaatctatgaggaagaagaaaataaaacctgattctgttacctacactgtgttgataagtggttgttgtaagatgtcaaaatatggtgaagccctatcttttatggaagaaatgatgcaattagaacttcctttgtccaaagaggtctactcatctatcatatgtgcctacagcaaacaaggccaaatcgtagaagcagaatctacattcaacttgatgaaatcatctggttgctaccctgatgtggttacatacactgcaatgcttgatgcatacaatgcagctgagaattgggagaaagcatatgcactttatgaagaaatggaagtaaatggcatcaagctagatacaattgcatgtgcagccctgatgcgagctttcaatgaaggtggccaatctggaagggtccttagtcttgcaaagaatatgcgagaaaaagatattccttttagtgataccatcttttttgaaatggtatctgcctgtagcttattacatgattggaggacagctgttgatatgatcaagcacatagagccctcacttcctgtaatttcatctggatgtttgaatttattcctgcaatttttaggaaatagcggaaaaaatgaaactatgttgaagttattctacaaaatgcttgcatcgggtgctgaagttaacttcaatacttattctattttattgaagaaccttttgtcctcgggaaattggaggaaatatttagaggtattggaatggatggaagatgcaggaatttatccatcaaatggaatgtaccgtgatttatcctccttttcgcaaaggtgttgtggggaagaaaatgccgcaatcataaaagaaagacttgaatcactgaaaagaaaatcagggaaccaagtctctacaagccaaacggaatctcccattctttgttgatcatcatcatggggtggatattttgcgtagccataacacgatgccccgaactactgagagtagttcatctcagaagttggaactcaatttattggatcatctgctatccttgtacaacattacttgttatattagacaactgcaattgtgtaactaacattatgttcctttgtagataatagttttggactctaattaagtcattttggttcttttcacgcacttgttattcacatgtacctatggcttcatgtgacatggaacttatggtagagattcttgtaaaggagataagctagtcaagattgagcaattacagcagtaagagtttattgtatattggcagcactggcatgtaaatactttcgttgttctatatacagagtaaagttgtatacatctacctgatacttgtttatgatgacctgtctccattcagagaagattaacatagaaccaagatcactggagtgcatgtgttaatatactttaggatatacatagaaacactaatgactgatgagtgctaaaatatcttgtaccatgattgaagttgtcaattctctgacgattttacattttagtggtacaaataatagaattggtaaaaagtttactgaggttga

SEQ ID NO: 8577 - DNA, 2480 bp, Medicago truncatula
gcacagtttatctgcatccttgaaatgctccggaatttcaatggccaccaccacatcaccttactgcatccaactcagcggcgttaccgagtcaactcgtcctccaaaatccacaaccacacgcaagaaaagctccaacgaagttgcattcaaggagaagaaggatggtttcgtcgactacgacagaggacaccaccaagtctccaccaaaatatccggcctccgtaaagaagatatccccgctcactaccgcctccgtgttgccggtaaccgcttccaaaaggattggaccgtgtcggaggtcgtcgactccgtcctctccctcactctccgtgacgacattgaaggcctgctcaatcgttggattggtcgattcgctcgcaagaatttccctttcctcatcagagagttgacacaacgaggttcaattgaacactgtaacttagttttcagctggatgaagaatcagaaaaattattgtgccagaacagatatatacaacatgatgattaggttgcatgctaggcataatagaacggatcaggcacgtggtttgttttttgagatgcaaaaatgcaggtgtaaacctgatgctgagacatacaatgctcttattaatgcgcatggtcgagccggacaatggcgttgggctatgaatattatggatgacatgctgcgtgcagctatcccaccaagtcggtcaacttacaacaacttgattaatgcttgtggatctagtggaaattggaaagaagcacttaatgtttgcaagaaaatgactgacaatggagttggacctgatcttgtcactcacaatattatgttaactgcatttaaaagtggcactcagtattcaaaagctttgtcgtactttgaacttatcaagggaactcacattcgcccggacacaactacacacaatatcattatccattgtctagtgaagcttaaacaatatgacaaagccgttgatatttttaattccatgaaggaaaagaagtcggaatgtcaccctgacgttgtaacattcaccagtatgattcatttgtattctgtgtgtggacacattgaaaattgtgaggctgcattcaatatgatgcttgcagaagggctgaaaccaaatatagtctcatacaatgcactactaggtgcatatgctgctcgtgggatggaaaatgaggcacttcaggtttttaatgagataaaacaaaatggtttccgtccagatgttgtatcttatacatctctacttaatgcttatggaagatcacgaaagccccaaaaagcaagggaaatattcaaaatgataaagagaaacaacttgaagccaaacattgtcagttacaatgcactgattgatgcctatgggtctaatggtttgcttgaagatgcaattgaaatcttgcgagaaatggaacaagataagattcatccgaatgttgtctcaatatgcacactcttggctgcctgtggacggtgtggtcaaaaggtgaaaattgatactgtgctgtcagcggctgagatgcgaggcattaaattgaacacagttgcatataattcagctataggaagctatattaatgtgggggaatatgacaaggctatagacttgtataactctatgaggaagaaaaaaataaaatctgattccgttacttacactgtcttgataagtggttgttgtaagatgtcaaaatttggggaagccctgtcttttatggaagaaatgatgcatctaaaacttcctatgtccaaagaggtctactcatctatcatatgtgcctatagcaaacagggtcaaatcatagaagcagagtctacattcaacttgatgaaatcattgggttgcagtccagatgtggttacatatactgcaatgcttgatgcctacaatgcagccgagaagtgggagaaattatatgcactatttgaagaaatggaagaaaatgacgtcaagctagataccatcgcatgtgcagctctaatgagagcttttaacaaaggtggccaaccaggaagggtccttagtcttgcacaaagtatgagagaaaaagacattcctttaagtgataccatattttttgaaatggtatctgcctgtggcttattacatgattggaagacagctgttgatatgatcaagtacatggagccctcacttcctgtaatttcatctgggtgtttaaatctgttccttaattctttaggaaaaagtggaaaaattgagattatgttgaagctattcttcaaaatgttggcatctggtgctgaagttaacttcaatacttattctattttattgaaaaaccttttatcatctggaaattggaggaagtatttagaggtactacaatggatggaggatgcaggaattcatccctcaaatgaaatgtaccgtgatatatctttttcacaaaaaaactgtggggttgaaaatgctgctgtcataaaagaaagacttggtatggatactctatttt

SEQ ID NO: 8578 - DNA, 2495 bp, Glycine max
atgtccgaaagcgcagttatccttaactcactcttccaaccgcgctactccatccccgttctcttcaatggggccagcaccgcatctcactatctccaactcgccggcaccaccgagtcaactcgtcgctggagaatctccatttcatgcacgaagaagtctaacaagttggcattccaggaaacgaaggaaggattcgtggactacgaccgaggccagcacgaggtctccacgaaaatctccggcctccgcaaggacgacattgccgcccgctaccgcctccgcgtctccggtaaccgcttccagatggactgtacagtatcggaggtcgtcgacctcgtcctctcccttgacgtctccgacgacgacgtcgacggcctactcaagcgctggataggccgcttcgcgcgcaagaatttccccttcctcatcaaggagttgacgcagcgagggtccattgaacactgtaaccgcgtgttccggtggatgaagaaccagaagaagtactgcgcgcgtaatgatatgtacaatatgatgattaggttgcacgcgaggcataaccgaacggaccaggcgcgtggattgttcttcgagatgcaagagtggaggtgtaaacctgatgttgagacttacaatgctcttatcagtgcacatggtcgagccggatagtggcgttgggctatgaatatcatggatgacatgctgcgtgcagctattccaccaagtcggtcaacttataacaacttgataaatgcttgtggatctagtggaaattggaaagaagcacttaatgtttgcaaaaaaatggcatagaatggtgttgggcctgatcttgttactcacaatattattctatctgcgattaaaagtggggctcagtattcaaaagctttgtcttattttgaactaatgaagggaactcatattcgtcctggcacaactacacttaatattgttatccattgtctagtaaaacttagacaatatgacaaagctattgatatttttaattccatgagggagaagaagtcggattgtatccttgatgttgttacattcactagtatcattcacttgtattctgtgtgtgggcgagttgaaaattgtatatgatgcttgcagaagggctgaaacctaatatagtctcatatgatgcactaataggtgcttatgctgctcatggtatggacaatgaggcacatttggttttcaatgagataaaataaaatggcttctgccctgatattgtatcttatacatctctccttaatgctgatggaaggtcacaaaatccccaaaaagcaagagaaatatttgataggatgaagagaaaccagttgaagccaaatcttgtcagttacaatgcactgattgatgcctatggatctaatggtttgctggcagatgcaattaaaatcttgcgagaaatggaacaagaaagaattcagccaaatgttgtctcaatatgcacactcttggctgcctgtggacgatgcagtcggaaggtgaagattgacacagtgctaacagcagctgatatgcgaggaattaaattaaacacagttgcatataatgcagctatagaaagctgtatgaatgtaggggaatatgacaaagctataggcttgtataaatatgaggaagaaaaaaatcaaaactgattctgttacatacactgtgttgataagtggttgttgtaagatgtcgaaatacggtgaagccctatcttttatggaagaaatgatgcatctaaaacttcctttgtccaaagaggtctactcatctgtgatatgtgcctatagcaaacacggccaaattgtagaggcagagtctgcattcaacttgatgaaatcatcatgtgttcctgatgtggttacgtacaccaccatagttgatgcgttcaatgcagctgagaatttggcgaaagcttatgcactctttgaagaaatagaagcaagtggcatcaagctagatactattgcccgtgcagctctaatgagatcttttaataaaggcggccaaccaggaagggttcttagtcttgcagaaattacgagagaaaagaaattcctttcagtgataccatattttttgaaatggtatctgcctgtagcatattacaagattggaggacagctgttgatatgatcaagtacatagagccctcacttcctgtaatttcatccggatgtttgaatcagttcctgcattctttaggaaaaagtggaaagattgaactatgttgaaggtattcttcaaaatgttggttggcatcaggtgctgatgttaacttaaacacttactctatattattgaagaaccttttatcatctggaaattggaggaagtatttagagatattgcaatagatggaggatgcaggaattcatccatcaaatgcaatgtaccatgatatatcctccttttcacaaaaatgctgtggggatgaaaatgctgctgtcataaaagaaagacttggtatgaatattcatgtt

SEQ ID NO: 8579 - DNA, 1756 bp, Arachis hypogaea
gatgggaaacctctttctctctccctgtgccagttggttagtgtgaaccaataaagcatataggtttcattctggtcagtgtttatttgctctatgtatcatccactttaccttacactcgttggcgatggggtcttgaagcagattccgccaagccggtcaacctataacaacttgataaacgcctgtggctctagtggaaattggaaagaagcacttaatgtttgcaagaaaatgacagacaatggagttgggcctgatcttgttacacacaatattgtgttatctgcatttaaaagtggggctcagtattcaaaagctctgtcttattttgaactaatgaagggaactcacattcgtcctgacacaactacccttaacattattatccattgtcttgtgaagcttcaacaatatgacaaagccatcgatattttcaattccatgaggagaaataagtctgattgtcgtcctgatgttgtaacttttaccagcatcatacacttgtattctacatgtgggcaagttgaaaattgcgtggctgcatttaatatgatgcttgcagaagggctgaaacccaacacaatctcatataattcattaattggtgcatatgctgctcgcgggatggacaaggaggcacttgtggttttcaatgagatcaaacaaaatggtttccggccagatattgtgtcctatacatctttgcttaatgcttatggaagatcacaaaagcctcaaaaagcaagagaaatatttgcaatgataaagaaaaacagattgaagcctaacattgttacttacaatgcactaattgatgcctatggatctaatggtttgttggcggaggcaattgaaatattgcgtgagatggaacaagatggaatttatccaaatgttgtctcaatatgcactctcttggctgcctgtgggcggtgcagtcagaaggtgaagattgatacaatcctatcagcagctgagatgcgaggcattaaattgaatacggttgcctataattcagctataggagcctatatgaatgtggggaaataacaaagctgtaggcttgtataaatctatgaggaagaaaaatataaaacctgattctgttacttgcactgtgttgataagtggttgttgtaatatgtcaaaatatagtgaagccctagttttcatggaagaaatgatgcatcttagactaactttgtccaaagaggtctactcttctgccatatgtgcttacagcaaactgggacaagtcatagaagcagaatccacattcaacttgatgaaatcatctggttgctatcctgatgtagttgcatacactgcaatgcttgatgcatacaatgcaggagagaattgggaaaaggcatatgcactctttgaagaaatggaagtaaatggcatcaagctagatacgattgcatgtgctgccctgatgagagcttttaataaaggtggtcaaccaggaagggtcctcagttcttgcagaaaagtctgagagaaaaagatattcctttcagtgataccatttatttgaaatggtatctgcctgtagcctattgcatgattgggaggacagtcggtgattatcatgaaagtacatagagccctcacttcctgtaattcgtctggatgcttgtacctttctctaattttaggaaaagtggaagattagaaactatagttgtaagttattactacaagtatgttggctagtcgggtgctattattaacctactaactactttac

SEQ ID NO: 8580 - DNA, 2370 bp, Brassica rapa
aatttaaatactcgatattgacttcttctctctctttccttctccagtttccatcaaaatcgattctttttttcccccagcaaaaccctagcttcgacgaatcgcgtacactttcttcttcggagtcggatcgaatcgccatggctaagagctcattccagctttctaatccgcttgagacaaggatgaatgaagcgactcgaatcagagagaagtaccctgacagagtccctgtgattgtggagaaggctggacaaagtgatgttcctgacattgacaagaagaagtatctcgtcccagctgatctaaccgttggtcagtttgtgtacgtggtccgcaaaagaatcaagcttggagctgagaaagctatcttcgtctttgtcaaggacacattgcctccaactgctgcattgatgtctgcaatctatgaggaacacaaagatgaagatgggttcctctacatgacttacagcggagagaacacttttggttctttcatcgttgcctgaataaataaatttccatgaatgtacatagataaaggaggaagataagatgtacattccttccttccttgtcctctctctggcttttgcttttcatgttttgaatctttgacatttgggttttataatcttcagaagcctttccttatataccctcttttgcattttctaattatgctactgaatcaattctatatcagagtaatcgatgtttgaaaacttgctcatatcatcacaaaggcaaatgttttacaaaaggatagaccacaactatacaaaagtcaaaagctttcaaatagagaatctcaagctcttacttcatctgttctagcactctagaactagactgaatgattttgttttgcaaagtcgactgattttttgcactttctaccgaacaagattcaagaacgatgtcaaagaatcaacatccctcttctctgacggatacttgattggtcgtgaagagttcttcgggaacacgagtatcgtcgggaagctcccaagctgcaactcccttttagcaaactccttctggtcaccatcagctctaaacttcgccaccttcacgccactcccacccaacttatccgccaactcatcaaaagaaccttccatcgcctgacaaaacgggcaccaaggcgcgtaaagcacaacgatccaagcctctttacgattctccagcttcatcagattctcaatcccttgcctgctcaagctcacaacgttctcgctcttgaagatatcagcaaccgtggatgacgtcccattgacattagcattagcgttcccgttgctgttctccttgatgttccctttgtgaagtccacactctttagccttagcgtcttcccaccaccatctcccttctctctcgtgctgcccaggcaaaaccgctctcgtgcacggctcacatcctatagaaacataccccgcagcgtgtagcgtgttcacgggaacatccatagtcctcaagaagttccaaacatcgttcccttcgacgttcgcaaccggattccacttcaccaaactaccagctccaccgtctaacccttcaaacaccggatcaacttgaacaacggggatctctgatctcgtccctggtgactgatctttcctttgtccagtgatccaagcgcgtaagcccttcaacgcacgcctcagtggtctaacctttctgatgcggcaacactcctggtgaccgtcttcgtagaaagagaacaaacctttgtttctaaccagagcttggacctcaacagcgtcgggaaacatgtactcgattcgaataccgtagtgcttctccacggtgtcgaagagtctgtatgtttcggggttcaatctccctgtgtctaaactgaacaccctgaagggtcttccggttaagtgagcgtactcaatgagagcaacgtcttctgctccactaaacgcgattgcgatgtcgtttccgaacttctcaagagccttgtccatgatctcaagaggagaagcggtctctagactctttgctagctcctcgaagtcttcaacttccaccacatctagtttctctgtaacctcagaagcaaccacggacgctgcttgagaaggaacaaacgactcctttgcaattgactgaacattcagaggcttcaccgatgatgatcgtttcccggatagactcagagacgccgttgagacattaacacgatccgataacctcagcgaaccgatccgtggagctgaaactttgagctctgaggaagggaagctagaggttgagatcgcagaagaagaagatgaggaaacgttgatcgctagtgccatttcaagcaaagaaaaaacagatttctattaaccaaatgtgtgttttgttttgttttgtttg

SEQ ID NO: 8581 - DNA, 2283 bp, Brassica rapa
gtccaggttcaatgaacctagtttcacctgtttcttttataatccccacgttctttcagacacatctctcatacaaacaaaacaaaacaaaacacacatttggttaatagaaatctgttttttctttgcttgaaatggcactagcgatcaacgtttcctcatcttcttcttctgcgatctcaacctctagcttcccttcctcagagctcaaagctccacggatcggttcgctgaggttatcggatcgtgttaatgtctcaacggcgtctctgagtctatccgggaaacgatcatcatcggtgaagcctctgaatgttcagtcaattgcaaaggagtcgtttgttccttctcaagcagcgtccgtggttgcttctgaggttacagagaaactagatgtggtggaagttgaagacttcgaggagctagcaaagagtctagagaccgcttctcctcttgagatcatggacaaggctcttgagaagttcggaaacgacatcgcaatcgcgtttagtggagcagaagacgttgctctcattgagtacgctcacttaaccggaagacccttcagggtgttcagtttagacacagggagattgaaccccgaaacatacagactcttcgacaccgtggagaagcactacggtattcgaatcgagtacatgtttcccgacgctgttgaggtccaagctctggttagaaacaaaggtttgttctctttctacgaagacggtcaccaggagtgttgccgcatcagaaaggttagaccactgaggcgtgcgttgaagggcttacgcgcttggatcactggacaaaggaaagatcagtcaccagggacgagatcagagatccccgttgttcaagttgatccggtgtttgaagggttagacggtggagctggtagtttggtgaagtggaatccggttgcgaacgtcgaagggaacgatgtttggaacttcttgaggactatggatgttcccgtgaacacgctacacgctgcggggtatgtttctataggatgtgagccgtgcacgagagcggttttgcctgggcagcacgagagagaagggagatggtggtgggaagacgctaaggctaaagagtgtggacttcacaaagggaacatcaaggagaacagcaacgggaacgctaatgctaatgtcaatgggacgtcatccacggttgctgatatcttcaagagcgagaacgttgtgagcttgagcaggcaagggattgagaatctgatgaagctggagaatcgtaaagaggcttggatcgttgtgctttacgcgccttggtgcccgttttgtcaggcgatggaaggttcttttgatgagttggcggataagttgggtgggagtggcgtgaaggtggcgaagtttagagctgatggtgaccagaaggagtttgctaaaagggagttgcagcttgggagcttcccgacgatactcgtgttcccgaagaactcttcacgaccaatcaagtatccgtcagagaagagggatgttgattctttgacatcgttcttgaatcttgttcggtagaaagtgcaaaaaatcagtcgactttgcaaaacaaaatcattcagtctagttctagagtgctagaacagatgaagtaagagcttgagattctctatttgaaagcttttgacttttgtatagttgtggtctatccttttgtaaaacatttgcctttgtgatgatatgagcaagttttcaaacatcgattactctgatatagaattgattcagtagcataattagaaaatgcaaaagagggtatataaggaaaggcttctgaagattataaaacccaaatgtcaaagattcaaaacatgaaaagcaaaagccagagagaggacaaggaaggaaggaatgtacatcttatcttcctcctttatctatgtacattcatggaaatttatttattcaggcaacgatgaaagaaccaaaagtgttctctccgctgtaagtcatgtagaggaacccatcttcatctttgtgttcctcatagattgcagacatcaatgcagctattacataaacaaaacaaaacaaaaaaagacaagtgagaccaagtttttagtgtaaaaaatgaaactttaacgcccttaccagttggaggcaatgtgtccttgacaaagacgaagatagctttctcagctccaagcttgattcttttgcggaccacgtacacaaactgaccaacggttagatcagctgggacgagatacctaaaacaaagtggagaaaacattagtatgtgatcaagcacaatgttcac

SEQ ID NO: 8582 - DNA, 1643 bp, Brassica napus
gatacaaacaaaacaaaacacacatttggttaatagaaatctgttttttctttgcttgaaatggcactagcgatcaacgtttcctcatcttcttcttctgcgatctcaacctctagctttccttcctcagagctcaaagtttcagctccacggatcggttcattgaggttatccgatcgtgtcaatgtctcatcggcgtctctgagtctatccgggaaacgatcatcatcggtgaagcctctgaatgttcagtcatttacaaaggagtcgtttgttccttctcaagcagcgtccgtggttgcttctgaggttacagagaaactagatgtggtggaagttgaagacttggaggagctagcaaagagtctagagaccgcttctcctcttgagatcatggacaaggctcttgagaagttcggaaacgacatcgcaatcgcatttagtggagcagaagacgttgctctcattgagtacgctcacttaaccggaagacccttcagggtgttcagtttagacacgggaagattgaaccccgaaacatacagactcttcaacaccgtggagaagcactacggtattcgaatcgagtacatgtttcccgacgctgttgaggtccaagctctggttagaaacaaaggtttgttctctttctacgaagacggtcaccaggagtgttgccgcatcagaaaggttagaccactgaggcgtgcgttgaagggcttacgcgcttggatcactggacaaaggaaagatcagtcaccagggacgagatcagagatccccgttgttcaagttgatccggtgtttgaagggttagacggtggagctggtagtttggtgaagtggaatccggttgcgaacgtcgaggggaacgatgtttggaacttcttgaggactatggatgtgcccgtgaacacgcttcacgctgcggggtatgtttctataggatgtgagccgtgcacgagagcggttttgcctgggcagcacgagagagaagggagatggtggtgggaagacgctaaggctaaagagtgtggacttcacaaagggaacatcaaggagaacagcaacgggaacgctaatgctaatgtcaatgggacgtcatccacggttgctgatatcttcaagagcgagaacgttgtgagcttgagcaggcaagggattgagaatctgatgaagctggagaatcgtaaagaggcttggatcgttgtgctttacgcgccttggtgcccgttttgtcaggcgatggaaggttcttttgatgagttggcggataagttgggtgggagtggcgtgaaggtggcgaagtttagagctgatggtgaccagaaggagtttgctaaaagggagttgcagcttgggagcttcccgacgatactcgtgttcccgaagaactcttcacgaccaatcaagtatccgtcagagaagagggatgttgattctttgacatcgttcttgaatcttgttcggtagaaagtgcaaaaaatcagtcgactttgcaaaacaaaatcattcagtctagttctagagtgctagaacagatgaagtaagagcttgagattctctatttgaaagcttttgacttttgtatagttgtggtctatccctttgtaaaacatttgcctttgtgatgatatgagcaa

SEQ ID NO: 8583 - DNA, 1800 bp, Eutrema parvulum
ctattttcacctgcttcttttataatcccacatttcttcagagagagatctcaacagaaaaaaacaaaagacaaaagccacttttagatcatacaattttcttgccaaaaaatttatagaagtttgttttttttgggcgtgaaatggcactagcgatcaaagtttcttcatcttcttctgcgatctcaagctctagcttcccttcttcagagctcaaagctccacaaatcggttcgttgaggttatcggatcgtatcaatgtctcgtcggcgtctctgagtctgtccgggaaacgatcctcggtgaaacctttaaatgtgctgtcaattacaaaggaatcgatggttactcctcaagcagcacccatggtggcttctgaggttacagagaaactagatgtggtggaagtggaagactttgaggagctagcaaagaggctagagaatgcttctcctcttgaaattatggacaaggctcttgagaaattcggaaacgacattgcaattgcgtttagtggagcagaagatgttgctctcattgagtatgctcatttaactggaagacctttcagggttttcagtttggacacagggaggttgaatccagaaacatacagactcttcgataccgtggagaaacactacggtattcggattgagtatatgtttcctgatgctgttgaggttcaagctttggttaggaacaagggtttgttctctttctatgaagatggtcaccaagagtgttgccgtatcagaaaggtgagacctttgaggcgtgctttgaagggtttacgcgcttggatcacgggacaaagaaaagatcaatcacccggaacacgatcagagattccggttgttcaagttgatccagtgtttgaaggattagatggtggagctggtagtttggtgaagtggaatccggttgcgaatgtcgaagggaacgatgtttggaatttcttgaggacaatggatgttccagtgaacacgcttcatgctgcgggttatgtttccattgggtgtgagccgtgcacgagagcggttttaccgggtcagcacgagagagaagggagatggtggtgggaagatgctaaggccaaagagtgtggacttcacaaagggaacatcaaggagaatagcaacggaaacgctaccgctaatgtcaacgggacatccacggtcgcagatattttcaaaagcgagaatgttgtgaacttgagcaggcaagggattgagaatttgatgaagttggagaaccggaaagaggcttggatcgctgtgctttatgcaccgtggtgcccgttttgccaggcaatggaagcttcttttgatgaattggcggataagttgaacggaagtggcgtgaaggtcgctaagtttagagctgatggtgatcaaaaggagttcgcaaaacgggagttgcagcttgggagctttccgacaatacttgtcttcccaaagaactcttcaagaccaatcaagtatccatcagagaagagagatgtcgattctttgacatcgttcttaagtcttgttcggtaagaccgcaaaaatctgtcgactcgacgatgagaaagagatcagcaattttacaaccattcaatctagttccagaatgctagaacagatgtagaagatcatgagattctctattgaaaaagtttggcttttgtatagttgtggttaaaatagttgcctttgtactgatatttttatcttctcattttgtaaaccttttgcttttgtgatgattatatgaacaaatttccaacatcgattactttgatatggaagtgattta

SEQ ID NO: 8584 - DNA, 1726 bp, Eutrema halophilum
aagagaaaaacaaaaaaaaatataaacctcagatcataaaaaaaaagacttcgagaaatttgttgtgtggtgaaatggcactagcgatcaacgtttctctatcttcttctgggatctcgagctctagcttcccttcttcagagcttaaagtatcgcaaatcggttcgttgaggctatcggatcggatcaatgtctctgcggcgtctctgagtttttccgggaagcgatcatcggtgaaacctctaaatgtgcagtcaattacaaaggaatcaatggtttctcaagcagcttccatggttgcctctgaggttacagagaaactagatgtggttgaagtggaagactttgaggagctagcaaagaggctagagaatgcttcacctcttgaaattatggacaaagctcttgagaagtttggcaatgacattgctatcgcctttagtggagcagaagacgttgctcttattgagtatgctcatctaactggaagaccctacagagttttcagcttagacacagggagattgaatccagaaacatacagactcttcgatacagtggagaaacactacggtattcgaattgagtacatgtttcccgatgctgttgaggttcaagctttggttaggaacaagggtttgttctctttctatgaagatggtcaccaagagtgttgccgtataagaaaggtgagacctttgaggcgggcgttgaagggtctacgcgcttggatcactgggcaaagaaaagatcaatcaccagggacaagatcagagattcctgttgttcaaattgatccagtgtttgaaggattagatggtggagctggtagtttggtgaagtggaatccggttgcgaacgtcgaagggaacgatgtttggaatttcttgaggaccatggatgttcctgtgaacacgcttcatgctgcagggtatgtttccatcgggtgtgagccgtgcacgagagcggttttaccaggtcaacacgagagagaagggagatggtggtgggaagatgcaaaggctaaagagtgtggacttcacaaagggaatatcaaggagaataacaacgggaacgcaacggctaatgtcaatgggacatccacagttgcggatattttcaaaagcgagaatgttgtgaacttgagcaggcaagggattgagaatttgatgaagttggagaaccggaaagaggcttggatcgttgttctttatgctccgtggtgcccgttttgtcaagcaatggaggcttcttttgatgaattggctgataagttggctggaaatggcgtgaaggtcgctaagtttagagctgatggtgaccaaaaggagtttgctaaaagggatttgcagctcggaagcttcccaacaatacttgtgttctcaaagaactcttcaagaccaatcaagtatccatcggagaagagagatgtcgattctttgacatccttcttgaatctcgttcggtgagcagcgaaaatccgtcgactttacgaggagaaacagccagtcaataaaccattcttcagtctcgttccagaatgctagaacagaatgaagaatatcatgagattctctattgaagctctgattttttgtatagttgtggttaaaagtagttgcctttgtgctgatatttttaccaaaacttctccttttgtactctttttgcttctgtgatgatatgaacaagtttcccaacatcgattactttgatattgaactga

SEQ ID NO: 8585 - DNA, 1662 bp, Eutrema parvulum
ttatagaagtttgttttttttgggcgtgaaatggcactagcgatcaaagtttcttcatcttcttctgcgatctcaagctctagcttcccttcttcagagctcaaagctccacaaatcggttcgttgaggttatcggatcgtatcaatgtctcgtcggcgtctctgagtctgtccgggaaacgatcctcggtgaaacctttaaatgtgctgtcaattacaaaggaatcgatggttactcctcaagcagcttccatggttgcctctgaggttacagagaaactagatgtggtggaagtggaagactttgaggagctagcaaagaggctagagaatgcttctcctcttgaaattatggacaaagctcttgagaagtttggcaatgacattgctatcgcctttagtggagcagaagacgttgctcttattgagtatgctcatctaactggaagaccctacagagttttcagcttagacacagggagattgaatccagaaacatacagactcttcgatacagtggagaaacactacggtattcggattgagtatatgtttcctgatgctgttgaggttcaagctttggttaggaacaagggtttgttctctttctatgaagatggtcaccaagagtgttgccgtatcagaaaggtgagacctttgaggcgggcgttgaagggtctacgcgcttggatcactgggcaaagaaaagatcaatcaccagggacaagatcagagattcctgttgttcaaattgatccagtgtttgaaggattagatggtggagctggtagtttggtgaagtggaatccggttgcgaacgtcgaagggaacgatgtttggaatttcttgaggaccatggatgttcctgtgaacacgcttcatgctgcagggtatgtttccatcgggtgtgagccgtgcacgagagcggttttaccaggtcaacacgagagagaagggagatggtggtgggaagatgcaaaggctaaagagtgtggacttcacaaagggaatatcaaggagaataacaacgggaacgcaacggctaatgtcaatgggacatccacagttgcggatattttcaaaagcgagaatgttgtgaacttgagcaggcaagggattgagaatttgatgaagttggagaaccggaaagaggcttggatcgttgttctttatgctccgtggtgcccgttttgtcaagcaatggaggcttcttttgatgaattggctgataagttggctggaaatggcgtgaaggtcgctaagtttagagctgatggtgatcaaaaggagttcgcaaaacgggagttgcagcttgggagctttccgacaatacttgtgttctcaaagaactcttcaagaccaatcaagtatccatcggagaagagagatgtcgattctttgacatccttcttgaatctcgttcggtgagcagcgaaaatccgtcgactttacgaggagaaacagccagtcaataaaccattcttcagtctcgttccagaatgctagaacagaatgaagaatatcatgagattctctattgaagctctgattttttgtatagttgtggttaaaagtagttgcctttgtgctgatatttttaccaaaacttctccttttgtactctttttgcttctgtgatgatatgaacaaatttccaacatc

SEQ ID NO: 8586 - DNA, 2261 bp, Eutrema halophilum
gtccagattcaatgaacctattttcacttgcttcttttataatccccgcatttcctctgagagatctcaaagagaaaaacaaaaaaaaatataaacctcagatcataaaaaaaaagacttcgagaaatttgttgtgtggtgaaatggcactagcgatcaacgtttctctatcttcttctgggatctcgagctctagcttcccttcttcagagcttaaagtatcgcaaatcggttcgttgaggctatcggatcggatcaatgtctctgcggcgtctctgagtttttccgggaagcgatcatcggtgaaacctctaaatgtgcagtcaattacaaaggaatcaatggtttctcaagcagcttccatggttgcctctgaggttacagagaaactagatgtggttgaagtggaagactttgaggagctagcaaagaggctagagaatgcttcacctcttgaaattatggacaaagctcttgagaagtttggcaatgacattgctatcgcctttagtggagcagaagacgttgctcttattgagtatgctcatctaactggaagaccctacagagttttcagcttagacacagggagattgaatccagaaacatacagactcttcgatacagtggagaaacactacggtattcgaattgagtacatgtttcccgatgctgttgaggttcaagctttggttaggaacaagggtttgttctctttctatgaagatggtcaccaagagtgttgccgtataagaaaggtgagacctttgaggcgggcgttgaagggtctacgcgcttggatcactgggcaaagaaaagatcaatcaccagggacaagatcagagattcctgttgttcaaattgatccagtgtttgaaggattagatggtggagctggtagtttggtgaagtggaatccggttgcgaacgtcgaagggaacgatgtttggaatttcttgaggaccatggatgttcctgtgaacacgcttcatgctgcagggtatgtttccatcgggtgtgagccgtgcacgagagcggttttaccaggtcaacacgagagagaagggagatggtggtgggaagatgcaaaggctaaagagtgtggacttcacaaagggaatatcaaggagaataacaacgggaacgcaacggctaatgtcaatgggacatccacagttgcggatattttcaaaagcgagaatgttgtgaacttgagcaggcaagggattgagaatttgatgaagttggagaaccggaaagaggcttggatcgttgttctttatgctccgtggtgcccgttttgtcaagcaatggaggcttcttttgatgaattggctgataagttggctggaaatggcgtgaaggtcgctaagtttagagctgatggtgaccaaaaggagtttgctaaaagggatttgcagctcggaagcttcccaacaatacttgtgttctcaaagaactcttcaagaccaatcaagtatccatcggagaagagagatgtcgattctttgacatccttcttgaatctcgttcggtgagcagcgaaaatccgtcgactttacgaggagaaacagccagtcaataaaccattcttcagtctcgttccagaatgctagaacagaatgaagaatatcatgagattctctattgaagctctgattttttgtatagttgtggttaaaagtagttgcctttgtgctgatatttttaccaaaacttctccttttgtactctttttgcttctgtgatgatatgaacaagtttcccaacatcgattactttgatattgaactgactcattatccccaagaacaatgtatttgaaaggtaaaatatagaggaaaggtttctgaatattaaaccccaaaaggcaaagattcaaacatcaaagcaaaggaaaaagccagagagaaggaaggaatgtacttcttatcttcctggtttatctatgtacataaagaaatcgaaagatcgatatatttattcaagcagcgatcaaagatccaaaagtgttctctccgctgtaagtcatgtagaggaacccgtcttcatccttgtgttcttcatagattgcagacatcaatgcagctttggaggcaatgtgttcttgacaaagacaaagatggctttctcggctccaagcttgattcttttgcgaaccacgtacacaaattggccaacggttagatctgctggcacaagtcacttcttcttgtcaatgtcagggacatcactttgtccagccttttccacaatcacct

SEQ ID NO: 8587 - DNA, 2210 bp, Brassica rapa
ctagtttcacctgcttcttttataacccctcatttgttcagacagagagatctcaaaccaaacaaaacaacacttagatcgtacaattgtctgaaaattttataaaataaattttgttttgtgtgaaatggcactagcaatcaacgtttcttcatcttcttcttcgatctcaacctctagcttcccttcttcagacctgaaagctccacaaatcggttcgttgaggttatcggatcgaattaatgtctcatctgcgtctctgagtctatccgggaaacgatcctcggtgaaagctctgaacgtacagtcaatcacaaaggaatccatggttcctcctcaagcagcatccatggttgcttctgagattagagagaaagtagatgtgatcgaagtggaagactttgaggagctagcaaagaagctagagactgcttctcctcttgaaatcatggacaaggctctcgaaaatttcggaaacgacattgcaattgcgtttagtggagctgaagacgttgctctcattgagtatgctcatttaacaggaagaccttacagggtattcagcttagacacagggagattgaatccagaaacatacagactcttcgacaccgtggagaaacactacggtattcgaatcgagtacatgtttcctgacgctgttgaggtccaagctttggttagaagcaaaggtctgttctctttctacgaagacggtcaccaagagtgttgccgtatccgaaaagtgagaccgttgagacgtgctttaaaaggtttacgcgcttggatcacgggacaaagaaaagatcaatcaccagggacaagatcagagatccctgtggttcaggttgatccagttttcgaaggactagacggtggagctggtagcttggtgaagtggaaccccgttgcgaacgttgaagggaacgatgtttggagctttttgaggactatggatgttcccgtcaacacgctgcacgctgcggggtatgtttccatagggtgcgagccgtgcacgagagcggttttgccaggtcagcacgagagagaagggaggtggtggtgggaagacgctaaggcgaaagagtgtgggcttcacaaagggaacatcaaagagagtagcaacggaaacaacgcagcggttaatggcaatgggacaacgtcaacggtcgatgatattttcaaaagcgagaacgttgtgagcttgagcaggcaagggattgagaatctgatgaagcttgagaacaggaaggaggcgtggatcgttgtgctttacgcgccttggtgcccgttttgccaagcgatggaggcttcgtttgatgagttggcggataagttgaggggaggagatggcgtgaaggtggctaagtttagagctgatggtgaccagaaggagtttgctaagagtgagttgcagctagggagctttccgacgatacttgtgttcccgaagaactcttcaagacctatcaagtatccatctgagaagagggatgttgattctttgacatctttcttgaatcttgttaggtaaaaactgctaaaaatccgtcgacttttcgatgtgaaagagatgagttaaagaaccattcagtcttgttccagaatgctagaacagatgaagatcatgagatcgtctactgaatgtatagttgtggttaaaatgtttgcttttgtgcttatattttgtttaccaaacttttcattttgtactatgtttgcttatatgattatgtaaacaagttttccaacatgacttttaatattggagtacaaaagaatgttttaaaaaaaaaaagagtttctaaatattataaatccaaaacatgaaaagcaaagcaaaagccagagaagtaggaagaggaatgtacatcttatcttcctagtttatgtatatacatcatcaaagtcatgaaaagatcaaagtttaattcaatgagcaataagagatccaaaagtgttctctccactgtaagtcatgtagaggaacccatcttcatctttgtgctcttcatagattgcagacatcaatgcagctgttggaggcaatgtgtttttgacaaagacaaagattgctttctcagcaccaagcttgattcttttgcgaaccacgtaaacaaattgaccaacggttaggtctgctgggacgagttacttcttcttgtcaatatcaggaacatcactttgtccagccttttcaacaatcacct

SEQ ID NO: 8588 - DNA, 1691 bp, Brassica napus
ttgttttgtgtgcaatggcactagcaatcaacgtttcttcatcttcttcttcgatctcaacctctagcttcccttcttcagacctcaaagctccacaaatcggttggctgaggttatcagatcgtatcaatgtctcatctgcgtctctgagtctatccgggaaacgatcctcggtgaaagctctgaacgtgcagtcaatcacaaaggaatccatggttcctcctcaagcagcatccatggttgcttctgagattagagagaaagtagatgtgatcgacgtggaagactttgaggagctagcgaagaagctagagaccgcttctcctcttgaaatcatggacaaggctctcgaaaaattcggaaacgatattgcaattgcctttagtggagccgaagacgttgctcttattgagtatgctcatttaacaggaagaccttacagagtattcagcttagacacagggaggttgaatcccgaaacatacagactcttcgacaccgtggagaaacactacggtattcgaatcgagtacatgtttcccgacgcagttgaggttcaagctttggttagaaacaaaggtctgttctctttctacgaagacggtcaccaagagtgttgccgtatcaggaaagtgagaccgttgaggcgtgccttgaaaggcttacgcgcttggatcaccggacaaagaaaagatcaatcaccagggacaagatcagagatccctgttgttcaagtcgatccggtgttcgaaggactagacggtggagttggcagtttggtgaagtggaaccccgttgcgaacgtggaagggaacgatgtttggagcttcttgaggactatggatgttcccgtcaacacgctgcacgctgcggggtatgtttccatagggtgcgagccttgcacgagagcggttttacccggccagcacgagagggaagggagatggtggtgggaagatgctaaggcgaaagagtgtgggcttcacaaagggaacatcaaagagagtagcaacggaaacaacgcagcggttaatggcaatgggacaacgtcaacggtggatgatattttcaaaagcgagaacgttgtgagcttgagcaggcaagggattgagaatctgatgaagctggagaacaggaaggaggcgtggatcgttgtgctttacgcgccttggtgcccgttttgccaagcgatggaggcttcgtttgatgagttggcggataagttgaagggaggagatggcgtgaaggtggctaagtttagagcggacggtgagcaaaaggagtttgctaagagtgagttgcagctagggagctttccgacgatacttgtgttcccgaagaattcttcaagacctatcaagtatccatctgagaagagggatgttgattctttgacatctttcttgaatcttgttaggtaaaaactgctaaaaatccgtcgacttttcgatgtgaaagagatgagttaaagaaccattcagtcttgttccagaatgctagaacagatgaagatcatgagatcgtctactgaatgtatagttgtggttaaaatgtttgcttttgtgcttatatttttgtttaccaaacttctcattttgtactatgtttgcttatatgattatgtaaacaagttttccaaaaaaaaaaaaaaaaaactcgagactagtctctcggggggcccggtcccatcg

SEQ ID NO: 8589 - DNA, 1703 bp, Brassica napus
agatcgtaaaattgtctgacaaaatttataaaataatttttgtttggtgtgaaatggcactagcaatcaacgtttcttcatcttcttctgcgatctcaacctctagcttcccttcttcagacctcaaagctccacaaatcggttcgttgaggttatcagatcgtatcaatgtctcatcagcgtctctaagtgtatccgggaaacgatcctcggtgaaagctctgaacgtgcagtcaatcacaaaggaatctacggttcctcctcaagcagcatccatggttgcctctgagattagagagaaagtagatgtgatcgaagtggaagactttgaggagctagcaaagaagctagaaactgcttctcctcttgaaatcatggacaaggctctcgaaaaattcggaaacgacattgcaattgcgtttagtggagctgaagacgttgctctgattgagtatgctcatttaacaggaagaccttacagagtattcagcttagacacagggagattgaatccagaaacatacaggctcttcgacaccgtggagaaacactacggtattcgaatcgagtacatgtttcctgacgctgtcgaggttcaagctttggttagaaacaaaggtttgttctctttctacgaagacggtcatcaagagtgttgccgcatcagaaaagtgagaccgttgaggcgtgctttaaaaggtttacgcgcttggatcacgggacaaagaaaagatcaatcaccagggacaagatcagagatccccgtcgttcaagtcgatccagtgtttgaaggactagacggtggagttggcagtttggtgaagtggaacccggttgcgaacgtagaagggaacgatgtttggagctttttgaggactatggatgttcccgtcaacacgctgcacgctgcggggtatgtttccatagggtgcgagccgtgcacgagggcggttttgccaggtcagcacgagagggaagggaggtggtggtgggaagacgctaaggctaaagagtgtggacttcacaaagggaacatcaaagagagtaacgcaacggttaatgtcaatggaacaacatcaacggtcgatgatattttcagaagcgagaacgttgtgagcttgagcaggcaagggattgagaatctgatgaagctggagaacaggaaggaggcttggatcgttgtgctttatgcgccttggtgcccgttttgccaagcgatggaggcttcgtttgatgagttggcggataagttgaagggaggagatggcgtgaaggtggctaagtttagagctgatggtgatcaaaaggagtttgctaaaagtgagttgcagcttgggagctttccgacgatacttgtgttcccaaagaactcttcaagacctatcaagtatccatctgagaagagagatgttgattctttgacatctttcttgaatcttgttaggtaaaaactgcgaaaaatccgtcgactttgcgatgtgaaagagatcagttaaagaacccattcagtcttgttccagaatgctagaacagatagagatcattagatcctctactgaatgtatagttgtggttaaaatgtttgcttttgtgcttatattttgttttttttaccaaacttctcatttttgtactctgttttgcttatgtgattgtgtaaacaagttttccaacatggctttaatattggagtatataagaat

SEQ ID NO: 8590 - DNA, 1702 bp, Brassica napus
acaacacttagatcgtacaattgtctgaaaattttataaaataaatcttgttttgtgtgaaatggcactagcaatcaacgtttcttcatcttcttcttcgatctcaacctctagcttcccttcttcagacctcaaagctccacaaatcggttcgttgaggttatcagatcgtatcaatgtttcatctgcgtctctgagtctatccgggaaacgatcctcggtgaaagctctgaacgtgcagtcaatcacaaaggaatccatggttcctcctcaagcagcatccatggttgcttctgagattagagagaaagtagatgtgatcgaagtggaagactttgaggagctagcaaagaagctagaaactgcttctcctcttgaaatcatggacaaggctcttgaaaaattcggaaacgatattgcaattgcctttagtggagctgaagatgttgctcatttaacaggaagaccttacagagtattcagcttagacacagggaggttgaatccagaaacatacagactcttcgacaccgtggagaaacactacggtattcgaatcgagtacatgtttcctgacgctgttgaggtccaagctttggttagaagcaaaggtctgttctctttctacgaagacggtcaccaagagtgttgccgtatcagaaaagtgagaccgttgaggcgtgctttaaaaggtttacgcgcttggatcaccggacaaagaaaagatcagtcaccagggacaagatcagagatccctgttgttcaggttgatccggtgttcgaaggactagacggtggagctggtagcttggtgaagtggaaccccgttgcgaacgttgaagggaacgatgtttggagcttcttgaggactatggatgttcccgtcaacacgctgcacgctgcggggtatgtttccatagggtgcgagccgtgcacgagggcggttttgccaggtcagcacgagagggaagggagatggtggtgggaagacgctaaggcgaaagagtgtgggcttcacaaagggaacatcaaagagagtagcaacggaaacaacgcagcggttaatggcaatgggacaacgtcaacggtcgatgatattttcaaaagcgagaacgttgtgagcttgagcaggcaagggattgagaatctgatgaagctggagaacaggaaggaggcgtggatcgtcgtgctttacgcgccttggtgcccgttttgccaagcgatggaggcttcgtttgatgagttggcggataagttgaagggaggagatggcgtgaaggtggctaagtttagagcggacggtgatcaaaaggagtttgctaagagtgagttgcagctagggagctttccgacgatacttgtgtttccgaagaactcttcaagacctatcaagtatccatctgagaagagggatgttgattctttgacatctttcttgaatcttgttaggtaaaaactgctaaaaatccgtcgacttttcgatgtgaaagagatgagttaaagaaccattcagtcttgttccagaatgctagaacagatgaagatcatgagatcgtctactgaatgtatagttgtggttaaaatgtttgcttttgtgcttatattttgtttaccaaacttttcattttgtactatgtttgcttatatgattatgtaaacaagttttccaacatgacttttaatattggagtacaaaagaatg

SEQ ID NO: 8591 - DNA, 1768 bp, Arabidopsis lyrata
gacgtctaggttcaatgaacctaatttcacctgcttcttttataatcccatttctctcacaaatcttaacagaaaacaaaattttaaaaacaacaaaaaaaaaaaaacattaagaacacattttcgagagatttagtttggtgtgaaaatggcactagcaatcaacgtttcttcatcttcttcttctgcgatctcaagctctagcttcccttcttccgatctcaaagtaccacaaatcggatcattgaggttattggatcgtatcaatgtctctgcggcgtctctgagtttatccgggaagagatcctccgtgaaagctctaaatgtgcaatcaattacaaaggaatccattgttgcttctgagcttacagagaagctagatgtcgtggaagttgaagactttgaggaactagcaaagagattagagaatgcttctcctcttgagatcatggataaagctcttgagaagtttgggaatgacattgcaattgcctttagtggagctgaagatgttgctctgattgagtatgctcatttaactggaagaccttatagggttttcagtttggatacagggagattgaatccggaaacatacagactcttcgataccgtggagaagcattacggtattcggattgagtatatgtttcctgatgctgttgaggttcaagccttggttaggaacaagggtttgttctctttctatgaagatggtcaccaggagtgctgccgtattagaaaggtgagacctttgaggcgtgctttgaagggcttacgtgcttggatcactggtcagagaaaagatcaatcgcctgggacaagatcggagattccggttgttcaggttgatccagtgtttgaaggattagatggtggagttggtagtttggtgaagtggaatccggttgcgaatgttgaagggaatgatgtttggaatttcttgaggactatggatgttcctgtcaacacgcttcatgctgctggttatgtttcaatcggatgtgagccatgtacgagagcagttttgccgggtcagcatgagagagaagggagatggtggtgggaagatgctaaggctaaagagtgtggacttcacaaagggaatatcaaggagaataccaatggaaacgcaactgctaatgtcaacgggacatccacggtggcggatattttcaacagcgagaatgttgtgaacttgagcaggcaagggattgagaatttgatgaagttagagaaccggaaagaggcttggatcgttgtgctttatgcaccgtggtgcccgttttgtcaggcaatggaagcttcatttgatgaattggcagataagctcggcggaaatggcgtgaaggttgctaagtttagagctgatggtgaccagaaggactttgccaaaaaggagttgcagcttggaagctttccaacaatacttgtgttcccaaagaactcttcgagaccaatcaagtatccatcagagaaaagagatgttgattccttgacatctttctttaatcttgttcggtaaatccgttaaaaatccgccgactttatgatgagaaaaagagatcaataaaagatctctcagtctcgttccagaatgctagaacagattgaagcaggtcaagatgagaatctctattggagctttagctttttgtatagctgtagttaaaataattacaccaaggttttgccttttgtgattttatttttaccaatcttcagtgtattactcttttttgcctttgtgatggatatgaacaagttt

SEQ ID NO: 8592 - DNA, 1784 bp, Arabidopsis lyrata
aatttcacctgcttcttttataatcccatttctctcacaaatcttaacagaaaacaaaattttaaaaacaacaaaaaaaaaaaaacattaagaacacattttcgagagatttagtttggtgtgaaaatggcactagcaatcaacgtttcttcatcttcttcttctgcgatctcaagctctagcttcccttcttccgatctcaaagtaccacaaatcggatcattgaggttattggatcgtatcaatgtctctgcggcgtctctgagtttatccgggaagagatcctccgtgaaagctctaaatgtgcaatcaattacaaaggaatccattgttgcttctgagcttacagagaagctagatgtcgtggaagttgaagactttgaggaactagcaaagagattagagaatgcttctcctcttgagatcatggataaagctcttgagaagtttgggaatgacattgcaattgcctttagtggagctgaagatgttgctctgattgagtatgctcatttaactggaagaccttatagggttttcagtttggatacagggagattgaatccggaaacatacagactcttcgataccgtggagaagcattacggtattcggattgagtatatgtttcctgatgctgttgaggttcaagccttggttaggaacaagggtttgttctctttctatgaagatggtcaccaggagtgctgccgtattagaaaggtgagacctttgaggcgtgctttgaagggcttacgtgcttggatcactggtcagagaaaagatcaatcgcctgggacaagatcggagattccggttgttcaggttgatccagtgtttgaaggattagatggtggagttggtagtttggtgaagtggaatccggttgcgaatgttgaagggaatgatgtttggaatttcttgaggactatggatgttcctgtcaacacgcttcatgctgctggttatgtttcaatcggatgtgagccatgtacgagagcagttttgccgggtcagcatgagagagaagggagatggtggtgggaagatgctaaggctaaagagtgtggacttcacaaagggaatatcaaggagaataccaatggaaacgcaactgctaatgtcaacgggacatccacggtggcggatattttcaacagcgagaatgttgtgaacttgagcaggcaagggattgagaatttgatgaagttagagaaccggaaagaggcttggatcgttgtgctttatgcaccgtggtgcccgttttgtcaggcaatggaagcttcatttgatgaattggcagataagctcggcggaaatggcgtgaaggttgctaagtttagagctgatggtgaccagaaggactttgccaaaaaggagttgcagcttggaagctttccaacaatacttgtgttcccaaagaactcttcgagaccaatcaagtatccatcagagaaaagagatgttgattccttgacatctttctttaatcttgttcggtaaatccgttaaaaatccgccgactttatgatgagaaaaagagatcaataaaagatctctcagtctcgttccagaatgctagaacagattgaagcaggtcaagatgagaatctctattggagctttagctttttgtatagctgtagttaaaataattacaccaaggttttgccttttgtgattttatttttaccaatcttcagtgtattactcttttttgcctttgtgatggatatgaacaagttttccaagatggattcctttgaaatgaaagtgactcatta

SEQ ID NO: 8593 - DNA, 1812 bp, Arabidopsis thaliana
gacgtctaggttcaatgaacctaaatttcagctgcttcttttataatcccatttctctcaacaaatcttaagagaacacaaaattagaaaaaacacaacacaaaaataaaaaaaacttaagaacattgtttcgagagatttggtttggagtgaaaatggcactagcaatcaacgtttcttcatcttcttcttctgcgatctcaagctctagcttcccttcttcagatctcaaagtaacaaaaatcggatcattgaggttattgaatcgtaccaatgtctctgcggcttctctgagtttgtccgggaagagatcctccgtgaaagctcttaatgtgcaatcaattacaaaggaatccattgttgcttctgaggttacagagaagctagatgtggtggaagttgaagactttgaggaactagcaaagagattagagaatgcttctcctcttgagatcatggataaagctcttgagaagtttgggaatgacattgctattgcctttagtggagctgaagatgttgctctgattgagtatgctcatttaactggaagaccttatagggtattcagtttggatacagggagattgaatccagaaacatatagactcttcgataccgtggagaaacattacggtattcggattgagtatatgtttcctgatgctgttgaggttcaagctttagttaggaacaagggtttgttctctttctatgaagatggtcaccaggagtgttgccgtattagaaaggtgagacctttgaggcgtgcgttgaagggtttacgtgcttggatcactggtcagaggaaagatcaatcacccgggacaagatcggagattcctgttgttcaggttgatccagtgtttgaaggattagatggtggagttggtagtttggtgaagtggaatccggttgctaatgttgaagggaatgatgtttggaatttcttgaggacgatggatgttcctgtcaacacgcttcacgctgcgggttatgtttcaatcggatgtgagccatgcacgagagcggttttgccgggtcagcatgagagagaagggagatggtggtgggaagatgctaaggctaaagagtgtggccttcacaaagggaatatcaaggagaataccaatggaaacgcaaccgctaatgtcaacgggacagcctcagtcgcggatatcttcaatagcgagaatgttgtgaacttgagcaggcaagggattgagaatttgatgaagttagagaaccggaaagaggcttggatcgttgtgctttatgcaccgtggtgcccgttttgtcaggcaatggaagcttcattcgatgaattggcggataagctgggaggaagtggtgtgaaggttgctaagtttagagctgatggtgaccagaaggactttgccaaaaaggagttgcagcttggaagctttccaacaatacttgtgttcccaaagaactcttcaagaccaatcaagtatccatcagagaagagagatgttgattctttgacatctttcttgaatcttgttcggtaaatccgcaataaaatccgccgactctacgatgacgaagagatcaataatagaccatccagtctcgttccagattgctagaacagatgaagaaggtgaagatgagaatctctatttggagctttagccttttgtatagctgtggttaaaaataattacgccaaggttttgccttttgtgagtttatttttaccaattttcagtgtattactccttttttgcctttgtgatggatatgaacaagtttgatatgaaagtgactcattactcattagccccaaaa

SEQ ID NO: 8594 - DNA, 1906 bp, Arabidopsis thaliana
agtgtatgttacattaatagaaaaaaaaagaattcttggaccaaagttgactagttttctctgccacacgaccaaagtgacgcaagcaatgatatatagaaaagcaaatgccgccacctaaaaaaagacgtctaggttcaatgaacctaaatttcagctgcttcttttataatcccatttctctcaacaaatcttaagagaacacaaaattagaaaaaacacaacacaaaaataaaaaaaacttaagaacattgtttcgagagatttggtttggagtgaaaatggcactagcaatcaacgtttcttcatcttcttcttctgcgatctcaagctctagcttcccttcttcagatctcaaagtaacaaaaatcggatcattgaggttattgaatcgtaccaatgtctctgcggcttctctgagtttgtccgggaagagatcctccgtgaaagctcttaatgtgcaatcaattacaaaggaatccattgttgcttctgaggttacagagaagctagatgtggtggaagttgaagactttgaggaactagcaaagagattagagaatgcttctcctcttgagatcatggataaagctcttgagaagtttgggaatgacattgctattgcctttagtggagctgaagatgttgctctgattgagtatgctcatttaactggaagaccttatagggtattcagtttggatacagggagattgaatccagaaacatatagactcttcgataccgtggagaaacattacggtattcggattgagtatatgtttcctgatgctgttgaggttcaagctttagttaggaacaagggtttgttctctttctatgaagatggtcaccaggagtgttgccgtattagaaaggtgagacctttgaggcgtgcgttgaagggtttacgtgcttggatcactggtcagaggaaagatcaatcacccgggacaagatcggagattcctgttgttcaggttgatccagtgtttgaaggattagatggtggagttggtagtttggtgaagtggaatccggttgctaatgttgaagggaatgatgtttggaatttcttgaggacgatggatgttcctgtcaacacgcttcacgctgcgggttatgtttcaatcggatgtgagccatgcacgagagcggttttgccgggtcagcatgagagagaagggagatggtggtgggaagatgctaaggctaaagagtgtggccttcacaaagggaatatcaaggagaataccaatggaaacgcaaccgctaatgtcaacgggacagcctcagtcgcggatatcttcaatagcgagaatgttgtgaacttgagcaggcaagggattgagaatttgatgaagttagagaaccggaaagaggcttggatcgttgtgctttatgcaccgtggtgcccgttttgtcaggcaatggaagcttcattcgatgaattggcggataagctgggaggaagtggtgtgaaggttgctaagtttagagctgatggtgaccagaaggactttgccaaaaaggagttgcagcttggaagctttccaacaatacttgtgttcccaaagaactcttcaagaccaatcaagtatccatcagagaagagagatgttgattctttgacatctttcttgaatcttgttcggtaaatccgcaataaaatccgccgactctacgatgacgaagagatcaataatagaccatccagtctcgttccagattgctagaacagatgaagaaggtgaagatgagaatctctatttggagctttagccttttgtatagctgtggttaaaaataattacgccaaggttttgccttttgtgagtttatttttaccaattttcagtgtattactccttttttgcctttgtgatggatatgaacaagtttgata

SEQ ID NO: 8595 - DNA, 1648 bp, Brassica napus
atctcaacctctagcttcccttcttcagacctcaaagctccacaaatcggttcgctgaggttatcagatcgtatcaatgtctcatctgcgtctctgagtctatccgggaaacgatcctcggtgaaagctctgaacgtgcagtcaatcacaaaggaatccatggttcctcctcaagcagcatccatggttgcttctaagattagagagaaagtagatgtgatcgacgtggaagactttgaggagctagcgaagaagctagagaccgcttctcctcttgaaatcatggacaaggctcttgaaaaattcggaaacgatattgcaattgcgtttagtggagctgaagacgttgctcttattgagtatgctcatttaacaggaagaccttacagagtattcagcttagacacagggaggttgaatcccgaaacatacagactcttcgacaccgtggagaaacactacggtattcgaatcgagtacatgtttcccgacgcagttgaggttcaagctttggttagaaacaaaggtctgttctctttctacgaagacggtcaccaagagtgttgccgtatcagaaaagtgagaccgttgaggcgtgctttaaaaggtttacgcgcttggatcaccggacaaagaaaagatcaatcaccagggacaagatcagagatccctgtggttcaggttgatccagttttcgaaggactagacggtggagctggtagcttggtgaagtggaaccccgttgcgaacgtagaagggaacgatgtttggaacttcttgaggactatggatgttcccgtcaacacgctgcacgctgcggggtatgtttccatagggtgcgagccttgcacgagagcggttttacccggccagcacgagagggaagggaggtggtggtgggaagacgctaaggcgaaagagtgtgggcttcacaaagggaacatcaaagagagtagcaacggaaacaacgcagcggttaatggcaatgggacaacgtcaacggtcgatgatattttcagaagcgagaacgttgtgagtttgagcaggcaagggattgagaatctgatgaagctggagaacaggaaggaggcgtggatcgttgtgctttacgcgccttggtgcccgttttgccaagcgatggaggcttcttttgatgagttggcggataagttgaagggaggagatggcgtgaaggtggctaagtttagagctgatggtgagcaaaaggagtttgctaaaagtgagttgcagctagggagctttccgacaatacttgtgttcccaaagaactcttcaagacctatcaagtatccttctgagaagagggatgttgattctttgacatctttcttgaatcttgttaggtaaaactgttgaaaatccgtcgactttacgatgagaaagagatgagttaaaagaaccattcagtcttgttccagaatgctagaacagatggagatcctctactgaatgtatagttgtggttaaaatgtttgcttttgtgcttataattttattttaccaaacttctcagttttgtactatgtttgcttatgtgatcgtgtaaacaagttttccaacatggttttaatattggagtgtaatagaatgtaaaaaaaaggtttctaaatattataaatccaaaaca

SEQ ID NO: 8596 - DNA, 1698 bp, Raphanus sativus
  misc_feature (546)..(546): n is a, c, g, or t
  misc_feature (648)..(648): n is a, c, g, or t
  misc_feature (687)..(687): n is a, c, g, or t
  misc_feature (732)..(732): n is a, c, g, or t
  misc_feature (788)..(788): n is a, c, g, or t
  misc_feature (791)..(791): n is a, c, g, or t
  misc_feature (803)..(803): n is a, c, g, or t
  misc_feature (1076)..(1076): n is a, c, g, or t
  misc_feature (1091)..(1091): n is a, c, g, or t
  misc_feature (1096)..(1097): n is a, c, g, or t
  misc_feature (1108)..(1108): n is a, c, g, or t
  misc_feature (1117)..(1117): n is a, c, g, or t
  misc_feature (1181)..(1181): n is a, c, g, or t
  misc_feature (1250)..(1250): n is a, c, g, or t
  misc_feature (1277)..(1277): n is a, c, g, or t
  misc_feature (1317)..(1317): n is a, c, g, or t
  misc_feature (1343)..(1343): n is a, c, g, or t
  misc_feature (1391)..(1391): n is a, c, g, or t
  misc_feature (1668)..(1668): n is a, c, g, or t
  misc_feature (1683)..(1685): n is a, c, g, or t
  misc_feature (1687)..(1687): n is a, c, g, or t
  misc_feature (1689)..(1691): n is a, c, g, or t
ggaaaccaaacaaacaaacacttagatcgtacaattgtctgaagaaaaaaaacataaaaatttgtttatttgtttttgtgtgaaatggcactagcaatcaacgtttcttcatcgtcttctccgatctcaacctctagcttcccttcttcagacctcaaaactccacaaatcggttcgttgaggttatcggatcgaatcaatgtctcatcagcgtctatgagtctatcctccgggaaacgatcctccgtaaaatctctgaacgtgcagtcgatcacaaaggaagccatggttgcttctgaggttactacagagaaagaagtagatgtggtggaagtggaagactttgaggagctagcaaagaagctagagactgcttctcctcttgaaatcatggacaaggctcttgaaaaattcggaaacgacattgcaattgcctttagtggagctgaagatgttgctctgatcgagtatgctcatttaacaggaagaccgtacagggtattcagtttagacacagggagattgaatcccgaaacgtacagactnttcgacacggtggagaaacactacggtattcgaatagagtacatgttccccgatgctgtcgaggtacaagctttggttagaaacaaaggtttgttctctttntacgaagacggtcaccaggagtgttgccgtatcagaaangtgagaccgttgaggcgtgctttgaaaggtttacgcgcttggatnaccggacagagaaaaatcaatcgccgggaacgaggtcggagatccccgtcgttcangtngatccggtgttngaaggactagagggtggagctggtagtttggtgaagtggaaccccgttgcgaacgtggaagggaacgatgtttggagcttcttgaggacgatggatgttccggtcaacacgctgcatgctgcggggtatttttcgatagggtgtgagccttgcacgagggcggttttgccaggtcagcacgagagggaagggaggtggtggtgagaggacgctaaggccaaagagtgtggacttcacaaagggaacatcaaagagagtagcgagacagctaangtcaatggaacaacngtcgnngatattttcanaagcgagantgttgtgagcttgagcaggcaagggattgagaatctgatgaagctggagaaccgtaaagaggcntggatcgttgtgctttacgcgccttggtgcccgttttgccaagcgatggaggcttcgttcgatgagttngcggataagttgaggggaggagatggngtgaaggtggctaagtttagagctgatggtgaccagaagnagtttgctaaaagcgagttgcagctngggagctttccgacgatacttgtgttcccgaagaactcttcgagaccnatcaagtatccatctgagaagagagatgttgattctttgacatctttcttgaatcttgttaggtgagaatcagtcgacttcactgatgtgaaagagatgagttaaaagaaccattcagtcttgttccagaatgctagaacagatgaagatcatgtgatcctctaatgaatgtttaattgtggttaaaatgtttgcttttgtgcttatatttttgtttaccaaacttctcagttttgtactctgtttgcttatatgattatgtaaacaagttttccancatggctttaatatnnnantnnnggagtga

SEQ ID NO: 8597 - DNA, 1687 bp, Eutrema parvulum
ggaaaagaaaaagaaaaaaagatcgaacagatcaaatcctagagagcaaaaactgttttcaatttgaaatctttctgttaaagatggcaatggcagcaacagtttcttcttcatcttcttctgggatcacgagcttctcacgaatttcttcagagcccaaagtgtcgcaaatcggttcattgaggttattggatcgtgttaatgtcactccgatgtctctgaatctatctgggaagcgatcttctgtgaaacctttaaacgcagagccaaagacaaaagactctatgattcctcttgcagcaacaatggtagcagaaactgcagaggaagtagaagtagtagagattgaggatttcgaagaacttgcaaagaagctagagaatgcttcacctcttgagattatggataaagccctcgagaaattcgggaacgatatcgccatcgcatttagtggcgcagaagatgttgctctaattgagtatgcgcatttaactgggagaccattcagagtatttagcttggatacagggagattaaaccctgagacatataggtttttcgatgcggtagagaaacactatgggattagaattgagtatatgtttcctgattctgttgaggttcaaggcttagttaggaacaagggattgttctctttctacgaggatggtcaccaagagtgttgccgtgtacgaaaggtgagacctttgaggcgtgcgctcaagggtttaagagcttggatcactggtcagaggaaagatcaatctcctggaacaaggtctgagattccaattgttcaggttgatccggttttcgaaggcttggatggtggagctggtagtttagtgaagtggaatccggttgctaatgttgaaggcaatgatgtttggaacttcttgatgaccatggatgttccggtcaacacattgcacgcggcagggtatgtttcgatcggttgtgagccgtgcacgagagcggttttaccgggacagcacgagagagaagggagatggtggtgggaagatgcaaaggctaaggagtgtggacttcacaaagggaatatcaaggatgaagctaaagggaatgttgtaaatggagaatcgaaatctgctgttgttgaggatattttcaagagtgagagtcttgtgactttgagcaggcaagggattgagaatctgatgaagttggagaacagaaaagagccttggatcgttgtgctttatgctccgtggtgtcccttttgtcaagccatggaagcatcgtacgatgaattggcggataaattggcgggaagtggggttaaggttgcgaaattcagagcagatggtgaccagaaggagtttgctaagcaggaattgcagctcggtagcttcccgaccatactcgtcttccccaagaactcttcaagaccgatcaagtatccgtctgagaagagagacgttgattctttggcttcgttcttgaatcttgtccggtaaataaaccgcgaaacctgtcgacatttcctcatgagaaagagagatcaaataagaaccatttcatctcgttccagattgctagaacagatagaaattggtgaagttggtattggagaatcatttcacagctttaggtcatagagttggagataagctctgcaacaaagcttgagtatttgcagtattgtaatattcttaaagctgtaaaa

SEQ ID NO: 8598 - DNA, 1769 bp, Eutrema halophilum
gaaaagaaaaagaaaaaaaaaacgatcgaacagatcaaatcctagagagcaaaaactgttttcaatttgaaatctttctgttaaagatggcaatggcagcaacagtttcttcttcatcttcttctgggatcacgagcttctcacgaatttcttcagagcccaaagtgtcgcaaatcggttcattgaggttattggatcgtgttaatgtcactccgatgtctctgaatctatctgggaagcgatcttctgtgaaacctttaaacgcagagccaaagacaaaagactctatgattcctcttgcagcaacaatggtagcagaaactgcagaggaagtagaagtagtagagattgaggatttcgaagaacttgcaaagaagctagagaatgcttcacctcttgagattatggataaagcccttgagaaattcgggaacgatatcgccatcgcatttagtggtgcagaagatgttgctctgattgagtatgcgcatttaactgggagaccattcagagtatttagcttggatacagggagattaaaccctgagacatataggtttttcgatgcggtagagaaacactatgggattagaattgagtatatgtttcctgattctgttgaggttcaaggcttagttaggaacaagggattgttctctttctacgaggatggtcaccaagagtgttgccgtgtacgaaaggtgagacctttgaggcgtgcgctcaagggtttaagagcttggatcactggtcagaggaaagatcaatctcctggaacaaggtctgagattccaattgttcaggttgatccggttttcgaaggcttggatggtggagctggtagtttagtgaagtggaatccggttgctaatgttgaaggcaatgatgtttggaacttcttgatgaccatggatgttccggtcaacacattgcacgcggcagggtatgtttcgatcggttgtgagccgtgcacgagagcggttttaccgggacagcacgagagagaagggagatggtggtgggaagatgcaaaggctaaggagtgtggacttcacaaagggaatatcaaggatgaagctaaagggaatgttgtaaatggagaatcgaaatctgctgttgttgaggatattttcaagagtgagagtcttgtgactttgagcaggcaagggattgagaatctgatgaagttggagaacagaaaagagccttggatcgttgtgctttatgctccgtggtgtcccttttgtcaagccatggaagcatcgtacgatgaattggcggataaattggcgggaagtggggttaaggttgcgaaattcagagcagatggtgaccagaaggagtttgctaagcaggaattgcagctcggtagcttcccgaccatactcgtcttccccaagaactcttcaagaccgatcaagtatccgtctgagaagagagacgttgattctttggcttcgttcttgaatcttgtccggtaaataaaccgcgaaacctgtcgacatttcctcatgagaaagagagatcaaataagaaccatttcatctcgttccagattgctagaacagatagaaattggtgaagttggtattggagaatcatttcacagctttaggtcatagagttggagataagctctgcaacaaagcttgagtatttgcagtattgtaatattcttaaagttgcaaaaaaaaaaaaaagttcatgtaactttatggttattagtgaaagaaagctcctgtttcttctttgcaatcttatcaaaacag

SEQ ID NO: 8599 - DNA, 1846 bp, Eutrema halophilum
gaaaagaaaaagaaaaaaaaaacgatcgaacagatcaaatcctagagagcaaaaactgttttcaatttgaaatctttctgttaaagatggcaatggcagcaacagtttcttcttcatcttcttctgggatcacgagcttctcacgaatttcttcagagcccaaagtgtcgcaaatcggttcattgaggttattggatcgtgttaatgtcactccgatgtctctgaatctatctgggaagcgatcttctgtgaaacctttaaacgcagagccaaagacaaaagactctatgattcctcttgcagcaacaatggtagcagaaactgcagaggaagtagaagtagtagagattgaggatttcgaagaacttgcaaagaagctagagaatgcttcacctcttgagattatggataaagcccttgagaaattcgggaacgatatcgccatcgcatttagtggtgcagaagatgttgctctgattgagtatgcgcatttaactgggagaccattcagagtatttagcttggatacagggagattaaaccctgagacatataggtttttcgatgcggtagagaaacactatgggattagaattgagtatatgtttcctgattctgttgaggttcaaggcttagttaggaacaagggattgttctctttctacgaggatggtcaccaagagtgttgccgtgtacgaaaggtgagacctttgaggcgtgcgctcaagggtttaagagcttggatcactggtcagaggaaagatcaatctcctggaacaaggtctgagattccaattgttcaggttgatccggttttcgaaggcttggatggtggagctggtagtttagtgaagtggaatccggttgctaatgttgaaggcaatgatgtttggaacttcttgatgaccatggatgttccggtcaacacattgcacgcggcagggtatgtttcgatcggttgtgagccgtgcacgagagcggttttaccgggacagcacgagagagaagggagatggtggtgggaagatgcaaaggctaaggagtgtggacttcacaaagggaatatcaaggatgaagctaaagggaatgttgtaaatggagaatcgaaatctgctgttgttgaggatattttcaagagtgagagtcttgtgactttgagcaggcaagggattgagaatctgatgaagttggagaacagaaaagagccttggatcgttgtgctttatgctccgtggtgtcccttttgtcaagccatggaagcatcgtacgatgaattggcggataaattggcgggaagtggggttaaggttgcgaaattcagagcagatggtgaccagaaggagtttgctaagcaggaattgcagctcggtagcttcccgaccatactcgtcttccccaagaactcttcaagaccgatcaagtatccgtctgagaagagagacgttgattctttggcttcgttcttgaatcttgtccggtaaataaaccgcgaaacctgtcgacatttcctcatgagaaagagagatcaaataagaaccatttcatctcgttccagattgctagaacagatagaaattggtgaagttggtattggagaatcatttcacagctttaggtcatagagttggagataagctctgcaacaaagcttgagtatttgcagtattgtaatattcttaaagttgcaaaaaaaaaaaaaagttcatgtaactttatggttattagtgaaagaaagctcctgtttcttctttgcaatcttatcaaaacagatgaagttttgatttttacagcattaagtcacagagttatagagatatgctcaaaagtgttcatttttttcatgtaa

SEQ ID NO: 8600 - DNA, 1747 bp, Arabidopsis lyrata
gaaaataaaaaacgaagaaacaaaacaaatcttacagaaaaaagatcgaatttttgctgtgaaaatggcaatgtctgtgaatgtttcttcttcttcttcttctgggatcataaactctggtttctctcgttccggtgcttcatcggagccaaaagtttcgcaaatcggttcgttgaggttatttgatcgtgttcatgttgctccggtgtctctgaatctatctgggaagcgatcatcatctgttaaacctttaaacgctgagccaaagacaaaggattcaatgattcctcttgctgcaacaatggtagcagaaattgcagaggaggttgaagtcgttgagattgcagagcttgcaaagaagcttgagaatgcttcacctcttgagattatggataaagctcttgagaaatacgggaaagatattgctattgcatttagtggtgcagaagatgttgctctaattgagtatgctcatttgactgggagaccatttagagtatttagtttggatacagggaggttgaatcccgagacgtatcggtttttcgatgcggtggagaaacactatgggattagaattgagtatatgtttcctgattctgttgaggttcaaggtttggttaggagcaagggattgttctctttctatgaggatggtcatcaggagtgttgccgtgttcgaaaggtgagacctttgaggcgtgctcttaagggcttaaaggcttggattactggtcagaggaaagatcagtctccaggaacgaggtctgagattccggtggttcaggttgatcctgtgtttgaaggtttggatggtggagttggtagtttggtgaagtggaatccggttgcgaatgtggaagggaatgatgtttggaatttcttgaggactatggatgttccggttaacacattgcacgcggcagggtatatatcgattggatgtgagccctgcacaaaagcggttttaccgggccagcacgagagggaagggagatggtggtgggaagatgctaaagccaaggaatgtggacttcacaaagggaatgtcaaggaaaacactgctgatgctaatgtaaacggggaatcgaaatccgctgttgcagatatctttaagagtgagaatcttgtaactttgagcaggcaagggattgagaatttgatgaagttagagaaccgtaaggagccttggatcgtcgtgctttatgctccgtggtgccccttttgtcaagccatggaagcatcgtatgatgaactggcggataaattggctggaagtgggattaaggttgcgaaattcagagcagatggtgaccagaaggattttgctaagcaggaattgcagcttggtagcttcccgaccatacttgtcttccccaagaactcatcaagaccgatcaagtatccgtctgagaagagagatgtcgattctttgacttcgttcttgaatctagtccgataaataaaccacaaaaccagtcgacatttctatgaggaataagaagtatttcttcatctcgttccagattgctagaacagatgaagttggtgtttggagaatcagttcaaagctttagatcacagagtcagagataagctctgcaacaaagcttgtgtaatggcagtattgtaagattataagttgcaatagtgttgattcttcatgtaaatgtgtggttattagtatcaagcccctgtttcttctttgcattcatttttcagtatagagctaaaaagttgatgattc

SEQ ID NO: 8601 - DNA, 1733 bp, Arabidopsis lyrata
gaaaataaaaaacgaagaaacaaaacaaatcttacagaaaaaagatcgaatttttgctgtgaaaatggcaatgtctgtgaatgtttcttcttcttcttcttctgggatcataaactctggtttctctcgttccggtgcttcatcggagccaaaagtttcgcaaatcggttcgttgaggttatttgatcgtgttcatgttgctccggtgtctctgaatctatctgggaagcgatcatcatctgttaaacctttaaacgctgagccaaagacaaaggattcaatgattcctcttgctgcaacaatggtagcagaaattgcagaggaggttgaagtcgttgagattgcagagcttgcaaagaagcttgagaatgcttcacctcttgagattatggataaagctcttgagaaatacgggaaagatattgctattgcatttagtggtgcagaagatgttgctctaattgagtatgctcatttgactgggagaccatttagagtatttagtttggatacagggaggttgaatcccgagacgtatcggtttttcgatgcggtggagaaacactatgggattagaattgagtatatgtttcctgattctgttgaggttcaaggtttggttaggagcaagggattgttctctttctatgaggatggtcatcaggagtgttgccgtgttcgaaaggtgagacctttgaggcgtgctcttaagggcttaaaggcttggattactggtcagaggaaagatcagtctccaggaacgaggtctgagattccggtggttcaggttgatcctgtgtttgaaggtttggatggtggagttggtagtttggtgaagtggaatccggttgcgaatgtggaagggaatgatgtttggaatttcttgaggactatggatgttccggttaacacattgcacgcggcagggtatatatcgattggatgtgagccctgcacaaaagcggttttaccgggccagcacgagagggaagggagatggtggtgggaagatgctaaagccaaggaatgtggacttcacaaagggaatgtcaaggaaaacactgctgatgctaatgtaaacggggaatcgaaatccgctgttgcagatatctttaagagtgagaatcttgtaactttgagcaggcaagggattgagaatttgatgaagttagagaaccgtaaggagccttggatcgtcgtgctttatgctccgtggtgccccttttgtcaagccatggaagcatcgtatgatgaactggcggataaattggctggaagtgggattaaggttgcgaaattcagagcagatggtgaccagaaggattttgctaagcaggaattgcagcttggtagcttcccgaccatacttgtcttccccaagaactcatcaagaccgatcaagtatccgtctgagaagagagatgtcgattctttgacttcgttcttgaatctagtccgataaataaaccacaaaaccagtcgacatttctatgaggaataagaagtatttcttcatctcgttccagattgctagaacagatgaagttggtgtttggagaatcagttcaaagctttagatcacagagtcagagataagctctgcaacaaagcttgtgtaatggcagtattgtaagattataagttgcaatagtgttgattcttcatgtaaatgtgtggttattagtatcaagcccctgtttcttctttgcattcatttttcagtatagagctaa

SEQ ID NO: 8602 - DNA, 1796 bp, Eutrema parvulum
ggaaaagaaaatcaaaacaagaaagaacaaatcgaatcttagagagccaaatttgtgtttcatttttgaaatcttgctgtgaaaaaatggtaatggcagcaactgtttcttcttcttcttcatctcggattacaagctatggtttctctcgttctgggatttcttcagagtccaaagtgtcgcaaattggttcgttgagattgttggatcgtgttaatgttgttactccgatgtctctgaatctatctgggaagcgatcttctgtcaaacctttaaacgctgagccaaagtcaaaagactctatgattcctcttgcagcaacaatggtagcagaaattgcagaggaagtagaagtagtggagatagaggattttgcagaacttgcaaagaagctagagaatgcttcacctcttgagattatggataaagccctcgagaaattcgggaacgatatcgccatcgcatttagtggcgcagaagatgttgctctaattgagtatgctcatttaactgggagaccatatagggtatttagcttggacacagggagattaaaccccgagacgtatcggtttttcgatgcggtggagaaacactatgggattaggattgaatatatgtttcctgattctcttgaggttcaaggtttggttaggaacaagggattgttctctttctatgaggatggtcatcaagagtgctgccgtgttcgaaaggtgagacctttgaggcgtgctctcaagggtttaaaagcttggatcactggtcagaggaaagatcagtctccgggaacaaggtctgagattccgattgtccaggttgatccggttttcgaaggtttggatggtggagctggtagtttggtgaagtggaatccggttgccaatgttgaagggaacgatgtttggaacttcttgaggactatggatgttccggttaacacattgcatgcagcagggtatatttccatcggttgtgagccgtgcacgagagcagttttaccgggacagcacgagagagaagggagatggtggtgggaagatgctaaggccaaggagtgtggacttcacaaagggaacatcaaagaaaacggtgctgctgatgctactactggtaatgtaaacggggaaccaaagcccgttgttgcggatatctttaagagtgagaatcttgtgactttgagcaggcaagggattgagaatttgatgaagttggagaaccggagagagccttggattgttgttctttacgctccatggtgtcccttctgtcaagccatggaagcatcgtatgatgatttggcagataaattggctgcaagcggaatcaaggttgcgaaattcagagccgatggtgaccaaaaggagtttgccaagcaggaattgcagctcggtagcttcccaacaatactcgtcttccccaagaactcttcaagaccgatcaagtatccgtctgagaagagagacgttgattctttgacttcgttcttgaatcttgtccggtaaataaaccgcaaaaccagtcgacatttccatgagaaaagtagacaaataagaaccatttcatctcgttccagattgctagaatagatgaaagtcggtgtttggagaatcaatttacagcttttggtcactgttagagagataagctctgcaacaaagcttgagtttttttgtagtcttgtagtgtttcaaagctgtaaaagtgatgattttttcatgtaaatttgtggttatcagtcgatttgagctcctgcttcttctttggattcgtatcaaacgttttttgaacttgag

SEQ ID NO: 8603 - DNA, 1662 bp, Brassica napus
ccaaaatctgtctttccgattcgaagtcttgctgtgaagaaatggcaatggcagcaacagtctcttcttcagggatcacaagctctgctttctctcgttccgtgatctcttcagaacccaaagtatcacagatcggttcgttgaagttattagaccgtgttagtgtcacaactccgatgtctctgaagaagcgatcatccgtcaagcccttaaacgctgagccaaagaggaacgactctatggtccctcttgcagcaacaatggtagcacaagtcgcagaggaagtagtagaggctgaggattttgcagagcttgctaagaagctagagaatgcttcacctcttgagattatggataaagccctcgagatgttcggcaacgacatcgctattgcttttagtggtgctgaagatgttgctctgattgagtacgctcatttaactgggaggccttatagagtgtttagtttggatacagggaggttaaaccctgagacgtatcggtttttcgacgcggtggagaaacactatgggattaggattgagtacatgtttcccgactctgttgaggttcaaggcttggttaggagcaagggtttgttctctttctacgaggatggtcatcaggagtgttgccgtgtgcggaaggtgagacctttgaggcgtgcgctcaagggtttaagagcttggatcactggtcagaggaaagatcagtctcctggaacgaggtctgagattccggttgttcaggttgatccggttttcggaggtttggacggcggagctggtagcttggtgaagtggaatccggttgcgaacgttgaagggagcgatgtttggagtttcttgaggactatggatgttccggtcaacacattgcacgcggcggggtatgtttcgatagggtgtgagccgtgcacgagagcggttttgcctggtcagcacgagagggaagggaggtggtggtgggaagatgctaaggctaaggagtgtggacttcacaaagggaacatcaaggagaatgctaatgtaaacggagagtcaaaacccgttgttgaggatatctttaagagtgagaatgttgtggctttgagcaggcaggggattgagaatttggtgaagttggagaaccgtaaagagccttggatcgttgtactctatgctccgtggtgtccgttttgtcaagccatggaagcatcgtatgatgaactggctgataaactcgccggaagtggggttaaggttgccaagttcagagctgatggtgagcagaaggagtttgctaagcaggagttgcagctcggtagcttcccaacgatactggttttccccaagaactcgccaagacctatcaagtatccgtctgagaagagagacgttgattctttgacttcgttcttgaaccttgtccggtgaagaaaccacaaaatcagtcgacacttccatgagaaaaaagagatcaaacaagaaccatttcatctcgttccagattgctagaacagataaaagttgttgtccagagagtgatgatttacagcttcaggtcacatattagagagataaagctctcgaataaagcttgagtttctgcagtattgtagtgtttcaaaagctgtaaaagtgatgcttttcatgtaaattttgtggttcttagtgaaatgaa

SEQ ID NO: 8604 - DNA, 2593 bp, Brassica rapa
atctgtaaaaaaagaaagaagaagaaatcaaatctatccaaaatctgtctttccgattcgaaatcttgctgtgaagaaaatggcaatggcagcaacagtctcttcttcagggatcacaagctctgctttctctccttccgtgatctcttcagaacccaaagtatcacagatcggttcgttgaagttattagaccgtgttagtctcacaactccgatgtctctgaagaagcgatcatccgtcaagcccttaaacgctgagccaaagaggaacgactctatggttcctcttgcagcaacaatggtagcacaagtcgcagaggaagtagtagagacagaggattttgcagagcttgctgagaagctagagaatgcttcacctcttgagattatggataaagccctcgagatgttcggcaacgacatcgctattgcttttagtggtgctgaagatgttgctctgattgagtacgctcatttaactgggaggccttatagagtgtttagtttggatacagggaggttaaaccctgagacgtatcggtttttcgacgcggtggagaaacactatgggattaggattgagtacatgtttcccgactctgttgaggttcaaggcttggttaggagcaagggtttgttctctttctacgaggatggtcatcaggagtgttgccgtgtgcggaaggtgagacctttgaggcgtgcgctcaagggcttaagaggttggatcactggtcagaggaaagatcagtctcctggaaccaggtctgagattccggttgttcaggttgatccggttttcgaaggtttggacggcggagctggtagtttggtgaagtggaacccggttgcgaacgttgaagggagcgatgtttggagtttcttgaggactatggatgttccggtcaacacattgcacgcggcggggtatgtttcaatagggtgtgagccgtgcacgagagcggttttgccgggtcagcacgagagggaagggaggtggtggtgggaagatgctaaggctaaggagtgtggacttcacaaagggaacatcaaggagaatgctaatgtaaatggagagtcaaaacccgttgttgaggatatctttaagagtgagaatgttgtggctttgagcaggcaggggattgagaatttggtgaagttggagaaccgtaaagagccttggatcgttgtactctatgctccgtggtgtcccttttgtcaagccatggaagcatcgtatgatgaaatggctgataaactggctggaagtggggttaaggttgccaagttcagagctgacggtgagcagaaggagtttgctaagcaggagttgcagctcggtagcttcccaacgatactggttttccctaagaactcgtcaagaccgatcaagtatccgtctgagaagagagatgttgattctttgacttcgttcttgaaccttgttcggtaaagaaaccacaaaatcagtcgacagttccatgagaaaaaagagatcaaacaagaaccatttcatctcgttccagattgctagaacagatgaaagttgttgtccagagagtgatgatttacagcttcaggtcacatagttagagagataaagctctccaataaagcttgagtttctgcagtatggtagtgtttcaaagctgtaaaagtgatgcttttcatgtaaattttgtggttcttagtgaaatgaaactcaatgtttcttccttgcttgcattcaccatatcaaacatacttttaaattgaagttttaagaatcaaaagcagagtaaacaaaggtaaagtaatggatcatataatcagattatatcaaaccttgtgatattcaataatcagaacaaagtaaattttgtaactaatattgcaatcaaattcctgtttcttcacattcatattaaacacaaagatgtaacctcaaagttgagaatttcaggaatcagaaccatagttaaaacaaagcaagtatctgatgatacataccacactacaaagatgttacctggaagttgagtccttttctaagaatcaaagccagagtaaacaccgctctctctcaactgcctcttctcttcttcaacgtagttcttccctctactcgcttgccccaaatctctcttcttcttctccttctgcgaaaaagacagactcttcctgtcactcctcagctgcgcgtttgcaatggtctccccacctgcaaccgcagctctagtagcttctcgttctcgaaaactctctttcacttcctctgctctttgcttatccttccccgtagcccacgaccaatcagctttctccacaggaggaggcaaatctggaagaccaacggctttgtaaccatgctgctgcagagattcatagtcaaaagctttcttctctttcttcgcaaacctcgctgcatataaacaacaagacaaaggtacataagagaactcacaatgttaaaacagggaaaaacacttttttttaatgtttctacctattgtcttcttgctctttctcttcttcttatcagtctctgtagtatcagcgttagagtcagaagatgatgattcctcggatgagtcttcttcttcatcatcatcat

SEQ ID NO: 8605 - DNA, 1713 bp, Brassica napus
agggtcaaaaaaaaagaaagaagaagaaatcaaaactatccaaaatctgtctttccaattcgaaatcttgctgtgaaggaatggcaatggctgcaacagtctcttcttcagggatcacaagctgtgctttctctcgttctgtgatctcttcagaacccaaagtatcgcaaatcggttcgttgaagttattagaccgtgttagtgtcacaactccgatgcctctgaatctatctgggaagcgatcatccgtcaagcccttaaacgctgagccaaagaggaacgactctatggtccctcttgcagcaacaatggtagcacaagtcgcagaggaagtagttgagacagaggattttgcagagcttgctaagaagctagagaatgcttcacctcttcagattatggataaagccctcgagatgttcggcaacgacatcgctattgcttttagtggtgctgaggatgttgctttgattgagtacgctcatttaactgggagaccatatagagtgtttagtttggatacagggaggttaaaccctgagacgtatcggtttttcgacgcggtggagacacactatgggattaggattgagtacatgtttcccgactctgttgaggttcaaggcttggttaggagcaagggtttgttctctttctacgaggatggtcatcaggagtgttgccgtgtgcgaaaggtgagacctttgaggcgtgcgctcaagggcttaagagcttggatcactggtcagaggaaagatcagtctcctggaaccaggtctgagattccggttgttcaggttgatccagttttcgaaggtttggacggtggagctggtagcttggtgaagtggaacccggttgcgaacgttgaagggagccatgtgtggagtttcttgaggactatggatgttccggtcaacacactgcacgcggcggggtatgtttcgatagggtgcgagccgtgcacgagagcggtttttcctggccagcacgagagagaagggagatggtggtgggaagatgctaaggctaaggagtgtggacttcacaaagggaacatcaaggagaatgctaatgtaaacggagagtcaaaacccattgttgaggatatctttaagagtgagaatcttgtggctctgagcaggcaagggattgataatttggtgaagttggagaaccgtaaagagccttggatcgttgtgctttatgctccgtggtgtccgttttgtcaagccatggaagcatcgtatgatgaactggctgataaactggctggaagtggggttaaggttgccaagttcagagctgatggtgagcagaaggagtttgctaagcaggagttgcagctcggtagcttcccgacgatactggttttccctaagaactctacaggaccaatcaagtatccgtctgagaagagagacgttgattctttgacttcgttcttgaatcttgtccggtaaagaaaccgcaaaactagtcgacacttccatgagaacagagagatcaaacaagaaccatttcatctcgttccagattgctagaacagatgaaagctcgtgtccagagagtgatgatttacagcttcaggtcacatagttagagagatataagctctcgaataaagcttgagtttatgcagtattgtagtgtttcaaagctgtaaaagtgatgcttttcatgtaaattttgtggtttttagtgaaatgaaac

SEQ ID NO: 8606 - DNA, 546 bp, Solanum tuberosum
cccctttctgtttcctcaatcaaaatttcatccaactaacaaaaaccagtattattcattgaattgcattcattttaatattttgattgatcgaagatgccgatgcgaccaacaggcggattgaaacaagattgggatccaatcgtgctgcacaagccgaagatgaaggcacaagacctgaaggatccgaaagttgtgaatcaggcattgcgagctggagcacaagttcaaacggtgaagaaattcgacggtggattgaacaagaaggcggcgacggcggctgttaatgtaaagaagctagatgaggcggcggaaccagcggcacttgagaaagtgacagtggatgtgaggcaagcgatacagaaagcgaggattgagaagaagatgagccaagctgatctagcgaagaagattaatgaaaggacgcaagttgttgcggagtatgagaatggtaaggcagtgcctaatcaacttgtgttggggaaaatggagaaagtgcttggtgttaaacttagaggtaaaattcacaagtcatgaaaattatag

SEQ ID NO: 8607 - DNA, 866 bp, Solanum phureja
gaaccttccatacaccctttgttatccacattttaccagaactttccagattctctcctctatatataagagcctcctctcccccctttttgtttcctcaatcaaaatttcatccaactaacaaaaaccagtattaattcattgaattgcattcattttaatattttgattgatcgaagatgccgatgcgaccaacaggcggattgaaacaagattgggatccaatcgtgctgcccaagccgaagatgaaggcacaagacctgaaggatccgaaagttgtgaatcaggcattgcgagctggagcacaagttcaaacggtgaagaaattcgacggtggattgaacaagaaggcggcgacggcggctgttaatgtaaagaagctagatgaggcggcggaaccagcggcacttgagaaagtgacagtggatgtgaggcaagcgatacagaaagcgaggattgagaagaagatgagccaagctgatctagcgaagaagattaatgaaaggacgcaagttgttgcggagtatgagaatggtaaggcagtgcctaatcaacttgtgttggggaaaatggagaaagtgcttggtgttaaacttagaggtaaaattcataagtcatgaaaagtatagtttaatttgtgtggaaatggaaaggctatagttgttccttgtatagatgtgaaggatctcagtgttttctaatttgtttttagaaaattaatagtgatatgatatttttagattgtgttgttgctcccagataactacacaagaaaatgttgtcctataatgcaaataataaaatgataaaaaatatgtgactattattccacaatcgtgatctcatctatatgaatagcatactca

SEQ ID NO: 8608 - DNA, 797 bp, Solanum melongena
aggacaagttcaagttgactccccgccaaagagaaccttccagacacccttcgtttatcaacatttcaccagaaccttccagatttccgatctactatataaatcttcctcttccccttctcctccccaatccatagatcatttttcagtttcaactaacaaaaataattgatcgaagatgccgatgcgaccaactggtggtttcaagcaagagtgggatccgatcgtgctccagaagccgaagacgaaggcacaagacctgagagatccgaaagctgtgaaccaggcattgcaaaccggagctcaggttcaaacagtgaagaaattcgacggcggtttgaataaaaaaccggcaacggctgttaatgctaggaagctagatgaggcggcggaaccggcggcgcttgagaaagtaccggtggatgtgagacaagcgatacaaaaagcgaggattgagaagaagatgagtcaagctgatttagcgaagaagataaatgaacgaacgcaggttgttgcggagtatgagaatggtaaggcggtgcctaatcaacttgtgttggggaaaatggcgaaagtgcttggtgttaaacttagaggtaaaaatcataagtgagttaattaagagtgtttgatttgtatagatttctaaggatttcaggttctaattagttaatcatccataactttttgaagttatggctatggctatggctatgtaaaaaggaaaaatctggtgtttgtgttgtgtgttcatgatgttaatcgttctcttcttcaatggcatgttcgttttttct

SEQ ID NO: 8609 - DNA, 690 bp, Nicotiana benthamiana
aattggaaattcaactagaaaaacaaattttcataaccaccaattatattcgtttaattgaagatgccggtccgaccaactggaggaatgaaacaagagtgggagccagtcgtgctccacaagccaaagaaagcacaagacctgagggatccaaaggttgtaaaccaggcattgcgaaccggagcacaggttcaaacggtgaagaaattcgacgccggtttgaataagaaagcgactgctacttccgctgtcgttaatgttagaaagctggatgaggcggccgaaccggcggcgcttgagaaagtacctgtggaggtgaggcaagctatacaaaaggcgaggattgagaagaagattagccaagctgagttggcgaaacagatcaatgaacggccacaggttgttgcagagtatgagaatggtaaggccgttcccaatcaagtggtgttggccaaaatggagaagatccttggtgttaaacttagaggtaaaattcacaagtgaaagtgtgtcatgtgtgtgtgagattgggaagttgatcgccgttgtattgttaataacttgtggtttctcctggatttcgtgttctgatctgataatcgtcttgtaactgtttagaagctgtggctatgtaaaaaatatagtgtaatgtgttcattttactgaaaaatggtagtactcttgtttcaa

SEQ ID NO: 8610 - DNA, 666 bp, Nicotiana tabacum
  misc_feature (56)..(56): n is a, c, g, or t
  misc_feature (108)..(108): n is a, c, g, or t
  misc_feature (582)..(582): n is a, c, g, or t
aacttccattagcatcgattatactcatttaattgaagatgccggtccgaccaacnggaggaatgaaacaagagtgggagccagtcgtgctccacaagccaaagaaancacaagacctgagggatccaaagattgtaaatcaggcattgcgaaccggagtacaggttcaaacggtgaagaaattcgacgccggtttgaataagaagacgactgccgcttccgctgctgctaatgttagaaagctagatgaggcggcggaaccggcggcgcttgagaaagtaccggtggaggtgaggcaagctatacaaaaggcgaggattgagaagaagatgagccaatctgatttggcgaaacagatcaatgaacggccgcaggttgttgcagagtacgagaatggaaaggccgttcctaatcaaacggtgttggctaaaatggagaagatccttggtgttaaacttagaggtaaaattcacaagtgagtgtttgtatgagattgcaaagttcctggttgtattgttaataacttgtggattctccaggatttcgtgttctgatctgattaatcgtcttgtaactgtttanaagctgtggctatgtaaaaaaattatagtgtcatgtgttcatcttagtgaaaaatggtagatactctgtttcagcggccgcatg

SEQ ID NO: 8611 - DNA, 1691 bp, Nicotiana benthamiana
gccttatccactgtttttttaacctcaattatttgcccccacacacactaagctgtggcgcctctccgcagcatcttacaaccaaactgcacatgtttttatagggtttcctctaaggtaaccttaactcaccactcaaacagctttcttctctcttttctttgcggtttcttcaactaaaaaatatgccttcacttcttcaaatattccttcctttgtttccattctttttctttatttctttctcagtttctcatggaccctttttgcctaaggccattattcttcctgtaaacaaagatctgtccacttttcagtatgttactcaagtttacatgggtgctcatcttgttcctaccaatttagttgtagatcttggaggttcatttctctggactaattgtggcttaacttctgtatcttcaattcagaaacttgtcccctgtaattcactcaagtgctcaatggctaaacctaatggttgcactaacaagatctgtggagtacaatcagaaaatcctttcacaaaagtggctgcaacaggggaattagtagagggcatgtttgctgtggaattcatagatgagttaaaaacaggttcaattgcttcaatacatgaattcttgttttcttgtgcatcaactactttgttacaaggccttgctagatgtgccaaaggaatgttaggacttggaaattcaagaattgcattgccatctcagttgtctgatacatttggtttccagaggaaatttgctctctgtttatcttcttcaaatggtgctataatatctggtgaaagtccttacttgtcacttttgggtcaggatgtttcaagatctatgctttacacacctttgatttcatctaaaaatggtgcttcagaagagtactacatcaatgttaaatccatcaaaattaatggcaagaaactgtctttaaatacatctttgtttacaatggatgaagaaggtgttggagggacaaagattagtacaatttccccttttactaccatgaaaacctcaatttataagacatttattgaagcttatgaaaaaattgctatttccatgaatttgactaaagtggtatccatagcaccatttgagctttgctttagcacagaggggatagatgtcacaaaagtggggccaaacgtgccaattatggatcttgtgttgcaaagtgaaatggttaagtggaggatttatgggagaaattcaatggtgaaagtaagtgatgaagtcatgtgtttgggatatttggatggaggggtcaatcaaaaggcttcaattgttatagggggttaccagttggagaataatctttttgagtttaacttgggaacttctatgcttggatttacttcttcactgtctacagcagaaacaagctgttctgacttcatgctccattctatatcgaaagattcagcttttgattcttgacaccaaattcttaacccaagattttgaattgtggatcaattcccctttgtatagttgtctaagaacatgtattggctcctatacataagcatgacttggccaatcttaggatatataactagtttattggtgagaaagagactcttgggttttggttatgacttatgagtgttttttgactcccttttgagaaaattttgatatgtaacatctatttttcaagttcctgattaagtaatg

SEQ ID NO: 8612 - DNA, 1516 bp, Capsicum annuum
tctttttcttgatttctttctgtgtttctcatggaccctttttaccaaaagccataattctccctgtaaacaaagatcccttcactttccaatatgtgacacaagtctacatgggcactcatcttgcccccataaagttagttgtaaatcttggtggttcatttctttgggctgattgtggcttaacaagtcaaaaacttgtaccttgtaattcactaaaatgctctatgactaagcctaatggttgcactaacaagatttgtggtgtgcaacaagaaaatccctttacaaaagtggctacaacagggcaattagcagaggacaattttgctgtggaatttatagatgagttaaaaacaggttcaattgcttcaattcatcaattcttgttttcttgtgcatcaactagtttgttacaaggacttgctagaggtgctaaaggtatgttaggccttggaaattcaagaattgcattgccatctcagttgtctgatgcatttggttttcagaggaaatttgctctttgtttatctgattcaaatggtgctataatttctggtgaaagtccttatttgtcacttttgggtcatgatgtttcaagatccatgctttacacacctttgatttcctccaaagatggtgtgcagagagtatacattaatgttaaatccatcaagattagtggcaagaaattgtctttgaacatatctttgtttacaatggatgaagaaggtcatggagggacaaagattagcacaatttccccttttacaactctgaagagttcaatttatgagaaatttgttgaggcatatgaaagatttggtatttctatgggattgattaaggtagagcccgtagcaccatttgggctttgctttagcgcaaagggggtagatttgacaaaagtaggaccgaatgtgccaactattgatctagtattgcaaagcgagatggttaagtggaggatatatgggagaaattcaatggtgaaggtaaatgatgaagtgatgtgtttgggaatcttggatggaggggtgaatcaaaaagcatcaattgttatagggggtcatcaattggaggataatctattggagtttaacttggggatttctatgcttggatttacttcttcattatcaatgtcagaaacaagttgttctgacttcatgttctcaaaggatgaagcttttgattcttgacttggacttggacaaaatccttaacccaagattttgaatgctagattccaacttgtatagttgtcttaagaacatgtattggctcttttatataatcatgacttggccaatcatagaatattagagtactagtttattgtgagagtactctttattgtgaggagagattgttggttctggttgagtgagtgtttcttgactcactttgagtcgtcccaaagctaggaggcattctggcggacgcatccgtgagaaagttttgatatgtaagaactgatttttaacttccagattaaagaatgtatttattctaa

SEQ ID NO: 8613 - DNA, 996 bp, Solanum phureja
aataacacacacgctaaaatatggcttctttcttctgttcaaccaagttccttctactcctattttttgtatctgcaattccaatcgcctttattatccatctagaaacttcttctccgacgactcacgtttaccattatcacagtaccggctggttacgtgagtgttctaaatgggacgatgctaaccgccggttcattgtcagtttttttgaaggcggtttgggtgtgattccggttgaggccgattattctcccggcgacgtgctacaggaaattccggtagtgaaagacgctgatttgaccggtaatgcgtcgctcggttttactatagaccgggaaaggaaccgggttttagtcgccgtcgctgatgtgttggggaatcggtatagcgctttggctgcctatgatttgacgtcgtggaaccgggtttttctcaccaaacttagcggtccagaggatgaaaaagcatttgcggatgatgtggtagttgatacagaggggaatgcatacataacagatgccaaagcagacaagatatggaaggtaggcgcgaatggtgaacttaaatatacaatcaagaacccaatatttactcctaaagagtggtacaataaactggttgggctaaacggaatagtgtatcatccaaacggatacttactggtggttcatacattctctggcaatttgttcaagattgaaatcgccaagggtgatgaagttaaactagtaaagattgacaatggatcgttgaaatttggcgatggcatggagttactgtcgccaaccaagcttgttgtggctggaaatccgacaagactagttgagagctctgatgattgggagagtggcactattgtggggaaggccaaaggcgctattcatcgtttaagtacagcagcaactgtgaaggaagggactgtttatcttaatcatatgattggtttgggatatcctaggaagaaacatgttcttgttgaggctgttttttctg

SEQ ID NO: 8614 - DNA, 1155 bp, Solanum tuberosum
gtggcttctttcttctgttcaaccaagttccttctactcctaatttttgtatctgcaattccaatcgcctttattatccatctagaaacttcctctccgacgactcacgtttaccattatcacagtaccggctggttacgtgagtgttctaaatgggacgatgctaaccgccggttcattgtcagttttttcgaaggcggtttgggtgtgattccggttgaggccgattattctcccggcgacgtgctacaggaaattccggtagtgaaagacgctgatttgaccggtaatgcgtcgctcggttttactatagaccgggaaaggaaccgggttatagtcgccgtcgctgatgtgttggggaatcggtatagcgctttggctgcctatgatttgacgtcgtggaaccggatttttctcaccaaacttagcggtccagaggatgaaaaagcatttgcggatgatgtggtagttgatacagaggggaatgcatacataacagatgccaaagcagacaagatatggaaggtaggcgcgaatggtgaacttaaatatacaatcaagaacccaatatttactcctaaagagtggtacaataaactggttgggctaaacggaatagtgtatcatccaaacggatacttactggtggttcatacattctctggcaatttgttcaagattgaaatcgccaagggtgatgaagttaaactagtaaagattgacaatggatcgttgaaatttggcgatggcatggagttactgtcgccaaccaagcttgttgtggctggaaatccgacaagactagttgagagctctgatgattgggagagtggcactattgtggggaaggccaaaggcgctattcatcgtttaagtacagcagcaactgtgaaggaagggactgtttatcttaatcatatgattggtttgggatatcctaggaagaaacatgttcttgttgaggctgttttttctgcttaattatggcgtgtaagagtcaattttatacttgattaccacactactgatttatgttcctcataaagaacagtcagtcgtatcgtaagatatacagtatttattttgtaatgcatcacgcagttgcagtatttggatgtattttgctcttttaccatcaaggaatgcaagcagttc

SEQ ID NO: 8615 - DNA, 1098 bp, Solanum melongena
ctctctctcgattccaaaaaattaataaacactaaagcatggcttcttttttctgttcaaccaacttctttctactcctattttttctatctgcaattcctatcgcctttatcatccatctagaaacttccgcccccaaaacccacgtttaccattaccacagtaccggctggttacgtgagtgttctaaatgggacgatgtgaaccgccggttcatcgtcagtttcttcgagggcggtttgggtgtgattccggtcgacgccgattattctccgggcgatgtgctacaggaaattccggtggtgaaagacgctgatttgatcggtaatgcatcgctcggttttaccatagaccgggaaaggaaccgagttttggtcgccatcgctgatgtgtttgggaatcggtatagcgctttggctgcctatgatttgacgtcgtggaaccggatttttctcaccaaacttaatggtccagaggatgagaaagcatttgcagatgatgtggtagtcgatacagaggggaatgcatacataacagatgccaaagcaaacaagatatggaaggtgggcgcgaatggtgaacttaaatatacaatcaggaacccaatatttactcctaaagagtggtacaataaactggttgggctaaacggaatagtatatcatccaaatggatacttactggtggttcatacattctctggcaatttgtacaagattgaaattgccaaaggtgatgaagttaagctagtgaagattaataatggatcgttaaaatttggcgatgggatggagttactgtctccgaccaagctcgtggttgctggaaatcctacaaaactagttgagagctttgatgattgggagagtggcactattgtggggaaggctacaggggctattcatcgattaagtacagcagcaactgtgaaggaaggagctgtttatattaatcatatgattggtttggggtatcctagtaaaaaacatgttcttgttgaggctgttttttttgcttaattgtagtttcatccatcctttttaatttgtgtgtaagagaatacattatttgctttgttataaatcacgcagttgcaag

SEQ ID NO: 8616 - DNA, 1862 bp, Solanum tuberosum
gaaagagctctatattccggccatctcctcccggcggtacagtacgactccggcgtcggcagaagaagtgactctcttacgcggcctctgtaaggaatgccgggtccaacaatggaatcagaatttccagtggagccacaatcgctgaagaagctaagcttcaagtcccttaaacgatctcttgacctattttcacctctccatggccatttccctcttcctgatcctgaaagcaagaaaattcgaacgagctttaagctaaatgtcgagtatggagggataaaaggctcagcggctgaaccgtcttctaatgctaaagcgggtgtgcagaatcaagctcaaccagcttctgcaccctccaatgcccttgctcttccaggtcctgaaaatacaagagacgagagaaccggaaatgaactggctcttggtccatccataccagcaaatggcccgactgatgttaggttctcagggaaaagcaatgctgttgttccttctcacggttcatctgaaagaaatctgtcaactgctgcaatcatggaaagaataccaagcagatggcctcgtccaatatggcgtgctccctggaaaaattaccgggttatcagtggccatttgggatgggtgcggtctgtcgcagtggatcctagtaatacttggttttgtacaggatcagcagatcgaactatcaagatatgggatttagcaagtggaagactgaagctcactttaacagggcacattgaacaagtccgaggccttgctgttagcaataaacacacatacatgttctcagctggtgatgataagctagttaaatgctgggacctggaacaaaataaggtgatccgctcctatcatggccacctcagcggtgtttattgcttggctcttcatccaaccattgacatcttgttcaccgggggtcgtgattctgtctgccgggtttgggatattcgtagcaaaatgcaaattcatgctctatctggacatgacaatactgtttgttctgtttttaccaggccgatggatccacaggttataactggctctcatgacagtaccattaagttctgggaccttagatatggtaagacaatggcaactctcacacatcacaagaaatctgttcgagctatggctcagcatcctacggaggattgttttgcttctgcatcagcagacaacataaaaaaattcagtcttccaaaaggagaatttatgcacaacatgctttcccaacagaaaaccatagtcaatgcgatggcagttaatgatgaaggtgtaatggtcactggaggtgacaatggaagcatgtggttttgggattggaaaagtggtcacaatttccagcaatctcaaactattgttcaacctgggtcactggacagtgaggctggcatttatgccctcacctacgacgcaaccggctcaaggctgatcagctgtgaagctgataagaccataaagatgtggaaagaagacgaaactgccaccccagaaactcatcctcttcactttaagcctcccaaagacattaggcgtttctagttataatcttagttcaggaagcattttagcaaaaaccctttgtaatacatacgaatcgaactttttctgtgggtcttttcggagcaagactgacccgataaaagcaccatgtccagagtagtaggtgttgattcacttgcctctttgtatccatcatttacttatgtgttcttttggtttttatttactaaaggagattgatcttaattcttattaatctttttcttcctaccaagaggctttggtcctttcgcaggagccaactctttatcctttcctaattaatctttctttttgtaacaaactattta

SEQ ID NO: 8617 - DNA, 1794 bp, Solanum phureja
gactccggcgtcggcagaagaagtgactctcttacgcggcctctgtaaggaatgccgggtccaacaatggaatcagaatttccagtggagccacaatcgctgaagaagctaagcttcaagtcccttaaacgatctcttgacctattttcacctctccatggtcatttccctcttcctgaccctgaaagcaagaaaattcgaacgagctttaagctaaatgtcgagtatggagggataaaaggctcagcggctgaaccgtcttctaatgctaaagcgggtgtgcagaatcaagctcaaccagcttctgcaccctccaatgcccttgctcttccaggtcctgaaaatacaagagacgagagaaccggaaatgaactggctcttggtccatccataccagcaaatggcccgactgatgttaggttctcagggaaaagcaatgctgttgttccttctcacggttcatctgaaagaaatctgtcaactgctgcaatcatggaaagaataccaagcagatggcctcgtccaatatggcgtgctccctggaaaaattaccgggttatcagtggccatttgggatgggtgcggtctgtcgcagtggatcctagtaatacttggttttgtacaggatcagcagatcgaactatcaagatatgggatttagcaagtggaagactgaagctcactttaacagggcacattgaacaagtccgaggccttgctgttagcaataaacacacatacatgttctcagctggtgatgataagctagttaaatgctgggacctggaacaaaataaggtgatccgctcctatcatggccacctcagcggtgtttattgcttggctcttcatccaaccattgacatcttgttcaccgggggtcgtgattctgtctgccgggtttgggatattcgtagcaaaatgcaaattcatgctctatctggacatgacaatactgtttgttctgtttttaccaggccgatggatccacaggttataactggctctcatgacagtaccattaagttctgggaccttagatatggtaagacaatggcaactctcacacatcacaagaaatctgttcgagctatggctcagcatcctacggaggattgttttgcttctgcatcagcagacaacataaaaaaattcagtcttccaaaaggagaatttatgcacaacatgctttcccaacagaaaaccatagtcaatgcgatggcagttaatgatgaaggtgtaatggtcactggaggtgacaatggaagcatgtggttttgggattggaaaagtggtcacaatttccagcaatctcaaactattgttcaacctgggtcactggacagtgaggctggcatttatgccctcacctacgacgcaaccggctcaaggctgatcagctgtgaagctgataagaccataaagatgtggaaagaagacgaaactgccaccccagaaactcatcctcttcactttaagcctcccaaagacattaggcgtttctagttataatcttagttcaggaagcattttagcaaaaaccctttgtaatacatacgaatcgaactttttctgtgtggtcttttcggagtaagactgacccgataaaagcaccatgtccagagtagtaggtgttgattcacttgcctctttgtatccatcatttacttatgtgttcttttggtttttatttactaaaggagattgatcttaattcttattaatctttttcttcctaccaagaggttttggttgctttcgcaggagccaactctttatcattttcctaattaa

SEQ ID NO: 8618 - DNA, 1652 bp, Nicotiana benthamiana
tttttgccccagttattagtcctgtgacacatttactgaagttccagaggttttggttccgaaggaaagagcgccctatatcccggccaacttctcccggcggcacagtactcgtccggcgtcggcaagaagaagtaataactctcttactctccctgtaaagaatgccggggcccacaacaatggaatcagaagtggcagtggaaccacaatccatcaagaagctcagcttcaaatccattaaacggtctcttgacctcttttcccctctccatggtcattttccccctcctgatcctgaaggcaagaaaattcgaacgagctataagctaaatgttgagtacggagggataaaaagcacagcagcccaccctgtttctaatgccaaagcggctgtgcagaatcaagctcaaaatgctccttctaatgcccttgctcttccaggtcctgaaaatacaagggacgagggaaccggaaatgaattggctcttggtccatccataccagcgaagggccccgctgatgtcaggttcccagggaaaggcaatgctattgttccttctcatggttcgtcagaaagaaatctgtcaactgccgcaatcatggaaagaataccaagcaaatggcctcgcccagtatggcatgctccctggaaaaactacagggttatcagtggccatttgggatgggtgcgatcagtcgcggtggatcctagtaacacatggttctgtactggatcggcagatcgcactatcaagatatgggatttagcaagtggaagattgaagctcactttaacagggcacattgaacaagttcggggccttgctgttagcaacaaacacacatacatgttctcagctggtgatgataagctagttaaatgctgggacctggaacaaaataaggttatccgctcctatcatggccatctcagtggtgtttattgcttggctcttcatccaaccattgacatcttgttcactgggggtcgtgattctgtctgtcgggtttgggatattcgtagcaaaatgcaaattcatgctctgtctggacatgataacactgtttgttctgtttttaccaggccaatggatccgcaggttataactggctctcatgacagtaccattaagttctgggaccttagatatggtaagacaatggcaaccctcacacatcacaagaaatctgttcgagctatggctcagcatcctacggaggattgttttgcttctgcatcagcagacaacataaaaaaattcaaccttccaaaaggagaatttttgcataacatgctctcccaacagaaaaccatagttaatgcgatggcggtcaatgatgatggcgtaatggccacaggaggtgataatggaagcatgtggttttgggattggataagtggtcacaatttccagcaatctcaaactattgttcaacctggatcactggacagtgaagcaggcatctacgctctcacctacgatatgactggctcaaggctgattagttgtgaagctgataagaccatcaagatgtggaaagaagatgaaactgccacaccagaaactcatcctcttcattttaagcctccaaaagacattaggcgtttctagttacaattgcagttcagaaagcgtttactgctattc

SEQ ID NO: 8619 - DNA, 1981 bp, Nicotiana benthamiana
gctccagttattagtcctgtgaaacatttactgaagttccagaggttttggttccgaaggaaagagcgccctatatcccggccaccttctcccggcggcacagtactcgtccggcgtcagcaagaagaagtaataactctcttactctccctgtaaagaatgccggggcccacgacaatggagtcagaagttgtagtggaaccacaatccatcaagaagctcagcttcaaatcccttaaacggtctcttgacctcttttcccctctccatggtcattttccccctcctgatcctgaaagcaagaaaattcgaacgagctataagctaaatgttgagtacggagggataaaaagcacaacagcccaaccggtttctaatgccaaagtggctgtgcagaatcaagctcaaaatgctccttctaatgcccttgctcttccaggtcctgaaaatacaagggacgaggtaaccggaaatgaattggctcttggtccatcagtaccagcgaagggccccgctgatgtcaggttcccagggaaaagcaatgctattgttccttctcatagttcgtcagaaagaaatctgtcaactgccgcaatcatggaaagaataccaagcaaatggcctcgcccagtatggcatgctccctggaaaaactacagggttatcagtggccatttgggatgggtgcgatcagtcgcggtggatcctagtaacacatggttctgtactggatcggcagatcgcactatcaagatatgggatttagcaagtggaagattgaagctcactttaacagggcacattgagcaagttcggggccttgctgttagcaacaaacacacatacatgttctcagctggtgatgataagcaagttaaatgctgggacctggaacaaaataaggtgatccgctcctatcatggccacctcagtggtgtttattgcttagctcttcatccaaccattgacatcttgttcactgggggtcgtgattctgtctgtcgggtttgggatattcgtagcaaaatgcaaattcatgctctgtctggacatgataacactgtttgttctgtttttaccaggccaatggatccgcaggttataactggctctcatgacagtaccattaagttctgggaccttagatatggtaagacaatggcaaccctcacacatcacaagaaatctgttcgagctatggctcagcatcctacagaggattgttttgcttctgcatcagcagacaacataaaaaaattcaaccttccaaaaggagaatttatgcataacatgctctcacaacagaaaaccatagtcaatgcgatggcggtcaatgatgacggtgtaatggccaccggaggtgacaatggaagcatgtggttttgggattggagaagtggtcacagtttccagcaatctcaaactattgttcaacctggatcactggacagtgaagcaggcatctacgcgctaacctatgatatgactggctcaaggctgatcagttgtgaagctgataaaacaatcaagatgtggaaagaagatgaaactgccacaccagaaactcatccccttcattttaagcctccaaaagacacaaggcgtttctagttaccatagttcagaaagcattactgctattccatgtcggctaattattcaggttgtagttgcgctaagcgtacaaatcaaactttactcttcgggtcattcagagcaagattgacccaagaaaggcaccatgttcagagttgatgaaagtgtttattttgatttgcctctttgtatcccatcttgttatacatttatatgctgttccgtttatgtataaatagataaaagtaaaagcaaagaaaattattgggtgtttgtacaactgaagtaatttttttgagtcattttttatgtttgttataataaaatggttttgaggaaaaacattttccaataaaagatggaaagtgatttccttcacttatgg

SEQ ID NO: 8620 - DNA, 1593 bp, Amsonia hubrichtii
gccgtgtccccctccccccaaaaaacctttctactgctgcgtttcagaagccgcagcaaaagctcaacaatataggaagaactcggttgccagagtgattttgtatatagtattaggaggccagagatgcccggttcttcaatggagctggagcttccggttgagccgcagtcattgaagaagctcagcttcaaatccctaaagcgagccctcgatctcttctcgcctatccatggccactgcccccctcccgatcccgaaagcaagaagattcgtataagccacaagctaaatcttgagtatggagggataaaaggcacagacagtcactcttcctctaatgctaaatcagcagcgcaaagccaagctcagcaatcatctgccccgtccaatgcccttgcccttccaggtccagaaaattcaagagaccagcagaaagcagtctcccttgatctggttattggtccaaccgtgcaactgaagagcggaactgatactggcttctcaggcaaaagtaatgcagttgttccagctcatggttcatctgaaaggaatctttctactgctgctattatggaaaggatcccaagtaggtggccgcgtcctgtctggcatgctccctggaagaattatagggttatcagtggtcatctgggatgggtgcgatctgttgcagttgatccaagtaataattggttttgtacgggatcagcagataggactatcaagatatgggatttggcaagtggaaggctaaagctcacactaacaggtcacattgaacaagtacgaggccttgctattagcaacaaacacacatatatgttctctgcaggggatgacaaacaggtcaaatgctgggacctggaacaaaacaaggttatccggtcttatcatggtcatctaagtggtgtttattgcttggctctgcatccaactattgacatccttctcactggaggtcgtgattctgtctgccgggtttgggatattcgtagtaagatgcaaattcatgcgctctctggacatgaaaatacagtatgctcagtttttactcggccaacggatccgcaggttgtgactggatctcatgatacaaccataaaattctgggaccttagatatggtaaaactatggcaactcttacgcatcataagaaatcagtgcgagcaatggctcctcatccaaaggaggagtgctttgcttctgcatctgctgacaacattaaaaagttcaaccttccaagaggagaatttgtgcataatatgctctctcagcagaagaccatcattaatgctatgacagtcaatgaagagggtgtattggctaccgcaggtgacaatgggagtttgtggttttgggattggaagagcggtcacaatttccagcaagctcaaactattgttcaaccaggatctttggagagtgaagctggcatctatgcgctctcatatgatgtaacaggttcaagactcattacttgtgaagcagacaagacgatcaagatgtggaaagaggatgaaactgctacccctgaaactcatcctcttcatttcaagcctcctaaagatatacggcgattttagtggacc

SEQ ID NO: 8621 - DNA, 1630 bp, Tabernaemontana elegans
aaaccttcagaaagccgcagcaaaaactctgcaacagagcgagaactccatttgctagttgtgaattctagtatcaagaaggagaagcaagcggagatgcccggtcctgcaatggacccggaccttccggtggagccacagtcattgaagaagctcagcttcaaatccctaaagcgagccctcgatctcttctcgcctgtccacggccactttccccctcccgatcctgaaagcaagaagattcgtataagccacaagctaaatcttgagtacggaggggtaaaagacgcagccaggcagccttcttctagtgctaaattggcagcacaaagtcaagctcagcaatcctctgccccatccaatgcccttgcgcttccaggtccagaaaattctggagacaagcagaaagcagcctcctgtgatctggttatcggtccatccctgcaaccaaagatgggaactgattctggcttctcgggcaagagtaatgctgttgttccagctcatggttcatccgaaaggaatctttctactgctgctattatggaaaggattccaagcaagtggccgcgtcctgtctggcatcctccctggaagaattacagggtcatcagtggtcatttgggatgggtgcgatctgttgcagttgatccaagtaatacttggttttgtaccggatcagcagataggactatcaagatatgggatttggccagtggaaggctaaagctcacactaacagggcacattgaacagatacgaggccttgccattagcagcaaacacacgtatatgttttctgctggagatgacaaacaggttaaatgctgggacctggaacaaaacaaggtaatccggtcgtatcatggtcacctaagtggtgtttattgcttggctctgcatccaactatcgacatccttcttaccggaggccgtgattctgtctgccgggtttgggatattcgcagtaagatgcaaattcacgcgctctctggacatgacaatacagtttgctcggtttttacccgaccaacggatccacaggttgtgactggatctcatgatacaaccataaaattctgggaccttagacatggtaaaactatggcaactcttacgcatcataagaaatcagtgcgagcaatggctcttcatcctaaggaggagtgctttgcttctgcatctgctgacaatataaaaaggttcaaccttccaagaggagaatttctgcacaatatgctctctcagcagaaaaccatcatcaatgctatggcggtcaatgaggagggtgtattggctactgcaggtgacaatggaagtatgtggttttgggattggaatagcggtcacaattttcagcaagctcaaactatcgttcagccaggttccttggacagcgaagcaggcatctatgctctctcctacgatgtatcaggttcaaggctcattacctgtgaagcagataagaccatcaagatgtggaaggaggatgaaactgctacccctgaaacacatccccttcatttcaagccaccaaaagatatacggcgattttagcagaccttcagtcttcattctgtatctcagttcagttaactgaatgtagttgtagctcccagggtgttttcat

SEQ ID NO: 8622 - DNA, 1809 bp, Panax ginseng
agtagcccacatatctctctctcatcggaagagagatgccggggcaaacaatggagccggaactgccggtggagccacaatcactgaaaaagctcagtttcaaatccttaaagcgagctctcgatcttttttctcctcttcacgctcaattccctcctcccgaccccgaaatcaagaagatacgaatgggccataagctaaatcttgagtatgggggtatcagaagcaccacagctcagcctcctaatcatgctaactcggctgcacaacaagctttgcaagcttccactccttcaaatgctcttgctcttactggccccgaaagttatagagatccacacaaaggaggggttcacaatgaattagttcttgttccttccattaaaccaaagggccttggggatgctagttttgctggcaaaagcactacaattattcctgcgcatggttcatctgacagaaacctctcaactgcagccctcatggaaagaattccaagcagatggccacgtcctgtatggcgtcctccgtggaaaaattacagggttattagtggccacttgggctgggttagatctgttgcatttgatccaagtaatgaatggttctgtactggatccgcagatcgtacaattaagatatgggatgtaggaagtggaaggttaaggctcactctaacaggacacattgaacaagtacgaggccttgctgttagcaacaaacacacatatatgttctccgccggtgatgacaaacaagtcaaatgttgggaccttgaacagaacaaggttatcaggtcctatcatggtcatctaagtggtgtttattgcttggctcttcatcccacaattgacattctgcttactgggggtcgtgattctgtctgtcgggtgtgggatatccgcagcaagatgcaaattcatgcactctctgggcatgataacactgtttgttcagtttttactcgaccaacggatccacaggttgtaactggctcccatgacacaaccataaagttctgggaccttagatatggcaaaacaatggctactcttacacaccataagaagtctgtgcgagcaatggctcagcatcctagcgaggactgctttgcatctgcatcagctgataacgtaaaaaaattcaaccttccaagaggagagtttttgcacaacatgctctcacaacagaagaccattattaatgccatggcagtcaatgaagaaggtgtgatggttacaggaggtgataatgggagtatgtggttctgggattggaagagcgggcacaatttccaacaaagccaatccattgttcagcctggctcgttggatagtgaagctggcatctatgctacctccttcgatggaactggtacaaggcttgtgacttgtgaggcagacaagactatcaagatgtggaaagaggatgagaatgccacccctgaaacccatcccctcaacttcaagccacccaaagaaatccggaggttctaggggtattatgacttcttctcatttctcttaaatgcgcggagttttgaagctttgtaatgtgtacctgtaagttgaattctttcacgtggattcatggagagaggtatgttttagagggattgaaatgctgaagatgttgctagaaaaagtttgccagtatgttaggctctagcctacatgtttaaaacaaaaagggcaaagatgataaagttgtattctttagttatcaaacatgaaactcctaaaaaggggatagttttgtatcattatgttttattttgtgaaaatttttagtccaattataattgtgatc

SEQ ID NO: 8623 - DNA, 1985 bp, Actinidia deliciosa
  misc_feature (29)..(29): n is a, c, g, or t
  misc_feature (31)..(31): n is a, c, g, or t
  misc_feature (33)..(33): n is a, c, g, or t
  misc_feature (36)..(36): n is a, c, g, or t
  misc_feature (41)..(41): n is a, c, g, or t
  misc_feature (47)..(47): n is a, c, g, or t
  misc_feature (57)..(57): n is a, c, g, or t
  misc_feature (71)..(71): n is a, c, g, or t
  misc_feature (77)..(77): n is a, c, g, or t
  misc_feature (85)..(85): n is a, c, g, or t
  misc_feature (87)..(87): n is a, c, g, or t
  misc_feature (435)..(435): n is a, c, g, or t
  misc_feature (439)..(439): n is a, c, g, or t
  misc_feature (493)..(493): n is a, c, g, or t
  misc_feature (514)..(514): n is a, c, g, or t
  misc_feature (516)..(516): n is a, c, g, or t
  misc_feature (531)..(531): n is a, c, g, or t
  misc_feature (795)..(795): n is a, c, g, or t
  misc_feature (803)..(803): n is a, c, g, or t
  misc_feature (953)..(953): n is a, c, g, or t
  misc_feature (971)..(971): n is a, c, g, or t
  misc_feature (974)..(974): n is a, c, g, or t
  misc_feature (1429)..(1429): n is a, c, g, or t
ggcgagctctctctctctctctctccgtntntnatngagtnataagncgagtgtganttttaggagtgagnagcaangagagagnangaagatccagggccaacgctggagatggaaccagtggagccacagtcgttgaagaagctcagcttcaaatccctaaagcgctctcttgatttcttctctcctctccactcccacttccctcctcccgaccccgacagtaagaagataaggattagccacaagttcaatgctgagtatggagggataaagagtaatagtcagcctcccgctaatgccaagtcagttgctcaagatcaagcccagcaagcttctggtacttcaaacgccctagctctgccaggtcctgaaaattctaaggatccacggaatggaggggctcagactaatttaattgttggtcctactgtncaancaaagggacttgatgttgctctttctgggaaaagcactgccgttgtttctgctnctggttcctctgaaaggaatntntcaacgtcagccatnatggaaagaattccaagtaaatggccacgtcctgtatggcatccaccatggaaaaactacagggtgattagtggccatttgggatgggtgagatctattgcatttgatccaagtaatacatggttctgtactggctcagctgatcggacaatcaagatatgggatgtaggaagtggaaggctaaagctcactcttaccgggcacattgaacaagttagaggccttgccgtcagcaataaacaccatacatgttctctgctggcnatgacaancaagttaaatgctgggaccttgaacagaacaaggttatccgttcttatcatgggcatcttagtggagtttattgcttagctattcatccgactattgacattctgctcactgggggtcgtgattctgtctgccgggtctgggatattcgnagcaagatgcaaattcangcnctgtctgggcatgagaacactgtttgctcagtttttactcgacctacggatccacaagttgtaactggctctcacgattcaacaataaagttctgggacctgagatatggtaagacaatggcaactcttacgcaccataagaaactgtgcgggcactggctcaacatcctactgagaattgttttgcatcagcatcagctgacaacataaaaaaattcaaccttccaaaaggagaatttttgcacaacatgctctctcaacagaaaaccatcatcaatgcgatggcagtcaatgaagagggtgtaatggttaccggaggcgataatgggagtttatggttctgggactggaagagtgggcataatttccagcaagaccaaacaattgtacaaccaggctcgctggatagtgaagctggcatctacgctatctcctacgacgttactggttcacgnctcatcacgtgcgaggcggacaagacgatcaagatgtggaaagaggacgaaatggccacaccggaaactcaccctgtccacttcaagccacctaaggatatccgaaggttctaatagtcatctctccgaattgcgaattttcttttttaagaaaccaaaagatccataaaatgtcgttgcaaattaagtgttgaaatgcaagcgtacggtgtttagttcaacgttttaaagggaaaaaaattaggaatcgatcctcaaagacgtcatgaggaatgtctagttggctgttggatgacctaatttacttgaatatgaatattttttttgcgtactgtttgtaaggatcattggagagacaacgcgtcggttctgagacaatggttttggtctctaccctacaaatgctctagcttttgtgtagtccccagcctaattgtattcctttttaggaaggcatcattaagactggccttgacgcttcgtgtatgtgtgtgtgtgttctttttggccgattggtgttgatttcatatgcaaattctattggaaaaaaaaaaaa

SEQ ID NO: 8624 - DNA, 1851 bp, Sesamum indicum
cggcatataaaccccagcagcgattttactacccaaatcgttcgccccgctccaccccacgccggcatccgacgccgtaccgccgccctcccccgtggttggcgtttcttttcagtatacaagttactctgccgtgtcgtcaggtactgcatacacgcatatttcgaatgccaggcgcaacgatggattccgagctacctgtggagccgcagtcgataaagaagctcagcttcaaatccatgaagcgagcgctcgatctgttctctcctatccacggtcaatttccccctcccgacccggaaagcaagaagattcgagtgagtcataagctcaatactgagtatggaggcgtgaaaagcgtggcaacagaatcttctactcatacagcatctgcaaaaagtcaggcagagaaagcttctgctccttccaatgtccttgcacttccaggccctgaacagccaaatgaaatgcagaagggagggccgcagaaggatttggtgattagttcaacagcacagcctaggggccctagcgaagttggtgttcaaggcaggagtacagcagttattcctgctcatggttcatctgaaaggaatctttcaacttctgccattatggaaaggattccaagtaggtggcctcgtcctgtatggcatcctccctggaagaattacagggtcattagtggccatctgggttgggtgcggtccgttgctattgacccgagtaattcttggttttgcacgggatctgctgatcgaacaatcaagatatgggacttagcaagtggccgactgaagctcacacttactggtcacatcgaccaaatacgaggcctggctgttagtagcaagcacacttacatgttttctgccggagatgacaaactagttaaatgttgggatctagagcagaataaggttattcgttcttatcatggtcaccttagtggtgtttattccttggctcttcatcctacaattgatattttgcttaccggaggtcgagattcggtttgtcgggtgtgggatatacgcagcaagatgcaaattcatgctctttctggtcatgataatacagtttgctcaatcttcacacgacctacggatccacaagtcataacaggttctcatgattcaactataaagttctgggaccttagatatggtaaaacaatggcaactctcacccaccataaaaaatctgtacgggctatggctccacatcctaaggaggactgttttgtatctgcatctgctgagaatattaagaagtttaaactcccaacaggagagttcatgcacaacatgctctctcaacagaaaactattattaattctgcagccgtcaatgaggagggtgtactggccacagcgggtgataatggaagtttgtggttctgggactggaagagtggtcataattttcaacaagcccaaaccattgttcagcctggttcactggatagtgaagcaggtatatatgcaatcacgtatgatttaactggttcaaggctgatcacttgtgaggcagacaagactatcaagatgtggaaagaggatgaaactgcaacccctgaaactcatccccttcattttaagccacccagagatatacggcgcttctagtgtttctgcagtgatctttggatatgttttccgccctttcttattcgtcattgtgctcacgaaaacaataatgttgagatgatgtatacttgatataactgttgcctatgaattccttgtcagctgcatcttaccacatagtttctatcatctaattcatcaagtgttgtaattatccgtgaggattgcaaatatctggtaactagagatggatgtatgggaa

SEQ ID NO: 8625 - DNA, 1730 bp, Arachis hypogaea
cagttaaaccctaaagaagaagaagaagaaagggcgatgacaagtgctacgtcgtcgtcggaggttgaaccggtcgagccgcagtcactgaagaagctcagcttcaagtccctgaagcgcgcactcgatctcttctctcccactcactctcacctcgctcctcccgatccccacagcaagagaattcgcactacccacaaggtacttgtggagtatggtggaatcaaactctctactactcaagctcctcgtcaagctaattccgcggcgcaaggtcaagctcaaccggggccatctaatgcacttgctcttccgggtccaggagattccaaagatccccagaaaggaggaccccaaaatgctttggttgttggtccaactatgccgtcaacagcttcgaatgatcgtggttttacaggcaaaagcacagcagttatttctgcttcttctggttcatctgaaaggaatttatccacagctgctttaatggaaagaatgccaagtaaatggccacgtcctgattggcatgccccatggaagaattacagggtcatcagtggtcacttaggatgggtgagatctgttgcagttgatcccagcaatacatggttttgtactggttctgcagatcgtaccatcaagatatgggatttagctagtggaaggctaaagctcacactgactggccacatcgagcaaataagaggccttgctgtcagcagcaagcatacttacatgttctctgctggtgatgataaacaagttaaatgttgggatcttgaacagaataaggttattaggtcctatcatggtcatcttagtggtgtctactgcttggctcttcatccaacaattgacattttacttactggagggcgtgattctgtctgccgggtctgggacatccgtagtaaaatgcaaattcatgctctttcaggacatgataatactgtctgctctgtatttacacgggcaacggatccccaagttgttacaggttctcatgacagcaccatcaagatgtgggatctaagatatggtaaaacaatgttaacccttacaaaccacaaaaaatctgttagagccatggcacaacatcctaaagagcaagcttttgcatcagcatcagctgataatattaagaaattcagtctcccaaagggagagttttttcacaatatgctctctcaacagaaaactatcatcaatacgatggctgtcaacgaggagggtgtgatggttacaggaggtgacaatgggagtctctggttctgggattggaagagtggtcacaatttccagcaagcgcagacaattgtgcagcctggttcactggacagtgaagctggtatttatgcttgtacctatgatgtaacgggttcaaggcttataacatgtgaagctgacaagacaatcaaaatgtggaaagaagatgaaactgccactcctgaaacccatcctcttaatttcaggccccctaaagacatcaggcgattttagcttcaatccttattatcaaccaatcaatctctatactatccctgtgatacattttatatttggttatttgtaggtctgatgtaaaattacatgtcaaaataattatcatgagtactatccatttttgtaacactggattgcatgtacattaatagttagatttagatccgtattatatattttaatagaattgcagtcagttttgtgcagacttacgaaaacaggtgtga

SEQ ID NO: 8626 - DNA, 2136 bp, Glycine max
atttttaattttttaagacactaatctttgaattggccaagaagaatatagtgttaaagagagcaagttctgtttaacacagacgagctgtggtagcagctagcgggtgaaggtttttgcgccgcgccttatatcacaccgtcgtccgaaagcgtcgttgccgtgaaaccctagaaagaaacgacgacgtaaatggaggtggagcccgtggagccgcagtcgctgaagaagctaagcttcaagtctctgaagcgcgctctcgatctcttctctcccatccacggacacctcgctactcccgatgccgaaagcaagaaaatacgcactagccacaaggtgagcgtggagtatggtggaatcaaaagcactgccaatcaacctcctcctcgtcaagttagttctgccacccaggatccagggtcctctaacactctggctcttccaggtcccggagattccaaggattctcagaaaggaggaccccaaaatgccttggttgttggtccaactatcccatccacaacaccgaatgatactggttttcagaacaaaagtacagcggttgtttcagcctctggttcatctgaaagaaatttatcaacatctgctttgatggaaagaatgccaagtaaatggccacgtcctgtatggcacgcaccatggaagaactacagggtcatcagcggtcacttgggatgggtgagatctgttgcagttgatcccagtaacacatggttttgtactggttctgcagatcgaactatcaagatatgggacttggcaagtggagtattgaagctcacattaacaggccacattgaacaagttagaggtcttgctgttagcaacagacatacttacatgttctctgctggtgacgataaacaagttaaatgttgggatcttgaacagaataaggttattaggtcttatcatggtcatctgagtggtgtttattgcttggctcttcatcccacaattgacgttttactaaccggaggacgtgattctgtctgccgggtttgggatatacgaagtaaaatgcagattcatgctctttcaggtcatgataacactgtctgttctgtgtttacgcggccaacggatccccaagttgttacaggttctcatgacactaccatcaagatgtgggaccttagatatggtaaaacaatgtcaactcttacaaaccataaaaaatctgttcgagcaatggcccagcatcccaaagagcaagcttttgcatctgcttcagctgacaatattaaaaagttcacccttccaaaaggagaattttgccacaatatgctctctcaacagaaaactatcatcaatgcaatggctgtcaatgaggagggtgtgatggttactggaggcgacaatggcagcatgtggttctgggattggaagagtggtcacaatttccagcaatcccaaacaattgtccagcctggttcattggacagtgaagctggtatttatgcttgtacctatgatcttactggttcgaggctcataacctgcgaagctgacaagacgataaaaatgtggaaagaagatgagagtgccactccagaaacccatccccttaacttcaggcctcctaaagacatccgtcgattctagacatgctcctcatttatctcaggcaacttattctgctaatacagagtgggtatgtgctatctggagggcttggtgtaaatttacttgttgggagattcacagttctcttcttagcaggcttttatcatcatttttgtatcacgagaaatgttaggaaaatactctcaaatactcttttgaacacaatctttcttattgattgaaaatcacaaattggtggatgctacatatttaacgaacctccttattttgtattttctgataattttcaactagtaggagagtgtggtgtcagaaagtatgtgttaaagagtgtgtaacacttctgtgtgcatcattggattgcttgtaagattattcctacatagttcgtgtgtctcaatagctttgcatttcagttgactagactccttgtagaattgaatagaatgacgtattttagttttggagaagttaaacgagagcttttgaagaatttgaagtatataaactgattttaacttattgaag

SEQ ID NO: 8627 - DNA, 2049 bp, Glycine max
gttaaagagagcaagttctgtttaacacagacgagctgtggtagcagctagcgggtgaaggtttttgcgccgcgccttatatcacaccgtcgtccgaaagcgtcgttgccgtgaaaccctagaaagaaacgacgacgtaaatggaggtggagcccgtggagccgcagtcgctgaagaagctaagcttcaagtctctgaagcgcgctctcgatctcttctctcccatccacggacacctcgctactcccgatgccgaaagcaagaaaatacgcactagccacaaggtgagcgtggagtatggtggaatcaaaagcactgccaatcaacctcctcctcgtcaagttagttctgccacccaggatccagggtcctctaacactctggctcttccaggtcccggagattccaaggattctcagaaaggaggaccccaaaatgccttggttgttggtccaactatcccatccacaacaccgaatgatactggttttcagaacaaaagtacagcggttgtttcagcctctggttcatctgaaagaaatttatcaacatctgctttgatggaaagaatgccaagtaaatggccacgtcctgtatggcacgcaccatggaagaactacagggtcatcagcggtcacttgggatgggtgagatctgttgcagttgatcccagtaacacatggttttgtactggttctgcagatcgaactatcaagatatgggacttggcaagtggagtattgaagctcacattaacaggccacattgaacaagttagaggtcttgctgttagcaacagacatacttacatgttctctgctggtgacgataaacaagttaaatgttgggatcttgaacagaataaggttattaggtcttatcatggtcatctgagtggtgtttattgcttggctcttcatcccacaattgacgttttactaaccggaggacgtgattctgtctgccgggtttgggatatacgaagtaaaatgcagattcatgctctttcaggtcatgataacactgtctgttctgtgtttacgcggccaacggatccccaagttgttacaggttctcatgacactaccatcaagatgtgggaccttagatatggtaaaacaatgtcaactcttacaaaccataaaaaatctgttcgagcaatggcccagcatcccaaagagcaagcttttgcatctgcttcagctgacaatattaaaaagttcacccttccaaaaggagaattttgccacaatatgctctctcaacagaaaactatcatcaatgcaatggctgtcaatgaggagggtgtgatggttactggaggcgacaatggcagcatgtggttctgggattggaagagtggtcacaatttccagcaatcccaaacaattgtccagcctggttcattggacagtgaagctggtatttatgcttgtacctatgatcttactggttcgaggctcataacctgcgaagctgacaagacgataaaaatgtggaaagaagatgagagtgccactccagaaacccatccccttaacttcaggcctcctaaagacatccgtcgattctagacatgctcctcatttatctcaggcaacttattctgctaatacagagtgggtatgtgctatctggagggcttggtgtaaatttacttgttgggagattcacagttctcttcttagcaggcttttatcatcatttttgtatcacgagaaatgttaggaaaatactctcaaatactcttttgaacacaatctttcttattgattgaaaatcacaaattggtggatgctacatatttaacgaacctccttattttgtattttctgataattttcaactagtaggagagtgtggtgtcagaaagtatgtgttaaagagtgtgtaacacttctgtgtgcatcattggattgcttgtaagattattcctacatagttcgtgtgtctcaatagctttgcatttcagttgactagactccttgtagaattgaatagaatgacgtattttagttttggagaagttaaacgagagctttagaagaa

SEQ ID NO: 8628 - DNA, 1990 bp, Glycine max
tctctcgtaagtttattaaaaatttgataatttttaataaattttaatgaaacacaaaataataagtgttgaagagagcatgttaacacagacgagctgtggtagcagctagcgggtgaaggtttctccgccgcgccttatcacgccgtccgaaagcgtcgttgctgcgaaaccctagacagaagcgacgccgtagatggaggtggagcccgtggagccacagtcgctaaagaagctaagcttcaagtctctgaagcgcgctctcgatctcttctctcccattcacggacacctcgctcctcccgatgccgaaagcaagaaaatccgcactagccacaaggtgagcgtggagtatggcggaatcaaaagcactgctaatcaacctcctcatcaagttagttctgccacacaggatccagggccctctaacactcttgctcttccaggtccaggagattccaaggattctcagaaaggaggaccccaaaatgccttggttgttggtccaactatgccatccacaacaccgaatgatactggctttcagagcaaaagtacagcggttgtttcagcctctggttcatctgaaagaaatttatcaacatctgctttgatggaaagaatgccaagtaaatggccacgtcctgtatggcatgcaccatggaagaactacagggtcatcagcggccacttaggatgggtgagatctgttgcagttgatcccagtaacacatggttttgtactggttctgcagatcgaactatcaagatatgggacttggcaagtggagtattgaagctcacattaacaggccacattgaacaagttagaggtcttgctgttagcaacagacatacttacatgttctctgctggtgatgataaacaagttaaatgttgggaccttgaacagaataaggttattagatcttatcatggtcatctgagtggtgtttattgcttggctcttcatcccacaattgacgttttactaaccggaggacgtgattctgtctgccgggtttgggatatacgaagtaaaatgcagattcatgctctttcaggacatgataacactgtctgctctgtgtttacgcggccgacggatccccaagttgttacgggttctcatgacactaccatcaagatgtgggaccttagatatggtaaaacaatgtcaactcttacaaaccataaaaaatctgttcgagcaatggcccagcatcccaaagagcaagcttttgcatctgcttcagctgacaatattaaaaagttcaaccttccaaaaggagaatttttgcacaacatgctctctcaacagaaaactatcatcaatgcaatggctgtcaatgaggagggtgtgatggttactggaggtgacaatggcagcatgtggttctgggattggaagagtggtcataatttccagcaatcccaaacaattgtacagcctggttccctggatagtgaagctggtatttatgcttgtacctatgatcttactggctcgaggcttataacctgcgaggctgacaagacgataaaaatgtggaaagaagacgagagtgccactccagaaacccatccccttaacttcaggcctcctaaagacatccgtcgattctagacatgctcctcatatatctcaggctatttattctgccaatacacagagtggatgtgctataatctggagggcttggtgtaaatttacgtgttgggagattcacagttctcttttaacaggcttttatcgtcatttttgtatcattggattgattttaagaatattcctacatagatccgtccgtatttctatagctttcctacaaggcgtcttccttgtagaattgaatagaatgatgcattttagcttttggagaagttaaaagttaaagtatataaattgattttaatttattaaagaagtttgatttgttttattattttgttttcttataggtatttattgaaaaacttgtctaaattg

SEQ ID NO: 8629 - DNA, 1913 bp, Glycine max
gaagagagcatgttaacacagacgagctgtggtagcagctagcgggtgaaggtttctccgccgcgccttatcacgccgtccgaaagcgtcgttgctgcgaaaccctagacagaagcgacgccgtagatggaggtggagcccgtggagccacagtcgctaaagaagctaagcttcaagtctctgaagcgcgctctcgatctcttctctcccattcacggacacctcgctcctcccgatgccgaaagcaagaaaatccgcactagccacaaggtgagcgtggagtatggcggaatcaaaagcactgctaatcaacctcctcatcaagttagttctgccacacaggatccagggccctctaacactcttgctcttccaggtccaggagattccaaggattctcagaaaggaggaccccaaaatgccttggttgttggtccaactatgccatccacaacaccgaatgatactggctttcagagcaaaagtacagcggttgtttcagcctctggttcatctgaaagaaatttatcaacatctgctttgatggaaagaatgccaagtaaatggccacgtcctgtatggcatgcaccatggaagaactacagggtcatcagcggccacttaggatgggtgagatctgttgcagttgatcccagtaacacatggttttgtactggttctgcagatcgaactatcaagatatgggacttggcaagtggagtattgaagctcacattaacaggccacattgaacaagttagaggtcttgctgttagcaacagacatacttacatgttctctgctggtgatgataaacaagttaaatgttgggaccttgaacagaataaggttattagatcttatcatggtcatctgagtggtgtttattgcttggctcttcatcccacaattgacgttttactaaccggaggacgtgattctgtctgccgggtttgggatatacgaagtaaaatgcagattcatgctctttcaggacatgataacactgtctgctctgtgtttacgcggccgacggatccccaagttgttacgggttctcatgacactaccatcaagatgtgggaccttagatatggtaaaacaatgtcaactcttacaaaccataaaaaatctgttcgagcaatggcccagcatcccaaagagcaagcttttgcatctgcttcagctgacaatattaaaaagttcaaccttccaaaaggagaatttttgcacaacatgctctctcaacagaaaactatcatcaatgcaatggctgtcaatgaggagggtgtgatggttactggaggtgacaatggcagcatgtggttctgggattggaagagtggtcataatttccagcaatcccaaacaattgtacagcctggttccctggatagtgaagctggtatttatgcttgtacctatgatcttactggctcgaggcttataacctgcgaggctgacaagacgataaaaatgtggaaagaagacgagagtgccactccagaaacccatccccttaacttcaggcctcctaaagacatccgtcgattctagacatgctcctcatatatctcaggctatttattctgccaatacacagagtggatgtgctataatctggagggcttggtgtaaatttacgtgttgggagattcacagttctcttttaacaggcttttatcgtcatttttgtatcattggattgattttaagaatattcctacatagatccgtccgtatttctatagctttcctacaaggcgtcttccttgtagaattgaatagaatgatgcattttagcttttggagaagttaaaagttaaagtatataaattgattttaatttattaaagaagtttgatttgttttattattttgttttcttataggtatttattgaaaaacttgtc

SEQ ID NO: 8630 - DNA, 2680 bp, Panax ginseng
gtcgtcgcgcccagtagtttcacaatctctgcctcttcggaagagagatggcagaaggcccaacaatggagtcggaactgccagtagagccacagtcactgaaaaagttaagcttcaaatccttaaagcgagccctcgatctcttctcgcctcttcacggccaatttccacctccggaccccgcaagcatgaagatacggttgagccataagctaaatgctgagtatgggggtatcagaagcactacagctcagcctcctaatcatgctaactcggctgcacaacaagttccacaagcttccactactcttgcccttactggttctgaaagttctagagacccacagaaaagaggagctcaaaacgaattagctgttgttccttccattcaaccaaagggccttggggaaactagtttttctggcaaaagtacgacaattattcctgctcatggtacatctgacagaaacctctcaactgctgccctcatggaaagaattccaagcagatggccacgtcccgtatggcgtcctccatggagaaactacagggttattagtggccatttgggatgggtgagatctgttgcatttgatccaagtaatgagtggttctgtacgggatctgcagatcgtacaatcaagatatgggatgtaggaactggaacattaaagctcactctaacaggacacattgaacaagtgcgaggccttgctgttagcactaaacacacatatatgttctctgctggcgatgacaaacaagttaaatgctgggacctagaacagaataaggttatcaggtcttatcatggtcacctgagtggtgtttactgcttggcgcttcatcccactattgacgttctgcttactgggggtcgtgattctgtttgtcgggtatgggatatccgcagcaagatgcaaattcatgcactctctgggcatgataacacagtttgttcagtttttactcgaccaacggatccacaagttgtaactggctcccatgacacaaccataaagttctgggaccttagatatggcaaaacaatggcaactcttacacaccataagaagtctgtacgagcaatggctcagcatcctattgaggactgctttgcatctgcatcagctgacaacatcaaaaaattcagtcttccaaaaggagagtttttgcacaacatgctctcgcaacagaagaccatcattaatgccatggcagtcaatgaagatggtgtgatggttacaggaggtgataatggaagtatgtggttctgggattggaagagtggccacaatttccaacaaagtcaaaccattgtccagcctggttctttggatagtgaagctggcatctatgctacctctttcgaccttactggtacaaggcttgtgacttgtgaagcagacaagactatcaaaatgtggagagaggatccaaatgccacccctgaaactcatcccctcaactacaagccacccaaagaaatccggaggttctagtgctatttttaggaattctagtgcaattttactcatcttctcatttctcgacttagattaaggttcgaagcttagtaatgtccaattgtaaacttaaaatctttcatatgactttgtggatatgaagcaacagttttcttgagaaaggggaagatgataaagttgtactcgggaaagtttcctaccttactcctctcccccccaaacaaaaaaaaaaaataaaaagaaaaaaaaagtgcgggtggggggaagttatgtactaatgttttcttttgtgaaaatttcactctaatatattaagattttgttcttgaaaagattgacccttactatggtaatgcttttgtactatttacaattatgttttacctgtgcgtgttcttcagtaaatcagctatctttttgtccccagttctagcttaatgtattttttagtgtgtttagaaaattcactagagtataacaatagacgattcttgtatatccttggtaagtatacaagagcaatatgtaagcatgtatctgtagcatttcaatcccagaatatgtatatatcttgttgaggctagatttcagaccaggtaatatccaaccacccccagtcatcgcgatgaaagcccagagaccttcccatacagatttcaaagcatcaacaatgttgttagaacatggaggctgatagttatgaacgccatcacacccccatagtcgaattgcactcatcaaccaccatggccatcacgctccaaccattaccacttatagcgatattgtggaagcatatttgttttttgttgaaccatcttgttgacaatgccactacttgtgtgtcatccgagtggtactgtttgtccgatggcccaccaccgtctctgcccatttgaaatctgttgagggtgtgaacagccttggtgtggctgaacaccattggcgagcacttaaaagtagtgtagtgcttgccttcaacacaacaatcggagtcattctattttttgcattttccaggaggcggtttcttgcctataatcttgccacttgatcaacaagcctgagcttcagcctcaaaagaatgtgccgaaagaagtatgagtaatactaagcaaaaagttcatactatccactctgtctttatagatttctttttgaatgaatgatggagaaacagggtgattgacagg

SEQ ID NO: 8631 - DNA, 1967 bp, Mimulus guttatus
aaattcatcccaaaccccaaccccaaccccaaatcggctgcagtaccgaaaagcttcgtcgcaaccctcaccgtcctccgccgttcctccgccgtcctccgccgtgaaccctgtctgccagtatatagattaatctctgagttcgtgaggctttcacattatcaaaacacacagacggtcgcatacggatgccgggggcgacgatggattccgagatacctgtagagccacagtcgctgaagaagctcagcttcaaatcagtgaagcgagccctggatctgttctctcctacacacggtcaatttccaccacccgacccggaaagcaagaagattcgagtaaattataagcttaataacgagtatggaggagtgaaaaacgtgtctacggaaccttctactcaaacaggatctgcaaaaaatcgatcgcaactaacatctacccccaacaatgtccttgcacttccaggccctgaacgatcaaatgatatgcaaaagggagggtcacagattagtacaacagggcaacctagcggcagtagcaatgttggtgttcaaggcaggagcacaactattatacctgcatctggtttacctgaaaggaatctttcaacttctgccatcatggaaagaattccaagtagatggcctcgtcctatatggcatgccccatggaagaattacagggtcattagtggccatttgggatgggtgcggtcagttgctcttgaccccagtaataattggttttgcacgggatctgctgatcgaacaatcaagatatgggacttagcaagtggcaggctgaaactcacacttaccggtcacattgaccaagtacgaggtctggctgttagtaagaagcacacatacatgttttctgctggggatgacaaattagttaaatgttgggacctagagcagaataaggccattcgctcttatcatggccatcttagtggtgtgtattgcctggcacttcatcctactattgacattttgtgtactggaggtcgggattccgtgtgtcgggtctgggatattcgtagcaagatgcaaatttttgcacttactggacatgataataccgtttgttcagtcttcacacgacctacggatccacaaatcataacaggttctcatgattcaactataaagttctgggacctcagatatggtaaagcaatggcaactctcacacaccataaaaaatctgtgcgagctatggctcagcatcctaaggaagacgcttttgtgtctgcatcagctgagaatattaagaagtttaaacttcctagaggagaatttatgcacaacatgctctctcagcagaagactataattaatgcagctgcagtcaacgaggagggagtaatggccacagcaggtgataatggaagtttatggttttgggactggaaaagcggccacaatttccagcaatcccaaacaattgttcagcccggttcgctggatagtgaagctggtatatacgctatcacgtatgatttaactggttcgaggctgatcacttgtgaggcggacaagactataaagatgtggaaagaagatgaaacggcaaccccagaatctcatcccgttcatttcaagccacccaaagatattcgccgcttctaatatttctgctttagaccatttggatttactttttgctctttcattacgtgttaatttaaaaaaaggctcgagaaagagttattgaagtacgtaaaactgtaaaattgtagtcttgcctagctgatatgtttattacgagtcctttaaacgaggattgaaatattcagttgtcgtgttaggtgtattatttattatcctgtttatcaagatttattgaagcaagcatctatgtaatttgagattgcaagttcgtgtattaatatttgcctgaattcattttctaccccaattaattctaggtttttcgttatcgtgcctgccaggctcata

SEQ ID NO: 8632 - DNA, 1875 bp, Cajanus cajan
aactcaacgggtgcaggtgcaggtgaaggtgcagctacagctagctaagaaacagagtgtgaaggttttgcgccgcgccgccgcactccgtccgaaagcgtcgttgttgggaaaccctagaacgcaaacgacgtcgtaaatggaggtggaacctgtggagccacagtcgctgaagaagctaagcttcaagtctctgaagcgcgctctcgatctcttctctcccattcacggacacctcgctcctcccgatgccgacagcaagaaaatacgcattagccacaaggtgagtgtggagtatggtggaatcaaaagcaccgtcaatcagcctcctcgtcaagttagttcctccacacaggatagtgctcaacaagcagggtcctctaacactgttgctcttccagctcctggagtttccaaagatccccagaaaggaagaccacaaaatgccttggttgttggtccaactatgccatccacaactccgaatgatattggctttcagagcaaaagtacagcaattgtttctgcatctggttcatctgaaagaaatttatcaacatctgctttgatggaaagaatgccaagcaaatggccccgtcctgtatggcatgcaccatggaagaactaccgggtcatcagtggtcacttaggatgggtgagatctgttgcagttgatcccagtaacacatggttttgtactggttctgcagatcgaactatcaagatatgggacttggcaagtggagtattaaagctcacactaaccggccacattgaacaaataagaggccttgctattagcaacaaacacacttacatgttctcttgtggtgatgataagcaagttaagtgctgggatcttgaacagaataaggttattaggtcttatcatggtcatctgagtggtgtttattgcttggctcttcatcccacgattgacattttactaaccggaggacgtgattctgtctgccgggtttgggatatacgtagtaaaatgcaaattcatgccctttcaggtcatgataacactgtctgctctgtgtttacacggccaacggatccccaagttgttactggttctcatgacactaccatcaagatgtgggaccttagatatggtaaaacaatgttaacccttacaaatcataaaaaatctgttcgagcaatggctccacatcccaaagaacaatcttttgcatctgcatcagctgacaatattaagaagttcaaccttccaaaaggagaattcgtgcacaatatgctctctcaacagaaaaccatcatcaatgcaatggctgtcaatgaggagggtgtgatggtcactggaggtgacaatggcagtatgtggttctgggattggaagagtggtcacaatttccagcaatcccaaacaattgtacagcctggttcattggatagtgaagctggcatttatgctttgacctatgatgttactggttcaaggctaatatcatgtgaagctgacaagacgataaaaatgtggaaagaagatgagactgcaactccagaaacccatcctcttaacttcaggcctcctaaagacatccgtcgattctagacatacacaagattggaggtcttggtgtaaatttacttgatgggtgattcagtgttctcctttaacaggctttagtcgtcatttttgtatcaatggattgcttgtaagattattcctacatagatccttgtgtatttctatagctttgcaattcagttgtgtccacacacctgaaaacaggcgggtgcctccttgtagaattcagtagactcgtgcatgttatctgttagacgttaaatgagagtttctcaaaaagttaaaaagtatataaattagtttcatttattttatca

SEQ ID NO: 8633 - DNA, 1959 bp, Solanum phureja
aacttttctctatatatcttataataagacccctagttttattatatccacataaaactttccctctatttactaaaatctcacatggctactcctctcaagaataccaatagactttctcttgcaatggaaagaactggccaatgggtattttcacaagaaattccaactgatgttattgttgaagtaggtgaagcaaactttaatcttcacaagttcatgctagtagcaaagagcaattacataaggaaacttatacttgatactaaagaaagtgatgtaagtcgtataaacttatcggatattcctggagggccagagatgtttgagaaggcagctaagttctgctacggagttaactttgaaatcacagtacataacgttgctgctcttcgttgtgctgctgaatatcttcaaatgactgataaatactgtgacaacaatctcgcaagccgaacagaggattttctagctcaagttgccttgactagcctttctggtgcacttgttgtgttaaagtcatgtgaaaatcttcttcctcttgcacatgatctcaatatcattcaaagatgtgttgacatcgccggtgctaaggcgtgtgtggaagcgaattttcctagcagatcaccaccaaattggtggacggaagagttaactatcttagatgtagcttttttcgagagaattattgttgcaatgaaagctcgtggggcaaaagcactaacaatagcaagtgctataatcacatatacagagagatctcttcgtgatcttgtacgtgaccactcaggaaacaacacgagattaatggaaccagaggattcggatatgagaatgcatcaacgggaacttctggagtcgattgtgactctgttgcctgcggagaaagcagcttttccaatcaatttcttgtgttgtctcctgcgtacagctattttcttaagagcagccagtagctgcaagaatgaattggagaaaaggatatcagcaatactagaacatgtgacagtcgatgatttgttagtgttatcttttacttatgatggagaaagactattcgatcttgagagcgttaggagaatcatttctggatttatggagaaagagaagagtgtagcagtgtttaaaggtggtgattttggagatgtttgtaccacggcaatgcagagagttgcaaagactgtcgatgcatatcttggtgaaatcgctacttttggagatctcagtatatcaaaattcaatggaattgctattttggttcctaagggcgcgagaaaagctgatgatgatctttatagagctgttgatatctacttgaaggcacatccacatttggatgaaattgaaagagaaaaagtgtgcagtgtgatggatcctctgaaactatcacatgaagccagagtccatgcttctcaaaacaaacgtttgccggtgcaaatagtccttcatgctctctatttcgatcaattaaagttaaggagcggggcagcagatgataccaataacaacatgcctgaagccatggcaacaaggaatcaattacaagccgatgtttccctcgtaaaggaaaatgaagttttaagaacagagttgctaaagatgaagatgtacatagcagatatacagaaaacaacaacttctactcaaggaacatcaaaagggggtttgaagaagacaactttcttctcttctgtctccaaaacattaggcaaattcaatccctttaaacatggatcaaaggacacttcgaatattgttgatgatgctgctctagatcttactaagcctaggaggagaagattttccatatcttaattaagttattcaaatgatttggtttaattttagtttatgttgtgtgagaaaactatgatttattttgtactgtaaatgattgattgattgattctgttgtttgattatattgttatgttaataagttcatgtatcacacttgat

SEQ ID NO: 8634 - DNA, 1815 bp, Solanum tuberosum
ctaaaatctcacatggctactcctctcaagaataccaatagactttctcttgcaatggaaagaactggccaatgggtattttcacaagaaattccaactgatgttattgttgaagtaggtgaagcaaactttaatcttcacaagttcatgctagtagcaaagagcaattacataaggaaacttatacttgatactaaagaaagtgatgtaagtcgtataaacttatcggatattcctggagggccagagatgtttgagaaggcagctaagttctgctacggagttaactttgaaatcacagtacataacgttgctgctcttcgttgtgctgctgaatatcttcaaatgactgataaatactgtgacaacaatctcgcaagccgaacagaggattttctagctcaagttgccttgactagcctttctggtgcacttgtcgtgttaaagtcatgtgaaaatcttcttcctcttgcacatgatctcaatatcattcaaagatgtgttgacatcgccggtgctaaggcgtgtgtggaagcgaattttcctagcagatcaccaccaaattggtggacggaagagttaactatcttagatgtagcttttttcgagagaattattgttgcaatgaaagctcgtggggcaaaagcgttaacaatagcaagtgctataatcacatatacagagagatctcttcgtgatcttgtacgtgaccactcaggaaacaacacgagattaatggaaccagaggattcggatatgagaatgcatcaacgggaacttctggagtcgattgtgactctgttgcctgcggaaaaagcagcttttccaatcaatttcttgtgttgtctcctgcgtacagctattttcttaagagcagccagtagctgcaagaatgaattagagaaaaggatatcagcaatactagaacatgtgacagtcgatgatctgttagtgttgtcttttacttatgatggagaaagactattcgatcttgagagcgttaggagaatcatttctggatttatggagaaagagaagagtgtagcagtgtttaaaggtggtgaatttggagatgtttgtaccacggcaatgcagagagttgcaaagactgtcgatgcatatcttggtgaaatcgctacttttggagatctcagtatatcaaaattcaatggaattgctattttggttcctaagggcgcgagaaaagctgatgatgatctttatagagctgttgatatctacttgaaggcacatccacatttggatgaaattgaaagagaaaaagtgtgcagtgtgatggatcctctgaaactatcacatgaagcaagagtccatgcttctcaaaacaaacgtttgccggtgcaaatagtacttcatgctctctatttcgatcaactcaagataaggagcggggcagcagatgatactaataacaacatgcctgaagccatggcaacaaggaaccaattacaagccgatgtttccctcgtaaaggaaaatgaagttttaagaacagagttgttaaagatgaagatgtatatagcagatatacagaaaacaacaacttctactcaaggaacatcagctagtcataaagggagtttgaagaaaacaaccttcttttcttctgtctccaaaacattaggcaaattcaatccctttaaacatggatcaaaggacacttcgaatattgttgatgatgctgctctagatcttactaagcctaggaggagaagattttccatatcttaattaagttattcacatgatttggtttaattttagtttatgttgtgtgagaaaactagtatgatt

SEQ ID NO: 8635 - DNA, 2001 bp, Nicotiana benthamiana
atcctaagctttccctctatgcactaaatattgaagcttctctctcacatggctgttcctatcaagaatacaaatcgactctctcttgccatggaaagaactggccaatgggtgttctcccaagaaattccaactgatgttgttgttgaagtaggtgaagcaaactttaatcttcacaagttcatgcttgtggcgaagagcaactacataaggaaacttatactagagtctaaagaaacagaagtaacgaggataaacttgtctgagataccaggaggtcctgagatgtttgaaaaatcagccaagttttgctatggagtcaactttgaaatcacagttcataatgtagctgctcttcgttgtgctgctgaatacttacaaatgactgataaatactgcgataacaatcttgctagcaggacagaagatttcctagcccaagttgccttgaatagcctttctggtgcacttgtagtattaaagtcttgtgaaaatcttcttccccttgctgaggacctcaacatcgttcaaagatgtgttgaaatcgccagtgctaaggcatgtgtagaggcgaattttccaagcagatcaccaccaaattggtggacggaagagttcaccatattagacataacatttttcgagagaattatcatttcgatgaaaactcggggagcaaaagcgttgacagcagcaagtgctataatcacgtatacagagagatctcttcgtgaccttgtacgtgaccactccggtaatggaaccagattagtcgagccagaggactccgacatcaggatgcatcaacgccaacttctcgagtcaattgtcaagctcttaccttcagacaaagcagcttttcccatcaatttcctatgttgtctcctccgtactgcaattttcttaagagcaacttctcgagtcaattctaatagttgcaagaatgaattggagaaaaggatatcagcaattttagaacatgtgactgtagatgatctgctcgtgttgtcttttacttatgatggcgaaagattattcgatcttgagagcgttaggagaattatttctggatttgttgagaaagagaagactgtggcggtttttaatggtggtgattttggacaacaagtttgttccacggcgatgcagagagttgcaaagactgtagatgcgtatcttggtgaaatagccacttttggggacctcactatagccaaattcaatggaattgctattttggttcctaagggagctaggagggttgatgatgatctttacagagccgtcgatatctacttaaaggcacatccaaatttggatgaaattgaaagagagaaagtttgcagcgtgatggatacactgaaactttcgtatgaagccagagttcatgcttcacaaaacaaacgtttgccagtgcaaatagtccttcatgctctctacttcgatcaactgaggataaggagtggcggagatgatactagtaatttacccgaagccatggcaacaaggaatcaactacaagccgatgtttcgcttgtcaaggagaacgaagctctaagaactgaactgttgaagatgaaaatgtacatatccgatatacagaaaacaagtcaagggactacttcagctaaacccagtcttagcaggaagccaaccttcttttcttctgtatccaaaaaattggggaaattgaatccctttaagcatggatcaaaggacacttctatgattgatgatgcgactgtagatcttactaagcctaggaggagaagattttccatttcctaagttaattatatatttggttttagtttatgttgagtgagaatgattgaatttgtgtaaaggattgattctgttgttaaaaattgcatttatattcccatgtcctaatgttactataaagtagaaaacacttgttttttcaatactgtgtcaattcatgtgattgtatatccaactctatcatccatatatatggatcacaagagataagacaaa

SEQ ID NO: 8636 - DNA, 1974 bp, Olea europaea
ttctattttcttgaagcatcctccaatggctacccccatcaaaaataatagcagattaactcttgccatggagagaactgggcagtgggttttttcgcaagatattcctactgatgttattgttgaagtaggtgaggccaatttctctcttcacaagttcatgcttatagcaaagagcaactacataagaaaacttattattgaatcaaaagaagctgatttggcaagaataaacctctccgatatccctggaggacccgaaattttcgaaaaagctgcgaaattctgttatggagtaaattttgagatcactgtacacaacgtggctgccctcagatgtgctgctgagtatctacagatgactgatatgtattgtgacaataatctctgtagtcggaccgaggatttcctctctcaagtggcattaagcagcctttcaggtgccgtcgtcgtgctgaaatcttgtgaagatctacttccaatggctgaagacctcaaaattgttcaaaaatgtgtcgatgttgcaagcgccaaggcttgtgttgaggcaaattttccaagccgttcgccgcctaactggtggaccgaagagctaacaatcttggatgtaagcttcttcgaaaagatcattacatcgatgaaatcaagaggtgcaaaggccttgacaatagctagtgctataatcacatacgcagagagatcgcttcgtgatcttgtgcgcgaccactctgggaaaggaataaaatcattagattccggggaatctgatatcagaatccaacaacgggaacttctcgaatctatagtcgctcttttgccccccgaaaaggctgccttccccataaacttcctctgctgtctcctaaggactgctattttcttgagggcaacaaatagttgcaagcaagaactagaaaagagaatttcagtgattttagagcatgtgacagtggatgatcttctggttctatcgttctcgtatgatggcgagcgcctgtttgatcttgagagcgttagaaggatcatatctggttttgtggagaaagagaagaacgtggctgtcttcaatggaggcgattttaaagaagtgtgttccacagctatgcagagagttgccaagacagttgatgcataccttggagagattgctacttacgttgatctgagtatttctaagtttaacgggatcgccaatttagtgcctaaaggcgctagaaaggtcgatgatgatctttaccgggctatcgacatctacttgaaggctcatccaaatttagatgaaatcgagcgcgagaaggtctgcagcgtgatggatccactcaaactctcctacgaagccagggttcatgcttcgcagaacaaacgattgcctgtacagatagttcttcacgctctgtattacgatcaactgaagctaagaagtggcacagacgaacaaaattcgaatgccatgacgacaagaaatcagttacaggcagatgtatccctggtgaaagagaacgaagcgctaagaaccgagctattgaagatgaaaatgtatgtacaagatttgcagaaaaatcaagggacatcgtcaaaagggagtgcaaagaagccaacattcttttcttctatgtcgaaaaccttgggaaaattgaatccatttaagcatggatcgaaggatacctcaaacatggatgatggaatgccagatttaaccaagcctagaaggagaaggttctccatttcttaagttcggagattgatttgtttagtttctttgtgtgctgaggttgtgcaaaggtttgatgcttttgtgtccagtcatttttgttgcgccgttatgtttgccctcttttcaaactaatttcttggttgtacaaatttgtgttacatacgtaaattttcttccttgtttgttattcttttggtttggcatgtttgataagattactggccttcaatatgttataattctatctaacatattttgag

SEQ ID NO: 8637 - DNA, 1794 bp, Sesamum indicum
atcaagctaaatatataacctattgaagctctattagttgtcttgaaatccctattctctttcttgaagctaagctcccaagaaatggccaatagactctctcttgcaatggagagaacagggcagtgggttttctctcaagaaattccaactgatgtcattgttgaagttggagaagccaacttttcccttcacaagttcatgcttgtggcaaagagcaaccatataaggaaactgattcttgattcaaaagaagctgatttaacaagaatagacctctcagacattcctggagggcctgagatctttgaaaaggctgcgaaattctgctatggtgtcaactttgagatcacggttcacaacgtcgcagccctccggtgtgctgctgagtatctgcagatgactgataagtattgtgacaacaatcttgctgggaggactgaggatttcttgtcccaagttgccttaaccagcctgtccggcgccctcgttgtgctgaaatcttgtgaagatcttcttcccatggctgaggacctcaagattgtccaaagatgtgttgaaattgcaagtgccaaggcttgcgtcgaggctaactttccaagccgttcgcctccaaattggtggaccgaggagctaacgatcttggacataaccttcttcgcaaagatcattgcatcaatgcggtcgagaggcgcaaagggcctcactctagctagtgctatcatcacatacaccgagagatcactccgtgatctagtgcgtgaccactctggaaacggcactagatcgacagattccatggacactgacctcagagcccgacaacgggaacttcttgaatctatagtggctttattgcccttggaaaaatcagctttccccatcaatttcttgtgttgtctcctaagaacagcaattttcttgagggcagacactaggtgcaagaatgagctagagaagaggatatccatgattctggaacatgtgaccgtcgacgatcttctcgtcctgtctttcacctatgacggtgagagacttttcgatcttgagagtgtgaggaggatcatatcgggattcgttgagaaagagaagaacgttgccgttttcaatgctggtgattttagagaagtctgttccacaggtatgttgagggttgccaagactgtagatgcatatcttggggagattgctacttacggagagctgagtatctcaaagtttaacgggatcgcaaatttggtgccaaagacagctcggaaggtcgacgacgatctttaccgtgctatcgatatctacttgaaggcacatccaaatctagacgaaatcgagcgtgagaaggtatgcagcgtaatggatccactcaagctatcgtacgaggccagggtccatgcttcacagaacaaacgcctcccggtgcaaatagtcctccacgccctatactatgatcaactcaagttaaggagtggagcggacgatcacaagacgcccgatgccctaacgacaagaaaccagctgcaagccgacacgtccctcgtcaaggaaaacgaagctcttagaaccgagctactaaagatgaaaatgtacatacaagatattcagaaatcccaggggaccacgtctaaagggagtgctaaaaaacctacgttcttctcgtccgtgtccaagactctggggaaattgaatccgtttaagcatggatcgaaggatacgtcgaatatcgacgatggaatggtggatttgaccaagcctagaaggaggaggttttccatctcttaaggaattaaattttttatt

SEQ ID NO: 8638 - DNA, 1845 bp, Plantago ovata
caatagtggtagactctctcttgccatggagagaacaggccaatgggtcttttctcaagaaattccaactgatgttaatattcaaattggagatgctaaaatttctcttcacaagttcatgcttgtagcaaagagtaaccgaataaggaaaatgatacttgattcgaaagaaggcgacgttacaagaatagatctctcaggcatacctggaggagcagagaatttcgaaaaagcagccaaattctgctatggtgtcaactttgagatcacggtacataacgtggctgcccttagatgtgctgctgagtatcttcaaatgactgatacttactgtgataataatcttgctggaagaactgaagatttcttatctcaagtcgccttaacaagcttgccaggtgccgtcgtggtgctcaagtcttgccaagatctccttcctatggcagaggatcttaatattgtccaaagatgcgtcgatattgcaagcgccaaggcttgtgttgaggcgaactttccaagccgtgcacctacgaattggtggactgaagagctaacgatattggatgtttgtttttttgagaagatcattgtctcaatgaagtcaaggggtgcaaagggacttactctagctagtgctattatcacgtatactgagagatcccttcgcgatctagttcgtgatcactctgggagtggaataagatcaacagatattgcagaatctggtacgaggacacgccaaagggaacttctcgagtccatagtgactcttttaccatccgaaaaatctgcctttcccataaatttcttgtgctgtctcctgaggactgcgattttcttgagggctgagaataaatgtaaacatgagttagagaaaagaatatgggcgatcttagagcacgtgacagttgatgatcttctagtgttgtcttatacttatgatggtgagaggttgtttgatcttgagagtgttaggaggatcatttcggggttcgttgagaaagaaaagaatgtggcggttttcaatgcaggtgatcttacagaagtttgttctacgacgatgcagagagttgccaagaccgttgatgcatatctcggggagattgctacttatgttgagcttagtatttcgaaatttaatgggatcgcgaatcttgtgcctaaggcagcaaggaaggtagatgatgatctttaccgtgcagtcgatatcttcttaaaggctcatccaaaccttgatgaaatcgagcgagagaaagtatgcagcgtgatggatccactcaaattgtcctacgaagccagggttcatgcttcacaaaataagcggttaccagtgcaaatagtccttcatgcactatactacgatcagctgaagatacggagtggtgcaaatgatcagaagatgccagatgccatggcaactagaaatcagctgcaggcggatgtttcactagtaaaagagaacgaagccttaagaactgaattgttgaagatgaaaatgtacataacagatataaagaaaaatcaggctacaacatccaaaaccagttcaaggaagcctacattcttctcatctatgtccaagactctgggaaagctgaatccgtttaagcatggatcgaaggatactttgaatcttgacgacgaagctgtagatttaaccaagcctagaagaagaaggttctctatctcttagcttaattaaggattttttgtttgtttttctctgtacttcatttattcctctatggtgtgctgaaactgtgtatatagggcttgatgattctgtttgtttgtttgttgctgtgaaacatcttcttggatttgttaaagctattgattgactgt

SEQ ID NO: 8639 - DNA, 1958 bp, Coffea canephora
gttccatttctcatgcgaagatcccttttccccgaagtcgtcttccaaaacatggctagtccccttgtgaataacagtagtaggctctctcttgccatggagaggactggccaatgggttttttcccaagaaattccaacagatgttctagttgaagtagggaaggccaccttttctcttcataagttcatgcttgtagcaaagagcaattgcataagaaaactaattcttgaatccaaggaagctgatctaacaaggatagatctctcggacatccctggaggccctgagatcttcgaaaaggcagctaagttctgttatggagtgaactttgagatcacggtccacaacgtagcagctctgcgttgtgctgctgagtatctccaaatgactgataaatattgtgacaataacctcgccggccggaccgaggatttcctttctcaagttgccctgcctagcctctctggtgccgtggttgttcttaaatcatgtgaagatcttctccctctggctgaagatctaagaatcgttcaaagatgtgttgatgttgttagctccaaggcttgcgttgaagcaaattttccaagccgttcgccaccaaattggtggacggaagagctgtcaatcttggacgtaaaattcttcggtaaagtgatcacttcaatgaagtcgcggggtgccaaggccttcactatagctagtgctttaataacatattctgagaagtccctccgggatcttgtacgcgaccattcaggaaatggtgccaggacagctgtttcagatgactctgacctcagaacccggcaacgggagcttctcgaatccatcgtggctctattaccgccagagaagtcctcttttcccattaacttcctctgctgtctcctcagagcagctattttcttgggagcagcgagtgcttgcaagattgagttggagaaaagaatatcagcaatactagaacatgtgacagtggatgatcttttggtggtatcttttacttacgatggggagaggctttttgatctcgagagcgtgaggaggattatatccggtttcatggaaaaagaaaagagcgttgcagtctttaatgcaggggatttcagggaagtgagttcaactgccatgctcagggctgccaaaactgttgatgcctaccttggtgaaatagcgactttttcagagcttagcatatctaagtttaacgggattgctattttggttccaaaggcagccagaaaggttgatgatgatgtttaccgggctgttgatatctacctaaaggctcatccgaatctagatgagatcgagcgggagaaagtgtgcagtgtgatggatccactcaagctatcctacgaggcaagggtccatgcttcacagaacaagcgcttgccagtacaaatcgttcttcatgcactatactacgatcagctgaaattaagaagtggaactgaagatcaaaagatgccaaatgcaattactacgagacgccaattgcaggctgatacatcactggctagagaaaacgaagaattgcgaactgagttgctaaagatgaaaatgtacatagcagatttgcagaagacacaggggccatctaccaaagcaactgcggcaagttcccgaaggccaacattcttctcctctatgtccaagacactggggaaactgaacccgttcaagcacggatcaaaagatacttctaatatagatgatgctctggtagatatttccaagcctaggaggagaaggttctctatttcctagatcgattctctccattgatcagggattaaatttttacgtttctgtcttgtgatgaatttgtgcattaggattggtgttgtgggtgaagaacttgtcgttgggtttgtgaaaaatttcagtttgtttctgtcccaaaacatttgtgtgtcattgaccatgacagagtatatggcacaccttaactt

SEQ ID NO: 8640 - DNA, 1843 bp, Triphysaria pusilla
atctccaaccttcctaacatatggccaacagagtctcccttgcaatggagagaactgggcaatgggttttttctcaagacattccaactgatgttattgttgtagttggggaagccaacttttcccttcacaagtttatgcttgtagcaaagagcaaccacataagaaaactgattcttgattcaaaagaagctgatctatcaagactaaacttatcagatatacccggaggcccggaaattttcgaaaaagctgcgaaattttgctatggtgttaactttgagattacagttcataacgtggcagctttgagatgtgctgctgagtatctacaaatgactgacaaatattgtgaaaataatcttgctggaagaacagaggatttcttgtcccaagttgcattaacgacgttatccggcgcactcgtcgtgctcaagtcttgtgaagatctcttacccatggcagaggatctaaggattgtccaaagatgtgttgagattgctagtgccaaggcctgtgttgaggctaactttccaagccgatcgcctccaaattggtggacagaggagctaacaatcttggacataaccttcttttcaagaatcatagcatcaatgaaatcaagaggagcaaaaggcctcactctagctagttccataatcacgtatacggaacgatcgcttcgcgatcttgtacgtgaccactccggaaacgctatcagaacatcggacttggatgtaatagaccgacaacgcgagcttctcgagtcgattgtgactattctaccctcagaaaaatcggccttcccgataaacttcttgtgttgtctacttaggacggcgattttcttgagggctgataataggtgcaagaacgagctcgaaaaacggatatcatcgatattggagcatgtgactgtggatgatcttttggttctttcgtttacgtatgatggtgagaggttgtttgatcttgagtccgtgaggaggattatatcgggatttgcggagaaagagaagaatgtgtctgtttttagcgcgggtgattttaaggaagtgtgctcgacggctatgcagagggtcgggaagaccgtcgatgcgtatcttggggagattgctacttatgttgatttgagtatttcgagatttaacgggattgcgaatttggtgcctaaggcagctaggaaggccgacgatgatctttaccgcgcaatcgatattttcttgaaggcacacccgaatctagatgaaatcgagcgagaaaaggtgtgtagtgtaatggacccgctcaaactatcgtatgaagctcgggtccacgcctcacagaataaacgcctcccggtccaaatagtgttgcacgcattatactacgatcaacttaagataagaagtggagtagaggagcacaagacaccggatgccattacgacgaggagtcaactgcaggccgacgttacccttgtgaaggaaaacgaagcgcttagaaccgagctattgaagatgaaaatgtatgtacaagagatacaaaaaacctaacactactactagtcgagggtcgtcgtctaaagtgagtagtgcgccgagaaagcctactttcttctcgtctgtgtcgaaaaactggggaaattgaatccgtttaagcatggatcgaaggatacgtcgaatgtggatgaggggttggatttgactaagcctagaaggaggaggttctctatttcttaagttagggattgtatttttaatttgttttttcatttttttttcttggtgtgctggtaatgtgtaaagaatttgatgcttttgtttgtttttatggattgtgaatttgtgagtgtgtttaatct

SEQ ID NO: 8641 - DNA, 2118 bp, Vitis vinifera
atactgataactatcccgaaaagtaagtcatcgaaagattaaaaaggcggcataacgatatgctcatcaagataaaactcaactaaaatctctatataaccctctactgatcctagagggtatctgacgatctctattctcagaaaccaatcgatctctcatggccgcctctctcaagggcaacaataggcgctctctggccatggagaggacaggtcaatgggttttctctcaagagattcctactgatgtggtagttgaagttggagaggccaatttctctcttcacaagttcatgctagtggcgaagagcaactacatcagaaaactgataatggaatcgaaagaagcagatttaacgaatattgatctctcggacatacctggagggcctgagatctttgagaaagctgcaaagttctgttatggcgtcaattttgagattacagttcacaacgtcgcggctctccgttgtgctgcagagtatctccagatgaccgacaagtactgcgacggcaacctgtccggacggacggaggatttcctcaaacaagttgccttgaccagcctttccggcgccgtcgtggttttgaagtcctgcgaagatcttctccctaaggcggaagagcttaagatcgttcaaagatgcgttgatgttgcaagcacaaaggcttgtaatgaagcaaatttccccagtcgttcgcctcctaactggtggacagaggagctttcaattttggacatcgggttcttcgagaaaatcatagctgccatgaaattacgcggcgcgaaatccctaaccgtagccagcgcactgatcacgtacacagagagaacgctccgagatctcgtccgagaccacaccggtaacggcatcaggtcgtcggacaccgaggattccaaccttagaagtcggcagcgggagcttctagaggcgatcgtcgtactcttaccctccgagagagcagcgctccctataaacttcctctgctgtcttcttcgctccgcgatcttcttaaaagtagcccatacttgtaagaacgagctcgagaaacggatctcggcgatcttagagcacgtaaccgtcgacgatctcttggtcctgtcgttcacctacgacggcgagaggctcttcgacctggacagcgttagaagaattatatcaggattcgtggagaaggagaagagcgtggctgtcttcaacggtggagatttccaggaggtttgttccaccgcgatgcagagagtcgccaagactgtagacgcgtacctaggggagattgccacgcacggagagctcagcatatgcaaattcaacggcatcgctaatctagtgcccaaggacgccagaaaggtggacgacgacctgtatcgcgccattgatatcttcctcaaggcacatccgaacctggacgagatcgagagggagaaggtatgcagcgtgatggatccactgaaactctcgtacgaagctcgagtccacgcttcgcagaacaagcggctgccggtgcagatcgttctgcacgccctctactacgatcagctgaagctcaggagcggcgccgacgatgcccacgacgccatgagcacgaggagccatttgcaggcggacgtgtcgctggtgagagaaaacgaggcgctgaggtcggagctgatgaagatgaagatgtacatctccgacatacagaagaattcttcggccggcggtggaaagggattaggcggtggttcaaagaagcccacgtttttctcgtccatgtccaagacattaggaaagctgaatcccttccggcatggatccaaggacacttccaacattgatgaagtgacggcggtcgatgttaccaagcccagaagaagaaggttctccatctcctaatccacttttgaaggagcatctacttctaatcccgctttaattaattttaattgtgtgctttggtttgttattcaaatctcatttgttttgattctgtattttatatgttagggaattgaattgttgtttgcgtgactttgatttaaaccgtcaaagttgaagttgtaatcaagtgattttgtataataaatagattgcattctctcctttcgatttcaatttctataattagacggttt

SEQ ID NO: 8642 - DNA, 1997 bp, Vitis vinifera
tataaccctctactgatcctagagggtatctgacgatctctattctcagaaaccaatcgatctctcatggccgcctctctcaagggcaacaataggcgctctctggccatggagaggacaggtcaatgggttttctctcaagagattcctactgatgtggtagttgaagttggagaggccaatttctctcttcacaagttcatgctagtggcgaagagcaactacatcagaaaactgataatggaatcgaaagaagcagatttaacgaatattgatctctcggacatacctggagggcctgagatctttgagaaagctgcaaagttctgttatggcgtcaattttgagattacagttcacaacgtcgcggctctccgttgtgctgcagagtatctccagatgaccgacaagtactgcgacggcaacctgtccggacggacggaggatttcctcaaacaagttgccttgaccagcctttccggcgccgtcgtggttttgaagtcctgcgaagatcttctccctaaggcggaagagcttaagatcgttcaaagatgcgttgatgttgcaagcacaaaggcttgtaatgaagcaaatttccccagtcgttcgcctcctaactggtggacagaggagctttcaattttggacatcgggttcttcgagaaaatcatagctgccatgaaattacgcggcgcgaaatccctaaccgtagccagcgcactgatcacgtacacagagagaacgctccgagatctcgtccgagaccacaccggtaacggcatcaggtcgtcggacaccgaggattccaaccttagaagtcggcagcgggagcttctagaggcgatcgtcgtactcttaccctccgagagagcagcgctccctataaacttcctctgctgtcttcttcgctccgcgatcttcttaaaagtagcccatacttgtaagaacgagctcgagaaacggatctcggcgatcttagagcacgtaaccgtcgacgatctcttggtcctgtcgttcacctacgacggcgagaggctcttcgacctggacagcgttagaagaattatatcaggattcgtggagaaggagaagagcgtggctgtcttcaacggtggagatttccaggaggtttgttccaccgcgatgcagagagtcgccaagactgtagacgcgtacctaggggagattgccacgcacggagagctcagcatatgcaaattcaacggcatcgctaatctagtgcccaaggacgccagaaaggtggacgacgacctgtatcgcgccattgatatcttcctcaaggcacatccgaacctggacgagatcgagagggagaaggtatgcagcgtgatggatccactgaaactctcgtacgaagctcgagtccacgcttcgcagaacaagcggctgccggtgcagatcgttctgcacgccctctactacgatcagctgaagctcaggagcggcgccgacgatgcccacgacgccatgagcacgaggagccatttgcaggcggacgtgtcgctggtgagagaaaacgaggcgctgaggtcggagctgatgaagatgaagatgtacatctccgacatacagaagaattcttcggccggcggtggaaagggattaggcggtggttcaaagaagcccacgtttttctcgtccatgtccaagacattaggaaagctgaatcccttccggcatggatccaaggacacttccaacattgatgaagtgacggcggtcgatgttaccaagcccagaagaagaaggttctccatctcctaatccacttttgaaggagcatctacttctaatcccgctttaattaattttaattgtgtgctttggtttgttattcaaatctcatttgttttgattctgtattttatatgttagggaattgaattgttgtttgcgtgactttgatttaaaccgtcaaagttgaagttgtaatcaagtgattttgtataataaatagattgcattctctcccttcg

SEQ ID NO: 8643 - DNA, 1550 bp, Solanum phureja
acagtgccgtcttgtagaacaagggaaagaagaagaagtggaattatagtttcccttttccatggctatctctacatccttttgccgccccatatcctctttcaatgctatcagttcaccgtctctctgttacttcaaacccttctaccaccacttgaaacttgatccttcttttgccctagtcaagtgttgctcctctcacattggacaatctccagaacacatgaacggcaggcaacctgatttatctcccatagctccttttggtgtcacgatgacaaataatggaacatctaaaccatcatatagatggcgtagggtactgcttaaagttagtggtgaggcactagcaggagatcaagcacaaaacattgacccaaagatcacaatggccattgcgagggaggtggcagctgtcactcgacttggcattgaggttgcaatagttgttggtggaggtaatatttttcgtggatcctcctgggcaggaagtagtggactggaacgttcttctgctgattatattgggatgttggctactgtaatgaatgcaatattcttacaagctacaatggagagcattggaatccccacaagagtccaaactgcatttagaatgtcagaagttgctgaaccatatatccgtagaagggctgttaggcatcttgagaaagggagagtagtaatttttgcagcaggaactggaaatcccttcttcacgacagacactgctgcagctctgcgttgtgcagagattaatgctgaggtggtcttgaaggcaacaaacgttgatggagtctatgatgataaccctaagcataatcctgatgctcgtcttcaggataacctgacttaccatgatgtaatttcaaaagagctctcagtgatggaccttactgcaattactttgtgccaagagaataacattccagttgtcgtttttaatctcaataaaacaggtaacattgctaaagccattaaaggagagagggttggcacattgattggtgacacatggaatacagaagcagtagtatcttaagaggacaaaaagttggtttcagcagatggaagttggattactgtttgtagcatttcaacacactcagagagctcattttggcagattgttccaagaagttggcactcaaagtattgagtaaattatgtgccgtttgcccttcaaaaactatggattcgaaagtactggagataagcatataatctcccggaatttttaacataaatgctgatactggatactactcccttggaattttcagagcttttcttgaagtgcaaaactaggtagccaagagttgcattctttgacatgtagtgctactttatatctacatttctattcttgcccctaacatatccattcacttaggggttgttttggtttgaataagatctatctataagaattatgcattacttatatatggtttgatgtataacaaaatttactgcgtatgtaaaattgcgtactacttatataacgtttgttttttgatacaaaatgctgcatgtcagttatatctatg

SEQ ID NO: 8644 - DNA, 1385 bp, Solanum melongena
tttccctagtttatccatggctatctgcacatcgttttgcggacctatttcctctttcaatgctatcacttggccgtctctctgtttcttcaaaccccacctcaaacttgatccctctttgcccgtcgtcaagtgttgctcctctcacattggtcaatctccagaccacaggcaacctgagttgtctcctatagccccttttggtgtcacgatgacaaataatggaacatctaaaccatcatacagatggcgtagggtactgcttaaagttagtggtgaggcactagcaggagatcaaacaaataacattgatcccaagatcacaatggccattgcgagggaggtggcagctgtcactcgacttggcatcgaggttgcaatagttgttggtggaggtaatatttttcgtggatcctcctgggcaggaagtagcggactggatcgttcatctgctgattatattgggatgttggcaactgttatgaatgcaatattcttacaagctacaatggagagcattggaatccccacaagagtccagactgcgtttagaatgtcagaagttgctgaaccatatatccgtagaagggctgttaggcatctcgagaaagggagagtagtaatttttgctgcaggaactggaaatcccttcttcacgacagacacagccgcagctctgcgttgtgcagagattaatgctgaggtggtgttgaaggcaacaaacgttgatggagtttatgatgataaccctaagcataatcctgatgctcgacttcaggataacctgacttaccacgatgtaattgcgaaagagctctcggtgatggacctgactgcaattactttatgccaagagaataacatcccagttgtcgtttttaatctcaataaaacaggtaacattgctaaagccattaaaggagagagggttggcacattaattggtgacacatggaatacagaagcagcagtattttaagaggacaaagtcactttcagcagccggaagttggaatgctctctgtagcatctcaacacactcagagagctcattttgtcagattgtcccaagaagttggcactcaaaagtgctgactgaattatgtgccctttgccattttgaaagccatggattcagaagcactgaagataaacctataatttcccagaatttaacgtggatactacttcctcggaattttcagagcttttcttgaagtgcaaaactaggtagccaagagtagttgcattctttgacgtgtaatgctactttatatctacatttttattttgcccctaacatgttcattcacataagggttgtttggtttgaagtatattccatctataagaattatgcataacttatatttggtttgaagttg

SEQ ID NO: 8645 - DNA, 1293 bp, Nicotiana benthamiana
gagatattttcctggggagatgacatgtttcaaaagcccaaacatttaacattatccacaaagaacgttcccacgttgtacaaaagcaaaggagaattgaacaaaaaggctttgatttgaacatcctattccgctgcaatttcttaaatttcggttttcctttgagagtaatttgctgttttttttccatggctatctctacatccttttgccggcccatttcatctttcaatgctatctcttcgccgtctctctgcttcttcaaacccctacaccaccacttcaaacttgatgactcttttcattctttggtcgtaaaatgttgttcgtctcacatggacaaatctccagaccacttgaatggcaggaaaccagagttgtctcctatagcttcttttggtgtcacgatgacagataatgggacttctacaccatcatatagatggcgtcgagtgcttcttaaagttagtggggaggcactagcaggagatcaagcacaaaacattgatcccaagatcacaatggccattgcaagggaggtggcagctgtcactcgtcttggaattgaggttgcaatagtggttggtggaggtaatatttttcgtggatcctcctgggcaggatgcagtggactggatcgttcatctgctgattatatcgggatgttggcaactgttatgaatgcaatattcttacaagctacaatggaaagcattgggatccctacaagagtccagactgcatttcgaatgtcggaagttgctgaaccatatatccgtagaagggctgttaggcatctcgagaaagggagggtagtaatttttgcagcaggaactgggaatcccttcttcacaacagacactgctgcagctttgcgttgtgcagagattaatgctgaggtggtgttgaaggcaaccaacgttgatggagtctatgatgataaccctaggcataatcctgacgctcggcttcaggataacctgacttaccatgatgtaatttctaaggagctctctgtgatggacctgactgcaataactttgtgccaagagaacaacattccagttgtagtttttaatctcaataaaccaggtaacattgctaaagccattaaaggggagagggttggcacattaatcggtgacacatggaatactgaagctgcagtgtcttaagaggaaaaaagaaaagaggtatgtttccgcagctggaagctggattgctgtttcgtagcattttaacacactgacatagctcatttttgcagattgttccaagaagttggcactcaaa

SEQ ID NO: 8646 - DNA, 1418 bp, Capsicum annuum
ggcagaacaagggaaagaagaagaagaattgaacatcgtaattttgagattagtttgttgtatttgttccatccatggctatctctacattcttaagccggcccatttcttctttcaatgctatcacttggccatctctctgttttttcaaatccatgtaccaccagttcaaacttgatcatccttctttgggcgtcaagtgttgctcgtctcacattgaccaatctccagaccacatgaatggcaggcaacctgagttagctcatatagctccttttggtgtcacgatgacaaataatcgaacatctaaaccatcatatagatggcgtagggtgctgcttaaagttagtggtgaagcactagcaggagatcaagcacaaaacattgatcccaagatcacaatggccattgcgacggaggtggcagctgtcactcgacttggcattgaggttgcaatagttgttggtggaggtaatatttttcgtggatcctcctgggctggaagtagtggactggatcgttcatctgctgattatattgggatgttggcaactgttatgaatgcaatattcttacaagctacaatggagagcattggaatccccacaagagtccagactgcatttagaatgtcggaagttgctgaaccatatatccgtagaagggctgttaggcatctcgagaaaggaagagttgtaatttttgcagcaggaactgggaatcccttcttcacgacggacactgctgcagctctgcgttgtgcagagattaatgctgaggtggtgttaaaggcaacaaacgttgatggagtctatgatgataatcctaagcataatcctgatgctcgtcttcaggataacctgacttaccatgatgttatttcgaaagagctctcggtgatggacctgactgcaattactttgtgccaagagaataacattccagttgtcgtttttaatctcaataaaccaggtaacattgctaaagctattagaggagagagggttggcacattaattggtgacacatggaatacagaagcagcagcatctaagagggcaaaaagtctgttttagctgctttaagttggattgatgtttgttgcatttcaacacactcagagagcgcattttggcagattgttccagcaaaattggaactcagtgtgagggaattagtgccctttgccttccgaaagccatggattcgaaaatattgaagataataatataatttccaggaataatttaacataaatgatgataatggacactactccttggaattttcagagcttttattgaagtgcaaaactaggtaagcatagagttgcattctttgacctgtaatagcacatattcattcactcacagccgcggattaacactatttaggacacgtttggtagatgtatttaa

SEQ ID NO: 8647 - DNA, 608 bp, Solanum melongena
catttggatatacgagaaaggatgttctattgatcggagttggagttactcttctaggggttggcttaaagagtggattggagttcttgggatttgaccctttacaagctggaaatgtagttcaattagtcctggtgttgggtctaacagttggatggatctctacatacatcttccgggtttcaaacaaggaaatgacatatgctctacaattgcgagactatgaaagcaaagtcgtggagaaacggttagagagcttaacagaagcagagttacaagtattgcttgagcaggttgaagaagagaagacccgcctgactagtggtgaggaggtcaaatagatatcgttttcctcatgcctatataccgttggaccttgttgtccatggaaaatggtgtagatgataagtctgtctgtacaatagtcaatatatgtttgcataacatctgatggtcatatccaacgtgataaaacaattctggaatggaaaaggtttccctaggtggggaattcatgttctgtaaattgtttaggattttatagaaatacatgatatacgaactattatttatcgtagaacatgaatgtgatgaaacaatttattgtc

SEQ ID NO: 8648 - DNA, 1250 bp, Glycine max
atctttatgcttatcacttccttaggacgctcgtttaagcttcttctatgttttgaaagcttgctacgtcagctgatttcccctttctccaggaatggcttatgttccacatggaaatgcaaatttcaactctttattcctaaaatttgcaatttctcatgtgggtatttcttctttgcccttcttgcacccgggactgaaatcttgtacagtcttcaacagaggaacactcattcgccagtgtttaaatggaaagcggaatttttctctatcagaaaagcgatttaattgcaagttttcaaagaaagacagattctttatccctagaagtagtagttcttctaactctagtggaagtacggatgaaccctctaatgagacagagaagacaccatttggatatacaaggaaagatgtcctattaattggacttggagttactttacttggcattggcttaaaaagtggactggagtttgttggagttgactcactgcaagcaggaaatgtagttcagctagtgctggttttgggccttacagttgggtggatctcaacatatatcttcagagtttcaaacaaggaaatgacatatgcacagcaactacgtgattatgaaagcaaagtgatggagaagcggttagagtccttaacagaagcagagctacaagcactgcttgaagaagttgaggaagagaagagtcgctagctagtggtacacaggtgaattggagtagcttgtttgtatatatacactgaaatgaagttttgccaaagtaattgaaacagaaatttcaacctatatggactactagttctgaaagattttagtgatgctttctttagtttactccagacaaaagggtgagacttcaaaatccttagtgttctgttcacaaaaaattccagatggaagcaactctgtaagatatgatgataatgcttcttttaaattcatataattttgtgacttttcttggagccgttcaccactgttctataatactatgatgaataatgttgaaggtaccgttggaacttggcctacaaccattttcctcataacctgagtttttaaatagtttacttgttgttcttatgttccctagctccttgagaaacgaattgcatgtcctttaggtacacaactaccaacaactcattgtgaccacttatttggtcatttgtgaatcttatcaatatgtgatctgcactgccctctagttgaagcatttgtttacaaaataaat

SEQ ID NO: 8649 - DNA, 1163 bp, Glycine max
ctccactcgtccctgcttattcttctccttccacaggaatggcttatgttccacatggaaatgcaaatttcaactctttattcctaaaatttgcaatttctcatgtgggtatttcttctttgcccttcttgcacccgggactgaaatcttgtacagtcttcaacagaggaacactcattcgccagtgtttaaatggaaagcggaatttttctctatcagaaaagcgatttaattgcaagttttcaaagaaagacagattctttatccctagaagtagtagttcttctaactctagtggaagtacggatgaaccctctaatgagacagagaagacaccatttggatatacaaggaaagatgtcctattaattggacttggagttactttacttggcattggcttaaaaagtggactggagtttgttggagttgactcactgcaagcaggaaatgtagttcagctagtgctggttttgggccttacagttgggtggatctcaacatatatcttcagagtttcaaacaaggaaatgacatatgcacagcaactacgtgattatgaaagcaaagtgatggagaagcggttagagtccttaacagaagcagagctacaagcactgcttgaagaagttgaggaagagaagagtcgctagctagtggtacacaggtgaattggagtagcttgtttgtatatatacactgaaatgaagttttgccaaagtaattgaaacagaaatttcaacctatatggactactagttctgaaagattttagtgatgctttctttagtttactccagacaaaagggtgagacttcaaaatccttagtgttctgttcacaaaaaattccagatggaagcaactctgtaagatatgatgataatgcttcttttaaattcatataattttgtgacttttcttggagccgttcaccactgttctataatactatgatgaataatgttgaaggtaccgttggaacttggcctacaaccattttcctcataacctgagtttttaaatagtttacttgttgttcttatgttccctagctccttgagaaacgaattgcatgtccttcaggtacacaattaccaacaactcattgtgaccacttatttggtcatttgtgaatcttatcaatatgtgatctgcactgccc

SEQ ID NO: 8650 - DNA, 885 bp, Ricinus communis
gccacccgcttcttcttcttcttcttctcctccttctcctttcgtccataaaaatcacaggatgaattctcttctgcatggaaatctaaattgcaatattttatgccaaaatagagctttttcctatgtgggtatttcaagtcctacagtgctgcatttcaagagaggaggattaatttcacgaagcttgtatagaaagaacattttctcttttccaagaaaagcatcatccagcagcgtaatatcaaataaagtaaaattcattacacctagatgtagcagttcctcagactccagtagcagtaaagatggttcccctgatcaaggcaaggcatacaccttttggatacaccaggaaggatgttttattgattggacttggagttactgttcttggctatggcttgaaaagtggactggagtttgttggagttgatcccttacaagcaggaaatgttgttcaattggtgttggttttaggcctaacagttggatggatttctacatacatctttagggtctcaaacaaggaaatgacatatgctcagcaactgcgggactatgaatacaaagtcatggagaagcggttggagggtttgacagaagcagaattagcagtactgcttgaacaagttgaggaagagaagagccgccaagcaagtggtgagcaggaaaatcagcttacagaatctatgtctaccttatctgtacccactgaaatatgggactgtagataactgttattaccttgtaactttctagttgcaaaatccaacagctgcagatttcaagaggtaaccaaaatacaatctggggtcaatacccaacagattctgatattttggtggtcattttatctgcaatataaaaattaaaatttgaaaa

SEQ ID NO: 8651 - DNA, 908 bp, Epimedium sagittatum
acagcagagatttgatttggttgggagtaagtaaagattcgacaattcttcgtccctagcagagatttaatctcctccgatggctctggacatgttgggtatatctgcttctgctcatggcttcgcttctcaaacaagacaaaccaacaaactatctacttttcttcaaacatttgctgctcatggaaatttaccatgccatcgctcatatccaacaaaaatcttcccacgtctaaggagcagcatgaaatcaaggaagaagttctctattatccccagtagcagtggtccgtcgtcttctgacggtggtgaagctgaagacggtggtgaagctgagtccaaagtttccgatcaggtgaaggtaccttttggatactcaaggaaggatgttttattgattggcgttggagtcactctgattggtgttggtttgaaaagtggattggagtttgttggagttgatcctttgcaagcaggaaatgttgttcaacttgtcctggttttggggttgactgttggttggatttcgacgtacatctttagagtctccaataaagaaatgacctatgctcaacagttacgtgactatgaaagcaaagtcatggagaagcgattagaaggactaacagaagcagagctccaagtactccttgaacaagtggaggaggaaaagcaacgcctaactggtggggagaagatttagtttgatgtcatgtgaatgtatcccaatccacttcaccaactaaaagttaaatggaattactctgtatatattctataaatagttgtgatggcctctcattgttacccgaatgctgtttcgatcaaatatgatgtggtcgggccatcttaccccatgtgggtgtgctagcatcacaccattgaaaatctgcaggcttaaaaaaacg

SEQ ID NO: 8652 - DNA, 949 bp, Fagopyrum esculentum
cggtcacagttgctcttcttcccaacagcctcgtcattgcgttctctgtctctccctctcttgctttgtttcttcccaattttgggggagatttattctagggtttgaaacatgatactagtactaggtaactctcgtcttctaaatcataatctcaatgcatcaggctgttcgagcttcaaattcaaaggaacgctgccatctcagcttgcttttccacggcaagatggaatagatgtttcagcttttgcgacgaagcagtcggtttgcagttcattgaaaaggctttctttaatcccaagatgcagctccaatgatgataacaatgcatctattaaccaggataagacaccgtttgggtacacaaggaaggatgttttactgattggagttggagttacagtcgttggagttggactgaagagcgggttagagttcattggttgggattccttacaagcagggaatgttgtgcagctggtgatagtattaggcctgactgtcggttggatatcaacatatatgtttagggtctcaaacaaagaaatgacgtacgcacagcagttgcgtgattacgagagcaaagtgatggagaagcggctggagagcttaacagaagcagagttggccgtattgcttgaacaagtagaggaggaaaagcaacgcgattctagtagcaagcaggttggttgaagctctcctgtcctcccgacgatatacaggtgcatagttattaaggacagctgaaaaatgggatagtaagtctaaactgtgaatgtattgtataaaatgcattgagttgagaatggttaaatggttgtaaattgtattgtatccatatgatcatccggattgctatgtactggatttgtttgacagtaaaaaaaggaaaacgaaaactaaactagtcgtggtataacctaacctacgtcgttcttcgtaggaacgt

SEQ ID NO: 8653 - DNA, 930 bp, Lupinus angustifolius
aaggacacatttgagagaacaacctcatcctcaatgctttaacgttctccactcatctctgcttcttcatcttctccttccacagggatggcttatgttattccacatgtaaatataaattgcacctttttataccaaaaatgtgctatttcgtatctgggtatttctgctttgcccttcttgcaaccgagattaaaagcttctacaggtttcagcagaggaacagtgattccccaatgcttcaatggtaggaggagttttactttaccaggaaacagagtaaggaaggtctttaagaaagatagattctctatcccaagaagtactacttcaaattctagcggcgacagtgctgacgagacaaagaagacaccgtttggatatacaaggaaagatgtcatattaattggggttggagttactctccttggcattggcttaaagagtggattagagtttgccggagttgatccattacaagcaggaaatgtggttcagctggtgctggttttgggtctcacaattggatggatctcaacttatatctttagagtttcaaacaaggaaatgacatatgctcaacaactacgtgactatgaaggcaaagtgatggagaaacggttagaatccctgacagaagccgaacttcaagcactgctagaagaagttgaggaagagaagagacgctagctagttgtgagcaggtgtgaataaaacagaaattcagcttgtttgtatatatagactgaagttttaccacagtaaatgaaacataaattttaatctctatggacctagttcagaaaggtttaagctatgcagtgcttcagtttattactcacagacaaaaatgtaatatacttcaatttccttagtgttcacacaaaattccagatgcaagtaactcgttaagcttgaatgataatgctt

SEQ ID NO: 8654 - DNA, 837 bp, Amsonia hubrichtii
aactttggagccactagaattctccttcgcaacagcaagaagtagactttgcagccatggcgtctgtaccatgtccagagataagcaacagcattttgtgcaaaagtagagcaatttctttggtgggcttgtcttcttttccattgcaagaaccaaggtctgttgagtacttcagtagagaaagagtattatcagcaagccttctgagacagggaagttctccttttcttagaaagagattctatggatttgtgccaaagcaggtgactataatcccaaggagcaacatcttcccaaactctggtggtagtgaggataattcctctaaacaagagaagacaccatttggatatacaagaaaggatgtcttattgattgggcttggagtaactgttgcagggattggcctgaaaagtggactggagtttcttggagttgatcctttgcaagctgggaatgttgtgcaactagtcctcgtcttaggcctgacagttggatggatctcaacatacatattcagagtctcaaacaaggaaatgacatatgctcaacaattgcgagactacgaaagcaaagtcatggagaaaagattggagagtttaacagaagcagagttggcagcattgcttgaacaggttgaggaagagaagagacggctggctagtggcgaacaagctaaataaatgtcatgttcatatcgtttcaaaaatcattccagaatgactggtatacatgcccccatatgtgaaaactctctgtataaatgggatcctctttaagattggaaatgtaagtatcaaagataatgatacttaggtttgcttattttaaatgctt

SEQ ID NO: 8655 - DNA, 967 bp, Humulus lupulus
ccagttacggaccgaaaaggcttcgtttaccagtcatctacaactctcaacagtaaaaatatccataaccgaagacgaactcagtcactgtgcttcatcctcgactacctccctacgctcttgttggaagttgcagggatggccaccgttttccatggaagcactgcaaattccagcatgttatgtgaaaggggtgcaatttcgttaatgggtatttcagctcttccactcctccaaactagggtcagagtttttgatggtttggttaaaggaaaattaataactcagaacttgtatagaaacaaaaaatcctctttccagggaagaggatacaaaagcatgaggtcgaaaagagtagtatttaccgttcccagatgtagtggttcttcggactccaacaacagtgaaaatgactcctctaataaggcaaagacaccttttggatacaatagaaaagatgttatactgattgggattggagtaactgctcttggagttggcttgaaaagcggattagagtttgttggagttgatcctttacaggcaggaaatgtagttcagttggttctggtcttaggactaactattgggtggatttcaacatatatctttagagtttcaaataaggaaatgacttatgctcaacagctacgcgattacgaaagtaaagtcatggagaagcgattagagggcctcactgaagcagaactagaggcattgctcgaacaagttgaggaagagaaacgcctagctagcggtgagcaagttaaatgaagttcaatttcaattggtcacatatatacctcaatactgttgttagtctttgaagctcaagtaccattgtatagagtactgactgaaaaaagatgattagaactaagaaataatgtcatattaatgtaacataatttctggtaaattcacagatgcaaataactgagaatagtcagagatcatatattaagtt

SEQ ID NO: 8656 - DNA, 3194 bp, Cannabis sativa
aaaaatatgagttgctaaattcatttacagttgaactagggtgttgtaaggaaggacatataaatatgtgttcttattgtatcacattctcttgctttcataacagacacctttcggatactctagaaaagatgttctattgattggggttggagtaactgctcttggcattggcttgaaaagcggtttagagtttgttggagttgatcctttacaggcaggaaatgtagttcagttggttctggttttaggactaactattggatggatttcgacgtatatttttcgagtttcgaataaggaaatgacttatgctcaacaattacgcgattacgaaagtaaagtcatggagaagcgattacagggtctgactgaagcagaactcgaggcattgctcgaacaagttgaggaagagaaacgcctagctagcggtgaacaaagttaaatttctctagtcatttttatacaacacatcgagaccattatcggtctttgaagctttagtaccactgtatagagtactgactgaaccaaaaaaaaaagatgactagaataatgtaacataatttctggtatattctttacaaatgcaaataactgaaaagggtcagagataatatattaaagtcacaagttttaaaatgcttctaatttgtaccatgagttaacaatttaacttaaggtaaaagaagttctaatacacaaaagcagttgatcaattcaacaatctctacactgagagtccaaaattttagaaatggcatgttagaaaacttataaactaattatgactttcgcgaccttccgcttttgccttttccagttttcccccgagctgcaggtgctttcgcgcttttgtttgctgaaaccttcccaccccgttttcctttatgcccattttcggccaaatcatcgtcgtcgtccaaaattttagaaatggcatgttagaaaacttataaactaattatgactttcgcgaccttccgcttttgccttttccagttttcccccgagctgcaggtgctttcgcacttttgtttgctgaacccttcccaccccgttttcctttatgcccattttcggccaaatcatcgtcgtcatggcatgacctataacatacataccctcaagaatatccacttttttcgggatagcagaagatttctgacccattggaccatatcccagctcaccattctgagcctgaccccaacttatgcatgactgatcagctccaacaaaatggtgcatgttacccgaatccatacaacgtaaattccaaccgcttagatccatgaccggtttaggatacatccaatcgtcgcctgtattctttaatttcccccacatgtataactggcctccagcagcagtacacgcagaattaacagaaccagcagatataactgcgtcgggaggtaaccatatcccagctcaccattctgagcctgaccccaacttatacatgactgatcagctccaacaaaatggtgcatgttacctgaatccatacaacgtaaattccaaccgcttagatccaagaccggtttaggatacatccaatcgtcacctgtattctttaatttcccccacatgtataactggcctccagcagcagtacaagcagaattaacagaaccagcagatatgactgcgtcagaaggtaaaacattttgcctctggaaaacatcaacacggcgaggttcccactcatccttctgctccctatgtccaagtcttccataaccaccaaatccccatgagtaaacatgaccatttgcatccacagcaattgtatggtttgttccacacgcaactttaacaattgtttcccccgaaagggaagctattggtttggggcgaggttgagcttcgtaagcaagcttcaccgagccatctttagtattgtactcgttgtcagtcccgtgcccaagttgcccatattgtgggagacccgcggtcagtatagaagctccttcaaccgaagataaccaaacggtgaaatcagccccacatgcagtagttttcacatcagacacaagacaactaactggagatggttcaaattcattttttgtcgagcctgttcccagttgtccatgtttgttccaaccaaaggctagggactctccattttcggcaactacaactgtgtgattcctcccagctgaagcttgaacaattttgtacctataacgcatcaaacacaaaaagccaatattacaaaagtcgctaatcaattatcggttggtgttcaaatagcaatacctccaaccaaacgccaccttataaaaaactaagccaaaacaaactataagaggtgacataccgttaacaatgcaatatcaatatcgaatcctataaattttaaatttttatttaatatataatatgagaaactatcagttggtgttcaaataacaatacctccaaccaaacgccactttataaaaactaagccaaaccaaatcataagaggggacatatcgttaacagtgcaatgttcaatatcaaatcctacaaattttaaatttttatttaatatatagtacaaaaaaaccgctaatcaattatcggttggagttcatatagcaatacttccaaccaaacgccaccttataaaactaagccaaaccgaaccataagaggtgacataccattaacagtacaatgtcaatatcgaatcctacaaattttaaatttttatttaatacataataaaaaaaaaccgctaatcaattattggttggtgttcaaatagcaacacctccaaccaaacaccaccttataaaaactaagccaaaccaaatcataagaggggacatatcgttaacagtgcaatgttcaatatcaaatcctacaaattttaaatttttatttaatatatagtacaaaaaaaccgctaatcaattatcggttggagttcatatagcaatacttccaaccaaacgccaccttataaaactaagccaaaccgaaccataagaggtgacataccattaacagtacaatgtcaatatcgaatcctacaaattttaaatttttatttaatacataataaaaaaaaaccgctaatcaattattggttggtgttcaaatagcaacacctccaaccaaacaccaccttataaaaactaagccaaaccaaatcataagaggggacatatcgttaacagtgcaatgttcaatatcaa

SEQ ID NO: 8657 - DNA, 795 bp, Catharanthus roseus
gcagaccttgtaattgtatccatggcgtccgtaccatgttcggacataagccacagcttattgtgcaaaagtaaggcgatttcttcagtgggcttgtcttattctccactgcaaggatcaaggccgaggtctgttgagtgcttcaatagagaaagagtaatctcagcaagtgtactgaaacagggaaggtctcattttcttagtaagggattctatggtttggtgtcgaagaaggtagctacaatcgcaaggagcaatgtttcctcaaactctggtggtaatgaggataattcctctaagcaagagaagacaccatttgggtatacaaggaaggatgttatattaattggagttggagtaactcttgctgggataggcctgaagagtggactcgagttcttgggagttgaccctttgcaagcggggaacgtagttcaactagtcctggtattaggtcttacagttggatggatctcaacatacatattcagagtctcaaacaaggacatgacttatgctcaacaattacgagactacgaaagcaaagtcatggagaaaagattggagagtttaacagaagcagagttggcagcattgcttgaacaggttgaggaagaaaagagagggctagctggtggtggtgaacaatctaaatgaaggtttcatggctttctaagtattcttcctagataaaattgtacacatgcctaatgttttcctatttttagaggaaatggtagaatttcaaggtcacatttcaatatcaatgcataattctgatattctattatatat

SEQ ID NO: 8658 - DNA, 678 bp, Chelidonium majus
tttggtttcaattgattcttattcgggtcatgggttctctttagaaacaacacagaaaatcaacttctccagaccttcttcttctcttctaaatacatttccaagaaaagttactccccagggttcatattcaacgaaaagcttctcttttccaagaagatgcgtcgacaacatcaactcaaggaccaagttctctgtagtccctagaagcggtggttcctcatcttctaatggcagtgaaaatgactcaaaagcctctgaccagaccaaggtaccttttggatactcaaggaaggatgttttgctgattggggttggagtgactttgcttggcatagggttaaaaagtgggctggagtatgccggagttgatccattacaagctggaaatgttgttcagctggtgttggtcttggggctaacagttggatggatatccacatatatttttagagtctcaaacaaggaaatgacgtatgctcagcagctacgtgactatgaagccaaagtcatggagaagcggttagagggattgacagaagccgagcttcaagtattgcttgagcaagtagaggaggaaaagcaacggtcggctagtggtgagaaggttaattgaagctcccttatcttgctatttttgtaagtcgtaattttgtatctatcacattttatacacgt

SEQ ID NO: 8659 - DNA, 925 bp, Lippia dulcis
tgttaagctgaagatagttttgctccactcaagtctcacaaccacttctggcaacaaattagaaaaccaagattctgtttttctgggaacaggcccaaatccaagataacagcaatggctgccatgccaatggcggatttgtgtagcaacagcatgtttagcaaatataggtcgattcctctaacgggtttgtctgcttttccatggcaagaagccagaacaagacctgctcagtgttccttcaaagaaaggattacttctcgagaatttatcacacaaggagcatgtcgtaagagaaatttttcttcaatatcaaagaaatcactctctataattcccagatgcagcgactcgccaaacgcgagtggcgataaagacaaaccctcaaacaaggggaagacgccatttggatacacaaggaaagatgttttactgattggtgtaggagttactgctgctggctatggtctgaaaagtggattagagtttgttggggttgatcccttacaggcagggaatgtggttcagttagtgctggttttaggtcttacagtaggatggatttcaacatatatcttcagagtctcaaataaggaaatgacatatgcccaacagttgcgcgactacgaagtcaaagttatggagaaaaggttggagagcttaacagaagcagagatacaagcattgcttgaacaggtggaggaagagaagcaacgtttggccagtggagagcaagttaactagtggctttggtaattttttaatacattggaaaatagttggtaaaaaagaggaatgctttttctttcttttttttttccatttgtaactattgtataaagttatgacgatgcaccgggaaattcttaattatatttgtaatagttgataaaattcatacctcctatccggatgtagggtgaaa

SEQ ID NO: 8660 - DNA, 929 bp, Trigonella foenum-graecum
ggtacagagagagaagttgaagaaaacctgatctctatcctctatctgtccactcgttttgtgtgttgttctttcgacggggatgatggcttgtgctaaatctactatttgctattctgctttacccttcttccaacggacgggattaccacctgcttcttcttcttcttctttcaacaacacaggaacattcattccccaatgttttagtggaaatagctcttttattttaacatggaagagcttcagttgcagcagcagcaagttttcaaacaatgacatattctctatccctacaagaagaacaagaacaacaactatcacttcttcaaactctaccaataatgacacctctaatcaggctaagaaggcaacatttggatattcaaggaaagatgtgatattaattggacttggagttactttccttggcattgccttgaaatccggactagagtttaccggagttgatccactgcaagctgggaatgtggttcaacttgtgctggtattgggcctcacacttggatggatttcgacatatatcttcagagtctcaaacaaggaaatgacatatgcacagcagctacgtgactacgaaagcaaagtcatggagaagcggttagagtccctaacagaagcagagctacaagtactgcttcaagaagttgaggaggagaagagtcgttagctagcgatgaagaggtgaattgaagtagcttgtttgtatataaacactgaagttttacagaagtaattaaactgaaactataatctacatggactagtttagaaatatgtttgctgcagttcactctcaaacaaaatgtagagaattgcaaaactacagtgtttatgaaaaactcgacatggaaataactctgtaatgacgcatgaatcacattgctttaaattcatataatttagcc

SEQ ID NO: 8661 - DNA, 855 bp, Trifolium pratense
  misc_feature (46)..(46): n is a, c, g, or t
ctcagttcaggatggcagcatatgcttcttgttctatttcctctgnctgctttaccctttttccaacaacggaggatcccactactacaacctccaccttctttttcttcacctttcaataacacaggaggaagaggaggaggaggaggcggaacactcatcccccaatgtttaaatggaaaaaagagattcagcctaaagttttcaaacaaacatagattcacttcaatccatactagaagtaccaatgatgatgaaattgacacctctaataaacagacaaagaaggcaccatttggatattcaaggaaagatgtcattttaattggacttggagttactttccttggcattgccttaaaatccggactagagtttgccggagttgatccactccaagctggaaatgtggttcaacttgtgcttgttttgggcctcacagttggatggatctccacatatatcttcagagtttcaaacaaggaaatgacatatgcacagcagctacgtgactacgaaagcaaagtcatggagaaacgattagagtccctaacagaagcagagctacaagtactgcttcaagaagttgaggaagagaagagtcgttagctttagctagtgatgaagaggtgaattgaagtaagcttgtttgtatataattaaacacttaagttatacagcagcaagtaaacagagacattaatctgtatggctagtttagaaagggtttttgctatgtttgctacagttcactctcagacaacatacatgtagagaattccaaaattatagtgtttggtatcttagcaatatgtaatatacactgccctttatttaaagcgattatttacaaaa

SEQ ID NO: 8662 - DNA, 1134 bp, Glycine max
cttgaacaacctcatctccaatgagttaacgttctccactcgtccctgcttctgcttctgctcattcttctccttccacagggatggcttatgttccacatggaaatgcaaattgcaactctttattccaaaaatttgcaaattcccatgtgggtatttctgctttgcccttcctgcaaccgggactaaaatcttgtacagttttcaacagaggaacactcattcccctgtgcttaaatggaaagaggagctttgctttatcagaaaagggatttaattgcaagttttcaaagagagagagattctctatccctagaagtagtagttcttctaactctagtggaagtacggatgaaacctctaaggagacaaatgtaaagacaccatttggatatacaaggaaagatgtcctattaattggacttggagttactttacttggcattggcttaaaaagtggactagagtttgttggagttgattcactacaagcaggaaatgtggttcagctagtgctggttttgggcctcacagttgggtggatctcaacatatatcttcagagtttcaaacaaggaaatgacatatgcacaacaactacgtgactatgaaagcaaagtgatggagaagcggttagaatccctaacagaagcagagctacaagcactgcttgaagaagttgaggaagagaagagtcgctagctagtggtacgcaggtgaattggagtagcttgtttgtatatatacactgaaatgaagttttgccaaagtaattgaaacagaaatttcaatctatatggactagttcagaaaggttttagctatgctttcttcaatttactcagacaaaaggatgagacttcaaaatccttagtgttctgctcacaaaaaattccagatggaagcaactctgtaagatatgatgataatgcttttaagttcatataattttgtgactttttttggagccgttcaccactgcacctcatgctatgatgaataatgttgaaggtactgttggaacttggccaacaaccattttcctcaaaagctgaatttttaaatagtttacttgttgttcgtatgttccctagctccttgagaaatgaattgcatgtcctttaggtacacaatt

SEQ ID NO: 8663 - DNA, 853 bp, Coffea canephora
gaagccactcgcactcgcccgcccggaacaaaaacgagcagcagaaaaccttaaagaaatggcatccgtaccatgttcagacataagtaacagcgttttatgcaaaagtagagcgatttctttggtgggcttgtcttcttttccattatcagagccaaaggcgggaggtttaccctacctctctagagatagagttatctcacagggaattcttagaagaggaactttgccttatattagaaggggattgcatggcttcgtgacaaagaaagtgactacaattcccaggagcaacatatcctcaaactccagtgatggtagtggtgatgactcctctgaccaagacaagaccccttttggatacacaagaaaggatgttctattgattggtcttggagtaactctttttggaataggcctgaaaagtggattggagttctttggagttgatcctttgcaggctgggaatgttgtccagttagtcctggttttgggtttgacagtagggtggatctctacatacattttcagagtttcgaacaaggaaatgacctatgctcaacaattacgagattatgaaagcaaagtcatggagaaaagactggagagtttaacataagcagagttacaagcactgctggaacaggtcgaggaagagaaaagccaaccgactcaaggcgagcaacgtacctgaatgtttttattatatctgttcaggattcaagtacatacacacctgtataagaagtgttcttgtacaattgagatgcataatcaaatgtagtgaccaacaagggaagacagatatggatcattttcttgtttgagatacaattatccaagttgatggtaa

SEQ ID NO: 8664 - DNA, 937 bp, Ipomoea nil
aaggctttccccgcggggctataagctgttatttgtttttcaatactatacctgaagagaagaaagcttgcggaaatggcttccacaacatatgcacccgcctatagcagccttatatgcacaaccagagtggtttccctcatgggtttacccctttttccattgatgaaaccagaaaatggtcgctctcgctcccccggacttcttagagctggcacttccacagtttttaaaagtggatcctactcagcttccaataaatcaaaaacactctttcctccaagatgtagtttagattcaagtgggagtaaagatgaatcctccaacaaagataagacaccgtttggatataccagaaaggatgttctattaattggacttggagtcacggctgccgggtatggcctaaagggtggactggagttcctcggtgttgattctttacaagctggaaatgtagttcagctggtcctggtcttgggcctaacagttggatggatttcaacatacatcttcagggtttcgaataaggaaatgacctatgctcaacaattaagggactatgagagcaaagtcatggagaaacgactggaaagcttaacagaagcggagctacaagtattgcttgaacaggttgaggaagagaagcaaagtctagctaagggcgatcaagtctagtggacactgtttttgccattttcatcattacgtaatcttctcgaaaagttggtgaaacaaatgccttgctgaaagtcgctgatagatggcgaagtatactgtatactggaaatgaaaagattcctcttcagttgggaggctatatgttgtacaaatttattagcaacttacaagataagaagatcatgtttagaaatagaataggattcagtagaatcatgaaaatgttttagaatttagaaagaatgtaataaatgca

SEQ ID NO: 8665 - DNA, 1373 bp, Sesamum indicum
gggggcggcgtgcggcggaggggggatgcgggagattggtgtagacgcattacccgacccgactcccacccgaaccgtccgagccatactacccgacccgactcgacactccgagcgggctgtgcgcttaacaacatatacaatccgcttctcatccatcttatctaatttccaccaagaaaaaaggatatatattgagactcatttctccccataaaaaagcacgggaagatatcagcaatggctaccacaccatgcatagatctttgtaacaacagtatattttgcaaaaataggcccatttctattatgggttcatcagcttttccattgcgacaatccagaaagcgacgggctcagtgcttcttgaaagaaaggaattattctcgaaaatttatcacacaaggagctattcctttcctgaagagaacttcgttttcttcaatatcgaagacatcagtatctacaattaccagatgcagcaactccccgaacttaggtggggatagagatgaaccctcgaaccaggagaagacaccttttggatatacaaggaaggatgttttactaattggacttggtgttactgttgctggtattggtttggaaagtggattggagtatcttggagttgatccattacaggctgggaatgtcgttcagttggtcctggttttaggtctgactgtaggatggatttcaacatatatcttcagagtctcaaataaggaaatgacatatgcccaacagttacgtgactatgaagtcaaagtcatggagaaaagattggaaagcttaacagaagccgagatagaagccttgcttgagcaggttgaggaagagaaaagacgtttggctggtggcgagcaaatgaaatgatggtttcttgaagtctttaatgcacttcaaaatagtcgagaaagatgatgaagtactctcaacgtatcattcctgtacaaagtcatcatgatgcagcaatagctgatagcaccagtgatagatttctagacgtaaactacatacaagtacatgtagggtgaagaattcggaaaatgggttaatattatgttagcgttcttgacgtataaacagatctatagcataattcacttataaaaatgaagaggaagtatatagatgaactggttgctcattcaatacttctctccccagtttcatttgcccttttctggtcattctgaggtgaggagacattattagctctaattgcagctcgttttgtacattctgtgtatgcaaaaactgtagccaattcctataattactcagtgttgtaagttttgttgctctgcacaagaaaatattctttgtttttgccatgattatatacagggtgtttagtgtttcttggc

SEQ ID NO: 8666 - DNA, 2147 bp, Glycine max
tagaacacgtatggaggaacaggaattaacgacacgtttgaacattgaacttgaacttgaacaacctcatctccaatgagttaacgttctccactcgtccctgcttctgcttctgctcattcttctccttccacagggatggcttatgttccacatggaaatgcaaattgcaactctttattccaaaaatttgcaaattcccatgtgggtatttctgctttgcccttcctgcaaccgggactaaaatcttgtacagttttcaacagaggaacactcattcccctgtgcttaaatggaaagaggagctttgctttatcagaaaagggatttaattgcaagttttcaaagagagagagattctctatccctagaagtagtagttcttctaactctagtggaagtacggatgaaacctctaaggagacaaatgtaaagacaccatttggatatacaaggaaagatgtcctattaattggacttggagttactttacttggcattggcttaaaaagtggactagagtttgttggagttgattcactacaagcaggaaatgtggttcagctagtgctggttttgggcctcacagttgggtggatctcaacatatatcttcagagtttcaaacaaggaaatgacatatgcacaacaactacgtgactatgaaagcaaagtgatggagaagcggttagaatccctaacagaagcagagctacaagcactgcttgaagaagttgaggaagagaagagtcgctagctagtggtacgcaggtgaattggagtagcttgtttgtatatatacactgaaatgaagttttgccaaagtaattgaaacagaaatttcaatctatatggactagttcagaaaggttttagctatgctttcttcaatttactcagacaaaaggatgagacttcaaaatccttagtgttctgctcacaaaaaattccagatggaagcaactctgtaagatatgatgataatgcttttaagttcatataattttgtgactttttttggagccgttcaccactgcacctcatgctatgatgaataatgttgaaggtactgttggaacttggccaacaaccattttcctcaaaagctgaatttttaaatagtttacttgttgttcgtatgttccctagctccttgagaaatgaattgcatgtcctttaggtacacaattaccaacaactcattgtgaccacttatttggtcatttgtgaatcttatcaatatgagatcactgatgtgcactgctctaaatttgaatatttcccattttcttttcattctgttactttcgtccccattttggagaccagtgtttagaatataagtcataaatgaggaacatgtgtagctgatagtactaagttagaaatagaccgggtctactgatagatagttaacgtaccaagtcacattgtgtgccaggaaagggcatgtgggaagtgcaagaggtgacaattcttatgtgtgctgctgtggtaaagctattcatttcatcatcgtgctgtgagaaaatgactgcttgccacccacaaattgatatcaaaatgcgtaggccaattttttatttatttttaccttaagtccagaaccagtcaggtgcaggtgccacctctatttcatatggcccttacccgttttggcatatgacactcacaaattcaaactcaagacgacaataccatgcggtattgaattgcatacaaagttaacattaaacccttattgttttcttcttaaatttccgagtgttacctaagctgaggaagtatcacctttttatttgtcctcaaatgtccgtaaaaaagctcatgcagtgcaagagttactttttcaaacatatataagatgagcaaaaaaaagttgctcatcttatacgagatatgtgtgaaagataaattgtttttcctttgaaaaaataaatacacatacatatatatttctttctttaatgttcgaaattaattaatttcaagagagattactcttaatcgtgctgttcattggcatatcacatcgagagagagaaaaaaaaacataattggcatatattgaaggaccatgaggttaggacatcttcgagataaaagaagaggttctaaatcaatgagatgcgacgtagatatatatgc

SEQ ID NO: 8667 - DNA, 770 bp, Fagopyrum esculentum
atgatactagtactaggtaactctcgtcttctacatcataatctcaatgcatcaggctgttcgagcttcaaattcaaaagacgctgccatctcagcttgcttttccacggcaagatggaatagatgtttcagcttttgcgaagaagcggtccgtttgtagttcattgaaaaggctttctttaatcccaagatgcagctccaatgatgataagaatggacctgttaaccaggataagacaccgtttgggtacacaaggaaggatgttttactgattggagttggagttacagtcgttggagttgggctaaagagcagtttagagttcattggttgggattctttacaagcagggaatgttgtgcagctggtgatagtattaggcctcactgtcggttggatatcaacatatatgtttagggtctcaaacaaagagatgacgtacgcacagcagttgcgtgattacgagagcaaagtgatggagaagcggctggagagcttaacagaagcggagttggcagcattgcttgaacaagtggaggaggaaaagcaaatcaattctagcagcaagcaggtcggttgaagttctcccgtcacacctgacggatataaaggtgcatagtaatgcaggacagctgaaaaaaaaggatagtaagtctaaactgtgatttgtattgtataaaatgcattgagatgagaatggttaaatgattgtaaattgtattgtatctatatgatcatcctaattgctatgttctggatatggttgaca

SEQ ID NO: 8668 - DNA, 923 bp, Vigna unguiculata
cagggatggcttatgttgcgtatggaaatgcaaattgcaactctttattccaaaaatttgcgagaatccatgttggtatttctgctttgccattcttccagctgggggtaaactcttgtacagtttttaacagaggaacagtaattcccctgtgcttaaaccgaaagaggagttttgctctgtcagagaatagatttaattgcaagttgccaaagaaagagagattctctatccttacaagtagaaattcttccaaccctagtggaagtacggatgaaaactctaaggagacagagaagacaccatttggatatacaaggaaagatgttctgttaattggacttgggattactttacttggaattggcttaaaaagtggattagagtttgctggagttgattcactacaagcaggaaatgtggttcagctagtgctggttttgggcctcacagttgggtggatcttcacatatgtgttcagagtttcaaacaaggaaatgacatatgcacaacaactacgtgactatgaaagcaaagtaatggagaagcggttagagtccctaacagaagcagagctacaagcactccttgaagaagttgaggaagagaagagacgctagctagtggtcgcaggtgaacagaagtagcttgtttgtatatatacactgaaattttgccaaactcattgaaacagaaatttgaatctatatggaaatggaaactagttcagagaggttttagctatgctttttttcagtttactcacggacaaagggacgagagttcaaaattctttagtgttctgttcacaaagaattcctgatcgagggaactctgttggataggatggtaatgcttttaaaatccatatattttgtgactttttctgtgattttatgaatcattaagtatctttctgtgaa

SEQ ID NO: 8669 - DNA, 1166 bp, Vaccinium corymbosum
aaccactcaaatcactcaccgcattcacggggctcatcagttcattccaattctcattacccatttccttcagcgttgcaaacgcacatcctctccttcaaatttcaaaaccagggggatagaaggaagaaaaggcagctggaatggcttatttgcagcacacaaatattagtaccaatgttttattaaaaaacgagcgatttccggagtgggtgtttctgctcttccgttgtcactaccaagggtcagaaccattgtgggtttagctggagaaagagctctctctcaaagattatactcaaaggaacttaacttttttccaaagagaagatcctacagcacgataccaaagaaagtgacctttccaatcccgagaagcggtagtccatcgaactctggtggcagtaaagatgaaccctctgatgatgccaagacaccatttggatactcaagaaaggatgttttgttgattggacttggagttactctagctggcattggactgaaaagtgggctagagttttttgggagttgatcccttgcaagctgggaatgtcgttcagttggtcttagtcttgggcctgacagttggatggatttcaacgtacatctttagagtctcaaacaaggaaatgacatatgctcaacaattacgtgactacgagaacaaagtcatggaaaagcgattggaagggttaagcgaagcagaattagaagcattgcttgaacaggtagaggaagagaagagacgcctggctagtttcggtgagcagatattttgcagaagcgattggaagggttaagcgatgaagaaatagaagcattggttgaacagatagaggaaaagaagagacgcctggctagtaccggtgagcaggtcaactaactgtcacaaagcatatccatgttatatgctctagaaactcttcatgcagttagtacataagactacctggttgtatagaatcatgaattttttcagctactaatttatgtatggaatttcggacggttgcttcgccttatagcaatgtaatcatagatgaattcatgtggaaaggagtgaagaataatgggtagctggcatgtaatgtttgccttctggtttcatgggagaactgactagaatgctttcttaagaggaaagcaaggctaccattaccact

SEQ ID NO: 8670 - DNA, 886 bp, Manihot esculenta
gagagattaggctattagaaaatcatgggccaaattcatctcttggcatcctagaaataagcttatgtttcttagcatacatgatttatactcgacgacgtggcgttttgcatgacctagtattttttgtctttgttcgttagcggcagtatccaatactagctaattacaagataaagcgagggacttttagaggacgagatcacttccagctactccttcacttcttactcaatcctcatccaggtatgacttctcttttgcatggatattcaaattgcagcattttattcagaaatagagcaatttcctatgtgggtatttcaactattccattattgcacttgagtgctcgagatttccaaggaagattaatttcaaacaacttctatagaagggtcacattctcttttccaagagaaggatccaggagaatgatgtcaaagaaagttaaatttattatccctagaagtagcagctcctcagactccagtagcaatgaagatggttcctctggtcaaggcaaggcatcagacgccttttggatacactaggaaggatgttttattgattggagttggagttaccgttctaggcattggactgaaaagtgggttggagtttgctggagtggattctttacaagcagggaatgttgttcagttggtactggttttgggcctaacagttggatggatttcaacatatatctttagggtctcaaacaaggaaatgacatatgctcaacaactgcgcgactacgaaaacaaagtcatgcagaagcggttagaaggtttgacagaagcagaattagaagcattgcttgaacaagtggaggaagagaagaaacgcctagccaatgtattattgagcgtttctttcatag

SEQ ID NO: 8671 - DNA, 1102 bp, Prunus mume
accctgcaagacaaaattgctgaatcagactaaaggatggagggaagggctgtataccagtcatctgcaatccattgacggtaatcagtgagttacctgctgctgcttccctctctctaccggggatggcatctcttccacatggaaaccctacaagttgtagtttagtatgtgaaagaggaccgatttccttcgtgggtatttcggctcttccatctattcaattgagggccagagcttttgatggtttggtgagaggaagagttataactcacagcttatatagaaaggagacatcccttttttgcgaaaaaagatctaatagcatcaacagaattatgaccatccccagaagtagcagttcggactctaatggcactgaagatgactcctctgatcaggcaaaggcataaaaaaccttttggatactcaaggaaggatgttttattgattggactaggagtaactggtatcggtatcggcttgaaaagtggattagagtttgctggagttgatcctttacaagcagggaatgtcgttcagctggtactggtgttgggcctgacaattggatggatttccacttatatttttcgagtttcaaataaggaaatgacatatgcacagcaaatacgtgactatgagaacaaagtcatggagaagaggttagaaggcctaacagaagcagaactagaagcattgcttgaacaagttgaggaagagaagcgacgcctaggtgagcaggtcaagtaaagatttacttaccttcgatcattatatagccttgaagcttcctcatttgtatatattgagtagtgagctcacaaatatattattaggtttccccatttgtactcttaagtctgataaaagacaacaggtaaaagtgatagacaacctcaaatcctcttcattatatgtactttacatatgaaaggaaggaattatagaaatggtttcgagtaatttttgaaagggacatttagtgtgtcatattcctcactggggggtggattcatataaacaatgtgtgcctgtctacaagtggaatgcgatatgatgactaatagttacttggcacgcaatagttgacatttgacaa

SEQ ID NO: 8672 - DNA, 992 bp, Theobroma cacao
acccgctttcgattcatccaattactcacctgagctgatttctcttattttttatttgttttttcctcagaaaaagaacactacggagatgtcttctcctctgcatggacacccaactgtcagtcccacttcttttctgggtgtttcggcttttcagttcttgcaaccgccaacacgatcagctgctgtttctttcttacggggtacagctatagctcagatcttgtataaaaagggaacttctttatatctgcaaaacaggttgaacaactcaaggtcaaagaaactgatctctgttgctcccagatgtagccgttcctcaaactccaatgaaagtaaagatcaaagcaagacaccttttggatacacaaggaaggatgttttattgattggtgttggagtcactgttgctggggttggcttgaaaagtggattggagtttgccggagttgatcctttacaagcaggaaatgtagtacagttggtattggttttgggcctcacagttggatggatttcaacatacatctttagagtctcaaacaaggaaatgacatatgctcaacaattacgtgactatgaagacaaagtcatgcagaaacgtctagaaggtttgactgaagctgagctggaagcattgctagaacaagtcgacgaagagaagaggagccaagcaagtggagagcaggttaactgaagctctttatattttatatcccattaaattttgacaggaatcaaggtgagaggctcattgtaaatggtaacttttggaggatgctctgaagttagcctcatttgttgttaacttttgggcaaaaggaaaatgcttgtgtatgttatttacggaaacccagaatcaatcactggacaacgccaaatagtttcaggtcaacaaggaatcatttttatggcgaaataggttttttttcttcttgcttttgggtgcatatgataaagcaacctggattaaggataatcgagtctttatc

SEQ ID NO: 8673 - DNA, 1217 bp, Gossypium raimondii
tctaaacacacaagaaactaggtaccgccacacaatcctcttcttccctctaaaaccatagcagtccagagttgcaacgttgcgagcctcatcgcctttcacttaacccctcgctgcttactagtcttctatctgggaaaacaaaaagaattactgtggagatgccttctcttctgcatgtacatccaaataagcccatttcttttctgggaatttcggcttttcctttattgcaaccttcaactaaatcaactactgcttctttcatacggggtactgcataccctcagatcttgcatagaaaagaagcttctctctttctgcaaaatgagttgaacaacacaaggtcaaagaaactggtctcctttgctcccaggtgtagcgggtccacaaactccagtgacagtaaagatcaaactaagacaccttttggatacacaaggaaggatgttctattgattggccttggagtcactgttgccggagttgggttgaaaagtggattggagtttgtgggagttgatcctttacaagcaggaaatgtagttcaattggtaatggttttgggcctcacagtgggatggatttcgacgtacatctttagagtctcaaacaaggaaatgacgtacgctcaacaattacgtgactatgaagtcaaagtcatggagaaacggctagaaggtttgacagaagcagagctggaggcattgcttgaacaagttgaagaagagaagcaacggcaagcaagtggggagcaggttaattgaagctctttacattttaatatccattattgaattttgacaggttggataatatgtatagttgtatattgccatgcaatgatgttccttctatagccactgtaaatgtaaccatgtatgactaatgtaagagtcatatacccttacaatgtaattgaatttagaataaggacggatggatgaatggatatacatatctttgcattcagtctggtaatcaactaaaatgaaaaagaaacaaaagccaaaaataatctacagcttaatgaatatacgtatgggatccactaagttccccatttatgttataaacaacacattctcaatggtagagaatcctaactaaaaacagtagttgaaaacccgtaagttccatcccgtcacaaatcaatcatccctcttccttttattttttccctttcatttttctttgtttactagacttgaaaaata

SEQ ID NO: 8674 - DNA, 854 bp, Vitis vinifera
aagcaaaagccaaaacgttctcttagcattatctgctacatccgggcagcgacgattagcagagagcagaagcatcaggcatggcttctcttccgctcaaaagtccaaattgcagcattttttgtgaaaggggaagtatttctattatgggagtttcagctcttccattattgcaacagagggtcagagctgtaggaggattgatgagaggaagcattatttctcaaagtgcatatacaaaggaaacttccacttttccaagaaaaggatccaacagcatgataccaaagaaattggtgtttactcccagaagcagcggttcatcaaactctgatggcagtaaagatgactccaccaaccaggacaaggtaccttttggatacaataggaaagatgttctactgataggagttggagtcactgttcttggcattggattgaaaagtggactggagtttgtgggtgttgatcctctacaagctggaaatgttgttcagttagtgctggttttgggcctcacaattggatggatttctacgtacatctttagagtctcaaacaaggaaatgacatatgcacagcaattacgtgactatgaaaataaagtcatgcagaagcggttggagggcttaacagaagcagagctagaagtattacttgagcaagttgaggaagagaagagacgcttagcgagtggtgaacaggttaactgattttcattcaccttatcattttcatccattaaagttttcacagtaaatgaagcctaaatttccttgtatagaatagttagttacacaaagacattgtaaagtttgcctcatttgtaccaactgcacaagaggcacatattg

SEQ ID NO: 8675 - DNA, 2838 bp, Theobroma cacao
tgtgatcatctctgaggccctatcaggattgttagcaatggctaaagcctccaaggatatttcgggtattgaaatttgtagaggaggttcgaatgtgactcatttactttttgcagatgattgcatgcttttcgggaaagttaaaagtagaaacactttaggagtggaaaaagagatgggttgtcaaatgttgggcatcaaaaatgaacaatgggaaggtttttaccttggaatgccattaatcagtggaggatcaaagagacaaatttttagttatgttaaggcaagagtcacgaaaagagttctgaactggaaaaataaattcttgtcagctgctggtcgagaaacgttgattaaggctgtagctcaagcagtgcctaactatgtaatgagctgttttaaactcccaaaggccatttgcaaatatatagattcagtgatagcaaggttctggtggaatggtgatgattcaaaacgaaagcagccgactcttgcttataaaattcttaaagcaagatattttccaagggttcattttatggatgcccctgttgggtctaatcccagttacctatggagaagcatcaaagaaagtcagcaaatcattaaaaaaggattagtatggagagttggcaacggcaatgatattcaggtattggaggactcttggatcccatatgaaacacctcgggttgcaatggcatatgaggaaaatgtgagtaactcaatgatggtgtctgaacttatcgatgcgagatgtgggaagtgggatgaagcgaaagttaagctgtgttttcctctttatgaaagcaatttaattttgtctatccctctcagtgtgaggctttctgttgatagacaggtgcgggttgtcagtaagcatggacaatatacggttaagtttggttatcgcttgatttcgtctctcctggatgattctgaacctggctgttcgtccgattcgttcgatggcttttggaaggaagtttggaagctctctattccgcgtaaaattatcttctttatgtggaaagccttgaaaggtgctcttccaaccaagaaagcattaagccatcggaaaattaatgtggacaatatatgtgttttctgccaagaggatgaagaaactgattttcatattttatgctactgtcaatttgcgagagcaacgtggttatcttcaaaatggggatttagagacacaggcgcacattccacctctgtttttgattggattttccaggtaagttgtaatcttggccctaaagatgttggagaaatagcttgcatattgtgggctatatggaaagcaagaaatttaagaatctttggcaaccagattatgaatcctgttcaggttcttaagctgggacttgacatgaataatcaatatcatatggctatggaggttagtgcaacagagaatcgagtattggagagagaaaatagaggttttcgttcgagaggactaaccttgcattcagatgcagcaatggaccaagttgatggaactacgagagtaggtgctggatttatcataagaagactgaatggtggttttttttgtgctgtcggaaggaaaatacagtattgtgcaagtgtggaggaagttgagttacgagctttggtttgggcgttaagttattgtgttaaagaacaaattatgcttgctgatgtttttctagacaaccaagtagttacgggatggattaaaaagcagcaatttactggagctttggaacatcttattgaggattgtacaattttgatggaaagaataaactgtcaagccattgatttttgctcaagagagaccaaccggacagcacattcaattgcccagattgctaaaagaatgatggatgaaatgatagaatggaaggactcttcacatctaccagtgttgattcaagaagctgttgataatgatagagttttgttcctaagacatgaaggaaaaagaacactacggagatgtcttctcctctgcatggacacccaactgtcagtcccacttcttttctgggtgtttcggcttttcagttcttgcaaccgccaacacgatcagctgctgtttctttcttacggggtaatttcttctgttgtcatgagtcattcatatgcaggtacagctatagctcagatcttgtataaaaagggaacttctttatatctgcaaaacaggttgaacaactcaaggtcaaagaaactgatctctgttgctcccagatgtagccgttcctcaaactccaatgaaagtaaagatcaaagcaagacaccttttggatacacaaggaaggatgttttattgattggtgttggagtcactgttgctggggttggcttgaaaagtggattggagtttgccggagttgatcctttacaagcaggaaatgtagtacagttggtattggttttgggcctcacagttggatggatttcaacatacatctttagagtctcaaacaaggaaatgacatatgctcaacaattacgtgactatgaagacaaagtcatgcagaaacgtctagaaggtttgactgaagctgagctggaagcattgctagaacaagtcgacgaagagaagaggagccaagcaagtggagagcaggttaactgaagctctttatattttatatcccattaaattttgacaggaatcaaggtgagaggctcattgtaaatggtaacttttggaggatgctctgaagttagcctcatttgttgttaacttttgggcaaaaggaaaatgcttgtgtatgttatttacggaaacccagaatcaatcactggacaacgccaaatagtttcaggtcaacaaggaatcatttttatggc

SEQ ID NO: 8676 - DNA, 933 bp, Castanea mollissima
  misc_feature (848)..(848): n is a, c, g, or t
cattaacggtcgcaactcccatatagctcccgctactgccaaccaaccaaaatatacagcaggaatggctagtcttccccatggaaatatgaattgcagcattttatgcaaaagagaagcggtttccttcgtgggtttgcctgcttttccatttttgcggccaagggcgagagcttttgaaggtttagtgagaggaagacttaatcgaagcttatataaaaaggaaacttctctttttcttggaaaaggatccaaccacatgttgtcaaagaagttgatcttttccatccctagaagtagcactgcttcaaactccagtggtaatggcaataactcctctgatcagtccaagaaaccttttggttacacaaggaaggatgttttactgataggagttggagttactgtcatcggtgttggcttgaaaactggattggagtttgtaggtgttgatcctctacaagctggaaatgtagttcagctggtactggttttgggtctaacagttggttggatctcaacatatatatttagagtttcaaacaaagaaatgacatatgctcaacaattacgagactatgaaaacaaagtcatggagaagcggctagagggcttgacagaagcagagctagaagcattgcttgaacaagttgaggaagagaagagacgcctagctagtggtgaccaggttaattaagtaccttgtcatcaatagccttaaaaacattacaacagtaattgatatacaactctctatgtatatacagtaggttagttcacagaaattttttgtgaagttggccttatttgtactcgcggaaggcagcaggatgataatgcaaaaaacntgtttactaatgcaaatgtttgtaatttttcagatacaggaaacccaaaccattacagtagttaaatgtagtttaccaaggtttg

SEQ ID NO: 8677 - DNA, 2424 bp, Gossypium hirsutum
atgggctaacgagactcgccccactggggccttcgtatccccttccaaccaatcctccccccgccaaagcattgggtaccatcttcttccttctccaccgctgctgctgttgcttcatcccaatctcttcatgataaagagaaaggatcaaaatggtcaagatggtttcttttccttcctggagctatcactttcggccttggaacttggcagattttcagaaggcaagacaagatagagatgctggattacagacagaagaggttgcaaatggaacctttgaaactaaatgacatgcctccttcaagtgaaatattggacactttagagtttaggcgagtcgtgtgcaaaggagtttttgattatgaaagatcaatctacattgggcctcgctctagaagcatttctggagtgactgaaaatggctactatgtcattacacccctaatgcccttccctgacaatgctgatagtgtgcagtctccagttcttgtaaatagaggatgggtcccacgcagctggagagacaaatcttttgaagtttcacaagacagagagaaatcttcaagtacagatgttgttcctgtccaacagaatgaacgaagctggtggggaatgtttcaatctaagaagcaaaaagctgttgaggctcaagcccctgctattacttatgtggaagttattggagttgtccgggggagtgagaaaccaagtgtatttgttccaccaaatgatccaaattcgggacagtggttttatgttgatgttcctgcaattgctgttgcttgtgggcttccaaaggatactcttttaattgaggacatcaatgaaaatgttaatccaagcaacccttaccctgttccaaaggatatcaatgccttgattcgcagttcagtaatgcctcaagatcatctaaattatacattgacatggtactctttgtccgctgctgttacatttatggctttcaagaggctcaagccaaaaaacagtaggagatagcaagcattactctaaaaggtttgcattgaagaccttggacaagcaaacaagcatggaatctttgagagacactgctgaaaaggctattccaattgcaccaccaggcttttgatctatggaaagaaacagatgagtgttttggcttgaaaatttacaaagaagggggaaaaacccttgttgtgcactttaagtttgatatttttcaagtctagcaaacaaagaaaaatgaaaggggaaaaaataagaggaagagggatgattgatttgtgaggggatggaacttacgggttttcatctactgtgtttagttaggattctctaccattgagaatgtgttgtttataacataaatggggaacttagtggatcccgtacgtatattcattaagctgtagattatttttggcttttgtttctttttcattttagttgattaccagactgaatgcaaagatatgtatatccattcatccatccgtccttattctaaattcaattacattgtaagggtatatgactctgacattagtcatacatggttacatttacagtggctatagaaggaacatcattgcatggcaatatacaactatacatattatccaacctgtcaaaattcaataatggatattaaaatgtaaagagcttcaattaacctgctccccacttgcttgccgttgcttctcttcttcaacttgttcaagcaatgcctccagctctgcttctgtcaaaccttctagccgtttctccatgactttgacttcatagtcacgtaattgttgagcgtacgtcatttccttgtttgagactctaaagatgtacgtcgaaatccatcctactgtgaggcccaaaaccattaccaattgaactacatttcctgcttgtaaaggatcaactcccacaaactccaatccacttttcaacccaactccggcaacagtgactccaaggccaatcaatagaacatccttccttgtgtatccaaaaggtgtcttagtttgatctttactgtcactggagtttgtggacccgctacacctgggagcaaaggagaccagtttctttgaccttgtgttgttcaactcattttgcagaaagagagaagcttcttttctatgcaagatctgagggtatgcagtaccccgtatgaaagaagcagtagttgatttagttgaaggttgcaataaaggaaaagccgaaattcccagaaaagaaatgggcttatttggatgtacatgcagaagagaaggcatctccacagtaattctttttgttttcccagatagaagactagtaagcagcgaggggttaagtgaaaggcgatgaggctcgcaacgttgcaactctggactgctatggttttagtgggaagaagaggattgtgtggcggtacctagtttattgtgtgtttagatagagtgg

SEQ ID NO: 8678 - DNA, 983 bp, Eucalyptus grandis
tcttatcgttcgccaattgcgtcagtcgagcggtctttcggttcgcggagtgcgggagaccgactctctccgtctcttcaattcggcttcacgagcttccattcgatcgggtgcggcgtcgacggaggatccgaagcgatggctcttcttcttcctctgcgcggaagctggaccgccgcagttctgtccagggacggaccggtctcgccggcggacgcctcggctcccccgtcgctgcgtcgtgatgcgagagcacccaacgatctattcggaggaagggcttctgtaagaagcttttacatggagagacattcttttccctccagaagtagattggacaggatgatgcctaagaggacgagatttacaagtcccagaagtggtggttcctcagactctagcaatgttagtgagggttcctctgatcagggcaaggctccttttggatactccaggaaggatgttctattgattggacttggagtcaccgttcttggcgttggcttaaaaagtggattggagcttgctggagttgatcctctacaagcagggaacgttgtccagctagtgctggtgttgggattaactgttggatggatatctacttatatatttagggtttcaaacaaggaaatgacatatgctcagcaactacgtgactatgaaaacaaggtcatggagaagcgcatagagagcttgacggaagctgagctcgaagctttgctggagcaagtggaggaagagaagagacgcgcgtagcgagcggcgagcaagtcgattgaagtgcacacgccatctgtatataagtatggcatcaagtctgcccccccatgttaatgtgtggtgaaagtttcctatagattgttgcttacacacgatgattttcctagtgctttcttcatgaacaagcctactttgggtcgataaatccaacttagtaccaacttcaaatcgaaaaccaaaaaaaaaaaaaaaaaaagaaa

SEQ ID NO: 8679 - DNA, 1108 bp, Gossypium raimondii
actctatcaacgcagagtaaactaggtactgccacacaatcctcttcttccctctaaaaccatagcagtccagagttgcaacgttgcgagcctcatcgcctttcactcaacccctcggtgcttactagtcttctatctgggaaaacaaaaagaattactgtggagatgccttctcttctgcatgtacatccaaataagcccattccttttctgggaatttcggcttttcctttattgctaccttcaactaaatcaactactgcttctttcatacggggtactgcagaccctcagatcttgcatagaaaagaagcttctctctttctgcaaaatgagttgaacaacacaaggtcaaagaaactggtctcctttgctcccaggtgtagcgggtccacaaactccagtgacagtaaagatcaaactaagacaccttttggatacacaaggaaggatgttctattgattggccttggagtcactgttgccggagttgggttgaaaagtggattggagtttgtgggagttgatcctttacaagcaggaaatgtagttcaattggtaatggttttgggcctcacagtgggatggatttcgacgtacatctttagagtctcaaacaaggaaatgacgtacgctcaacaattacgtgactatgaagtcaaagtcatggagaaacggctagaaggtttgacagaagcagagctggaggcattgcttgaacaagttgaagaagagaagcaacggcaagcaagtggggagcaggttaattgaagctctttacattttaatatccattattgaattttgacaggttggataatatgtatagttgtatattgccatgcaatgatgttccttctatagccactgtaaatgtaaccatgtatgactaatgtaagagtcatatacccttacaatgtaattgaatttagaataaggacggatggatgaatggatatacatatctttgcattcagtctggtaatcaactaaaatgaaaaagaaacaaaagccaaaaataatctacagcttaatgaatatacgtatgggatccactaagttccccatttatgttataaacaacacattctcaatggtagagaatcct

SEQ ID NO: 8680 - DNA, 1053 bp, Vitis vinifera
acgttaccacttcatttcacacacacataaaaggaaggaagcaaaagccaaaacgttctcttagcattatctgctacatccgggcagcgacgattagcagagagcagaagcatcaggcatggcttctcttccgctcaaaagtccaaattgcagcattttttgtgaaaggggaagtatttctattatgggagtttcagctcttccatcattgcaacagagggtcagagctgtaggaggattgatgagaggaaccattatttctcaaagtgcatatacaaaggaaacttccacttttccaagaaaaggatccaacagcatgataccaaagaaattggtgtttactcccagaagcagcggttcatcaaactctgatggtagtaaagatgactccaccaaccaggacaaggtaccttttggatacaataggaaagatgttctactgataggagttggagtcactgttcttggcattggattgaaaagtggactggagtttgtgggtgttgatcctctacaagctggaaatgttgttcagttagtgctggttttgggcctcacaattggatggatttctacgtacatctttagagtctcaaacaaggaaatgacatatgcacagcaattacgtgactatgaaaataaagtcatgcagaagcggttggagggcttaacagaagcagagctagaagtattacttgagcaagttgaggaagagaagagacgcttagcgagtggtgaacaggttaactgattttcattcaccttatcattttcatccattaaagttttcacagtaaatgaagcctaaatttccttgtatagaatagttagttacacaaagacattgtaaagtttgcctcatttgtaccaactgcacaagaggcacatattgttgaatccatttcttttatcatttctgtatgtgattatctgaacaatcagaaaccaaaactgttaattaggaccaccaaatatgtggggtgggtttccgggattatatcattccagttgaaaagagaaatggaaagttcatagggtgtattgcctattgaa

SEQ ID NO: 8681 - DNA, 821 bp, Heritiera littoralis
ctccgaaagagagtactgtggagatgccttctattctgcccatttcttttcttggcatttcggcttttccatccctgcaaccgccaataagatcaactactgctttgatgcggggtactgctgtatctcagatcttgtatgacaagagaacctctctatttctgcaaaatagtttgaacaacacaaggtcaaagaaactgatctccattgctcccagatgtagcggttcctcagaatccagtgatagcaaagatcaaaccaagacaccattcggatacactaggaaggatgttttgttgattggtcttggagtcactcttgctggggttggcttgaaaagtggattggagtttgctggagttgatcctctacaagcaggaaatgtagttcagttggtaatggttttgggcctcacagttggatggatttcaacatacatctttagagtttcaaacaaggaaatgacgtatgctcaacaattacgtgactatgaagccaaagtcatgcagaaacgcttagaaggtttgactgaagcggagctggaggcattgcttgaacaagttgaagaagagaagcaacgccaagcaagtggagagcaggttaattgaagctcttcacactttatatccattaaattttgacaggaattaaggtgggagggatcaatgtgtatgttctaaagttacccttatttgttgtaatgtaaaatgtagcttttggcaaattgaaaacacatttatatgcgatttaacaaaaccccgaaaatctatcaatcactggacaaaacaaaatagttacagcccagcacaaggttttcgccg

SEQ ID NO: 8682 - DNA, 845 bp, Tabernaemontana elegans
agagtgacaggtgcagtgaaacaggaaagctttggagccactcgaattcttcttcaccaaagcaagaagtagaccttgcagccatggcatctgtgccatgttcagacataggcaacagcattttgtgcaaaactagagcaatttctttggtgggcttgtgttcttttccattgcaagaaccaagggcgaggtctgttgagtacttcgctagagaaagagtaatctcggcaagtcctctgagacaggggagctctgctttccttagaaagggattctatggcttgggttcaaagaaggtgcagactacaatcccgaggggcaacatttcctcaaactctggcgatagcgaggataattcctctgaaaaagagaagacgccttttggatatacaagaaaggatgttttgttgattgggcttggagtaactattgctgggattggcctgaaaagtggattggagttccttggagtcgattctttgcaagccgggaatgtggtgcaactagtcctggtcttgggtctgacagttggatggatctcaacatacattttcagagtctcaaacaaggaaatgacctatgctcaacaactgcgagactacgaaagcaaagtcatggagaaaaggctggagagtttaacagaagcagagttggcagcattgcttgaacaggttgaggaggagaagagacggacagctagtggcaagcaagctaaatgaacgttagttcatgtcttttaagtattcttccaggttgacatgcccacacttgaagaattcaccaagctcagtatagtactcatcatttacatatttgtaaatcgaaatactttagttttgactatc

SEQ ID NO: 8683 - DNA, 1440 bp, Solanum melongena
agtcgcaaaataaacttacaacacaacatatacagacaaaaccacataatacgccctcgccggaatctattctctccatcaccggccgttaaaacttttagcaattatagactcttaatttttttcagctcggaggtcaaaaaactaacctccgatctgaagaagtagttgctgtagcattttttttcctgggaacggaaaaccctaagctgtgtaaggtggatttcgtgatgggattttgtatctgtcctttggaaagtcctgctagattactgtggagtactagtttcttccgccacaagctcatgctcttctaaaacttagtcaactctctttctcatacaaatccatgctaaataagaactctgttctggagtttttctctcttttctgtttcgccggaaaaatataaataatcttctgtgtaaataggcgatcttccagatcattgaaaatatgggatctgggcacatatttttcgacccgtcctcgtgtcacggcaacatgttgttccttgggaacggagatcctattttccgagggccaagatcgacgatgatgaagatggaggactcctcgaagaggcgacccttctttagctcgccggaggatctatatgacgaggaatattatgacgagcagtcgccggagaagaagcgccgtctcactcctgagcaggtgcacttgttggagaagagctttgagacagagaacaagctggagcccgaacgcaagacccagctggccaagaagctggggctgcagcccaggcaggtggctgtatggttccaaaaccgccgtgcccggtggaagaccaaacagctcgagagggattatgatcagctcaaatcctcttatgactctcttctcgctgattttgactctattcgcaaagataacgataagctcaaatctgaggttgtttcattgatggagaagttgcagggtaaagtggttggagcagcaggggaaagtgaaaaaactgaggccttggaggttgatgctatgacaacccttcaagtgaaggtgaaggctgaggaccggctgagcagtggcagtggtgggagcgcggtggtagatgagcatagtccacagctggtggacagtggggactcatattttcacactgatcatgaggagtatccagggcctggaggatgcaatattcctccacctgtggatggtttacaatcagaggaagatgatggtagtgatgatggcagctgccatggctacttctctaatgtctttgtggcggctgaggagcagcaccatgaaggagaagagcctcttggatggttctggtcgtaattcagttctagaatatatatgtattacaatttttattatctactcgcgctttgtacgatgaaataagtgttgtattataaacatctattaatatgcttttgtatcttttgatttctagctttaatactg

SEQ ID NO: 8684 - DNA, 60 bp, Zea mays
cgcgatggagaaggtgtgggagtcggggcggcggatgagccggagcatcggccgcggcat

SEQ ID NO: 8685 - DNA, 60 bp, Sorghum bicolor
tcacgcccccatgccgtctttcttttctagtattttttaataacacaaaaaagctcctac

SEQ ID NO: 8686 - DNA, 3032 bp, Zea mays
cttgtaattacagcttgtaaccctgctttatgggaatattccggggataaactaggcgtctgagggcacatgcgtccttaacacaagacgctgggcactcagacacctataaatacccccgcacagtgcccgtgagaggctagatcaacagagctattgcccccgtgcacgtaaccctgttgtcgccattgttcacccccgttggcccacttgcagcagagagcaagttccaacagatatgttggctagttatcttgctgtggacagagtggaaaactagaatgtttgtctgtgaaggcgacaataaaaaaaatgccttgtgatttgctgccacgctgaaagccctgcttccatggaagacttcccattatggaaatttgagaaccaagtggagacattgcccacaagggaccctctgctcttgccttttctggacagaaacttattcaagttgaagagccagatgctcaagttgaccttgtcttaaattctgctggcccagctttagttggagaattatttactgtaccgaggtggtggtatgttgttgagtccaagggaagcggaagattctgaaagtcaccatgttgaacttcttggtgtctcaactgtgtccgaggacaaagagtcgaaggaagaggccgatagcataagaaatatccagtattcatttggggttatatctgttcccacattgggtgtgggtgattcctggtcgtgcaaactagaaatcaaacggcatcgagcaaaatcagtcatgctttatgtttcacttagttactccctaggttcaagtgaagaagaagcatcgcaccggcttaacgtccatagaagcatgcaacttgaagggcagacccccttattagttagtcaacttggaaactagccgtgcccgtgcagtatcggatgagatcgtgagttgagacgacctgagcaacctgaagtctccactctcctgacacttgttagctcggcccgggctgcgtgccatgcgagggtacaacaacatactacacaggacaggaggaggataggctgcatgcttcgtgatggcagggccatggaggagaaaaccaacgcgtccttgagcaagtagcccgtcgcgttcagccggcggcgcgctccatgccgatccgtctcggcgtcgcatacggcatatgccagtcgccttcgcgtctgtctatataccggggaaattcgcgttatcttcatccccactttgttcgcctcgccgcatcttcgcatcgacgggccgccttgtttcaatagcgcgccgctggggactggggtagtggggtatagggtttaggctcgcaaaaatattccgtctcgataaagccgacatcaaaactgttccgtcgaagcagagcccgccccttcccgcgccgttctttttggttcccctgtccccgccgctgccgaaaaaccgccgatggaggtcgtcgccgccgcgaagcagaaggcgaagaagcatatacacctcttctactgctccgaatgcgaggagctcgctctcaaggtcgccgccagctccgacgtcatcgagctccagtctatcaactggcggagcttcgacgacgggttcccgaacctgttcatcaacaaggcccacgacatccgggggcagcacgtggcgttcctggcctccttcagctcgccggcggtcatattcgagcaggtctccgtcatcttcgcgctgcccaagctcttcatcgcctcgttcacgctcgtgctgcccttcttccccacgggctccttcgagcgcgtcgaggaggagggcgacgtcgccaccgccttcaccctcgcgcacatcctctccatgatccccaagtcgcgcggcgggcccaccagcgtcgtcatctacgacatccacgccctccaggagaggttctacttcggggacgacgtcctgccatgcttcgagacggggatcccgctcctgctgcagcgcctccgccagctcccggacgcagagaatatcaccattgcctttccagatgatggagcgtggaagcggttccacaagctgttgcagcactttccaatgatagtctgtaacaaggttcgtgaaggtgacaagagaatagttcgtataaaggaaggaaatcctgaaggccgtcatgttgttattgttgatgatttagtgcaatctgggggaactcttagagaatgccagaaagttctagcttcacatggcgcttcaaaagtaagtgcttatgtgacccatgctgtgttccctaagcagtcatacgaaaatttcatggcgtctaactctgctgggccaggcgaccagctcgcttacttctggatcacggactcatgcccgcacacaataaaagccatcgggcaaagacctccgtttgaggttctgagccttgctggctcgattgctgacgctcttcagatatgagcgcgtacactgactggtagacggggggcttgaaccgtgggatgcccgtcagatcgagaacttgtaccgtgagatgagctgctcctgctttttttccctaaatgtaggagtttgttccggttccttgaaaaaagcaaataatgtggagcaagttttaagtacctgaaggttccacaaacagcgctgtgaattgatgataaaatcaggcattgggatactcacatctgtgtgtacttattgtcgatgttcgcttccgtttgaagttcgcgagaccagtgcttctttcctgagtcctgaccctatgttggagtaccgttgccgtgcattcaacagaggccagtgcttctttcctgtgtcaagtctcgggcctgcacctctcaacttcagccatgtacatgagccgcacgaacttgcagagtcgtcacctgcgcgtgcgggtgctgctgcggctgtgggcttcttcctcccgagcgctggcggctggctgccctgcaatgcattcaaccaaccggccagcagctcccacagggaatcagaaaccaccaccgtaaaaacgatgctgtagcagtaacaaaaccgtgaatgcctcatgttcggagcctgcaactctggacggtctttt

SEQ ID NO: 8687 - DNA, 1988 bp, Setaria italica
ttgtacatcgtttttattcgaatgaaaacaccatttctagtttatctaaagcaacattttactgggcaaaacaatactttatgctgccttttcaagattaacaattcaacatgatgggataaggctcttctttattgtgactcttgacatatgacgatggctgcgtgcttcatgatggtcgccgtgcaggggaaaaacaacgcgagcaaagtagccgtcgccttcagccggcggcgcgctccatgccgaatccttctcggcgtagcatatccccgcgccgtcgcgtcctcctataaattgcaacatcttcttccaaaattcgcttgcctcgccgtttccgtgttcacatcacgggccgtttccggttcgtagtgcggctggggtctagggtttagagcggtaggctcccccaaaaaaaagtcgagggaaattattcgccgccctgcccgcttcgcgtctcgataaagccgacaccacctgtcccgtcagagcagagcccgcccctccccgcgccgttctttctgggattcccctgtcccggccgccgccgcggagacccgccggcacgagatggaagtcgccaccgccgccgccgccgccaagcagaagccgaagaagcacatacacctcttctactgctccgaatgcgaggagctcgccctcaagattgccgccagctctgacgccatcgagctccagtccatcaactggcggagcttcgatgacggtttcccgaacctgttcatcaacaaggcgcacgacatccgggggcagcacgtggcgttcctggcctccttcagctcgccggcggtaatcttcgagcagatctccgtcatattcgcgctgcccaagctcttcatcgcctccttcaccctcgtgctgcccttcttccccacgggctcctttgagcgcgttgaggaggaaggggacgtcgccaccgcgttcaccctcgcgcgcatcctctccatgatccccaagtcgcgcggtggaccgactagtgtcgtcatctacgacatccacgcgctccaggagaggttctactttggggacgacgtcttgccgtgcttcgagacagggatcccgctcctgctgcagcgcctccgccagctcccggacgcagacaatatcaccattgccttcccagatgatggggcttggaagcggttccacaagatgttgcaacactttccaatgatagtctgtaataaggttcgtgaaggcgacaagagaatagttcgaataaaggaaggaaatcctgaagggcgccatgttgttattgttgatgatctagtgcaatctgggggaactcttagagaatgccagaaagctctggcttcacatggtgctgcaaaagttagcgcttatgtgactcatgctgtgttccctaagcaatcatatgaacgtttcatgacgtctaattctgctgggccaggcgatcagtttgcttacttctggatcacggactcatgccctcacacagtgaaagccattggccaaagacctccatttgaggtgctgagccttgctggctcgattgcggatgctcttcagatatgagcttggaccggtagaggggtttgaattgcccatcatattaaaagggtactaggagatgggctgctcctgttttacctaaatgtaagagttcattccagtttctggaaaacaaataatgtggagtaagtttgctgtggaagtatctgaaggttccataaacagccctgtgatgtgataataaaatcaggctttggatgttcacatctgtgtatttctcagtgttaacttctgtttcaagggcgcaagatcggtgctttagttccctgatctgtctgagtactttagcctaagctttcagttactagggctttgttgtgaactacaaaattgcttcaatatacctgagcttcaactgaattaatgaatttctatcagattgaatgaatgatcatgagagtcgttgcagtcaaaacctcctggtcgccctgaaa

SEQ ID NO: 8688 - DNA, 2366 bp, Sorghum bicolor
ccctactatcttgcatatcgtttttctttcactggaaacgccactctatacaggaaaaaaaagtcactttatgctcatgggtcatgatgtttctcactggaaacaccattctatctatatctatacaagaaaaaaaaagtcactttagcaatgatgttttggcgtatatacaggaaaagtcactttatgagtaatggcgtatttgaggtggctgcgtgcttcatgatggccatgcaggagaaaagcgtacttggctcctcgagcaagtagccgtcgcgttcaggcggcggcgcgctccatgccgatccgtctcggcgtcgcatacggcattattgcccgtgccttcggcccttcgcgtccgtctataaaaaaccgggaacattcgcacaatcttttcccccactttgttcgcctcgccgtattttcacatcgcgggcctctttttgtttctctagcgcgtcgcggctggggtctagggtttaggctcccaaaagccaaaaatcaaggagaaatattcgcagcggcagcgcgtctcgataaaagccggcatcaactgttccgtcaaagcagagtccacccctccccgcgccgttctttttggttcccctgtccccgccgcctccgaaacccaccgatggaggtcgtcgccgccgccgccgccgccgcgaagcagaagacgaagaagcacgagaagcacatacacctcttctactgctccgaatgtgaggagctcgccctcaaggtcgccgccagctccgacgccatcgagctccagtccatcaactggcggagcttcgacgacggcttcccgaacctgttcatcaacaaggcccacgacatccgggggcagcacgtggcgttcctggcctcattcagctcgccggcggtcatattcgagcagatctccgtcatcttcgcgctgcccaagctcttcatctcctcattcacgctcgtgctgcccttcttccccacgggctccttcgagcgcgttgaggaggagggcgatgtcgccaccgcgttcaccctcgcgcgcatcctctcgatgatccccaagtcgcgcggcgggccgacaagtgtcgtcatctacgacatccacgcgctccaggagaggttctacttcggggacgacgtcctgccatgcttcgagacagggatcccgctcctgctgcagcgcctccgccagctgccggacgcaaaaaatatcaccattgcctttccagatgatggagcgtggaagcggttccacaagctgttgcagcactttccaatgatagtctgtaacaaggttcgtgaaggtgacaagagaatagtccgtataaaggaaggaaatcctgaaggccgtcatgttgttattgttgatgatttagtgcaatctgggggaactcttcgagaatgccagaaagttctagcttcgcaaggcgctgcaaaagttagtgcttatgtgactcatgctgtgttccctaagcggtcatatgaacgtttcatggcgtctaattctgttgggccaggcgaccagtttgcttacttctggatcacggactcatgcccacacacagtaaaagctattggccaaagacctccatttgaggttctgagccttgctggctcaattgctgacgctcttcagatctgagcgtacacaggtagatatgggctgatgcccatcacaatcagattgaacttgtactatgagatgagctgctgctgctttttctaaatgtaagagtttgtttccagttcctggaaaagcaaataatgtggagtaagttaagtacctgagggttccgtaaacagcactgtgaattgataataaaatcaggcattggatactcagttgttgacatctgtgtatttgtcaatattcacttctgtttgaagttcgcgagatgagtgcttctttcctgacctgttgtaccgtttagcgacttcggatactgagctttgttgtgaacaactaaatagtgcaatgtaactgagcttcaacccaattggctgccttgaattatactgttctatggatgcatcgaggcgattggtttgtgttgatagcctgcgtatgaagagcaagaatgcaagagcatgcagcatcattgcaatttgaccctgctcttgcctctcttacttatctgagctgttgtaaaacaagctattcttcaggctgatttttgtgggatagtagattttagtatcaaagtgtttttttaaatgatgatcctgccggataatagagtttagtatcaaagtagtcattttttggtccttggttcggagtataagcttctaggaatgtgagcttgtcagttggcacatctagcatctcgtcaccaaactcgaaattgatagtgcaagtagttggttgagaataa

SEQ ID NO: 8689 - DNA, 1956 bp, Brachypodium distachyon
tgtgaaatttgagcgacttttttttttgttttgaaaaggattttttgggtgaaattctcgtgttgataagaagttcagtaaccagaaagcgctccgggagagaaagagacgtggcaactgatgcgacgccggccgcggcgtgcccaggtgctgcctgcgtggttcacgatggtcgccgtgctggcggcggcgcactccatgccgaatcatgccgcccctgatcaaacagtcttgtccataaaaatcgcactgtcttcttccccagttcgctcgcccctctgctctgccttcaaccccacaaccaatcacacattaccaattttaatctcctacgctattgccatcacgggccgattcgtagcacggtgggtctagggtttagagcagtagtacttggaacgaaaagaggggggaatcaaatactcgaaaaatctcaatagaagccgatacccagaggagcctcttcccacgccgttctttcctgggttcccctcgcgccgctcccctgtccgcgccgccgccgccgccgccgcttgccgggacgagatggaggtggccgctcctgccccgaagcacaaggtgaagaagcagataaacctcttctactgcgccgagtgcgaggagctcgccctcaaggtcgccgccagctccgacgccatccagctccagtccatcaactggaggaacttccccgatgggttcccgaacctgttcatcaacaacgcgcacgacatccgggggcagcacgtggcgttcctggcgtccttcagctcgccggcggtcatcttcgagcagatctccgtcatcttcgcgctgcccaagctcttcatcgcctccttcacgctcgtgctgcccttcttccccacggggtccttcgagcgcgtcgaggaggaaggtgacgtcgctaccgccttcacgctcgcgcgcgtcctctccatgatccccaagtcccgcggcgggccgaccagcgtcgtcatctacgacatccacgcgctccaggagaggttctactttggggacgacgtcctgccctgcttcgagaccgggataccgctcctgctgcagcgcctccgccaactcccggacgccgaaaatatcacaattgccttcccagatgatggggcgtggaagcgcttccacaagctattggtcaactttccaatggttgtctgtgcgaaggttcgtgaaggcgacaagaggatagttcggattaaagaagggaatcctgaagggcgacatgttgttattgtcgatgatttagtgcaatctggaggaactcttagagaatgccagaaagttttggctgctcatggtgctgcaaaagttagcgcctatgtgactcatgccgtgttccccaatcagtcatatgaacggttcatgactgctaattctgctggaccaggcgaccagtttgcttacttctggataacagattcgtgccctcagacggtgaaagccattagtcgacattctccatttgaggtgttgagccttgcgggctcgattgctgatgcccttcagatatgaacttgcaatgtgagatgggctggtcccatatgtaagaggagttcatttccagctccagcaaaacaaataatgtggagctagtttatctaattatgttgaatctgaagcctccataaactgccccaagacgtgatgaaataaaacctggcattattgcagtgctctcgctattctctttttgagcaagtggtcttgatcagtgttttagtttctactaatgccctgaaacttgagtgctgcatttggatgaaattatgctgaaattctagcttctgcatttgatttgagtacatttttgggtggttgcaccgcgttagctgcgcacctgcgctgtatgctgcatgatggatggaggtgtgaccgtgcgattgctacccctctctgcaggtggtgaatcatcaagacgcaagcaatccttgccagtcttgc

SEQ ID NO: 8690 - DNA, 1255 bp, Cenchrus ciliaris
gaggagctcgccctcaagattgccgccagctccgacgccatcgagctccagtccatcaactggcggaacttcgatgacgggttcccgaacctgttcatcaacaaggcgcacgacatccgggggcagcacgtggcgttcctggcctccttcagctctccggcggtgatcttcgagcagatctccgtcatcttcgcgctgcccaagctcttcatcgcctcattcacgctcgtgctgcctttcttccccacgggctccttcgagcgcgttgaggaggaaggggacgtcgccaccgcgttcaccctcgcgcgcatcctctccatgatacccaagtcgcgcggcggcccgaccagcgtcgtcatctacgacatccacgcgctccaggagaggttctacttcggggacgacgtcctgccgtgcttcgagacagggatccccctcctgctgcagcgcctccgccagctcccggacgcagacaatatcaccattgccttcccagatgatggggcgtggaagcggtttcacaagatgttgcaacactttccaatgatagtctgtaacaaggttcgtgaaggtgacaagagaatagttcggataaaggaaggaaatcctgaagggcgccatgttgttattgttgatgatttagtgcagtctggaggaactcttagagaatgccagaaagttctggcttcacatggtgctgcaaaagttagcgcttatgtgactcatgctgtgttccctaagcaatcgtatgaacgtttcatgacatctaattctgctgggccaggtgaccagtttgcttacttctggatcacggactcatgccctcagacagtgaaagccattggacaaagttctccatttgaggtgctgagccttgctggctcgattgcggatgctcttcagatatgagcttgcaccggtagatgggtttgaattgcccatcatattgaacttgtactatgagatgggctgctcctgttttacctaaatgcaagcaaataatgtggagtaagttgcggcggaagtacctgtaggttccatcaacagcactgtgatgaataaaaacaggcagtggatgttcacatatgtggattcctcagtgttaaacttctgtttcaagggtgcaagatcagtacttagtttcctcgcctatctgagtactttagagcaagctttcagctttgttgtgaactacaaaattgctgcaatatacctgagcttcaagccgtcaacctaattaatgaatttccatcca

SEQ ID NO: 8691 - DNA, 1301 bp, Brassica juncea
gaatcctcttctcttatctatctccttctgattccttcttatactcccttgtaattctctcccggttttatttcatttcctctgcaatggcgagtgctttgaatgctgctgtctctctcacttctccgaaatcatctgctcttccagctacaagctgtgccattgctcctgaaaggatcaggtttggtaagggtgctttttactataaaagcaacaatgtagtgacaagctgcagaagactggtttcggtaagagctgaggtcacaacagatactcctcctgtgaagaaagtagagaaagagtctaagaagaacgaggaaggtgtgatcaccaacaagtacagaccaaaagagccttacaccggcaaagtccttctcaacaccaagatcacggctgatgatgcccctggagagacctggcacatggttttcagccatcaaggtgaaataccgtacagagagggacaatctgttggtgtgattgcagatgggattgacaagaatgggaagcctcacaaggtcaggctttactccattgcaagcagcgctcttggagacctcggcaactctgaaaccgtttctttgtgcgtgaaaaggcttgtttatactaatgacgcaggagaggttgttaaaggagtttgctcaaacttcttgtgtgacttgaaaccggggagtgatgttaagctcactggtcctgtaggaaaagaaatgcttatgccaaaggatccaaacgccactgttattatgcttgcaacagggacaggaatagctcctttcaggtctttcttgtggaagatgttctttgagaaacatgatgactacaagttcaatggcttagcttggctgttcttgggtgtaccaaccactagttcattgctctacacagaggagtttgataagatgaaagcaaaggcaccagagaacttcagggttgattacgcgataagcagagaacaagcaaacgataaaggagagaaaatgtatatccagacaagaatggcgcagtacgcacctgagctatgggagttgctgaagaaagacaacacatttgtgtacatgtgtgggcttaagggcatggagaaaggaattgacgacatcatggtctcattagctgctaatgacggtattgactggtttgattataagaagcagttgaagaaggcagagcaatggaacgttgaagtctactgattaacgtttggtggcaagtatagtggagcaacaagtgtaatttttgcatccaagtttctgtaatctgaagataagcttttgttttagatctattatactaaagaaaagttg

SEQ ID NO: 8692 - DNA, 2767 bp, Hordeum vulgare
tccgcctccgacatcgctggaagaggaggaagaaacgtcggggactcgtcgtctcgtccgtcccgagtcatcacgcttatccagcccagccacgcccgcaccaaaccaaacaacatatccccgaccagccccgccactccctccccactccccgccccaccactccgccgcgctcggctcacacgccaccggcgatggcctcccgcctcctccgcctgcaccaccagctccggcgccggcgccaccacggcacgagccccgtcccctgcaggctcctctcctcctcctccgccacggagccgccgccgccgccccagacggcggagaaggtgctggtggccaaccggggcgagatcgcgtgccgggtcatgcggacggcgcgccggctcgggatcgccaccgtcgccgtctacagcgacgccgaccgcgccgcgctgcacgtgcgcgccgccgacgaggccgtccggctcggcccgccccccgcgcgggagagctacctcaacgccgccgccatcgtcgacgccgccctccgcaccggtgcgaaggcgatccaccctggatatgggtttctttcagagagcgcagattttgcacagctctgtgaatccgaggggctaacatttattgggcctccgccatctgcaatccgagatatgggtgataagagcgcctcaaagaggatcatgggtgctgctggtgtaccgcttgttccaggctaccatggggctgaccaagacattgagttgttaaaacttgaagctgataagattggatatccagttttgattaaacccacccacggtggaggcggcaaggggatgagaatagttcaagggcctgatgactttgtggattctgtacggagtgctcaacgtgaagctgcagcatcatttggtatagatacactgttgattgagaagtatattactcaacccagacatatagaagtccaggtatttggtgacaaacatggaaatgctattcacctttacgagagagactgcagcctacaaagaaggcatcagaagatcatcgaggaagcaccagctccaaatgtgacaactgagtttcggactcatattggtgaagctgctgtgtcggctgcgaaggcagttggttactacagtgctggaacagtggagtttatcgtggatactctttcaggagaattctatttcatggagatgaatactcgactccaggttgaacacccagtaacagagatggtcgttggtcaagatcttgtggagtggcaaatacgtgttgcaaatggagagcgcctgccattatcccaggagcaagtcccattaaatggacatgcatttgaagcccgaatatacgctgaaaatgttccaagaggatttcttcctgcaacaggaaccttacatcactatcaaccagtcctgtcttccccaacagtaagagttgaaactggagttgaagaaggagatgctgtcagtatgcattatgatcccatgatagccaaacttgtagtttggggtgaaagtcgcaatgctgcactagtcaagctaaagaactgtttgtcaaactttcagattgcaggtttgcctacaaatgttgctttccttcaagaactcgcaggccataatgcctttgaaagaggcctagttgatacacatttcattgagcggtacaaagatgattttcaaagtacttctgctaaggcctcgggtgaagcacatgatgcagctaagcttggtgcaattttggctgctgcctgcatttgtaaaaaggatcacattacctctgaagaatctcttcgtgacaagacactttcggtatggtatacccgtccacctttcaggatgcatcactccgcgaagcgtttgatggaatttgagttagatgaagaacttgaggagttgagtgatgagcttcttaaattattggttacgtataaatctgatggaggctacttcattgagactgaagatggctcttctcctggttttgatgtcaaagtagatggtaggagtgaaaatgattttcgggttgaagttggtggtgtgcaaacagacgtgacattagcattttattcaaaggataatagcaaacatatacacatctggcatgggaagcatcaccatcattacaggcagaccatgagagctgagcatttgcttgatgacagttctcagccaaggcaggcttccgagggaaggtcacatccaaaaggaagtgttttggcaccaatggctggtttggtcgttaaggttttgcttaaggatggggtacatgtggaagatggtcagcctgtcatggttatcgaagcaatgaagatggagcatgtcgtgaaggcgcctcgggcaggttatatagaagggctgaaggctaccgctggacaacaagtttttgactccagtgtccttttcactgtcaaggataagagcacaaactgatgaaccaagaaattggggccccatatcggaattgaagtggcgcctccgtccttcggaaagaagaataagcaaacaagcagctggagatcatcctgtgactaaataatactaggtgatctccctagtatagccggagatcgtatcttgtggcgcccatttcctgtatagcctgtacattaatgtcagtggcatttgtgcaatgtaacaaatcatgtgagtatgtaacgcaatttgtgaaattcgatggtccaacaacaacaacaaagccttgcttccaaaagtttaaacttaggtagcaggagctgcaatttaggtatgccgaaagaagaattgtccaatgtgaacct

SEQ ID NO: 8693 - DNA, 2844 bp, Triticum aestivum
cacgcgtccgaccactccgccgcgctcggctcacacgccaccggcgatggcctcccgcctcctccgcctgcaccaccagctccggcgccggcgccaccacggcacgagccccgtcccctgcaggctcctctcctcctcctctgccccggagccgccgctgccgtccccgacggtggagaaggtgctggtggccaaccggggggagatcgcgtgccgggtgatgcggacggcgcgccggctcgggatcgccaccgtggccgtgtacagcgacgctgaccgcgccgcgctgcacgtgcgcgccgccgacgaggccgtccggctcggcccgccccccgcgcgggagagctacctcaacgccgccgccatcgtcgacgccgccctccgcaccggcgccaaggctatccaccctggatatgggtttctctcagagagcgcagatttcgcgcagctctgtgaatccgaggggctaacgtttattgggcctccgccatctgcaatccgagatatgggtgataagagcgcgtcaaagaggatcatgggtgctgctggtgtaccgcttgttccaggctaccatggggctgaccaagacattgagttgttaaaacttgaagctgataagattggatatccagttttgattaaacccacacacggtggagggggcaaggggatgagaatagttcaagggcctgatgactttgtggattctgtacggagtgctcaacgtgaagctgcagcatcatttggtatagacacactgttgattgagaagtatattactcaacccagacatatagaagtccaggtatttggtgacaaacatggaaatgctattcacctttacgagagagactgcagtctacaaagaaggcatcagaagatcatcgaggaagcaccagctccaaatgtgacaactgagtttcgggctcatattggtgaagctgctgtgtcagctgcgaaggcagttggttactacagtgctggaacagtggagtttattgtggatactctttcaggagaattctatttcatggagatgaatactcgactccaggttgaacacccagtaacagagatgatcgttggtcaagatcttgtggagtggcaaatacgtgttgcaaatggagagtgcctgccattatctcaggagcaggtcccattaaacggacatgcatttgaagcgcgaatatacgccgaaaatgttccaagaggatttcttcctgcaacaggaaccttacatcactatcgaccagtcctgtcttccccaacagtaagagttgaaactggagtcgaagaaggagatgctgtcagcatgcattatgatcccatgatagccaaacttgtagtttggggtgaaagtcgcaatgctgcactagtcaagctaaagaactgtttgtcaaactttcagattgcaggtttgcctacaaatgttgctttccttcaagaactcgcaggccataatgccttcgaaagaggcctagttgatacacatttcattgagcggtacaaagatgattttcaaagtacttctgctaaggcctccggtgaagcacatgatgcagctaagcttggtgcaattttggctgctgcctgcatttgtaaaaaggatcacattagctccgaagaatcccttcgtgacaagacgctttcagtatggtatacccgtccacctttcaggatgcatcactctgcgaagcgtttgatggaatttgagttagatgaagaacttgaggggttgagtgatgagctccttaaattattggttacatatggatctgatggaggctacttcattgagactgaagatggctcttctcctggttttgatgtcaaagtagatggtaggagcgaacatgatttccgggttgaagttggtggtgtgcaaacagacgtgacattagcattttattcaaaggacaatagcaaacatatacacatctggcatgggaagcatcaccatcattacaggcagacgatgagagctgagcatttacttgatgatagttctcaacctagccaggcttccgagggaagatcacatccaaaaggaagtgttttggcaccaatggctggtttggtcgttaaggttttgcttaaggatggggtacacgtggaaaatggtcagcctgtcatggttatcgaagcaatgaagatggagcatgttgtgaaggcgcctcgggcaggttatatagaaggactgaaggctaccgctggacaacaagtttttgactccagtgtccttttcactgtcaaggataagagcacaagctgatgaacccagaaattggagccacatatcagaattctagtggcggctccgcccttgggaaagaagaataagcaaacaagcagctggagatcattctgtgactaaataatgctaggtgatctctctagtatagctggagatcatatcttccggcacccatttcctgtatagcgtgtacatcaatgtcagtggcattgtgcgatgtaaaaaatcatgtgagtatgtaacgcaacttgcctgccttgcgttgtccaacgtgaatcttcttgattgagaaattcgatgatccaacaacaacaaagcctttaatctcaaacaagttggggtaggctagagttgaaagcctaacacccataagatttcgtaaccaagctcatggttctggaacatggatagctagctttcagaagtttcaacttaggtagctagagctgcaatttaggtatggtgaaagataggcaaaaaggctccattagccgggtattgaaccgggtcgccgtggtgaagccgaggtagtctaaccggctggacgacgaataggtagttagtgaagttgtaggattaggttcgtaacg

SEQ ID NO: 8694 - DNA, 2511 bp, Triticum aestivum
ctccgccgcgctcggctcgcacgccaccggcgatggcctcccgcctcctccgcctgcaccaccacctccggcgccggcgccaccactgcacgagccccgtcccctgcaggctcctctcctcctccgacgaaccaccgcggtcccagacggtggagaaggtgctggtggccaaccggggggagatcgcgtgccgggtgatgcggacggcgcggcggctcgggatcgccaccgtggccgtgtacagcgacgccgaccgcgccgcgctgcacgtgcgcgccgccgacgaggccgtcaggctcggcccgccccccgcgcgggagagctacctcaacgccgacgccatcgtcgacgccgccctccgcaccggcgccaaggcaatccaccctggatatgggtttctttcagagagcgcagatttcgcacagctctgcgaagcagaggggctaacgtttattgggcctccgccatctgcaatccgagatatgggtgataagagcgcgtcaaagaggatcatgggtgctgctggtgtaccgcttgttccaggctaccatggggctgaccaagacattgagttgttaaaacttgaagctgataagattggatatccagttttgattaaacccacacacggtggagggggcaaggggatgagaatagttcaagggcctgatgactttgtggattctgtacggagtgctcaacgtgaagctgcagcatcatttggtatagacacactgttgattgagaagtatattactcaacccagacatatagaagtccaggtatttggtgacaaacatggaaatgctattcacctttacgagagggactgcagtctacaaagaaggcatcagaagatcatcgaggaagcaccagctccaaatgtgacaactgagtttcggactcatattggtgaagctgctgtgtcggctgcgaaggcagttggttactacagtgctggaacagtggagtttattgtggatactctttcaggagaattctatttcatggagatgaatactcgactccaggttgaacacccagtaacagagatgatagtcggtcaagatcttgtggagtggcaaatacgtgttgcaaatggagagcgcctgccattatctcaggagcaggtcccactaaacggacatgcatttgaagcccgaatatacgccgaaaatgttccaagaggatttcttcctgcaacaggaaccttacatcactatcgaccagtcctgtcttccccaacagtaagagttgaaactggagtcgaagaaggagatgctgtcagcatgcattatgatcccatgatagccaaacttgtagtttggggtgaaagtcgcaatgctgcactagtcaagctaaagaactgtttgtcgaactttcagattgcaggtttgcctacaaatgttgctttccttcaagaactcgcaggccataatgccttcgaaagaggcctagttgatacacatttcattgagcggtacaaagatgattttcaaagtacttctgctaaggcctcgggtgaagcacatgatgcagctaagcttggtgcaattttggctgctgcctgcatttgtaaaaaggatcacattagctccgaagaatcccttcgtgacaagacgctttcagtatggtatacccgtccacctttcaggatgcatcactctgcgaagcgtttgatggaatttgagttagatgaagaacttgaggggttgagtgatgagctccttaaattattggttacatatggatctgatggaggctacttcattgagactgaagatggctcttctcctggttttgatgtcaaagtagatggtaggagcgaacatgatttccgggttgaagttggtggtgtgcaaacagacgtgacattagcattttattcaaaggacaatagcaaacatatacacatctggcatgggaagcatcaccatcattacaggcagaccatgagaattgagcatttacttgatgatagttctcaacctagccaggcttccgagggaagatcacatccaaaaggaagtgttttggcaccaatggctggtttggtcgttaaggttttgcttaaggatggggtacacgtggaagatggtcagcctgtcatggttatagaagcaatgaagatggagcacgttgtgaaggcgcctcgggcaggttatatagaagggctgaaggctaccgctggacaacaagtttttgactccagtgtccttttcactgtcaaggataagagcacaagctgatgaacccagaaattggagccacatatcagaattctagtggcggctccgcccttgggaaagaagaataagcaaacaagcagctggagatcattctgtgactaaataatactaggtgatctccctagtatagctggagatcatatcttccggcacccatttcctgtatagcgtgtacattaatgtcagtggcattgtgcaatgtaacaaatcatgtaagtatgtaacgcaatttttctgccttgcattgtccaatgtgaacctt

SEQ ID NO: 8695 - DNA, 2675 bp, Secale cereale
aggaagaaacgtcggggactcgtcgtctcgtccgtccccagtcaccacgcttatccagcccagcagccacaccaaaccaacacatatccccgaccagacccatcgccccgccactccgcctcgcccatccccaccccccccaccccaccactccgccgcgctcggctcacgcgccaccggcgatggcctcccgctcctccgcctgcaccaccagctccggcgccggcgccaccgcggcacgagccccgtcccctgcaggctcctgtcttcgccctctgccccggagccgccgccgccgccgcagacggtggagaaggtgctggtggcgaaccggggggagatcgcgtgccgggtgatgcggacggcgcgccggctcgggatcgccaccgtggccgtctacagcgacgccgaccgcgccgcgctgcacgtgcgcgccgccgacgaggccgtcaggctcggcccgccccccgcgcgggagagctacctcaacgccgccgccatcgttgacgccgccctccgcaccggcgccaaggctatccaccctggatatgggtttctttcagagagcgcagatttcgcacagctctgtgaatccgaggggctaacatttattgggcctccaccatctgcaatccgagatatgggtgataagagcgcgtcaaagaggatcatgggtgctgctggtgtgccgcttgttccaggctaccatggggctgaccaagacattgagttgttaaaacttgaagctgataagattggatatccagttcttattaaacccacacacggtggagggggcaaggggatgagaatagttcaagggcctgatgactttgtggattctgtacggagtgctcaacgtgaagctgcagcatcatttggtatagacacactgttgattgagaagtatattactcaacccagacatatagaagtccaggtatttggtgacaaacatggaaatgctattcacctttacgagagagactgcagtctacaaagaaggcatcagaagatcatcgaggaagcaccagctccaaatgtgacaactgagtttcggactcatattggtgaagctgctgtgtcggctgcgaaggcagttggttactacagtgctggaacagtggagtttattgtggatactctttcaggagaattctatttcatggagatgaatactcgactccaggttgaacacccagtaacagagatgatcgttggtcaagatcttgtggagtggcaaatacgtgttgcaaatggagagcgcctgccattatctcaggagcaggttccattaaacggacatgcatttgaagctcgaatatacgccgaaaatgttccaagaggatttcttcctgcaacaggaaccttacatcactatcgaccagtcctgtcttccccaacagtaagagttgaaactggagtcgaagaaggagatgctgtcagcatgcattatgatcccatgatagccaaacttgtagtttggggtgaaagtcgcagtgctgcactagtcaagctaaagaactgtttgtcgaactttcagattgcaggtttgcctacaaatgttgctttccttcaagaactcgcaggccataatgcctttgaaagaggcctagttgatacacatttcattgagcggtacaaagatgattttcaaagtacttcttctaaggcctcgggtgaagcacatgatgcagctaagcttggtgcaattttggctgctgcctgcatttgtaaaaatgatcacattagctctgaagaatcccttcgtgacaagacgctttcggtatggtatacccgtccacctttcaggatgcatcactctgcgaagcgtttgatggaatttgagttagatgaagaacttgaggggttgagtgatgagctccttaaattattggttacatatagatccgatggaggctacttcattgagactgaagatggctcttctcctggttttgatgtcaaagtagatggtaggagcgaacatgatttccgggttgaagttggtggtgtgcaaacagacgtgacattagcattttattcaaaggataatagcaaacatatacacatctggcatgggaagcatcaccatcattacaggcagaccatgagagctgagcatttacttgatgatagttctcagcctagccaggcttccgagggaaggtcacatccaaaaggaagtgttttggcaccaatggctggtttggtcgttaaggttttgctcaaggacggggtgcacgtggaagatggtcagcctgtcatggttatcgaagcaatgaagatggagcacgttgtgaaggcgcctcaggcaggttatatagaagggctgaaggctaccgccggacaacaagtttttgactccagtgtccttttcactgtcaaggacaagagcacaaactgacggacacagaagttggagccacatatcagaattcaagtggcgactccaccattcggaaagaaagaataagcaaacaagcagctggagatcattctgtgactaaataatactaggtgatctccctagttagctggagatcatatcttccggcacccatttcctgtatagcgtgtacattaatgccagtggcattgtgcaatgtaataacttgtgagtatgtaaaccaatttgcctgccttgccttgtccaatgtgaaccttcttgaaat

SEQ ID NO: 8696 - DNA, 2801 bp, Brachypodium distachyon
tggggcaggagcaagaagaaggagagacgtcggggactcgtcgtctctctctttccagtcaccacccttatccagccttccagcgagctaccaaaccaaacagccccccactccgccttgctcccccacctgcacactcactctgccgcgcgagcgcgatggcctcccgcctcctccgcctccacccgcaactccgccgccggcgccacggcgccagcaggctcctgtcctcttcctcctcctcccccgcggaaccgccagcggcggctatgatggagaaggtgctggtggcgaacaggggcgagatcgcgtgccgggtgatgcggacggcgcggcggctcggggtcgccaccgtggccgtgtacagcgacgccgaccgcggcgcgctgcacgtgcgggacgcggacgaggccgtcaggctcggcccggcacccgcgcgggacagctacctcaacgcctccgccatcgtcgacgccgctctccgcaccggcgccaaggccatccatccgggatatggttttctatcagaaagcgcagatttcgcgcaactctgtcaagctgagggccttacattcatcgggccaccgccgtctgcaatccgtgatatgggcgataagagcgcgtctaagaggatcatgggtgctgctggcgtaccacttgttccaggctaccatggggctgaacaagacatcgagttgttaaaacttgaggctgataagattggatatccagttttgataaaacccacccatggtggagggggcaaggggatgagaatagttcaagggcctgatgacttcgtggattctgtgctgagtgctcaacgtgaagctgcagcctcatttggcataaacacattattgattgagaagtacatcactcaaccaagacatatagaagtccaggtattcggagaccagcatggaaatgctattcacctttacgagagagactgcagtctacaaagaaggcatcagaagatcattgaggaagcaccagctccaaatgtgacaactgaatttcggtctcatattggtgaagctgctgtgtctgctgcgaaggcagttggttactacagtgctggaacggtggagtttattgtggatactatttcaggagagttctatttcatggagatgaatactcgactccaggttgaacacccagtaacagagatgattgttggtcaagatcttgttgagtggcaaatacgtgttgccaatggagagcgcctgccattatctcaggagcaggtccagttaaatgggcatgcatttgaagcccggatatatgctgaaaatgttccaagaggatttcttcctgcgacaggaaccttacatcattaccgaccagtcacgtcttccaaaacagtgagagttgaaactggagttgaagaaggagatactgtcagcatgcactatgatcccatgatagccaaacttgtagtttggggtgaaagtcgcaatgctgcactagtcaagctaaagaactgcttgtcaaactttcagattgcaggtttgcctaccaatgttggtttcctccaagaacttgcagggcatagtgccttcgaaaaggccctagttgagacacacttcattgagcgctataaagatgatcttctgagtacatctgctaagacctcggatgaatcacatgatgcagttgagcttggtgctattttggctgctgcctgcatttgcaaaaaggatcacattgcctctgaagaatcccttcgtgacaagacactttctgtatggtactccggttcacctttcaggatgcatcattccgcgaagcgtctaatggaattcgagattgataaagaacttgaggggttgagtgatgaacctcttaagctgcacattacatataaatctgatggaagctacttcatcgagactatagatgggtcttctcctggtttggaaatcaaattagatgacaggagtgaccatgatttccgggttgatgttggtggtgtgcaaaaagatgtgacattagcattttatacaaaggatgacagcaaacacatccacatttggcatgggaagcatcatcatcattacaggcagaccatgagagctgagcagtcacttgatgatagttctcaacctagccatgcttccgagggaagatcatatccaaaagggagtgttttggcaccaatggctggtttggttgttaaggttctgcttaaagatggggcacaggtggagaatggtcagcctgtcatggtcatggaagcaatgaaaatggagcatgttgtgaaggcgccgcgggctggttatatacaagggctgaaggctactgccggacaacaagtttttgactccagtgtccttttcactgtacaggataagagcacaaactgatgaacccagcaactgtaacctgacccctctaccgattcccagatgcttcagaagtcagtaccgtggcgcagccgtccagaaagataaataagcaacacaatagcaagggttcgttctgtgagaaaataagtacggagtagcaagataaataagcatcataacagcagggtttcattctgtgagaaaataagtagctgatgaattccctgcccatctatggccgcgtccattccctgtgcagcgtgcgtatcactgtgtcagtcacattgtacaatgaaaataagcatctccgattggagccgtctcccttgcaaaattaaacaaatggagccgttctacttctgagccgtcagagaaattctcattcgcgactaagagaaactcctgtcaatgtaagtacgcatctgcccaattagattttgttttacc

SEQ ID NO: 8697 - DNA, 2595 bp, Brachypodium distachyon
aacagccccccactccgccttgctcccccacctgcacactcactctgccgcgcgagcgcgatggcctcccgcctcctccgcctccacccgcaactccgccgccggcgccacggcgccagcaggctcctgtcctcttcctcctcctcccccgcggaaccgccagcggcggctatgatggagaaggtgctggtggcgaacaggggcgagatcgcgtgccgggtgatgcggacggcgcggcggctcggggtcgccaccgtggccgtgtacagcgacgccgaccgcggcgcgctgcacgtgcgggacgcggacgaggccgtcaggctcggcccggcacccgcgcgggacagctacctcaacgcctccgccatcgtcgacgccgctctccgcaccggcgccaaggccatccatccgggatatggttttctatcagaaagcgcagatttcgcgcaactctgtcaagctgagggccttacattcatcgggccaccgccgtctgcaatccgtgatatgggcgataagagcgcgtctaagaggatcatgggtgctgctggcgtaccacttgttccaggctaccatggggctgaacaagacatcgagttgttaaaacttgaggctgataagattggatatccagttttgataaaacccacccatggtggagggggcaaggggatgagaatagttcaagggcctgatgacttcgtggattctgtgctgagtgctcaacgtgaagctgcagcctcatttggcataaacacattattgattgagaagtacatcactcaaccaagacatatagaagtccaggtattcggagaccagcatggaaatgctattcacctttacgagagagactgcagtctacaaagaaggcatcagaagatcattgaggaagcaccagctccaaatgtgacaactgaatttcggtctcatattggtgaagctgctgtgtctgctgcgaaggcagttggttactacagtgctggaacggtggagtttattgtggatactatttcaggagagttctatttcatggagatgaatactcgactccaggttgaacacccagtaacagagatgattgttggtcaagatcttgttgagtggcaaatacgtgttgccaatggagagcgcctgccattatctcaggagcaggtccagttaaatgggcatgcatttgaagcccggatatatgctgaaaatgttccaagaggatttcttcctgcgacaggaaccttacatcattaccgaccagtcacgtcttccaaaacagtgagagttgaaactggagttgaagaaggagatactgtcagcatgcactatgatcccatgatagccaaacttgtagtttggggtgaaagtcgcaatgctgcactagtcaagctaaagaactgcttgtcaaactttcagattgcaggtttgcctaccaatgttggtttcctccaagaacttgcagggcatagtgccttcgaaaaggccctagttgagacacacttcattgagcgctataaagatgatcttctgagtacatctgctaagacctcggatgaatcacatgatgcagttgagcttggtgctattttggctgctgcctgcatttgcaaaaaggatcacattgcctctgaagaatcccttcgtgacaagacactttctgtatggtactccggttcacctttcaggatgcatcattccgcgaagcgtctaatggaattcgagattgataaagaacttgaggggttgagtgatgaacctcttaagctgcacattacatataaatctgatggaagctacttcatcgagactatagatgggtcttctcctggtttggaaatcaaattagatgacaggagtgaccatgatttccgggttgatgttggtggtgtgcaaaaagatgtgacattagcattttatacaaaggatgacagcaaacacatccacatttggcatgggaagcatcatcatcattacaggcagaccatgagagctgagcagtcacttgatgatagttctcaacctagccatgcttccgagggaagatcatatccaaaagggagtgttttggcaccaatggctggtttggttgttaaggttctgcttaaagatggggcacaggtggagaatggtcagcctgtcatggtcatggaagcaatgaaaatggagcatgttgtgaaggcgccgcgggctggttatatacaagggctgaaggctactgccggacaacaagtttttgactccagtgtccttttcactgtacaggataagagcacaaactgatgaacccagcaactgtaacctgacccctctaccgattcccagatgcttcagaagtcagtaccgtggcgcagccgtccagaaagataaataagcaacacaatagcaagggttcgttctgtgagaaaataagtacggagtagcaagataaataagcatcataacagcagggtttcattctgtgagaaaataagtagctgatgaattccctgcccatctatggccgcgtccattccctgtgcagcgtgcgtatcactgtgtcagtcacattgtacaatgaaaataagcatctccgattggagccgtctcccttgcaaaattaaa

SEQ ID NO: 8698 - DNA, 2832 bp, Oryza sativa
caggtgggtcccactccaagttagccaaaagccgtacgtacaccccccatccgacgtcgccggagggagagaagaagggagggccgagggagggagagccgtcgggaactcgctcactctctcactctcactgcctcaccaaccagtcaccgcccttatcctttttccctctaaggtctaaaccacccccaatcacgcggacccccatcgccgcgcgcgcccactcctccgcgtcgcgtcacccatggcctcccgcctcctcctcctcccccgccgccgcagccgccatggcggcgccagcctcctcctcgcgcggctcctctcctcatcctcctccgaggctggcggtggtggggcggtggagaaggtgcttgtggcgaacaggggggagatcgcgtgcagggtgatgaggacggcgcggaggctcgggatccccaccgtcgcggtctacagcgacgccgaccggggggccctccacgtgcgcgccgccgacgaggccgtccgcctcggcccgccgcccgccagggagagctacctcaacgcctccgccatcgtcgacgccgcgctccgcaccggcgccaaggctatccacccaggatatggttttctttcggagagcgcagatttcgcgcagctctgtaaagccgaggggcttacattcattggaccaccaccatctgctatccgagacatgggcgacaagagtgcttctaagaggatcatgggtgctgctggtgtaccgctcgtcccaggttaccatggggctgaacaagacattgagctgttaaaacttgaagccaataagattgggtatccagttttgatcaagcccacacatggtggagggggcaaggggatgagaatagttcaaaggcctgaggactttgtggattctgtattgagtgctcaacgagaagccgcagcatcatttggcataaacacgctgctggttgagaagtatattacccaacccagacatatagaagtccagatatttggagatcaacatggaaatgtgattcacctttatgagagagattgtagtctacaaagaaggcaccaaaagattatcgaggaagctccagctccaaatgtgacagctcagtttcggtctcatattggtgaagctgctgtatcagctgcaaaggcagttggttactacagtgctggaacagtggagtttatcgtggatactctttccggagaattctatttcatggaaatgaatactcggctccaggttgaacacccagtgaccgagatgatcgttggccaagatcttgttgagtggcaaatacgaattgcaaatggagagtgcctaccattatctcaggagcaggttccgttaaatggacatgcgtttgaagcccgaatatacgcagaaaatgtgccaaggggatttcttcctgctacaggaaccttacaccactacaggccagttccctctaccgcaacagtaagagttgaaactggagttgaagaaggagatactgtcagcatgcattatgatcccatgatagccaaacttgtggtttggggtgaaagtcgcaatgctgcgctagtcaagctaaagaacagcctgtcaaactttcagattgcaggtttgccgaccaatgttggtttcctccaagaactcgcaggtcatagtgcctttgaaaaaggcctagtcgatacacatttcattgaacgctatcaaaatgatcttctgagtacttctactcaagccttgagtggatcacatgaagcagaagagcttggtgcaattttggctgctgcctgcatttgcaagaaggatcatgtttcctctgaagtgtcacttcatgataagaaactttctatgtggtacgcccatccacctttcaggatgcatcattttgccaagcgtctaatggaatttgagttggatagagaacttggtggatcaagtgatgatcttcttaaactgtcggtaacatatagatctgacggaacctacttcgttgagactgaagatggttcttctcctggattggatgtcaaagtagatagcagaggtgaccatgatttccgggttgatgttggtgggctgcaaacagacgtaactctagcattttattcaaaggacaattgcaaccatatacacatctggcatgggaagcatcatcatcattacaggcagacgttgagagctgagcagtcacctgatgacagttctcaacctagcgcttcctctgaggcgaggtcacatccaaaggggagtgttttggcaccaatggctggtctggttgtaaaggttttgcttaaagacggggcacgggtggaggaaggtcagcctgtcatggttatggaagcaatgaagatggagcatgttgtgaaggcgccttgtgccggatatgtggaagggctgaaggctactgccggacaacaagtttttgactctagtgtccttttcaccgtgaaggagaacaagccaaattgagaaacccaggcagagattcacgacctgtacagctcaattcacagacgcttcataagttggctgatgatgctgccggccgtccaaaagcaagcaaataataagcgacaacatcgagttcacaacacaaaagcaagcaaaaataagcaacgggttcatctgtgtgaataaattagttgacgagctcccaacccaccccctgttgttgttgtcgcaaacctgaaactgtacagtgtacattactgctgtcacatacagtgacaaaaacaattaaacctcatttgttcttccattgccctgaaagttggaataaccgtgaaaattggaataatcccagtaatgaacgaactaacctgacactgacagtgaaaactaaa

SEQ ID NO: 8699 - DNA, 2684 bp, Oryza sativa
gtcgggaactcgctcactctctcactctcactgcctcaccaaccagtcaccgcccttatcctttttccctctaaggtctaaaccacccccaatcacgcggacccccatcgccgcgcgcgcccactcctccgcgtcgcgtcacccatggcctcccgcctcctcctcctcccccgccgccgcagccgccatggcggcgccagcctcctcctcgcgcggctcctctcctcatcctcctccgaggctggcggtggtggggcggtggagaaggtgcttgtggcgaacaggggggagatcgcgtgcagggtgatgaggacggcgcggaggctcgggatccccaccgtcgcggtctacagcgacgccgaccggggggccctccacgtgcgcgccgccgacgaggccgtccgcctcggcccgccgcccgccagggagagctacctcaacgcctccgccatcgtcgacgccgcgctccgcaccggcgccaaggctatccacccaggatatggttttctttcggagagcgcagatttcgcgcagctctgtaaagccgaggggcttacattcattggaccaccaccatctgctatccgagacatgggcgacaagagtgcttctaagtggatcatgggtgctgctggtgtaccgctcgtcccaggttaccatggggctgaacaagacattgagctgttaaaacttgaagccaataagattgggtatccagttttgatcaagcccacacatggtggagggggcaaggggatgagaatagttcaaaggcctgaggactttgtggattctgtattgagtgctcaacgagaagccgcagcatcatttggcataaacacgctgctggttgagaagtatattacccaacccagacatatagaagtccagatatttggagatcaacatggaaatgtgattcacctttatgagagagattgtagtctacaaagaaggcaccaaaagattatcgaggaagctccagctccaaatgtgacagctcagtttcggtctcatattggtgaagctgctgtatcagctgcaaaggcagttggttactacagtgctggaacagtggagtttatcgtggatactctttccggagaattctatttcatggaaatgaatactcggctccaggttgaacacccagtgaccgagatgatcgttggccaagatcttgttgagtggcaaatacgaattgcaaatggagagtgcctaccattatctcaggagcaggttccgttaaatggacatgcgtttgaagcccgaatatacgcagaaaatgtgccaaggggatttcttcctgctacaggaaccttacaccactacaggccagttccctctaccgcaacagtaagagttgaaactggagttgaagaaggagatactgtcagcatgcattatgatcccatgatagccaaacttgtggtttggggtgaaagtcgcaatgctgcgctagtcaagctaaagaacagcctgtcaaactttcagattgcaggtttgccgaccaatgttggtttcctccaagaactcgcaggtcatagtgcctttgaaaaaggcctagtcgatacacatttcattgaacgctatcaaaatgatcttctgagtacttctactcaagccttgagtggatcacatgaagcagaagagcttggtgcaattttggctgctgcctgcatttgcaagaaggatcatgtttcctctgaagtgtcacttcatgataagaaactttctatgtggtacgcccatccacctttcaggatgcatcattttgccaagcgtctaatggaatttgagttggatagagaacttggtggatcaagtgatgatcttcttaaactgtcggtaacatatagatctgacggaacctacttcgttgagactgaagatggttcttctcctggattggatgtcaaagtagatagcagaggtgaccatgatttccgggttgatgttggtgggctgcaaacagacgtaactctagcattttattcaaaggacaattgcaaccatatacacatctggcatgggaagcatcatcatcattacaggcagacgttgagagctgagcagtcacctgatgacagttctcaacctagcgcttcctctgaggcgaggtcacatccaaaggggagtgttttggcaccaatggctggtctggttgtaaaggttttgcttaaagacggggcacgggtggaggaaggtcagcctgtcatggttatggaagcaatgaagatggagcatgttgtgaaggcgccttgtgccggatatgtggaagggctgaaggctactgccggacaacaagtttttgactctagtgtccttttcaccgtgaaggagaacaagccaaattgagaaacccaggcagagattcacgacctgtacagctcaattcacagacgcttcataagttggctgatgatgctgccggccgtccaaaagcaagcaaataataagcgacaacatcgagttcacaacacaaaagcaagcaaaaataagcaacgggttcatctgtgtgaataaattagttgacgagctcccaacccaccccctgttgttgttgtcgcaaacctgaaactgtacagtgtacattactgctgtcacatacagtgacaaaaacaattaaacctcatttgttcttccattgccctgaaagttggaataaccgtgaaaattggaat

SEQ ID NO: 8700 - DNA, 5876 bp, Setaria italica
caccaacccacgcccatgcccatcccgtccgtccccgcgaattatttccccgacccaccgccgcgccactccgccttgctggctcactgctgcggctccactccagctgctcgaattccccgaccaccgaggcagcgatggcctcccgcctgctccgcctccacctccgccgccgcgggggcggccggagccccggctcacccgtgcccccgctcccgctcctcctcgcggcgcggctcctctcctcctcctcctcctcctccgcccccacttctcctgccgcggcggcgtccccgggcgcggggatcgagaaggtgctggtggcgaaccggggcgagatcgcgtgccgggtcatgcgcaccgcgcggcggctcggggtcgccaccgtggccgtgtacagcgacgccgaccggaaggcgctgcacgtgcgcgccgccgacgaggccgtcaggatcggcccgccgcccgccagggagagctacctcgacgccagggccatcatcgacgccgcacaccgcaccggcgcccaggcaatccacccggggtacgggtttctttcagagagtgctgattttgcgcagctctgtgaagccgaggggcttaaattcattggaccgcctgcatctgcaatccgagatatgggtgataagagtgcatccaagaggatcatgggtgctgctggagtaccgctagttccaggttaccacggggctgaacaagacattgagttattgaaactcgaagctgataaaatcggttatccagttttgatcaagcccacccatggtggagggggcaaggggatgaggatagttcagcggcccgaagagtttgtggattctgtactgagcgctcaacgggaagccgcagcatcatttggggtaaacacactattgattgagaagtatattactcaacccagacatgtagaagtccaggtatttggcgaccaacatggaaatgcaatatacctttatgagagagactgcagtcttcaaagaagacatcaaaagattattgaggaagctccagctccaaatgttacagctgagtttcgttctcatattggtggagctgctgtgtctgcagcaaaggcagttggttactacaatgctggaacagtggagtttattgtggacactctttctggagaattctacttcatggagatgaatactcgacttcaggttgaacacccagtaacagagatgattgtcggtcaagatcttgtggagtggcaaatacgtgttgcaaatggagaacgcctaccactatctcaggagcaggtcccattaaatggacatgcatttgaagctaggatatatgctgaaaatgttccaagaggatttcttcctgcaacaggaaccttacatcactacagaccagtcccttctgcctcaacagtaagagttgaaactggagttgaagaaggagatactgtcagcatgcattatgatcccatgatagccaagcttgtagtatggggtgaaagccgcagtgctgccctagtcaagctgaagaaatgtctgtcgaactttcagattgcaggcttgccaaccaatgttggtttcctccaagaacttgcaagccatagttcctttgaagaaggcatagtcgacacacacttcattgagcgttacaaagatgatcttttgagtacttctacaaaggcctcaggtgaatcgcgtgatgtagctgagcttggtgcaattctggctgctgcatgtatttgcaagaaggatcacattacatctaaagaatcaatacgagctgacaagaaactgtctgtatggtacaataatacacctttcaggatgcatcactttgctaggcaaccactagaattggagtttgaagaacatgatggattcagtgagaaactgcttaaactgttcattacgtataagcctgatggaagctacttcatcgagactgaagatggcacttctggtttggatgtcaaagttgatcacaagggtgaccatgattttcgtgtagatgctgctggcctgcaaactgatgtgactctagcttattattcaaaggataatagcgagcatatacacatttggcatgggaagcatcatcaccattacagacagactctgagaactgagcatgtagttgatgatacctcccaacctagccatgcttctgaggggaagtcacatccaaaagggagtgttctggcaccgatggctggtttggttgtgaaggttttgcttgaagatggggcacaggtggaggcagggcagcctgtcatggttatggaagcaatgaagatggagcatgttgtgaaggcacctcgcgctggatatgtggagggcctgaaggttactgctggccaacaagtttttgactctagtgtccttttcactattaaggacaatactgcgaactgagatgcagcatcccagaagctgtccgactacagcagtatcaaacaattcacggatgatccaggagttgatcgacaacgctggcattcagatagaaagcaaatgaataaacaggtgggtgggttcatctgcgggcaagcaacctgctggaccatgaactcccagcggcatactggtatcctggaccatggatggcacagctctctcgtagtcttgtggtacaaaaggtttttgagcacgctttgggtctccaaatacacgaggggtattaacaatgattggcctcagcatgaagcatggctagtacagagccgaccaagtcactgtgacgaccgcagtggcgaagtcaaatttccagcggtcactgacagacccatgcgctgcaaccctgaaggcaaaatcaccgataagatgagacgtcgggtcgtcaccaccaccagcagcaggagctttgaagcgtaggatcagatcagacgtaacgacgtgattcccttcaaatccctcacgaatttgacgtgatcccctttaaatccctcacgaatttgacttgaatcgaaattttttccaaaaccgtgtttttagttggacgttcccctttaaatccctcatgaatttaacttgaatcgaaatttttcccaaaaccgtgttcttagttgggcgttcgattttcttcccaaaaccgtgttcttggttggacgttcgactttctccaaattcaaacggtgttcttagttggacgttcgattttcttcaaaatccacgagggatacttgaaaaactcaagatcttcttcctagatgtattagtccttgaggctcaagatcttcttcctagatctattagtccttgaggggttgcatccatagctcaagtttcatctcgaatcgttgaatcttttttttttttgaaatgtaaatcgttgaatcttgaggggagtatttttcgtttgaagttggtgcctttcttggttccttctgttatctgttcgagcgcaggagcaatcgaccggcagcttcgcacggacgcggggcaggccagctcatcgggccaggccagcagcagcgagcccagctagtggcagcaggctgcccagcagcagcacgccctgcttgtgcttcgcaggccaggccagcaggccaacagtagcaggcctggcgagcaccgcagctcaacctggtggccagcggcccagcacgcacgtgtgagagcaggcggagacacaagcactctatagccaggagcacccacgtgtggcctaaggagaatcaacccatcatttccagctggcccatcgaggttcggtctagtgcttttaattcgtgctaagttaattattgctagataatctgtgcaaccttgttcaattgttttgtcattcgctaatcatgcttagttcttaattaattatttcaagcatttttagtcaagtaatgatttggtagtggttgagctcaatcacttgtgcaagcttttcagtgtctcactttgctttgcttgcgctccgcttcgagaattcctaatcgttactaggatgagtttgttacgagttgttgacttgtgtcatcttgatgattaggcacgatgtgtgttttagagtagcaattggaacatacgtctcattctcgaagacaatttcaaaagctcccattcaacctccctttagttgcccgttctgatccttcttgcagcctaactccgtaactcggcataggaggatgcagcagcatacggctgctaaaacttcgatgaatgcttctaggtttgaccactctgatacgatatccctttttatattcttttcgaaaagcataacccttatgcacttaaaactgataagacgaagcagagacgaagtagacgacgacgggtttggttggatgctggaatcgaacaagacgctcccggccaggttacccgactgctagctaagttgttcttttttcctgggacgacaacaacgacaagctgcacctgcacgtgcgcgagttggcacggactacggcggcgtcagagttcaagttcccctggagcagcccgaaagcgacggcgcactcgatccggccagccatggcgacgctgccggccggccggccgccaaagcagaaggtgacgctgcacgaaaggacaagggattccggcggcgacgtttctgtggcacagaaacgcatgcacgatcgagctggaaaaagaagcctgcggggagagatcgaggacgatcgtgttcccggcgacgtggccgtgtcgccgcgcgtaggaggagggaacctgatgctcccagcctcccaggttgtaggcgcgtagtcgcctgcgtgtgcgtgcagggctcgcctctccgcgcgcgcacgtgcatggggtttgtgcgtgcgtggcggttctggcgtcgacgcctctccgtccaacaagaaccggcggccacgcacgcacacggagcgttgaacgaaggtgttccgttcaaccttctattcacttgtttacgacatcgcggcgatggaccacggttgaagagagaccgaggacggcgaccacgcaaaaggaatatgcatcgtctatgcttcactctacatcaccatctacttcctttccttctttaattttacatgtatcttgctgcatgaattggaaatatctctttatcaaagcctacaactaatcaaacaaatagcacgaagaaccaagtacagaaatgataccatgttctccgaatatccgactgatgaaccccaagaaactataactatcctcatttattaacgtatattttttgagcttgcattcctggaaggtaggagcatgcaagcaacaaccaaatcatgtcgtcattagtaggtacgtaatttcaacgtcaacattattaactacatagccaatgtggacatcttgatgcaattattgcatgtaaaatgttattttctgcgtgtcaacgtggcgacatgatgcaaataagaagcgtcattcaagatgtcgtaaaagagtggaccgctttgcctgaatgggcgttcttgactttgttgttgctccaaagaaattaaatccagttgaaacgatcattgcgcgttgaatcatggcttctagtgtatatactcatgaaggatatacttttctacatgatttatcaacttttacctttttttaacttctatctccgatttccttttttttaagaaaaaacaatgtgttgtaatgttcatgtcaatttcaagaaaacatcacagcagattatcgcaaaaaacgaaggaaagtcaaaagagttacccttgttgtatatttcgcacacggcttttgttgtataactccttgctacaacgatattgttttcctgtacaaccgacactactccattattgtaaccaatagagaccctaactttagaataagtggataactgagagctcccgccgaggacaaaataaaccattctttctcttgtttgatgctctctccgtagaaatgcaatctttgaggtgtaattttggccac

SEQ ID NO: 8701 - DNA, 6068 bp, Setaria italica
ccctgacccgtctgaccagtcaccacccttatccagcggggcccaccaacccacgcccatgcccatcccgtccgtccccgcgaattatttccccgacccaccgccgcgccactccgccttgctggctcactgctgcggctccactccagctgctcgaattccccgaccaccgaggcagcgatggcctcccgcctgctccgcctccacctccgccgccgcgggggcggccggagccccggctcacccgtgcccccgctcccgctcctcctcgcggcgcggctcctctcctcctcctcctcctcctccgcccccacttctcctgccgcggcggcgtccccgggcgcggggatcgagaaggtgctggtggcgaaccggggcgagatcgcgtgccgggtcatgcgcaccgcgcggcggctcggggtcgccaccgtggccgtgtacagcgacgccgaccggaaggcgctgcacgtgcgcgccgccgacgaggccgtcaggatcggcccgccgcccgccagggagagctacctcgacgccagggccatcatcgacgccgcacaccgcaccggcgcccaggcaatccacccggggtacgggtttctttcagagagtgctgattttgcgcagctctgtgaagccgaggggcttaaattcattggaccgcctgcatctgcaatccgagatatgggtgataagagtgcatccaagaggatcatgggtgctgctggagtaccgctagttccaggttaccacggggctgaacaagacattgagttattgaaactcgaagctgataaaatcggttatccagttttgatcaagcccacccatggtggagggggcaaggggatgaggatagttcagcggcccgaagagtttgtggattctgtactgagcgctcaacgggaagccgcagcatcatttggggtaaacacactattgattgagaagtatattactcaacccagacatgtagaagtccaggtatttggcgaccaacatggaaatgcaatatacctttatgagagagactgcagtcttcaaagaagacatcaaaagattattgaggaagctccagctccaaatgttacagctgagtttcgttctcatattggtggagctgctgtgtctgcagcaaaggcagttggttactacaatgctggaacagtggagtttattgtggacactctttctggagaattctacttcatggagatgaatactcgacttcaggttgaacacccagtaacagagatgattgtcggtcaagatcttgtggagtggcaaatacgtgttgcaaatggagaacgcctaccactatctcaggagcaggtcccattaaatggacatgcatttgaagctaggatatatgctgaaaatgttccaagaggatttcttcctgcaacaggaaccttacatcactacagaccagtcccttctgcctcaacagtaagagttgaaactggagttgaagaaggagatactgtcagcatgcattatgatcccatgatagccaagcttgtagtatggggtgaaagccgcagtgctgccctagtcaagctgaagaaatgtctgtcgaactttcagattgcaggcttgccaaccaatgttggtttcctccaagaacttgcaagccatagttcctttgaagaaggcatagtcgacacacacttcattgagcgttacaaagatgatcttttgagtacttctacaaaggcctcaggtgaatcgcgtgatgtagctgagcttggtgcaattctggctgctgcatgtatttgcaagaaggatcacattacatctaaagaatcaatacgagctgacaagaaactgtctgtatggtacaataatacacctttcaggatgcatcactttgctaggcaaccactagaattggagtttgaagaacatgatggattcagtgagaaactgcttaaactgttcattacgtataagcctgatggaagctacttcatcgagactgaagatggcacttctggtttggatgtcaaagttgatcacaagggtgaccatgattttcgtgtagatgctgctggcctgcaaactgatgtgactctagcttattattcaaaggataatagcgagcatatacacatttggcatgggaagcatcatcaccattacagacagactctgagaactgagcatgtagttgatgatacctcccaacctagccatgcttctgaggggaagtcacatccaaaagggagtgttctggcaccgatggctggtttggttgtgaaggttttgcttgaagatggggcacaggtggaggcagggcagcctgtcatggttatggaagcaatgaagatggagcatgttgtgaaggcacctcgcgctggatatgtggagggcctgaaggttactgctggccaacaagtttttgactctagtgtccttttcactattaaggacaatactgcgaactgagatgcagcatcccagaagctgtccgactacagcagtatcaaacaattcacggatgatccaggagttgatcgacaacgctggcattcagatagaaagcaaatgaataaacaggtgggtgggttcatctgcgggcaagcaacctgctggaccatgaactcccagcggcatactggtatcctggaccatggatggcacagctctctcgtagtcttgtggtacaaaaggtgcatcataattcatgttaattccacaatttgttatagagacaagcttgtctaccatcttcatctctttgggtttggatatgcataaagcaccaaccacttttagctacacgtgcatggaaaatgatcgtatgggagtcggacgcaggtttttgagcacgctttgggtctccaaatacacgaggggtattaacaatgattggcctcagcatgaagcatggctagtacagagccgaccaagtcactgtgacgaccgcagtggcgaagtcaaatttccagcggtcactgacagacccatgcgctgcaaccctgaaggcaaaatcaccgataagatgagacgtcgggtcgtcaccaccaccagcagcaggagctttgaagcgtaggatcagatcagacgtaacgacgtgattcccttcaaatccctcacgaatttgacgtgatcccctttaaatccctcacgaatttgacttgaatcgaaattttttccaaaaccgtgtttttagttggacgttcccctttaaatccctcatgaatttaacttgaatcgaaatttttcccaaaaccgtgttcttagttgggcgttcgattttcttcccaaaaccgtgttcttggttggacgttcgactttctccaaattcaaacggtgttcttagttggacgttcgattttcttcaaaatccacgagggatacttgaaaaactcaagatcttcttcctagatgtattagtccttgaggctcaagatcttcttcctagatctattagtccttgaggggttgcatccatagctcaagtttcatctcgaatcgttgaatcttttttttttttgaaatgtaaatcgttgaatcttgaggggagtatttttcgtttgaagttggtgcctttcttggttccttctgttatctgttcgagcgcaggagcaatcgaccggcagcttcgcacggacgcggggcaggccagctcatcgggccaggccagcagcagcgagcccagctagtggcagcaggctgcccagcagcagcacgccctgcttgtgcttcgcaggccaggccagcaggccaacagtagcaggcctggcgagcaccgcagctcaacctggtggccagcggcccagcacgcacgtgtgagagcaggcggagacacaagcactctatagccaggagcacccacgtgtggcctaaggagaatcaacccatcatttccagctggcccatcgaggttcggtctagtgcttttaattcgtgctaagttaattattgctagataatctgtgcaaccttgttcaattgttttgtcattcgctaatcatgcttagttcttaattaattatttcaagcatttttagtcaagtaatgatttggtagtggttgagctcaatcacttgtgcaagcttttcagtgtctcactttgctttgcttgcgctccgcttcgagaattcctaatcgttactaggatgagtttgttacgagttgttgacttgtgtcatcttgatgattaggcacgatgtgtgttttagagtagcaattggaacatacgtctcattctcgaagacaatttcaaaagctcccattcaacctccctttagttgcccgttctgatccttcttgcagcctaactccgtaactcggcataggaggatgcagcagcatacggctgctaaaacttcgatgaatgcttctaggtttgaccactctgatacgatatccctttttatattcttttcgaaaagcataacccttatgcacttaaaactgataagacgaagcagagacgaagtagacgacgacgggtttggttggatgctggaatcgaacaagacgctcccggccaggttacccgactgctagctaagttgttcttttttcctgggacgacaacaacgacaagctgcacctgcacgtgcgcgagttggcacggactacggcggcgtcagagttcaagttcccctggagcagcccgaaagcgacggcgcactcgatccggccagccatggcgacgctgccggccggccggccgccaaagcagaaggtgacgctgcacgaaaggacaagggattccggcggcgacgtttctgtggcacagaaacgcatgcacgatcgagctggaaaaagaagcctgcggggagagatcgaggacgatcgtgttcccggcgacgtggccgtgtcgccgcgcgtaggaggagggaacctgatgctcccagcctcccaggttgtaggcgcgtagtcgcctgcgtgtgcgtgcagggctcgcctctccgcgcgcgcacgtgcatggggtttgtgcgtgcgtggcggttctggcgtcgacgcctctccgtccaacaagaaccggcggccacgcacgcacacggagcgttgaacgaaggtgttccgttcaaccttctattcacttgtttacgacatcgcggcgatggaccacggttgaagagagaccgaggacggcgaccacgcaaaaggaatatgcatcgtctatgcttcactctacatcaccatctacttcctttccttctttaattttacatgtatcttgctgcatgaattggaaatatctctttatcaaagcctacaactaatcaaacaaatagcacgaagaaccaagtacagaaatgataccatgttctccgaatatccgactgatgaaccccaagaaactataactatcctcatttattaacgtatattttttgagcttgcattcctggaaggtaggagcatgcaagcaacaaccaaatcatgtcgtcattagtaggtacgtaatttcaacgtcaacattattaactacatagccaatgtggacatcttgatgcaattattgcatgtaaaatgttattttctgcgtgtcaacgtggcgacatgatgcaaataagaagcgtcattcaagatgtcgtaaaagagtggaccgctttgcctgaatgggcgttcttgactttgttgttgctccaaagaaattaaatccagttgaaacgatcattgcgcgttgaatcatggcttctagtgtatatactcatgaaggatatacttttctacatgatttatcaacttttacctttttttaacttctatctccgatttccttttttttaagaaaaaacaatgtgttgtaatgttcatgtcaatttcaagaaaacatcacagcagattatcgcaaaaaacgaaggaaagtcaaaagagttacccttgttgtatatttcgcacacggcttttgttgtataactccttgctacaacgatattgttttcctgtacaaccgacactactccattattgtaaccaatagagaccctaactttagaataagtggataactgagagctcccgccgaggacaaaataaaccattctttctcttgtttgatgctctctccgtagaaatgcaatctttgaggtgtaattttggccacc

SEQ ID NO: 8702 - DNA, 2672 bp, Zea mays
cccccatctcgcatctcgcgtactatttccacaattccaccgacccgtcgtcgcgccactccgtcttgctcaacaccagtcaccactgctctccaagcctccaccagcgtccagccgaaccatcgccaccgcaggatggcctcccgcctcctcctccacctccacctgcgccgccgcgggcgcgggatcccgggctgccccgtgcccgcgctacccctccacgccgcgcggctcctctcctcctccccaccaaccgcagctgcggcctcgtcgtcggcggcgggcggcgggggcatcgagaaggtgctggtggcgaaccggggcgagatcgcgtgccgggtcatgcgcaccgcgcgccgcctcggggtcgccaccgtggccgtgtacagcgacgccgaccgcggggcgctgcacgtgcgcgccgccgacgaggccgtcaggatcggcccgccgcccgcgcgggagagctacctcaacgccagggccatcatcgaggccgccctccgcaccggcgcccaggctatccacccgggatacggtttcctttcagagagtgctgatttcgcgcagctctgtgaagccgaggggctcaaattcattggaccaccagcatctgcaatccgagacatgggcgataagagtgcatccaagaggatcatgggtgctgctggcgtgccgctggttccagggtaccatggggctgaccaggacgttgagctgttgaaactcgaagcggataaaatcggttatcctgttttaatcaaacccacccatggtggagggggcaaggggatgagaatagtcgaaaggcctgatgaatttgtggattctgtactgagcgctcaacgggaagctgcagcatcgtttggtgtaaacacactattgattgagaagtatattactcaaccaagacacgtagaagtccaggtatttggcgaccaacatggaaatgcgatatacctttatgagagagactgcagtctacagagaaggcatcagaagatcatcgaggaagctccagctccaaatgtgccagctgagtttcggtctcatattggtggagctgctgtatctgcagcaaaggcagttggttactacaatgctggaacagtggagtttattgtggacactctttctggagagttctacttcatggagatgaatactcgactccaggttgaacacccagtgacagagatgattgttggtcaagatcttgtggagtggcaaatacgtgttgcgaatggagaacgactaccattatctcaggagcaggttccattaaatggacatgcatttgaagcacggatatatgctgaaaatgttccaagagggtttctccctgcaacaggaaccttacatcactaccgaccagtcccttctgacccaactgtaagagttgaaactggagtcgaagaaggagataccgtcagcatgcattatgatccaatgatagccaaacttgtagtatggggtgaaagtcgcacggctgcactagtcaagctaaagaagtgtttatcaacctttcagattgcaggtttgccaaccaatgttgatttcctccaagaactcgcaagccacagtgcctttgaaaaaggcctagttgacactcacttcattgaacgttataaagatgaccttttgagtatttctacaaagtcctcaaaagaatctcatggtgtagctgagcttggtgcaattttggctgctgcatgcatttgcaagaaggaacacattacatctaaagaatcactacgagccaacaagtcactatctgtatggtacaataatccacctttcaggatgcatcactttgctaggcatcccctggatcttgagttggaagagaatgatggattcagtgagaaacttcttaaactgttcattactcataagtctgatggaagctacttcatcgagacagaagatggcacttctggtttagatgtcaaagtcgatcacaagggtgaccacgattttcgtgtggatgtttctggtctgcaaactgatgtgactctagcatcttattcaaagggaaacagcaaacacatacatgtctggcatgggaatcatcaccaccattacagacagactgtaagagctgaacatgcagttgatgatagctcccaacctagtcatgcttctgaagggaagtcgcatccaaaagggagtgttctggcaccgatggctggcttggttgtgaaagttttgcttgaagacggggctcaggtggacgcagggcagcctgtcatggttatggaagcaatgaagatggagcatgttgtgaaggcgcctcgtgccggatacgtgagtggcctgaaggttactgcaggccaacaagtttttgactccagtgtccttttcacaatcaaggacagctctgcaaactgagatggagcgatcactgccctagagtagttgcactgcaactgcatcaagcacccagcggatgctcgtccagatagagaagcgaaggaaataaacggctgggttcgtctgcgggcaatccaatccggcagtgcaagcagacggcgcatggtgttttcccggcttgatgcgaatccatcattcaccgcaacaattccattgcgtagtgtacacgaacatgaaactgtaccacgctgagcaagaggaattcttgtttgatttgtgcaatgaaataagttgattcc

SEQ ID NO: 8703 - DNA, 2811 bp, Zea mays
cttctcggcacgctcgcgcaggaaggctggagagctacggacggccgacgggaacaaggagagacgtcgcggactcgtctgaccagtcaccgcccttatccagcgggaccaacccaggcccacactgacgacgccccccatctcgcatctcgcgtactatttccacaattccaccgacccgtcgtcgcgccactccgtcttgctcaacaccagtcaccactgctctccaagcctccaccagcgtccagccgaaccatcgccaccgcaggatggcctcccgcctcctcctccacctccacctgcgccgccgcgggcgcgggatcccgggctgccccgtgcccgcgctacccctccacgccgcgcggctcctctcctcctccccaccaaccgcagctgcggcctcgtcgtcggcggcgggcggcgggggcatcgagaaggtgctggtggcgaaccggggcgagatcgcgtgccgggtcatgcgcaccgcgcgccgcctcggggtcgccaccgtggccgtgtacagcgacgccgaccgcggggcgctgcacgtgcgcgccgccgacgaggccgtcaggatcggcccgccgcccgcgcgggagagctacctcaacgccagggccatcatcgaggccgccctccgcaccggcgcccaggctatccacccgggatacggtttcctttcagagagtgctgatttcgcgcagctctgtgaagccgaggggctcaaattcattggaccaccagcatctgcaatccgagacatgggcgataagagtgcatccaagaggatcatgggtgctgctggcgtgccgctggttccagggtaccatggggctgaccaggacgttgagctgttgaaactcgaagcggataaaatcggttatcctgttttaatcaaacccacccatggtggagggggcaaggggatgagaatagtcgaaaggcctgatgaatttgtggattctgtactgagcgctcaacgggaagctgcagcatcgtttggtgtaaacacactattgattgagaagtatattactcaaccaagacacgtagaagtccaggtatttggcgaccaacatggaaatgcgatatacctttatgagagagactgcagtctacagagaaggcatcagaagatcatcgaggaagctccagctccaaatgtgccagctgagtttcggtctcatattggtggagctgctgtatctgcagcaaaggcagttggttactacaatgctggaacagtggagtttattgtggacactctttctggagagttctacttcatggagatgaatactcgactccaggttgaacacccagtgacagagatgattgttggtcaagatcttgtggagtggcaaatacgtgttgcgaatggagaacgactaccattatctcaggagcaggttccattaaatggacatgcatttgaagcacggatatatgctgaaaatgttccaagagggtttctccctgcaacaggaaccttacatcactaccgaccagtcccttctgacccaactgtaagagttgaaactggagtcgaagaaggagataccgtcagcatgcattatgatccaatgatagccaaacttgtagtatggggtgaaagtcgcacggctgcactagtcaagctaaagaagtgtttatcaacctttcagattgcaggtttgccaaccaatgttgatttcctccaagaactcgcaagccacagtgcctttgaaaaaggcctagttgacactcacttcattgaacgttataaagatgaccttttgagtatttctacaaagtcctcaaaagaatctcatggtgtagctgagcttggtgcaattttggctgctgcatgcatttgcaagaaggaacacattacatctaaagaatcactacgagccaacaagtcactatctgtatggtacaataatccacctttcaggatgcatcactttgctaggcatcccctggatcttgagttggaagagaatgatggattcagtgagaaacttcttaaactgttcattactcataagtttgatggaagctacttcatcgagacagaagatggcacttctggtttagatgtcaaagttgatcacaagggtgaccacgattttcgtgtggatgtttctggtctgcaaactgatgtgactctagcatcttattcaaagggaaacagcaaacacatacatgtctggcatgggaatcatcaccaccattacagacagactgtaagagctgagcatgcagttgaagatagctcccaacctagtcatgcttctgaagggaagtcgcatccaaaagggagtgttctggcaccgatggctggcttggttgtgaaagttttgcttgaagacggggctcaggtggacgcagggcagcctgtcatggttatggaagcaatgaagatggagcatgttgtgaaggcgcctcgtgccggatacgtgagtggcctgaaggttactgcaggccaacaagtttttgactccagtgtccttttcacaatcaaggacagctctgcaaactgagatggagcgatcactgccctagagtagttgcactgcaactgcatcaagcacccagcggatgctcgtccagatagagaagcgaaggaaataaactgctgggttcgtctgcgggcaatccaatccggcagggcaagcagacggcgcatggtgtttcccggcttgatgcgaatccatcatccgccgcaacaattccattgcgtagtgtacacgaacatgaaactgtaccacgctgagcaagaggaattcttgtttgatttgtgcaatgaaataagttgattccatcacc

SEQ ID NO: 8704 - DNA, 3091 bp, Sorghum bicolor
ggagagacgtcgcggactcgtctgaccagtcaccgcccttatcctgcgctgcgggaccaatcagccccacaccacactgacgacgcccatgctgctctgctcatcatctcctatttccccgacccgtcgccgcgccactcctccgccttgctcaccaccactgctgctctcccaagcctccagcccaaccaccgccaccgccaccgcgtgatggcctcccgcctcctccacctccacctgcgccgcgggcgcgtgcgcgtgcgcggcgggagcccggcgggcagccccgtgcccgcgcccgcgcccgcgcggctcctctcctcctcgcctcctccaaccgcgtcctcggcctcggcgggcggtggcgggggcatcgagaaggtgctggtggcgagccggggcgagatcgcgtgccgggtcatgcgcaccgcgcgccgcctcggggtcgccaccgtcgccgtgtacagcgacgccgaccgcggcgcgctgcacgtgcgcgccgccgacgaggccgtcaggatcggcccgccccccgcgcgccagagctacctcaacgccggggccatcatcgacgccgcactccgcaccggcgcacaggctatccatccaggatacggttttctctcagagagtgctgattttgcgcagctctgtgagaccgaggggctcaaattcattggaccaccagcatctgcgatcagagatatgggcgataagagtgcatccaagaggatcatgggtgctgctggcgtgccgctggttccaggataccatggggctgaccaagacattgagctgctgaaacttgaagctgataaaattggttatcctgttttaatcaagcccacccatggtggagggggcaaggggatgagaatagtcgaaaggcctgatgaatttgtggatgctgtactgagcgctcaacgggaagctgcagcatcatttggtgtaaacacactactgattgagaagtacattactcaaccaagacacgtagaagtccaggtatttggcgaccaacatggaaatgcaatatatctctatgagagagactgcagtctacaaagaaggcatcagaagattattgaggaagctccagctccaaatgtgacagctgagtttcggtctcatattggtggagctgctgtatctgccgcaaaggcagttggttactacaatgctggaacagtggagtttattgtggatactctttctggagagttttatttcatggagatgaatactcgactccaggttgaacacccagtgacagagatgattgttggtcaagatcttgtggagtggcaaatacgtgttgcaaatggagaacgactgccattatctcaggagcagattccattaaatggacatgcatttgaagcacggatatatgctgaaaatgttccaagagggtttctccctgcaacaggaaccttacatcactaccgaccagtcccttctgatccaacagtaagagttgaaactggagtcgaagaaggagatacagtcagcatgcattatgatccaatgatagccaaacttgtagtatggggtgaaagtcgcactgctgcactagtcaagctaaagaactgtttatcaaactttcagattgcaggtttgccaaccaatattggtttcctccaagaactcgcaagccatagtgcctttgaaaaaggcctagttgacactcacttcattgaacgttataaagatgatcttttgagtatttctacgaagtcctcagaagaatctcatggtgtagctgtgcttggtgcaattttggctgctgcatgcatttgcaagaaggatcacattacatttaaagaatcacaacgagccaacaacacactatctgtatggtacaataatccacctttcaggatgcatcactttgctaggcatcccctggatcttgagttggaagagaatgatggattcagtgagaaacttcttaaactgttcattactcataaatctgatggaagctacttcatcgagacagaagatggcacttctggtttagatgtcaaagttgatcacaagggtgaccatgattttcgtgtcgatgtttctggtctgcaaactgatgtgactctagcatcttattcgaagggcaacagcaaacatatacatgtctggcatgggaagcatcatcaccattacagacagactgtaagagctgagcatgcagttgatgatagctcccaaccttgtcatgcttctgaagggaagtcacatccaaaagggagtgttctggcaccaatggctggcttggttgtgaaagttttgcttgaagatggggcacaggtggaggcagggcagcctgtcatggttatggaagcaatgaagatggagcatgttgtcaaagcacctcgtgccggatatgtagatggcctgaaggttactgctggccaacaagtttttgactccagtgtccttttcacaatcaaggacaatattgcaaactgagatggagcgatcacatccgaagtaactgcactgcaactgtattcaaacactcaacggatgcttcaggggttggccaacgacgctgctgctgtccagatagagaaccgaaggaaataaacagctgggttcgtctgcgggcaatccggcaatgcaagcagacggctcatggtgttcccagcttgatgcgaattcatccatcattcgccacaacgattccattgcatagtgtacacgaacatgaaactgtaccacgttgagcaaagaaataagcagatggaatcagatttgtcatttgtgtacctttgctgaataagtgatgggaagctgggaaccttcactgtgaaggatcagtcacctgaacgaggcgctggtttgccatttgacgcaacaccaggtcgtcacacagcccctgcggcagccgtacaaacgtggccaaagaatatgatatgcgtgtatgtttgcacaccgtctgaacgctatacgatggtaaaccgtttgcgtttaatgggttattctgtctgtttaaacagccggtttgcccgtttaaacggacatgataacacctgtgttcatggacttgggttcacaaagaatggattccaggtcagaaaacgaccaggtt

SEQ ID NO: 8705 - DNA, 2908 bp, Sorghum bicolor
acactgacgacgcccatgctgctctgctcatcatctcctatttccccgacccgtcgccgcgccactcctccgccttgctcaccaccactgctgctctcccaagcctccagcccaaccaccgccaccgcgtgatggcctcccgcctcctccacctccacctgcgccgcgggcgcgtgcgcgtgcgcggcgggagcccggcgggcagccccgtgcccgcgcccgcgcccgcgcggcccctctcctcctcgcctcctccaaccgcgtcctcggcctcggcgggcggtggcgggggcatcgagaaggtgctggtggcgaaccggggcgagatcgcgtgccgggtcatgcgcaccgcgcgccgcctcggggtcgccaccgtcgccgtgtacagcgacgccgaccgcggcgcgctgcacgtgcgcgccgccgacgaggccgtcaggatcggcccgccccccgcgcgccagagctacctcaacgccggggccatcatcgacgccgcactccgcaccggcgcacaggctatccatccaggatacggttttctctcagagagtgctgattttgcgcagctctgtgagaccgaggggctcaaattcattggaccaccagcatctgcgatcagagatatgggcgataagagtgcatccaagaggatcatgggtgctgctggcgtgccgctggttccaggataccatggggctgaccaagacattgagctgctgaaacttgaagctgataaaattggttatcctgttttaatcaagcccacccatggtggagggggcaaggggatgagaatagtcgaaaggcctgatgaatttgtggatgctgtactgagcgctcaacgggaagctgcagcatcatttggtgtaaacacactactgattgagaagtacattactcaaccaagacacgtagaagtccaggtatttggcgaccaacatggaaatgcaatatatctctatgagagagactgcagtctacaaagaaggcatcagaagattattgaggaagctccagctccaaatgtgacagctgagtttcggtctcatattggtggagctgctgtatctgccgcaaaggcagttggttactacaatgctggaacagtggagtttattgtggatactctttctggagagttttatttcatggagatgaatactcgactccaggttgaacacccagtgacagagatgattgttggtcaagatcttgtggagtggcaaatacgtgttgcaaatggagaacgactgccattatctcaggagcagattccattaaatggacatgcatttgaagcacggatatatgctgaaaatgttccaagagggtttctccctgcaacaggaaccttacatcactaccgaccagtcccttctgatccaacagtaagagttgaaactggagtcgaagaaggagatacagtcagcatgcattatgatccaatgatagccaaacttgtagtatggggtgaaagtcgcactgctgcactagtcaagctaaagaactgtttatcaaactttcagattgcaggtttgccaaccaatattggtttcctccaagaactcgcaagccatagtgcctttgaaaaaggcctagttgacactcacttcattgaacgttataaagatgatcttttgagtatttctacgaagtcctcagaagaatctcatggtgtagctgtgcttggtgcaattttggctgctgcatgcatttgcaagaaggatcacattacatttaaagaatcacaacgagccaacaacacactatctgtatggtacaataatccacctttcaggatgcatcactttgctaggcatcccctggatcttgagttggaagagaatgatggattcagtgagaaacttcttaaactgttcattactcataaatctgatggaagctacttcatcgagacagaagatggcacttctggtttagatgtcaaagttgatcacaagggtgaccatgattttcgtgtcgatgtttctggtctgcaaactgatgtgactctagcatcttattcgaagggcaacagcaaacatatacatgtctggcatgggaagcatcatcaccattacagacagactgtaagagctgagcatgcagttgatgatagctcccaaccttgtcatgcttctgaagggaagtcacatccaaaagggagtgttctggcaccaatggctggcttggttgtgaaagttttgcttgaagatggggcacaggtggaggcagggcagcctgtcatggttatggaagcaatgaagatggagcatgttgtcaaagcacctcgtgccggatatgtagatggcctgaaggttactgctggccaacaagtttttgactccagtgtccttttcacaatcaaggacaatattgcaaactgagatggagcgatcacatccgaagtaactgcactgcaactgtattcaaacactcaacggatgcttcaggggttggccaacgacgctgctgctgtccagatagagaaccgaaggaaataaacagctgggttcgtctgcgggcaatccggcaatgcaagcagacggctcatggtgttcccagcttgatgcgaattcatccatcattcgccacaacgattccattgcatagtgtacacgaacatgaaactgtaccacgttgagcaaagaaataagcagatggaatcagatttgtgtacctttgctgaataagtgaatagggaagctgggaaccttcactgtgaaggatcagtcacctgaacgaggcgctggtttgccatttgacgcaacaccaggtcgtcacacagcccctgcggcagccgtacaaacgtggccaaagaatatgatatgcgtgtatgtttgcacaccgtctgaacgctatacgatggtaaaccgtttgcgtttaatgggttattctgtctgtt

SEQ ID NO: 8706 - DNA, 3533 bp, Panicum virgatum
cggcgccctcactcccgaaaagcgaaaaccatatccacgccgcgtgggcccgaggccaatccacatccgccacgtgccatatccgggataccctcctcgtccccgtggcccgtgcctctcctctcctccctccctccacaacggcacagcagcagcggccaactcgtccgcttgtctctcctcctcgccgccgcccccggccccctctcctcctccgaccacccaccgcgcgtgcaattcgaagcaggagagccgcgctgggagagtgggcagcgagcgggagcccgaggaggggcaagcgcaatgtggctctcgggtgcggcgatctccgcgccgctcggctgccgcgggctgcggcgcggcgcggtcggcggaggcggcaaggcgcggagggcggaggcggagaggtggcggcgggcgggcgcgggccggcgctcgggcggcgcgaaggtgaggtgcgtggcgaccgagaagcacgacgagacgacggcggcggcggcggtcggcgtggagttcgcggacgaggaggactaccgcaagggcggaggcggcgagattctctacgtgcaaatgcaggccaccaagcccatggaaagccagtccaagatcgcctccaagctgctgcccatatctgatgaaaattcagtactcgatttggttatcattggctgtggtcctgctggtctttctctagcttcagagtcagccaagaaagggctcactgttggtcttattggccctgaccttccattcacgaacaactatggtgtgtgggaggatgaattcaaagatcttggtctagagagctgtatcgagcatgtctggaaggatactattgtctacctagacaataacaaaccaatactgattggccgttcttatggcagggtgcaccgtgacctgctccatgaggagttgttgagaagatgctatgaagctggcgttacatacctcaactcaaaagtggacaagatcattgaatctccagatggtcatagagtagtctgttgtgaaaggggccgtgagatactctgcaggcttgccattgttgcttcaggggcagcatctggtaggcttctggagtatgaggttggaggtccccgtgtctgtgtacagactgcatatggagtagaagttgaggtggaaaacaatccatatgatcccagcttaatggttttcatggactacagagattgtttccaagagaaattctcacactctgaacaagaaaatccaactttcctgtatgctatgcctatgtcgtccacacgagttttctttgaggaaacatgtttagcctctaaagatgcgatgccctttgatgtacttaagaagagattaatgtatcggttggatgcgatgggagttcgaatcctgaaagttcacgaggaggaatggtcctacattcctgttggagggtccttacctaatacagatcagaaaaatcttgcatttggtgctgcagcaagtatggtgcatcctgcaactggctactcagtggtcagatctttatctgaggctccaagatatgcctctttaatatccgatatcttaaggaaccgagttcctgcacaatatttggcaggaagttctcaaaattacagtccatcaatgctcgcatggagaacactatggcctcaagaaagaaaacgtcagcgatccttcttccttttcgggttggcattgataatccaactgaataatgaaggcatacaaacattcttcgaagcctttttcagggtgccaaaatggatgtggcaagggttcttgggctcaaccctttcatcggtggatctaatactgttttcattctacatgttcgccatagctccgaatcaattgcgaatgaacctggtcagacatctcctctctgacccgacaggctcaacaatgataaagacctacctgaccttgtaaaaccatgtcaccagtctgcaagaagtctagaaactgtacggttttgtagttgtacataacctagagggaatctgagggttacttttctttttgctgtttgacagcgggtgggcctcggggtcactgctcattggcatgatagagtacacttgttaactttttgtttgctatagtgatggcctgatgggatagggaagcacatgttgtcgtgcatgctggacgaataagtagagggatcaactggtggtcatggtcctgcattatattggccatttttaggtctccggctcttgtgtttgtttccatccctgtctttgctgtttcaaggcatttttacatgcccatcaattacacccttattttagctaggttgctcaatgccaagtcaaaatgttcctttttcgaacaatatttgcaaatgaggaaaggagaaaaaaaggtgtgcaagattagtatgaggctgtccttgctcctgccgccatggcccatggcatttagcttcaagatgtagaggagggattggagaaggcctgtgcaggacacaaaggttggaggcaagggagagaggggaaggaagggcaggaggagaggcggaacaacccgtctccctccacctctctgccttcttctcccgcgccccctatcctctcgcactgatcggccagtcaccggcgtccatctcggctggtgtggccgcgcgcggcggctagtcgcaatcatcaccgggcggtggcgcgatgcagggaggccctctgagcccggacgagtaccgggccgcgtcgccgccgccgccgctgccgcaccaggcggcgcccaccatcgtcgtggccatcgaccgcgacaggaacagccagctgggcgccaagtgggtcgtggaccacctcctctccagcgcctcccacatcatcctcctccacgtcgccgccccccaccacccctccaaccgtacgtcgtcccccgccgtagccgccatcgccagcgcacgcgcaccttcatgtctccctcccttaatgcagcggcggtggcggctgagctgtggtttcgttgatgatcttcgcagatggatcctccgcggcggagacaacgaatggctcgcttgaggctgagatgaaggagctctttgccccctacagaggactattcagccggaatgcggtgagttttaatttactagagattgcaaaaataccaccaccattgatggaagaatggaatgccatgtgatgcgagtgatcttgtggctgacggcaccatccatggatgttacacagcaggtggatgtgtccgaggtcgtattggaggagccagacgtgtccaaggccattctagcttacatcactgcaaacaagatccagagcatcgcgctcggcggagcatgcagaaatgcattcaccaagtaactactagtagctagaatccttcatttttttttcgtaggtcattttccatcatcattcagattcagcagcgatggactgacgccctgaactgaaacaatgcgtctctctcgggcaggaaattcaagaacgcggacgtgccgtcgaccctgatgaagtgcgcgcccgactactgcaacatctacgtcgtcgccaagggcaggtccgtcaacgtccggc

SEQ ID NO: 8707 - DNA, 2244 bp, Setaria italica
gtgaccaatccacatccgccacgtgccatatccggtatacccctctccccgtgcctctcctctccctccacaacggcacagccgcagcggccacctcctctgctctgctagtcttcgccgccgcctccgaccaaccgccgcggaattcgaagcaagacagcggcgccgggagaggaggttgtgggtgagagccggaggaggggcggcgcaatggggctctcgggcgcggcgatctccgcgccgctcggctgccgcgggctgccgcacggggcggtcggcggaggcagcaaggtgcggagggcggaggtggagaggtggcggcggcgggagggcgcgggccggcgcgtggccggaccgaaggtgaggtgcgtggcgaccgagaagcacgatgagacggcggcggtcggggcggcggcggcgggcgtggagttcgcggacgaggaggactaccgcaaggggggcggcggcgagctgctctacgtgcaaatgcaggccaccaagcccatggaaagccagtccaagatcgcctccaagctgctgcccatatccaatgaaaattcagtacttgatctggttatcattggctgtggtcctgccggtctttctctagcttcagagtcagccaagaaaggcctcactgttggtcttattggccctgaccttccgttcacgaataactatggtgtgtgggaggatgaattcaaagatcttggtctagagagctgtattgagcatgtctggaaggataccattgtctatctagacaataatgaaccaatactgattggccgtccatatggcagggtgcaccgtgacctgctgcatgaggagttgctgagaagatgctatgaagctggcgttacatacctcaactcgaaagtggacaagatcatcgaatctccagatggtcatagagtagtctgttgtgaaaggggccgtgagatactctgtaggcttgcgattgttgcttcgggggcagcatctggtcggcttttagaatacgaggttggaggtccccgtgtctgtgtgcagactgcatatggagtagaagttgaggtggaaaacaatccatatgatcccagcttaatggttttcatggactacagagattgtttcaaagagaaattctcgcattctgaacaagaaaatccaactttcctgtatgctatgcctatgtcatccacacgagttttctttgaggaaacatgcttagcctctaaagatgcgatgccctttgatgtacttaagaaaaggttgatgtatcggttggatgcaatgggagttcggatcctgaaagttcatgaggaggaatggtcctacattcctgttggaggttccttaccaaatacagatcagaaaaatcttgcatttggtgctgcagcaagtatggtgcaccctgcaactggctactcagtggtcagatctttgtctgaggctccaagatatgcctctgtaatatcagatatcttaaggaaccgagttcctgcgcaatatttgccaggaagttctcaaaattacagtccatcaatgcttgcttggagaacactatggcctcaagaaaggaaacggcaacgctcatttttccttttcggattggcattgatcatccaactgaataatgaaggcatacaaacattcttcgaagcctttttcagggtgccgaaatggatgtggcgagggttcttgggctcaaccctttcatcggtagatctaatactattttcattctacatgtttgcgatagctccgaatcaattgcgaatgaacctcgtcagacatctactctctgatccgaccggctcaacaatgatcaagacctacctgaccttgtaaaaccaagtcaccagtctgcaagaactctagaaactgtacagttttgtagttgtatataacttagaggggatctgaggggttacttttctttttgccgtttgacggcgggtctcggtgtcactggcatgatatagaatacgcttgaaactgtttatgtttgctatggtgatgggatagggaagcacatggtgttgtcatgctggaagaacacaagtagaaagatcaactgatggtcatggttcctggattggccattttttggccttctgtctcttgtatttgtttccatccctgtctttgctatttcaaggctttttacatgcatgcccaatcaattacacccttattttaggttgctcaattccaagccaaaatgtttttcttttccaacaatatttgcacaaagagaaa

SEQ ID NO: 8708 - DNA, 2099 bp, Setaria italica
aacggcacagccgcagcggccacctcctctgctctgctagtcttcgccgccgcctccgaccaaccgccgcggaattcgaagcaagacagcggcgccgggagaggaggttgtgggtgagagccggaggaggggcggcgcaatggggctctcgggcgcggcgatctccgcgccgctcggctgccgcgggctgccgcacggggcggtcggcggaggcagcaaggtgcggagggcggaggtggagaggtggcggcggcgggagggcgcgggccggcgcgtggccggaccgaaggtgaggtgcgtggcgaccgagaagcacgatgagacggcggcggtcggggcggcggcggcgggcgtggagttcgcggacgaggaggactaccgcaaggggggcggcggcgagctgctctacgtgcaaatgcaggccaccaagcccatggaaagccagtccaagatcgcctccaagctgctgcccatatccaatgaaaattcagtacttgatctggttatcattggctgtggtcctgccggtctttctctagcttcagagtcagccaagaaaggcctcactgttggtcttattggccctgaccttccgttcacgaataactatggtgtgtgggaggatgaattcaaagatcttggtctagagagctgtattgagcatgtctggaaggataccattgtctatctagacaataatgaaccaatactgattggccgtccatatggcagggtgcaccgtgacctgctgcatgaggagttgctgagaagatgctatgaagctggcgttacatacctcaactcgaaagtggacaagatcatcgaatctccagatggtcatagagtagtctgttgtgaaaggggccgtgagatactctgtaggcttgcgattgttgcttcgggggcagcatctggtcggcttttagaatacgaggttggaggtccccgtgtctgtgtgcagactgcatatggagtagaagttgaggtggaaaacaatccatatgatcccagcttaatggttttcatggactacagagattgtttcaaagagaaattctcgcattctgaacaagaaaatccaactttcctgtatgctatgcctatgtcatccacacgagttttctttgaggaaacatgcttagcctctaaagatgcgatgccctttgatgtacttaagaaaaggttgatgtatcggttggatgcaatgggagttcggatcctgaaagttcatgaggaggaatggtcctacattcctgttggaggttccttaccaaatacagatcagaaaaatcttgcatttggtgctgcagcaagtatggtgcaccctgcaactggctactcagtggtcagatctttgtctgaggctccaagatatgcctctgtaatatcagatatcttaaggaaccgagttcctgcgcaatatttgccaggaagttctcaaaattacagtccatcaatgcttgcttggagaacactatggcctcaagaaaggaaacggcaacgctcatttttccttttcggattggcattgatcatccaactgaataatgaaggcatacaaacattcttcgaagcctttttcagggtgccgaaatggatgtggcgagggttcttgggctcaaccctttcatcggtagatctaatactattttcattctacatgtttgcgatagctccgaatcaattgcgaatgaacctcgtcagacatctactctctgatccgaccggctcaacaatgatcaagacctacctgaccttgtaaaaccaagtcaccagtctgcaagaactctagaaactgtacagttttgtagttgtatataacttagaggggatctgaggggttacttttctttttgccgtttgacggcgggtctcggtgtcactggcatgatatagaatacgcttgaaactgtttatgtttgctatggtgatgggatagggaagcacatggtgttgtcatgctggaagaacacaagtagaaagatcaactgatggtcatggttcctggattggccattttttggccttctgtctcttgtatttgtttccatccctgtctttgctatttcaaggctttttacatgcatgcccaatcaatt

SEQ ID NO: 8709 - DNA, 5125 bp, Oryza sativa
gtgccccttcccggataccgcctccctccaaacccgctccctctccctctccctcctcctacaatggccgcagcagcagcagccagcagcagacgcagagaccagtagctttcgcagaggcggcagccaccaccgcctcctcctcctcctcctcatccgacggtgtgcaaccaagcgatggagttctccggcggcgcgaccgtgtcggcgccgttcggttgctgccgtgcggcgtggggcgccgcggcggcgggtgcgggggcggagggaaggagcaggagggttgtgccgcgcgcggtggagccgcggcggcgcgggcggtggatggtgaggtgcgtggcgacggagaagcacaaggacgcggcggcgcggcgcggcggcgtggaggtggagttcgccgacgaggaggactacgtcaagggcggcggcggcgagcttctctacgtgcaaatgcaggcgtccaagtccatggacagccagtccaagatctcctccaagctgctgcccatacccgatgaaaattcagttcttgatttggtcatcattggctgcggtccagctggcttatccctagcagcagagtcagctaagaaagggctcaatgttggtctcattggccctgatcttccattcacgaacaactacggtgtgtgggaggatgaattcaaagacctgggcctggagagctgcattgaacatgtctggaaggatactatcgtgtacctagacggtaacaagccaataatgattggccgtgcgtatggcagggttcacagggacttgctgcacgaggagttgctgagacgatgctatgacgctggcgtcacatacctcagctcgaaggtggacaagatcatggaatctcctgatggacatcgggtagtctgttgtgaaggggatcgtgaggtactttgcaggcttgccattgttgcatctggggcagcatctggtaggcttctagagtacgaggttggtggtccgcgtgtttgtgtgcagactgcatatggtgtcgaagtcgaggtggaaaacaatccatatgatcccagcttaatggttttcatggactacagagattgcttcaaagacaaattctcacatcctgagcaaggaaatccaacgttcctctatgccatgcccatgtcatccacacgaattttctttgaggaaacatgcctagcttctaaagaagcaatgccctttgacctccttaaaaagcggttgatgtctcggttggatgcaatgggagttcatattcgaaaagtatacgaggaggaatggtcctacattcctgttggagggtccttaccaaatacagaccagaaaaatctcgcatttggtgcggcagcaagtatggtgcatcctgcaaccggatactcggtggttagatcattgtctgaagctccaagatatgcatctgtgatatctgatatcttgagaaaccgtgtctaccctggagaatatttgcctggaacctctcaaagttccagtccatcaatgcttgcatggagaacattatggccccaagaacggaaacgtcaacgatcattcttcctttttgggctggctttgataatccaactgaataacgaaggcattcagacattctttgaaacctttttccggttgcccaaatggatgtggcgaggattccttggttcgacgctttcttcagtggatctcatactctttgcattctacatgttcacaattgcgccgaaccaaatgcgaatgaaccttgtcagacatctcctctctgatccgaccggctcaacgatgatcaagacctacctgaccttgtaaaaccatttcagcagtctacaagaatattaggaaatgtacagttttgtagtttgtacataacatagtgagagccagaggatatgggggttggggggttacttatcatgctagaacaacaaaacactgcaagaattttatgcatgaatttggcaaatggaatagattatgcagaatgggaacacgtgaatacgtgatgcgtgtgctggaacaacaagtaggaggaataaaacccatggattatggatcttgtagtgagttgcattatagccattcttaggtcttatcatctctctcccctttccatttttacctctatccggttttcgacatgccggattacacaccctattttagatagctcggccaaaatgttccacaaacattttagaaaaggaacaaaatggaaaagaggagagaaaaaaaagagatggtgcaagaatagtctgaggctatccttgctccattgccatggcatttaggtcccagaagaaggggggagggaggaggaggccattgcagagtttgagaggaaggttggaggcaaggaagagagacagaggagaaggaagagcaggaggggagggaaaaggaaaaccctttctctctctctctctcagcctctctctccctctctcttcttctccttccttgcaccaccgtcctactcaccgtcgcatcatccactgatccggccggcgatatcacctccatccatccatcacattacggtcggcgtcggcggcggcgacgacgaaggcgggtgagatctcaccggagaagtgcaggcgggcaggatgcaaggaggagggccactcagccccgacgagcaccgggccacctcgccgccggggataatgcaccaccagccggcgatgacgatcgtcgtcgccgtggaccgtgaccggaacagccagctcgccgtgaagtgggtcgtcgaccacctcctcaccggcgcctccaacatcatcctcctccacatcgccgtccacccccctgccgccaaccatggattcgccatggccgaggcgacgcatggcgcgttggaggccgagatgagggagatctttgtccccttcagaggattctgcaccaggaatggggtgcatgtatcggagttggtactggaagaggcagacgtgtcaaaggccttaatagagttcatcaccgtgaacaagatccagagcatcgcgctcggcgcatccaacagaaatgcattcaccaagaaattcaagaacgccgacgtgccgtccagcctgatgaagggcgcgccggactactgcaacatctacgtggtggcgaagggcaagtcggtgaacgtgaggctcgccaagtgcggcgtcgatggcggttgcggcggtggcggtggctacgagggcgactcatcgatcaggagcctgtacacgaggaggtgctcgagggggaagctgccgccggcgacgccgtcgccggactcgtcgaggcggtcggtggacagtcgcaccctgccggagctcaccacgcggccgccgttccgcgagcgctcgctcccgtcctcgtcgtccaagcccgtcgtgctgtccagcagggcggcgcccgactgcggcggcggcggcgtcgacgggtcgtaccgctccacgaggcggtccgtgtcgaacgagtccttcgtgggcgacctcgacttcggccagagctcgcgcttctcctccatggacttctgcgacagcctcgacatgtcgtcgctctccgccagcccacgggagagcagctcgcctctctccgccccgcagcgcgaggtggaggtggagatgcggcggctgaggctggagctgaagcagacgatggacatgtacaacgcggcgtgccgggaggcgatcaacgcgaagcagcggaccaaggagctgcagctgctgaagctggaggaggcgcggcggctggaggaggcgcggcacgcggaggaggcggcgctggcgatggcggagatggagaagaccaagtgccgcgcggccatggaggcggccgaggcggcgcagcgactggccgacctggaggcccagcggcgtcgcaacgccgaggtgcgcgcccgccgcgaggccgacgagaaggtccgcgccctggacgccatctccagccacgacttccgctaccgccgctacaacatcgacgacatcgagctcgccaccgagcgcttctccgacgagctcaagatcggcgagggcggctacggccccgtctaccgcgcctccctcgaccacaccccggtggccatcaaggtgctccgccccgacgcgcagcagggccggaagcagttccagcaggaggtggaggtgctcagctgcatccgccacccaaacatggtgctcctcctcggcgcctgcccggactacggctgcctcgtctacgagtacatggacaacggcagcctcgaggaccgcctgttccgccgcggcggcacgccgccgatcccgtggagccagcggttcaggatctcggcggagatcgccaccgcgctgctgttcctccaccagaccaagccggagccgctggtgcaccgcgacctgaagccggccaacatcctgctcgaccgcaactacgtcagcaagatcagcgacgtcgggctggcgcgcctcgtgccgccggcggtggcggacagcgtgacgcagtaccggctgacggcgacggcggggaccttctgctacatcgacccggagtaccagcagacggggaagctgggcgtcaagtccgacatctactccctcggcgtgctgctgctgcaggtgctcaccgcgcggccgcccatgggcctcacccaccacgtcgagaaggccatcgacgccggcaccttcgcccagatgctcgacgtcaccgtcaaggactggcccgtcgacgacgccatcggcttcgccaagctcgccctcaagtgcaccgaaatgcgccggagggaccgcccggacctcgccaccgtcatcctgccggagctcaaccgcctcaggaacctcggacacgcctacgaggcgcgcatgagcgccgccgccgccgacgccgccgcgcacgcccaggacaacgtcggctcgccgacggtggtgggcgcgtcgtggagaacggcggagagctaagctagcgggaggccgtgtcagttattttagagtcacaggagagggtggagttcacacggtacatttacggtctttttttgtcggtgtaaatccttaaataccttggtgtttgtacagttgacaaaaaaaattaacatgttctgcggtggttggctcaaaattttgaggtgtccgaatgattcttttttcctggttatacagcagaaagattaaaaaaaaattacggtaatgac

SEQ ID NO: 8710 - DNA, 1973 bp, Oryza sativa
cagcagccagcagcagacgcagagaccagtagctttcgcagaggcggcagccaccaccgcctcctcctcctcctcctcatccgacggtgtgcaaccaagcgatggagttctccggcggcgcgaccgtgtcggcgccgttcggttgctgccgtgcggcgtggggcgccgcggcggcgggtgcgggggcggagggaaggagcaggagggttgtgccgcgcgcggtggagccgcggcggcgcgggcggtggatggtgaggtgcgtggcgacggagaagcacaaggacgcggcggcgcggcgcggcggcgtggaggtggagttcgccgacgaggaggactacgtcaagggcggcggcggcgagcttctctacgtgcaaatgcaggcgtccaagtccatggacagccagtccaagatctcctccaagctgctgcccatacccgatgaaaattcagttcttgatttggtcatcattggctgcggtccagctggcttatccctagcagcagagtcagctaagaaagggctcaatgttggtctcattggccctgatcttccattcacgaacaactacggtgtgtgggaggatgaattcaaagacctgggcctggagagctgcattgaacatgtctggaaggatactatcgtgtacctagacggtaacaagccaataatgattggccgtgcgtatggcagggttcacagggacttgctgcacgaggagttgctgagacgatgctatgacgctggcgtcacatacctcagctcgaaggtggacaagatcatggaatctcctgatggacatcgggtagtctgttgtgaaggtgatcgtgaggtactttgcaggcttgccattgttgcatctggggcagcatctggtaggcttctagagtacgaggttggtggtccgcgtgtttgtgtgcagactgcatatggtgtcgaagtcgaggtggaaaacaatccatatgatcccagcttaatggttttcatggactacagagattgcttcaaagacaaattctcacatcctgagcaaggaaatccaacgttcctctatgccatgcccatgtcatccacacgaattttctttgaggaaacatgcctagcttcaaaagaagcaatgccctttgacctccttaagaagcggttgatgtctcggttggatgcaatgggagttcatattcgaaaagtatacgaggaggaatggtcctacattcctgttggagggtccttaccaaatacagaccagaaaaatctcgcatttggtgcggcagcaagtatggtgcatcctgcaaccggatactcagtggttagatcattgtctgaagctccaagatatgcatctgtgatatctgacatcttgagaaaccgtgtctaccctggacaatatttgcctggaacctctcaaagttccagtccatcaatgcttgcatggagaacattatggccccaagaacggaaacgtcaacgatcattcttcctttttgggctggctttgataatccaactgaataacgaaggcattcagacattctttgaaacctttttccggttgcccaaatggatgtggcgaggattccttggttcgacgctttcttcagtggatctcatactctttgcattctacatgttcacaattgcgccgaaccaaatgcgaatgaaccttgtcagacatctcctctctgatccgaccggctcaacgatgatcaagacctacctgaccttgtaaaaccatttcagcagtctgaaagaatactaggaaatgtacagttttgtagtttgtacataacatagtgagagccagaggatatgggggttggggggttacttatcatgctagaacaacaaaacactgcaagaattttatgcatgaatttggcaaatggaatagattgtgcagaatgggaacacgtgaatacgtgatgcgtgtgctggaacaacaagtaggaggaataaaacccatggattatggatcttg

SEQ ID NO: 8711 - DNA, 1749 bp, Secale cereale
ccggccagccagctcgcaattcccgcaacctgcgccgccgcgggggcaatggagtccaccggcgccgccatctcggcgccgttcggctgccgcgcgttgcgctggcccgggcagcggcctctccgggcggccgatgccaggagaaggcgggtgggtccggagcagtggaggagcttgaaggcgagctgcgtggccacggagaagcccgatgagaaggcggcgccggggctgggggtggatttcgccgacgaggaggactacgtcaagggcggaggcggtgagctgctctacgtgcaaatgcaggccaccaaggccatggaaagacagtccaagatcgcctccaagctgttgcctatagctgatgaaacatcagtgcttgatttggttatcattggctgtggtccagccggcttatctctggctgcagaatcagcaaagaaaggactcactgttggtctcattggccctgatcttccattcacaaacaattacggtgtatgggaggacgaattcaaagatctcggcctggagagctgtattgagcatgtttggaaggatactgtcgtgtaccttgaccgtaacaagccgataatgattggccgagcatatggccgggtggaccgagacttgctgcacgaggagttgctgagaagatgcaatgaagctggtgttacatacctcaactcaaaggttgaacagataatagaatctccagatggacatcgagtagtatattgtggaagggaccgcaagatactttgcaggcttgccattgttgcatctggagcagcatctggtaagcttctagagtatgaggttggaggaccacgtgtctgtgtgcagactgcatacggtgtagaagtcgaggttgaaagatatccgtatgatcccagcttaatggttttcatggactacagagattgtttcaaagagaagttctcacaccctgaggaagccaatccaacatttctttatgccatggccatgtcatccacacgagttttctttgaggaaacatgcttagcttcaaaggatgcaatgccttttgatctccttaagaagaggttgatgtctcggttggatgcgatgggagttcgtatcgtaaaagtatacgaggaggagtggtcctatattcctgttggaggatccttacctaacacagaccagaagaatcttgcatttggtgctgcagcgagtatggtccatcctgcaactggatattcggtggtcagatctttgtctgaagctccaagatatgcttctgtgatatctgatatcttacgaaatcgtgtctattctggacaatatttgcctggaagttctgaaatgtccagtccatcaatgcttgcatggggaacactatggcctcaagaacggaaacgtcagcgctcattcttcctctttggattggccttgataattcaactggataacgaaggcatccaaacattcttcgagacatttttccggttaccgaaatggatgtggcgaggattccttggttcgacgctttcatcagtggatctcatgctgtttgcactctacatgtttgcaattgcgccaaacaatctgcgaatgaacctcgtcagacacctcctctccgacccgactggttcagcaatgatcaggacctacctgaccttgtaaaaccatttgactagtctgcgagaaatctagaaagtgtacagttttgtagttgtacataacatagttagagatgttggaggatgtcaccctccatgtgttgcc

SEQ ID NO: 8712 - DNA, 2142 bp, Brachypodium distachyon
gttccatgtggccgcagctaatcgccgtcggccacgttgcatatcccggataccctctccaaaacctctcctcctccacggaggcagcagcagcagccagcaagccccctcctcctccgctcttccctgggtaggtagtccccgcctcttccccttccttccacctccctcgcaattccgcaaccggcggcacaccgccgccgcttcagggggcaatggagttcacgggcgcgactgtctcggcgccgttcggctgccgagcgttgcgcggcggcgggcagcggccgctgcgggcggccggcctggccgccgatggcaggaggaggcgggcagcggggtcgaagcccggggcgcagcagtggaggaacaacaggaaggtgaggtgcgtggcgacggagaagcacaaggacaacaaggcggcggcggcggggctgggggtggagttcgccgacgaggaggactacgtcaagggcggcggcggcgagctgctctacgtgcaaatgcaggccaccaaagccatggaaagccagtctaagatcgcctcgaagctgtcccccatagctgatgaaacttcagtgcttgatttggttgtcattggctgtggtccggctggcctatctctggctgcagaatcagcaaagaaaggactcactgtcggtctcattggccctgatcttccgttcacaaacaactacggtgtgtgggaggacgaatttaaagatcttggtctggagagctgtatcgagcatgtctggaaggacactattgtttacctagaccataatgagccaataatgattggccgagcgtatggccgggtgcaccgagacttgctacacgaggagttgctgagaagatgtaatgaagctggtgttacataccttaactcaaaggtggacaagataatagaatctccagatggacatcgagtagtatattgtgaaaggggccacaagatactttgcaggcttgccattgttgcatctggagcagcatctggtaagcttctagagtatgaggttggaggtccacgtgtttgcgtgcagactgcatatggtgtagaagtcgaggttgaacaattcccgtatgatcccagcttaatggttttcatggactacagagattgtttcaaagagaatttctcacaccctgaggaagcaaatccgacttttctctatgccatgcccatgtcatccacacgagttttcttcgaggaaacatgcttagcttcaaaagaggcagtgccctttgaacttcttaagaaaaggatgatgtttcggttggatgcaatgggagttcgtatcctaaaagtatatgaggaggaatggtcctatattcctgttggagggtccttacctaacaccgaccagaaaaatcttgcattcggtgcagctgcgagtatggtgcatcctgcaactgggtactcggtggtcagatctttgtctgaagctccaagatatgcttctgtgatatcggatatcttacggaatcgtgtctattctggacaatatttgcctggaagttctcaagactccagtccatcaatgcttgcatggagaacactatggcctccagaacggaaacgtcaacgctcattctttctctttgggttagctttgattatacaactggataatgaaggcatccaaacattctttgaaacctttttccgtttacccaaatggatgtggcgaggattccttggttcaactctttcttcagtggatctcatgctctttgcgctctacatgtttgcaattgcgccaaatactttgcggatgaacctcgttagacacctgctctctgatccaacaggctcggcaatgatcaagacctacctggccttgtgaaaccatttcaagggtccacaggaattctagaaagtgtacagttttgtagttgtacataacatagttagaggagtcaggtgtcactaagcatgttatagcagcaattctcctttgttgacaatgtccatcgggcagatcaatctcgcacaaaggggaacacatatgatgcgtgtcaaaaaacaactagtggagtaaagtgtggatcatggatcatgcacagttgaactggccatttttaggccatgtttctcgcctccaattttactttttcctggtattctgccatgttttt

SEQ ID NO: 8713 - DNA, 2026 bp, Brachypodium distachyon
aagccccctcctcctccgctcttccctgggtaggtagtccccgcctcttccccttccttccacctccctcgcaattccgcaaccggcggcacaccgccgccgcttcagggggcaatggagttcacgggcgcgactgtctcggcgccgttcggctgccgagcgttgcgcggcggcgggcagcggccgctgcgggcggccggcctggccgccgatggcaggaggaggcgggcagcggggtcgaagcccggggcgcagcagtggaggaacaacaggaaggtgaggtgcgtggcgacggagaagcacaaggacaacaaggcggcggcggcggggctgggggtggagttcgccgacgaggaggactacgtcaagggcggcggcggcgagctgctctacgtgcaaatgcaggccaccaaagccatggaaagccagtctaagatcgcctcgaagctgtcccccatagctgatgaaacttcagtgcttgatttggttgtcattggctgtggtccggctggcctatctctggctgcagaatcagcaaagaaaggactcactgtcggtctcattggccctgatcttccgttcacaaacaactacggtgtgtgggaggacgaatttaaagatcttggtctggagagctgtatcgagcatgtctggaaggacactattgtttacctagaccataatgagccaataatgattggccgagcgtatggccgggtgcaccgagacttgctacacgaggagttgctgagaagatgtaatgaagctggtgttacataccttaactcaaaggtggacaagataatagaatctccagatggacatcgagtagtatattgtgaaaggggccacaagatactttgcaggcttgccattgttgcatctggagcagcatctggtaagcttctagagtatgaggttggaggtccacgtgtttgcgtgcagactgcatatggtgtagaagtcgaggttgaacaattcccgtatgatcccagcttaatggttttcatggactacagagattgtttcaaagagaatttctcacaccctgaggaagcaaatccgacttttctctatgccatgcccatgtcatccacacgagttttcttcgaggaaacatgcttagcttcaaaagaggcagtgccctttgaacttcttaagaaaaggatgatgtttcggttggatgcaatgggagttcgtatcctaaaagtatatgaggaggaatggtcctatattcctgttggagggtccttacctaacaccgaccagaaaaatcttgcattcggtgcagctgcgagtatggtgcatcctgcaactgggtactcggtggtcagatctttgtctgaagctccaagatatgcttctgtgatatcggatatcttacggaatcgtgtctattctggacaatatttgcctggaagttctcaagactccagtccatcaatgcttgcatggagaacactatggcctccagaacggaaacgtcaacgctcattctttctctttgggttagctttgattatacaactggataatgaaggcatccaaacattctttgaaacctttttccgtttacccaaatggatgtggcgaggattccttggttcaactctttcttcagtggatctcatgctctttgcgctctacatgtttgcaattgcgccaaatactttgcggatgaacctcgttagacacctgctctctgatccaacaggctcggcaatgatcaagacctacctggccttgtgaaaccatttcaagggtccacaggaattctagaaagtgtacagttttgtagttgtacataacatagttagaggagtcaggtgtcactaagcatgttatagcagcaattctcctttgttgacaatgtccatcgggcagatcaatctcgcacaaaggggaacacatatgatgcgtgtcaaaaaacaactagtggagtaaagtgtggatcatggatcatgcacagttgaactggccatttttaggccatgtttctcgcctccaattttactttttcctggta

SEQ ID NO: 8714 - DNA, 3739 bp, Triticum aestivum
gcgccaccgcgggggcaatggagtccaccggcgctgccatctcggcgccgttcggctgccgcgcgttgcgctgggccgggcagcggcctctccggccggccgatggcaggagaaggcgggtgggtccgggccccgggccggagcagtggaggagcttgaaggcgagctgcgtggccacggagaagcccgacgagaaggcggcgccggggctgggggtagagttcgccgacgaggaggactacgtcaagggcggcggcggtgagctgctctacgtgcaaatgcaggccaccaaggccatggaaagccagtccaagatcgcctccaagctgttgcctatagctgatgaaacttcagtgcttgatttggttatcattggctgtggtccagccggcctatctctggctgcagaatcagcaaagaaaggactcactgttggtctcattggccctgatcttccattcacaaacaattacggtgtatgggaggacgaattcaaagatctcggcctggagagctgtattgagcatgtatggaaggatactgtcgtgtaccttgaccgtaacaagccgataatgattggccgagcatatggccgggtggaccgagacttgctgcacgaggagttgctgagaagatgcaatgaagctggtgttacatacctcaactcaaaggttgaacagataaaagaatctccagatggacatcgagtagtatattgtggaaggggccgcaagatactttgcaggcttgccattgttgcatctggagcagcatctggtaagcttctagagtatgaggttggaggaccacgtgtttgtgtgcagactgcatacggtgtagaagtcgaggttgaaagatatccgtacgatcccagcttaatggttttcatggactacagagattgtttcaaagagaagttcacacaccctgaggaagccaatccaacatttctctatgccatggccatgtcatctacacgagttttctttgaggaaacatgcttagcttcaaaagatgcaatgccttttgatctccttaagaagaggttgatgtctcggttggatgcgatgggagttcgtatcataaaagtatacgaggaggagtggtcttatattcctgttggaggatccttacctaacacagaccagaagaatcttgcatttggtgctgcagcgagtatggtccatcctgcaactggatattcggtggtcagatctttgtctgaagctcctagatatgcttctgtgatatctgatatcttacgaaatcgtgtctattctggacaatatttgcctggaagttctgaaatgtccagtccatcaatgcttgcatggggaacactatggcctcaagaacggaaacgtcagcgctcattcttcctctttggattggccttgataattcaactggataacgaaggcattcaaacattcttcgagagctttttccggttacccaaatggatgtggcgaggattccttggttcgacgctttcgtcagcggatctcatgctgtttgcactctacatgtttgcaattgcgccaaacactttgcgaatgaacctcgtcagacacctcctctcggacccgactggttcggcaatgatcaggacctacctgaccttgtaaaaccatttgatgactagtctgcgagaaatctagaaagtgtacagttttgtagttgtacataacatagttagagatgttgggggatatcacctgccatgtgttgcctctgcctatgcctagtagtggagtaaagcgtggatcttgtatagttgaagttgccatggtttaattttaggtttggtctgggtcaagcttctccgggagccaaaagtgggagcgtgcaagaatagccaaatgtgctggtctaatctggtaccccctcgccccctaggtcatttaacggcggcatgcacggggaggatctttgtaggcaaggaagggagcaggaggaagaggaggagaagggacgcttccgtcgttccctcaacctctctgcctctcctttctctttctcttggtggccgccccttgtaacatttggcatccatccaactaatcggagcatcgccgggatccattcgcagtggaaccgatgatgcagggaagccccctgagccccgaggagcaccggctgaccttgccgccgagcccgcaccagccggtgtcgaccatcgtggttgccatcgaccgggaccgcaacagccaactggccatgaaatgggtggtggaccacctcctctccggcgcctcccatatcattctcctccacgtggcggcccaccctcctgcagccaaccatggatttgccatggctgagacgacgcaggacgcgctggaggctgaaatgatggagatctttgtccccttcagaggattctgctctaggaatggggtgcaagaatcggaggtgatactggaagaggcagacgtccccaaggccatcatagactacatcagtgccaacaagatccagagcatcgcgctgggcgcgtccaacaggaacgcattcaccaagaagtggaagaaccccgacgtgccctcgagcctcatgaagggcgcgcccgactactgcaacatctacgtggtcgccaagggcaagcccgtcaacgtcaggctcgccaagtgcggcgtgccggccgacgacagcgacttcctcctcgccacctactccaggaggagctccaggagccagctgccgccggtcctgcccgactttttgtcctccagcaggcgctccatcgacaggcccgagctcaccacgcgcccgccgttccgcgagcgccccctgcaggcgtccgcgaccaagccccacctcctctcggcaaggatcgacagcaccacgctgcgctccaactcccacgacccatccagcctcgaccccgacttcgcacaggccgtgcatttctcctccatggactttggcgagaacatggacgcgctccccctcagcccccgggagcccggctcgcccctctccgccgcccagcgcgaggtggaggcggagatgaggcggctcaagctggagctgaagcagaccatggacatgtacaacgcagcatgcaaggaggccatcaacgccaagcagagggccaaggagatgcacctgctcaagatggaggaggcgcggcgcctggaggaggcccgccagtcggaggaggccgcattggcgctcgccgagatggagaaggtcaagtgccgggccgccatggaggctgccgaggccgcgcagcgtctggccgacctcgaggcacagcgtcgccgcaacgccgaggtgcgcgcgcgccgggaggccgacgagaaggtgcgcgccctggacgccatcgccaaccacgacttccgctaccgcaagtacagcatcgacgagatcgagattgccaccgagggcttctccgagagtctcaagatcggggaaggcggctacggccccgtctacagcgccagcctcgaccacactccggtcgccatcaaggtgctccgcccggacgcccagcagggccggaagcagttccagcaggaggtggaggtgctcagccgcatccgccaccccaacatggtcttgctcctcggtgcctgcccggagtacggctgcctcgtctacgagtacatggagaacggcagcctcgaggaccgcctgtaccgccgcggcggcacgccgacgctcccgtggagccagcgcttcaggatctcggctgagatcgcgacggctctgctgttccttcaccagaccaagc

SEQ ID NO: 8715 - DNA, 2974 bp, Brassica rapa
gtatatgaaaatgagctagcgcaacacccaaaattatccaaacatcgcactcgtcataataaccatcttatctatatactctgtagtgactactcaccgtcccttacttgtggttaaaatgagacgtgccagtctctcccaagtaccgttactctcacatggaaattgccttcttcccctttactcttttgttttttttttttttgtgtttttttttaaattgtgtactaggattgatgttggagggaatctttcattaatgcgagtgatgtaaccttgaatggttcacaaaatttcttcctttctgtcatctaattatctcctgaatttcttctcataacctctcctttaaatctgatgatgcgtttgagcaacctctcatcactacactgagaaaccaaagtaaaagattcacaagagtgagctacacagagatagtaacgatggatgatcatgaaagccctcttttgtccaaggagccatcatcgtcatcatcatcatccgtggtggcttcctcgtttaaatggattctgaaagttttaatgtccgtgattttcgttgcatggattgttttcctttttgtgtaccctgggaaactcggcgatggaattcttacaaattggagagctgtttcttccaacactctcttcggcaccacaggaagcatgttcttgattttcagtggtccgattcttgttatctccgttttagcttctctctatctgatcatctccggagaagagaaggtgttcgctaagaagaagatatcgaaattcccaaggttcaggctgtggacatttcctgttcttgtggatgggccatttggagttgtttctgcagctgagtttcttgtaattatgatcttctctgtgtttttcctctgggctatctatgcatataccatgagggatcttgaccttcttgatctcttccatgtgcttcccgaggatagaagtatgcttctgttggagataacgggtctgcgtttcgggatgattggactcttgtgtatggtgtttttgtttcttccaatctcgagaggctccattctcctccgtcttgtcgatatccctttcgagcatgctacaaagtatcacgtttggcttggtcatatcaccatggctttcttctcctttcatggcctttgttatgttgttgcgtggaccgttcaaggtcgacttttagagcttttatttgagtggaaagctattggaatcgcagtgttacctggagttatcagtcttgtagcgggtttacttatgtgggttacatcgttacagtacgtgaggaagcattactttgagcttttcttctacacccatcaactctatattgtcttcgttgtcttcttggcgcttcacgtgggtgactacttattcagcatagttgctggaggaattttccttttcattctcgaccgtttcttgaggttctgccaatccagaaggactgtagatgtaatctctgcaaagagttttccctgcgggactctggagctcgtcctttcgaaaccaccgaatatgcgatacaatgcactgagttttgtctttctccaagtaagggaactatcatggctacaatggcatcccttcagtgtttcatcaagccctctagatgggaagcatcatgttgccgttctcataaaggttcttggtggatggactgcaaagcttagggaccagttgtcaaagctatatgaggcagagaaccaagatcagctcctttctcctctgtcatatcccaaaatcacaacttgcgtggagggcccttatggccatgaatctccataccacctggcgtacgagaatctggtcttagtagcaggaggaattgggatttcgccatttttcgccatcttaagtgatatcctacaaagaaaaagagatgggaaagcttgtctaccaaagaaggttttagttatctgggcaatcaaaaactcagacgagctctctctcctctcatcgatcgacattccttccctttgcccttctttctctcagaaaataaaccttgagattaacatctatgtcacaagacaatccgagcctctcttggaagatggaatggttcacaagatggtgaatccttctgtgaagccaaggagcaacgggtgtcccatgtcggtattagttggtacaggggataatatatgggctggactctatctggtatcatccaccatcgggtttgttttaatgatcacattgttggacatcttttacataaacaaattcaacataacggcgtggtggtacaagggacttcttttcgtggtttgtatggttgcaagtgtgttgatttttggaggtcttgttgttgttttctggaatctttggggtgaaaaagccggtgatgtagaaccaaatggccacgacaaggtgactacgaatggagaagaactacataatccatctgcggaacttaaaggccttaacacagaagacgatattcagagtttcatcactactcgttatggcacgagacctgattttaaagagatatttgagtcattgaatgagaaatggggaagtgttgatgttggagttattgtatgcggaccggccagtcttcagtctaccgttgccaaagagatacgttcacatagcatctggcgatccacgaatcatccacttttccacttcaacagccacagcttcgacttgtaactttgctaaaaggctgaagagaattatgtaatcaatctgtggaatgtaaaagaaaaaagtatgcatatgtatgtaatagcagtctgtatgtatgaaggatacagctaggggaatatgtgactttctattttcatgtataattatgcaaatatatgagcttcttatattgtactatatgtgggaagtaaatcatgcaatcaataattttatagaacaaggtgttagctttaggataacagtggcaatttatatgagtacatctttaagatagtttgcccaagttgggtattttgcttcttggacccggg

SEQ ID NO: 8716 - DNA, 2463 bp, Arabidopsis lyrata
cttaatttatctctagtaacgcctccttaaaagccgatgctgcttctgagccaactctcatcacaacactgaaaagtagaaaattcaaagaaaaatggatgatcacgaaagccctcttttgtctaaggagtcaccaccatcatcatcatcagtgttggtttcatctttgaaatggatattgaaagttgtaatgtcggtgatttttgtgacttgggttgtgttccttatgatgtaccctggatcactcggtgatcaagtcctcacaaactggagagcaatctcctccaacactctctttggcatcacaggaagcatgttcttaattttcagtggtccgattcttgtcatcgccgtcttagcttctctctatctgatcatatcaggggaagagagggttttcactaagaagaagatatcgaagttcccgaggtttaggctatggacatttcctgttcttgtggatggaccatttggagttgtttctgcagctgagtttcttggaattatggtcttctctgtttttttcctttgggctatctatgcttataccttgaggaatctcaacgttcttgaatacttccacgtgcttcccaagaacagaagtatttttctgttggagttaacgggtctgcgttttgggatgattggattgttgtgtatggtgtttttgtttcttccaatctcgagaggctccattcttctccgccttatcgatatccctttcgaacatgctacaagatatcatgtttggcttggtcatatcactatggctttcttctccttacatggcctctgttatgttgttggatggactattcaaggtcaacttttagagcttttatttgaatggaaagatactggaatcgctgttttacccggagttatcagtctagtggctggtttactcatgtgggtcacgtcccttcacaccgtgagaaagttttactttgagctcttcttctacacacatcaactatacatcgtctttgttgtgttcttggcacttcatgttggtgactacttgttcagtatagttgctggaggaatattccttttcattctcgaccgcttcttgaggttctgccaatccagaaggactgtagatgtaatctctgcaaagagtttaccctgtggaactctggaactagtcctttcaaaaccaccaaatatgcgatacaatgctcttagctttatctttcttcaagtgagggaactatcttggttacagtggcatcctttcagtgtttcatcaagtcctctagatgggaaccatcatgttgcggttctcataaaggttcttggtggatggaccgcaaagcttagagaccagttgtcaaatctatatgaggcagagaatcaagaccagcttatttctcctgattcatatcccaaaatcacaacttgtgtggaagggccttatggccatgaatctccataccacttagcgtacgagaacctggttttagtagcaggaggaatcggtattacaccttttttcgccatcttaagtgatatcctacaccgtaaaagagatgggaaagcttgtttgcctagtaaggttttagttgtgtgggccattaaaaactcagacgagctctctctactctcagcaatcgacgtaccttccatttgccctttcttctctaagaaactaagccttgagattcacatatatgttactcgacaatccgagcctcgcttggaagatgggatggttcagatggtggtgcatccttctgtcaaaccaccacggaccaacggatgttccatgtcggttctagttggtacaggggacaatatatggtctggactctatctaattgtctccaccattgggtttattgcaatgatcacatttttggacgtcttttacataaacaaatacaacataacgacgtggtggtacaaaggacttctatttattgtttgtatggttgcaagtgtgttgatttttggtggccttgtagttgttttctggcatcgttggggtcacaaaaccggtaaagtggaagcaaatggcaatgacaaggtatatttgaacggagaagaaacccataatccatatgcagcagagctcaagggcttggacatagaagaagatgtccagagttacaccactatccgttatggcaccagaccggcctttagagagatatttgagtcattgaatgggaaatggggaagtgtggatgttggagtaatagtatgcggtccagcgactcttcaaacgaccgtagccaaagagatacgatcacatagcatctggcgatcagcgaatcatcctcttttccacttcaacagccacagtttcgatctataactatcctttcaaggccaaagaacataatggaaattcgaaaaaatattgatgcatatattttaggtaatcacagtctgtatgtattatggaaacaactatatcttgtaatgtattcatctaaattcagttttttaatttataaa

SEQ ID NO: 8717 - DNA, 2266 bp, Arabidopsis lyrata
agtagaaaattcaaagaaaaatggatgatcacgaaagccctcttttgtctaaggagtcaccaccatcatcatcatcagtgttggtttcatctttgaaatggatattgaaagttgtaatgtcggtgatttttgtgacttgggttgtgttccttatgatgtaccctggatcactcggtgatcaagtcctcacaaactggagagcaatctcctccaacactctctttggcatcacaggaagcatgttcttaattttcagtggtccgattcttgtcatcgccgtcttagcttctctctatctgatcatatcaggggaagagagggttttcactaagaagaagatatcgaagttcccgaggtttaggctatggacatttcctgttcttgtggatggaccatttggagttgtttctgcagctgagtttcttggaattatggtcttctctgtttttttcctttgggctatctatgcttataccttgaggaatctcaacgttcttgaatacttccacgtgcttcccaagaacagaagtatttttctgttggagttaacgggtctgcgttttgggatgattggattgttgtgtatggtgtttttgtttcttccaatctcgagaggctccattcttctccgccttatcgatatccctttcgaacatgctacaagatatcatgtttggcttggtcatatcactatggctttcttctccttacatggcctctgttatgttgttggatggactattcaaggtcaacttttagagcttttatttgaatggaaagatactggaatcgctgttttacccggagttatcagtctagtggctggtttactcatgtgggtcacgtcccttcacaccgtgagaaagttttactttgagctcttcttctacacacatcaactatacatcgtctttgttgtgttcttggcacttcatgttggtgactacttgttcagtatagttgctggaggaatattccttttcattctcgaccgcttcttgaggttctgccaatccagaaggactgtagatgtaatctctgcaaagagtttaccctgtggaactctggaactagtcctttcaaaaccaccaaatatgcgatacaatgctcttagctttatctttcttcaagtgagggaactatcttggttacagtggcatcctttcagtgtttcatcaagtcctctagatgggaaccatcatgttgcggttctcataaaggttcttggtggatggaccgcaaagcttagagaccagttgtcaaatctatatgaggcagagaatcaagaccagcttatttctcctgattcatatcccaaaatcacaacttgtgtggaagggccttatggccatgaatctccataccacttagcgtacgagaacctggttttagtagcaggaggaatcggtattacaccttttttcgccatcttaagtgatatcctacaccgtaaaagagatgggaaagcttgtttgcctagtaaggttttagttgtgtgggccattaaaaactcagacgagctctctctactctcagcaatcgacgtaccttccatttgccctttcttctctaagaaactaagccttgagattcacatatatgttactcgacaatccgagcctcgcttggaagatgggatggttcagatggtggtgcatccttctgtcaaaccaccacggaccaacggatgttccatgtcggttctagttggtacaggggacaatatatggtctggactctatctaattgtctccaccattgggtttattgcaatgatcacatttttggacgtcttttacataaacaaatacaacataacgacgtggtggtacaaaggacttctatttattgtttgtatggttgcaagtgtgttgatttttggtggccttgtagttgttttctggcatcgttggggtcacaaaaccggtaaagtggaagcaaatggcaatgacaaggtatatttgaacggagaagaaacccataatccatatgcagcagagctcaagggcttggacatagaagaagatgtccagagttacaccactatccgttatggcaccagaccggcctttagagagatatttgagtcattgaatgggaaatggggaagtgtggatgttggagtaatagtatgcggtccagcgactcttcaaacgaccgtagccaaagagatacgatcacatagcatctggcgatcagcgaatcatcctcttttccacttcaacagccacagtttcgatctataactatcctttcaaggccaaag

SEQ ID NO: 8718 - DNA, 2575 bp, Arabidopsis lyrata
ctctagtaacgcctctttaaaagccgatgctgcttctgagccaacttctcatcacaacactgagaagtagaaattcaaataaagatggatgatcataaaacccctcttttgtccaaggactcatcatcatcatcatcatctacatcatctgtcgtgacttcatctttgaaatgggtattgaaagttgtaatgtctatgatttttgtgacgtggattgtttttcttatgatattgtaccctgaacaactcggcgatgatttcctcacagtagtcgcctccaagactttcctcggcaccacaggaagcatgttcttaattttcagtggtccgattcttgtcatcgctgtcttagcttctctctatctaattatctccggagaagacaaggtcttcactaaaaacaagatatcaaaattcccgaggtttaggctatggacatttcctgttcttgtggatggaccatttggggttgtttctgcagctgagtttcttggaattatggtcttctctgttttcttcctttgggctatatatgcttatactttgaggaatcttgatcttcttgaacgcttccacgtccttcccaagaatcgaagtattctgctgttggaggtaactggtctgcgtttaggagtgattggattgttgtgcatggtttttttgtttcttccaatctcgagaggctccattcttctccgccttatcgatatccctttcgaacatgctacacgataccatgtttggcttggtcatatcactatggctttcttctctttacatggcctctgttatgttgttggatggaccattcaaggtcaacttttagagcttatattttcatggaatgctattggaattgctgtgttaccgggagttatcagtctagtggctggtttactcatgtgggtcacgtcgcttcacaccgtgagaaagcattactttgagctcttcttctacacacatcaactatacatcgtctttgtcgtcttcttggcacttcatgttggtgactacttattcagtatagttgctggaggaatatttcttttcattctagaccgcttcttgaggttctgccaatccagaaggactgtagatgtaatctctgcaaagagtttgccttgtggaactctggaactagtcctttcaaaaccaccaaatatgcgatacaatgcgcttagctttatctttcttcaagtgagggaactatcatggctacaatggcatcctttcagtgtttcatcaagtcctttagatgggaaccatcatgttgcggttctcataaaggttcttggtggatggaccgcaaagcttagagaccagttgtcaaatctatatgaggcagagaatcaagaccagcttatttctcctgattcatatcccaaaatcacaacttgtgtggaaggaccttatggccatgaatctccataccacttagcgtacgagaacctggtcttagtagcaggaggaatcgggattacgccttttttcgccatcttaagcgatatcctacatcgtaaaagagatgggaaagcttgtttacctagtaatgttttacttgtatgggccattaaaaactcagacgagctctctcttctctcagcaattgacataccttccatttgccctttcttctctaagaaactaaaccttgagattcacatatatgtcactcgacaatccgagccccgcttggaagatgggatggttcacaaggtggtgcatccttctgttaaaccaccacggaccaacagatgttccatgtcggttctagttggtacaggggacaacatatggtctggactctatctaattgtctccaccattgggttcattgcaatgatcacattgttggacatcttttacataaaaaaatacaacataacgacgtggtggtacaagggacttctatttgttgtttgtatggttgcaagtgtgttgatttttggaggtcttgtagttgttttctggcatcgctggggtcacaaaatcggtgaagtggaaggaaatggcaatgacaaggtgaatttaaatggagaagaaacccataatccatctgcagcagagctcaaggggttggcaacagaagaagatgtccagagttacaccactattcgttatggcaccagaccgaactttagagagatatttgcgtcgttgaatgggaaatggggaagtgtggatgttggagtaatagtatgcggtccagggactcttcagacgaccgtagccaaagagatacggtcacatagcatctggcggtctgcgaatcatcctcttttccacttcaacagccacagtttcgatctctaagtctctaacgatgctttcaaggccaaggaacatcatggaaaattcgacaaaaaaattgatgcatatattttaggtaatcgcagtctttatgaattatggaaagagcctatggttgatatgtgtatgttttatctttcagttttcatgtataagtagtaatcaaatgtatgagcatcttctatggtttctagttctacacttggtatttgtttgtactttggacatatgatactaattaaatgcaagctgataaggcctaaaa

SEQ ID NO: 8719 - DNA, 2555 bp, Arabidopsis thaliana
ctctagtaacgccaccttaaaagccgatgctgcttctgagccaacttctcatcacaacactgagaagtggaaattcaaataaagatggatgattatgaaacccctcttttgtccaaggactcatcatcatcatcatctgtgattacttcatctttgaaatggatattgaaagttgtaatgtctatgatttttgtgacttgggttgtttttcttatgatgatgtaccctgaacaactcggtgatgatttcctcacatttgtctcctccaagactttcctaggcaccacaggaaccatgttcttgattttcagttgtccgattcttgtcatctctgtcttagcttctctctatctcattatctccggggaagacaaggtcttcactaagaagaagatatcgaaattcccgaggtttaggctatggacattccctgttcttgtggatggaccatttggagttgtttctgcagctgagtttcttggaattatggtcttctctgtttttttcctttggtctatctatgcttataccttgaggaatcttgaccttcttgaacgcttccacgtccttcccaagaatcgaagtattcttctgttggaggtaacgggtctgcgtttaggaatgattggattgttgtgtatggtttttttgtttcttccaatctcgagaggttccattcttctccgtcttatcgatatcccttttgaacatgctacaagatatcatgtttggcttggtcatatcaccatggctttcttctccttacatggcctctgttatgttgttggatggatcattcaaggtcaacttttagagcttatattttcatggaatgctatcggaattgctatcttacccggagttatcagtctagtggcgggtttactgatgtgggtcacatcgcttcacaccgtgagaaagaattactttgagctcttcttctacacacatcaactatacatcgtctttattgtgttcttggcacttcatgttggtgattacatgtttagtatagttgctggaggaatatttcttttcattctagaccgcttcttgaggttctgccaatcaagaaggactgttgatgtaatctctgcaaagagtttaccttgtggaactcttgaactagtcctttcaaaaccaccaaatatgcgatacaatgcgcttagctttatctttcttcaagtgagggaactatcttggctacaatggcatccatttagtgtttcttcaagccctctagatgggaaccatcatgttgcggttctcataaaggttcttggtggatggactgcaaagcttagagaccagttgtcaaatctatacgaggcagagaaccaagatcagctcatttctcctcagtcatatcctaaaatcacaacttgtgtggagggaccttatggccatgaatctccataccatttagcgtatgagaacctggtcttagtagcaggaggaatcgggattacgccttttttcgccatcttaagcgatatcctacaccgtaaaagagatgggaaagcttgtttacctagtaaggttttagttgtatgggccattaaaaactcagacgagctctctctgctctcagcaattgacataccttccatttgccctttcttctctaagaaactaaaccttgagattcacatatatatcactcgacaatccgagcctcgcttggaagatgggatggttcacaaggtggtgcatccttctgtcaagctaccacggaccaacggatgttctatgtcggtactagttggtacaggggataacatatggtctggactctatctaattatatccaccattggatttatttcaatgatcacattgttggacatcttttacataaaaagatacaacataacaacgtggtggtacaagggacttctatttgttggttgtatggttgcaagtgtcttgatttttggaggtcttgtggttgttttctggcatcgctgggaacacaaaaccggtgaagtggaagcaaatggcaacgacaaggtagatttgaatggagaagaaacccataatccatctgcagcagagcttaagggcttggcaatagaagaagatgtccagaattacaccactattcgttatggcaccagaccggcctttagagagatatttgagtcattgaatgggaaatgggggagtgtggatgttggagtgatagtatgcggtccagcgactcttcagacgaccgtagccaaagaaatacggtcacatagcatctggcgatcggcgaatcatcctcttttccacttcaacagccacagtttcgatctctaacgatgctttcaaggccaaagaacattatggaaggaaattcgaagacaaattgatgcatatattttaggtaatctctgtcagtatgtactatggaaacagctatggttgatatgtgtatgtttatctttcagttttcgatgtataaagtagaaatcaaatgtatgagcatctatggtttctagttctacacttgttggtgtttctacattggacatttaatattaattaaatgcaagctgataagtcctataatt

SEQ ID NO: 8720 - DNA, 2525 bp, Arabidopsis thaliana
gctgcttctgagccaacttctcatcacaacactgagaagtggaaattcaaataaagatggatgattatgaaacccctcttttgtccaaggactcatcatcatcatcatctgtgattacttcatctttgaaatggatattgaaagttgtaatgtctatgatttttgtgacttgggttgtttttcttatgatgatgtaccctgaacaactcggtgatgatttcctcacatttgtctcctccaagactttcctaggcaccacaggaaccatgttcttgattttcagttgtccgattcttgtcatctctgtcttagcttctctctatctcattatctccggggaagacaaggtcttcactaagaagaagatatcgaaattcccgaggtttaggctatggacattccctgttcttgtggatggaccatttggagttgtttctgcagctgagtttcttggaattatggtcttctctgtttttttcctttggtctatctatgcttataccttgaggaatcttgaccttcttgaacgcttccacgtccttcccaagaatcgaagtattcttctgttggaggtaacgggtctgcgtttaggaatgattggattgttgtgtatggtttttttgtttcttccaatctcgagaggttccattcttctccgtcttatcgatatcccttttgaacatgctacaagatatcatgtttggcttggtcatatcaccatggctttcttctccttacatggcctctgttatgttgttggatggatcattcaaggtcaacttttagagcttatattttcatggaatgctatcggaattgctatcttacccggagttatcagtctagtggcgggtttactgatgtgggtcacatcgcttcacaccgtgagaaagaattactttgagctcttcttctacacacatcaactatacatcgtctttattgtgttcttggcacttcatgttggtgattacatgtttagtatagttgctggaggaatatttcttttcattctagaccgcttcttgaggttctgccaatcaagaaggactgttgatgtaatctctgcaaagagtttaccttgtggaactcttgaactagtcctttcaaaaccaccaaatatgcgatacaatgcgcttagctttatctttcttcaagtgagggaactatcttggctacaatggcatccatttagtgtttcttcaagccctctagatgggaaccatcatgttgcggttctcataaaggttcttggtggatggactgcaaagcttagagaccagttgtcaaatctatacgaggcagagaaccaagatcagctcatttctcctcagtcatatcctaaaatcacaacttgtgtggagggaccttatggccatgaatctccataccatttagcgtatgagaacctggtcttagtagcaggaggaatcgggattacgccttttttcgccatcttaagcgatatcctacaccgtaaaagagatgggaaagcttgtttacctagtaaggttttagttgtatgggccattaaaaactcagacgagctctctctgctctcagcaattgacataccttccatttgccctttcttctctaagaaactaaaccttgagattcacatatatatcactcgacaatccgagcctcgcttggaagatgggatggttcacaaggtggtgcatccttctgtcaagctaccacggaccaacggatgttctatgtcggtactagttggtacaggggataacatatggtctggactctatctaattatatccaccattggatttatttcaatgatcacattgttggacatcttttacataaaaagatacaacataacaacgtggtggtacaagggacttctatttgttggttgtatggttgcaagtgtcttgatttttggaggtcttgtggttgttttctggcatcgctgggaacacaaaaccggtgaagtggaagcaaatggcaacgacaaggtagatttgaatggagaagaaacccataatccatctgcagcagagcttaagggcttggcaatagaagaagatgtccagaattacaccactattcgttatggcaccagaccggcctttagagagatatttgagtcattgaatgggaaatgggggagtgtggatgttggagtgatagtatgcggtccagcgactcttcagacgaccgtagccaaagaaatacggtcacatagcatctggcgatcggcgaatcatcctcttttccacttcaacagccacagtttcgatctctaacgatgctttcaaggccaaagaacattatggaaggaaattcgaagacaaattgatgcatatattttaggtaatctctgtcagtatgtactatggaaacagctatggttgatatgtgtatgtttatctttcagttttcgatgtataaagtagaaatcaaatgtatgagcatctatggtttctagttctacacttgttggtgtttctacattggacatttaatattaattaaatgcaagctgataagtcctataa

SEQ ID NO: 8721 - DNA, 1307 bp, Gossypium raimondii
atttcacagtaaacaaagataactccaaatcaacctcgagtgacgaacctgcccgcctgcctgcctgccacgctcccttccctccacctcctcatcttcaccctccacgtttcatcccatccctctctcacgcttttcctttgctttcctaatctcacctctctttcctttctgctgcttcttccgctgtttgcatttgaaaaactctgttttcctttttttccttttcatcaaaagcttgggtttctttttcttcttttttgcgccatgttgctgaaagctgttccaactttttcttcgttaaatcctcaactggaaaatcagggtgccctgtttttccctttttcttcttcgattaatcatcagctatcttctttaagaaatggacctgggtctcttgtagtttgtgcagccaaaggagccaaccacaagccactaagtggtgttgttttccagccctttgtggaagtgaaaaaggaacttgatcttgtcccctccgtgcctcaactttctctggctcgccaaaagtttactgatgactgtgaagcttccatcaacgaacaaatcaatgtcgaatacaatgtttcctatgtgtatcatgctatgtttgcttacttcgatagggacaacgttgcactcaagggtcttgccaagttcttcaaggaatcgagtttagaagagagagaacatgctgagaaatttatggaataccagaacaaacgaggtggaaaagtgaagctgcagtccatagtgatgcccctctctgagtttgatcatgcagagaaaggagatgcattatacgcaatggagcttgccttgtccctggagaaactaacaagtgaaaagctctttaacctacgtaatgtagccgtgcggaaccatgatgtgcagttgacggatttcattgaaggcgaattcttagctgagcaggtggaggccatcaagaaaatatcagaatatgtagctcaattgagaagagttggaaaaggacacggggtgtggcacttcgatcaaatgcttcttcatgagggagaggaagctattgcatgaagccccaacttgctgcttcgttccatgtcaaaagtttgtgcataaggtcttatttcagtagttctttgttgatatattttggctgtaagttgaaagatagtgccggatctttggtttgatgataaaagctcgtaagggatttatttttggtagtccttttaatcaaagtagttatagattcgtggatttcctatataggtatttttcttctccaagatccttccttctgtgttttttcttttaaatttgccctagcg

SEQ ID NO: 8722 - DNA, 2229 bp, Ceratodon purpureus
gtgttttcggagccattctggtcgcagttgcagcgatcagagatcagaccctagcgtcgtcgttctcgccactggtggttgctgtcgtcgctctgttcatgatggaggccgtggcagccatggcgactcctccgctggcgctctctgcggccacggccgcggtcgcttcctcgtcgtgttgctgctcctcgtcggtgtccaggggtttgtatgcagcgcggtggcgggggctggagtcgtcgtcatcgctgcagatgggagggagggagtttcagggatggaaattcgttgaaaattcgcgtggagggaggggcgcggcgtggtcgttgcgggtgagggccgatgcgggcgttgcggtgaaggagagggtgggaggggatgagaggcctaagttgacgcagggttttaccacggtgatgaagttcggcgggtcgtctgttgcgtcagctcatcggatgcgggaggtggctcaactgattttgagctttccggaggagcgtccagtaattgtgttgtcggctatgggaaagacgacgaacaatctgctgaaggcgggagagaaggccgtgacatgtggtgtgaaggagtctgggaaaattgaggagctccaagttctcagagatctacataagacgacagcacgtgaacttaaggtggacgaatccttgatcacagaccttctggacgaattggaacagcttctgttgggcattgctcttatgaaggagttgacggtgcgaacaaaggattatttggtttcctttggagagcgtctctcaacccgattatttgcagcctatttgaacagcatcggcacttatgcacgacagtacgatgctttcgatcttggaatcatcacaactgatgagttcaccaatgctgaaattttggagaccacgtacccaaccgtgagagaaaggctccttaatgatcttgaaaaagacgcagataggggaacacccatatgtgttgtcacaggtttccttggtaagggtgttgaaactgggtgcgtgacaacgctcgggcgaggtgggagtgacttgactgcgacagctcttggtaaagcgctaggtctccgagaaattcaggtgtggaaagatgtcgatggcgtcttgacatgtgatccccgtgtctttgcgaacgcgttaccggttccgtttctgactttcgatgaagcatctgagctggcttattttggtgctcaggtgttacatcctcagtccatgaggcctgcccgtgatgcaaatatacctgtgcgtgtcaagaattcttacaacccacaggcgcctggtactctcataacaggggaacgtgatatgagcaaggcagagatgacaagcatagttctgaaaaaggatgtaacaatgttggacatccaaagcacacgtatgcttgggcaagtcgggtttttggcaaaggtattcactacgttcgaagacttgggaatttcagtagatgtggtggccaccagcgaggtcagtatatcattgacgttggatccttcaaagctctgggagcgtgccctcattgaacaggagttggacaaaatgaaagcagagctgtcaaggatcgccaatgtgcagcttttgaagaaaaaagctattatttctctgattagcaatgtgaagcagtcatctgctgttcttgaaaaggtcttcagggtcttcaagaaaaacaatatcaatgtccaaatgatctcacagggtgcttcgaaggtgaatatatcgatggtcgtggatgatgaagatgctccaaagtgtgtgcaggagttgcacaaagttttctggcctgattcagatgaggtcatgactggaaatggccatttataggaacacgactttttgttgctgtgcaaaattgcgcaggtggaggaaggcgacaccttttgagttgaacgttctgttcagagacatttttgtaaatgttggtcaattgatgattgagaattttttatattggttggaaattgagtttctggccactagggttgaacaaaatgtcatttcttagtacattattgagtgcaagttagccttgatcccgtaaagtgcatcctgtttcccctcttaaacagtcgcacattgttgctaccagggtaaccatagacattatttcagctctgccgttcactcattccaaaagtagcgtagatggcaatggcattagtggttagctagaattcattctataatttgaataattttataatcgaagagatgtgattggtgg

SEQ ID NO: 8723 - DNA, 2073 bp, Physcomitrella patens
gttgctaaacttcgtggtcctgctccttgagcatgtactcgtttttgctggtgcagcataaaccctagcattcctgtggactccttgttacgtgttgtaaggccagtttgaacactgagagcatgatggaggtcgcagtagccatggctatccctaccttaaccctctccgctgctgcttcttcatcttgtgcatcttcttcgacgtgcaggtctttgaatttatcacagggccctagatggcggcgtttagagtcttcctcctcctcccacttcatgcctgctggtagctctttgctccaggagtttaaattcgttgaaaattctcgaagggacaggacgagagtgtggtcgctgcaggtacgatgcgacgcgggtgtatctgttgtaaaagagctagtaggagaggacgaggggcggcggatagtgcaagatttcaccaccgtcatgaagtttggcggatcctctgttgcctctgcccacagaatgaaagaagtggcacaacttattttgagttttccggaagagaaacctatcattgttctgtctgccatgggaaagacaaccaacaatttgctgaaggctggagacaaggcaatttcatgtggtgtgaagaattccggtagaattgaagagctgcaagttgtcagggatctacataaaacgacagcacgcgaacttaagcttgacgaatccttaatcacagggcttttggacgagttggaacaactgctgatgggcattgccctgatgaaggagctgacgtcacggactaaggattacttggtttcctttggggagcgcctttcaacccggctatttgcagcttacttgaatagtatcggcacctacgcacggcagtacgactctttcgaccttgggatcataacaaccgatgagttcacaaatgctgaaattttggatgtcacttacccaaccgtgcgagagcgtctttttaacgaccttgaaaaagacgcagctaagggtacacccatatgtattgttacaggcttccttggtaagggcatagaaactgggtgcgtgacaacccttggacgcggagggagtgatttgactgccacagccctcggcaaggcactaggtctccgagaaattcaggtgtggaaagatgtcgatggcgtcctgacatgtgatccccgtgtgttcccgagtgccttatcagttccattcttgactttcaatgaggcctctgaattggcctattttggagctcaggtgttacatcctcagtctatgaggccagcccgcgatgctaacatacctgttcgtgtcaagaattcgtataatccaaaagcgcctggtacactcataacaagagaacgtgatatgagccaggtagagatgacaagtatagtgctcaaaaaggatgtgacaatgttggatatccaaagcacacgtatgcttgggcaagttgggtttctagcaaaggtattcactacatttgaagaattagggatctctgtagatgtagtggccacaagtgaggtcagtatatcattgacattggacccagcgaagctctgggaacgggccctaattgagcaggaattagataaaatgaaatcagaattgtcaaggatcgccaacgttcagcttttgaagaaaaaggctattatctctcttattagtaacgtgaagcagtcatcagcggttcttgaaaaggtttttagtgttttcaaatcgaacaatatcaatgtacaaatgatctcacaaggtgcctcgaaggtgaatatatccatggtggtggatgatgatgatggtccaaagtgtgtgcaagagttgcaccaagctttttggcctgattcagatgaggtattggcagtaaatggtcatttgtaggaacatgaatttttattgctgtgcagcctttgtaaggtgatgaaaacctataattggtagccaaaagctttggccaaagtggctgtataatttatggttttaaaatttctggtcaattttgggttttttttacatgtagagatgggtatgctttccttcttaaactgggatgattgttgcaacctctgattgcaatacagaagtccggttgaac

SEQ ID NO: 8724 - DNA, 2480 bp, Brassica rapa
gaattgttggtgacaaaacgacagcgttttcagaacagactgttgaagaagaggggttcaacaaagtttccatctttggcgtctcactcaacattctcctcctcctcctccgatggcggctgctgctagggttcagtgtcataacaatacctctctcaccggatcaccactcccccgccgccgccgcaactcgccgacgctacacttttctccaaatcgcgtcaatttcacaccgctgaaatggatcggagacggctcatcttcctgcacaaggatggtttcaggtccatccctcaaaggcggcaccactactgtacgagctgcgttggaagaggagaagaagacagacgcggtcagtgaggtagtagaagaagagaagaggttcacgtgcgtgatgaagttcggaggatcatcggtggcgacggcggagaggatgagggaggtggcggatttggttttgacgtttcctgaagagagtcccgtcattgttctttctgcgatggggaagactactaacaacctcttgcttgcgggagagaaggcggttagttgtggtgtttctaatgcttctgagatcgaggagttgagcgttatcaaggagttgcatctcaggacagtgaaggaactcgagatcgacccctctgttgtttcgtcatttttggaagaactggagcaactccttaaaggtatagccatgatgaaggagctgacacttagaaccagagactacttagtctcttttggagagtgcttgtccacaaggattttcgcagcttatcttaataaaattggagtcaaggcacgccaatatgatgcatttgaaattggtttcatcacaacggatgacttcactaatggagatatcttggaagcaacttatccagctgttgccaagagattatatgatgattggatggatgatcctgctgtcccagttgtaacaggtttccttggaaagggttggaaaacttgtgcggttactaccttgggtaggggtggcagtgatttgacggcaaccacaattggtaaagcattgggtttgcaagagattcaggtgtggaaagatgttgatggtgttctaacatgtgaccctactatttataaacgagctacaccagtaccttttctaacgttcgatgaagcagccgagctagcttattttggtgcacaggtgttgcatccacagtcaatgagaccagcaagagaaggtgggattcctgttagggtgaaaaattcttataaccctaaagctcctggaactatcatcactaaaacaagagacatgaccaagacagttttaacgagcattgttctgaaacgcaatgtgaccatgctggatatagcaagcacccgaatgcttggtcaagttggctttcttgccaaggtattttcgatatttgaggatcttgaaatatccgtagatgttgttgccactagtgaagtcagcatatctctgacactggacccgtcaaagctttggagcagggaactgattcaacaggagcttgatcatgtagttgaagaacttgagaaaattgcagttgtgaatcttgcaaaaggaagagcaatcatctctctaatcggaaatgttcaacactcctccctgattctagagagggcgtttcatgttctttggaccaaaggcatcaatgtccagatgatatcacaaggagcatccaaggttaacatttcccttatagtaaatgatgctgaagctgaaggatgcgtggaggctcttcacaaatccttcttcgagagcggtgacctctcagagttattgatacaacccagacttggcaacgggtcacctgttaggacaatgcaagtagagaactgacttgacgagctcactgcttgatctttagttttcatcaagaactgcttgttgtattgttcacgtttaggctagtgaaccgcttgccatcttttcatttggtgtgagaacgatctcttggaccatttttgatttagcgtgatcaaacattaaccagtaagagaataagaaacatattgagatgtaactacagatgcttgaataggttttggtacaagaacagattaggctaaaagctgtggagttgtgtaagcatgtggacaagctcatcacttgaaggccggtctgcaggaaagtcagaaaggcagacgatggtgatccgtaaagccattaacatctcatcttcctccacttcctccccaagtatactctcatctaatgcttctcttgattcccctgattgctgcaaatgcttaagccacagtcctaagctacctccgcttgcaccattcacacaaaaaggttgcgtggggtcttttccggttaaaagaacacccaatatcatcccaaagctaaacacatcacttttctctgtatatctgttcacaaggaggttgcataccaacgttagttagtaaaagggaagaaattgtcagttcggattcggatccggttgtctatgaactgctaatacccactatttttt

SEQ ID NO: 8725 - DNA, 2105 bp, Brassica napus
ttccatctttggcgtctcactcaacattctcctcctcctcctccgatggcggctgctgctagggttcagtgtcataacaatacctctctcaccggatcaccactcccccgccgccgccgcaactcgccgacgctacacttttctccaaatcgcgtcaatttcacaccgctgaaatggatcggagacggctcatcttcctgcacaaggatggtttcaggtccatccctcaaaggcggcaccactactgtacgagctgcgttggaagaggagaagaagacagacgcggtcagtgaggtagtagaagaagagaagaggttcacgtgcgtgatgaagttcggaggatcatcggtggcgacggcggagaggatgagggaggtggcggatttggttttgacgtttcctgaagagagtcccgtcattgttctttctgcgatggggaagactactaacaacctcttgcttgcgggagagaaggcggttagttgtggtgtttctaatgcttctgagatcgaggagttgagcgttatcaaggagttgcatctcaggacagtgaaggaactcgagatcgacccctctgttgtttcgtcatttttggaagaactggagcaactccttaaaggtatagccatgatgaaggagctgacacttagaaccagagactacttagtctcttttggagagtgcttgtccacaaggattttcgcagcttatcttaataaaattggagtcaaggcacgccaatatgatgcatttgaaattggtttcatcacaacggatgacttcactaatggagatatcttggaagcaacttatccagctgttgccaagagattatatgatgattggatggatgatcctgctgtcccagttgtaacaggtttccttggaaagggttggaaaacttgtgcggttactaccttgggtaggggtggcagtgatttgacggcaaccacaattggtaaagcattgggtttgcaagagattcaggtgtggaaagatgttgatggtgttctaacatgtgaccctactatttataaacgagctacaccagtaccttttctaacgttcgatgaagcagccgagctagcttattttggtgcacaggtgttgcatccacagtcaatgagaccagcaagagaaggtgggattcctgttagggtgaaaaattcttataaccctaaagctcctggaactatcatcactaaaacaagagacatgaccaagacagttttaacgagcattgttctgaaacgcaatgtgaccatgctggatatagcaagcacccgaatgcttggtcaagttggctttcttgccaaggtattttcgatatttgaggatcttgaaatatccgtagatgttgttgccactagtgaagtcagcatatctctgacactggacccgtcaaagctttggagcagggaactgattcaacaggagcttgatcatgtagttgaagaacttgagaaaattgcagttgtgaatcttgcaaaaggaagagcaatcatctctctaatcggaaatgttcaacactcctccctgattctagagagggcgtttcatgttctttggaccaaaggcatcaatgtccagatgatatcacaaggagcatccaaggttaacatttcccttatagtaaatgatgctgaagctgaaggatgcgtggaggctcttcacaaatccttcttcgagagcggtgacctctcagagttattgatacaacccagacttggcaacgggtcacctgttaggacaatgcaagtagagaactgacttgacgagctcactgcttgatctttagttttcatcaagaactgcttgttgtattgttcacgtttaggctagtgaaccgcttgccatcttttcatttggtgtgagaacgatctcttggaccatttttgatttagcgtgatcaaacattaaccagtaagagaataagaaacatattgagatgtaactacagatgcttgaataggttttggtacaagaacagattaggctaaaagctgtggagttgtgtaagcatgtggacaagctcatcacttgaaggccggtctgcaggaaagtcagaaaggcagacgatggtgatccgtaaagccattaacatc

SEQ ID NO: 8726 - DNA, 3517 bp, Brassica rapa
agatataaaactgaaaaggagggtttaaagttttcatctttggcgtctgagccgtacgatttctctccacttctatcaatacacattctcggtcttcttcttcttcctctcggatggcggcggctgctagggttcggtgtcattgcaatgctcttttcaccagccaccggaactcgtcgacgctaccgatctctccgagtcgcgtcggtttcacagctttgaaatgcccgaggaagttcttgttgtccattggagatggctcatcctcctgcacacggaatgtctcgggttcatgtctcaaaggcactgtgcgagctgttatggaagaggagaagacagacgttataaaggagagggagggggacgagaagagattcacgtgcgtaatgaagttcggtggatcctcggtggcgacggcggagaggatgagggaagtggcggatctgattttggcgtttccggaagagagtccggtcattgttctttccgctatggggaagacaacaaacaatctcttgcttgcgggagagaaggctgtgagctgtggtgtctctaatgcatctgagattgaggaattgagcgttataaaggaattgcatctcaggacagtgaaagagctcaagatcgatccctctgttgttacatcgtttttggaagaactggagcaactcctgaaaggcatagccatgatgaaggagctgacacttcgaaccagagactacttagtctcttttggagagtgtttgtctacaaggattttcgcagcttatcttaataaaatcggtgtcaacgcacgccagtatgatgcatttgaaattggtttcattacaacggatgatttcacaaatggggatatcttggaagcaacgtatccagctgttgccaagagattatatgatgattggatgcatgatcctgctattcctattgtaacgggtttccttgggaagggttggaaaactggtgcgattactaccttgggtagaggtggcagtgatttgacggcaaccacaattggtaaagcgttgggtttgcaagagattcaggtgtggaaagatgttgatggtgttctaacttgtgaccctacaatttataaaagagctacaccagtaccctttctaacattcgatgaagcagccgagctagcttattttggtgcacaggttttgcacccacaatcaatgaggccagcaagagagggtgagattcctgttagggttaaaaactcttataaccctaaagctcctggaactatcatcactaaaacaagagacatgaccaagacagttttaacgagcattgttctgaaacgcaatgtgaccatgctggacatagcaagcacccgaatgcttggtcaagttggctttcttgcaaaggtgttttcgatatttgaggaccttgaaatatccgttgatgttgttgccactagtgaagtcagcttatctctgacattggatccgtcaaaactttggagcagggaactgattcaacaggagcttgatcatgtagtagaggaacttgagaaaattgcagttgtgaatctctcaaaaggaagagctataatctctttgattgggaatgttcaacattcctccctgattttagagagggcgtttcatgttctttggacaaaaggtatcaatgtccagatgatatcacaaggagcatccaaggtaaacatttcgcttatagtaaatgatgatgaagctgaaggatgcgttgaggcccttcacaaatccttctttgagagcggtgacctctcagagttattgatacaaccaagactgggcaacgggtcacctcttaggacaatgcaagtagaaaattgacttgcctgatctgcaatttttccattgtattgcttctgagttctacgttacgttcattaagaactgcttgtcgtctactacttgttttacacttttcatttggtatgagaacgatttcttggaccattcgtgtgatctattttaatcaataagagaagaaatatattgagatgcagttacatatgttcacagataggttttggtacaagaacattggggctaaaagctgtgcagttgtgtaagcatgtggacaagctcatcacttgaaggccgatctgctggaaagtcagaaaggcagataatggtgattcttaaagccattaacatctcgtcttcctccacttcctctccaagaatactcttatctaatgcttccctcacttctcccgtttgctgcaaatgcttcagccactgtcctaagctccctccgcttgcaccttctattgagaaaggaagggtagggtctctcccggttaaaagaacacctaatatcatcccaaagctgaagacgtcgcttttgtctgtatatctgtgtcacaatcatttgcatacctatgttagtaaaaagagagtttaactcaaaggtgatggtgttgattctaagcaagcacctgttagtctgagaagactcaggagctgagtagcaagacactgatgtatgtgaagcaggaatgatcttggccaatccgcaatcagcaagccgaggctcaaactcagaatcaagcatcacattcgtaggtttcaagttgtaatgaagaatctgttgctcacagctgaaatggagatactgaagccctttgacaattccaacggcaactctcagcctaatctcccatcctagctctagttcttgagctctaaccttagtcatcacatcctcaagactaccgttgggcgtgtaatcatacaccagagagaactcatctgattcacggacataagctcttaaactcatcaggttcctatctcttaacccagcaagaagctcaagctccttctgcagccttctcttaaccgacttagttgcttctggtgagccgccgtttccttcaagcgagcctagtctcttgactgcaaccactagaccattatcaagcaccatcttgtagtatttaccgttagggtctgagccgagcaactggatgccattagcaagagctgcgtgaagagacttgggtgtgatcttaggggaaaacaccacagggcctttgagaattggcgtctgtttcaggtacttgacagtgctacggaccaagaaagctaacgctaaggccgagaccaatcctgttaaaacccctgagacgatgctaacaacgataacctttgaagtgattttggactccagtggtgtagatgaaggtggagctgtggataagtgtttcacagctcttcgccgacaacttgcgcttgttcttgaagagaagactaagaagatgaacaagaggagatggacagtgttgcaatatctctttcttcttctttgctccattgaagagaaagaaaaaagcatataagtttttcaagattcggacacaaaagctgaagctgtgttcaaagctaaaagaagcagaaaagtgaagtctttttaatactacagtgaagctctctctctctctctctctcttcctatcctcttctcccaaacccacacaatatattctcgagaaaaccaatgagaaaagaaaaag

SEQ ID NO: 8727 - DNA, 4013 bp, Brassica rapa
ctccttctcgcattctcccctcttcacgaaactcgatgtctttgctttcggccactcatgacaaagcaacgagagctgcctttcgtacgcgtacgtggcaacgggacccatgtttactaaggaccgtctgacatacgaggtcccactctaaggcgggaacccatttttcctcttttcttgtattcttttgcgtgcaagtgtaacaaggatggtcatgctttttgtgaggagagagagagagagagttcacggtctcgcagatactgtttcttgaaaagagagtgtgtgttgtttcgtttgtgtgtctctgtctggttgatagatagttttgtttgttttgttcatcgtttcaaccacaagatatgtagaaaccaagggagaaaaaaaaacgtcattgaagtttgttcttttgattattttgagacatagtttgagtttctgtttgtagcttcttggaaaatttcagtttttttttttaattgtggaggaaaagagggagaattttcagataagaatctttgagccaatggttccattcatcttctttgtaaacattttgaattgaagattccttttttctttttcttttctcattggttttctcgagaatatattgtgtgggtttgggagaagaggataggaagagagagagagagagagagagcttcactgtagtattaaaaagacttcacttttctgcttcttttagctttgaacacagcttcagcttttgtgtccgaatcttgaaaaacttatatgcttttttctttctcttcaatggagcaaagaagaagaaagagatattgcaacactgtccatctcctcttgttcatcttcttagtcttctcttcaagaacaagcgcaagttgtcggcgaagagctgtgaaacacttatccacagctccaccttcatctacaccactggagtccaaaatcacttcaaaggttatcgttgttagcatcgtctcaggggttttaacaggattggtctcggccttagcgttagctttcttggtccgtagcactgtcaagtacctgaaacagacgccaattctcaaaggccctgtggtgttttcccctaagatcacacccaagtctcttcacgcagctcttgctaatggcatccagttgctcggctcagaccctaacggtaaatactacaagatggtgcttgataatggtctagtggttgcagtcaagagactaggctcgcttgaaggaaacggcggctcaccagaagcaactaagtcggttaagagaaggctgcagaaggagcttgagcttcttgctgggttaagagataggaacctgatgagtttaagagcttatgtccgtgaatcagatgagttctctctggtgtatgattacacgcccaacggtagtcttgaggatgtgatgactaaggttagagctcaagaactagagctaggatgggagattaggctgagagttgccgttggaattgtcaaagggcttcagtatctccatttcagctgtgagcaacagattcttcattacaacttgaaacctacgaatgtgatgcttgattctgagtttgagcctcggcttgctgattgcggattggccaagatcattcctgcttcacatacatcagtgtcttgctactcagctcctgagtcttctcagactaacagatatacagacaaaagcgacgtcttcagctttgggatgatattaggtgttcttttaaccgggagagaccctacccttcctttctcaatagaaggtgcaagcggagggagcttaggacagtggctgaagcatttgcagcaaacgggagaagtgagggaagcattagataagagtattcttggagaggaagtggaggaagacgagatgttaatggctttaagaatcaccattatctgcctttctgactttccagcagatcggccttcaagtgatgagcttgtccacatgcttacacaactgcacagcttttagccccaatgttcttgtaccaaaacctatctgtgaacatatgtaactgcatctcaatatatttcttctcttattgattaaaatagatcacacgaatggtccaagaaatcgttctcataccaaatgaaaagtgtaaaacaagtagtagacgacaagcagttcttaatgaacgtaacgtagaactcagaagcaatacaatggaaaaattgcagatcaggcaagtcaattttctacttgcattgtcctaagaggtgacccgttgcccagtcttggttgtatcaataactctgagaggtcaccgctctcaaagaaggatttgtgaagggcctcaacgcatccttcagcttcatcatcatttactataagcgaaattattaccttggatgctccttgtgatatcatctggacattgataccttttgtccaaagaacatgaaacgccctctctaaaatcagggaggaatgttgaacattcccaatcaaagagattatagctcttccttttgagagattcacaactgcaattttctcaagttcctctactacatgatcaagctcctgttgaatcagttccctgctccaaagttttgacggatccaatgtcagagataagctgacttcactagtggcaacaacatcaacggatatttcaaggtcctcaaatatcgaaaacacctttgcaagaaagccaacttgaccaagcattcgggtgcttgctatgtccagcatggtcacattgcgtttcagaacaatgctcgttaaaactgtcttggtcatgtctcttgttttagtgatgatagttccaggagctttagggttataagagtttttaaccctaacaggaatctcaccctctcttgctggcctcattgattgtgggtgcaaaacctgtgcaccaaaataagctagctcggctgcttcatcgaatgttagaaagggtactggtgtagctcttttataaattgtagggtcacaagttagaacaccatcaacatctttccacacctgaatctcttgcaaacccaacgctttaccaattgtggttgccgtcaaatcactgccacctctacccaaggtagtaatcgcaccagttttccaacccttcccaaggaaacccgttacaataggaatagcaggatcatgcatccaatcatcatataatctcttggcaacagctggatacgttgcttccaagatatccccatttgtgaaatcatccgttgtaatgaaaccaatttcaaatgcatcatactggcgtgcgttgacaccgattttattaagataagctgcgaaaatccttgtagacaaacactctccaaaagagactaagtagtctctggttcgaagtgtcagctccttcatcatggctatgcctttcaggagttgctccagttcttccaaaaacgatgtaacaacagagggatcgatcttgagctctttcactgtcctgagatgcaattcctttataacgctcaattcctcaatctcagatgcattagagacaccacagctcacagccttctctcccgcaagcaagagattgtttgttgtcttccccatagcggaaagaacaatgaccggactctcttccggaaacgccaaaatcagatccgccacttccctcatcctctccgccgtcgccaccgaggatccaccgaacttcattacgcacgtgaatctcttctcgtccccctccctctcctttataacgtctgtcttctcctcttccataacagctcgcacagtgcctttgagacatgaacccgagacattccgtgtgcaggaggatgagccatctccaatggacaacaagaacttcctcgggcatttcaaagctgtgaaaccgacgcgactcggagagatcggtagcgtcgacgagttccggtggctggtgaaaagagcattgcaatgacaccgaaccctagcagccgccgccatccgagaggaagaagaagaagaccgagaatgtgtattgatagaagtggagagaaatcgtacggctcagacgccaaagatgaaaactttaaaccctccttttcagttttatatct

SEQ ID NO: 8728 - DNA, 3384 bp, Eutrema parvulum
agggtttcaaagtttccatctttgacgtctcagcattgagccgtacgatttctattcctcgtcttgctttaaacctatcgataaacattctcggccttcttcgtcttcatctcctgcgatggcggctgctagggttcggtgtcatagcaatgcccctttcaccagattgccgctcacccgccaccgaaactcgtcgacgctaccggtttctccgaatcgtattgattttgcagcactgaaaggcccgaagaaattgttgttacccattggagatggctcatcctgcacaaggatggtttcagctccatgcctcaaaggcactgtacgagctgttttggaagagaagaagacagacgcgattaaggagacggaggtagacgagaagagtttcacgtgcgtgatgaagtttggtggatcttcggtggcaacggcagagagaatgagggaagtggcggatttaattttgacatttccggaagaaactccggtcattgttctttcagctatggggaaaactaccaacaacctcctccttgcgggagagaaggcggtgagttgtggtgtttcaaatgcatctgagattgaggagttgagcattataaaggaattgcatttcaggacagtgaaagagctcaagatcgacccttctgttgtttcgccgtttttggaagaactggagcaactcctgaaaggtatagccatgatgaaggagctgacacttcgaactagagactacttagtctcttttggagagtgcttgtctacaaggattttcgcggcttatcttactaaaatgggtgtcaaagcacgccaatatgatgcatttgacattggtttcattacaacggatgatttcacaaatggggatatcttggaagcgacttatccagctgttgccaagaggttatatgatgattggatgcatgatcctgctgttcctattgtaacgggcttccttgggaagggttggaaaactggtgctattactaccttgggtagaggtggcagtgatttgacggcaaccacaattggtaaagcattgggtttgcaagagattcaggtgtggaaagatgttgatggtgttctaacatgtgaccctactatttataaacatgctacaccagtaccatatctaacattcgatgaagcagccgagctagcttattttggtgcacaggtcttgcacccacagtcaatgaggccagcaagagagggtgaaattcctgttagggttaaaaattcttataaccctaaagctccgggaactatcatcactaaaacaagagacatgaccaagacagttttgacgagcattgttctaaaacgcaatgtgaccatgctggatatagcaagcacccgaatgcttggtcaggttggctttcttgcgaaggtattttcgatatttgaggaccttgaaatatccgtagatgttgttgccactagtgaagtcagtatatctctgacactggacccttcaaaactttggagcagggaacttattcaacaggagcttgatcatgtagttgaagaactggagaaaattgcagttgtgaatctttcaaaaggaagagcaataatctctctaattgggaatgttcaacattcctccttgattttagagagggcgtttcatgttctttggaccaaaggtatcaatgtccagatgatatcacaaggagcatccaaggtaaacatctcccttatagtaaatgatgccgaagctgaaggatgcgtcgaggctctccacaaatccttctttgagagcggtgacctctcagagttattgatacagcccagatttggcaacgggtctcctgctaggacaatgaaagtagaaaactgacttgatgagcgcattgcgtgatctgcattttcatattatttcttctgagttatacgtacgttcttcacgaactacttagtgcttgttttagttgttttacgttaagatacattttttcatagtatcttttcatttggtgtgagaccgatttcttggaccatttgcgtgatcaaattttgaccattaagaaaaaataatattgagatgtaactacagatgtttggatattacggacaagaacaatgggctaaaagctgtgcagttgtgtaagcatgtggacaagctcatcacttgaaggccggtctgccggaaagtcagaaaggcagataatggtaattcgtaaagccattaacatctcgtcttcctcaacttcttccccaagaatactcttatctaatgcttcccgtgcttccccggattgctgcaaatgcttcagccactgtcctaagctacctccgcttgcaccttctgcacagaaaggctgggtcagatctcttccggtcaaaagaacacccaatatcatcccgaagctaaatatgtcgcttttgtctgtatatctgtcacaagggtttgcatactgcgttagtaaaagagaagaattaggagttaactcaaaggcgatggcattgattcgacgcacctgttactttgagaagactcaggagcagagtagcaagatactgctgtgtgtgaagtaggcatgatcttggccaatccgcaatcagcaagccgaggctcaaactcagaatccaacatcacatttgtaggtttcaagttataatgaagaatctgatgctcacaactgaaatggagatactgaagccctttcacaatcccaacagcaactcttagcctaatctcccatccgagctctacttctttccctctaaccttagtcatcacatcctcaagactaccattcggcatgtaatcatagatgagagagaactcatcggattcgcgaacataagctcttaaactcataagattcctatgccttaacccagcaagaagctcaagttccttttgcaaccttctcttaaccgacttgctactaccactactagttgcttctggtgagccatttccttcaagtgagcctagcctcttaactgcaaccactaacccattatcgagtaccatcttgtaatatttactattagggtctgagccaagcaactggataccattaccaagagctgcgtgaagagatttaggtgtaatctttggggaaaagaccacaggacctttgagaattggcgtctgttgcatgtatttgacaatgcaacggaccaagaaagctaacactaaggccgagaccaacccggttaaaatccctgacacgatgcttatgacgataaccttggaagtgattctggattgaagtggtgtagatgatggtggagttgtggataagtgtttcacagttcttcgccgacaacttgcgcttgtgcttgttctggaagagaagagtaagaagaagaataagaggaaatagatagtgttgctatatccgtatcttcttcttctttgctccattg

SEQ ID NO: 8729 - DNA, 1945 bp, Eutrema halophilum
aggcttcttcttcttcttcttctccgatggcggctactagggttcggtgtcatgcacctttcaccagattgccgcacatccccaaccgaaactcgtcgacgctacagatttctccgaatcgtgtcgatttcgcgtcactgaagggtccaaagaaattatttttacacattggagatggctactccacaaggagggattcaggttcatgcctcagaaccactgtacgagctgttttggatgagaagaagacggacgcgatagcggagacggaggtagaggagaagagattcacgtgcgtgatgaagtttggcggatcttcggtggcgacggcggagagaatgagggaggtggcggatttgattctgacattcccggaagaatgtccggtcattgttctttctgcaatggggaaaactaccaacaatctcttgcttgcgggagagaaggcggtgagttgtggtgtttcaaatgcatctgagattgaggagttgagcattattaaggaattgcatctcaggacagtgaaagagcttaatatcgattcctctgttattttgtcctttttggaagaactggagcaactcctgaaaggcatagccatgatgaaggagttgacacttcgaaccagagactacttagtctcttttggagagtgcttgtctacaaggattttcgcggcttatcttaataaactcggtgtcaaggcacgccaatacgatgcatttgaaattggtttcattacaacggatgatttcacaaatggggatatattagaagcaacttatccagctgttgccaagagattatatgatgattggatgcatgatcctgctgttcctattgttactggtttccttggaaagggttggaaaactggtgcggttactaccttgggtaggggtggcagtgatttgacggcaaccacaattggtaaagcattgggtttgaaagagattcaggtgtggaaagatgttgatggtgttctaacatgtgaccctactatttataaaagagctacaccagtaccatatctgactttcgatgaagcagccgagctagcttattttggtgcacaggtattgcacccacagtcaatgagaccagcaagagagggtgagatacctgttagggttaaaaattcttataaccctaaagctcctggaactattatcactaaaacaagagacatgaccaagacagttttaacgagcattgttctgaaacgcaatgtgaccatgctggatatagcaagcacccgaatgcttggtcaggttggctttcttgcaaaggtattttcgatatttgaggatcttgaaatatccgtagatgttgttgccactagtgaagtgagtatatctctgacactggacccttcaaaactttggagcagggaactgattcaacaggagcttgatcatgtagttgaagaactggagaaaattgctgttgtgaatctttcaaaaggaagagcgataatctctctaattgggaatgttcaacattcctccctgattttagagagggcgtttcatgttctttggaccaaaggtatcaatgtccagatgatatcacaaggagcatccaaggtaaacatctctcttatagtaaacgatgctgaagctgaaggatgcgttgaggctcttcacaaatccttctttgagagcggtgacctctcggagttattgatacaacccagatttggcaacgggtcacctgtcaggacaatgcaagtagaaaactaacttaacgagctcattgcttgatatgcatttttcattgtattgcttctgagttatacgcacgttcatcaagaactacttgttgttttacgtttaggcaagggaagtgcttgccaccttttcagctgttgtaagaccaatttcttggaccattttgagtgatcaaagtttgaccagtaagagaaaaagaaatatattggtgaact

SEQ ID NO: 8730 - DNA, 3360 bp, Eutrema halophilum
agtgagcaatacgcttgtctgcttcttgttttaaacctatcaaaaacattccattcacaggcttcttcttcttcttcttctccgatggcggctactagggttcggtgtcatgcacctttcaccagattgccgcacatccccaaccgaaactcgtcgacgctacagatttctccgaatcgtgtcgatttcgcgtcactgaagggtccaaagaaattatttttacacattggagatggctactccacaaggagggattcaggttcatgcctcagaaccactgtacgagctgttttggatgagaagaagacggacgcgatagcggagacggaggtagaggagaagagattcacgtgcgtgatgaagtttggcggatcttcggtggcgacggcggagagaatgagggaggtggcggatttgattctgacattcccggaagaatgtccggtcattgttctttctgcaatggggaaaactaccaacaatctcttgcttgcgggagagaaggcggtgagttgtggtgtttcaaatgcatctgagattgaggagttgagcattattaaggaattgcatctcaggacagtgaaagagcttaatatcgattcctctgttattttgtcctttttggaagaactggagcaactcctgaaaggcatagccatgatgaaggagttgacacttcgaaccagagactacttagtctcttttggagagtgcttgtctacaaggattttcgcggcttatcttaataaactcggtgtcaaggcacgccaatacgatgcatttgaaattggtttcattacaacggatgatttcacaaatggggatatattagaagcaacttatccagctgttgccaagagattatatgatgattggatgcatgatcctgctgttcctattgttactggtttccttggaaagggttggaaaactggtgcggttactaccttgggtaggggtggcagtgatttgacggcaaccacaattggtaaagcattgggtttgaaagagattcaggtgtggaaagatgttgatggtgttctaacatgtgaccctactatttataaaagagctacaccagtaccatatctgactttcgatgaagcagccgagctagcttattttggtgcacaggtattgcacccacagtcaatgagaccagcaagagagggtgagatacctgttagggttaaaaattcttataaccctaaagctcctggaactattatcactaaaacaagagacatgaccaagacagttttaacgagcattgttctgaaacgcaatgtgaccatgctggatatagcaagcacccgaatgcttggtcaggttggctttcttgcaaaggtattttcgatatttgaggatcttgaaatatccgtagatgttgttgccactagtgaagtgagtatatctctgacactggacccttcaaaactttggagcagggaactgattcaacaggagcttgatcatgtagttgaagaactggagaaaattgctgttgtgaatctttcaaaaggaagagcgataatctctctaattgggaatgttcaacattcctccctgattttagagagggcgtttcatgttctttggaccaaaggtatcaatgtccagatgatatcacaaggagcatccaaggtaaacatctctcttatagtaaacgatgctgaagctgaaggatgcgttgaggctcttcacaaatccttctttgagagcggtgacctctcggagttattgatacaacccagatttggcaacgggtcacctgtcaggacaatgcaagtagaaaactaacttaacgagctcattgcttgatatgcatttttcattgtattgcttctgagttatacgcacgttcatcaagaactacttgttgttttacgtttaggcaagggaagtgcttgccaccttttcagctgttgtaagaccaatttcttggaccattttgagtgatcaaagtttgaccagtaagagaaaaagaaatatattggtgaactacagatgtttggatttcatggattgggttcacagataggtttggtacaagaacattaaggctaaaagctgtgcagttgtgtaagcatgtgaacaagctcatcactggaaggcctgtctgccggaaaatcagaaaggcagataatggcgattctcaaagccattaacatctcgtcttcctccacttcctctccaagaatactcttatctaatgcttctcgtgcctccccggattgctgcaaatgcttcaaccactgtcccaagctgcctccgcttgcaccctctccaccgaaaggaagggtggggtcttttccggttaaaagaacacccaatatcatcccaaagctgaatatgtcgcttttgtcggtgtatctgtcacaaggaattgcacaccgtgttagttaaaagagaagaattaggagttaactcaaaggtgatgatggcgttgatttttgaaacacctgttactttgagaagactcgggagcagagtagcaagaaaccgctgtgtgtgaactaggcatgatcttggccaatccgcaatcagcaagccgaggctcaaactcagaatccaacatcacatttgtaggtttcaagttataatgaagaatctgttgctcacagctaaaatggagatactgaagccctttcacaatcccaactgcgactctaagcctaatctcccatccgagctctacctctttcgctctaaccttattcatcacatcctcaagactaccatttggcatgtaatcatagacgagagagaactcatcggattctcgaacataagctcttaaactcataaggttcctatgccttaacccagcaagaagctcaagttccttctgcaatcttcttttaaccgacttgctactactagttgcttctggtgagccgtttccttcaagtgagcctagtctcttgactgcaaccactagaccgttgtcgagtaccatcttgtagtatttaccatttgggtctgagccaagcaactggataccattaccgagagctgcgtgaagagatttaggagtaatctttggggaaaacaccacaggacctttgagaattggagtctgtttcatgaatttgacaatgcaacggaccaataaagctaacactaaggccgagaccaagccggttaaaatccctgagacgatgctaataacgataaccttggaagtgattctggattcgagtggtatagatgaaggtggatttgtggataagtgcttcacagttcttcgccgacaacttgcgcttgtgcttgttcttgaagcgaagactaagaagaagaataacaggagacaaatagtgttgctacatccgtttcttcgtcttcttctatgctccattg

SEQ ID NO: 8731 - DNA, 1983 bp, Arabidopsis thaliana
aaatgagagtgagccgtacgatttctctcctcttcttgttttaaaaacctatcaataatattcttcttcttcctcctctcaaatggcggctactagggttcgttgttgtcatagcaatgcagctttcaccagattgccacttacccgccaccgaaactcgccgacgctaccgatttctctaaatcgtgtcgatttccctacgctgaagaaattatcattacccattggagatggctcctccattagaaaggtttcaggttcaggcagcagaaacattgtgcgagctgtgttggaagagaagaagacagaggcgataacggaggtagatgagaagggtatcacgtgcgtgatgaagtttggtggatcttcggtggcgtcagctgagagaatgaaggaagttgctgatttgattttgacttttccggaagaaagtcccgtcattgttctctctgctatggggaaaactaccaacaatctcttgcttgcgggagagaaggcggttagttgtggtgtttctaatgcatctgagattgaggagttgagcattataaaggaattgcatatcaggacggtgaaagagctcaacattgatccctctgttattttgacctatttggaggaactggagcaactcctgaaaggcattgccatgatgaaggaattgacacttcgaaccagagattacttagtctcttttggagagtgtttgtctacaaggatttttgctgcttatcttaatacaatcggtgtcaaggcacgccaatatgatgcatttgaaattggtttcattacaacggatgatttcacaaatggggatatcctggaggcaacttatccagctgttgccaagagattatatgatgattggatgcatgatcctgctgttcctattgtaacaggtttccttgggaagggttggaaaactggtgcggttactaccttgggtaggggtggcagtgatttgacggcaaccacaattggtaaagcgttgggtttgaaagagattcaggtgtggaaagatgtcgatggtgttctaacatgtgaccctactatatataagcgagctacaccagtaccatatctgacatttgacgaagcagccgagctagcttattttggtgcacaggtcttgcacccacagtcaatgagaccagcaagagagggtgagattcctgttagggttaaaaattcttataaccctaaggctcctggaactatcatcactaaaacaagagacatgaccaagagtattctaacgagcattgttctgaaacgtaatgtgaccatgctggatatagcaagcacccgaatgcttggtcaagttggctttcttgcaaaggtattctcgatatttgaggagcttggcatttccgtagatgttgttgccactagtgaagtcagtatatctctgacactggatccttcaaaactttggagcagagaactgattcaacaggagcttgatcatgtagttgaagaactggagaaaattgcagttgtgaatcttctaaaaggaagagcaatcatctctctaattgggaatgttcaacattcctccctgattttagagagggcgtttcatgttctttataccaaaggtgtcaatgtccagatgatatcacaaggagcatccaaggtaaacatttcctttatagtaaacgaagctgaagctgaaggttgtgttcaggctcttcacaaatccttcttcgagagcggtgacctctcagagttattgatacaacccagacttggcaacgggtcacctgtcaggacactgcaagtagaaaattgactcgacaagcttattgcttgatctgtgtttttctttgtattccttctgagtgtagtatgtacgttcatcaagcactgcttgttgtcctacgtttaggaacgggaactgctggctacctttcgactgttgtaagaccaattttttgtaccatttgcgtgatcaaagttaaaccagttactagcaagaataaa

SEQ ID NO: 8732 - DNA, 1970 bp, Arabidopsis thaliana
gagagtgagccgtacgatttctctcctcttcttgttttaaaaacctatcaataatattcttcttcttcctcctctcaaatggcggctactagggttcgttgttgtcatagcaatgcagctttcaccagattgccacttacccgccaccgaaactcgccgacgctaccgatttctctaaatcgtgtcgatttccctacgctgaagaaattatcattacccattggagatggctcctccattagaaaggtttcaggttcaggcagcagaaacattgtgcgagctgtgttggaagagaagaagacagaggcgataacggaggtagatgagaagggtatcacgtgcgtgatgaagtttggtggatcttcggtggcgtcagctgagagaatgaaggaagttgctgatttgattttgacttttccggaagaaagtcccgtcattgttctctctgctatggggaaaactaccaacaatctcttgcttgcgggagagaaggcggttagttgtggtgtttctaatgcatctgagattgaggagttgagcattataaaggaattgcatatcaggacggtgaaagagctcaacattgatccctctgttattttgacctatttggaggaactggagcaactcctgaaaggcattgccatgatgaaggaattgacacttcgaaccagagattacttagtctcttttggagagtgtttgtctacaaggatttttgctgcttatcttaatacaatcggtgtcaaggcacgccaatatgatgcatttgaaattggtttcattacaacggatgatttcacaaatggggatatcctggaggcaacttatccagctgttgccaagagattatatgatgattggatgcatgatcctgctgttcctattgtaacaggtttccttgggaagggttggaaaactggtgcggttactaccttgggtaggggtggcagtgatttgacggcaaccacaattggtaaagcgttgggtttgaaagagattcaggtgtggaaagatgtcgatggtgttctaacatgtgaccctactatatataagcgagctacaccagtaccatatctgacatttgacgaagcagccgagctagcttattttggtgcacaggtcttgcacccacagtcaatgagaccagcaagagagggtgagattcctgttagggttaaaaattcttataaccctaaggctcctggaactatcatcactaaaacaagagacatgaccaagagtattctaacgagcattgttctgaaacgtaatgtgaccatgctggatatagcaagcacccgaatgcttggtcaagttggctttcttgcaaaggtattctcgatatttgaggagcttggcatttccgtagatgttgttgccactagtgaagtcagtatatctctgacactggatccttcaaaactttggagcagagaactgattcaacaggagcttgatcatgtagttgaagaactggagaaaattgcagttgtgaatcttctaaaaggaagagcaatcatctctctaattgggaatgttcaacattcctccctgattttagagagggcgtttcatgttctttataccaaaggtgtcaatgtccagatgatatcacaaggagcatccaaggtaaacatttcctttatagtaaacgaagctgaagctgaaggttgtgttcaggctcttcacaaatccttcttcgagagcggtgacctctcagagttattgatacaacccagacttggcaacgggtcacctgtcaggacactgcaagtagaaaattgactcgacaagcttattgcttgatctgtgtttttctttgtattccttctgagtgtagtatgtacgttcatcaagcactgcttgttgtcctacgtttaggaacgggaactgctggctacctttcgactgttgtaagaccaattttttgtaccatttgcgtgatcaaagttaaaccagttactagc

SEQ ID NO: 8733 - DNA, 1989 bp, Arabidopsis lyrata
aatgacaatgagccgcactacttctctcctcttctttgttttacccaaaaacctatcaataatattcttcttcttcctcttctccaatggcggctactagggttcggtgttgtcatagcaatgcacctttcaccagattgccttatacccgccaccgaaactcgccgacgctaccgatttctctgaatcgtgtcgatttctctgcgctgaagtgctcgaggagattatcattacccattggagatggctcctccattagaaatgtttcaggttcaggctgcagaaacattgtgcgagctatcttggaagagaagacagaggcattaacggaggtagatgagaagggattcacgtgcgtgatgaagtttggtggatcttcagtggcgtcagctgagagaatgaaggaagttgcggatttgattttgacttttccggaagaaagtcccgtcattgttctctctgcaatggggaaaactaccaacaatctcttgcttgcgggagagaaggcggtgagttgtggtgtttctaatgcatctgagattgaggaattgagcattataaaggaattgcatatcaggacggtgaaagagctcaacattgatccctctgttattttgacctatttggaagaactggagcaactcctgaaaggcattgccatgatgaaggagctgacacttcgtacgagagactacttggtctcttttggagagtgcttgtctacaaggattttcgctgcttatcttaatacaatcggtgtcaaggcacgccaatatgacgcatttgaaattggtttcattacaacggatgatttcacaaatggggatatcctggaggcaacttatccagccgttgccaagagattatatgatgattggatgcatgatcccgctgttcctattgtaacaggtttccttgggaagggttggaaaacaggtgcggttactaccttgggtaggggtggcagtgatttgacggcaaccacaattggtaaagcattgggtttgaaagagattcaggtgtggaaagatgtcgatggtgttttaacatgtgaccctactatatataagcgagctacaccggtaccatttctgacattcgacgaagcagccgagctagcgtattttggtgcacaggtcttgcacccacagtcaatgagaccagcaagagagggtgagattcctgttagggttaaaaattcttataaccctaaggctcctggaactatcatcactaaaacaagagacatgaccaagagcattctaacgagcatagttctgaaacgcaatgtgaccatgctggatatagcaagcacccgaatgcttggtcaagttggttttcttgcaaaggtattttcgatatttgaggagcttggcatttccgtagatgttgttgccactagtgaagtcagtatatcgctgacactggacccttcaaaactttggagcagggaactgattcaacaggagcttgatcatgtagttgaagaactggagaaaattgcagttgtgaatcttctaaaaggaagagcaataatttctctaattgggaatgttcaacattcctccctgattttagagagggcgtttcatgttctttataccaaaggtgtcaatgtccagatgatatcacaaggagcatccaaggtaaacatttcctttatagtaaacgaagctgaagctgaaggatgcgttcaggctcttcacaaatccttctttgagagcggtgacctctcagagttattgatacaacccagacttggcaacgggtcacctatcaggatgcaagtagaaaattgactcgacaagctcattgcttgatctgcgtttttctttgtattccttccaagtgtagtatgtacgttcatcatgaactgcttgttgttatgtttaggcacgggaactgctgaggctatcttttttgttgtaagaccaatttttttgtaccatttgcgcgatcaaagtttaaccagtaactcgcaaggataaa

SEQ ID NO: 8734 - DNA, 1979 bp, Arabidopsis lyrata
gacaatgagccgcactacttctctcctcttctttgttttacccaaaaacctatcaataatattcttcttcttcctcttctccaatggcggctactagggttcggtgttgtcatagcaatgcacctttcaccagattgccttatacccgccaccgaaactcgccgacgctaccgatttctctgaatcgtgtcgatttctctgcgctgaagtgctcgaggagattatcattacccattggagatggctcctccattagaaatgtttcaggttcaggctgcagaaacattgtgcgagctatcttggaagagaagacagaggcattaacggaggtagatgagaagggattcacgtgcgtgatgaagtttggtggatcttcagtggcgtcagctgagagaatgaaggaagttgcggatttgattttgacttttccggaagaaagtcccgtcattgttctctctgcaatggggaaaactaccaacaatctcttgcttgcgggagagaaggcggtgagttgtggtgtttctaatgcatctgagattgaggaattgagcattataaaggaattgcatatcaggacggtgaaagagctcaacattgatccctctgttattttgacctatttggaagaactggagcaactcctgaaaggcattgccatgatgaaggagctgacacttcgtacgagagactacttggtctcttttggagagtgcttgtctacaaggattttcgctgcttatcttaatacaatcggtgtcaaggcacgccaatatgacgcatttgaaattggtttcattacaacggatgatttcacaaatggggatatcctggaggcaacttatccagccgttgccaagagattatatgatgattggatgcatgatcccgctgttcctattgtaacaggtttccttgggaagggttggaaaacaggtgcggttactaccttgggtaggggtggcagtgatttgacggcaaccacaattggtaaagcattgggtttgaaagagattcaggtgtggaaagatgtcgatggtgttttaacatgtgaccctactatatataagcgagctacaccggtaccatttctgacattcgacgaagcagccgagctagcgtattttggtgcacaggtcttgcacccacagtcaatgagaccagcaagagagggtgagattcctgttagggttaaaaattcttataaccctaaggctcctggaactatcatcactaaaacaagagacatgaccaagagcattctaacgagcatagttctgaaacgcaatgtgaccatgctggatatagcaagcacccgaatgcttggtcaagttggttttcttgcaaaggtattttcgatatttgaggagcttggcatttccgtagatgttgttgccactagtgaagtcagtatatcgctgacactggacccttcaaaactttggagcagggaactgattcaacaggagcttgatcatgtagttgaagaactggagaaaattgcagttgtgaatcttctaaaaggaagagcaataatttctctaattgggaatgttcaacattcctccctgattttagagagggcgtttcatgttctttataccaaaggtgtcaatgtccagatgatatcacaaggagcatccaaggtaaacatttcctttatagtaaacgaagctgaagctgaaggatgcgttcaggctcttcacaaatccttctttgagagcggtgacctctcagagttattgatacaacccagacttggcaacgggtcacctatcaggatgcaagtagaaaattgactcgacaagctcattgcttgatctgcgtttttctttgtattccttccaagtgtagtatgtacgttcatcatgaactgcttgttgttatgtttaggcacgggaactgctgaggctatcttttttgttgtaagaccaatttttttgtaccatttgcgcgatcaaagtttaaccagtaactcgcaa

SEQ ID NO: 8735 - DNA, 1527 bp, Eutrema halophilum
atctctttatcttcgatggcattgatacaaccaccaattcaagggaattcttccgcttgcgccaatgaaatcatccaactctcttctacgattcgctgcttttcacgcagcgcggttcagcaacatatatcatcccctgcttgttttcgacatgtaacctctgtttcagtaacgcccacaacgtgttcgaccaaaatacccaacgagcgtatagggaaaatgagccctggcctgatctcaacaagacaccgagtagatcctaaaaaggaattgtctcggattctgagaacagatgctgctgttaagggcatcgagaggaaagccaactccgaaaagtacaacactttgtggccaaaagctgttcttgaagcacttgatgaggctatcagcgagaatcgttggcagtctgcgctcaagattttcaatcttcttaggaagcagcattggtatgagccaagatgcaaaacatacacaaagctgttaaaagtgcttgggaattgcaaacagcctgagcaggccagcttacttttcgaggtcatgttgtctgaaggattgaaacccaccattgatgtgtatacatctcttatagctgtttatggcaaaagcggacttctagacaaggcctttgccacgcttgaatatatgaaatcggttagtgattgcaagccagatgtcttcacctttactgttctcatcagttgttgctgcaaacttggtcggtttgatctggttaaacgcatccttcttgagatgtcgtatcttggagttagatgcagcacggttacttacaatactattattgatgggtacggaaaggcaggcatgtttgaggagatggaaaatgtactggctgatatgatcgaggatggagattctcatccagatgttttcacgtttaactcgatcattgggtcatatggaaatggtggcaacacgagaaagatggaaagctggtataatcggttccagctgatgggagtgcagccagacatcactacatttaacatactgatcctatcatttggtaaagcggggatgtttaagaagatgagctctgttatggatttcatggagaaaaggttcttctccctgacgactgtcacttataatatagtgattgagacgtttggaaaagcaggaagaatcgagaaaatggatgagacattcaggaaaatgaagtatcaaggagtgaaacccaactctatcacttattgttcgcttgttaacgcgtatagcaaagctggtcttgtggtgaagatagattcggttttgaggcaaattgtgaattcagatgtggtactggatacgcccttcttcaattgcataatcaatgcatacggtcaggctggtgatctggctacgatgaaggaactgtacctacaaatggaagagagaaaatgtaagcctgataaaatcacttttgccactatgatcaaaacctatgctgcgcatggaatctttgatgcagtccaggaactcgagaaacaaatgatttccactggtgagaattcaagttttctcttgtag

SEQ ID NO: 8736 - DNA, 1638 bp, Eutrema halophilum
atctctttatcttcgatggcattgatacaaccaccaattcaagggaattcttccgcttgcgccaatgaaatcatccaactctcttctacgattcgctgcttttcacgcagcgcggttcagcaacatatatcatcccctgcttgttttcgacatgtaacctctgtttcagtaacgcccacaacgtgttcgaccaaaatacccaacgagcgtatagggaaaatgagccctggcctgatctcaacaagacaccgagtagatcctaaaaaggaattgtctcggattctgagaacagatgctgctgttaagggcatcgagaggaaagccaactccgaaaagtacaacactttgtggccaaaagctgttcttgaagcacttgatgaggctatcagcgagaatcgttggcagtctgcgctcaagattttcaatcttcttaggaagcagcattggtatgagccaagatgcaaaacatacacaaagctgttaaaagtgcttgggaattgcaaacagcctgagcaggccagcttacttttcgaggtcatgttgtctgaaggattgaaacccaccattgatgtgtatacatctcttatagctgtttatggcaaaagcggacttctagacaaggcctttgccacgcttgaatatatgaaatcggttagtgattgcaagccagatgtcttcacctttactgttctcatcagttgttgctgcaaacttggtcggtttgatctggttaaacgcatccttcttgagatgtcgtatcttggagttagatgcagcacggttacttacaatactattattgatgggtacggaaaggcaggcatgtttgaggagatggaaaatgtactggctgatatgatcgaggatggagattctcatccagatgttttcacgtttaactcgatcattgggtcatatggaaatggtggcaacacgagaaagatggaaagctggtataatcggttccagctgatgggagtgcagccagacatcactacatttaacatactgatcctatcatttggtaaagcggggatgtttaagaagatgagctctgttatggatttcatggagaaaaggttcttctccctgacgactgtcacttataatatagtgattgagacgtttggaaaagcaggaagaatcgagaaaatggatgagacattcaggaaaatgaagtatcaaggagtgaaacccaactctatcacttattgttcgcttgttaacgcgtatagcaaagctggtcttgtggtgaagatagattcggttttgaggcaaattgtgaattcagatgtggtactggatacgcccttcttcaattgcataatcaatgcatacggtcaggctggtgatctggctacgatgaaggaactgtacctacaaatggaagagagaaaatgtaagcctgataaaatcacttttgccactatgatcaaaacctatgctgcgcatggaatctttgatgcagtccaggaactcgagaaacaaatgatttccactggtgagaattcaagttttctcttgtagctctgtttgataattgtatttgtggttgtttctaaaatatgtttcttccatttagttttaagatgtatgcaagaagaatcttatgggggtgatgtgataatttggtttgtg

SEQ ID NO: 8737 - DNA, 1494 bp, Arabidopsis thaliana
atggcattgatacaaaatcctgttcaaggaactacttccgcgtacgccaatgagatcgcacaacttggtttttctcgaagcgtggttcagcaacatatatcttcccctgtttattttcggtgtataccaactatttcaataacgcccacaatgtgttcgacaaaggtccccaacgaacgtacagagaaaatgaattctggtttgatctcaacaagacaccaagtagatcctaagaaagaattgtctcggattctgagaacagatgctgctgtgaagggcattgagaggaaagccaattccgaaaagtacttaactttatggccaaaagctgttctagaagctcttgacgaagctatcaaagagaatcgatggcagtctgctctcaagattttcaatcttcttaggaagcagcattggtatgaaccaagatgcaaaacttatacaaagctgtttaaagtgcttgggaattgtaaacagcctgatcaagccagcttgcttttcgaagttatgttatctgaaggattgaaaccaaccattgatgtgtatacctctcttatctctgtttatggcaaaagcgagcttctagacaaggcgttttctacacttgagtatatgaaatctgttagtgactgcaagccagatgtgttcacctttactgttctcatcagttgttgctgcaaactgggtcggtttgatctggttaaaagtatcgttcttgagatgtcgtatcttggagttggatgcagcacggttacttacaatactattattgatgggtatggaaaggctggaatgtttgaggaaatggaaagtgttctggctgatatgatcgaggacggagattctcttccggatgtttgtacgcttaactcgatcattgggtcatatggaaatggtcgcaacatgaggaagatggagagctggtatagtcggttccagctgatgggggtgcaaccggatatcactacatttaacatactgatcctgtcatttggaaaagctggtatgtataagaagatgtgctctgttatggattttatggagaaaaggttcttctccctgacgactgtcacttacaatatagtgattgagacgtttggaaaagctggaagaattgagaaaatggatgatgtattcaggaaaatgaagtatcaaggagtgaaaccaaactcaatcacttattgttcgcttgttaacgcgtatagcaaagcaggtcttgtcgttaagatagattcggttttgaggcaaattgtgaattcagatgtggtactggatacaccgttcttcaattgcataatcaatgcatatggtcaggctggtgatttggctacaatgaaagaattatacatacaaatggaagagagaaaatgtaagcctgataaaatcacttttgctactatgatcaaaacctatactgctcatgggatattcgatgcagtccaggaactcgagaaacaaatgatttcctctggtgagaatttagatatcctctaa

SEQ ID NO: 8738 - DNA, 1390 bp, Eutrema parvulum
cggtgattttcgttgtatagctttttgttcaatgacgcccacaacgtgttcgacgaaaaaccccaacgaacgtacaggaaaaatgagctctggcctgatctcaacaagacaccgagtagatactaagaaagagttgtctcggattctgagaacagacgctgctgttaagggcatcgagaggaaagccaactctgaaaagtacaatactttgtggccaaaagctgttcttgaagcacttgacgaggctatcatcgagaatcgatggcagtctgcgctcaagattttcaatcttcttaggaagcagcactggtatgaaccaagatgcaaaacgtacacaaagatgtttaaagtgcttgggaattgcaaacagcctgagcaagccagcttacttttcgaagtaatgttatctgaaggattgaaacccaccatcgatgtgtatacatctcttatagctgtttatggcaaatgcgaacttctagacaaggcctttgccatgcttgaatatatgaagtcggttagtgattgcaagccagatgtgttcacctttactgttctcatcagttgttgctgcaaacttggtcggtttgatctggttaaacgcatccttgttgagatgtcgtatcttggagttagatgcagcacggttacttataatactattattgatgggtatggaaaggcaggcatgtttgaggaaatggaaaatgttctggctgatatgattgaggatggagattctcttccagatgttttcacgtttaactcgatcgttggttcatatggaaatggtggcaacacgaggaagatggagagctggtataatcgtttccagctgatgggggtgcaaccagacatcactacgtttaacatattgatcctgtcgtttggaaaggctggaatgtataagaagatgagctctgttattgatttcatggagaaaagattcttctccccgacgactatcacttacaatatagtgatccaaacgtttggaaaagcaggaagaatcgagaaaatggatgatatgttcaggaaaatgaaatatcaaggagtgaaacccaactctatcacttattcttcacttgttagtgcgtatagcaaagctggtcttgtggttaagatagattctgttttgaggcaaattgtgaattcagatgtggtactggatacagcattcttcaattgcataatcaatgcatacggtcaggctggtgatttggcaacgatgaaggaattgtacatacaaatggaagagagaaaatgtaagcctgataaaatcacctttgccactatgatcaaaacctatgctgttcatgggatatttgatgcagtccatgaactcgagaaacagatgatttccactggtgagaattcaagtattctcttgtag

SEQ ID NO: 8739 - DNA, 1500 bp, Eutrema parvulum
cggtgattttcgttgtatagctttttgttcaatgacgcccacaacgtgttcgacgaaaaaccccaacgaacgtacaggaaaaatgagctctggcctgatctcaacaagacaccgagtagatactaagaaagagttgtctcggattctgagaacagacgctgctgttaagggcatcgagaggaaagccaactctgaaaagtacaatactttgtggccaaaagctgttcttgaagcacttgacgaggctatcatcgagaatcgatggcagtctgcgctcaagattttcaatcttcttaggaagcagcactggtatgaaccaagatgcaaaacgtacacaaagatgtttaaagtgcttgggaattgcaaacagcctgagcaagccagcttacttttcgaagtaatgttatctgaaggattgaaacccaccatcgatgtgtatacatctcttatagctgtttatggcaaatgcgaacttctagacaaggcctttgccatgcttgaatatatgaagtcggttagtgattgcaagccagatgtgttcacctttactgttctcatcagttgttgctgcaaacttggtcggtttgatctggttaaacgcatccttgttgagatgtcgtatcttggagttagatgcagcacggttacttataatactattattgatgggtatggaaaggcaggcatgtttgaggaaatggaaaatgttctggctgatatgattgaggatggagattctcttccagatgttttcacgtttaactcgatcgttggttcatatggaaatggtggcaacacgaggaagatggagagctggtataatcgtttccagctgatgggggtgcaaccagacatcactacgtttaacatattgatcctgtcgtttggaaaggctggaatgtataagaagatgagctctgttattgatttcatggagaaaagattcttctccccgacgactatcacttacaatatagtgatccaaacgtttggaaaagcaggaagaatcgagaaaatggatgatatgttcaggaaaatgaaatatcaaggagtgaaacccaactctatcacttattcttcacttgttagtgcgtatagcaaagctggtcttgtggttaagatagattctgttttgaggcaaattgtgaattcagatgtggtactggatacagcattcttcaattgcataatcaatgcatacggtcaggctggtgatttggcaacgatgaaggaattgtacatacaaatggaagagagaaaatgtaagcctgataaaatcacctttgccactatgatcaaaacctatgctgttcatgggatatttgatgcagtccatgaactcgagaaacagatgatttccactggtgagaattcaagtattctcttgtagctccgtttggtgattgtaattgtggttgtttctaaactctgtgtcttccatttggttttaagatgtaggcaagaagaggcttgtggggtgaagtggtttgtgatttgagc

SEQ ID NO: 8740 - DNA, 2475 bp, Sorghum bicolor
gcctgcccgccccatccgcttcatcactcctttcttcccctgtttctcctcgaacccagcagcgccttcttccgtcttcccgccctgcctcaggcctcagccatgcccgtcgcggcgctccaccctcccccggtcgctgtcggcgcgggacgccgcagttgccgacgccaggcgcggtggttcgccctccgcgcgagctccctcgaggcgtcgtcggcggccgtgacggtggcagtgaatgggacggcggcggcaggggccgcggtggagaaggtgcaggaggataacgagggcctgtcggtgaaggaggatcaggacgagagggggctggaggtcctctacgacgacggcttcggctccgtgaccgtcaaggactacttcgcggcggccaaggtcctgtgcagcagggacgacggcgggccgccgcgctggttctcccccgtcgagtgcggccgcccggcagtggacgacgcgccgctgctgctcttcttgccaggaatggatggcgtcggcacggggctcatcctgcaccacaagtctttgggcaaagtattcgaggttcggtgtttgcatataccagtcaatgatcgtacaccattcgaagggttagtagaaactgttgaaaaatcgatcgagcatgagcatgatttatcacccgacagaccgatatatctagtcggagattcatttggtgggtccctggcagtggcagtggcggctcgtaatccacaaattgatttggttctcatactagtaaatccagctacatcgtttgcaaagactccattgcagccagtattgcctctactggaatcaatgccaagcgagtttcatgttacagtgccttatcttctcagttttgtcatgggtgatccactgaagatggctgcagttagcattgaaaacaacctatctcctccagaaactctacagaaattgtcagacagtctcacatcaatgcttcctttgctttcagaattgtctgatattataccaagggatactcttttgtggaagctcaaacttcttaaggcaggagcagcctatgcaaattctcgtcttcatgctgtgcaagccgaagttctacttcttgccagtggtaaggacaatcttctacctagtggagaagaagcggatcgactcttcaaggcactgaaaaactgcagagttcgatacttcaaggacaatggtcatacactactcttggaggatggtgtcaatctgttatctgtcataaaaggagcaaacatgtatcgccgtggaaggcaaagggattttgtaaccaattatctcccccctactttaagtgaattcaagcaaacatttgatgtggatcacaaactgtttcaccttgcactgagcccagtcatgatgtctaccctgaagaatggaaaagttgttcgcgggctttctggtgttcctgataaaggtcctgtcttgtttgtgggctatcatgcgctgatgggtattgagttgagtcctctgtatgaagagttccttagggagaagaagacagttgttcgtggcatggctcatccatttctgtttggaaacaaatttgactcatcgcgccaggagatatctcggatcgatactgtttctatgtatggtggattaccggtcaccccaatcaatatgtacaggttattcaagaggaatgactttgttctgctttatcctggcggagttcgggaagctctgcataggaagggtgaagaatacaagttgttttggccagatcaaccagaattcgtaagaatggccgcgcgctttgatgttactatcataccctttgggtgtgtaggagaggatgacgttctagagttggttctcgattacaatgatcagaagaacattcccggacttcgggagtggatagagtcaatcaacaaagaagccgagagagtgagggacagcgtaaaaggggaggatggaaatcaagacatgtacttgccagctcttctcccaaaagtacctggtcgattctactatctattcggccaaccgattgaaatgaaagggatgaacaaccttgtcagagatagaaagaggaccaacgaggtgtatttacgtatcaaatcagaagtggaggagataatgtcatatctcaagaggaagagagaggaagacccttacaggagtatagcgcagcgtgcgctgtaccaggcaacatggggcgcctctgctcaggtcccaacttttgagccatgaagatttggtgcagaaatgtttgtgtgattggatatttagaagttcacacaaacgacgacaggagaacagcgactaccatttctgtgtgaaagtagggaagggcatctacgagctgcaattcattgaccggatgtaatgcattctgatttctgaggaaatctccctcatgctgtacagaagtagattacgtatagtatacagaaaaaatgtatatttttagaaaaactgaaataataattttaaataaaaagcacactaagcgca

SEQ ID NO: 8741 - DNA, 3005 bp, Sorghum bicolor
tttgatgtcataaacataatttatttccatccttggggcatggtttaaatctcctgtaaaattaaaaacaatggctactcggcagacacgtggcatctatataacaacagaaaagccattctaacccaatcattcacgagagaaccagtaacaaaactgtgtactacgtggtacgtgccagtatattttaatctatcgtccactgcctgcccgccccatccgcttcatcactcctttcttcccctgtttctcctcgaacccagcagcgccttcttccgtcttcccgccctgcctcaggcctcagccatgcccgtcgcggcgctccaccctcccccggtcgctgtcggcgcgggacgccgcagttgccgacgccaggcgcggtggttcgccctccgcgcgagctccctcgaggcgtcgtcggcggccgtgacggtggcagtgaatgggacggcggcggcaggggccgcggtggagaaggtgcaggaggataacgagggcctgtcggtgaaggaggatcaggacgagagggggctggaggtcctctacgacgacggcttcggctccgtgaccgtcaaggactacttcgcggcggccaaggtcctgtgcagcagggacgacggcgggccgccgcgctggttctcccccgtcgagtgcggccgcccggcagtggacgacgcgccgctgctgctcttcttgccaggaatggatggcgtcggcacggggctcatcctgcaccacaagtctttgggcaaagtattcgaggttcggtgtttgcatataccagtcaatgatcgtacaccattcgaagggttagtagaaactgttgaaaaatcgatcgagcatgagcatgatttatcacccgacagaccgatatatctagtcggagattcatttggtgggtccctggcagtggcagtggcggctcgtaatccacaaattgatttggttctcatactagtaaatccagctacatcgtttgcaaagactccattgcagccagtattgcctctactggaatcaatgccaagcgagtttcatgttacagtgccttatcttctcagttttgtcatgggtgatccactgaagatggctgcagttagcattgaaaacaacctatctcctccagaaactctacagaaattgtcagacagtctcacatcaatgcttcctttgctttcagaattgtctgatattataccaagggatactcttttgtggaagctcaaacttcttaaggcaggagcagcctatgcaaattctcgtcttcatgctgtgcaagccgaagttctacttcttgccagtggtaaggacaatcttctacctagtggagaagaagcggatcgactcttcaaggcactgaaaaactgcagagttcgatacttcaaggacaatggtcatacactactcttggaggatggtgtcaatctgttatctgtcataaaaggagcaaacatgtatcgccgtggaaggcaaagggattttgtaaccaattatctcccccctactttaagtgaattcaagcaaacatttgatgtggatcacaaactgtttcaccttgcactgagcccagtcatgatgtctaccctgaagaatggaaaagttgttcgcgggctttctggtgttcctgataaaggtcctgtcttgtttgtgggctatcatgcgctgatgggtattgagttgagtcctctgtatgaagagttccttagggagaagaagacagttgttcgtggcatggctcatccatttctgtttggaaacaaatttgactcatcgcgccaggagatatctcggatcgatactgtttctatgtatggtggattaccggtcaccccaatcaatatgtacaggttattcaagaggaatgactttgttctgctttatcctggcggagttcgggaagctctgcataggaagggtgaagaatacaagttgttttggccagatcaaccagaattcgtaagaatggccgcgcgctttgatgttactatcataccctttgggtgtgtaggagaggatgacgttctagagttggttctcgattacaatgatcagaagaacattcccggacttcgggagtggatagagtcaatcaacaaagaagccgagagagtgagggacagcgtaaaaggggaggatggaaatcaagacatgtacttgccagctcttctcccaaaagtacctggtcgattctactatctattcggccaaccgattgaaatgaaagggatgaacaaccttgtcagagatagaaagaggaccaacgaggtgtatttacgtatcaaatcagaagtggaggagataatgtcatatctcaagaggaagagagaggaagacccttacaggagtatagcgcagcgtgcgctgtaccaggcaacatggggcgcctctgctcaggtcccaacttttgagccatgaagatttggtgcagaaatgtttgtgtgattggatatttagaagttcacacaaacgacgacaggagaacagcgactaccatttctgtgtgaaagtagggaagggcatctacgagctgcaattcattgaccggatgtaatgcattctgatttctgaggaaatctccctcatgctgtacagaagtagattacgtatagtatacagaaaaaatgtatatttttagaaaaactgaaataataattttaaataaaaagcacactaagcgcaataactgaaaatagataaaagaaattgtatgtaacaccccagacgccacaaaagcctaggatgtcactatctcttccctcatgccaaattctaaaacttggcaacataaacccattaacaatgtaaagcgcagaagcaagaccaacgatgaaaccattattaaaataggctccaccccatttaatattatcaaatcatgaggggtcaccatgactaataaattaattttattacatcaatccaaacccaacattaatcattaataactctatgtgtgggtgaatcagtgaagatgtgctgcaaatcccctcccttccatgcaagca

SEQ ID NO: 8742 - DNA, 2539 bp, Setaria italica
tcgtccactgcccaccccatccgctccagtcgatccctctctacttctctagctcccctgtttcaccttcagctcctctgttttctcctcctgtcttcccgcccagccgtgccccatgcccgtcgccgcgctccaccccctcccggccgtcgtcggggccggccgccgagggttccgacgccaggcgcggttcggcctccgcgcgagctccctggagtcgccgtcggcggccgtgacggtgctgaatggcgtggcaggggcgcccgtggagaggatggagaaggtgaaggaggataaggccgatgtgccagtggtgaaggacgaggatgagaagaaggggctagacgtcctctacgacgacggcttcggcagcgtcaccgtcaaggactacttcgcggcggccaaggccgtgtccagggacgacggcggcccgccgcgctggttctgccccgtcgagtgcggccgcccggcggtggacgacgcgccgctgctgctcttcttgccaggaacggatggcgtcgggatggggctcatcctgcaccacaagtcgttgggcaaagtattcgaggttcgttgcttgcatataccaatcaatgatcgtacgccatttgaagggttgctacaaaccgtcgaaaatactatcgagcatgagcatgatttatcaccaaacagaccaatataccttgttggagattcatttggtggatgccttgcagtggcagtggcagctcgtaatccacaaattgatttggttctgatactagtaaatccagctacatcatttgcaaggactccattgcagccaatattgcctcttctggaatcaatgccaagcgagtttcatgttacagttccatatcttctcagttttgtcatgggtgaccctctaaagatggcttcggttagcattgaaaacaacctatctcctccagaaactctacagaagttgtcagacagtctcacttcaatgctgcctttgctttcggagttggcagatattataccaagagatactcttttgtggaagttaaaacttctcaagaccggagcagcctatgcaaattctcgtcttcatgctgtacaagcagaagttctacttcttgccagcggtaacgacaatcttctaccaagcggagatgaagcagatcgactcttcaaggcactgaagaactgcagagttcgatacttcaaggacaatggtcatacactactcttggaggatggtgtcaatctgttatctgtcataaagggagtaaacatgtatcgccgcagaaggcaaagggattttgtaactgattatctccctcctactttaagtgagttcaagaaaacatttgatgaggatcacaaactttttcaccttgcactgagcccagtcatgatgtctacgctgaagaatggaaaaattgtccgtggtctttctggcattcctgatcagggtcctgtcttgttcgtgggctatcatgcgctcatgggtatcgaattgagtccactgtatgaagagttcttgagggagaagaaaacaattgttcgtggcttggctcatccatttttgtttggaacaaaatttgagtcttcgcgccaggagttatctcggttggatacagtttctatgtatggtggactaccggtcaccccaattaatatgtacaggttatttgagaggaatgaatttgttctgctttatcctggtggtgttcgtgaagcccttcataggaagggtgaagaatacaagttgttttggccagatcaaccagaatttgtaagaatggcggcacggtttggggtgactgtcataccctttgggtgtgtaggagaagatgatgttctagagttggttctggattacaatgatcagaagaacatccctggccttcgggaatggatagagtcagtcaacaaagaagctgacagagtgagggatagtgtcaaaggggaggatgggaatcaagacatgtacttgcctgctcttctcccaaaagtacctggtcgattctactatctattcggcaaaccgattgaaatgaaagggatgaacagccttgtcagagacagaaagagtgcaaatgatgtgtatctacgcataaaatcagaagtggaggagataatgtcgtatctaaagaggaagagggaggaagacccttacaggagtattgcgcagcgtgcgctataccaggcaacatggggcacctctggtcaagtcccaacttttgaaccatgaagatcaggtgcagagaaatgttagtgtgattggatatttgaaagctcacacaaacagaataggagaaagaattggtgaacgtagggcaggacatctgcaactgcaagcgattgcgattctttgatcagatgcaatgcattcggaggaaatttcctcccttacacattgtacagaagtagattacatgtactatacagaaaaaaatattgcatgtgtatatttttctgacagttttccgactggggtgtaagtggtttatcaatatgattagcacgatatattcatgtttgttcaaacaaaggatcaccattccttttt

SEQ ID NO: 8743 - DNA, 2571 bp, Setaria italica
ctcgcttagaaaaccaatagcagtcgtccactgcccaccccatccgctccagtcgatccctctctacttctctagctcccctgtttcaccttcagctcctctgttttctcctcctgtcttcccgcccagccgtgccccatgcccgtcgccgcgctccaccccctcccggccgtcgtcggggccggccgccgagggttccgacgccaggcgcggttcggcctccgcgcgagctccctggagtcgccgtcggcggccgtgacggtgctgaatggcgtggcaggggcgcccgtggagaggatggagaaggtgaaggaggataaggccgatgtgccagtggtgaaggacgaggatgagaagaaggggctagacgtcctctacgacgacggcttcggcagcgtcaccgtcaaggactacttcgcggcggccaaggccgtgtccagggacgacggcggcccgccgcgctggttctgccccgtcgagtgcggccgcccggcggtggacgacgcgccgctgctgctcttcttgccaggaacggatggcgtcgggatggggctcatcctgcaccacaagtcgttgggcaaagtattcgaggttcgttgcttgcatataccaatcaatgatcgtacgccatttgaagggttgctacaaaccgtcgaaaatactatcgagcatgagcatgatttatcaccaaacagaccaatataccttgttggagattcatttggtggatgccttgcagtggcagtggcagctcgtaatccacaaattgatttggttctgatactagtaaatccagctacatcatttgcaaggactccattgcagccaatattgcctcttctggaatcaatgccaagcgagtttcatgttacagttccatatcttctcagttttgtcatgggtgaccctctaaagatggcttcggttagcattgaaaacaacctatctcctccagaaactctacagaagttgtcagacagtctcacttcaatgctgcctttgctttcggagttggcagatattataccaagagatactcttttgtggaagttaaaacttctcaagaccggagcagcctatgcaaattctcgtcttcatgctgtacaagcagaagttctacttcttgccagcggtaacgacaatcttctaccaagcggagatgaagcagatcgactcttcaaggcactgaagaactgcagagttcgatacttcaaggacaatggtcatacactactcttggaggatggtgtcaatctgttatctgtcataaagggagtaaacatgtatcgccgcagaaggcaaagggattttgtaactgattatctccctcctactttaagtgagttcaagaaaacatttgatgaggatcacaaactttttcaccttgcactgagcccagtcatgatgtctacgctgaagaatggaaaaattgtccgtggtctttctggcattcctgatcagggtcctgtcttgttcgtgggctatcatgcgctcatgggtatcgaattgagtccactgtatgaagagttcttgagggagaagaaaacaattgttcgtggcttggctcatccatttttgtttggaacaaaatttgagtcttcgcgccaggagttatctcggttggatacagtttctatgtatggtggactaccggtcaccccaattaatatgtacaggttatttgagaggaatgaatttgttctgctttatcctggtggtgttcgtgaagcccttcataggaagggtgaagaatacaagttgttttggccagatcaaccagaatttgtaagaatggcggcacggtttggggtgactgtcataccctttgggtgtgtaggagaagatgatgttctagagttggttctggattacaatgatcagaagaacatccctggccttcgggaatggatagagtcagtcaacaaagaagctgacagagtgagggatagtgtcaaaggggaggatgggaatcaagacatgtacttgcctgctcttctcccaaaagtacctggtcgattctactatctattcggcaaaccgattgaaatgaaagggatgaacagccttgtcagagacagaaagagtgcaaatgatgtgtatctacgcataaaatcagaagtggaggagataatgtcgtatctaaagaggaagagggaggaagacccttacaggagtattgcgcagcgtgcgctataccaggcaacatggggcacctctggtcaagtcccaacttttgaaccatgaagatcaggtgcagagaaatgttagtgtgattggatatttgaaagctcacacaaacagaataggagaaagaattggtgaacgtagggcaggacatctgcaactgcaagcgattgcgattctttgatcagatgcaatgcattcggaggaaatttcctcccttacacattgtacagaagtagattacatgtactatacagaaaaaaatattgcatgtgtatatttttctgacagttttccgactggggtgtaagtggtttatcaatatgattagcacgatatattcatgtttgttcaaacaaaggatcaccattccttttttggtaaaac

SEQ ID NO: 8744 - DNA, 2670 bp, Panicum virgatum
aaaactaatagcaatcgtcagtgcccgccccatccgctccctacctctccagctcccctgctcctctgtttcttcttccgtcttcccgcccaggcctagccgccgtgagccgtggccatgcccgtcgccgcgctccaccctctcccggccatcgtcggggccggccgccgcagggcccgacgccaccggcgtttcggcctccgcgcgagctccctggagtcgccgtctgtggcctcgacggcgctggatggcgtggcagggcccccggtggagaggaaggagaaggtgaaggacgatgcggcggcggcggagaaggaagagaacaaggggctgcacgccctctacgacgacggcttcggcggcgtcaccgtcaaggactacttcgcggcggccaaggccgtgtccagggacgacggcggcccgccgcgctggttctgccccgtcgagtgcggccgcccggcggtggacggcgcgccgctgctgctcttcctgccaggaacggatggcgtcggaatggggctcatcctgcaccacaagtcgttgggcaaagtattcgaggttcgttgcttgcacataccagtcaatgatcgtacaccatttgaagggttactacaaaccgttgaaaatactatcaagcatgagcatgatttatcacctaacagaccaatatacctcgttggagattcatttggtggatgccttgcagtggcagtggcagctcgtaatccacaaattgacttgcttctcatactagtaaatccagctacatcatttgcaaagactccattacagcccatattgcctcttttggaatcaatgccaagcgagtttcatgttacagttccgtatcttctcagttttgtcatgggtgaccccctgaagatggcttcggttagcattgaaaacaatctatctcctccagaaactctacagaaattgtcagatagtctcacttcaatgctacctttactttcggaattgccagatattataccaagggatactcttttgtggaaactcaaacttcttaagactggagctgcctatgcaaattctcgacttcatgctgtacaagcagaagttctacttcttgccagcggtagcgacaaccttctaccaagcagagatgaagcagatcgtcttttcaaggcactgaagaactgcagagttcgatacttcaaggacaatggccatacgctactcttggaggatggtgtcaatctgttatctgtcataaagggagtaaacatgtatcgccgtggaagacaaagggattttgtaaccgattatctccctcctactttaagtgagttcaagaaaacatttgacgaggatcacaaactttttcaccttgcactgagcccagttatgatgtctaccctgaagaatggaaaaattgtccgtagtctatctggcattcctgataagggtcctgtcttgtttgtgggctatcatgcgctcatgggtattgaattgagtccactgtatgaagagttcctgagggagaagaaaaaaattgttcgtggcttggctcatccacttttgtttggaacaaaatttgagtcttcgcgccaggaattatctcggttagatacagtttctatgtatggtggactaccggtcaccccaatcaatatgtacaggttatttgagaggaatgaatttgttctgctttatcctggcggtgttcgggaagctctgcatagaaagaacgaagaatacaagttgttttggccggatcaaccagaatttgtaagaatggctgcacggtttggtgttactgtcataccctttgggtgtgtaggagaggatgatgttctagagttggttgtggattataatgatcagaaaaacatccctggccttcgggaatggatagagtcagtcaacaaagaaactgacagagtgagggatagcgtcaaaggggaggatgggaatcaagacatgcacttgcctgctgttctcccaaaagtacctggcagattctactacctatttggcaaaccgatcgaaatgaaaggaatgaacaaccttgtcagagacagaaagagtgcaaatgaagtgtatcttcgcataaaatcagaagtggaggagataatgtcatatctaaagaggaagagggaggaagacccttacaggagtatagcgcagcgtgcgttataccaggcaacatggggcgtctctgctcaagttccaactttcgaaccatgaagatcaggtgcagaaatgttagtgtgattggatatttgaaatctcacacaaacaaagtaggtgaaagaatcggtgaaagtagggcaggacatctgtaactgcaagcttattgcgattctttgatcagatgcaaattacgcaatccattcagaggaaatttcctcccttacacactgtacagaagtacattacatgtactatgcagaaaaacattgcatgtgtatattttctgacagttttctgacgggggtgtaagtggtatactgatagtgattagcctgataatatttttttaagaaacaggaggggcaatgctcctctgattatatattaacaaggtgtctcaatcatgaaaaaaagaaattactgaattctagaaaagtaaaaaaattagaggaaaagatcctgtgcaataagcaagaaaactacagaaaaaaattcagagtaaactgaaacaaa

SEQ ID NO: 8745 - DNA, 2538 bp, Oryza sativa
aatcaatcattcccccgcctcatctcctctcctctcctcccccctgcttctccgaccaaagccgcgccgcgcattccgccgccatgtccgccgcgctccacacgctccccgccgtcgccgctggcggcctcggctgtcggtggcggcggccctccgcgacgctacgggcggcgagctccgtggggacggcgtcggtggcggtgtccgtgaatgcggagacgcagcagcagcggcaggtgggtgtggaggaggaggagaagaggagggaggatgcggcggaggtgaggacgggcagggtggtggaggctctctacgacgacgggttcggcggcgtcacggtgaaggactacttcgcggcggccagggccgtctccagcgacgacggcggcccgccgcggtggttctgccccgtcgacgccggccggccggcggtggacaacgcgccgctgctgctcttcttgccaggaactgatggtgttggaatggggctcattttgcaccacaagtctttgggaagggtattcgaggttcgctgcttgcatataccagtgaatgatcgtacgccatttgaagggttgttgcagattgtggaaaattctatcaaatatgagcatgctatgtcaccaaaccgacccatatatctcgtcggggactcatttggaggatgcctagcactttcggtggcagctcgtaatccacaaattgatctggttctcatactgattaatccagcaacgtcctttgcaaagactccgttgcagccgatattacctgtgttggaagcaatgccaagtgaacttcatgtcacagttccatatcttctcagttttgtcatgggcgatcctcttaaaatggctatggtcagcgttgagaacaacctttctcctccaaaaactctgcagaagttgtcagatagtctcacttccatgctgcctttgctttcagaattggcagatatcataccaagggatactcttttctggaaactcaagctgctgaagtcaggagcagcctacgctaactctcgtcttcatgctgtacaagctgaagttctacttcttgctagtggcaatgataatcttctgccaagtggagaagaggcagatagactcttcaaatcactgaaaaactgcagagttcggtacttcaaagacaatggccatacactactgttggaggacggtgttaatcttttatcagtcataaaaggagtaaatatgtaccgccgtggcagacaacgggatcctgtgacggattacattcccccgacattgagtgagttcaagaaaacattcgatgaagatcacaaattgtttcaccttgcattgagcccagtcatgctgtctaccctgaagaatgggaagattgttcgtggccttactggtgttcctgaccaaggtcctgtcttgtttgtgggttatcatgcactgatggggatcgagttgagtccattgtacgaggagttcttgagagagaagagaacaagtttccgtggtatggctcacccaattttatttggaggaaaacatgagagttcgcgacaggagctgtctcggttcgatacaatttctatgtacggtggattaccagtcactgcgatcaatatgtataggttgtttgagagaaatcaatttgttttgctctatccaggcggtgtgcgggaagctcttcacaggaagggtgaagcatacaagttgttttggccagaccaaccagaatttgtaagaatggcagcacgttttggtgttactatcataccatttggttttgtaggagaagatgatgttttagagttggtcgccgactacaatgatcaaaagaacattccctaccttcgggaatggattgagtcgattaaccgagaagcccaaagagtaagggatagcgtcaaaggagaggatggaaatcaagacgttcacatacctgctttgctccccaaagtgccaggccggttctactacctatttggcaaaccaatcgaaatgaaaggtatggataatgtcgtcagagataggaaaagtgcaaacgaagtgtatttgcatatcaaatccgaagtagagagcttaatgtcatatctgaagaggaagagggaggaagatccttacagaagcatagcgcagcgtgcagtgtaccaggcatcttggggtgcttctgcagaggtcccaacatttgaaccatgaaggttgggtgatctcgtggtactgtgattgaatgagcatcggcaatcttgtgttccgaagcaaacatggaaagggggtattatctgttggaagtaaatagcattttcagtaggctggctgcaagcctgcaactcttgaatcagttacacattttgatggaacatacccccaagtaggccattatacaagtgtatagtaaagtagaacagatatatctgaacagtttttttttgttatatattttaaccaatgtatagtgattgatatacagactagttactgatgaatggaattcttgctcatacataagggttccatctttttttttttctataatacaaaagtgatattcttgggc

SEQ ID NO: 8746 - DNA, 3502 bp, Oryza sativa
aaaaaatgaaaagcaccaacggccacgctacacctgtagtactcctacatggcaatctgcgggtgacgtcacctctttaagcccccccctttttttttgcgcccctcaaaaagctctgcgcgcatcaatcaatcattcccccgcctcatctcctctcctctcctcccccctgcttctccgaccaaagccgcgccgcgcattccgccgccatgtccgccgcgctccacacgctccccgccgtcgccgctggcggcctcggctgtcggtggcggcggccctccgcgacgctacgggcggcgagctccgtggggacggcgtcggtggcggtgtccgtgaatgcggagacgcagcagcagcggcaggtgggtgtggaggaggaggagaagaggagggaggatgcggcggaggtgaggacgggcagggtggtggaggctctctacgacgacgggttcggcggcgtcacggtgaaggactacttcgcggcggccagggccgtctccagcgacgacggcggcccgccgcggtggttctgccccgtcgacgccggccggccggcggtggacaacgcgccgctgctgctcttcttgccaggaactgatggtgttggaatggggctcattttgcaccacaagtctttgggaagggtattcgaggttcgctgcttgcatataccagtgaatgatcgtacgccatttgaagggttgttgcagattgtggaaaattctatcaaatatgagcatgctatgtcaccaaaccgacccatatatctcatcggggactcatttggaggatgcctagcactttcggtggcagctcgtaatccacaaattgatctggttctcatactgattaatccagcaacgtcctttgcaaagactccgttgcagccgatattacctgtgttggaagcaatgccaagtgaacttcatgtcacagttccatatcttctcagttttgtcatgggcgatcctcttaaaatggctatggtcagcgttgagaacaacctttctcctccaaaaactctgcagaagttgtcagatagtctcacttccatgctgcctttgctttcagaattggcagatatcataccaagggatactcttttctggaaactcaagctgctgaagtcaggagcagcctacgctaactctcgtcttcatgctgtacaagctgaagttctacttcttgctagtggcaatgataatcttctgccaagtggagaagaggcagatagactcttcaaatcactgaaaaactgcagagttcggtacttcaaagacaatggccatacactactgttggaggacggtgttaatcttttatcagtcataaaaggagtaaatatgtaccgccgtggcagacaacgggatcctgtgacggattacattcccccgacattgagtgagttcaagaaaacattcgatgaagatcacaaattgtttcaccttgcattgagcccagtcatgctgtctaccctgaagaatgggaagattgttcgtggccttactggtgttcctgaccaaggtcctgtcttgtttgtgggttatcatgcactgatggggatcgagttgagtccattgtacgaggagttcttgagagagaagagaacaagtttccgtggtatggctcacccaattttatttggaggaaaacatgagagttcgcgacaggagctgtctcggttcgatacaatttctatgtacggtggattaccagtcactgcgatcaatatgtataggttgtttgagagaaatcaatttgttttgctctatccaggcggtgtgcgggaagctcttcacaggaagggtgaagcatacaagttgttttggccagaccaaccagaatttgtaagaatggcagcacgttttggtgttactatcataccatttggttttgtaggagaagatgatgttttagagttggtcgccgactacaatgatcaaaagaacattccctaccttcgggaatggattgagtcgattaaccgagaagcccaaagagtaagggatagcgtcaaaggagaggatggaaatcaagacgttcacatacctgctttgctccccaaagtgccaggccggttctactacctatttggcaaaccaatcgaaatgaaaggtatggataatgtcgtcagagataggaaaagtgcaaacgaagtgtatttgcatatcaaatccgaagtagagagcttaatgtcatatctgaagaggaagagggaggaagatccttacagaagcatagcgcagcgtgcagtgtaccaggcatcttggggtgcttctgcagaggtcccaacatttgaaccatgaaggttgggtgatctcgtggtactgtgattgaatgagcatcggcaatcttgtgttccgaagcaaacatggaaagggggtattatctgttggaagtaaatagcattttcagtaggctggctgcaagcctgcaactcttgaatcagttacacattttgatggaacatacccccaaataggccattatacaagtgtatagtaaagtagaacagatatatctgaacagttttttttttgttatatattttaaccaatgtatagtgattgatatacagactagttactgatgaatggaattcttgctcatacataagggttccatcttttttttttctataatacaaaagtgatattcttgggctctgaactaaggagttgctaagtccagttgccagctgaacctgttgtaactacctgattataagaccacctttgcggctttgccattggattgtacacattgcagcaggggggggattaagcatcaccaaatttttgatgaacatccaggcataaaatttatagaaaccagacaatatgatcttcaaaactgaaacgcgaggagatactggtaactgataccatatctttaaggtacaaaatctgtaactgatggaatgcaatgacccaacaagaccaaattgaagttgaatagtaaactctctagattctccagattgctttctcaaattaaaaaaaaaaatctccagattgcaaagtaggtgttttaacattttgcgtgcattctaagctcctaatttcctagacggctaacaagctgaaacaatttgcacatacttcagctttactccatttctgtttatgtagaagtaaaatttcattcaacatcgaatcccttctcttggagttcttgtacgacctcattcctcatccgaaaccagagcttctgtgcttcttggtcaaacttttttgactgcaattgtttctgcatgttatcagagtccatgttggaatcagcaaaacctttgggtccaattgtggtgcctagagcacctccactttttatgaactcctcaactgcctcttcatcacctgggtatggaaacatcctgcgctcgtaaaggtgggccatttctctttcttcctgagaaacatggaagataacatatcagaaaggataacttgaataagagtaagccgaaagaagtgttaggttcttagcacatatatggccatag

SEQ ID NO: 8747 - DNA, 2347 bp, Secale cereale
tcttcaagtaactcctccgtttctccaacccaaaagcatcatttccatctccagcaatgtccattcccgccctccgctccttccccgccgtctacggcgtgaagccggccgcgcgccttgtccgacaccattcccggctcggcggcagcctccgggccagctccgtcgccgtgaacggggaggtggggctgagaaacaggggtgggaagaaagaggacgcggcgaaggaggaggacagaggactggagcccctctacgacgacgggttcgggggcgtgaccgtcaaggactacttcgcggccgccagggccctgtgcaaggacgacggagggccgccgcggtggttcagccccgtggagtgcggcaagccggcggtggaggacgcgcccctgctgctcttcttgccaggaactgatggtgttggcatgggactcattttgcaccacaagtctttgggcaaggcctttgaagttcgttgtttgcatataccagtgaatgatcgtacaccatttgaagggctactacaaattgtcgaacaatctatccaatatgagcatgatttatcaccaaacagaccaatatatcttgttggagattcctttggtggatgcctggcgcttgcagcggcagctcgtaatccacacattgatttggtcctcctactggtaaatccagcaacatcgtttgcaaggactccattgcagccaatattgcctcttttggaagcaatgccaagcgacctccatgttacagttccgtatcttcttagttttgttatggctgaccctctgaagatggctatggttagcattgagaacaacctttctcctccagaaactcttcaaaagctgtcagaaagtctcacttctttgctgcctttgctttcacaattggcagatatcataccaagggatgctcttttgtggaagctcaagcttcttaagtcaggagcagcctatgccaactctcgtcttcatgctgtacaagctgaagttctgtttcttgccagtggcaaagacaatcttctgccaagtggagaagaggcagatcgactcttcaaggcactgaaaaactgcagagttcgatacttcaaggaaaatggtcatacactactcttggaggatggtgtgaatctgttatctgttataaaaggtgcaaacatgtaccgccgtggcaggcaacgggactttgtgaccgattacctcccccctacactaagcgagttcaaaaaaacatttgatgaagaccacaaattgtttcaccttgcactgagcccagtcatgatgtctactctgacaaatggaaaaattgtccgtggcctcgctggtgttcctgaccaaggtcctgtcttgtttgtgggttaccatgcactaatggggattgagttaagcccattgtatgaagagtttctgagggagaagaacacgattgttcgtggcatggctcatcctgtgttgtttggatcaaattatgagacctcacgccaagagttctctcggtttgatacggtctctatgtatggcggtttaccagtcactccaatcaatatgtacaggctgtttgagagaaatcaatatgttctcctctatcctggtggtgttcgggaagctctacatagaaagggtgaagaatacaagttattttggccagaccagccagaatttgtaaggatggcggcaaggtttggtgttacagtcgttccatttgggtttgtcggagaagatgacattttagagttggttctggattacaatgatcaaaagaacattccataccttcgggagtggatagagtcaatcaacaaagacagccggagagtgagagatagcgtcaaaggagaggaagggaatcaggacatgcacatacctgctattgttcccaaagtacccggacgattctactacctttttggcaaaccaatcaaaatggaagggatgaacaatgttctgacggatagggagagcgcaaatgaagtgtatttacatatcaaatcagaagtcgagaacgcaatggcgtacttacagaggaagagggaggaagacccttacaggagtatagctcagcgtgccgtgtatcaggctactcagggtgtttctgctcaagtcccaacttttgaaccatgaagactaggtgcaaatatattcctgtgatagtgtgactgcacattggcagatagaagatatccattatagcagagtataacacagtatataatgtgtagctaacaaatgtatctgaatatatttttattattgttttgaatgtacatgttacttactcactgatagtgattaattaacaccaaaatattgctgactatttgatacttgttcacaataaagggtct

SEQ ID NO: 8748 - DNA, 2470 bp, Triticum aestivum
gtaactcctccgtttctgcaacccaaaagcaccatccatctccagcaatgtccattcccgccctccgctccttccccgccgtctacggcgtgaagccgaccgcccgcctggtccgacaccattcccggctcggcggcggcctccgggccagctccgtcgccgtgaacggggaggtggggctgagaaacaggagcgggaagaaagaggacgcggtgaaggaggagaaggacagaggactggagcccctctacgacgatgggttcgggggcgtgaccgtcaaggactacttcgctgccgccagggccctgtgcaaggacgacggagggccgccgcggtggttcagccccgtcgagtgcggccagccggcggtggaggacgcgcccctgctgctcttcttgccaggaactgatggtgttgggatggggctcattctgcaccacaagtctttgggcaaggcctttgaagttcgttgtttgcatataccagtaaatgatcgtacaccatttgaagggctattacaaattgtcgaaaaatctatccaatatgagcatgatttatcaccaaacagaccgatatatcttgttggagattcctttggtggatgcctggcgcttgcagcggcagctcgtaatccacacatcgatttggtcctcctactggtaaacccagcaacatcatttgcaaagactccactgcagccaatattgcctcttttggaagcaatgccaagcgaccttcatgttacagttccgtatcttcttagttttgttatggctgaccctctgaagatggctatggttagcattgagaacaacctttctcctccagaaactcttcaaaagctgtcagaaagtctcacttctttgctgcctttgctttcacaattggcagatatcataccaagggatgctcttttgtggaagctcaagcttcttaagtcaggagcagcctatgccaactctcgtcttcatgctgtacaagctgaagttctgtttcttgccagtggcaaagacaatcttctgccgagtggagaagaggcagatcgactcttcaaggcactgaaaaactgcagagttcgatacttcaaggaaaatggccatacactactcttggaggatggtgtgaatctgttatctgttataaaaggtgcaaacatgtaccgccgtggcaggcaacgggactttgtgaccgactaccttccccctacactaagtgagttcaagaaaacatttgatgaagaccacaaattgtttcaccttgcactgagcccagtcatgatgtctactctgacaaatggaaaaattgtccgtggccttgctggtgttcctgaccaaggtcctgtcttgtttgtgggttatcatgcactgatggggatcgagttaagcccattgtatgaagagtttttgagggagaagaacacgattgttcgtggcatggctcatccaatgttgtttggatcaaaatatgagacctcgcgccaggagtcgtctcggcttgatacagtctctatgtatggcggattaccagtcactccaatcaatatgtacaggctgtttgagagaaatcaatatgttctcctctatcctggtggtgctcgggaagctctacataggaagggtgaagaatacaagttgttttggccagatcagccagaatttgtaaggatggcggcaaggtttggtgttacagtcgttccatttgggtttgtcggagaagatgacattttagagttggttctggattacaatgatcaaaagaacattccgtaccttcgggagtggatagagtcaatcaacaaagacggccagagagtgagagatagcgtcaaaggagaggaagggaatcaggacatgcacatacctgctattgttcccaaagtacccggacgattctactacctttttggcaaaccaatcaaaatggaagggatgaacaatgttctgacggatagggagagcgcaaatgaagtgtatttacatatcaaatcagaagtcgagaacgcaatggcatacttacagaggaagagggaggaagacccttacaggagtatagctcagcgtgctgtgtaccaggcaactcagggtgtttctgctcaagtcccaacttttgaaccatgaagactaggtgcaaatatattcctgtgatagtgtgactgcacattggcagatagtaggtatccattatagcagagtataacacagtacataatgtgtagctaacagatgtatctgaatatttgtattatgttttgaatgtacatgttacttactcattagtagtgattaattaacaccaaaatgttactgattatttgatacttgttcacaataaagggtctcttttatctctctactatgtagtcaatgtgaaagcacaccacctaaagtgacaggtgcaccagatgtgttcacctttgtgacaacttctttaggagaagatgttatactggctaccaacgattttatttatt

SEQ ID NO: 8749 - DNA, 3057 bp, Sorghum bicolor
ccacccccgcctcgccgcctcctccccgccccgctttgccgtttccgaccgccaactcgccaaggctgagccgagccggggctgccgcctaccggaatccccgccgcggaggaggctgctgtgttatattgggggtggctctagcctctaggattggaggggctctggttggttgcctagacgttcgccgccgcctctcccctgccccgaccgcgaggctccgtcgccggcgatggcgtcgccggccggcggcgggtctccggctaagcccgtcctcctgcacggcgacctcgacctctggatcctcgaggcgcgcctgctgcccaacatggacatgttctccgagcatgtccgccgctgcctcgccgcatgccgcccgcccagctcctgcgggaccaagcacccgaccgccgccgcgcgcggccccggcggcggccgcggcggccgccaccaccaccggaagatcatcaccagcgacccctacgtcacgctgtccgtgtccggcgccgtcgtggcgcgcaccgccgtcatccccaactcccaggaccccgtctgggaggagcgcttcgccgtgccgctcgcgcaccgcgccgccgagctcgagttccaggtcaaggacaacgacaccttcggcgcgcaggccatcggcaccgtcaccgtccccgccgaacgcgtcgtgtcgggcgacgaggtcgaggactggttccccgtcataggcaccaacggcaagccgtacaaacccgacaccgcgctgcgcctccgcttcaagttccagcccatcgccaacaacccggcctaccgccacggcatcgccggcgaccctgaccacaggggcatcgaggactcctacttcccgctccgccacggcggccaagtcacgctgtaccaggacgcgcacgtcagggaaggggacctgcccgagattgagctcgacgacggcaagacgttccagcacaacgcgtgctgggaggacatctgccacgccatcctagaggcgcaccacatgatatatatcgtcggctggtcggtgtacgataaggtgcggctcgtacgcgagccatcgccgtcgcggccattgcctgagggtggcgaccttacgcttggcgacctgcttaagttcaagtcgcaggagggtgtcagagtgtgcctgctggtgtgggatgacaagacttcgcatgacaagttcttcatcaagacgggtggagttatggcaactcatgatgaagaaactcggaagtttttcaaacattcctcagtcatctgtgttctctctcctagatatgctagcaataagctgagcattttcaaacagcaggttgttgggactttgtttacacaccatcaaaagtgtgtgctggttgatacacaagccaggggaaacaagcggaaaattacagctttcattgggggcctagatctttgtgatggccgctatgacacacctgaacacaggcttttcaaagatcttgacacagtattccaaaatgattaccataaccctacattttcagcaggtgcaaagggacccaggcaaccatggcatgatttacattgcaggattgatggtcctgctgcctatgatgtcttgcttaattttgagcaaaggtggcgaaaggcaacaaaatggcgtgaccggtttagaagagtatctcattggaaagacgatgctttaattaagctggagcgtatatcatggattctaagcccttcacccaatgttccaaatgatcatcctagtttgtgggtttcaaaggaagaagatcatgaaaagtggcatgttcaggtatttcggtcaattgactctggttccctaaaaggatttcctagtgatagcaaagaagcttcaaagctgaatcttgtgtgccggaaaaacttggtaattgataagagcatccacactgcatacgtccgagcaatcagatctgcacagcatttcatttatattgaaaaccagtattttcttggttcttcatatgcttggccgtcctatgtgaattcaggtgctgataatctgataccaatagaactggccctcaaaattgcaagtaagattagagcgggagaacgctttgcagtgtatgtagtgataccaatgtggcctgaaggagtccctactgcagcatctgtgcaagaaatccttttctttcaggcccagacaatggagatgatgtataaaataattgcagatgagctcaaggcaatggacattaaggatatgcaacttgaagattacttgaacttcttttgtcttggaaaccgggaagaaccaccatctaatggcagcccagaatcagagaaatctacagataaaagtgcagcgggcttagctacaaaatatcgacggttcatgatctatgttcacgcaaaagggatgattgtggatgatgaatatgtcattctgggttcagcaaacatcaaccagagatccctggctggttctagagatactgaaattgcaatgggtgcataccaacctcattatgcatggtctacaaagaatggacatcctcatggccaggtatacgggtatagaacgtctctctgggcagagcaccttggaacggttgatgatcgcttcaaggatccttcgagtttggagtgtgtaaggcgtgtgaatcaaatagctgtagagaactggcaaaggtttacagccgaagaaatgagtacattacaagggcacctcctcaagtacccagttaaggtggaggctgatggtaagatcagctcactgccagaccaagaatgctttcctgatgttggcggcaagattctgggagcttcaacttcacttcctgattcgctgaccatgtagagttattattacattttttttttcagagtcgagcttcgtaattgtctaaacttggtgcaattgtcactgaacttgtactgtatctgtaatcatccatagttggcgcagggaaagctcaaggtgtcggtggtgtttgtagagtcgtgctcctgtaagttttcccagcatttgtaaatgaaccatatgataggatccttgacaatgcttccatttccattgctattatacaactgttctgaacattt

SEQ ID NO: 8750 - DNA, 3280 bp, Sorghum bicolor
tttttttgcagggcaccactccgcatcagaggaaatcacaccaccaaacggtggagtaaaaaactcactctgatattaaacgcaactaaaatcgccatactatttcgagctaaattgccaaatctcgagatccagccagccgaaccgcaccccacccccgcctcgccgcctcctccccgccccgctttgccgtttccgaccgccaactcgccaaggctgagccgagccggggctgccgcctaccggaatccccgccgcggaggaggctgctgtgttatattgggggtggctctagcctctaggattggaggggctctggttggttgcctagacgttcgccgccgcctctcccctgccccgaccgcgaggctccgtcgccggcgatggcgtcgccggccggcggcgggtctccggctaagcccgtcctcctgcacggcgacctcgacctctggatcctcgaggcgcgcctgctgcccaacatggacatgttctccgagcatgtccgccgctgcctcgccgcatgccgcccgcccagctcctgcgggaccaagcacccgaccgccgccgcgcgcggccccggcggcggccgcggcggccgccaccaccaccggaagatcatcaccagcgacccctacgtcacgctgtccgtgtccggcgccgtcgtggcgcgcaccgccgtcatccccaactcccaggaccccgtctgggaggagcgcttcgccgtgccgctcgcgcaccgcgccgccgagctcgagttccaggtcaaggacaacgacaccttcggcgcgcaggccatcggcaccgtcaccgtccccgccgaacgcgtcgtgtcgggcgacgaggtcgaggactggttccccgtcataggcaccaacggcaagccgtacaaacccgacaccgcgctgcgcctccgcttcaagttccagcccatcgccaacaacccggcctaccgccacggcatcgccggcgaccctgaccacaggggcatcgaggactcctacttcccgctccgccacggcggccaagtcacgctgtaccaggacgcgcacgtcagggaaggggacctgcccgagattgagctcgacgacggcaagacgttccagcacaacgcgtgctgggaggacatctgccacgccatcctagaggcgcaccacatgatatatatcgtcggctggtcggtgtacgataaggtgcggctcgtacgcgagccatcgccgtcgcggccattgcctgagggtggcgaccttacgcttggcgacctgcttaagttcaagtcgcaggagggtgtcagagtgtgcctgctggtgtgggatgacaagacttcgcatgacaagttcttcatcaagacgggtggagttatggcaactcatgatgaagaaactcggaagtttttcaaacattcctcagtcatctgtgttctctctcctagatatgctagcaataagctgagcattttcaaacagcaggttgttgggactttgtttacacaccatcaaaagtgtgtgctggttgatacacaagccaggggaaacaagcggaaaattacagctttcattgggggcctagatctttgtgatggccgctatgacacacctgaacacaggcttttcaaagatcttgacacagtattccaaaatgattaccataaccctacattttcagcaggtgcaaagggacccaggcaaccatggcatgatttacattgcaggattgatggtcctgctgcctatgatgtcttgcttaattttgagcaaaggtggcgaaaggcaacaaaatggcgtgaccggtttagaagagtatctcattggaaagacgatgctttaattaagctggagcgtatatcatggattctaagcccttcacccaatgttccaaatgatcatcctagtttgtgggtttcaaaagaagaagatcatgaaaagtggcatgttcaggtatttcggtcaattgactctggttccctaaaaggatttcctagtgatagcaaagaagcttcaaagctgaatcttgtgtgccggaaaaacttggtaattgataagagcatccacactgcatacgtccgagcaatcagatctgcacagcatttcatttatattgaaaaccagtattttcttggttcttcatatgcttggccgtcctatgtgaattcaggtgctgataatctgataccaatagaactggccctcaaaattgcaagtaagattagagcgggagaacgctttgcagtgtatgtagtgataccaatgtggcctgaaggagtccctactgcagcatctgtgcaagaaatccttttctttcagacaatggagatgatgtataaaataattgcagatgagctcaaggcaatggacattaaggatatgcaacttgaagattacttgaacttcttttgtcttggaaaccgggaagaaccaccatctaatggcagcccagaatcagagaaatctacagataaaagtgcagcgggcttagctacaaaatatcgacggttcatgatctatgttcacgcaaaagggatgattgtggatgatgaatatgtcattctgggttcagcaaacatcaaccagagatccctggctggttctagagatactgaaattgcaatgggtgcataccaacctcattatgcatggtctacaaagaatggacatcctcatggccaggtatacgggtatagaacgtctctctgggcagagcaccttggaacggttgatgatcgcttcaaggatccttcgagtttggagtgtgtaaggcgtgtgaatcaaatagctgtagagaactggcaaaggtttacagccgaagaaatgagtacattacaagggcacctcctcaagtacccagttaaggtggaggctgatggtaagatcagctcactgccagaccaagaatgctttcctgatgttggcggcaagattctgggagcttcaacttcacttcctgattcgctgaccatgtagagttattattacattttttttttcagagtcgagcttcgtaattgtctaaacttggtgcaattgtcactgaacttgtactgtatctgtaatcatccatagttggcgcagggaaagctcaaggtgtcggtggtgtttgtagagtcgtgctcctgtaagttttcccagcatttgtaaatgaaccatatgataggatccttgacaatgcttccatttccattgctattatacaactgttctgaacatttttgttcaaccccatgttcacactgtggccgtgatggaagtgccatttcttattcggctggaaggactgaaatgctggg

SEQ ID NO: 8751 - DNA, 3010 bp, Zea mays
ctatttcgggctaaattgccaaatctcgagatccatgatccatccgaaaccccgcctcgccgcctcctctcgctttgccgtttccgaccgccaatgctgaggcgagccgacgctaccgcccacccgaatcctcgccgctgagggtgctctaggattggagtgctctggttggttgcatagacgctcgccgccgcctctcccgtgccccggcggccggcaccggccccgaccgcgaggctccgtcgccggcgatggcgtcgccggccggcggcgagtctccagcgaagcccgtcctcctgcatggcgacctcgacctctggatcctagaggcgcgcctgctccccaacatggacatgttctccgagcaggtccgccgctgcctcgccgtatgccgcccgcccacctcctgcgggaccaaccacccgcctgccgccgcgcgcggcggcggcggccgccaacaccaccaccggaagatcatcaccagaggcccctacgtcacgctgtccgtctccggcgccgtcgtggcgcgcaccgccgtcatccccaactcccaggaccccgtctgggaggagcgttttgccgtgccgctcgcgcaccgcgccgccgagctcgagttccaggtcaaggataacgataccttcggcgcgcagctcatcggcaccgtcaccgtccccgccgactgcgttgtgtcgggcaccgaggccgaggattggttccccgtcaaaggcaccaacggcaagccgtacaaacccgacaccgcgctgcgcctccgcttcacattccaccccatcgccaacaacccggcctaccgccacggcatccctggcgaccctggccacaggggcatcggggagtcctactacccgctccgccacggtggccaagtgacgctgtaccaggacgcgcacatcagggaaggggacctgccagagattgagctcgacgacggcaagacgttccagcacaactcgtgctgggaggacatctgccacgccatcctggaggcgcaccacatgatatatatcgtcggctggtcggtgtatgataaggtgcgactcgtgcgcgaaccatcgccgtcgcggccattgcccgatggtggcgaccttacgcttggagacctgctcaagttcaagtcacaggaaggtgtcagagtgtgcctgctggtgtgggatgataaaacttcgcatgacaagttcttcatcaagacgggtggagttatggcaactcatgatgaagaaactcggaaattttttaaacattcctcagtcatctgtgttctctctcctcgatatgctagcaataagctgagcattttcaaacagcaggttgttgggactttgtttacacaccatcaaaagtgtgtgctggttgatacacaagccaggggaaacaagcgaaaagttacagctttcattgggggcctagatctttgtgatggtcgctatgacacacctaaacacaggcttttcaaagatcttgacacagtattccaaaatgattaccataaccctacattttcgtcaggtgcaaagggacccaggcaaccatggcatgatttacattgcaggattgatggccctgctgcctatgatgtcttgacaaattttgagcaaaggtggcgaaaggcaacaaaatggcgtggccgatttagaagagtatctcattggaaagacgacgctttaattaagctggaacgtatctcatggataataagcccttcacccaatgttccaaatgatcatcctagtctgtgggtttcaaaagaagaagatcgtgaaaattggcatgttcaggtattccgatcaattgactctggttccctaaaaggatttcctagtgattgcaaagaagcttcaaagcttaatcttgtgtgccgaaagaatctggtaattgataagagcatccacactgcatatgtccgagcaatcagatctgcacagcatttcatttatattgagaaccagtactttcttggttcttcatatgcttggccatcctatgtgaattcaggtgctgataatctgataccaatagaactggccctcaaaattgcaagtaagattagagcacaagaacgctttgcagtgtatgtagtgataccaatgtggcctgaaggagtccctactgcagcatctgttcaagaaattcttttctttcaggcccagacaatggagatgatgtatacaataattgcagatgagctcaagtcaatggacaataaggacatgcgccctgaagattacttgagcttcttttgtcttggaaaccgggaagaaccaccatctaatggcagcccagaatcagagaaatctacagataaaagtgcagtgggcttagctacaaaatatcgacggttcatgatctatgttcatgcaaaaggaatgattgtggatgatgaatatgtcattctgggttcagcaaacatcaaccagagatccctggctggttctagagatactgaaattgcaatgggtgcataccagcctcattatgcatggtctacaaagaatggacatcctgacggccaggtatacgggtacagaacgtccctgtgggcagagcaccttggaacgatcgatgaccgcttcaaggatccttcgagtttggagtgtgtaaggtttgtgaatcaaatcgctgtagagaactggcgaaggtatactgcagaagaaatgagtacattacaagggcacctcctcaagtacccagttaaggtggaggctgatggtaagatcagcccactgccagaccaagaatgctttcctgatgttggcggcaagattctgggagcttcaacttcacttcctgattcgctgaccatgtagcgtcattacataatttttttttcagagttgaactctgtaattgtctagatttggtgggattgtcgcagaacttatactactagtgaagtgcgcgtgccctgcgcgcgtgtagtgtaggctcatggagatccaaccacacaactaatataactatataaatttacatatataataagtgtaccaaccta

SEQ ID NO: 8752 - DNA, 3205 bp, Setaria italica
gagagatgacactgggagtaacggaaactggagttcatctgataataaagtgatgagggaaaacttaaagccgcatactatttcaggctaagttgccaaatcctgagatccaccccaagcccccgccccgcgtcgccgccgcggcgcctcctcccgcaaactccgccgttttgcgggccgccccgccggaatccccgccacgggggcctgcggtataagacggccctctgggattggagggctccggttggtcggttagacgctcgccgctgccgcctcccctcgaccgcgaggctccgtcgccggcgatggcgtcgtcagccggcggcgagtctccggcgaagcccaagaccgtgctcctgcacggcgacctcgacctctggatcaaagaggcgcgcctgctgcccaacatggacctcttctccgagcaggtccgccggtgcttcgccgcctgccgaccgcccacctcctgcgggcccaagcacccacccgccgccgccgtcccccgcggcggctccggcggccgccaccaccaccaccggaagatcatcaccagcgacccctacgtcacgctctccgtctccggcgccgtggtggcgcgcaccgccgtcattcccaacaaccaggaccccgtctgggaggagcgcttcgccgtgccgctcgcgcaccgcgccgccgcgctcgagttccaggtcaaggacaacgacaccttcggcgcgcagctcatcggcaccgtcaccgtcccagccgacatcgtcgccagcggcgaggaggtcgaggactggtaccccatcatcggcaccaacggtaagccgtacaagcccgacaccgcgctgtgcctccgcttccggttccagcccatcgccgagaacccggcttaccggcgcggcatccccggcgaccccgagcgcaagggcatcaaggactcctacttcccgctccgccacggcggtcaggtgacgctgtaccaggacgcgcacgtcagggaaggggacctgccggagattgagctcgaggacggcaagatgttcgagcacaacgcgtgctgggaggacatctgccacgccatcctagaggcacaccacatgatatacatcgtcggctggtcggtgtatgacaaggtgcggcttgtgcgtgagcggtcgccgtcgcggccattgcctgagggtggcgaccttacccttggagagctgctcaagttcaagtcgcaggagggcgtcagagtgtgcctgctcgtgtgggatgacaaaacttcgcatgacaagtttttattcaagacgggtggagttatggcaactcatgatgaggatactcgaaagtttttcaagcattcctcagtcatctgtgttctttctcctcgatatgctagcaataagctgagcattttcaaacagcaggttgttgggactttgtttacacaccatcaaaaatgcgtgcttgttgatacacaagcatggggaaacaagcggaaggttacagctttcatcgggggcctagatctttgtgatggccgctatgacacacccgaacacaggcttttcaaagatcttgacacagtatttcataatgattatcataaccctacattttcggcaggtgcaaaaggacctagacaaccatggcatgatttacattgcaggattgatggtcctgctgcatacgatgtcttgacaaattttgaacagcggtggcgaaaggcaacaaaatggcgtgaccgttttagaagagtatctcattggaaagatgatgctttaattaagctggagcgtatctcatggatactaagcccttcacgtaatgttccaaatgatcatcctagtttgtgggtttcaaaagaagaagatcgtgaaaattggcatgttcaggtattccggtcaatcgattctggttctttaaaaggatttcctagtgattgcaaagaggcatcaaagctgaatcttgtgtgccgtaagaacctggtaattgataagagcatccacactgcatatgtccgggcaatcagatctgcacagcattttatttatatcgagaaccaatactttcttggttcttcatatgcttggccatcctatgtgaattcaggtgctgataatctgataccaatagaattggccctcaaaattgcaagtaagattagagcaggagaacgctttgcagtgtatgtagtgataccaatgtggcctgaaggagtccctactgcagcatctgtgcaagaaatccttttctttcaggcccagacaatggagatgatgtataaaataattgcagatgaactcaaggccatggacattaaggatatgcaccctcaagattacttgaacttcttttgtcttggaaaccgggaagaaccatcatcaaacggcagcccggaatcagagaagtctacagataaaagtgcagcggccttagctacaaaatatcgacggttcatgatctacgttcatgccaaagggatgattgtggatgatgagtacgtcattctgggttcagcaaacatcaaccagagatccctggccggttctagagatactgaaattgcaatgggggcataccagcctcatcacgcatggtctacaaagaatagacatcctcacggccaggtatatggatacagaacatctctctgggcagagcaccttggaatggttgatgatcgcttcaaggatccttcaagtttggattgtgtaaggtttgtgaatcaaatagctgtagagaactggcaaaggtttacagccgaagaaattagaacattacaagggcacctcctcaagtacccagtcaatgtggaggatgatggtaagatcggcccgcttccagaccaagaaaactttcctgatgttggcggcaagattctcggagctccaacttcacttcctgattcgctgaccatgtagatttacattaaaaagttgacctttttcagagttgaagcttgatcatatccacttgtgaactttgtaattgtctaaatttggcgggattgtcgcagaatttgtaccatatctgcaatcatccatagttggcgcagggaaagctcaagtgttaatggtgttggtgtttgtagagttgtgtttctgtaagttctcccagcgtctgtaaatgaatcatatgataggatccttgacagagcttccattttcattggataataccacgctttttgaacattttgtccaagcctagtgtttaccctgtttctgttcga

SEQ ID NO: 8753 - DNA, 3013 bp, Panicum virgatum
ggagggctccggttggttgcctaggcgctcgcccgtctgcgtcccgcgcgccccctcgaccgcgaggctccgtcgccggcgatggcgtcgtcggccggcggcgagtctccggcgaagcccgtgctcctgcacggcgacctcgacctctggatcctcgaggcgcgcctgctgcccaacatggacctcttctccgagcaggtccgccggtgcttcgccgcctgccgcccgcccacctcgtgcgggcccaagcagccgccccccgccgcgcgcggcgcctctggcggcgcccgccagcaccaccggaagatcatcaccagcgacccctacgtcacgctgtccgtgtccggcgccgtcgtcgcgcgcaccgccgtcattcccaactgccaggagcccgtctgggaggagcgcttcgccgtgccgctcgcgcaccgcgccgctgcgctcgagttccaggtcaaggacaacgacaccttcggcgcgcagctcatcggcaccgtcaccgtgccggccgacctcgtcgccaggggcgaagaggtcgaggattggtaccccgtcatcggcaccaacggcaagccgtacaagcccgacaccgcgctgcgcctccgcttccgcttccagcacatcgctgaaaacccggcataccggcacggcatccccggggaccccgagcacagcggcatcaaggactcctacttcccgctccgccacgggggccaagtcacgctgtaccaggacgcgcacgtcaaggaaggggatttgccggagattgagctcgagaacggtaagatgttcgagcacaacgcgtgctgggaggacatctgccacgccatcctagaggcgcaccacatgatatacatcgtcggctggtcggtgtacgacaaggtgcggctcgtgcgcgagcggtcgccatcgcggccattgcctgagggtggcgaccttaccctgggggacctgctcaagttcaagtcgcaggagggcgtcagagtgtgcctgctcgtgtgggatgacaaaacttcacatgacaagtttttcatcaagacgggtggagttatggcaactcatgatgaagaaactcggaagtttttcaagcattcctcagtcatatgtgttctttctcctcgatatgctagcaataagctgagcattttcaaacaacaggttgttggaactttgtttacacaccatcaaaaatgtgtgctggttgatacacaagcatggggaaacaagcggaaagttacagctttcatcgggggcctagatctttgtgatggtcgctatgacacgccggaacacaggcttttcaaagatcttgacacagtattcgaaaatgattatcataatcctacattttcggcaggtgcaaagggacctagacaaccatggcatgatttacattgcaggattgatggtcctgctgcctacgatgtcttgaaaaattttgaacagaggtggcgaaaggcaacaaaatggcgtgaccgttttaggagtgtatcccattggaaagatgatgctttaattaagctggagcgtatctcatggatactaagtccttcacgtaatgttccaaatgatcatcctactttgtgggtttcaaaagaagatgatcctgaaaattggcatgttcaggtattccggtcaattgactctggttcgctaaaaggatttcctagtgattccaaagaagcttcaaagctgaatctcgtgtgccgcaagaacctggtaattgataagagcattcacactgcatatgtccgggcaatcagatctgcacagcatttcatttatatcgagaatcaatactttcttggttcttcatatgcttggccatcctatgtgaattcaggtgctgacaatctgataccaatagaattagccctcaaaattgcaagtaagattagagcaggagaacgctttgcagtgtacgtagtgataccaatgtggcctgaaggagtccctactgcagcatctgtgcaagaaatccttttcttccaggcccagacaatggagatgatgtataaaataattgcagatgaacttaaggcaatggacattaaggatttgcaccctcaagattacttgaacttcttttgtcttggaaatcgggaagaaccaacatcaaatggcattctggagtcagagaaatcttcagataaaagtgcagcggccttagctacaaaatatcggcggttcatgatctatgttcatgcaaaagggatgattgtggatgatgaatacgtcattctgggttcggcaaacatcaaccagagatccctggcaggttctagagatactgaaattgcaatgggggcataccagcctcattacgcatggtctacaaagaatagacatcctcatggccaggtatatggatacagaacgtctctctgggcagagcaccttggaatggttgatgatcgcttcaaggatcctacgagtttggactgtgtaaggtttgtgaatcaaatagctgaagagaactggcaaaggtttacagctgaagaaatgagaacactacaagggcacctcctcaagtacccagtcaaggtggaggatgatggtaagatcgtctcactgccagaccaagaatgctttcctgacgttggcggcaagattcttggagctccaacttcacttcctgattcgctaaccatgtagcattacatacaaacaattgaccttttcggagttgatgctggaccatatctacctgtgaactttgtgactgtctaaacttggcgggattgtcgcaaaatttgtatcatacctgtaatcatccatagttggcgcagggaaagcccaagttgttaatggtgtttgtagagttgttcctctgcgagttctcccagcgtctgtaaatgaaccctaataggatccttgacggtgattccacttccattacgattgtaccacccgttttgaacatgggtcttgtttggattgtgctagttattagcacgcacattttttttaaaaaaaatttcgcatgcatggagtactaaataaagtttatttg

SEQ ID NO: 8754 - DNA, 2796 bp, Panicum virgatum
ctcgaggcgcgcctgctgcccaacatggacctcttctccgagcaggtccgccggtgcttcgccgcctgccgcccgcccacctcgtgcgggcccaagcaaccgctccccaccaccgccgccacgcgaggcgcctccgccgccggcggcggcggcggcgcccgccaacaccaccggaagatcatcaccagcgacccctacgtcacgctgtccgtggccgacgccgtcgtcgcgcgcaccgccgtcattcccaactgccaggagcccgtctgggaggagcgcttcgctgtgccgctcgcccaccgcgccgccgcgctcgagttccaggtcaaggacaacgacaccttcggcgcgcagctcatcggcaccgtcaccgtaccggccgacctcgtcgccaggggcgaagaggtcgaagattggtaccccatcatcggcaccaacggcaagccgtacaagcccgacaccgcgctgcgcctccgcttccgcttccagcccatcgccgagaacccggcataccggcacggcatccccggggaccccgaccacagcggcattaaggactcctacttcccgctccgccacgggggccaagttacgctgtaccaggacgcgcacgtcagggaaggggacctgccagagattgagctcgagaacggcaagatgttcgagcacaacgcgtgctgggaggacatctgccacgccatcctagaggcgcaccacatgatatacatcgtcggctggtcggtctacgacaaggtgcggctcgtgcgcgagcggtcgccctcgtggccattgcctgagggtggcgaccttacactgggagacctgctcaagttcaagtcgcaggagggcgtcagagtgtgcctgctcgtgtgggatgacaaaacttcacatgacaagtttttcatcaagacgggtggagttatggcaactcatgatgaagaaactcggaagtttttcaagcattcctcagtcatatgtgttctttctcctcgatatgccagcaataagctaagcattttcaaacaacaggttgttggaactttgtttacacaccatcaaaaatgtgtgctggttgatacacaagcatggggaaacaagcggaaagttgcagctttcatcgggggcctagatctttgtgatggccgctatgacacaccagaacacaggcttttcaaagatcttgacacagcattcgaaaatgattaccataaccctacattttcggcaggtgcaaagggacctagacaaccatggcatgatttacattgcaggattgatggtcctgctgcctacgatgtcttgaaaaattttgaacagcggtggcgaaaggcaacaaaatggcgtgaccgttttaggacagtatcccattggaaagatgatgctttaattaagctggagcgtatctcatggatactaagcccttcacctaatattccaaatgatcatcctactttgtgggtttcaaaagaagaagatcctgaaaattggcatgttcaggtattccggtcaattgactctggttcactaaaaggatttcctagtgattccaaagaagcttcaaagcagaatctcgtgtgccggaagaacctgataattgataagagcattcatactgcatatgtccgggcaatcagatctgcacagcatttcatttatattgagaatcaatattttcttggttcttcatatgcttggccatcctatgtgaattcaggtgctgacaatctgataccaatagaattagccctcaaaattgcaagtaagattagagcaggagaacgctttgcagtgtacgtagtgataccaatgtggcctgaaggagtacctactgcagcatctgtgcaagaaatccttttctttcaggcccagacaatggagatgatgtataagataattgcagatgagcttaaggcaatggacattaaggatttgcaccctcaagattacttgaacttcttttgtcttggaaatcgggaagaaccaacgtcaaacggcagcctggagtcagagaaatctacagataaaagtgcagcggccttagctacaaaatatcggcggttcatgatctacgttcatgcaaaagggatgattgtggatgatgaatacgtcattctgggttcggcaaacatcaaccagagatccctggcaggttccagagatactgaaattgcaatgggggcataccagcctcattatgcatggtctacaaagaatagacatcctcacggacaggtatatggatacagaacgtctctctgggcagagcaccttggaatggttgatgatcgcttcaaggatccttcgagtttggactgtgtaaggtttgtgaatcaaatagctgaagagaactggcaaaggtttacagccgaagaaatgagaacactacaggggcacctcctcaagtacccagtcaaggtggaagctgatggtaagatcggctcactgccagaccaagaatgctttcctgacgttggcggcaagatcctcggagctccaacttcacttcctgattcgctaaccatgtagcattacatacaaaaaatttaccctttcagagttgaagctggatcatatccgcctgtgaactttgtaactgtctaaatttggcggggttgtcacagaatttgtaccatacgtccatacctgtaatcatccatagttggcgcagggaaagctcaaagttaatggtgtttgtagagtcgctcctttgcaagttctcccagcgtttgtaggatccttgacagtgattccatttccattacgattataccacccgttttgaacattttgttcacc

SEQ ID NO: 8755 - DNA, 3149 bp, Oryza sativa
atagcggcgcggcgagagagagagactatttttgggcgtaatccagcgcggccgtccgcccgagatctccctctcccaccgcgcgtttcgccgccggaatccgcgccgcagagagcggggggtataaagaggtgagacggtggtctcccggattcggtgggtggtgggtcccgctgctgtgtgcgtgtgcgtgccgagggagggagggaggcctcgtcgccgccgatggagtcgtcggccggcggcggcggcggcgagtctccgcctccggcgaagcccgtgctgctccacggggacctcgacctgtgggtggtcgaggcgcgcctgctcccaaacatggacatgttctccgagcacgtacggcggtgcttcgccgcctgcaagccgcccacctcctgcgccaccgccaggcagccgcgccacgcccgcggccaccaccgccggaagatcatcaccagcgacccctacgtcacgctctccgtcgccggcgccgtggtggcgcgcacccgcgtcatccccaacgaccaggaccccgtctgggacgagcgcttcgccgtgcccctcgcccactacgccgccgcgctcgagttccacgtcaaggacaacgacacgttcggcgcgcagctcatcggcaccgtcaccatccccgccgacagggtcgcctcgtgccaggaggtggaggactggttccccatcatcggcaacaacggcaggccgtacaagcccgacacggcgctccgcctccgcctccgcttcaaccccgcggccgacaacccgctctaccgccgcggcatccccggcgaccccgaccaccaggggatcaaggactcctacttcccgctccgccacggcggccgcgtcacgctgtaccaggacgcccactacagggaaggggacctgccggagatcgagctcgacgaggggggcaaggtgttcgaccacaacgcgtgctgggaggacatctgccacgccatcctcgaggcgcaccacatgatatacatcgtcggctggtcggtgtacgacaaggtgcgcctcgtccgggagccgtcgccgtcgaggccgctgccggaaggcggcgacctcaatctcggggagctgctcaagttcaagtcgcaggagggcgtgagggtgtgcctgctcgtgtgggacgacaagacgtcgcacgacaagttgttcatcaaaacgggtggagtgatggcgacacatgatgaagaaactagaaaattcttcaagcattcctcagtcatttgtgttctttcacctcggtatgccagcagtaagctgagcattttcaaacaacaggttgttgggactttgtttacccatcatcaaaaatgcgtgctggttgatacacaagcttggggaaacaagcggaagattactgcttttatcggtggcctggatctttgtgatgggcgttatgatacacccgaacataggctttttaaggatcttgacacagtattcgataatgattatcataaccctacatttccgtcaggtgcaaagggggggcctagacaaccatggcatgaccttcactgtaggattgatggtccagctgcgtatgatgtcttgaaaaattttgagcaacgctggagaaaggcaacgaaatggcgtgaacgatttagaaaagtgtctcattggaaagatgatgccctgataaagttggaacgtatctcatggatacttagcccttcgcctactattccaaatgatgatattagtttgcgggtttcaaaagaagaagatcctgaaaattggcatgttcaggtattccggtcaatagactctggttcgcttaaagggtttcctagtgattgcaaagaagcttcaaagcagaatcttatttgccggaaggacctgataattgataagagcatccacactgcttatgtccgggcaatcagatccgcccagcatttcatttatattgaaaatcaatatttccttgggtcatcatatgcttggccgtcctatgttaattcaggtgctgacaatctggtacctattgaattggccctcaaaattgcaagcaagattagggctggtgaacggtttgcagtttatgtagtcataccgatgtggcctgaaggagtccctacagcagcttctgtacaagaaattcttttctttcagacaatggagatgatgtatcgtataattgcacaagagctcaaggccatgaatattaagaatgcacaccctcaagattacttgaacttctattgtctgggcaatcgagaagaatcatcatcatcaaatggcagccctgaatctaacgataaaagtgcagcggccttggctagaaaataccggcgttttatgatctatgttcatgcaaaggggatgattgtagatgatgaatatgttattctggggtcagcaaacatcaaccaaagatctttggctggttccagagatactgaaattgccatgggcgcataccagcctcaccacacatggtctacaaaggggggtcatcctcgcggtcaggtatacgggtatagaacttccctctgggcagagcatcttgggatggttgatgacctcttcaaggatccatcaagtttggagtgtgtaaattatgtcaatgaaatagcagaagagaactggagaaggttcaccgcagaacaacttataacgttacaagggcacctcctcaaatacccagtcaaggtagaggctgacggtaaggttggtccattgccagaacacgaatgctttcctgacgttggtggcaagattcttggagctccaacttcactccctgatacgctaacaatgtaacacggttcaagcaaaatattgacatgttttccagaattgaagcccttttttgttcatattttaaactttgtgattgcttgaagatggtatcggagaggaatttgtatcatgtctgtataatcatccagagagggggtatagggagagctcaagctgctaatggtgtctgtaaagtttgtggctatgtgagaaatttttcagccgttgtaaatgaaacacacgacagtacgatagactacagtgttgtctcatttccattgcaatcatacacgcacaactgttttaattcatgattagctgctgttacagtcatacattcagtggtgtgttcgagagaaggaaaagagagatacataaaa

SEQ ID NO: 8756 - DNA, 3136 bp, Brachypodium distachyon
ccaaatctcttccagctttgccgtttgcgtccgcgaggttggagagggcgttgcctcgcctgcgccccaccggaatccccgccgggtagcgggggtcgtcgcggttgccaggtataagaggaggcctcccgggattggaggcccgactccaattggaccctggccgccgccgccgccgcccccgaccgcgaggcctcgtcgccgccgatggcgtcgccggcggacggcgagtctccggccaagcccatcctcctccacggggacctcgacctgtggatcattgaggcgcggctgctccccaatatggacatgttctccgagcatatccgccgctgcttcgccacctgcggcaccgcctcctcctgcgcgcccaagcagccgccccgcacccggggcggggaagggccgaaccgccgccaccaccggaagatcatcaccagcgacccttacgtgacgctgtccgtggccggcgcggtggtggcgcgcacggcagtgattcccaacagcgaggagccgcgctggggggagcaattcttcgtgccgctcgcgcaccgggccgccatgctcgagttccaggtcaaggacaacgacaccttcggcgcgcagctcatcggcacggcttccatccccgccgaccgagtcacctccgcgtgcgaggaggaggtcgacgagtggttccccatcgtcggccccagtggcaggccgtacaagccccgcaccgcgctccacctccgtttccggttccgaccgctcgacaccaacccgatgtacaagcacggcatcccgggcgaccccgagaagcagggcgtccaggactcctacttcccgctccgccatggcggccgcgtgacgctgtaccaggacgcgcatgtcaacgaaggggacctgccgggtatcgagcttgagcgagggaagcagttcgagcacaacaactgctgggaggacatctgccacgccatactcgaggcgcaccatatgatatacattgtcggctggtccgtgtacgacaaggtgaagcttgtgcgcgagccgtcgccgtcgaggccgttgcctgagggtggcgacctcacgctcggggacctgctcaagttcaagtcgcaggagggtgtgagagtttgcctgctcgtgtgggacgacaagacttctcatgacaagttgttcatcaaaacgggtggtgtgatgggaacacatgatgaagaaactagaaagtttttcaagcactcctccgtcatttgtgttctttcaccgcgatatgccagcagtaagctgagcattttcaaacaacaggttgttgggacattgtttactcatcatcaaaaatgtgtgctggttgacacacaagcctcggggaacaagcggaaagttactgcttttgttgggggcctagatctttgtgatgggcgttatgatactcctcaacatagactttttaaagatctagacacagtatttgaaaatgactatcataatcctacgttttcggcaggcgcaaaaggaccgagacaaccatggcatgatttgcactgtaagattgatggaccagctgcctatgatgtcttaaagaattttgagcaacgctggagaaaagcatcaaaattccgtgaacgatttaggaaaatatctcattggaaagatgatgctctaataaagctggagcgtatctcatggatacttagcccttcacctaatattccaaatgatcatgctagtttgcgagtttcaaaagaagaagatcctgaaaattggcacgttcaggtattccgatcaatagactctggctctctaaaaggatttcctagtgattgcaaagaagcttcaaagcagaatcttgtgtgccgaaagaacctcataatcgataagagcatccacacagcatatgtccgggcgatcagatcagcgcaacatttcatttatatagaaaatcagtattttcttggttcttcctacgggtggccatcctatgtgaattcaggtgctgacaatttgataccaatggaattggccctcaaaattgcaagcaagattagggctggcgaacgatttgcagtttatgtagtcataccaatgtggcctgaaggagttcctactgcagcctctgtacaagaaattctttactttcaggctcagacaatggagatgatgtatagagtggtcgcacaggagctaaagaccatgaatatcgagaatgcacatccccaagattacctgaacttctactgtcttggcaatcgagaagaatcatcaacaaacggcagccctgagtcagataaatctacagacaaaagtgcagcggccctggctagaaaatatcggcggttcatgatctatgttcatgcaaaagggatgattgtagacgatgaatacgtcattttgggttcagcaaacattaaccagcgatccctggctggatctagagatactgaaattgcaatgggcgcctaccagcctcatcattcatggtctaagaagggggctcatcctcacggccaggtatacggatataggagttctctttgggcagagcacctggggatggttgatgacaggttcaaggatccttccagcttggactgcgtacgttttgtgaaccaaatagctgaagagaactggaacagattcacagcagaagagatgaaaacgttgcaagggcacctcctcagatacccagtgaaggtagagccggatggcaacatcggcccgttgccagaccaagaatgcttccctgacgtcggtggcaagatatgcggagctccaacctcacttcctgattcgctgacgatgtaatgtcgtggcacaccaattccaaagttgaagcttgctctcttccctccgtgaaaaaactccttgattttcttgtgttggcgcgggaggagaattgaatttgtaccataatctgtcatcacccatagtgtggtgtagaaaagttaagctcgagttgccagtggtgtttgtagagttgtgcctttgtaaggttttatacaacctgtaaatggaacacgtacgacaggatcattgatagtgttggccatttgtactacgagttatacgtacgagtttacaactctgttcctcgcaatgtgttttgtgggactggaaccaactctttccataaaattatctaaaaaaacctagtcac

SEQ ID NO: 8757 - DNA, 6625 bp, Glycine max
ggaaaaagaagaaaacgtctttgtattgtgtgctgcaaatgtccgcaacctctcactctctccttttctttgcaccttttccttagcttcgaagtagcttaataagcttctctgtctctgtgctagggtttcaaattccattcctgcatctctctctctctatatatgctccaacattagtaatcacaatccgaatctccattctcctttctctgtctgtcgttctatagagtggtcggaatgtcgtcgtccagaggaggcgcggggccgtcctcggaggcgccgccgccgaggcggatcatgcggacgcagactgcggggaacttgggagagtcggtgattgacagtgaggtggtgccttcctctctggtcgagattgcgcccattcttcgtgtcgctaacgaagttgaaaagactcatccaagggttgcttatctctgccgtttttatgcctttgagaaagctcataggttggatcccaactcaagtggtcgtggtgttcgccaattcaaaactgcacttcttcaacgccttgaaagagaaaacgatccaactttgaaaggaagggtaaagaaaagtgatgctcgcgagatgcagagtttttatcagcattactacaaaaaatatatccaagctttacaaaatgctgctgataaagctgaccgtgcacagcttaccaaggcatataacacagctaatgttctttttgaggttttgaaggctgttaacatgacacaatctatggaagttgatcgcgagattttggagacccaagataaagttgctgagaaaacagagatcttagtcccttataatattcttcctcttgatcctgatagtgctaaccaggctataatgagatttcctgagatccaagctgctgtatatgctcttcgtaacactaggggtcttccttggccgaaggacttcaagaaaaaaaaggatgaagacatcctggattggcttgggtcgatgtttggatttcagaaacacaatgttgcaaatcagagagagcatttgatcttactgcttgctaatgttcacataagacaatttccaaagccggatcagcaaccaaagttggatgagcgtgctctgacagaagtgatgaagaaactgtttaagaattacaaaaagtggtgcaagtatctgggtcggaaaagtagcctttggttacctaccattcagcaagaagtacagcagcgcaaactactatatatgggtctgtatcttctaatatggggtgaagctgccaacttaagattcatgccagaatgcctttgttatatatatcaccatatggcttttgaattgtatggtatgcttgcgggtaatgtcagtccgatgacgggagagaatgtgaagccagcatatggaggtgaagatgaggcttttttaaggaaagttgtcactcctatctataacgtgattgctaaggaagctgcacgtagcaaaaagggaaggtcaaaacattcacaatggagaaactatgacgatttaaatgaatatttctggtccgctgattgttttcgattaggttggccaatgcgtgctgatgctgatttcttttgcctgccagctgaaaagctggtttttgataaatcaaatgatgacaagccacctagcagagacagatgggttgggaaagtgaattttgttgagattagatcattttggcatatgtttagaagtttcgatcgaatgtggagttttttcattctgtgtttacaggctatgattgttgttgcttggaatggatctggggatcccagtgcaatctttaatggtgatgtgttcaagaaggtgttgagtgtgtttataactgcagcaatattgaagtttgggcaagctgttctagatgtgatcttgagttggaaagcacaatggagtatgtcactgtatgttaagttaagatacattctcaaagttgtttcagctgcagcatgggtgattgttctgtcagttacttatgcgtatacttgggataatcctcctgggtttgctcaaaccattaaaagttggtttggaagtggtggttcaagtgctccttcattgtttattttggctgttgttgtttacctgtcaccaaatatgcttgctgcaatattctttctgatcccttttattcgtcgtcatctcgaaaggtcgaactataggattgtgatgctaatgatgtggtggtcacagcctcgtttatatgttggtaggggaatgcatgagagcgcattttcccttttcaaatacacaatgttttgggtcttactcataattacgaagttggctttcagttactatatagagataaaacctctggtgggacctacaaaagctataatgagtgtaaaaatcacaactttccagtggcatgaattctttcctcatgctaggaataatattggcgttgtaattgcactttgggctccaattattctggtatactttatggatacccaaatttggtatgccatattctcaacattatttggtggtatttatggtgcctttcgtcggcttggggagatacggacactgggaatgctgaggtctcgttttcaatcattgcctggtgccttcaatgccagtttgattccggaagaaacaaatgagccaaagaaaaaaggattaaaagccactttatcccgcagatttcctgagatctcatcaaacaaagggaaggaggctgcaaggtttgcacaattgtggaaccaaataattactagtttcagggatgaagatcttattaatgatagggaaatgaaccttttgctggtaccttattgggctgatactcagttggaccttatacaatggcccccctttctacttgctagcaagattccaattgcactggatatggccaaagatagcaatggaaaggaccgagagctgaagaaaagaattgcggctgacaactacatgtcttgtgctgtccgtgagtgctatgcttcatttaagagcattattaagcacttggttcaaggggaacgagagataccggttatagagtacatgtttgatgaagtggataaaaatatagaaacagataaactgattagtgaattcagaatgagtgcacttcctagcctctatgcacagtttgtcgagctaacccaatatttattgaataatgatccgaaagatagggacaacgttgttattctattccaggacatgctggaggtcgtgacaagagatataatgatggaggatcaggatcaaatattcagtttggtagattcaagccatggtggtaccggacatgaggggatgcttcaccttgagcctgagccacatcaccaactgtttgcatctgaaggagctatcaagtttccaattgaaccacttacagcagcttggacagagaagattaaacgacttcacttgctgcttacgacaaaagaatctgccatggatgtaccatctaacttggaagctagaaggcgtatttctttcttctcaaattctttgtttatggacatgcctatggcgccaaaagttcgcaacatgctttcattctcggttttgacaccatattatacagaagaagttttattctccttgcatgatttggattcacagaatgaggatggggtttcaatactgttctacttgcaaaagatttatccagatgagtggaacaattttcttgaacgagtgaaatctactgaggaggatattaaagggagtgaatttgatgagttagtagaagaacgtcgtctttgggcatcatatagagggcaaacattgaccagaactgtaagaggtatgatgtattatagaaaagctttggaactccaggcttttcttgatatggccaaagatgaagatttgatggaaggttataaagccatggaaaactcagatgacaattcaaggggggaaaggtcattgtggacacagtgtcaagcagtagctgatatgaaattcacatatgtggtatcatgccaacaatatggcattgataagcgatctggttctcttcgtgcacaggacatattaaggcttatgacaagatatccgtctctccgagttgcctatattgatgaggtagaagaacctgtccaagacagtaagaaaaagatcaacaaggtttactactcttgcttggtgaaggctatgccaaaatccaatagtccttcagagcctgagcagaatctggaccagatcatatataaaataaagcttcctggaccagcaattttgggtgagggtaagccagaaaatcagaatcatgccataattttcacacgtggagagggattgcaaacaatagatatgaaccaggataactacatggaagaagctttgaaaatgagaaatttgttgcaagaatttcttaagaagcatgatggtgttcggttccctagtattcttggacttagggagcatatatttactggaagtgtttcttcccttgcatggttcatgtcaaatcaggagacaagtttcgtgacaattggtcagagattgttggctaatcctttgaaggttcgtttccattatggtcatcctgatgtctttgataggctttttcacctgacgagagggggtgtgagtaaagcctccaaggttatcaatctaagtgaagatatttttgctggcttcaactctacactccgtgaaggaaatgttactcaccatgagtacatacaagtagggaagggaagagatgtgggtctcaatcagatttctatgtttgaagcaaaaatagctaatgggaatggagagcaaacactaagtcgagacgtataccgacttggacaccgttttgacttcttcagaatgttgtcctgttatttcaccacagttggattttatttcagcactcttataactgttctcactgtatatgtattcctctatggtcgcctctatcttgttctcagtgggctcgaagaaggtctgagcactcaaaaagccattcgagacaataagcctcttcaagtggctcttgcttctcagtcatttgttcaaattggggttttgatggccttgcccatgttgatggaaatcggtttggagaggggtttccgaactgcacttagtgagttcatattaatgcaactgcagcttgccccagtattcttcacattttcacttgggacaaaaactcattattttggaagaacattacttcatggaggtgcgaaatatagacccactggtcgaggatttgtggttttccatgctaaatttgctgacaactatagactttactctcgtagccactttgtcaagggtattgagctcatgatattacttgttgtatatgaaatttttggtcattcttacagaagtactgttgcatatatcttgattaccgcatcaatgtggtttatggtgggtacctggctgtttgctcccttcttgttcaatccttctgggtttgaatggcaaaaaattgttgatgattggaccgattggaataaatggattagtaatcgagggggtataggtgtactgcctgaaaaaagttgggaatcttggtgggaagaggaacaagagcatctccaatattctggaatgcggggaattatagtggagatactgttatcattgagattttttatctaccagtatggtctggtatatcacttaaatattacgaagaaaggcacaaaaagttttctggtctatggcatttcatggttggtgatattcgtaatattgtttgtgatgaagacggtatctgttgggaggcgtaaattcagtgcaaattttcaacttgtcttccgactaatcaagggaatgatattcctcacttttgtctcgattcttgtcattttgattgctcttccgcatatgacagtgcaggacattgttgtttgcattcttgctttcatgccaactggttggggaatgctgcagattgctcaagcattaaaacctgtagtacgccgggctgggttttggggatcagtgaaaactcttgctcgaggttatgagattgtcatgggtttgctattgttcactcctgttgcttttctggcttggtttccatttgtttcagaatttcaaacccgtatgctgttcaaccaagcattcagcagaggtttgcaaatttctcgtattcttggtggccaaaggaaggaacgctcttctcgcaacaaagaataggttgttaactctgaagggttaattattaggagtccaaaattcttggttgccgtaagagctgtattaattgtaagtagttgtaactatgaatctgacagattctactctttgctttcattgtaacatttgagtaatcattatcattatcaaacatgaaagttattaagtcttcacatgtaagccctaagctatgcatcttcagagtgatatagattcgcttgtgttgcacctacaaaacaactataataggatcgatcgaacttgtgtgcaggatcgttttaatttttcttttttgtactgtgttaacgtggacaatagagtgtcgcactccaagccaaactatagattaggttaattgataccacgattttacttttttttaaagatcaatacgctggataatttattgatgaatagagtttagagaaactacattcaagatgatttggtatgaaaatcattatataaaggtacgaatatttattctcatttgttgggaagttgtttg

SEQ ID NO: 8758 - DNA, 6573 bp, Glycine max
ctgcaaatgtccgcaacctctcactctctccttttctttgcaccttttccttagcttcgaagtagcttaataagcttctctgtctctgtgctagggtttcaaattccattcctgcatctctctctctctatatatgctccaacattagtaatcacaatccgaatctccattctcctttctctgtctgtcgttctatagagtggtcggaatgtcgtcgtccagaggaggcgcggggccgtcctcggaggcgccgccgccgaggcggatcatgcggacgcagactgcggggaacttgggagagtcggtgattgacagtgaggtggtgccttcctctctggtcgagattgcgcccattcttcgtgtcgctaacgaagttgaaaagactcatccaagggttgcttatctctgccgtttttatgcctttgagaaagctcataggttggatcccaactcaagtggtcgtggtgttcgccaattcaaaactgcacttcttcaacgccttgaaagagaaaacgatccaactttgaaaggaagggtaaagaaaagtgatgctcgcgagatgcagagtttttatcagcattactacaaaaaatatatccaagctttacaaaatgctgctgataaagctgaccgtgcacagcttaccaaggcatataacacagctaatgttctttttgaggttttgaaggctgttaacatgacacaatctatggaagttgatcgcgagattttggagacccaagataaagttgctgagaaaacagagatcttagtcccttataatattcttcctcttgatcctgatagtgctaaccaggctataatgagatttcctgagatccaagctgctgtatatgctcttcgtaacactaggggtcttccttggccgaaggacttcaagaaaaaaaaggatgaagacatcctggattggcttgggtcgatgtttggatttcagaaacacaatgttgcaaatcagagagagcatttgatcttactgcttgctaatgttcacataagacaatttccaaagccggatcagcaaccaaagttggatgagcgtgctctgacagaagtgatgaagaaactgtttaagaattacaaaaagtggtgcaagtatctgggtcggaaaagtagcctttggttacctaccattcagcaagaagtacagcagcgcaaactactatatatgggtctgtatcttctaatatggggtgaagctgccaacttaagattcatgccagaatgcctttgttatatatatcaccatatggcttttgaattgtatggtatgcttgcgggtaatgtcagtccgatgacgggagagaatgtgaagccagcatatggaggtgaagatgaggcttttttaaggaaagttgtcactcctatctataacgtgattgctaaggaagctgcacgtagcaaaaagggaaggtcaaaacattcacaatggagaaactatgacgatttaaatgaatatttctggtccgctgattgttttcgattaggttggccaatgcgtgctgatgctgatttcttttgcctgccagctgaaaagctggtttttgataaatcaaatgatgacaagccacctagcagagacagatgggttgggaaagtgaattttgttgagattagatcattttggcatatgtttagaagtttcgatcgaatgtggagttttttcattctgtgtttacaggctatgattgttgttgcttggaatggatctggggatcccagtgcaatctttaatggtgatgtgttcaagaaggtgttgagtgtgtttataactgcagcaatattgaagtttgggcaagctgttctagatgtgatcttgagttggaaagcacaatggagtatgtcactgtatgttaagttaagatacattctcaaagttgtttcagctgcagcatgggtgattgttctgtcagttacttatgcgtatacttgggataatcctcctgggtttgctcaaaccattaaaagttggtttggaagtggtggttcaagtgctccttcattgtttattttggctgttgttgtttacctgtcaccaaatatgcttgctgcaatattctttctgatcccttttattcgtcgtcatctcgaaaggtcgaactataggattgtgatgctaatgatgtggtggtcacagcctcgtttatatgttggtaggggaatgcatgagagcgcattttcccttttcaaatacacaatgttttgggtcttactcataattacgaagttggctttcagttactatatagagataaaacctctggtgggacctacaaaagctataatgagtgtaaaaatcacaactttccagtggcatgaattctttcctcatgctaggaataatattggcgttgtaattgcactttgggctccaattattctggtatactttatggatacccaaatttggtatgccatattctcaacattatttggtggtatttatggtgcctttcgtcggcttggggagatacggacactgggaatgctgaggtctcgttttcaatcattgcctggtgccttcaatgccagtttgattccggaagaaacaaatgagccaaagaaaaaaggattaaaagccactttatcccgcagatttcctgagatctcatcaaacaaagggaaggaggctgcaaggtttgcacaattgtggaaccaaataattactagtttcagggatgaagatcttattaatgatagggaaatgaaccttttgctggtaccttattgggctgatactcagttggaccttatacaatggcccccctttctacttgctagcaagattccaattgcactggatatggccaaagatagcaatggaaaggaccgagagctgaagaaaagaattgcggctgacaactacatgtcttgtgctgtccgtgagtgctatgcttcatttaagagcattattaagcacttggttcaaggggaacgagagataccggttatagagtacatgtttgatgaagtggataaaaatatagaaacagataaactgattagtgaattcagaatgagtgcacttcctagcctctatgcacagtttgtcgagctaacccaatatttattgaataatgatccgaaagatagggacaacgttgttattctattccaggacatgctggaggtcgtgacaagagatataatgatggaggatcaggatcaaatattcagtttggtagattcaagccatggtggtaccggacatgaggggatgcttcaccttgagcctgagccacatcaccaactgtttgcatctgaaggagctatcaagtttccaattgaaccacttacagcagcttggacagagaagattaaacgacttcacttgctgcttacgacaaaagaatctgccatggatgtaccatctaacttggaagctagaaggcgtatttctttcttctcaaattctttgtttatggacatgcctatggcgccaaaagttcgcaacatgctttcattctcggttttgacaccatattatacagaagaagttttattctccttgcatgatttggattcacagaatgaggatggggtttcaatactgttctacttgcaaaagatttatccagatgagtggaacaattttcttgaacgagtgaaatctactgaggaggatattaaagggagtgaatttgatgagttagtagaagaacgtcgtctttgggcatcatatagagggcaaacattgaccagaactgtaagaggtatgatgtattatagaaaagctttggaactccaggcttttcttgatatggccaaagatgaagatttgatggaaggttataaagccatggaaaactcagatgacaattcaaggggggaaaggtcattgtggacacagtgtcaagcagtagctgatatgaaattcacatatgtggtatcatgccaacaatatggcattgataagcgatctggttctcttcgtgcacaggacatattaaggcttatgacaagatatccgtctctccgagttgcctatattgatgaggtagaagaacctgtccaagacagtaagaaaaagatcaacaaggtttactactcttgcttggtgaaggctatgccaaaatccaatagtccttcagagcctgagcagaatctggaccagatcatatataaaataaagcttcctggaccagcaattttgggtgagggtaagccagaaaatcagaatcatgccataattttcacacgtggagagggattgcaaacaatagatatgaaccaggataactacatggaagaagctttgaaaatgagaaatttgttgcaagaatttcttaagaagcatgatggtgttcggttccctagtattcttggacttagggagcatatatttactggaagtgtttcttcccttgcatggttcatgtcaaatcaggagacaagtttcgtgacaattggtcagagattgttggctaatcctttgaaggttcgtttccattatggtcatcctgatgtctttgataggctttttcacctgacgagagggggtgtgagtaaagcctccaaggttatcaatctaagtgaagatatttttgctggcttcaactctacactccgtgaaggaaatgttactcaccatgagtacatacaagtagggaagggaagagatgtgggtctcaatcagatttctatgtttgaagcaaaaatagctaatgggaatggagagcaaacactaagtcgagacgtataccgacttggacaccgttttgacttcttcagaatgttgtcctgttatttcaccacagttggattttatttcagcactcttataactgttctcactgtatatgtattcctctatggtcgcctctatcttgttctcagtgggctcgaagaaggtctgagcactcaaaaagccattcgagacaataagcctcttcaagtggctcttgcttctcagtcatttgttcaaattggggttttgatggccttgcccatgttgatggaaatcggtttggagaggggtttccgaactgcacttagtgagttcatattaatgcaactgcagcttgccccagtattcttcacattttcacttgggacaaaaactcattattttggaagaacattacttcatggaggtgcgaaatatagacccactggtcgaggatttgtggttttccatgctaaatttgctgacaactatagactttactctcgtagccactttgtcaagggtattgagctcatgatattacttgttgtatatgaaatttttggtcattcttacagaagtactgttgcatatatcttgattaccgcatcaatgtggtttatggtgggtacctggctgtttgctcccttcttgttcaatccttctgggtttgaatggcaaaaaattgttgatgattggaccgattggaataaatggattagtaatcgagggggtataggtgtactgcctgaaaaaagttgggaatcttggtgggaagaggaacaagagcatctccaatattctggaatgcggggaattatagtggagatactgttatcattgagattttttatctaccagtatggtctggtatatcacttaaatattacgaagaaaggcacaaaaagttttctggtctatggcatttcatggttggtgatattcgtaatattgtttgtgatgaagacggtatctgttgggaggcgtaaattcagtgcaaattttcaacttgtcttccgactaatcaagggaatgatattcctcacttttgtctcgattcttgtcattttgattgctcttccgcatatgacagtgcaggacattgttgtttgcattcttgctttcatgccaactggttggggaatgctgcagattgctcaagcattaaaacctgtagtacgccgggctgggttttggggatcagtgaaaactcttgctcgaggttatgagattgtcatgggtttgctattgttcactcctgttgcttttctggcttggtttccatttgtttcagaatttcaaacccgtatgctgttcaaccaagcattcagcagaggtttgcaaatttctcgtattcttggtggccaaaggaaggaacgctcttctcgcaacaaagaataggttgttaactctgaagggttaattattaggagtccaaaattcttggttgccgtaagagctgtattaattgtaagtagttgtaactatgaatctgacagattctactctttgctttcattgtaacatttgagtaatcattatcattatcaaacatgaaagttattaagtcttcacatgtaagccctaagctatgcatcttcagagtgatatagattcgcttgtgttgcacctacaaaacaactataataggatcgatcgaacttgtgtgcaggatcgttttaatttttcttttttgtactgtgttaacgtggacaatagagtgtcgcactccaagccaaactatagattaggttaattgataccacgattttacttttttttaaagatcaatacgctggataatttattgatgaatagagtttagagaaactacattcaagatgatttggtatgaaaatcattatataaaggtacgaatatttattctc

SEQ ID NO: 8759 - DNA, 6479 bp, Glycine max
ataataaagtaaagagaaaatggtctttgtgatgtatgtatgtatggagtagtgtggtgcaatgtccgcaagcagcaatagttagtaagtaagagtaactctctctggtttccttagcttggaagtagcttagcaagcttcacactcttagcctagggtttcctcatccctgccattgcctccattctcctttctccatcctactcatctttttctttgcacattttgcttgagagtgctcggaatgtcgtcgtccagaggaggcgctgggccgtcctcggaggctccgccgccgaggcggatcatgcggactcagactgcggggaacttgggagagtcggtgattgacagtgaggtggtgccttcctctctggtcgagattgcgcccattcttcgtgtcgctaacgaagttgaaaagactcatcccagggttgcttatctctgccgtttttatgcctttgagaaagctcataggttggatcccaattcaagtggtcgtggtgttcgccaattcaaaactgcgcttcttcaacgccttgaaagagaaaacgatccaactctgaagggaagggtaaagaaaagtgatgctcgcgagatgcagagtttttatcagcattactacaaaaaatatatccaagctttacaaaatgctgccgataaagctgaccgtgcacagcttaccaaggcgtataacacagctaatgttctttttgaggttttgaaggctgttaacatgacacaatctatggaagttgatcgcgagattttggagacccaagataaagttgctgagaaaaccgagatcttagtcccttacaatattcttcctcttgatcctgacagtgctaaccaggctataatgagatttcctgagatccaagctgctgtatatgctcttcgtaacaccaggggtcttccttggcctaaggactacaagaaaaaaaaggatgaagacatcctggattggcttgggtcgatgtttggatttcagaaacacaatgttgcaaatcagagagaacatttgatcttactgcttgctaatgttcacataagacaatttccaaagcctgatcagcaaccaaagttggatgaacgtgctctgacagaagtgatgaagaaactgttcaagaattacaaaaagtggtgcaagtatttgggtcggaaaagtagcctttggttacctaccattcagcaagaagtacagcagcgcaaactactatatatgggtctgtatcttctaatatggggtgaagctgccaacctaagattcatgccagaatgcctttgttatatatatcaccatatggcttttgaattgtatggtatgcttgcgggtaatgtcagtccgatgacaggagagaatgtgaagccagcgtatggaggtgaagaggaggcttttttaaggaaagtggtcactcctatctataacgtgattgctaaggaagctgcacgtagcaaaaagggaaggtcaaagcattcacaatggagaaactatgacgatttaaatgaatatttctggtctgctgattgttttcgagtaggttggccaatgcgtgctgatgctgatttcttttgcctcccagccgaaaagctggtttttgataaatcaaatgatgacaagccacctagcagagacagatgggttggaaaagtgaattttgttgagattagatcattttggcatatgtttagaagttttgatcgaatgtggagttttttcattctgtgtttacaggctatgattattgttgcttggaatggatctggggatcccagtgcaatatttaatggtgatgtgttcaagaaggcattgagtgtgtttataacagcagcaatattgaagtttgggcaagctgttctagatgtgatcctaagttggaaagcacaacagagtatgtcgctgtatgttaagttaagatacattctaaaagttgtttcagctgcagcatgggtgattgttctctcagttacttatgcgtatacttgggataatcctcctgggtttgctcaaaccattaaaagttggtttggaagtggtggttcaagttctccttcattgtttattctggctgttgttgtttacctgtcaccaaatatgcttgctgcgatattctttctgatcccttttattcgtcgtcatctcgaaaggtcgaactataggattgtaatgctaatgatgtggtggtcacagcctcgattgtatgttggtaggggaatgcatgagagcgcattttcccttttcaaatacacaatgttttggatcttgctcataattacgaagttggctttcagttactatatagagataaaacctctggtgggacctacgaaagctataatgagtgtaaaaatcacaatcttccagtggcatgaattctttcctcatgctaggaacaatattggtgttgtaattgcactttgggctccaattattctggtatactttatggatacccaaatttggtatgccatattctcaacattatttggtggtgtttatggggcctttcgtcggcttggggagatacggacactgggaatgctaaggtctcgttttcaatcattgcctggtgccttcaatgccagtttgattccggaagaaacaaatgagccaaagaaaaaaggattaaaagccactttatcccgcagatttcctgagatctcatctaacaaagggaaggaggctgcaaggtttgcacagttgtggaaccaaataattactagtttcagggatgaagatcttattgatgatagggaaatgaaccttttgcttgtaccttattgggctgatactcagttggaccttatacaatggcccccctttcttcttgctagcaagattccaattgcactggatatggcgaaggacagcaatggaaaggaccgagagctgaagaaaagaattgcggctgataactacatgtcttgtgctgtccgtgagtgctatgcttcatttaagagcattattaagcacttggttcaaggggaacgagagataccggttatagagtacatgttcaatgaagtggataaacatatagaatcagataaactgattagtgaattcaaaatgagtgcacttcctatcctctatggacagtttgttgagttaatccaatatttgttgacaaatgatccgaaagatagggaccgagttgttcttctattccaggacatgctggaggttgtgacaagagatataatgatggaggatcaggatcaaatattcagtttggtagattcaagccatggtggtactggacatgaggggatgcttcaccttgagcctgagccacatcaccaactttttgcatctgaaggagctatcaagtttccaattgaaccacttacagcagcttggacagagaagattaaacgacttcacttgctgcttacgacaaaagaatctgccatggatgtaccatccaacttggaagcaaggagacgtatttctttcttctcaaattcgttgtttatggacatgcctatggcaccaaaagttcgcaacatgctttcattctcggttttgacaccatactatacagaagaagttctattctccttgaatgatttggattcacagaatgaggatggggtttcaatactgttctacttgcaaaagatttttccagatgagtggaacaattttcttgaacgagtgaattctactgaggaggatattaaagggagtgaatctgatgagttagtagaagaacttcgtctttgggcatcatataaggggcaaacattgaccagaactgtaagaggtatgatgtattatagaaaagctttggaactccaggcttttcttgatatggccaaagatgaagatttgatggaaggttataaagccatggaaaactcagatgacaattcaaggggggaaagatcattgtggacacagtgtcaagcagtagctgatatgaaatttacatatgtggtatcgtgccaacaatatggcattgataagcgatctggttctcctcgtgcacaggacatattaaggcttatgacaagatatccgtcactccgagttgcctatattgatgaggtagaggaacctgtcaaagacagcaagaaaaagatcaacaaggtttactactcttgcttggtgaaggctatgcctaaatcgaatattccttcagagcctgagcggaatctggaccagatcatatataaaataaagcttcctggaccagcgattttgggtgagggtaagcccgaaaatcagaatcatgccataattttcacacgtggagagggcttgcaaacaatagatatgaaccaggataactacatggaagaagctttgaaaatgagaaatttgttgcaagaatttcttaagaagcatgatggtgttcggttccctagtattcttggacttagggagcatatatttactggaagtgtttcttcccttgcatggttcatgtcaaatcaggaaacaagttttgtgacaattggtcagagattgttggctaatcctttgaaggttcgtttccattatggtcatcctgatgtctttgataggctttttcacctgacaagagggggtgtgagtaaagcctccaaagttatcaatctaagtgaagatatttttgctggcttcaactctacactccgtgaaggaaatgttactcaccatgagtacatacaagtagggaagggaagagatgtgggtctcaatcagatttctatgtttgaagcaaaaatagctaatgggaatggagagcaaacactaagtcgagatgtataccgacttgggcaccgttttgacttcttcagaatgttgtcctgttatttcaccacagttggattttatttcagcactcttataactgttctcactgtgtatgtattcctctatggtcgcctctatcttgttctcagtgggctcgaagaaggtctgagcactcagaaagccattcgagacaataagcctcttcaagtggctcttgcttctcagtcatttgttcaaattggggttttgatggccttgcccatgttgatggaaattggtttggagaggggtttccgaactgcacttagtgagttcatattgatgcaactgcagcttgccccagtattcttcacattttcacttgggacaaaaactcattattttggaaggacattgcttcatggaggtgcgaagtatagacccactggtcgaggatttgtggttttccatgctaaatttgctgacaactatagactttactctcgtagccactttgtcaagggtattgagctcatgatattgcttgttgtatatcaaatttttggtcattcttacagaagtactgttgcgtatatcttgattaccgcatcaatgtggtttatggtgggtacctggctgtttgctcccttcttgttcaatccttctggttttgaatggcaaaaaattgttgatgattggaccgattggaataaatggattagtaatcgagggggtataggtgtaccgcctgaaaaaagttgggaatcttggtgggaagaggaacaagagcatctccaatattcaggaatgcggggaatcatagtggagatactgttatcgttgcgattttttatctaccagtatggtctggtatatcacttaaatattacgaagaaaggcccaaaaagttttctggtctatggcatttcgtggttggtgatattcgtaatattgtttgtgatgaagacagtatctgttgggaggcgtaaattcagtgcaaactttcaacttgtcttccgactaatcaagggaatgatattcctcacttttgtctcgattcttgtcattttgattgctcttccgcatatgacagtgctggacattgttgtttgcattctagctttcatgccaactggttggggaatgctgcagattgctcaagcattaaaacctgtagtacgccgggctgggttttggggatcagtgaaaactcttgctcgaggttatgagattgtcatgggtttgctattgtttactcctgttgcttttctggcttggtttccttttgtttcagaatttcaaacccgtatgttgttcaaccaagcattcagcagaggtttgcaaatttctcgtattcttggtggccaaaggaaggagcgctcttctcgtaacaaagaataggttgtctaactctgaaggcttttaattattaggagcccgaaattcttggttgccttaagagctgtagcaattgtaagtagttgtatctatgaatgtgacagattctactctttgctttcattgtagcatttgagtatcattatcatgatccaacatgaaacttattaagtcttcacatgtatgcatcttcagagatatagattctcacgtgttgcacctacgaaacaaatataataggatcgatcgaacttgcgtgcaggatcgttttaatttttcttttttgtgcgtgctaacgttaggggagagtaggaataggcgtggaccctagagtgtcgcactccaagccaaaatataaact

SEQ ID NO: 8760 - DNA, 6421 bp, Glycine max
atgtccgcaagcagcaatagttagtaagtaagagtaactctctctggtttccttagcttggaagtagcttagcaagcttcacactcttagcctagggtttcctcatccctgccattgcctccattctcctttctccatcctactcatctttttctttgcacattttgcttgagagtgctcggaatgtcgtcgtccagaggaggcgcggggccgtcctcggaggcgcctccgccgaggcggatcatgcggactcagactgcggggaacttgggagagtcggtgattgacagtgaggtggtgccttcctctctggtcgagattgcgcccattcttcgtgtcgctaacgaagttgaaaagactcatcccagggttgcttatctctgccgtttttatgcctttgagaaagctcataggttggatcccaattcaagtggtcgtggtgttcgccaattcaaaactgcgcttcttcaacgccttgaaagagaaaacgatccaactctgaagggaagggtaaagaaaagtgatgctcgcgagatgcagagtttttatcagcattactacaaaaaatatatccaagctttacaaaatgctgccgataaagctgaccgtgcacagcttaccaaggcgtataacacagctaatgttctttttgaggttttgaaggctgttaacatgacacaatctatggaagttgatcgcgagattttggagacccaagataaagttgctgagaaaaccgagatcttagtcccttacaatattcttcctcttgatcctgacagtgctaaccaggctataatgagatttcctgagatccaagctgctgtatatgctcttcgtaacaccaggggtcttccttggcctaaggactacaagaaaaaaaaggatgaagacatcctggattggcttgggtcgatgtttggatttcagaaacacaatgttgcaaatcagagagaacatttgatcttactgcttgctaatgttcacataagacaatttccaaagcctgatcagcaaccaaagttggatgaacgtgctctgacagaagtgatgaagaaactgttcaagaattacaaaaagtggtgcaaatatttgggtcggaaaagtagcctttggttacctaccattcagcaagaagtacagcagcgcaaactactatatatgggtctgtatcttctaatatggggtgaagctgccaacctaagattcatgccagaatgcctttgttatatatatcaccatatggcttttgaattgtatggtatgcttgcgggtaatgtcagtccgatgacaggagagaatgtgaagccagcgtatggaggtgaagaggaggcttttttaaggaaagtggtcactcctatctataacgtgattgctaaggaagctgcacgtagcaaaaagggaaggtcaaagcattcacaatggagaaactatgacgatttaaatgaatatttctggtctgctgattgttttcgagtaggttggccaatgcgtgctgatgctgatttcttttgcctcccagccgaaaagctggtttttgataaatcaaatgatgacaagccacctagcagagacagatgggttggaaaagtgaattttgttgagattagatcattttggcatatgtttagaagttttgatcgaatgtggagttttttcattctgtgtttacaggctatgattattgttgcttggaatggatctggggatcccagtgcaatatttaatggtgatgtgttcaagaaggcattgagtgtgtttataacagcagcaatattgaagtttgggcaagctgttctagatgtgatcctaagttggaaagcacaacagagtatgtcgctgtatgttaagttaagatacattctaaaagttgtttcagctgcagcatgggtgattgttctctcagttacttatgcgtatacttgggataatcctcctgggtttgctcaaaccattaaaagttggtttggaagtggtggttcaagttctccttcattgtttattctggctgttgttgtttacctgtcaccaaatatgcttgctgcgatattctttctgatcccttttattcgtcgtcatctcgaaaggtcgaactataggattgtaatgctaatgatgtggtggtcacagcctcgattgtatgttggtaggggaatgcatgagagcacattttcccttttcaaatacacaatgttttggatcttgctcataattacgaagttggctttcagttactatatagagataaaacctctggtgggacctacgaaagctataatgagtgtaaaaatcacaatcttccagtggcatgaattctttcctcatgctaggaacaatattggtgttgtaattgcactttgggctccaattattctggtatactttatggatacccaaatttggtatgccatattctcaacattatttggtggtgtttatggggcctttcgtcggcttggggagatacggacactgggaatgctaaggtctcgttttcaatcattgcctggtgccttcaatgcgagtttgattccggaagaaacaaatgagccaaagaaaaaaggattaaaagccactttatcccgcagatttcctgagatctcatctaacaaagggaaggaggctgcaaggtttgcacagttgtggaaccaaataattactagtttcagggatgaagatcttattgatgatagggaaatgaaccttttgcttgtaccttattgggctgatactcagttggaccttatacaatggcccccctttcttcttgctagcaagattccaattgcactggatatggcgaaggacagcaatggaaaggaccgagagctgaagaaaagaattgcggctgataactacatgtcttgtgctgtccgtgagtgctatgcttcatttaagagcattattaagcacttggttcaaggggaacgagagataccggttatagagtacatgttcaatgaagtggataaacatatagaatcagataaactgattagtgaattcaaaatgagtgcacttcctatcctctatggacagtttgttgagctaatccaatatttgttgacaaatgatccgaaagatagggaccgagttgttcttctattccaggacatgctggaggttgtgacaagagatataatgatggaggatcaggatcaaatattcagtttggtagattcaagccatggtggtactggacatgaggggatgcttcaccttgagcctgagccacatcaccaactttttgcatctgaaggagctatcaagtttccaattgaaccacttacagcagcttggacagagaagattaaacgacttcacttgctgcttacgacaaaagaatctgccatggatgtaccatccaacttggaagcaaggagacgtatttctttcttctcaaattcgttgtttatggacatgcctatggcaccaaaagttcgcaacatgctttcattctcggttttgacaccatactatacagaagaagttctattctccttgaatgatttggattcacagaatgaggatggggtttcaatactgttctacttgcaaaagatttttccagatgagtggaacaattttcttgaacgagtgaattctactgaggaggatattaaagggagtgaatctgatgagttagtagaagaacttcgtctttgggcatcatataaggggcaaacattgaccagaactgtaagaggtatgatgtattatagaaaagctttggaactccaggcttttcttgatatggccaaagatgaagatttgatggaaggttataaagccatggaaaactcagatgacaattcaaggggggaaagatcattgtggacacagtgtcaagcagtagctgatatgaaatttacatatgtggtatcgtgccaacaatatggcattgataagcgatctggttctcctcgtgcacaggacatattaaggcttatgacaagatatccgtcactccgagttgcctatattgatgaggtagaggaacctgtcaaagacagcaagaaaaagatcaacaaggtttactactcttgcttggtgaaggctatgcctaaatcgaatattccttcagagcctgagcggaatctggaccagatcatatataaaataaagcttcctggaccagcgattttgggtgagggtaagcccgaaaatcagaatcatgccataattttcacacgtggagagggcttgcaaacaatagatatgaaccaggataactacatggaagaagctttgaaaatgagaaatttgttgcaagaatttcttaagaagcatgatggtgttcggttccctagtattcttggacttagggagcatatatttactggaagtgtttcttcccttgcatggttcatgtcaaatcaggaaacaagttttgtgacaattggtcagagattgttggctaatcctttgaaggttcgtttccattatggtcatcctgatgtctttgataggctttttcacctgacaagagggggtgtgagtaaagcctccaaagttatcaatctaagtgaagatatttttgctggcttcaactctacactccgtgaaggaaatgttactcaccatgagtacatacaagtagggaagggaagagatgtgggtctcaatcagatttctatgtttgaagcaaaaatagctaatgggaatggagagcaaacactaagtcgagatgtataccgacttgggcaccgttttgacttcttcagaatgttgtcctgttatttcaccacagttggattttatttcagcactcttataactgttctcactgtgtatgtattcctctatggtcgcctctatcttgttctcagtgggctcgaagaaggtctgagcactcagaaagccattcgagacaataagcctcttcaagtggctcttgcttctcagtcatttgttcaaattggggttttgatggccttgcccatgttgatggaaattggtttggagaggggtttccgaactgcacttagtgagttcatattgatgcaactgcagcttgccccagtattcttcacattttcacttgggacaaaaactcattattttggaaggacattgcttcatggaggtgcgaagtatagacccactggtcgaggatttgtggttttccatgctaaatttgctgacaactatagactttactctcgtagccactttgtcaagggtattgagctcatgatattgcttgttgtatatcaaatttttggtcattcttacagaagtactgttgcgtatatcttgattaccgcatcaatgtggtttatggtgggtacctggctgtttgctcccttcttgttcaatccttctggttttgaatggcaaaaaattgttgatgattggaccgattggaataaatggattagtaatcgagggggtataggtgtaccgcctgaaaaaagttgggaatcttggtgggaagaggaacaagagcatctccaatattcaggaatgcggggaatcatagtggagatactgttatcgttgcgattttttatctaccagtatggtctggtatatcacttaaatattacgaagaaaggcccaaaaagttttctggtctatggcatttcgtggttggtgatattcgtaatattgtttgtgatgaagacagtatctgttgggaggcgtaaattcagtgcaaactttcaacttgtcttccgactaatcaagggaatgatattcctcacttttgtctcgattcttgtcattttgattgctcttccgcatatgacagtgctggacattgttgtttgcattctagctttcatgccaactggttggggaatgctgcagattgctcaagcattaaaacctgtagtacgccgggctgggttttggggatcagtgaaaactcttgctcgaggttatgagattgtcatgggtttgctattgtttactcctgttgcttttctggcttggtttccttttgtttcagaatttcaaacccgtatgttgttcaaccaagcattcagcagaggtttgcaaatttctcgtattcttggtggccaaaggaaggagcgctcttctcgtaacaaagaataggttgtctaactctgaaggcttttaattattaggagcccgaaattcttggttgccttaagagctgtagcaattgtaagtagttgtatctatgaatgtgacagattctactctttgctttcattgtagcatttgagtatcattatcatgatccaacatgaaacttattaagtcttcacatgtatgcatcttcagagatatagattctcacgtgttgcacctacgaaacaaatataataggatcgatcgaacttgcgtgcaggatcgttttaatttttcttttttgtgcgtgctaacgttaggggagagtaggaataggcgtggaccctagagtgtcgcactccaagccaaaatataaactaag

SEQ ID NO: 8761 - DNA, 6617 bp, Cicer arietinum
aaaagaatagaaaaacgtgtttgtattatgactggaaccgacaataggaactgagtcactcactttctcactctcctttccttagcttcgaagtagctttgtagtttgcacgctacatctctctcacactctcctagggtttcttcccctcaaccaaaccctacatttccactttctctcttctctccacaatcctcaaccatttccattattaacttccctttctttttcgctctgtgaagataagcgagcaggaagagtttaattcggaatgtcgtcgtcttcgaggggagcagggccgtcggaacctccgcaacggcggattatacggacgcaaactgccggaaatctaggagagtcaatatttgacagtgaagttgttccttcatctctagttgagattgcacctattcttcgtgttgctaatgaagttgaaaagacacatcctagagttgcttatttatgtcgattttatgcttttgagaaagctcataggttggaccctacttcaagtggtcgcggtgttcgtcaattcaaaacagctcttcttcaacgccttgaaagagaaaatgatccaactttgaagggaagggttaagaaaagtgatgctcgtgagatgcagagtttttatcaacattactacaaaaaatatatccaagctttacaaaatgctgctgataaagctgaccgcgcacagcttaccaaggcatatcagactgcaaatgttctgtttgaggttttgaaggctgttaacatgacccaatctatggaagttgaccgtgagattttggagacacaagataaagttgccgagaaaacagagatcttagtcccttacaatattcttcctcttgatcctgatagtgcgaatcaggcgataatgagatttcctgagatccaagctgctgtatttgctcttcgtaacactaggggtcttctgtggcctaaggactacaagaaaaaaaaagacgaagacattttggattggctagggtcgatgtttggatttcagaagcacaatgttgcaaatcagagagaacatttaatcttattacttgctaatgttcacataagacaatttccaaagcctgatcagcaacccaagttggacgagcgtgcactgaccgaagtcatgaagaaactgttcaagaattacaaaaaatggtgcaaatatttggatcggaaaagtagcctttggttacctaccatacagcaagaagtgcagcagcgcaaacttctatatatgggtctatatcttctaatatggggtgaagctgccaacctaagattcatgccggaatgcctttgttatatatatcaccatatggcttttgaattatatggtatgcttgctggtaatgtcagtccaatgactggcgagaatatcaagccagcttatggaggtgaagaggaagctttcttacggaaagtggtcactcctatctacaacgtgattgcagaggaagctaaaaagagcaaaaagggaaggtcaaagcattcacaatggcggaactatgatgatttaaatgaatatttctggtctgctgattgttttcggttgggttggccaatgcgtgctgatgccgatttctttagcctgccatctgagcgggtggtttttgacaaatcgaatgatgacaagccggctaacagagacagatgggttgggaaagttaatttcgttgagataagatcgttttggcatcttttcagaagttttgatcgtatgtggagttttttcattctgagtttacaggctatgattattgttgcctggaatggatctggagatccaactgtgatctttaatggggatgtcttcaagaaggtgttgagtgtgtttattactgcagctatattgaagcttgggcaagctgttcttgatgtgatcgtaagttggaaagcacggcagagtatgtcattgtatgttaaattaagatatattctaaaagttgtctcagctgcagcatgggtgattgttctgtcagttacttatgcatatacttgggataatcctcctgggtttgctcaaactattaaaagttggtttggtagcagttcaagtgcgccttcattatttattttggctgttgttgtttacctgtcaccaaatatgcttgctgcgatattctttctcttcccattcattcgtcgctatctcgagaggtcaaactataggattgtgatgttaatgatgtggtggtcacagcctcgcctctatgttggtaggggaatgcatgagagtacattttcccttttcaagtacacaatgttttggttcctccttatagttacaaaattggctttcagttactatatagagataaaacctctggtgggacctacaaaagctataatgagtgtgaaaatcacaactttccaatggcatgaattctttccccatgctaggaacaatattggggttgtagttgctctttgggctccaattatgctggtatactttatggatacacaaatttggtatgcaatattctcgaccttatttggtgggatttatggtgcattccgtcgcctgggggagatacggacactaggaatgcttaggtctcgatttcaaacattgcctggcgccttcaatgccagtttgattcctgaggaaacaacagatgagccaagaaaaaaaggattaaaggccacattatctcgcagatttactgaggtcccatctaacaaagggaagaaagccgcaaggtttgcacagctgtggaaccaaataattactagttttagagaggaagatcttattagtgatagggaaatggaccttttgcttgtaccttattgggctgatactcagttggaccttatacaatggcccccctttctacttgctagcaagatcccaattgcattagatatggccaaggacagcaatggaaaggatcgagagctgacaaaaataattgaggctgacaactacatgttttgcgctgtccgtgagtgctatgcttcatttaagagcattatgatgcagttggttcgaggggaacgagagaaaccagttatagagttcatgttcagtgaggtagacaagcatatagcggaaggtacattaataaaggaattcaaaatgagtgctctacctagcctctatgaacagtttgttcagctaatcaaatatttgttggaaaataatcagaaagatagggaccaagttgtaattctattccaggacatgctggaagttatgacgagagatataatgatggaggatcaggatcaaatattcagattggtagattcaaatcatggcggtgctggacatgaagggatgtttccccttgaacctgagccacagcatcagctatttgcatctgaaggtgctatcaggtttccaattgagccagttacagcagcttggactgagaagattaaacggcttttcttgctgcttactacaaaagaatctgccatggacgtaccctctaacttagaagcaagaaggcgtatttctttcttctcaaattcattatttatggacatgccattggcaccaaaagttcgcaacatgctttcattttcggttttaacaccgtactacacggaagaggttctcttttcgttacataatttggattcaccaaacgaagatggtgtttcaatactattttatttgcaaaagatatttccagatgagtggaacaactttcttcagcgagtgaagtgctccagtgaggaggaacttaaagggaatgaatatgaagagttagaagaagagcttcgtctatgggcatcatatagagggcaaactttgacaagaactgtaaggggtatgatgtattatagaaaagctttggagcttcaagcttttcttgatatggccaaagacgaagatttgatggaaggctacaaagccatggaaaatttggatgataactcaaggggagaaaagtcattgttgacacagtgccaagcagtagctgatatgaaattcacatatgttgtatcatgccaacaatatgggattgacaagcgatctggttctctccgcgcacatgacatattaaggcttatgacaagatacccttcacttcgagttgcctatattgatgaggtagaagaacctatcaaagacactaagaaaaaaatcaacaaagtttattactcttgcttggtgaaggccatgccgaaatccagtagtccttcagagcccgagcagaatctggaccaggtcatatataaaataaagcttcctggaccagcgattttaggcgaaggtaagcctgaaaatcaaaatcatgccataatttttacacgtggagaaggcttgcaaacaatagatatgaaccaggataattacatggaagaagctttgaaaatgagaaatttgttgcaagaatttcttaagaagcatgacggtgtgaggttccctagtattcttggacttagggagcatatattcactggaagtgtttcttctcttgcatggtttatgtcaaatcaggagacaagttttgtgacaattggtcagagattgttggctaatcccttgagggttcgtttccactatggtcatcctgatgtctttgataggctttttcacctgacaagagggggtgtcagtaaagcctccaaggttatcaatctaagtgaagatatttttgctggcttcaactctacactccgagaagggagtgttactcatcatgagtacatacaagttgggaagggaagagatgtgggtctcaaccaaatttcaatgtttgaagcaaagatagctaatggaaatggagagcagacactaagtcgagatgtataccggcttgggcaccgttttgacttcttcagaatgttgtcctgttattttactacagttggattttatttcagtactcttataactgttctcactgtatatgtattcctatatggtcgcctctatcttgttctcagtgggcttgaagaaggtttgagtacacaaaaagccattcgggacaataagcctcttcaagtggctcttgcttctcagtcatttgttcaaattgggtttttaatggccttgccgatgctgatggaaattggcttggaaaggggcttccgaactgcacttagtgagtttatattgatgcagttgcagttggctccagtattcttcacgttttccctagggaccaagactcactattttggaaggacattgcttcatggaggtgcaaaatatagatccactggtagagggtttgtggttttccatgctaagtttgctgacaattataggctttattcccgaagccactttgtcaagggtattgagctcatgatattgcttgttatttatcaaatttttggtcattcatatagaggcgctgttgcatatgtattgattactgtatcaatgtggtttatggtgggaacctggctgtttgctccattcttgttcaatccctctgggtttgaatggcaaaaaattgttgatgattggactgattggaataaatggattagtaatcgaggaggaataggtgttctacctgaaaaaagttgggaatcttggtgggaagaggaacaagatcatctccagtattcaggaatccggggaatcatagtggagatattgctatcactgcgattttttatctaccaatatggtcttgtatatcacttgaatattacaaagaagggctcaaaaagttttctggtctatggcatttcgtggttggtgatctttgtaatattatttgtcatgaagactgtatctgttgggaggcgtaaattcagtgcaaattttcagcttgtcttccggttaatcaaggggatgatattcgtgactttcgtctcgattctcgtcattttaattgcccttccacatatgacattgcaagacattgttgtttgcgttcttgcattcatgccaactggttggggaatattacagattgcgcaggcattaaaacccatagtacgccgcgctggattttggggatcagtaaaaactcttgctcgcggatatgagattgtcatgggtttgcttttgttcactcctgttgctttcctggcttggtttccttttgtttcagaatttcaaacccgtatgctgttcaaccaagcgttcagcagaggtttgcaaatttctcgtattcttggaggccaaaggaaggaacgctcttctcgcaacaaagaatagtctgtctacaaaaggctttatcgttgttaagaggctgaaatcctttgtagcaatttgtaaatagttgtaactgtgaatgtgtctaattctaggcttcacttcttatagcattggattgttgtactcaaacatcaatggaaggtgctattatttgaatttggcttcatctcttttattccttgctcaaaaatgatttcgtcaggtcccatttcttgaatgcatttgagtgcttggtataaacccactgcctctatctcgtgcccctttaaatgtatttctagtgcccctttaaatgtatttctaatcaatgttgctttttttgttacttagttaattaaatgcaagtatgaattgaaatagcttgttgggatataagttcgagtatgcgtttgtttttttaaatgtgaatacctgtaaatagtgtatactcttgatactatactaaattgttggtgtctaattcatttgacat

SEQ ID NO: 8762 - DNA, 6075 bp, Arachis hypogaea
agattctgctggaatctctaggctcattgtttgtgaagtgaagaagagaaaataggagaggagatcagaggagcaggatgtcgtcccgaggggcggggccctcctcggaggcgccacagaggcggatcatgcggacacagacggcggggaacctcggggagtcgatattcgacagtgaggtggtgccctcctctcttgtggagatagctcccatcctccgtgttgccaatgaggttgaaaagacgcatcccagggttgcttatctctgtcgcttttatgcattcgagaaagctcacaggttggaccccacttcaagtggtagaggtgttcgccagttcaaaacagcccttcttcaacgactcgaaagagaaaatgatcccactctcaagggaagggtcaagaaaagtgatgctcgtgagatgcagagtttttatcagcattactacaaaaaatacatccaagctttacaaaatgctgctgataaggccgaccgtgcacagcttaccaaggcttatcagactgctaacgttctttttgaggttttgaaggcggttaacatgactcaatctatggaagttgatcgtgagattttggaaactcaagataaggttgcagagaagacagagatcttagtcccatacaatgttcttccacttgatcctgatagtgcaaatcaggcaataatgcgatttcctgagatacaagctgctgtatatgctcttcgtaacatcaggggccttccctggcccaaggactacaagaagaaaaaagaagaagacattctggattggcttggggcgatgtttggatttcagaaacacaatgttgcaaatcagagagagcatttgattttattgcttgctaatgttcatatcagacagtttccgaaacctgatcagcagccaaagttggatgagcgtgcactgacagaagtgatgaagaaacttttcaagaattacaaaaagtggtgcaagtatttgggtcggaaaagtagcttatggttaccaaccatacaacaagaagtgcagcagcggaagctcctatatatgggtctgtatcttctaatatggggcgaagctgccaacctacgattcatgccagaatgtctttgctatatatatcaccatatggcgtttgaattgtatggaatgctagctggtaatgtcagtccaatgacgggagagaatgtcaagccagcatatggcggtgaagaggaggcttttttaaagaaagttgttactccaatatatgatgtgattagacaggaagctgcacggagcaaaaagggaaggtcaaagcattcacaatggaggaactatgatgatttaaatgaatatttctggtcagctgattgctttaggttaggttggccaatgcgtgctgatgctgatttcttttgggtgccatcaaatgagcagtctagttttgacaaatctaacgatgagaagccaactaacccagacagatgggttgggaaagtgaattttgttgagataaggtcattttggcatattttcagaagttatgatcgcatgtggagttttttcattttgtgcttacaggcaatgattattgttgcttggaataaatctggtgacccaattgcaatcttcaatggtgatgtgttcaagaaagtgttaagcgtgtttatcacggccgctatattgaagtttgggcaagcttttcttgatgttgttctgagttggaaagcacaacggagtatgtcgctatttgtcaagttaagatacattttgaaagttgtttcagctgcagcgtgggtgattgttctgtcagttacttatgcgtatacctgggacaatcctcctgggtttgctcagaccatcaaacgttggtttggaaacgattctagttttccttcattgtttattttggctgttgttatttacctgtcaccaaatatgctcgctgctgtattctttttgttcccattcattcgccgcttccttgagaggtcgaactataagattgtgatgctaatgatgtggtggtcacagcctcgtctttatgttggaagggggatgcatgagagcacattttcccttttcaaatacacagtgttttgggttctccttataattacaaagcttgctttcagttactatatagagataaaaccgctggtgggacctacaaaagctataatgggtgtaagaatcacgactttccagtggcatgaattctttcctcatgctcggaacaatattggtgttgttgttgcactttgggcgccaatcattttggtatactttatggatacccaaatttggtatgcaatattctcaaccttatttggtggtatttatggtgcattccgtcgtctcggagagatacggacgttaggaatgcttaggtctcgttttcaatcactgcctggtgccttcaatgctagtttgataccagaggaaaagaatgaaccaaggaaaaaaggattaaaagccactttatctcgcagatttgctgagatcccatctaacagagggaaggaagctgctagatttgcacaactgtggaatcagataatcaccagcttcagagaggaggatcttattagcaatagggaaatggaccttttgcttgtaccttattgggctgatcgtgagttggaccttatacaatggcccccctttttacttgctagcaagatcccaattgcattagatatggctaaggacagcaatggaaaggatagagagctgaaaaagagaattgatgctgatcactacatgtcttgtgctgttcgtgagtgctatgcttcatttaagagcatcattaaacacttggttcaaggggaacgcgagaaaccggttattgattatctttttactgaagtagactcacatatagaggacggcaaactgataaccgaattcagaatgagtgcccttcctagcctctacgcacagtttgttcagctaataaaatatttgttggacaatgataagaaagatagggaccaagttgtaattctgttccaagacatgctggaggtggtgacaagagatataatgagggaagagcaggataatgtattcagtttggtagattcaagccatggtgggactggacatgaggggacgcttcccctcaaccttgaaccagagccacaacatcagttatttgcatctgaaggagctatcaggtttccgattgaaccactttcagaagcttggaaagagaagattaaccggctctacttgctgcttacaacaaaagaatctgcgatggatgtaccatccaacttggaagcaagaaggcgtatttcatttttctccaactcactgttcatggatatgccaatggcaccaaaagttcgcaacatgctttcgttctcggttttaacaccatattacacagaagaggttctattctctttgactgatttggactcaccaaatgaagatggtgtatccatattgttttacttgcagaagatttttccagatgaatggaccaactttctggagagagtgaacactagtgaggaggatcttaaaggaaatgaatctgaagaattagaagaagaacttcgtcgctgggcatcatatagaggccaaacattgactagaactgtaagaggcatgatgtattacagaaaagctttagagctccaggcttttcttgatatggccaaagacgaagacttgatggaaggttataaagccatagaaaactcggatgataactcaagcggggaaaggtcattgttgacacaatgtcaagcagtggctgatatgaagttcacatatgtggtatcatgccaacaatatggtatcgacaagcgatctggttctccacgtgcacaggacatattaaggcttatgacaagatatccttcactacgcgttgcctatattgatgaggtagaggaaactagcaaagacagagacaacagacaaaaaaagatcaacaaggtttactactcttgtttggttaaggctatgccaaaatccagcagtccttcagaacctgagcaggctcttgatcaggtcatatataaaataaagcttcctggaccagccattttaggagagggcaagcctgaaaatcagaatcatgcaataatttttacacgtggagaaggcttgcaaacgatagatatgaaccaggataattatatggaagaagctttgaaaatgagaaatttattgcaagaatttcttaagaagcatgatggtgtgaggttcccaagtattcttggactaagggagcatatatttactggaagtgtttcttcccttgcttggttcatgtcaaatcaagagacaagttttgtgacaattggacagagactgttggctaatccgctgagggttcgtttccactacggtcatcctgatgtctttgataggctttttcaccttacaagagggggtgtgagtaaagcttccaaggttatcaatttgagtgaagatatttttgctggattcaactctacactgcgggaaggcaatgttactcatcatgagtacatacaagttgggaagggaagagatgtgggtctcaaccagatttctatgtttgaagctaagatagctaatggaaatggagagcaaacactaagtcgagacatataccgacttggacatcgttttgatttcttcagaatgctgtcctgttatttcaccacagttggattttatttcagcacacttataactgttctcactgtatatgtattcctctatggtcgtctctatcttgttctgagcgggcttgaagaaggtttgagtacgcagaaagccattcgagacaataagcctcttcaagtggctcttgcttctcaatcgtttgttcaaataggatttttaatggctttgcccatgctgatggaaatcggcttggaaagaggctttcgaacagcacttagtgagttcatattaatgcaattgcagttggcccctgtgttcttcactttttcgcttgggacaaagactcactattttggaaggacattgcttcatggaggcgcaaaatatagaccaactggccgagggtttgttgtttttcatgccaagtttgccgacaactatagactgtactctcgcagccacttcgttaagggtattgagctcatgatattgctcatagtatatgaaatatttggtcaaagttatagaagtgctgttgcatatatcttgattaccatatcaatgtggtttatggtgggaacctggctctttgctcccttcctgtttaatccatctggctttgaatggcaaaagattgttgatgattggactgattggaataaatggattagtaaccgcggaggtataggtgtaccacccgaaaaaagttgggaatcttggtgggaagaggaacaagaacatctccaacattcaggactgcggggaattatagtggagatactgttatcattgcgattttttatttaccagtatggtcttgtatatcacttaaatatcactaaaaggaacccaaaaagttttttggtatatggcatttcatggttggtgatctttgtgatattgtttgtgatgaagacggtatctgttgggaggcggaaattcagtgcaaattttcagcttgtcttccgactaatcaagggattgatattcctgacttttgtgtcgattcttgtgactttaattgcccttccgcacatgacaatgcaggacattgtcgtttgtattcttgccttcatgccaactggttggggattgctgcagattgcacaagcattgaaacccgtggtacggcgtgcgggattttggggatcagtgaagactcttgctcgtggttatgagattgtgatgggtttgcttttgttcactcccgttgcgtttcttgcttggttcccgtttgtttcagaatttcaaacacgtatgctcttcaaccaagccttcagcagaggattgcaaatttcccgtatccttggaggtcaaaggaaggagcggtcgtctcgcaacaaggaatagtttgtctaagaaagccttactattattattttaatagcccgaataccttgttatatatagctcaacaaggttttctataacaattgtaattagttgcaagtaactatgaatggga

SEQ ID NO: 8763 - DNA, 6200 bp, Medicago truncatula
ttagcttcgaagtactcgctgctattcacctttctactttttcagttcttcttctctgctagggtttcaagtttcaacaaaccctacattctccaatgtcatcctcctcttcacggggaccgacgccgtcggaaccacccccacggcgacttgtacgaactcaaaccgctgggaatcttggagaatctattttcgacagtgaagttgttccttcttctcttgttgaaattgctcccattcttcgtgttgctaatgaagttgaaaaaactcatcctagagttgcttatttatgtcgattttatgcttttgagaaagctcataggttagatcctacttctagtggtcgtggtgttcgtcaattcaaaactgctcttcttcaacgacttgaaagagaaaatgatccaactttgaagggaagggtaaagaaaagcgatgctcgtgagatgcagagtttttatcagcattactacaaaaaatatatccaagctttgcaaaatgctgctgataaagctgaccgcgcacaacttaccaaggcatatcagactgctaatgttctttttgaggttttgaaggccgttaacatgacccaatctatggaagttgatcgcgagattttggagacacaagataaagttgctgagaagacggagatcttagttcctttcaatattcttcctcttgatcctgatagtgcaaatcaagcgataatgaaatttcccgagatccaagcagctgtatatgctcttcgaaacactaggggtcttccgtggcctaatgactacaagaaaaaaaaagacgaagacattttggattggcttggctcgatgtttggatttcagaagcacaatgttgcaaatcagagagagcatttgatcttattgcttgctaatgttcacataagacaatttccaaatcccgatcagcagcccaagttggacgagtgtgctctgacagaagtgatgaagaaactgttcaagaactacaaaaaatggtgcaaatatttggatcggaaaagtagcctttggttacctaccatacagcaagaagtgcagcaacgcaaactactatatatgggtctatatcttctaatatggggtgaagccgccaacctaagattcatgccagaatgcctttgttatatatatcaccatatggcttttgaattgtatggtatgcttgcgggtaatgtcagtccaatgaccggtgagaatatcaagccagcgtatggaggtgaagatgaggctttcttaaggaaagtagtgactcctatttataacgtgattgctgaggaagctaaaaaaagcaaaaggggaaggtcaaagcattcacaatggcggaactatgatgatttgaatgaatatttctggtctgctgattgttttcggttaggttggccgatgcgtgctgatgccgatttcttttgcctgccagctgagcgggtggtttttgacaaatcgaatgatgacaagccgcctaaccgagacggatggttcgggaaagtgaattttgttgagataaggtcattttggcaccttttcagaagttttgatcgcatgtggagttttttcattctgtgtttacaggccatgattattgttgcttggaacggatctggggatccaactgtgatctttcacggggatgtcttcaagaaggtgttgagtgtatttattacagcagctatattgaagtttggtcaagctgttcttggtgtaattctaagttggaaagcacggcggagtatgtcgctgtatgtcaaattaagatatattctaaaagttatttcagctgcagcatgggtgattcttctgtcagttacgtatgcatatacttgggacaatcctcccgggtttgctgaaaccataaaaagttggtttggtagcaattcaagtgcgccttcattgtttatcgtggctgttgttgtttacctgtcaccaaatatgcttgctgcaatattctttatgttccccttcattcggcgctatctcgagaggtcgaactataggattgtgatgctaatgatgtggtggtcgcagcctcgcctctatgttggtaggggaatgcatgagagtacattttcccttttcaagtacacggtgttttgggtcctccttttatttacaaagttggctttcagttattatatagagataaaacctctggttggacctacaaaggctattatgaaagtaaaaatatcaactttccaatggcatgaattctttccccatgctaggaacaatattggtgttgtagttgttctttgggctccaattattctggtatactttatggatacccaaatttggtatgcaatattctcaacattatttggtgggatttatggtgcattccgtcgactgggggagatacgtacactaggaatgcttaggtctcggtttcagtcattgcctggtgccttcaatgccagtttgattcctgaggaatcaacagacgagccaaggaaaaagggattaaaagctactttatctcgcagatttactgagatcccgtctaacaaagggaagaaagctgcaaggtttgcacaattgtggaaccaaataattactagtttcagagaggaagatcttattaatgatagtgaaatggaccttttacttgtaccttattgggctgatactcagttggaccttatacaatggcccccctttctacttgctagcaagatcccaattgcattagatatggcgaaggacagtaatggaaaggatcgagagctgacaaaaagaattgaggctgacaactacatgtcttgtgctgtccgtgagtgctatgcttcatttaagagcattattatgcacttggttcgaggagaacgggagaaaccatttatagagtacatgttcggtgaagtagacagtcatatagaggcaggcacattaataaaggaattcagaatgagtgctcttcctagcctctatggacagtttgttcagctaatccaatatttgttggttaataatcagaaagatagggatcaggttgtaattctattccaggacatgctggaagtcgtgacaagagatataatgatggaggatcaggatcaaatattcagtttgatagattcaagtcatggtggtgttggacacgaggggatgtttccccttgagcctgagccacatcaccagctatttgcatctgaaggggctatcagctttccaattgaaccagtcacagcagcttggacagagaagattaaacgacttttcttgctgctgacaacaaaagaatctgccatggatgtaccgtctaacttagaagcaagaaggcgtatttctttcttttcaaattcattgtttatggacatgcctgtggcaccaaaagttcgcaacatgctttcattttcgattttaacaccatactacacagaagaggttctcttctcattgcttgatctggattcgccaaatgaagatggtgtttcgattctgttttatttgcaaaagatatttccagatgagtggaccaactttcttcagcgagtgaaatgttctagcgaggaggaacttaaaggaaatgaatctgaagagttagaagaagagcttcgtctatgggcatcatatagagggcagactttgacaagaactgtaaggggtatgatgtattatagaaaagctttggagcttcaggctttccttgatatggccaaagacgaagatttgatggaaggctacaaagccatggaaaactcagatgataactcgcggggggaaaggtcattatggacacagtgccaagcggtagctgatatgaaattcacatatgttgtatcatgccaacaatatggcattgacaagcgatctggttctccccgggcacacgacatattgaggcttatgactagatacccttcacttagagttgcctatattgatgaggtagaggaacctatcaaaaacagtaagaaaaagatcaacaaggtttactactcttgcttagtgaaggctatgccgaaatccagtagttcttcagagcctgagcagaatctggaccaggtcatatataaaataaagcttcctggtccagcgattttaggtgagggtaagcccgaaaatcaaaatcacgccataattttcacacgtggagaaggtttgcaaacaatagatatgaaccaggataactacatggaagaagccttgaaaatgagaaatttgttgcaagaatttcttaagaagcatgatggtgtgaggttcccaagtattcttggactaagagagcatatatttactggaagtgtttcttcccttgcatggtttatgtcaaatcaagagacaagtttcgtgacaattggtcagagattgttggccaatcccctgagggttcgtttccactatgggcatcctgatgtctttgataggctttttcacctgacaagagggggtgtcagtaaagcctccaaggttatcaatctaagtgaagatatttttgctggcttcaactctacactccgtgaaggaagtgttactcatcatgagtacatacaagttgggaagggaagagatgttggtctcaaccaaatttcgatgtttgaagcaaaaatagctaatggaaatggagagcagacactaagtcgagacgtgtaccggcttgggcaccgttttgatttcttcagaatgctgtcctgttattttactacagttggattttatttcagcactcttataactgttctcactgtatacatatttctctatggtcgcctctatcttgttctcagtggccttgaagaagggttgagtgcacaaaaagccattcgagacaataagcctcttcaagtggctcttgcttctcagtcattcgttcaaattgggtttttaatggccttgcccatgctgatggaaattggcttggaaaggggcttccgaactgcacttagtgaatttatactgatgcagttgcagcttgctcctgtattcttcacgttttccctagggaccaagactcactattttggaaggacactgcttcatggaggtgcaaaatatagacccacgggtagaggatttgtggttttccatgccaagtttgctgataattatagactttattcgcgaagtcactttgtcaagggtattgagctcttggtattacttgttgtatacgaaatttttagtcattcatacagaagtgctgttgcatatatattgattactgtatcaatgtggttcatggtgggaacctggctgtttgctccattcttgttcaacccctctgggtttgaatggcaaaaaattgttgatgattggactgattggaataaatggattagtaaccgaggaggtataggtgtaccgcctgaaaaaagttgggaatcttggtgggaagaagaacaagatcatctacagtattcaggaatccggggaatcatagtggagatattgttgtcactgcgattttttatctaccaatatggtcttgtatatcacttgaatattacaaagaagggctcaaaaagttttttggtgtatggcatttcgtggctggtgatctttgtaatattatttgtgatgaagactgtatctgttgggaggcgtaaattcagtgcaaattttcagcttgtcttccgattaatcaaggggatgatattcgtaacttttattgcgattctggtcattttaatcgcccttccacatatgacaccgcaagacattattgtttgcattcttgccttcatgccaactggttggggaatgttacagattgcgcaagcattaaagcctatagtacgtcgtgctggattttggggatctgtgaaaactcttgctcgtggttatgagatagtcatgggtttgcttctgttcactcctgttgcctttctggcttggtttccttttgtttcagaatttcaaacccgaatgctgttcaaccaagcgttcagcagaggtttgcaaatttctcgtattcttggaggacagaggaaggagcgcgcttctcgcagcaaagaatagtttgactacaaaaggcttcattattaagaggctgacatcctttgttgcaatttgtaagtagctgtaattatgaacgtgactaattctaggcttcagcatttgattattaatgaaatttgctttaatttaaaaatttggcttaatctttttccgttccttgattatccgatactaatatctttgcattgttatgaacttttaattcttaatatgatgtagtaccttgcc

SEQ ID NO: 8764 - DNA, 6159 bp, Medicago truncatula
ttcacctttctactttttcagttcttcttctctgctagggtttcaagtttcaacaaaccctacattctccaatgtcatcctcctcttcacggggaccgacgccgtcggaaccacccccacggcgacttgtacgaactcaaaccgctgggaatcttggagaatctattttcgacagtgaagttgttccttcttctcttgttgaaattgctcccattcttcgtgttgctaatgaagttgaaaaaactcatcctagagttgcttatttatgtcgattttatgcttttgagaaagctcataggttagatcctacttctagtggtcgtggtgttcgtcaattcaaaactgctcttcttcaacgacttgaaagagaaaatgatccaactttgaagggaagggtaaagaaaagcgatgctcgtgagatgcagagtttttatcagcattactacaaaaaatatatccaagctttgcaaaatgctgctgataaagctgaccgcgcacaacttaccaaggcatatcagactgctaatgttctttttgaggttttgaaggccgttaacatgacccaatctatggaagttgatcgcgagattttggagacacaagataaagttgctgagaagacggagatcttagttcctttcaatattcttcctcttgatcctgatagtgcaaatcaagcgataatgaaatttcccgagatccaagcagctgtatatgctcttcgaaacactaggggtcttccgtggcctaatgactacaagaaaaaaaaagacgaagacattttggattggcttggctcgatgtttggatttcagaagcacaatgttgcaaatcagagagagcatttgatcttattgcttgctaatgttcacataagacaatttccaaatcccgatcagcagcccaagttggacgagtgtgctctgacagaagtgatgaagaaactgttcaagaactacaaaaaatggtgcaaatatttggatcggaaaagtagcctttggttacctaccatacagcaagaagtgcagcaacgcaaactactatatatgggtctatatcttctaatatggggtgaagccgccaacctaagattcatgccagaatgcctttgttatatatatcaccatatggcttttgaattgtatggtatgcttgcgggtaatgtcagtccaatgaccggtgagaatatcaagccagcgtatggaggtgaagatgaggctttcttaaggaaagtagtgactcctatttataacgtgattgctgaggaagctaaaaaaagcaaaaggggaaggtcaaagcattcacaatggcggaactatgatgatttgaatgaatatttctggtctgctgattgttttcggttaggttggccgatgcgtgctgatgccgatttcttttgcctgccagctgagcgggtggtttttgacaaatcgaatgatgacaagccgcctaaccgagacggatggttcgggaaagtgaattttgttgagataaggtcattttggcaccttttcagaagttttgatcgcatgtggagttttttcattctgtgtttacaggccatgattattgttgcttggaacggatctggggatccaactgtgatctttcacggggatgtcttcaagaaggtgttgagtgtatttattacagcagctatattgaagtttggtcaagctgttcttggtgtaattctaagttggaaagcacggcggagtatgtcgctgtatgtcaaattaagatatattctaaaagttatttcagctgcagcatgggtgattcttctgtcagttacgtatgcatatacttgggacaatcctcccgggtttgctgaaaccataaaaagttggtttggtagcaattcaagtgcgccttcattgtttatcgtggctgttgttgtttacctgtcaccaaatatgcttgctgcaatattctttatgttccccttcattcggcgctatctcgagaggtcgaactataggattgtgatgctaatgatgtggtggtcgcagcctcgcctctatgttggtaggggaatgcatgagagtacattttcccttttcaagtacacggtgttttgggtcctccttttatttacaaagttggctttcagttattatatagagataaaacctctggttggacctacaaaggctattatgaaagtaaaaatatcaactttccaatggcatgaattctttccccatggtactaggaacaatattggtgttgtagttgttctttgggctccaattattctggtatactttatggatacccaaatttggtatgcaatattctcaacattatttggtgggatttatggtgcattccgtcgactgggggagatacgtacactaggaatgcttaggtctcggtttcagtcattgcctggtgccttcaatgccagtttgattcctgaggaatcaacagacgagccaaggaaaaagggattaaaagctactttatctcgcagatttactgagatcccgtctaacaaagggaagaaagctgcaaggtttgcacaattgtggaaccaaataattactagtttcagagaggaagatcttattaatgatagtgaaatggaccttttacttgtaccttattgggctgatactcagttggaccttatacaatggcccccctttctacttgctagcaagatcccaattgcattagatatggcgaaggacagtaatggaaaggatcgagagctgacaaaaagaattgaggctgacaactacatgtcttgtgctgtccgtgagtgctatgcttcatttaagagcattattatgcacttggttcgaggagaacgggagaaaccatttatagagtacatgttcggtgaagtagacagtcatatagaggcaggcacattaataaaggaattcagaatgagtgctcttcctagcctctatggacagtttgttcagctaatccaatatttgttggttaataatcagaaagatagggatcaggttgtaattctattccaggacatgctggaagtcgtgacaagagatataatgatggaggatcaggatcaaatattcagtttgatagattcaagtcatggtggtgttggacacgaggggatgtttccccttgagcctgagccacatcaccagctatttgcatctgaaggggctatcagctttccaattgaaccagtcacagcagcttggacagagaagattaaacgacttttcttgctgctgacaacaaaagaatctgccatggatgtaccgtctaacttagaagcaagaaggcgtatttctttcttttcaaattcattgtttatggacatgcctgtggcaccaaaagttcgcaacatgctttcattttcgattttaacaccatactacacagaagaggttctcttctcattgcttgatctggattcgccaaatgaagatggtgtttcgattctgttttatttgcaaaagatatttccagatgagtggaccaactttcttcagcgagtgaaatgttctagcgaggaggaacttaaaggaaatgaatctgaagagttagaagaagagcttcgtctatgggcatcatatagagggcagactttgacaagaactgtaaggggtatgatgtattatagaaaagctttggagcttcaggctttccttgatatggccaaagacgaagatttgatggaaggctacaaagccatggaaaactcagatgataactcgcggggggaaaggtcattatggacacagtgccaagcggtagctgatatgaaattcacatatgttgtatcatgccaacaatatggcattgacaagcgatctggttctccccgggcacacgacatattgaggcttatgactagatacccttcacttagagttgcctatattgatgaggtagaggaacctatcaaaaacagtaagaaaaagatcaacaaggtttactactcttgcttagtgaaggctatgccgaaatccagtagttcttcagagcctgagcagaatctggaccaggtcatatataaaataaagcttcctggtccagcgattttaggtgagggtaagcccgaaaatcaaaatcacgccataattttcacacgtggagaaggtttgcaaacaatagatatgaaccaggataactacatggaagaagccttgaaaatgagaaatttgttgcaagaatttcttaagaagcatgatggtgtgaggttcccaagtattcttggactaagagagcatatatttactggaagtgtttcttcccttgcatggtttatgtcaaatcaagagacaagtttcgtgacaattggtcagagattgttggccaatcccctgagggttcgtttccactatgggcatcctgatgtctttgataggctttttcacctgacaagagggggtgtcagtaaagcctccaaggttatcaatctaagtgaagatatttttgctggcttcaactctacactccgtgaaggaagtgttactcatcatgagtacatacaagttgggaagggaagagatgttggtctcaaccaaatttcgatgtttgaagcaaaaatagctaatggaaatggagagcagacactaagtcgagacgtgtaccggcttgggcaccgttttgatttcttcagaatgctgtcctgttattttactacagttggattttatttcagcactcttataactgttctcactgtatacatatttctctatggtcgcctctatcttgttctcagtggccttgaagaagggttgagtgcacaaaaagccattcgagacaataagcctcttcaagtggctcttgcttctcagtcattcgttcaaattgggtttttaatggccttgcccatgctgatggaaattggcttggaaaggggcttccgaactgcacttagtgaatttatactgatgcagttgcagcttgctcctgtattcttcacgttttccctagggaccaagactcactattttggaaggacactgcttcatggaggtgcaaaatatagacccacgggtagaggatttgtggttttccatgccaagtttgctgataattatagactttattcgcgaagtcactttgtcaagggtattgagctcttggtattacttgttgtatacgaaatttttagtcattcatacagaagtgctgttgcatatatattgattactgtatcaatgtggttcatggtgggaacctggctgtttgctccattcttgttcaacccctctgggtttgaatggcaaaaaattgttgatgattggactgattggaataaatggattagtaaccgaggaggtataggtgtaccgcctgaaaaaagttgggaatcttggtgggaagaagaacaagatcatctacagtattcaggaatccggggaatcatagtggagatattgttgtcactgcgattttttatctaccaatatggtcttgtatatcacttgaatattacaaagaagggctcaaaaagttttttggtgtatggcatttcgtggctggtgatctttgtaatattatttgtgatgaagactgtatctgttgggaggcgtaaattcagtgcaaattttcagcttgtcttccgattaatcaaggggatgatattcgtaacttttattgcgattctggtcattttaatcgcccttccacatatgacaccgcaagacattattgtttgcattcttgccttcatgccaactggttggggaatgttacagattgcgcaagcattaaagcctatagtacgtcgtgctggattttggggatctgtgaaaactcttgctcgtggttatgagatagtcatgggtttgcttctgttcactcctgttgcctttctggcttggtttccttttgtttcagaatttcaaacccgaatgctgttcaaccaagcgttcagcagaggtttgcaaatttctcgtattcttggaggacagaggaaggagcgcgcttctcgcagcaaagaatagtttgactacaaaaggcttcattattaagaggctgacatcctttgttgcaatttgtaagtagctgtaattatgaacgtgactaattctaggcttcagcatttgattattaatgaaatttgctttaatttaaaaatttggcttaatctttttccgttccttgattatccgatactaatatctttgcattgttatgaacttttaattctta

SEQ ID NO: 8765 - DNA, 6205 bp, Lupinus angustifolius
tattccgctctgctagggtttcatttccatttcacgatgtcgtcgtcgacgtcgccatctcaacaacaaccggtggcggcacggcggttaatgaggacacagacggcggggaacttaggagagtcaatattcgacagcgaggtggttccgtcgtcgctggtggagatagcacctatcctccgtgtggctaatgaagttgaaaagactcatcctagggttgcttatctgtgtcgtttttatgcgtttgagaaagctcataggttggatccaacttcgagtggtcgtggtgttcgtcaattcaaaactgctcttcttcaacggcttgaaagagaaaacgatcctactttgaaaggaagagtcaagaaaagtgatgctcgtgagatgcagagtttttatcagcattactataaaaagtatattcaagctttgcaaaatgctgctgataaagctgatcgtgcacaacttacaaaggcataccaaactgctaatgttctatttgaggtattgaaagctgttaacatgacacagtctatggaagttgatcgtgagattttggagacacaagataaagttgctgcaaagacagagatcttagtcccttacaatattcttccacttgatcctgatagtgcaaatcaggccataatgagatttcctgagatccaagctgctgtatatgctctacgtaacactcggggtcttcctttgcccaaggactacaagaaaaagaaagatgaagacattctcgattggcttggttcaatgtttggatttcagaagcacaatgtcgcgaatcagcgagagcatttgatcttattgcttgctaatgttcacataaggcagtttcccaagcctgaccagcagccaaagttggatgaccgtgccctgacggaagtgatgaaaaaacttttcaagaattataagaagtggtgcaagtatttgggtcggagaagtagcctttggttaccaactatacagcaagaagtgcagcagcgtaaactactctatatgggtctgtatcttctcatatggggtgaagccgccaacctaagattcatgccagaatgcctttgctatatttatcaccatatggcttttgagttgtatggtatgcttgctggtaatgtcagtccaatgactggagagaatgtcaagccagcgtatggaggtgaagaggaggctttcttaaggaaagttgtgactcctatttatgatgtgattgcaaaggaagctgggcggagcaaaaagggaaggtcaaagcattcgcaatggagaaactatgacgatttaaatgaatatttctggtctgctgattgttttcggttaggttggccaatgcgtgctgatgctgatttcttttgcctgccagttgagcatctattttttgacaaatctaacgatgacaagccagctaacaaggacagatgggttgggaaagtgaattttgttgagataaggtcattttggcatatattcagaagttttgaccgcatgtggagttttttcattctatgtttacaggctatgattattattgcatggaatggatctggaaatccacttgcaatctttaacggtgatgtattcaagaaggtgttgagtgtttttataacagcagcaatattgaagcttgggcaagcttttcttgatgtgatcttgagttggaaagcacaacggagtatgtcgctgtatgtaaagttaagatacattttaaaagttgtttcagctgcagcatgggtgattgttctgtccgttacttatgcatatacttgggataatcctcctggctttgctcaaaagatcaaaagcttgtttggaaacaattcgagcgtgccttcattgtttattttggctgttgctgtttacctgtcaccaaatatgctcgcagctttactatttctgttcccactcgttcgtcgtcttctcgagaggtctaactatagggttgtaatgctaatgatgtggtggtcacagcctcgtctgtatgttggtaggggaatgcatgagagcacattttcccttgtcaagtacacattcttttgggctctccttatatttacaaagttggcttttagttactatatagagataaaacctctggtgcaacctacgaaagctataatgagcgtgagaatctcgactttccagtggcatgaattcttccctcatgctcggaacaatcttggcgttgtagttgcactttgggctccaatcattctggtatactttatggattgccaaatttggtatgccatattctcgacattgtttggtggtatttatggtgcattccgtcgccttggtgagatacggacattaggaatgcttagatctcgtttccaatcattgcctggtgccttcaatgcctgtttgattcctgaggaaaagaatgagccaaggaaaaaaggtttaaaagctactttatctcgcagatttgatcagatcccatctaacaaggggaaggaagctgcaagatttgcacaattatggaaccaaataatcactagtttcagagaggaggatcttattagcaatagggaaatggaacttttgctcgtaccttattgggctgacagtgagttggacctcatacaatggcccccttttctacttgctagcaagattcccattgcattagatatggctaaggacagcaatggaaaggatcgagagctgaaaaaaagaattgaggctgacaactacatgtcttgtgctgtccatgagtgctatgcttcattcaagagcattatgaagcatttggttcaaggggagcgtgagaaaccggttatagattacatgtttgctgaagtagacagacacatagatgctagttcactgataagtgaattcagaatgagtgctcttcctagcctctacaaacagtttgttcagctaatcaagtacttgttggaaaatgaccagaaagatagggaccaagttgtgattctattccaggacatgctggaggtggtaacaagagatataatgatggaggatcaagatcatatttttaatttggtagattcaatccatggtggagctggacatgagggaatgcttcccctagagacagaggcacatcaccagttatttgcatctgaaggagctatcaagtttccaattgaaccactcacagcagcttggacagagaagattaaacggcttttcttgctgcttacaacaaaagaatctgcaatggatgtaccatctaacttagaagcaagaaggcggatttctttcttctcaaattcactgtttatggacatgcccttggcgcctaaagttcgcaacatgctttcattctcggttttaacaccatactacacagaggaggttctcttctccttgcgtgatttggattcaccgaatgaagatggtgtttcaatacttttctacttgcaaaagatttttccagatgagtggaacaactttcttcagcgagtgaattgttctagtgaagaggaacttaaagggaatgaatctgatgagttagaagaagaacttcgtctttgggcatcatatagaggccaaactttgactagaactgtgagaggcatgatgtattatagaaaagctttggagctacagtcttttcttgatatggccaaagatgaagatttaatggaaggatataaagccattgaaaattcagaggataattcaaacggggaaaggttgtggacacaatgtcaggcagttgctgatatgaaattcacttatgtggtatcgtgccaacaatatggcattgataagcgatctggttctcctcgtgcacaggacatattgaggcttatgaccagatatccttcacttcgagttgcctatattgatgaggtagaggagactagcaaagaccgacaaacaaagatcaataagttttactactcttgcttggtgaaggctatgccaaaatctagtagttctgagcctgagcagaatcttgaccaggtcatatataaaattaagcttcctggaccagctattttaggtgaaggtaaaccggaaaatcagaaccatgccataattttctcacgtggagaaggcttgcaaacaatagacatgaatcaggataactatatggaggaagctttgaaaatgagaaatttgttgcaagagtttcttaagaagcatgatggtgtgaggtacccaagtattcttggactcagggagcatatatttacgggaagtgtttcttcccttgcatggttcatgtcaaatcaggagacaagttttgtgacaattggtcagagattgttggctaatcccctgagggttcgtttccactatggtcatcccgatgtctttgataggctttttcaccttacaagagggggtgtcagtaaagcctccagggttatcaatttgagtgaagatatttttgctggcttcaactctacgctccgcgaaggaaatgttactcatcatgagtacatacaagttgggaagggaagagatgtgggtctcaaccagatttcaatgtttgaagcgaagatagctaatggcaatggagagcagacactaagtcgagatgtataccgacttgggcaccgctttgacttcttcagaatgctgtcctgttatttcaccaccattgggttttatttcagcactcttataactgttctgactgtgtatgtattcctctatggtcgactctatcttgttctcagtgggcttgaagaaggtttgagtacacagaaagccattcgagacaataagcctcttcaagttgctcttgcttctcagtcaattgttcaaattgggtttttgatggccctgcccatgttgatggaaattggcttggaaagaggtttccgaactgcacttagtgagttcatacttatgcagttgcagcttgccccggtattcttcacgttttcacttgggacaaagactcactattatggtaggacattgcttcatggaggtgcaaaatatagacccacaggtcgagggtttgtggttttccatgctaagtttgctgacaactatagactttactcccgtagccactttgtcaagggtattgagctcatgatattgcttgttgtataccaaattttcggccacacttatagaagcgctcttgcatatgtcttgattaccatatcaatgtggtttatggtgggcacttggctgtttgctccattcttgttcaatccatctgggtttgaatggcaaaaaattgtcgatgattggactgattggaataaatggattagcaaccgaggaggtataggtgtaccacctgaaaagagttgggaatcttggtgggaggaggagcaagagcatctccagttttcaggaattcggggaatcatagtggagatagtgttatcattgcggttttttatctaccagtatggtcttgtataccacctaactattacgaagaagggatcaaaaagttttctggtatatggaatttcatggttggtgatctttgtgatattgtttgtgatgaagacggtgtctgttgggaggcgtaaattcagtgcaaatttccaacttgtcttccgactaatcaagggattgatattcctaactttcatctcgattctcgtaactttgattgccctaccacacatgacagtccaagatattgttgtttgcattcttgctttcatgccaactggttggggaatgctacagatagcacaagcattaagacctgtagtgaagagagctggattctggggatcagtaaaaacactagctcgtggttatgagatagtgatgggtttgcttttgttcacgcctgttgcttttcttgcttggttcccctttgtttcagaatttcaaactcgaatgctcttcaaccaagccttcagcagaggtttgcaaatttctcgtattcttggaggccacaggaaggagcgttcttctcgcaacaaggaatagtctttcctcctattttttgccttaaattctccttctgttaggtttcctgtaaccattgtaagtagtagtagtagttgttgttgttgttgtatttaaccatgacatagtattatataggggcttcaactctagttattatagccattttatcattctcaaaaacatcatctattatggaatcaaaacacaaggatctctgctagttatttactattatggaaatcgtattttgtatgctgtatattttctgcacgttcaagttcccttttttaattttaactgtttgctaaataatttcatacca

SEQ ID NO: 8766 - DNA, 6360 bp, Cajanus cajan
tacgtgggagaatgtcgtcgagagcgggaccgtcggagccgccgggaccgccgcagaggcggatcacgcggacgcaaaccgccgggaacctcggcgaggcgatatttgacagtgaggttgtgccgtcgtcgcttgtggagattgcaccgattcttcgcgttgctaatgaggttgagaagactcatccgagagttgcttatctctgccgtttttacgcatttgagaaagctcataggctggatcccacttcaagtggtcgtggtgttcggcaattcaaaactgcacttcttcaacgtctggaaagagaaaatgatccaacgttgaaaggaagggtaaagaaaagtgatgctcgtgagatgcagagtttttatcagcattattacaaaaaatatatccaagctttacaaaatgctgctgataaagctgatcgtgcacagcttaccaaggcataccagactgccaatgttctttttgaggttttgaaggctgttaacatgacacaatctatggaagttgatcgcgagattttggagactcaagataaagttgctgagaaaacagagatcttagttccttacaatattcttcctcttgatcctgatagtgcaaatcaggcaataatgagatttcccgagatccaagctgctgtatatgctcttcgaaacacaaggggtcttgcctggcccaaggactacaagaaaaaaaaagatgaggatgttctggattggcttggggtaatgtttggatttcagaagcacaatgtagcaaatcagagagagcatttgatcttactgcttgcaaatgtgcacataagacaatttcccaagcctgatcaacagccaaagttggacgagcgagcactgacagaagtgatgaagaaactttttaagaattacaaaaaatggtgcaagtatttgggtcggaagagtagcctttggttgccaaccatacagcaagaagtgcagcagcgtaaattactatatatgggtctatatcttctaatatggggtgaagctgctaacctaagattcatgccagaatgtctttgctatatctatcaccatatggcttttgaattgtacggtatgcttgctggtaatgttagtccaatgacaggagagaatgtcaagccagcctatggaggtgaagaggaggctttcttaaggaaagttgtaactcctatatatgatgtgattgcaaaggaagctgcacggagcaaaaaggggaggtcaaagcattcacaatggaggaactatgatgatttaaatgaatatttctggtcagctgattgttttcggcttggttggccaatgcgtgctgatgctgatttcttttgcctgccagttgagcagctaaattttgacaaatctaatgataacaagccatctaacagggacaaatgggttggaaaagtcaactttgttgagataaggtcattttggcatattttcagaagttttgatcgcatgtggggttttttcatcctgtgcttgcaggctatgatcattgttgcttggaatggatctggggatccaagtgtaatctttagaggtgatgttttcaagaaggtgcttagcgtgtttataacagcagctatattgaagtttggacaagctattctggatgtgatcctcagttggaaagcacaatggagtatgtcaatgcatgttaagttgagatacattctaaaagttgtttgtgctgcaacatgggtgattgttctatcagttagttatgcttttacttgggaaaatcctcccgggtttgctcaaacgatccaaagttggtttggaaacaattcaagttcgccttcattctttatcatggctgttgttgtatatctgtcaccaaatatgctagctgctgtgttgtttctgttcccactcattcggcgttttcttgagaggtcgaactataggattgtgatgctaatgatgtggtggtcacagcctcgactatatgttggtagggggatgcatgagagcacactttcccttttcaagtacacaatgttttgggtcctccttataattacaaagctagctttcagttactatatagagataaaacctctggtgggacctacgaaagctataatgagtgtaaaaatctcgacttttcaatggcatgaattcttcccccgtgctcgaaaaaatcttggtgttgtagttgcactttgggctccaattattctggtttatttcatggatacccagatttggtatgacatattctctactttatttggtggtatttatggggcattccgtcgccttggagagataaggacactaggaatgcttagatctagatttgattcattgcccggtgccttcaatgcctgtttagtcccagaggaaaagagtgagccaagaaaaaaaggattaaaagccactttatctcgcaaatttgatcagatctcaaataacaaaggtaaagaagctgcaagatttgctcaactatggaatcaaataatcactagttttagggaggaagatcttatcagtaatagggaaatgaatcttttgcttgtaccttactgggctgatcgtgagttggaccttatacagtggcccccatttctacttgctagcaagattccaattgcactggacatggctaaggacagcaatggaaaggatcgagagttgagaaaaagaattaacagtgaccactatatgtcttctgctattcaggagtgctatgcttcatttaagagcattgttaagcacttggttcaaggggaccgtgaaaaacaagttatagaatacattttctccgaggtagacaaacatattgaagctggtgaccttataagtgaattcagactgagtgcacttcctagcctctacgggcaatttgttaagctaataaattatctgttagacaataaacatgaagacagggatcaaatagtgattctattccaggatatgctggaggttgtgactagagatataatgatggaggatcatatattcagcttggtagattcaatccatggtggatctggacatgagggaatgcttcttcttgagcaacaacaccagttatttgcatctgaaggggctatcaggtttccaattgaaccagttactgaagcttggacagagaagataaaacggctttacttgctgcttacaacaaaagaatcagcaatggatgtaccatctaacttagaagccaaaaggcgcatttcatttttctctaattcactgtttatggatatgcctacagcaccgaaagttcgcaatatgctttcattctcggttttaacaccatactacacagaagaggttctcttttccttgcgcgagttggaatcacccaatgaagacggtgtttcaatactcttctacttgcagaagatctttccagatgaatggaataactttcttcagcgagtgaattgttccagtgaggaggaacttaaagggaatgaatctgacgagttagaagaagaacttcgtcgctgggcatcataccgaggccaaactttgaccagaactgttagaggtatgatgtactacagaaaagctttggagctccaggcttttcttgatatggccaaagatgaagatttgatggaaggctataaagctatagaaaattcagatgataactcaaagggggaaaggtcactgtggacacaatgtcaagctgtagctgatatgaaattctcgtatgtggtgtcatgccaacaatatgggattgacaagcgatctggtgctgctcgtgcacaggacatattgaggctcatgacaagatatccttcacttcgagtggcctttattgatgaggtagaggaacctagcaaagagagacccaaaaagatcaacaaggtttattactcttgcttggtgaaggctatgccaaaatccagtagtccttcagagacagagcctgtccaatatttagaccaggtcatatataaaataaagcttcctgggccagctatcttaggtgagggtaaacctgaaaatcagaaccatgccataattttcacacgtggagaaggtttgcaaacaatagatatgaaccaggataattacatggaagaagctttaaaaatgagaaatttgttgcaagaattccttaagaagcacgatggggtgagattcccaagtattcttggacttagggagcatatatttactggaagtgtttcttctcttgcatggttcatgtcaaatcaggagaccagttttgtgacaattggtcagagattgttggctaatccactgaaggttcgcttccactatgggcatcctgatgtctttgataggctttttcacctcacaagagggggcgttagcaaagcctctaaggttatcaatttgagtgaagatatctttgctggtttcaactctactctacgtgaaggaaatgttactcatcatgagtacatacaagttgggaaaggaagagatgtgggtctcaaccagatttccatgtttgaagcgaagatagctaatggcaatggagagcaaacattgagtcgagatgtataccgacttgggcaccgctttgacttcttcagaatgttgtcttgttatttcaccacaattggattttacttcagtactcttataactgttctcactgtgtatgtatttctctatggtcgcctttatctcgttcttagtgggcttgaagaaggtttgagtacacaaaaagccattcgagacaataagcctcttcaagtggcgctcgcctctcagtccattgttcaaattggttttttgatggccttgcccatgttgatggaaattggcttggaaaggggctttcgaactgcacttagtgagttcatattaatgcagttgcagctagctccagttttcttcacattttcgcttggaacaaagactcattattatggaaggacattgcttcatggaggtgcaaaatatagaccaactggtcgagggtttgtggttttccatgctaaatttgctgacaactatagactttactcccgtagccattttgtaaagggtattgagctaatggttttgcttatcgtataccaaatttttggtcacacttatagaagtgggcttgcatatttcatgattaccatatcaatgtggtttatggttggcacctggctttatgctcccttcttgttcaatccttctgggtttgagtggcaaaagattgttgatgattggactgattggaataaatggattagcatccgaggcggtataggtgtaccatctgaaaaaagttgggaatcctggtgggaggaggaacaagagcatctccaatattcaggaatgcggggaatcattgcggagatattgttgtcattacgtttttttatctatcagtttggtcttgtttatcacttgacctttacaaaaaagacaaaaagttttctggtctatgggatatcgtggttggtgatctttctaatattatttgtgatgaagacggtatctgttgggaggcggaaattcagtgcagaatttcaacttgtcttccggctaatcaaggggttgatattcttaacttttgtctcaattctagttaccttgattgcccttcctcatatgacaatccaggacattgttgtttgcattcttgccttcatgccaactggttggggaatgctacagattgcacaagcattaaagcctctagtacaacgagctggattttggggatcagtaaaaactctggctcgtggttatgagattgtcatgggtttgcttttgttcactcctgttgccttcctggcttggtttccttttgtttcagaatttcagacccgtatgttgttcaaccaagcattcagccgaggtctgcaaatttctcgtattcttggaggccaaaggaaggggcgctcttctcgcaacaaggaataattatatgctctccgtttccttgattgcagtaacagttagcttgagcaacgattttggtaactattgtaagtagttgtatgttgtaattaagaaagggatagatccctaggcttcaattttgtttatttcgatcatcgttgaagcttggatgcaatgcaaaactaagagccccattttataaaacttggatggcgcaccattcatctgcaccgaggccctcggcagttttttcttcgaagtcttcagattctggcacctgaagtgtcatctcaaatttatccttaataccgactcaatgggttgagttcagagctactcctatatataaggaaaaaattaattatagtattgtgaccgtgccattaccatatatgaaatctatttgaaatcatcatattaaaatataatatgtcaataaaagtaaattacaatagttttctaaaattcatttaaaattgataacgaatattatcctaaatatgatgta

SEQ ID NO: 8767 - DNA, 6102 bp, Phaseolus vulgaris
tccgtcggaggatgtcgtcgagggcggggccgtcgtcggagacgcagggaccgtcgcagaggcggatcacgcggacgcaaaccgccgggaaccttggcgaggcgatatttgacagcgaggtcgtgccgtcgtctcttgttgagattgcaccgattcttcgcgttgctaatgaggtcgagaagactcatcctagagtcgcttatctctgccggttttatgcgtttgagaaagctcataggctggatcctacttcaagtggtcgtggtgttcggcaattcaaaactgcccttcttcaacgtttggaaagagaaaatgatccaacattgaaaggaagagtaaagaaaagtgatgctcgcgagatgcagagcttctatcagcattactacaaaaaatatatccaagccttacaaaatgctgctgataaagctgatcgtgcacagcttaccaaggcatatcagactgctaatgttctttttgaggttttgaaggctgttaacatgacacaatctatggaagttgatcgagagattttggagactcaggataaagttgccgagaaaacagagatcttagtacctttcaatattcttcctcttgatcctgatagcgcaaatcaggcaataatgagatttcctgagatccaagcggctgtatatgctcttcgtaacacaaggggtctagcctggccaaaggactacaagaaaaaaaagatgaagacattctggactggcttggcgtaatgtttggatttcagaagcacaatttagcaaatcagagagagcatttgatcttattgcttgcaaatgtgcacatcagacaatttcccaagcctgatcaacagccaaagctggatgagcgcgcactgacagaagtgatgaagaaactttttaagaattacaaaaagtggtgcaagtatttgggacggaagagtagcctttggttgccgaccatacagcaagaagtgcagcagcgtaagctactatatatgggtctgtatcttctgatatggggtgaagctgccaacctaagattcatgccagaatgcctttgctacatctatcaccacatggcttttgaattgtacggtatgcttgctggtaatgttagtccaatgactggagagaatgtcaagcctgcctatggaggtgaagaagaggctttcttaaggaaagttgtaactccaatatatgatgtgattgcaaaggaagctgaacggagcaaaaaggggaggtcaaagcattcacaatggaggaactatgatgatttaaatgaatatttctggtcagttgattgttttcggcttggttggccaatgcgtgctgatgccgattttttttgcctgccagttgagcagctaaattttgacaaatctaatgataacaagccagttaacagggacaaatgggttggaaaagtcaattttgttgagataaggtcattttggcatattttcagaagttttgatcgcatgtggggtttttttattctgtgcttacaggctatgattattgttgcttggaatggaactggggatccaagtgcaatctttgatgtgaatgttttcaagaaggtgcttagtgtgtttataactgctgctatcttgaagcttggacaagctattctggatgtgatcctcagttggaaagcacaatggagcatgtctatgcatgttaagttgagatacattctaaaagttgtttcagctgcagcatgggtgattgttctatcagttagttatgcttatacttgggaaaatcctcctggatttgctcaaacgatacaaagttggtttggaagcaattcaaattcgccttcattctttattatggccgttgttgtatacctgtcaccaaatatgctagctgccatgttgtttctgttcccactcattcgccgttttcttgagaggtcaaactataggattgtgatgcttatgatgtggtggtcacagcctcgactctacgttggtaggggaatgcatgagagcacattttcccttttcaagtacacaatgttctgggttctcctcataattacaaagttagctttcagttactatatagagataaaacctctggtggaaccaacgaaagctataatgagtgtaaaaatctcaacttttcagtggcatgaattctttccccgtgctcgaaaaaatcttggtgttgtagttgcactttggtctccaattattctggtatactttatggatacccagatctggtatgccatattctctacgttatttggtggtatttatggggcattccgtcgcctcggagagataaggactctgggaatgcttagatctcgttttgattcgttgcctggtgccttcaatgcctgtttgatcccagaggaaaggagtgagacgaggaaaaaaggattaaaagccactttatctcgcagatttgatcagatcccaaataacaaaggtaaagaagctgcaagatttgcacaactatggaatcaaataatcactagttttagagaggaagatcttatcagtaatagggaaatggatcttttacttgtgccgtactgggctgatcgtgagttggaccttatacagtggccaccatttctacttgctagcaagattcctattgcattggatatggctaaggacagcaatggaaaggatcgagagttgagaaaaagaattaacactgaccactatatgtattctgctattaaggagtgctatgcttcttttaagagcattgttaagtacttggttcaaagggaccgtgaaaaacaggtcattgaatacattttctccgaggtcgacaaacatattgaagctgatgaccttacaagtgaattcagactcagtgcacttcctagcctctatgagcaatttgttaagctaataaaatatttgttagagaataagcatgaagacagggatcaaattgtgcttctattccaagatatgctggaggtagtgactagagatatgatgatggaggatcatatattcagcttggtagattcaatccacggtggatctggacatgagggaatgcttcttcttgagcaagaataccagttatttgcatctgaaggggctatcaggtttccaattgaaccagttactgaagcttggacagagaagattaaacggctttacttactgcttacaacaaaagaatcagcaatggatgtaccatctaacttagaagccaaaaggcgcatttcttttttctctaattcactgtatatggatatgcctacagcacccaaagttcgcaatatgctttcattctcggttttaacaccgtactacaccgaagaggttctcttttccttgcacaatttggattcacccaatgaagatggtgtttctatactcttctacttgcaaaagatatttccagatgaatggaacaactttcttcagcgagtgaagtgttccagtgaagaagaacttaaaggaaatgaatctgatgagttagaggaagaacttcgtcgctgggcatcataccgtggccaaacattgaccagaactgtgagaggtatgatgtactacagaaaagctttggagctccagtcttttcttgatatggccaaagatgaagatttgatggaaggctacaaggccatagaaaattcagatgataactcaaagggggaaaggtcattgtggacacagtgtcaagccgtggctgatatgaaattctcctatgtggtgtcatgtcaacaatatgggattgacaagcgatctggtgctgcttgtgcacaggacatattgaggcttatgacaacatacccttcacttcgagttgcctatattgatgaggtagaggagcctagcaaagagagacccaaaaagatcaataaggtttattactcttgcttggtgaaggctatgccaaaatccagtagtccttcagagacagagcctgtgcaatatttagaccaggtcatatataaaataaagcttcccggaccagccatcttgggtgagggcaaacctgaaaatcagaaccatgccataattttcacacgtggagaaggcttgcaaacaatagatatgaaccaggataactacatggaagaggctttaaaaatgagaaatttattgcaagaattccttaagaagcatgatggggtgagattcccaagtattcttggtcttagggagcacatatttactggaagtgtttcttctcttgcatggttcatgtcaaatcaggagaccagttttgtgacaattggtcagagattgttggctaatccactgaaggttcgcttccactatggtcatcccgatatctttgataggctttttcacctcacaagagggggtgttagtaaagcctccaaggttatcaatttgagtgaagatatttttgctggcttcaactctacactccgtgaaggaaatgttactcatcatgaatatatacaagttggtaaaggcagagatgtgggtctcaaccagatttctatgtttgaagcaaagatagctaatggaaatggagagcaaacattgagtcgggatgtgtaccgacttggccaccgctttgacttcttcagaatgttgtcgtgttatttcaccacaattggattttacttcagcactcttataactgttctcactgtatatgtattcctctatggtcgcctttatcttgttcttagtggacttgaagaaggtttgagtacacaaaaagccattcgagacaataagcctcttcaagtggctctcgcctctcagtcctttgttcaaattggatttttgatggccttgcccatgttgatggaaattggcttggaaagaggcttccgaactgcacttagtgagttcatattaatgcagttgcagctagctccagttttcttcacattttcgcttgggacaaagactcactattatggaaggacattgcttcatggaggtgcaaaatatagacctactggtcgagggtttgtggttttccatgctaaatttgctgacaactatagactttactcccgtagccactttgtcaagggtattgagctaatgattttgcttattgtataccaaatatttggtcacacgtatagaagtggggttgcatatctaatgattactataccaatgtggtttatggttggcacctggctatatgctcccttcttgttcaatccatctgggtttgagtggcaaaagattgttgatgattggactgattggaataaatggattagcatccaaggtggtataggtgtaacacctgaaaaaagttgggaatcctggtgggaggaggaacaagagcatctccaatattcaggaatccgcggaatcattgcagagatattgttgtcttcacgtttttttatatatcagtatggtcttgtttatcacttgacctttacgaaaaatacgaaaagtgttctggtctatggcatatcgtgggtggtgatctttctgatattatttgtgatgaagacagtgtcagttgggagacgcaaattcagtgcagaatttcaacttgtcttccggctaatcaaggggttgatattcttaacttttgtctcagttctagtcatcctgattgcacttcctcacatgacaatccaggatattgttgtttgcattcttgcctttatgccaactggttggggaatgctacagattgcgcaagcactaaggcctctagttcgacgagcaggattctgggaatcagtaaaaactcttgctcgtggttatgagatagtcatgggtttgcttttgttcactcctgttgccttcctggcttggtttccttttgtttcagaatttcagacccgaatgttgttcaaccaagccttcagtcgaggattgcaaatttctcgtattcttggaggtcaaaggaaggggcgctcttctcgcaacaaggaataatttaatttgtctacgcgaaagcttgattatatgcttctctacatttcctttgattgcagaaacagcttcagcaacgattttgtaactaatttaagtagcgtatgttgtaagtaggaacgggatacatcataggctttaattttattattttgtacatgttatttcaatttcagaaactgcaccagggaatgcaaaactcagttccatttatttaaggttattttcgt

SEQ ID NO: 8768 - DNA, 6176 bp, Medicago truncatula
acattacaacactcactcattctctgttttcgtgccacaaataaaaaaaaaaaaaacattctcactcactctctcattcccatttctctcttctctctctttcttagggttttcactcttctctcatttgtatatcggtgatagaagagaatgtcgtccagaccgggtcctccgtcgtcgtcggagactcaaggaccgccgttgcagaggcgtattacgcggactcaaacagctggtaaccttggtgaagccatttttgatagtgaggttgtaccttcctctcttgttgaaattgctcccattcttcgtgttgctaatgaggttgaaaagactcatcctagagttgcttatctctgccggttttatgcttttgagaaagctcataggttggaccccacttcaagtggtcgtggtgttcgtcaattcaaaactgctctacttcaacgtctggaaagagaaaatgatccaacattgaaaggaaggataaagaaaagtgatgcccgtgagatgcagagtttttatcagcattactacaaaaagtatatccaagctttacaaaatgctgctgataaagctgaccgtgcacagctaaccaaggcatatcagactgctaatgttctttttgaggttttgaaagctgttaatatgacacaatctatggaagttgaccgtgagattttggagactcaagataaagttgccgagaaaacagagatcttagttccttacaacattcttcctctcgatcctgatagtgcaaatcaggcaataatgagatttcctgagatccaagctgctgtatttgctcttcgtaacacaaggggtcttgcctggccaaaggactacaagaaaaaaaaagacgaagacattctggattggcttggggcaatgtttgggtttcagaagcacaatgtggcaaatcagagagagcatttgatcttattgcttgcaaatgtacatataagacaatttcctaagcctgatcaacaaccaaagttggatgagcgtgcactgacagaagtgatgaagaagcttttcaagaattacaagaagtggtgcaagtatttgggtcgaaagagtagcctttggttgccaaccatacaacaagaagtgcagcaacgtaaattactatacatgggtctttaccttctaatatggggtgaagcggccaacctaagattcatgccagagtgcctttgctatatctatcaccatatggcttttgaattgtatggtatgcttgctggcaatgttagtccaatgacgggagagaatattaaaccagcctatggaggtgaagaggaggctttcttaaggaaagttgtaacccccatatataatgtgattgcaaaggaagctgaaaggagcaaaagagggaggtcaaagcattcacaatggaggaactatgatgatttaaatgaatatttctggtcagctgattgttttcggcttggttggccaatgcgggctgatgctgatttcttttgccttccagttgaacatctacactttgataagttgaaggacaacaaggctgataatagggacagatgggttggaaagggaaactttgttgagataaggtcattttggcatattttcagaagttttgatcgcatgtggagtttcttcattctatccttacaggccatgattattgttgcttggaatggacctggggatccaactgcaatatttaacggtgatgttttcaagaaagcacttagcgtgtttataacagcagctatattaaagtttggacaagctattcttgatgtgatccttaattggaaagcgcaacggagtatgtcaatgcatgctaagttaagatacattctaaaagtagtttcaggtgcagcatgggtgattgttttatcggtcacttacgcttatacttgggacaatcctcctggctttgctcaatccatccaaagttggtttggaagcaattctcattcgccttcaatgtttattttggccgttgttgtatatctgtcaccaaacatgctagctagatcgaattataggattgtgatgctaatgatgtggtggtcgcagccccgtctctatgtcggtagggggatgcatgagagcacattttccctttttaagtacacagtgttttgggttctcttgataattacaaagttagcattcagttattatatagagataaaacctctggtgggaccttcaaaggatataatgaatgtacatatctcgcattttcagtggcatgaattctttccacgagctcgaaaaaatataggtgttgtaattgcactttgggctccaattattttggtctacttcatggatacccaaatttggtatgccatattctcaactttatttggtggtatttatggagcattccgtcgtctcggtgagataaggacactgggaatgcttaggtctcgttttgaatcattgcctggtgcctttaatgcctgtttgatcccagaggaaaagtgtgagccaagaaagaaaggattaaaagcaactttatctcgcagatttgaccagatcccatctaacaagggtaaggaagctgcaagatttgcacaactttggaaccaaattatcactagttttagagaggaagatcttatcagtaatagggaaatggaccttttgcttgtgccttattgggctgatcccgagttagacctaatacaatggccaccgtttctacttgctagcaagattccaattgcattggatatggctaaggatagcaatggaaaggatcgagagctgagaaaaagaatagagttcgacaactatatgtcttgtgctgttcgggagtgttatgcttcatttaagagtattattaggtacttggttcaaggggatcgtgagaaacaggttatagaatacattttatcagaggtagacaaacatattgaagctggtgatctaataagtgaattcaaactgagtgcgcttcctagcctctatgggcaatttgttgcgctaatcaaatatttgttagacaataagcacgaagacagggaccaagttgtgattctattccaggacatgctggaggtggtgacaagggatataatgatggaggatcatctactcagcttggtagattcaatccatggaggatctggacaagaggggatgcttcttcttgagcagcaacaccagttatttgcatctgaaggggcaatcaggtttccaattgaacctgttacagaagcttggacagagaagattaaacgcctttatcttctgcttacaacaaaagaatcagcaatggatgtaccatctaacttagaagccaaaaggcgtatttcatttttctcaaattcactgtttatggatatgcctacagcacccaaagttcgcaacatgctgtcattctcggttttaactccatactacacagaagaggttctcttttccttgcgtgagttggagtcacccaatgaagatggtgtttcaatacttttctacttacaaaagatctttccagatgaatggaacaactttctgcagcgagtgaattgttccaacgaagaggaacttaaagaatatgatgagttagaagaagagcttcgtcgctgggcatcataccgaggacaaactttgaccagaactgttagaggaatgatgtactacagaaaagccttggagctccaggcttttctcgatatggccaaagatgaagatttgatggaaggctataaagccatagaaaactcagatgataactcaaggggggaaagatcattatggacacaatgtcaagctgtagctgatatgaaattctcatatgttgtatcgtgccaacaatatgggattgacaagcgatctggtgctgctcgtgcacaggacatattgaggcttatggcaagatatccttcactccgagtcgcctatattgacgaggtagaggaacctagcaaagagagaccaaaaaggatcagcaaggtttattactcctgcttggtgaaggctatgccaaaatccagtagtccctccgagacagagcccgagcaatgtttggaccaggtcatatataaaataaagcttcctgggccagctattttgggtgagggtaaacctgaaaatcagaatcatgccataatgttcacacgcggagaaggcttgcaaacaatagatatgaaccaggataattacatggaagaagctttgaaaatgaggaatctgctgcaagaattccttaagaagcatgatggagtgaggtacccaagtattcttggacttcgggagcatatatttactggaagtgtttcttctcttgcctggttcatgtcaaatcaggaaaccagttttgtgacaattggtcagagattgttagctaatccactgagggttcgcttccactatgggcatcctgatgtcttcgataggatttttcacctcacaagagggggtgtaagcaaagcctccaaagttatcaatttgagtgaagatatatttgctgggtttaattctacccttcgtgaaggaaatgttactcatcatgagtacatacaagttgggaaaggaagagatgtgggtctcaaccagatttctatgtttgaagcaaagatagctaatggcaatggagagcaaacactgagtcgagatgtataccgacttggccaccgattcgacttcttcagaatgctgtcttgttatttcacaacaattgggttttacttcagcactcttattactgttctcactgtgtatgtattcctctatggtcgcctttatcttgttcttagtgggcttgaagaaggtttgagtacacagaaagccattcgagataataagcctcttcaagtggctctcgcatcacagtcctttgttcaaattgggtttttgatggctttgcctatgttaatggaaatcggcttggaaaggggattccgaactgctcttagtgagttcatattaatgcagttgcagttggctccagttttcttcacattttcgcttgggacaaagactcactattatggaaggacgttgcttcatggaggtgcaaaatatagacctactggccgagggtttgtggttttccatgctaaatttgctgacaactatagactttactcccgtagccattttgtcaagggtattgagctaatgattttgctcattgtataccaaatttttggcaatggttataggagtgggctttcatatctgttgattacaacaccaatgtggtttatggtgggcacctggctttatgctcccttcttgttcaatccttctgggtttgagtggcaaaagattgttgatgattggactgattggaataaatggattagcatccgaggcggtataggtgtgccacctgaaaagagttgggaatcctggtgggaggaggaacaagagcatctaaaatattcaggaatgcgcggaatcatagccgagatattgttatctttgcgttttttcatttatcagtacggtcttgtttaccacttgaactttacgaaatctacaaaaagtgtcctggtctatggcatatcatggttggtgatctttctaatattagttatcttgaagacggtgtctgttgggagaaggaaatttagtgcagattttcaacttgtcttccggctaatgaagggattagtatttgtgacttttgtctcaattctagtgaccatgattgcccttgctcacatgacgttgcaggacattgttgtttgcattcttgccttcatgccaactggttggggaatgctacagattgcacaagcattaaagcctctagtacgccgaggtggattttgggaatcagtaaaaactctagcacgtggttatgaggttatcatgggtttgctcttgttcactcctgttgccttcctggcctggtttccttttgtgtcagaatttcagacacgtatgcttttcaatcaagcatttagccgtggtttacaaatttctcgtattcttgggggccaaaggaagggtcgctcctctcgcaacaaggaatagttgttactctgcaaggcggcttaaaccatatatgcactccactacttccttgagaagtaatggcttgttgtggaaccttttctgtaacgttataagtagttgtaggttgtagtctgtagctgtaagaatgagattagatcacaggctttaattttattacagaaatatattattccgaacatcaatggaagttatttaag

SEQ ID NO: 8769 - DNA, 6236 bp, Prunus mume
gttcgataggctctctgaggttttgataggaagtgaagaacaatgtcctcgtccagagggggttcggatcagccacctccgcaactgcagaggcggttaactcgaacgcagaccgccggtaacctcggggagacggcattcgacagtgaggttgtgccctcttccctcgtcgaaatcgcccccattcttcgtgtcgccaatgaggtcgaatcgcacaatcccagagttgcatatctctgtcgattttatgccttcgagaaagctcatagactggatcccacttctagtgggcgtggtgttcgtcagtttaaaacggcccttcttcaacgtcttgaaagggagaatgatcccacacttaagggaagggtgaaacaaagtgatgcacgtgaaatgcagagcttctatcaacattactacaaaaaatatattcaagctttgactagtgctgctcataaagcagaccgtgcacaacttaccaaggcataccagactgccaatgttctctttgaggttttaaaggctgttaatatgacacaatctatggaagttgatcgtgagattttggaagctcatgataaagttgcagaaaagacaaagctcttggtcccatacaatatccttccgcttgatcctgatagtacaaatcaagctattatgaaactttctgagattcaagctactgtttttgctcttcgtaacaccaggggtcttccttggccaaaggaatacaaaaagaaaaacgatgaagacattctggattggcttcagtcaatgtttgggtttcagaaggataatgtggcaaatcaaagggagcacctgatattattacttgcaaatgtgcacataaggcagtttccaaagcctgagcaacaacccaagttggatgaccgtgcgttgacagaagtgatgaagaagcttttcaagaattacaaaaaatggtgcaagtacttgggccggaaaagtagcctttggttaccaactatacagcaagaggtgcaacaacgcaaactactatatatgggtctatatcttctgatatggggggaagctgctaatttgagattcatgccagagtgcctttgttatatctatcaccatatggcatttgaattgtatggtatgctagctgggaatgtgagtccaatgacaggagagaatgtgaagccagcatatggaggtgaagaagaggctttcttgaaaaaagttgtaactcctatttatgatgtgattgcaaaggaagccgaaaggagcaaacgggggaaatcaaagcattcccagtggaggaactatgatgatttaaatgaatacttttggtcagtggattgtttccggttaggttggccgatgcgtgcaggtgctgatttcttttgcctgcccattgaacagcttcgttttgacaaaagtagtggggacaacaagccagctagtggagatcgatgggtggggaaagtgaattttgttgagatacggtcattttggcatatttttagaagctttgaccgcatgtggagtttctttattctatgtttacaggttatgatcattgttgcttggaatggctccgggcaacccactgcaatatttactgctggtgtattcgagaaagtgttgactgtcttcataactgctgcaatcttgaaacttggacaagctgttctcgatgtaattcttagctggaaggctaggcggagtatgtcattccatgttaagttgagatacattttgaaggttattacagctgctgcgtgggtgataattctaccggttacttattcatatagctggaaaaaccctcctgggtttgctcgaaccatcaaaagttggtttgggaatgactcacattcaccttccttgtttatcttggctgttgttgtctacttgtcgccaaatatgctggctgcggtgttgtttcttttcccatttattcgccgattcctagagagatcaaactataggattgtgatgcttatgatgtggtggtcacagcctcgactttatgttgggaggggaatgcatgagagcacattttctcttttcaagtacacaatgttttgggttcttcttataattacaaagctggcattcagttactacatagagataaggcctttagttggtccaacaaaagccatcatgagtgtacatataaccacttttcagtggcacgagttttttccccgcgcaaagaataatatcggtgttgtgattgcactctgggctccaattatccttgtctattttatggatacccagatttggtatgccatcttctccacaatatttggaggaatttatggtgcattccgtcgccttggagagattcgaacgttaggaatgctgagatctcgttttcaatcattgcctggtgcttttaatgcccgtttgattccagcagaaaagagtgaaccaaagaagaaaggattgaaggctaccttgtcccgcaattttgttcaggatgaagataacaaagagaaagaagcagcaagatttgctcaattatggaacaaaataataagtagcttcagagaagaggatcttataagcgatagggagatggaccttttgcttgttccttattgggctaatcgtgatttagggcaccttattcagtggcctccatttttacttgctagcaagatcccaatagcattagacatggccaaggacagcaatggcaaggataaagagctgaagaagaggattgatgcagacaactacatgtcttgtgctgtttgtgaatgctatgcttcatttaagaacataattaggttcctggttcaggggaaccgtgagaaagaggttatagattttatattttctgaggttgacaagcacatagaaagtaatgacctgatggttgaattcaagatgagtgctcttcctgacctctatgcccagttcgttaggcttatcgaatatctgttaagtaataagcaggacgacagggatcaagttgtgattctgtttcaggacatgctggaggtggtgactagagacataatgatggaggaccatatatccagtttggtagattcaatccatggtgtgtctggacatgaagcgatgatgcccattgatcaacatcaacagcatcagttgtttgcatcttctggagctatcaggtttcctattgaacaagtaacagaggcttggaaggagaagattaaacgtctttttttattgcttacgacaaaggagtctgccatggatgttccgtccaacttagaagctaggaggaggatttctttcttctcaaattcattgtttatggacatgcctccagcaccaaaagttcgcaatatgctttctttctctgttttaactccttactacaccgaagaggttctcttttcctcacatgatttggaagtgccaaatgaagatggtgtttcaattctcttctacttgcaaaaaattttcccagatgagtggaacaactttcttcagcgtgtaaattgcacaagtgaagaggagcttaaagggtctaatggattggatgaagatcttcgcctttgggcatcatatagaggccaaactttgactcgtactgtaagaggaatgatgtactaccggaaagctttggagcttcaggcttttcttgatatggcccaagatgatgctttaatggatggctataaggctatagaattaaattcagaggatgaatcaaaggaggaaaggtcactgtgggcacaatgtcaagcagtagctgatatgaaattcacatatgtggtatcatgccaactatatgggattcacaagcgatctggtgatcctcgtgcacaggacattctgaagcttatgacaacatatccgtcgctacgtgtggcatatattgatgaggttgaagaacctagcaaagataggtccaagaagattaaccaaaaggcttattattctactttagtaaaggcagctttgccaaagtcgattgattctccagagccagtacaaaatctggaccaggtaatttatcggataaagcttccaggacctgctattttgggtgagggaaagccagaaaatcaaaatcatgccattattttcacacgtggggaagggttgcagacaattgatatgaaccaggataactacatggaagaagccttgaaaatgaggaatttgctgcaagaatttcttgagaagcatgatggggtgagacaccctacaattcttggactgagggagcatatatttactggaagtgtttcttctctagcttggttcatgtcaaatcaggaaaacagttttgtcactattggtcagagattgttggccaaccctctcaaggttcgattccattatggtcatccagatgtgtttgataggctctttcaccttaccagggggggtgtcagtaaagcatcaaaggttatcaatttgagtgaagacatatttgctggctttaattccacactccgtgaaggcaatgtaactcatcacgagtacatacaagttgggaagggaagagatgtgggccttaaccagatctcaatgtttgaagcaaaaatcgctaatggaaatggggagcagacactcagtcgagatatataccgacttggacaccgttttgactttttccgtatgttgtcgtgctatttcaccacaattggtttctactacagtactctgattacggtgcttaccgtgtatgtcttcctttatggacgcctttacctagttcttagtggacttgaagagggtttgagcactcaaccggcaatccgagataataagcctcttcaagtagctcttgcttctcaatcatttgttcaaataggatttttgatggcgttgcctatgttgatggaaattggtttggaaaagggtttccgaactgcactaagtgaattcatattgatgcaattgcaattggccccagtattttttacgttctcactcggaacaaagacccactattatggacgaacattacttcatggtggtgcaaaatatagacctacaggccgtgggtttgtggttttccatgctaagtttgctgataactataggctctattcccgcagccactttgttaagggtattgaactcttagttttacttctggtgtaccagatctttggccatacttatagaagtgctgttgcgtacattttgatcacagtatctatgtggtttatggtgggcacctggctttttgctccctttttgttcaatccttctggttttgagtggcaaaagatagttgatgattggacagattggaataagtggataagtaaccgtgggggtataggtgttccccctgaaaaaagctgggaatcatggtgggaggaggaacaagagcatctccagcattctggaaagcgtggtattgtagctgagatactgttatcgttacggttctttatctatcagtatgggctcgtctatcacttgaacattgccaagaaaaccaagagtgttctggtctatggtatttcttggctggtgatcttccttattttgtttgttatgaagactgtatccgttgggaggcgaaagttcagtgcagagtttcaactagtgttccggctaataaagggactaatattcataacttttgtgtccattttggtgactttgattgtgctgcctcacatgacgctgcaggatatcattgtgtgcattcttgctttcatgccaactggttggggaattcttctgattgcacaagcttgcaagcctgttgtccacaaggctggtttatggccatcagttcggactcttgctcgcggctttgagattgttatgggtttgcttctattcaccccagttgcattcttggcctggtttcctttcgtttctgaattccaaacccgtatgctcttcaaccaagcattcagcagaggtttacagatttctcgtattcttggtgggcaacggaaggatcgttcgtcccggaacaaggagtaaccatgctagttacaagagcagctttcaagttaattttttgattgccgtgctacttccttcccgcagactcgttaaacaatagtttgtcggtatatgctgtaattattaatgtgtttgggttgcatttttgttagttcaacttgactgacggcggccctgtcaatttttcagatgttattaaaattgcatatttgtatctatgtagatatgataaaattcatggctaaattatcaaaccatgccttgtgtcatttggttgattggcttttctaacgtcgtacaaacatttgcaccaatggttataatttgaagttttccca

SEQ ID NO: 8770 - DNA, 6200 bp, Prunus persica
aacaatgtcctcgtccagagggggttcggatcagccacctccgcaactgcagaggcggttaacccgaacgcagaccgccggtaacctcggggagacggcattcgacagtgaggtcgtgccctcttccctcgtcgaaatcgcccccattcttcgtgtcgccaatgaggttgaaacgcacaatcccagagttgcatatctctgtcgattttatgccttcgagaaagctcataggctggatcccacttctagtgggcgtggtgttcgtcagtttaaaacggcccttcttcaacgtcttgaaagggagaatgatcccacacttaagggaagggtgaaacaaagtgatgcacgtgaaatgcagagcttctatcaacattactacaaaaaatatattcaagctttgactagtgctgctcataaagctgaccgtgcacaacttaccaaggcataccagactgccaatgttctctttgaggttttaaaggctgttaatatgacacaatctatggaagttgatcgtgagattttggaagctcatgataaagttgcagaaaagacaaagctcttggtcccatacaatatccttccgcttgatcctgatagtacaaatcaggctattatgaaactttcagagattcaagctactgtttttgctcttcgtaacaccaggggtcttccttggccaaaggaatacaaaaagaaaaacgatgaagacattctggattggcttcagtcaatgtttgggtttcagaaggataatgtggcaaatcaaagggagcatctgatattattacttgcaaatgtgcacataaggcagtttccaaagcctgagcaacaacccaagttggatgaccgtgcgttgacagaagtgatgaagaagcttttcaagaactacaaaaaatggtgcaagtacttgggccggaaaagtagcctttggttaccaactatacagcaagaggtgcaacaacgcaaactactatatatgggtctatatcttctgatatggggggaagctgctaatttgagattcatgccagagtgcctttgttatatctatcaccatatggcatttgaattgtatggtatgctagctgggaatgtgagtccaatgacaggagagaatgtgaagccagcatatggaggtgaagaagaggctttcttgaaaaaagttgtaactcctatttatgatgtgattgcaaaggaagccgaaaggagcaaacgagggaaatcaaagcattcccagtggaggaactatgatgatttaaatgaatacttttggtcagtggattgtttccggttaggttggccgatgcgtgctggtgctgatttcttttgcctgcccattgaacagcttcgttttgacaaaagtagtggggacaacaagccagctagtggagatcgatgggtggggaaagtgaattttgttgagatacggtcattttggcatatttttagaagctttgaccgcatgtggagtttctttattctatgtttacaggttatgatcattgttgcttggaatggctccgggcaacccactgcaatatttactgctggtgtattcgagaaagtgttgactgtcttcataactgctgcaatcttgaaacttggacaagctgttctcgatgtaattcttagctggaaggctaggcggagtatgtcattccatgttaagttgagatacattttgaaggtcattacagctgctgcgtgggtgataattctaccggttacttattcatatagctggaaaaaccctcctgggtttgctcgaaccatcaaaagttggtttgggaatgactcacattcaccttccttgtttatcttggccgttgttgtctacttgtcgcccaatatgctggctgctgtgttgtttcttttcccatttattcgccgattcctagagagatcaaactataggattgtgatgcttatgatgtggtggtcacagcctcgactttatgttgggaggggaatgcatgagagcacattttctcttttcaagtacacaatgttttgggttcttcttataattacaaagttggcattcagttactacatagagataaggcctttagttggtccaacaaaagccatcatgagtgtacatataaccacttttcagtggcacgagttttttccccgcgcaaagaataatatcggtgttgtgattgcactctgggctccaattatccttgtctattttatggatacccagatttggtatgccatcttctccacaatatttggaggaatttatggtgcattccgtcgccttggagagattcgaacgttaggaatgctgagatctcgttttcaatcattgcctggtgcttttaatgcccgtttgattccagcggaaaagagtgaaccaaagaagaaaggactgaaggctaccttgtcccgcaattttgttcagaatgaagataacaaagagaaagaggcagcaagatttgctcaattatggaacaaaataataagcagcttcagagaagaggatcttataagcgatagggagatggaccttttacttgttccttattgggctaatcgtgatttaggccatcttattcagtggcctccatttttacttgctagcaagatcccaatagcattagacatggccaaggacagcaatggcaaggataaagaactgaagaagaggattgatgcagacaactacatgtcttgtgctgtttgtgaatgctacgcttcatttaagaacataattaggtccctggttcaggggaaccgtgagaaagaggttatagattatatattttctgaggttgacaagcacatagaaagtaatgacctgatggttgaattcaagatgagtgctcttcctagcctctatgcccagttcattaggcttatcgaatatctgttaggtaataagcaggacgacagggatcaagtggtgattctgtttcaggacatgctggaggtggtgacaagagacataatgatggaggaccatatatccagtttggtagattcagtccatggtgtgtctggccatgaagcgatgatgcccattgatcaacatcaacagtatcagttgtttgcatcttctggagctatcaggtttcctattgaacaagtaacagaggcttggaaggagaagattaaacggctttttttattgcttacgacaaaggagtctgccatggatgtgccgtccaacttagaagctaggaggaggatttctttcttctcaaattcattgtttatggacatgcctccagcaccaaaagttcgcaatatgctttctttctctgttttaactccttactacaccgaagaggttctcttttcctcacttgatttggaagtgccaaatgaagatggtgtttcaattctcttctacttgcaaaaaattttcccagatgagtggaacaactttcttcagcgtgtaaattgcacaagtgaagaggagcttaaagggtctaatggattggacgaagatcttcgcctttgggcgtcatatagaggccaaactttgactcgtactgtaagaggaatgatgtactaccggaaagctttggagcttcaggcttttcttgatatggcccaagatgatgctttaatggatggctacaaggctatagaattaaattcagaggatgaatcaaaggaggaaaggtcactgtgggcacaatgtcaagcagtagctgatatgaaattcacatatgtggtatcatgccaactatatgggattcacaagcgatctggtgatcctcgtgctcaggacattctgaagcttatgacaacatatccgtcgctacgtgtggcatatattgatgaggttgaagaacccagcaaagataggtccaagaagattaaccaaaaggcttattattctactttagtaaaggcggctttgccaaagtcgattgattctccagagccagtacaaaatctggaccaggtcatttatcggataaagcttccaggacctgctattttgggtgagggaaagccagaaaatcaaaatcatgccattattttcacacgtggagaaggcttgcagacaattgatatgaaccaggataactacatggaagaagccttgaaaatgaggaatttgctgcaagaatttcttgagaagcatgatggggtgaggcaccctacaattcttggactgagggagcatatatttactggaagtgtttcttctctagcttggttcatgtcaaatcaggaaaacagttttgtcactattggtcagagactgttggccaaccctctcaaggttcgattccattatggtcatccagatgtgtttgataggctctttcaccttaccagggggggtatcagtaaagcatcaaaggttatcaatttgagtgaagacatatttgctggctttaattccactctccgtgaaggcaatgtaactcatcacgagtacatacaagttgggaagggaagagatgtgggccttaaccagatctcaatgtttgaagcaaaaatcgctaatggaaatggggagcagacactcagtcgagatatataccgacttggacaccgttttgactttttccgtatgttgtcatgctatttcacgacaattggtttctactacagtactctgattacggtgcttactgtgtatgtcttcctttatggacgcctttacctagttcttagtggacttgaagagggtttgagtactcaaccagcaattcgagataataagcctcttcaagtagctcttgcttctcaatcatttgttcaaataggatttttgatggcattgcctatgttgatggaaattggtttggaaaagggtttccgaactgcactaagtgaattcatattgatgcaattgcaattggccccagtattttttacgttctcactcggaacgaagacccactattatggacgaacattacttcatggtggtgcaaaatatagacctacaggccgtgggtttgtggttttccatgctaagtttgctgataactacaggctctactcccgcagccactttgttaagggtattgaactcttagttttacttctggtgtaccagatctttggccatacttatagaagtgctgttgcgtacattttgatcacagtatctatgtggtttatggtgggcacctggctttttgctccctttttgttcaatccttctggttttgaatggcaaaagatagttgatgattggacagattggaataagtggataagtaaccgtgggggtataggtgttccccctgaaaaaagctgggaatcatggtgggaggaggaacaagagcatctccagcattctggaaagcgtggtattgtagctgagatattgttatcgttacggttctttatctatcagtatgggctcgtctatcacttgaacattgcaaagaaaaccaagagtgttctggtctatggcatttcgtggctggtgatcttccttattttgtttgttatgaagactgtatctgttgggaggcgaaagttcagtgcagagtttcaactagtgttccggctaataaagggactaatattcataacttttgtgtccattttggtgactttgattgtgctgcctcacatgacgctgcaggatatcattgtgtgcattcttgctttcatgccaactggttggggaattcttctgattgcacaagcttgcaagcctgttgttcacaaggctggtttatggccatcagttcggactcttgctcgcggctttgagatagtgatgggtttgcttctattcaccccagttgcattcttggcctggtttcctttcgtttctgaattccaaacccgtatgctcttcaaccaagcattcagcagaggtttacagatttcgcgtattcttggtgggcaacggaaggatcgttcgtcccggaacaaggagtgagcatgctagttacaagagcagctttcaagttaattttttgattgccttgctacttccttcctgcagactcgttaaacaatagtttgtcggtatatgctgtaattattaatgtgtttgggttgcatttttgttagttccacttgactgacggcagccctgtcaatttttcagatcttattaaaattgcatatttgtatctatgtagatatgataaaattcctggcaaaattatcaaaccatgccatatgtcatttggttgattggcttttctaacgttgtacaaacatttgcaccagggttataatttgttgaagttttccca

SEQ ID NO: 8771 - DNA, 6069 bp, Euphorbia peplus
ttcacattttgaactccgcagatttgtgaagtgaagtgaggtttatagaaggcggggaaaatgtcttcgtcttccagaggcggaccggatcaggggactcccccgttgcagaggcggatcacgaggacacagaccgcaggaaaccttggggagtcgatatttgatagtgaggttgtgccttcttcacttgttgagattgcgcctattcttcgtgttgctaatgaggttgaatctagtaatcctagagttgcttatctatgtcggttttatgcatttgagaaagcgcacaggttggatcccacttcaagtggacgaggtgttcgccaatttaaaactgctctccttcagcgtcttgagagggagaatgatcctaccttgatgggaagggtgaaaaagagtgatgccagggaaatgcagagcttctatcagcattactacaaaaagtatatccaagcattgcaaaatgcagcagataaagctgatcgtgcacaacttaccaaggcataccaaactgctaacgttctctttgaggttttgaaggctgttaatatgacgcaatctattgaagtggatcgcgagattttggaagctcaggataaagttgcggaaaagactcagatatacgttccttacaatatccttcctctcgatcctgatagtgcaaatcaggccattatgcgataccctgagatccaagctgctgttgttgcgcttcgcaacacaaggggtctcccatggcataaggactataagaagaaaaaggatgaagatgttttggattggcttcaagcaatgttcgggtttcaaaaggataatgtggctaatcaaagagagcacctaatcttattgcttgcaaatgttcacattcggcaatttccgaagcctgatcaacaacccaagttggatgagcgtgcattgactgaagtgatgaagaagcttttcaagaactacaagaaatggtgcaagtacctggacagaaaaagtagtctttggttacctactatacagcaggaggtgcagcagcgtaaattgctctatatgggtctatatcttttaatagtggggggaagctgctaacctgagattcatgcctgaatgcctgtgctatatttatcatcacatggcatttgagctatatgggatgctagctgggaatgtcagtcccatgacaggggaaaatgtcaagcctgcttatggaggtgaagaagaggcattcctgagaaaagttgtaactcctatctatgatgtgattgctaaggaatctgaaaggagtaaaaagggcaaatcaaagcattcccaatggaggaactacgatgatttaaatgaatacttctggtcagtggactgctttcggttaggttggccaatgcgtgcagatgctgatttctttcacatgcctactgcacaattccgttatgacaaaaatgaggagaataaaccagcttttaaagatcgatgggtgggaaaagtaaattttgttgagatccgttctttctggcatatctttagaagctttgatcgaatgtggagtttttatatcctgtgcttacaggctatgataattgttgcttggaatggttcgggccagctgggttctgtttttagcggtgatgtattcaaaaaagtattgagtgtcttcataactgctgctatcttaaagcttgggcaagctgttctcgatgtaatactttgttggaaggcgcgacagatcatgtctttctacgtcaaattgagatatattctgaaggttgtttctgctgctgcatgggttgtggttctaccagtcacttatgcttacacttgggaaaatcctccaggatttgctcaaaccattaaaagttggtttgggaataactcaagctcgccttctttatttattttggctgtagtcatctacttggcaccaaatatgttatcggcaatgttgtttcttttcccctttttgcgccgattccttgagaggtcaaactacaggattgtgatgctcatgatgtggtggtcacagccccggctttatgttggacgaggaatgcatgaaagcgctctctctctcttcaagtatacaatgttttgggttctccttctcatgacaaagttggcattcagttactacatagagatcaaacctttagtcagtccaacaaaggctgttatgagtgttcatgtaactcaattccagtggcatgagttctttccacaggcaaaaaacaatattggagttgtagtagcgctctgggctccaattatccttgtatattttatggatacccagatctggtatgccatattctccactttatttggaggcatttatggtgccttccgacgccttggggagattcgaacattgggaatgcttcgttctcgatttcaatcattgcctggtgcttttaatgcccgtttgattccagaagagaggagtgagccaaagaaaaaaggacttaaggccaccctgtctcgcaattttgcagagattatatcgaacaaagaagatggagcagcgagatttgcacagttgtggaacaaaataatcagtagttttagagaagaagatttaataagcgatagggaaatggatttgttacttgtcccatattgggcagatcaagatctaggtcttatacagtggcctccctttttgcttgctagcaagattcctatagcattagacatggccaaagatagcaatggtaaagataaagagctgaaaaagagaattgctaatgacaactatatgtcttgtgctgttcgtgaatgttatgcttcatttaggaatatcatcaaatttttggttgaggggaaacgggagactgaagtgattgatttcatatttaaggaagttgaaaatcatataaatgaaggcaacctgattcttgagtacaagatgagtgctcttccgagcctctatgaccattttgtgaagcttatcacctatctgttaagcaataagcaggaagacagggatcaagttgtgattctattccaggatatgctggaggttgtgacgcgcgatatcatgatggaggatcaaatatcaagtttggtagattcgatgcatggtggaactggacaagaggaaatgatttcctttgatcaacaatatcaattatttgcctcttcaggagccattagatttcctattcaacctgctacagaagcatggaaagagaaaatcaagcggctttatcttttgcttacaacaaaagaatctgccatggatgtgccatccaaccttgaagctaagaggcgaatttcttttttctcaaattcattatttatggacatgccaactcctcctaaagtgcgcaatatgctttcattttctgtcttaactccatactacacagaggaggtactgttttccttgcatgatttggaagtgccaaatgaagatggtgtctcaatcctcttttacttgcaaaaaatatttccagatgaatggaagaattttcttgagagagtcaagtgccacaatgaagatgaattaagaggaatggatgaattagaagaagaacttcggtgttgggcatcttacaggggccaaactctgaccagaactgtaagaggaatgatgtattaccggagggctttggagcttcaggctttccttgatatggccaagcatgaagatttgatggagggctataaagccatagagctgaatactgatgatcaatcaaagggggaaaggtcaatgttggctcagtgtcaagctgtagctgatatgaaattcacatatgtggtatcatgtcaacaatatgggattcacaagcggtcgggcgatcatcgagctcaagatatattgaaactcatgacagcatatccatctctccgcgtggcatacattgatgaggttgaagtaaccaacaaagataaatccaagaagaacaaccaaaaagtatattattctgctctggtgaaggctgcctcaccgaaatcaattgatcctctagagccagttcaaaatttggatgaggtcatttatcggatcaaacttccaggaccatccatcttgggtgagggaaaaccagaaaaccaaaatcacgctattatttttacacgtggagaaggcttgcaaacaatagatatgaaccaggataactacatggaggaggccttaaaaatgaggaatttactgcaagaatttcttaaaaagcatgatggagtgagacatcctacaatactggggctcagagagcatatatttacaggaagtgtttcatctcttgcatggttcatgtcaaatcaggagacgagttttgtaactataggtcaaagactgttggccaatccactgaaggttcggttccattatggacatccagatgtatttgataggctttttcatctcacaaggggcggtgtgagtaaagcgtccaaggttatcaatttgagcgaagacatatttgctggtttcaattctacacttcgtgaaggcaatgttacccatcacgaatacatccaagttgggaagggtagggatgtgggactaaatcaaatttctatgtttgaagccaaaattgctaatggaaatggtgaacagactttgagtcgcgatatataccgacttgggcaccgctttgactttttccgcatgatgtcttgctatttcaccacagttggattttacttcagtactttgataactgtgcttaccgtatatgtcttcctctatggtcgcctttatcttgttctaagtggactggaagaaggtttgatcaatcagaaagcaatccgagataacaaacctcttcaggtggctcttgcgtctcaatcatttgttcaaattgggttcctaatggccttacctatgctgatggaaattggattggaaagaggttttcgaactgctctaagtgaatttatattgatgcaattgcaattggcaccagtgtttttcacattttctcttggaactaagacacattattatggaaggaccatgcttcatggaggtgcaaaatacaggcctacaggtcgaggatttgtggtgtttcatgctaagtttgctgaaaactataggctttattctcgaagccactttgtgaagggtatcgagatgatgattttgctagttgtttaccagatatttggtcagccttatagaagtgctgttgcttatctcttgattactatttcgatgtggtttatggttgggacctggctttttgctcccttcctatttaatccttctggcttcgagtggcaaaagattgttgatgattggactgattggaataaatggattagtaatcgaggaggtataggtgtacctccagaaaagagttgggaatcatggtgggaggaggaacaagaacacctgcgtcattcaggaaaacgtggcattgtggctgagatatgtttgtctttgcggtttttcatttatcaatatgggctggtatatcacctgaagattacaaaagaaactaaaagttttctggtctatggaatatcatggctggtcatctttgtgatattgttcgtgatgaagactgtatctgttggaaggagaaagttcagtgcaaacttccagcttgttttccggcttatcaagggaatgatattccttacctttgtctccattttggttactttaattgcattgccacacatgacaattcaagacattgttgtctgcattcttgctttcatgccgactggatggggaatgcttttgattgcacaagcttgtaagccagtagttcagaaggctgggttctggggatcagttaagacattggctcgaggttatgagatagtaatggggttgcttctgttcacaccagttgcattcttggcttggtttccatttgtttcagaattccagacgcgtatgcttttcaaccaagcatttagcagaggtttgcaaatttcacgtattcttggaggccaaaggaaggaccgttcttctcgtaacaaggagtaatagatgtatgtatatttatttgtgatcatgatctgatcaaggttcctgtctatatctaatctaatgtaaaacaccttttgtaattatgaatggcttgtcatgtaattgtggatgagatagggagcaatttttggtgataaaaa

SEQ ID NO: 8772 - DNA, 6095 bp, Ricinus communis
gctaatctcaatgatgccagattcactaccttacttcttttgaattttcttgagaagtgaggagggtgagagacaggggtaaaaatgtcatcttcgtcgagagtggggccggatcaaggaacgccgcagccaccgcggcggatcatgaggacgcagacagcaggaaatctaggagaatcgatatttgatagtgaagtagttccatcttcacttgtcgagatagctcccattcttcgtgttgctaatgaagttgaatctagcaatcctagagttgcttatctttgccgattttatgcctttgagaaagcacataggttggaccccacttctagtggacgtggagttcgacaatttaaaactgctctcctgcaacgtcttgaaagggaaaatgatccaaccttgatgggaagggtaaaaaagagtgatgcacgggaaatgcagagtttttatcaacattactacaagaagtatattcaagctttgcaaaatgctgctgataaagctgatcgagcacagcttacaaaagcataccaaacggctaatgtcctctttgaggttttgaaggctgttaatatgactcaatctattgaagtggatcgcgagattttagaagctcaagacaaagttgcagaaaagactcagatctatgttccttacaatattcttcctctcgatcctgatagtgcaaatcaggcaattatgagatatcccgagatccaagctgctgtttacgcactgcgtaacacaaggggtcttccatggcccaaggactacaagaagaaaaaggatgaagatattttagattggcttcaagcaatgtttgggtttcagaaggataatgtggctaatcaaagggaacacttaatcttattgcttgcaaatgttcacattcgacaatttccaaagcctgatcaacaaccgaagttggatgagcgtgcattaacagaagtgatgaagaaacttttcaagaactacaaaaaatggtgcaagtaccttgatagaaagagtagcctttggttacccaccatacaacaggaggtgcagcagcgtaaattgctgtatatgggtctgtaccttttgatatggggagaagctgcaaacttaagatttatgccagaatgcttgtgctatatttatcatcatatggcctttgagctgtatggcatgctagctgggaatgtcagtctctcgacgggggaaaatgttaagcctgcttatggaggtgcaaatgaggcattcttgagactagttgttactcctatctatgatgtcattgcaaaggaatctgaaagaagtaaaatgggaaaatcaaagcattcccaatggaggaactatgatgacttaaatgaatacttttggtcagttgattgctttcggttaggttggccaatgcgtgatgatgccgatttctttcatttacctgctgaacactaccgttatgagaaaaatggggagaatagtaaaccagcttttagagatcgatgggtggggaaagttaattttgttgagatacgtacattttggcatgtctttagaagctttgatcgaatgtggagttttttcattctatgcttacaggcaatgattattgttgcatggaatggttcgggggaaccaaatgctgtctttaacggtgatgtattcaagaaagtgttgagtgtctttataactgctgcaatattaaagcttgggcaagctgtccttgatgtaatccttagttggaaggctcggcagataatgtcattccatgttaagttgagatatattctgaaggttgtttcagcagctgcgtgggtggtgattctccctgttacttatgcttatacttgggagaaccctccaggatttgctcaaaccattaaaagctggtttggcaataattcaagctcgccttcattgtttattttggctgtagttatctacttgtcaccaaatatgttagcagcagtgttgtttctttttcccatcctacgtcgattccttgagagatcgaactataagattgtgatgctcatgatgtggtggtcacagccacggctatatgttggtagaggaatgcatgagagtgcactttctctcttcaagtatacaatgttttgggttcttcttattatgacaaagttggcatttagttactacattgagataaagcctttagttcgtccaacaaaggatgttatgaatgttcatatcataactttccaatggcatgaattctttccacgtgcaaggaacaatattggagctgttattgcactctgggctccaattattcttgtatattttatggatacccagatttggtatgccatattttctacattatttggaggtatttatggtgcattccgacgccttggagagattcggacattgggaatgcttcgatctcgttttcaatctattcctggtgcttttaatgcctgtttaattccagaggagaagagtgagccaaagaaaaaaggattaaaggccaccttggctcgcaattttgctgtgataacatctaataaagaggatggggcagcgagatttgctcagttgtggaacaaaattatcagtagctttagggaggaagatttaataagcaatagggaaatggacttgttgctggttccatattgggcagatgaagatttgggccttatacagtggcctccttttttgcttgctagcaagatcccaatagcactagacatggccaaggacagcaatggtaaagataaagagctgaaaaagagaattgaggctgagaactacatgtcctgtgctgttcgcgaatgctatgcttcatttaggaacatcatcaagttcttggttcaagggaaacgtgagacagaagtgattgatttcatattttctgaagtcgaaaaacacatagatgagggtaccctgataagtgagtacaagatgagcgctcttcctagcctctatgaccagtttgtgaggcttatcaaacatttgttagataacaaacaggaggatagggatcaagttgtgattcttttccaggacatgttggaggttgtgacacgagacattatgatggaggatcatatctcaagtttggtggattcaatgcatggtggatctgggcatgaggagatgattttaattgatcaacaatatcagttgtttgcatcttccggagctattaagtttccaattgatcctgcaacagaagcatggaaagagaagataaaaaggctttatcttttacttacaacaaaggaatctgctatggatgtgccgtccaacttagaagctaggaggcgcatttcgttcttctcaaattcattatttatggacatgcctgatgctccaaaagttcgcaatatgctttctttctctgttttgactccatactacacagaggaggtactattttcattgcgtgatttggaagttccaaatgaagatggtgtttcaattctcttttacttgcaaaagatctttccagatgaatggaacaattttcttgagagagtaaattgctctagtgaagaagagctcaaaggatcagatgagttagaagaagaacttcgtctatgggcctcatacaggggccaaacactgactagaactgtaagaggtatgatgtattatcggaaggcgttggagcttcaggctttccttgatatggccagacatgaagatttgatggagggctacaaagccatggaattgaatacagaggatcagtcaaagggggagaggtctatgttggcacaatgtcaagcagtagctgatatgaaattcacatatgtggtatcatgccagaagtatgggattcacaagagatctggcgatcctagagcacaggacattttgaagctcatgacaacgtatccatcattgcgagtggcatatattgatgaggttgaagtaactagccaagacaaatccaagaagaacaatcgaaaagaatacttttctgctctcgtaaaggctgcctcacccaagtccattgatccttcagagccagtacaaaatttggatgaggtcatttatcggatcaaacttcccggaccagccatcttgggtgagggaaaacctgaaaaccaaaatcatgctattatcttcacacgtggagaaggcttgcaaacaatagatatgaatcaggacaattacatggaagaagctctgaaaatgaggaatttactgcaagaatttcttaagaaacatgatggtgtgagacatcctacaattcttggacttagggagcatatatttactggaagtgtttcatctctcgcatggtttatgtcaaatcaggagactagttttgtgactataggtcagagactgttggccaaccctcttaaagttcggttccactatggtcatccggatgtttttgataggctatttcacctcactagagggggtgtgagtaaagcatctaaggttatcaatctgagtgaagacatctttgctggtttcaattctacactccgggaaggcaatgttactcatcatgaatacatacaagtcgggaagggaagggatgtgggtctcaatcagatttctatgtttgaagccaaaattgctaatggcaatggtgaacagactttgagtcgtgatatataccggcttggacatcgttttgactttttccgtatgctgtcatgctatttcaccacagttggtttttacttcagtactctgatgactgtgctcactgtatatgtgttcctttatggccgcctttatcttgttcttagtggacttgaaaaaggcttaattagtcagaaggcaattcgagataataagccccttcaggtggctcttgcttctcaatcatttgttcaaattgggtttttgatggccttgcctatgctgatggaaattggcttggaaagaggtttccgaactgcgctaagtgaatttatattaatgcaactgcaactggcaccggtatttttcacattttctcttggaacgaagacgcactattatggaaggactttgcttcatggaggtgcaaaatacaggcccacaggtcgaggatttgtcgtgttccatgccaagtttgctgaaaactataggctttattctcgcagccacttcgttaagggtattgagatgatgattttacttgttgtataccaaatcttcggtcagccttatagaagtgcggttgcttatgtgttgattactatatctatgtggtttatggttgggacctggctttttgctcccttcctgtttaatccttctggttttgagtggcaaaagattgttgatgattggactgattggaacaaatggatcagtaaccgagggggtattggtgtaccgcctgaaaaaagttgggaatcatggtgggaggaggaacaagaacatcttcgtcattctggaaaacgcgggattgtggctgagatattgttgtcattgcgattctttatttatcaatatgggctggtgtatcatttaaagattacaaaggaacacaaaagttttctggtgtatggaatatcttggctggtcatctttgtaatactgtttgtcatgaagacggtatctgttggaaggcgaaaatttagtgcaaacttccagcttgtgttcaggctgataaagggaatgatattcctcacctttgtctccattctggtcactttaattgcactgcctcacatgacagttcaggacatcgttgtatgtattcttgctttcatgccaactggctgggggatgcttttgattgcacaagcttgtaagcctcttgttcatcgaatgggtttctggggatcagttcggacactggcacgtggttatgagattgttatgggcttgcttctgttcactccagttgcattccttgcctggtttccgtttgtgtctgaattccagactcgaatgttattcaaccaagcatttagtagaggtctgcaaatttctcgtattctcggtgggcaaagaaaggatcggtcttctcgtagcaaggaatgtaggggcattgtctcaatgatggatgagatggggagaaattttgattattggaattgattagtcctggcttcccaatcattctgttaaattatattgcaaaaagaaaaagattgtaatctattcttgatcattttataatctga

SEQ ID NO: 8773 - DNA, 6206 bp, Citrullus lanatus
ggggatttggagtttgagagtctgaagggacaaaatgtcgtcgagaggggggtccgatcagcctcctccattgcagaggaggatcacaaggacacagacaacggggaatctcggtgagtcagtgttcgacagcgaagttgtaccgtcgtcgctcaaggaaattgcaccaatcctgcgtgtggctaatgaggttgagtccagcaatcccagagtggcatatctgtgtcggttctatgcattcgaaaaagcccataggttagatccaacttctagtgggcgtggtgttcggcaatttaaaactgctctacttcaacggcttgaaagggagaatgatccaaccttaatgggaagagtaaagaaaagtgatgctcgtgaaatgcagagtttctatcaacattattataaaaagtacatccaagctttgcaaagtgctgctgataaagctgatcgtgctcagcttaccaaggcttatcaaactgctaatgtgctctttgaagttttgaaggctgttaacatgacccagtccattgaagttgatcgggagattctggaagcacaagataaggttgcacagaaaacacagatttttctcccctataatattcttcctcttgatcctgatagtgcaaatcagacgattatgagatatcatgagatccaagctgcagttattgcccttcgtaacactaggggccttctttggccaactgatcacaagaggaaagatggcgaagatatcttggattggctccaagcaatgtttgggtttcaggaaggcaatgtggcaaatcaaagggagcaccttattctattacttgcaaatgtacacattcggcagtttccgaagtctgatcagcaacccaagctggatgaacgtgctgtgactgaagtaatgaagaagcttttcaagaactacaaaaaatggtgcaagtatttggatcgtaaaagtagtctttggttacctaccatacagcaggaagtgcagcagcggaaacttctatacatggctttgtatcttctaatttggggagaggcagcgaatttgagattcatgcccgagtgtctttgttatatataccatcatatggcgtttgaattatatggcatgctagctgggaatatcagccctatgacaggagaaaatgtcaagccagcctatggtggtgaaaatgaagctttcttgcgtaaagttgtgactcccatttatgaagtgattgcaaaggaagctgcaaggagcaaacaagggaaatcaaaacattctcaatggaggaattatgatgatttgaatgaatatttctggtcagttgattgtttccgtttagggtggccaatgcgtgcagatgcagacttcttttgccctccttatgatcaaattcgtgcagacagaagtggggagaacaagcctctttcaaaggatcgatgggtggggaaagttaattttgttgaaataagatcatattggcatctcttcagaagctttgaccgtatgtggagcttttttatactttgcttgcaggcgatgataattgttgcctggaatggctctgggcaaccaagtgcaatctttaatgttgatgtgttcatgaaagttttaagtgtcttcattactgcagccatattgaagctttgtcaagctctccttgatgtgattcttagttggaaagcccaccggagtatgtcgttttatgttaagttgagatatatcttgaaggtggtttcggctgctgcatgggtggtaattcttcctgtgacttatgcttatagctgggaaaatccatctgggtttgcccaaactatcaaaggctggtttggtggcaaccgttcaaattcaccctccttgtttatcttggctattgtgatctatttatctccaaatatgctagctggtgtattctttttattcccttttattcgtcggtttcttgagagatccaattacagaattgtgatgctcatgatgtggtggtcacagcctcgactttatgttggcagaggaatgcatgaaagtacattttctcttgtcaagtacacgttgttctgggtgcttcttattgcaacgaagttggcattcagttattatatagagataaagcctctagtaggtccaaccaaagcaatcatgagtgttcgaataactgtcttccaatggcatgagttctttcctcgagcaaaaaacaatattggcgttgtcattgcactctgggctcctattattcttgtttactttatggatgcccagatttggtatgccatattttccacattatttggtggtatttatggtgcatttcgtcgcctgggagagattcgtacattgggaatgcttaggtctcgttttgagtcattgccgggagcttttaatgcctgtttgattccagaggaacagggtgaacccaagaagaaaggactgaaggccacgctttcccgaaacttttcagttatttcatctaacaaagagaaagagggtgcaagatttgctcaactgtggaataaaattatcagcagttttagggaggaagatcttataagtaatagggaaatggaccttttgcttgttccttattgggcagacactgaattaggcctcatgcagtggcctccgtttcttcttgctagtaagattccaatagcattagacatggctaaagacagcaatggaaaggaccgggagctgaaaaaacgaattgatgccgacagctacatgtccagtgctattcgtgaatgttatgcctcatttaagaagataatcaagcatttagttcaaggtgctcgtgagaaagaggttataaattatatatttactgaggtggacaaacacatagaagagaatagcttaataagcgagttcaagatgagtgctcttccaaagctctatgatcgctttgtcaagcttacgaagtatttgttggataacaagcaagaggacaaggatgctgttgtgattttatttcaggacatgcttgaagatgtaacaagagatatcatgaatgaggaacatatatccagtttgcttgaaacactccatggaggatcttggcatgaaggaatgacttctttggatcaacaatatcaactatttgcatccactggagccataaagtttcctgttgatcagacagaagcatggaaggaaaagattaaacgtctctatctattgctcacaaccaaggaatctgccatggatgtaccatccaacttagaagcaagaaggcgtatctctttcttttcaaattcattgtttatggacatgcctgcagcacccaaagtccggaacatgctttctttctctgttctaactccatactacacggaggaggttctattttcattgcatgatctagaagagccaaatgaggatggggtttcaattctcttctacctacaaaagatatatccagatgaatggaaaaactttcttgaaagagtgaaatgcaccagcgaagaggaattaaaaggagtgagtgagcttgaggaagaacttcgactctgggcatcctatagaggccaaacgttaacaaaaacagtaagaggaatgatgtattaccgaaaggctttagagcttcaagcttttcttgatactgctgaggatcaagaccttatggagggttacaaggcggtggagttgaactcggaagaaaattccaagggtgataggtcattatgggcacattgtcaggcaatatctgacatgaaatttacctatgtggtgtcatgtcagcagtacgggattcaaaagcaatctggtgatgctcgtgcccaagacattttgaaactaatgacaaagtacccctcccttcgagtggcatacatcgatgaggtagaagaacctagtaaagataaatccaagaaaaaccagaagacatattattcatctcttgtgaaggctgcttcacccaaatctattaatgcttctgagcatgtgcaattggatgagattatttatcaaataaagctcccgggtcctgctatcttgggtgaggggaagccagaaaatcagaaccatgcaataatatttacacgtggtgagggcttgcaaacaatagacatgaatcaggataactacatggaagaagcaatgaagatgaggaacttgttgcaagagtttcttaaaaagcatgatggtataagacacccctctattcttggacttagagagcatatatttactggaagtgtgtcatcgcttgcttggttcatgtctaatcaagaaacaagttttgttaccattggtcagagacttctggccaatcctctgaaagtccgtttccactacggacatcctgatgtgttcgataggctcttccacctaactagagggggcgtcagtaaagcttccaaggttatcaatttgagcgaagacatatttgctggtttcaattcaactcttcgtgaaggcaatgtcacccatcacgagtacatacaagttggaaaagggagagatgtgggccttaatcagatttcaatgtttgaagcaaaaatagcaaatgggaatggggagcagactttaagtcgtgatatataccgtcttggacaccgatttgacttcttccgcatgttatcttgttatttcacgactattggattctattttagtactctgataactgtactcacagtatatgtgttcctttacggtcgcctttatcttgttcttagtggacttgaaaaaggtttgagcactcaaccagcaattcgagacaataaacctctgcaagtggcccttgcttctcaatcttttgtccaaattggattcttgatggccttgcctatgctgatggagatcggtttggaaaggggattccgcactgcattgagtgaattcgtattgatgcagttacaactagcccccgtcttttttactttttctcttgggacaaagacccactattatgggaggactttacttcacggaggtgccaaatacaggcctacaggtcgtggatttgtggtgtttcatgccaagtttgctgataactacaggctctactcccgtagccactttgtcaaaggtcttgagctcatgattctacttcttgtgtaccagatatttggtcacacttacagaagcgcagttgcttatgtgttgattactgtatctatgtggtttatggtcggcacgtggttgtttgctccgtttctattcaacccttctggttttgagtggcaaaagattgtcgacgattggacagattggaataagtggataagtaatcgcggtggaattggtgttccaccagaaaaaagttgggagtcatggtgggaggaagaacaagagcatttacgtcactctggaaagcgaggcttagtagctgaaatattattagcttctcggttctttatctatcagtatggtctcgtctatcatcttagcattactcagcgcacaaatactaaaagtttcctggtatatggcatttcatggctggtgatctttctaatactgtttgtaatgaagactgtatcggttggaaggcgaaagtttagcgcagatttccaacttgtgttccgtttgatcaagggtttaattttcctaacgttcgtctcgattctcgtcaccttgattgctcttcctcatatgacagtgcaagatatcattgtttgcatccttgctttcatgccaactggttggggcatgcttttgattgcacaagcattgaaaccacttgtccagcgagctggattctggggatctgtaaggacactcgctcgtggctacgagatcatcatgggtttgcttctcttcactcccgttgcattccttgcctggtttccatttgtttcagaattccagactcgtatgctcttcaaccaagcgttcagcagaggtttgcagatttctcgtattcttggcggtcatcggaaggatcggtcgtcccgaaacaaagattagtaacattgtaagacaacaattaccttttgtcaattccttgattgcacatgatgttgcattgagaggcttgtttatattattaggagttgtaagcaatggtgggtaggtagtagaatacactagtagtatttaatggctgcaaattttggttttgttcatattttatgtttacacgcccccattcccctgctgaaaatgtaatcttgctagattgaacggtttatattttctaatcattggggtttcttcttgtatttaaagatgatgatgattattattaacattatcgaattgtttaatttcccagccaaggtta

SEQ ID NO: 8774 - DNA, 6132 bp, Malus domestica
aatggcgtcgtcgtcgagagggggtggttcggatcagccacctcagcagccactgcagaggcggttaactcgaacacagaccgccgggaacatcggggagacggctttcgacagtgagatcgtgccatcgtcccttgtcgaaatcgcccccattcttcgtgttgccaatgaagtcgaaaccaacaatcctagagttgcttatctctgtcgattttatgccttcgagaaggctcataggctggatcctacttctagtggacgtggcgttcgtcagtttaaaactgcccttcttcaacgtcttgaaagggagaatgatccaacactcaagggaagggttaaaaaaagtgatgcacgtgaaatgcagagcttctaccatcagtactacaaaaaatatattcaagctttgtcaaatactcataaagctgaccgtgcacaacttaccaaggcataccagactgccaatgttctctttgaggttttaaaggctgttaatatgacacaatctatggaagttgatcgtgagattttggaagctcatgataaagttgcagaaaagacacagctcttggtcccttacaatatccttccacttgatcctgatagtgcaaatcaagcaattatgaaatatccagaggtacaagctgctgtttttgcccttcgtaacaccaggggtcttccttggccaaaggaatacaaaaagaaaaatgaagaagacattctggattggcttcagtcaatgtttgggtttcagaaggataatgtggcaaatcaacgggagcatctgatactattgcttgcaaatgtgcatataaggcagtttccaaagcctgatcaacaacccaagttggatgaccgtgcattgacagaagtgatgaagaagcttttcaagaactacaaaaaatggtgcaagtatttgggccggaaaagtagcctttggttaccaacaatacagcaagaggtgcaacagcgcaaactactatacatgggtctatatcttctgatatggggagaagctgcaaatttgagattcatgccagagtgcctttgctatatctatcaccacatggcatttgaattgtatggtatgctcgctgggaatgtcagtccaatgacgggagagaatgtgaagcctgcctatggaggcgcagaagaggctttcttgagaaaagttgtgactcctatttatttagtgatcgcaaaggaggctgaaaggagtaaacgagggaaatcaaagcattcccagtggagaaattatgatgatttaaatgaatacttctggtcggtggattgtttccggttaggctggccgatgcgtgcaggtgctgatttcttttgcatgcctattgatcagcgtcattctgatataagtaatgaggataaaaagccagctagtggagatcgatgggtggggaaggttaatttcgttgagatacggtccttttggcatatttttagaagctttgaccgcatgtggagcttctttattctatgtttacaggttatgatcattgttgcttggaatggctctgggcaacctactggattatttgatggtgaagtattcacgaaagcattgtctgtcttcataactgctgcagtattgaagcttgggcaagcttttctggatgtaattcttagctggaagggtaggcggagtatgtcattccatgtgaagttgagatacattttgaaggtcattacagctgctatgtgggtggtaattctaccgattacatatgcatatagttggaaaaaccctcctgtgtttgctcaaactatcaaaagttggtttggcaacaatggacatcaaccaaccttgtttatcttggctgttgttatctacttgtcaccaaacatgctggctgcggtgctgtttctgttcccatttattcgtagattccttgagagatcaaattataagattgtgatgtttatgatgtggtggtcacagcctcgactttatgttgggaggggaatgcatgagagcacattttcccttttcaagtacacaatgttttgggttcttcttataattaccaagctggctttcagttactatatagagataaaacctttagttggtccaacaaaagccatcatgagtgtacgtataaccaattttcagtggcacgagttttttccccgtgcaaagaacaatattggtgttgtgattgcactctgggctccaattatccttgtctattttatggatacccagatttggtacgccattttctccacaatatttggaggaatttatggtgcattccgtcgccttggggagattcgaacattaggaatgctgagatctcgttttcaatcacttcctggtgcttttaatgcccgtttgattccggcggaaaagagtgaaccaaagaagaaaggattgaaggctactttgtctcgcacctttgttcaggttgaagtcaacaaagagaaagaggcagcaagatttgctcaattatggaacaagataataagtagtttccgagaggaggatcttataagcaatagggaaatggaccttttgcttgttccttattgggctgatcgtgatttaggctcccttacgcagtggcctccatttttgcttgctagcaagatcccgatagcattagacatggccaaggacagcaatggcaaggataaagagttgaaaaagaggattgaggctgacaattacatgtcttgtgctgttttggaatgctatgcttcatttaggaacataattaagttcctggttcagggagaacgtgagaaagaggttatagatgatatattttttgaggttgacaagcacatagacgcgggtgacctgatggtcgaatacaatatgagtgctcttcctagcctctatggctatttcgttaagctcatcaaacatctgttggacaataataaggacgaaagggatcaagttgtgattctgttccaggacatgctggaggtagtgacaagagacataatggaggaccatatgtccagtttggtagattcaagccatggtatgtctggccatgaagggatgatgccccttgatcaacctcaacagtatcagttgtttgcgtcttttggggcgatcaggtttcctattccacaagtaacagaggcttggagggagaagattaaacgtctttatcttttgcttacaacaaaggagtctgccatggatgtaccgtccaacttagaagctagaaggcggatctcttttttctcaaattcattatttatgaacatgcctccagcaccaaaagttcgcaatatgctctctttctctgttttaactccttactacactgaggaggttctcttttcgttgcgtgatttggaagtaccaaatgaagatggggtttcaattctcttctacttgcaaaaaattttcccagatgagtggaacaactttcttgagcgtgtgaattgcaccagtgaagaggagctcaaaggatcagacgaattggaagaagatcttcgcctttgggcatcatatagagggcaaactttgactcgtactgtaaggggaatgatgtactaccgaaaggctttggagcttcagtcttttctagatatggcccaagatgaagatttaatggaaggctataaggccatagaattgaattctgaagatcaaaaggaaggaaggtcactgtgggcgcaatgtcaagcagtagctgatttgaaattcacatacgtggtatcatgccaactatatgggatacacaagcgatctggtgatgctcgtgcgcaagacattctgaggcttatgacaacatatccatcactacgtgtggcatatattgatgaggttgaggaacctagcaaagatagttccaagaagatcaaccaaaaagtttattactctactttagtcaaggctgctctgcctaagtcaattgattcttcagagcccgttcaaaatctggatcaagtaatttatcgcataaagcttccaggacctgctattttgggtgaaggaaaaccagaaaatcaaaatcatgccattattttcacacgtggagaaggattgcaaacaattgatatgaaccaggataactacatggaagaagccttgaaaatgaggaatttgctgcaagaatttctcgagaagcatgatggggttaggtatcctacaattcttgggcttagggagcatatatttactggaagtgtttcttctctagcttggttcatgtcaaatcaggaaaacagttttgtcaccattggtcagagactgttggccaatcctctcagggttcgatttcattatggccatcctgatgtgtttgataggctctttcaccttaccagagggggtgtcagtaaagcatccaaggttattaatttgagtgaagacatatttgccggctttaattccacactccgtgaaggcaatgtaactcatcacgagtacatacaagttgggaagggaagagatgtgggccttaaccagatctctatgttcgaagcaaaaatagctaatggaaatggggagcagacactcagtcgagatatataccgacttggacaccgttttgactttttccgaatgatgtcttgctatttcaccacaattggtttctactacagtactctgatcactgtgcttaccgtgtacgtcttcctttatggacgcctttatcttgttcttagtggacttgaagagggtatgagcacggaacgagcaattagagacaacaagcctctgcaagtggcccttgcttctcaatcatttgttcaaataggatttttgatggcgttgcctatgttgatggaaattggtttggagaagggtttccgaactgcactaagtgaattcgtattgatgcaattgcaattggccccagtatttttcacattttcacttggaacgaagacccactattatggaaggacattacttcatggtggtgcgaaatatagatctacaggccgaggttttgtggttttccatgccaaatttgctgacaactataggctctactcccgcagccactttgttaagggcattgagctcttaattttactcgttgtgtaccagatctttggtcatacttatagaagtgctgttgcgtacattttgatcactgtatctatgtggtttatggtgggcacctggctgtttgctccctttctgttcaatccatctggctttgagtggcaaaagattgttgatgattggacggattggaataagtggataagcaaccgtgggggtataggtgttccacctgaaaaaagctgggaatcatggtgggaggaggaacaagagcatctccaatattctggaaaacgcggtattgtagctgagatactgttatccttacggttctttgtctatcagtatgggctcgtgtatcacttgaacatcgcaaaggaaaacaagagtgttctggtctatggcatttcgtggctggtgatcgtcgttattttgttcgttatgaagactgtatctgttgggaggcgaaagttcagcgcagaattccaacttgtgttccggctgatcaagggactgatattcataacttttgtgtccattttggtcactttgattgtgctgcctcacatgaccctgcaggatatcctcgtctgcattcttgctttcatgccaactggctggggaatgcttctgattgcacaagcttgcaagcctgtcgtgcacaaggctggtttatggccatcggttcggactcttgctcgcggctttgagatagttatgggcctgcttctattcaccccggttgcattcttggcctggtttccttttgtttctgaattccagactcgtatgctcttcaaccaagcattcagcagaggcttgcagatttctcgtattcttggcgggcaacgcaaggatcgctcatcccggagcaaggagtaaccttactagtaacaagagcgaaattcgagctgatttttcgatcgcctagccactttcagactcggctaaacaacatcttgttcatatgcgttgtaattatttgtgtgtttgggttgcatttttgttaggtccgcttgactgactgcaaccccgtcggttttctgatcttcttaagatgcatatatctaatttatgaaaaacttattcgctgaatcatcaatctatttgcacccttgcatgttgttgatatggtattc

SEQ ID NO: 8775 - DNA, 6143 bp, Eutrema parvulum
tcattgttagggtttctggatcgctctccatctctgaacctttattaccgctttatcctggaggtttagggtaggagtaatgtcggcttcgcgaggaggtcctgaccagggaccgtctcagccgcagcagcgacggatcgtacggactcagactgctggtaatctcggagaatcattcgatagtgaagttgttccgtcatcgcttgttgagattgcccctattctccgtgttgctaatgaggttgaatctagcaaccctagagttgcctatctctgtcggttttatgcattcgagaaagctcacaggctggatccaacctccagtggaagaggtgttcggcagtttaagactgcacttctacagcgtcttgaaagagaacatgatccgacactgatgggcagggttaagaaaagtgattcccgtgagatgcaaagcttttatcaacattactataagaagtatatccaagctttgcaaaatgctgcagataaggctgaccgtgctcagctgacaaaggcataccaaactgccaatgttttgtttgaggtgttgaaggctgttaatctgacacagtctattgaggttgaccgggagattttggaagctcaagataaggttgcagaaaagacacagttgtatgtccactataatatcctacctctcgatcctgatagtgcaaatcaagcgattatgagatatcctgagatccaagctgctgttcttgctcttcgcaacactagaggtcttccttggccagaaggtcacaagaaaaagaaagatgaagatatgcttgattggcttcaggaaatgtttggatttcagaaagacaatgtggctaatcaaagggagcacctgatcttattacttgcaaatgtgcacataagacaatttcctaagcctgatcagcagccaaagttagatgatcaagcactgacagtagtgatgaagaagctcttcaagaactataagaaatggtgcaaataccttggtcgaaagagtagtctttggttgccaactatacagcaggaaatgcaacagcgcaaactattgtatatggccctatatcttctaatctggggtgaagcagcaaacttgagattcatgccagagtgtctctgctacatttatcatcatatggcatttgaactctatggtatgctggctgggaatgttagtcccatgactggggaaaatgtgaagcctgcttatggaggtgaggaagatgcattcttgaggaaagttgtgactcctatttatgaagtgattgccacggaggctcagaggagcaagaaagggaagtccaagcactctcagtggaggaactatgatgatttgaatgaatacttttggtcagttgattgttttcgactaggttggccaatgcgagctgatgctgatttcttttatccgcctgttgatcagcccagtacagacaaagatggggataacagcaagcccgctgttgccagggatagatgggtggggaaggttaattttgttgagatccgttccttctggcatgtcttcagaagttttgatcgaatgtggagcttctatattctgtgccttcaggccatgattattatggcttgggatgggggagaaccaagttcagtctttggagctgatgtgttcaagaaagttctgagtgtgtttatcacagctgcaataatgaagcttggacaagcttctcttgatgtgatccttagtttcaaagcccatcgaagcatgtcgcttcatgttaaactaagatacatcctgaaggtgttatctgctgcagcatgggttattattctgcctgttacttacgcttacagctggaaagatcctccagcatttgccagaactatcaagagttggtttgggaatgccatgcactcaccttcactgtttataatagctgttgttttctatttggcacctaatatgctcgcggcagtactgtttcttttccctctgctacgtcggtttcttgagaggtccaactacagaattgtaatgctaatgatgtggtggtctcagcccagactctatgtcggcagaggaatgcatgagagcgcattttccctcttgaaatataccatgttctgggtgtcgcttattgcaacaaagctggcgttcagttactacattgagatcaagcctttagtttctccaacacaagccattatgagggcccgtgtgactaattttcagtggcatgagttctttcctcgtgccaaaaacaatattggtgtcgttattgccctctgggcccctattattctggtatactttatggatagtcagatttggtatgctatattttccacaatatttggaggtatatatggtgcatttcgccgccttggagagattcgtacactgggaatgcttagatcacggtttgaatcactgcctggagcttttaatgaccgcttaattccagatggaaaggaccagcaaaggaagaagggattaagggcaactttatctcataactttacagaggataaggtacctgttaacaaagagaaagaggctgcaagatttgcacagttgtggaacacaataatcagtagttttagagaggaagatcttataagtgatagggagatggatctgttgcttgttccatattgggctgaccgtgatttggatctcatccagtggcctccgttcttattggctagcaagattccaatagcgttggatatggcaaaagacagtaatgggaaggacagagagctcaaaaagaggatagagagtgactcttatatgaagtgtgctgtccgtgagtgctatgcttcattcaagaatgtcataaagtttttggttcagggaaaccgtgaaaaagaggtgatagagattatatttgccgaggttgacaaacatatagaaacaggtgatttgattcaggagtgcaggatgagtgctcttcctagtctctatgaccactttgtcaagctgatcaaatacttgctggacaataatgtggatgatagagatcatgttgtaatcctcttccaagacatgctggaagttgtaacaagagacattatgttggaggattacaatatatcgagcttggtagattcgagtcatggtggcacttggcatgggggaatgatccctctcgaacaacaatatcagctgtttgcatcttcaggtgccataagatttcctattgaaccagtaacagaagcttggaaagagaagatcaaacggctgtatctcttgcttactactaaagagtctgctatggatgttccctctaacttggaagcaagaagacggatctctttcttctcaaattcattgtttatggacatgcctatggcaccgaaagttcgcaacatgctatcattttctgttttgactccatactacactgaagaggtcctcttttccttgcgtgacctggaaacaccaaatgaagatggtgtctccatcctcttttacctacaaaagatttttccagatgaatggaacaattttcttgagcgggtgaagtgcttaagtgaagaggaaattaaagagtctgttgaattagaggaggaacttcgtttatgggcttcatatagggggcagactttgactagaactgtaagaggaatgatgtactatagaaaagcattggagcttcaggcattccttgacatggctatgcatgaagatttgatggaaggttacaaggctgtagaactaaactcagagaacaattcaagaggagaaagatcattatgggcacagtgccaagctgttgctgacatgaagtttacatatgttgtatcatgtcaacaatatggtattcataaacgatccggtgatcctcgtgcgcaggatatattgaggcttatgactagatacccttcgctccgtgttgcatatattgatgaggtcgaagaaccagtgaaggacaagtcaaagaaggggaaccagaaagtgtattattctgttttggtaaaggtgcctaagtcaactgatcattccagcctagcacaaaatctggaccaggttatctataggattaagcttcctggacctgctattcttggagagggaaagccagaaaaccaaaatcatgctattattttttctcgtggagaaggtttacagacaatcgatatgaatcaggataattacatggaggaagcgctcaagatgaggaatttgcttcaagaatttcttacaaagcatgatggtgtgaggcatccatcaattcttggactcagggaacatatatttactggatccgtttcctcccttgcttggttcatgtcaaatcaagagactagttttgttaccattggtcagagattactggcaaaccctttgagggtccgtttccattatggtcatccagatgtgtttgatagactgtttcatttaacaagaggtggtgttagcaaagcatccaaggtaatcaacctcagtgaagatatatttgcaggattcaattctacacttcgtgaaggaaatgttacccatcatgaatacatacaagttggtaaaggaagagatgttggtctaaatcagatctcgatgtttgaggccaagattgctaacggaaatggagagcaaacattaagtcgggacatttacaggcttggacaccgttttgactttttccggatgatgtcgtgttacttcaccactgttggcttttacttcagcaccctgattaccgttctcactgtctatatcttcctttatggacgtctctatcttgttttgagtgggctcgaacaaggattaagtacacagaaaggcatccgtgacaatacacctttgcaaatagctcttgcttcacagtcttttgttcagattggcttcctgatggctttacctatgcttatggaaattggattagagaggggatttaggactgccttgagtgaatttgtgctgatgcagcttcagttggcgccagtgttctttacattctctcttgggacaaagacccactactatggaaggactttacttcatggtggtgccaagtacaggtccacaggcagagggtttgttgtctttcatgcgaaatttgctgataattacagactctattcccgaagccattttgtcaaggggcttgagatgatgctgctacttgttgtgtatcaaatttttggaagtgcttacagaggcgtagtagcatatcttttgatcaccatatctatgtggttcatggtcgggacttggctttttgctccctttctcttcaatccttctggttttgaatggcagaaaattgttgatgattggactgattggaataaatggataaacaacattgggggtattggtgttccagcagaaaaaagttgggaatcgtggtgggaagaagagcaagaacatctccgatattccggaaagcgtggcatagttgttgagattttgttatctctgcggttctttatttatcaatatgggcttgtttatcatctcacgattacagagaagactaaaaactttctggtttacggagtatcgtggctggtgattttcttgatattgtttgtgatgaagactgtttcggttggaaggcggaaattcagtgcgagtttccagctaatgttccggttgataaaggggctaatattcttgacatttatatcgattattgtgatattgatcacacttgctcacatgacgatacaagacataattgtgtgcatccttgcatttatgcctacaggctggggtatgcttttgattgcgcaggcgtgtaagccggtggtacatcgagcaggattctggggatcagtgaggacactcgctcgtggatatgagatagtaatgggactgttgctgttcacgccagtggcgttcttggcttggtttccgtttgtgtcggagttccaaacgcgtatgctcttcaatcaagctttcagtagaggtcttcagatctctcgtatccttggaggacataggaaggatcggtcttcaagaaacaaggaatgaatcatcacttctcctcctccaacttcactgtattgcagggatgtctaatttatctttagtagttgttattgttgttggtacaagtagagaatcgtatggatcgacactagtgactagtgttaagttattttaatttagttatcgcgtagtttttaaaaaacaattgagtatgttttaaccatcctaaaatctatta

SEQ ID NO: 8776 - DNA, 5884 bp, Mimulus guttatus
gataaataataataaaaaaaatgtcatcgagaggaggaccatcgcaacagaatcaaccgctgccacgtaggattccgcgcactcagacagtggggaatcttggtgagtcggtatttgacagtgaagtggtgccttcgtctttggtggaaatcgcccccattcttcgtgttgccaatgaagtcgagcctagcaatccccgagtggcctacctctgtcgattttatgcgtttgagaaggctcataggttggatccgacttcgagtggacgtggtgttcgtcaatttaaaacagctcttttgcaacgtcttgaaagggaaaacgatcctaccttaatgggaagagttaaaaaaagcgatgcacgtgaaatgcagagcttttatcagcattactacaaaaagtacatccaagctttgcaaaatgccgctgacaaagctgatcgcgcacagctgacaaaagcatatcaaacagctaatgtgctctttgaggttttgaaagcagttaaccagacgcaatctgtggaagttgatcgtgaggtattggaaactcatgataaagttgcggagaagacagaaatctatgtcccgtataatattctacctcttgatcctgatagtgcaaatcaggcaataatgaaatatccagagattcaagctgccgtacatgcgcttcggaatacgagaggtcttccttggcctaaggactataagaagaaaaaggatgaagatatccttgactggcttcagtctatgtttggttttcagaaagatagtgtggcaaatcaaagggagcatttgattttgttacttgcaaatgtacacatacgacagttcccaaagccagatcaacaacccaagttggatgaacgtgctctagatgaagtgatgaagaagcttttcaagaattacaggaaatggtgcaagtatttggatcggaagagcagcctgtggttacctactatacaacaggaagtgcagcagcgtaaattgttatatatggggctttatcttcttatttggggagaagctgctaatttacgatttatgccagagtgcctctgctacatttatcatcatatggcttttgaactttatggtatgcttgctggaaatgttagtccgatgactggcgaaaatgtcaagccagcttatggaggagaagaagaggcattcctaagaaaagttatcaccccaatttatgaagtggttgctcgggaagctgcaaggagcaaaaaaggaaaatcaaaacactcccagtggagaaattatgacgatttgaatgagtacttttggtctgtagattgttttcgtctgggatggcccatgcgttctgatgctgattttttctgcaagactgtggatcagcttcaaagtgaaaaaaatggagagacaaggtctacaaaagatcggtgggtggggaaagtaaattttgtcgagatccgttcgtattggcatatctttagaagctttgacagaatgtggagtttcttcatattatgcttacaggctatgatcattattgcctggaatggctcgggacagccaagttcgattttcgattctggtgttttcaagaaagtactgagcatctttataactgcttcagttttgaaacttggacaagctgttcttgatgtgattctgagttggcaagctagaaagagcatgtccttccatgtcaaattacgatacattctaaaagttgtctctgccgctgcttgggtgattattctccctattacgtatgcttattcatggaagaatccacctggcattgctcaaattatcaaacactgggttgggaataactcaaattttccgtcactattcatattcactgtcgttatctatttatcaccgaatttgcttgctggcgttttgttccttttcccctttgttcgtcggttccttgagagttccaactataaaattgtgatgctattgatgtggtggtctcagcctcggctttatgttggaaggggaatgcatgaaagtacattttctctcttcaagtatacggtattctgggcgctccttttgattacaaagttggctttcagcttctatgtcgagataaagcctttggttggtccaactaaaaccatcatgagtgctcatgtatcaaactatcagtggcacgagtttttccccgatgcaaagaacaatattggagttgtgatcactatctgggcaccagttattcttgtctacttcatggatgcacagatctggtatgctatattctctactctttttggaggcatatatggtgcatttcgtcgtcttggagagattcgaactttgggaatgcttagatcccgatttcaatcactacctggtgcttttaatgcatgcttaatgccagaggagaaaaatgagttggtgaaaaagaaagggctgaaggctacatttgcccgcaagtttgaagtgatcccagccagtaaagagaaagaagctgcaaggtttgctcagttgtggaacaaaattattacaagtttcagagaagaggatcttataagtaacagggaaatggatctgctcttagttccatattgggccgatcgtgatttggagataatacagtggcctccgtttcttcttgccagcaagatcccaattgcagtggatatggctaaagacagtaatggcaaagacagtgagctgaaaaaccggatcaaatccgatgattatatgtattctgctgtctgcgagtgctacgcttcgttccgaaacatcgtcaaattgctagttcgtggcagcagagagaaagaggttatcgaatacatattttccgaagttgacaagcatatagaggaggataatctattaatcgagtacaagctgagtgctcttccaaatctttatgatctctttgttaggctcgtcaagtacttgctagacaataagcaagaggatagggatcaagttgttattcttttccaagatatgcttgaagtcgtgacccgagatattatgatggaagatcacatatccaacttattagattctatcccgggtggactggggcatgaaggaatgacccctcttgatcaacagtatcagttgtttgcatcagctggagccattaaatttccaactcccggatcggaagcttggaaagagaagatcaagaggttgtatttgttgctgacggtgaaggaatctgctatggacgtgccttcgaatctagaagctagaaggcgcatttccttcttctcaaattctctgtttatggacatgccttcggcccctaaagtccgcaatatgctgtctttctctgttttgactccatattacacggaggaggtcctcttttcgttgcctgagcttgaagtgcctaatgaagacggtgtttccattctcttctacctgcagaaaattttcccagatgaatggaacaattttatggagcgtgtcaagtgtttcaacgaagaagaacttagagaatctcatgaattagaagagcaactacgactttgggcatcatacaggggccaaacattgacaagaactgtgagagggatgatgtactatcgcaaagcgctagaacttcaagccttcctcgatatggcaaaggatgaagatttgatgcaaggctataaggccattgagttgaacgaagatcagataaagggagagaggtctctatggacacaatgccaagcagttgcagacatgaagttcacatttgttgtatcttgtcagttatacggtattcaaaaacgatctggcgatcctcgtgctcaagatatattgaggcttatgacaacgtatccatcacttcgagtagcatatatagatgaagttgaagaaccaagtaaagataggaccaagaagattaatgataaggtgtactattccactcttgtgaaggctgctttgccaaagtccaattcttcggagcccggacagaatctggaccaggttatttatcgtataaaacttccgggacctgctattatgggcgaaggaaaacctgaaaatcagaatcacgcgattattttcacacgtggagaaggtttacaaactatcgacatgaatcaggataactacatggaagaagctctgaaaatgagaaacttacttcaagaatttcttaaaaagcatgatgtgaggcatccatcaattcttggtttgagggaacatatctttactggaagtgtttcttctcttgcttggtttatgtcgaatcaagagacaagttttgttactattggtcagagattgttggccaaccctctgaaggttcggtttcactatggtcatccggatgttttcgataggatatttcaccttactagaggtggggttagcaaagcctccaagattatcaatctgagcgaggatatttttgccggcttcaattcgacacttcgcgaaggcaatgttacccatcacgaatacatacaagttggtaaaggcagagacgtaggccttaatcagatctctctgttcgaggcaaaaattgccaatggcaacggagaacagacattgagtcgtgatttatataggctgggccatcgtttcgacttcttccgaatgctttcttgctatttcaccacaatcggattctacttcagtaccttaattacggtgctcactgtttacgtattcctttatggacgtctttacctagttcttagcggactcgagaaagggctaagtcaaataccaggaatccgagataacaagccgctcgaagtcgctctcgcctcacagtcattcgtccaaatcggatttctaatggcactcccaatgatgatggaaatcggactcgaaaagggttttcgaaccgcactaagcgaattcatactcatgcagctacagctcgcacctgttttcttcacattctcgctcggaacaaaaacacactactacggaagaacactactccacggaggagcaaagtacaggcccactggccgtggatttgtagtcttccatgcgaaatttgcagataactatcgactatactctcgcagccactttgtgaagggcctcgagctaatgatactgctcctcgtttatcaaatattcggccagtcttacagaggcaccgttgcgtatatattaattactgtatctatgtggtttatggtcggcacttggctttttgctccgttcctttttaatccttccggcttcgagtggcaaaagatagtggatgattggactgattggaataagtggattagtaatcgaggcggtatcggtgtgccgccagagaaaagttgggaatcttggtgggaggaggagcaggaccatcttcgtcattcgggcaaacgtgggattgttgctgagattattttatcgttacggtttttcatttatcaatacgggcttgtctatcatttgaacataacaaggcatacgaaaagtgttttggtttatggtatatcgtggctggtgatctttgctatactttttgtcatgaagacaatctctgttggaaggaggaaattcagtgcaaatttccagctcgttttccggctaataaagggtttaatattcgtcacattcgtatctatccttgctattctgattgccctcccacatatgacaccgcgcgatattcttgtctgtatactcgcattcatgcctactggttggggtttacttctgattgcacaagcgtgtaagcctgtagtacaaaaagctggattctggggttcggttagaacactagcacgagggtacgagatagtaatgggattgcttctgtttacgccagtggcgtttctcgcatggttcccgtttgtgtctgaattccaaacacgaatgttgttcaaccaagctttcagcagaggtcttcagatttctcgtattctcggtggtcatcggaaagacaggtcctcaaggagcaaggagtaattattttttttactact

SEQ ID NO: 8777 - DNA, 6001 bp, Nicotiana benthamiana
taattataatggcgtcaagaggggggcctgagccgtcgctgcagcggcggataacacggacacagacgatggggaacatcggggagtcgatgattgatagtgaagtggtgccatcgtctctagcggagattgctcctattcttcgtgttgccaatgaagttgagcctagcaacccccgtgttgcctatctatgtcggttttatgcttttgagaaagctcatcggttagatcccacttctagtggacgtggtgttcggcagtttaaaacgtccctcctgcagcggcttgaaagggaaaatgatccaaccttgattggaagggttaaaaaaagtgatgcacgtgaaatgcagagcttttaccagcattactacaaaaagtacatccaagctttgcaaaatgctgctgagaaagcagaccgtgcacaacttactaaggcataccaaactgcaaacgtactctttgaagttttgaaagcagttaaccagacgcaagcagtagaagtcgaccgtgagattttggaagctcatgataaagttgctgagaagacacagattttagtcccctataatattcttcctttggatcctgatagtgtaaatcaggcaattatgagatttcctgagattcaggctgctgtttacgctctcagaaacacaagaggtcttccatggcccaaggattacaagaagaagaaagatgaagatattcttgattggcttcaagcaatgtttgggtttcagaaagatagtgttgcaaatcagagggagcatctcattttgctacttgcaaatgtacacatacgccagtatccaaagcctgaccagcaacccaagttggatgagcgtgctttgaatgaggtcatgaagaagcttttcaaaaactacaagaaatggtgcaaatatttggacaggaaaagcagtttatggttgccaaccatacaacaggaagtacagcagcgtaaattattatacatgggattgtatcttctcatatggggggaagcagcaaatttaagattcatgccagaatgcctatgctacatttaccatcatatggcatttgaactctatggcatgctagctggcaatgttagtcccatgacgggtgaaaatgttaagccagcttatggaggggaagaggaagctttcttgagaaaagttgttacgcctatttatgaagtgattgcacgggaagctactaggagcagaagaggaaaagcaaagcattcccagtggaggaactatgatgatttaaacgaatacttttggtcagtggactgcttcaggttaggttggcccatgcgcgctgatgctgatttcttttgcctccctgtggaagaacttcgtgctgagagaaatggggaaaacaagccttctagagatcgctgggtggggaaagttaattttgttgagatacgatcatatttgcatatctttaggagctttgacagaatgtggagcttcttcatattgtgcttacaggcaatgataattattgcttggaatggttcgggagagctgagcatggttttcacttcagatgttttcaagaaagtattgagtgtgtttataacagctgcagttttgaaacttgggcaagccgctcttgatgtggttcttaattggaaagctaggcacagcatgtcattctatgttaaactacgatacatattgaaggtcatatccgcagctgcttgggtggtcattttacctgttacatatgcttatacatgggaaaatcctccttcatttgcccaaaccattaaaaattggtttggcaacaactcaaattctccttcactatttatactggctgtggtaatctacttggcgcccaatatgctcgctgctctgctctttctttttcccttcgtccgtcgattcctagagagatcacactacaaaattgtgatgctgatgatgtggtggtcacagcctcggctttatgtcggtaggggaatgcatgagagcactttttctttgttcaaatacactatgttctgggtacttttaattgcgacaaaactagcattcagtttctatgtagagataaagcctttagtggatccaacaaaaaagattatgaatgtccacattaccacttatcagtggcatgagttttttccccacgcaagcagcaacattggtgttgttatcgctctttgggctccagttatccttgtttatttcatggatgctcagatatggtatgccatattctccacactattcggtggtatttatggagcatttcgtaggcttggagagattcgaaccttaggaatgctgaggtccaggttccagtctttgccaagtgcttttaacgcctgtttgataccggaggaaaagggcgaccaaccaaaaaagaaaggactaaaagcaacattttcccgaaagttcaacagggtgccatccaacaaggaaaaggaagctgcaaggtttgctcagttgtggaataaaataataacaagttttagggaggaagatcttattagcaatcgtgagatggaccttttgcttgttccttactgggctgatcgtgagttggatctcgtgcagtggccgccatttttgcttgctagcaagattccaatagcagtggatatggctaaggatagcaatggaaaggaccgtgagctgaaaaagaggatagaggctgacccttatatgtcatctgctgtttgtgagtgctatgcttcatttcgcaatgtaataaaagttttggtatctggtcatcgtgagaaggaggttatagagtatatcttttcagaagttgacaaacatattgaggctggtgacttaactagtgaactcaagatgagtgctcttcccagtctatatgagctgtttgttaagcttatcaagtacttgctagacaataggcaggaggacagggatcaagttgtacttctattccaggacatgttagaagttgttacgcgagatataatgatggaagatcatgtatcaagcttggtagattccatccatggagtctcaggatatgaaggaatggttcctcttgataagcaatatcagttatttgcttcagctggagctatcaaatttcctactcctgaatcagaagcttggaaagagaaaatcaaaaggttgtacttgttgcttacagtaaaggagtcggcaatggatgtaccgtccaacttagaagctaggaggcgaatatcctttttctccaattcattgttcatggaaatgcccacagcaccgaaagtccgaaacatgctttctttctctgtcttgaccccatactacacggaagaggtccttttttcatcagatgatttggatagacaaaatgaagatggtgtttccattctgttctatttgcagaaaatttatccagatgaatggctcaatttcattgagcgtgtggattgtaccagtgaagatgatctcaggtttaaatggtctcctgatttagaagaaaaactccgccattgggcttcatatagggggcagactttaacaaggacagtgagagggatgatgtactaccgcagagcgctggaacttcaatctttcctagatatggcccaggatgatgatttgttggaggggtataaggctattgagttaaacgaggatcagatgaagggagagaggtctctttgggtacaatgtcaagcagtagctgatatgaaattcacatatgttgtctcatgccagttatatggtatacacaagcgatctggtgatcaacgtgcacaagatattctccggcttatgacaacgtacccatccatgcgtgttgcgtacattgatgaaattgaagaaccgagcaaagacaggtccaagaaagttaatccaaaggtctactattccacccttgcaaaagctgccatttcaaattcttctgagcctggtcaaaacttggatcaggatatctaccgtataaaacttccaggccctgctatcttgggtgagggaaagcctgaaaaccagaatcatgctattatcttcactcgtggagaagggctgcaaaccatagatatgaatcaggataactacatggaggaagccttaaaaatgaggaatttgcttcaagagtttcttaagaaacacgatggtgtgaggttccctagtatactggggctgagggagcacatatttactggaagtgtttcttctctcgcgtggtttatgtcaaatcaagagacaagttttgtgacaattggtcagagactattggctaaccctctgaaggttcgattccattatgggcacccagatatttttgacagactgttccaccttacaaggggtggagtcagcaaagcttctaagattatcaacttaagtgaggacatatttgctggctttaattctacactacgtgaaggcaatgttactcaccatgagtacattcaagttggtaaaggaagggacgtgggacttaatcagatatctctatttgaggccaaaatagccaatggcaatggagaacagaccctgagtcgggatttatacaggcttggacatcgttttgactttttcagaatgttatcatgttatttcactaccattggtttctatttcagtaccttgattactgtcctcacggtatatgtgttcctctacggccgtctttaccttgtccttagtggacttgaggaagggctgagtaagcaaccgtctatcaagaacaataaagctcttcaagtggctcttgcttctcagtcttttgtgcaaattgggtttttgatggccctccctatgatgatggagattggcttggaaaagggattccgcacagcactcagtgaatttgtactgatgcaactgcagttggcaccagtattcttcacattttcacttggaacgaagacccattattatggaagaacattgctccatggaggtgcaaaatataggcctactggccgtggttttgtggtctttcatgctaagtttgctgataactatcgcttctactcccgtagtcactttgtcaagggacttgagctaatgatactattgctcgtgtatcaaatttttgggcaaggttatagaggagctgttgcatatgtcttgatcactgtgtcaatgtggttcatggtgggaacctggctctttgctccgttcctcttcaatccctctggttttgaatggcaaaagatagttgatgattggactgattggaataagtggatgagcaacagaggaggtattggtgtccccccagagaaaagttgggaatcttggtgggaggaggaacaagagcatcttaggcattctggaatacgcggtattgttgctgaaattctgttgtctttgcgcttctttatctatcagtatgggctcgtctaccacttgaagatcacggtgaaaaatcagagttttctggtttatggtgcttcatggttagtaatatttctggtacttttcgtaatgaagacaatatctgttggtcgacgaaaattcagtgcaaatctccaacttgtgttccgtattataaagggattgatattcttaacatttgttgcaacactggtgatactgatgacactgctccatatgactcctaaagacatggtggtgtgtgttctcgctttcttgccaactggctggggcatgcttctgattgctcaagcattgaagcctgtggttcgaagagctggattctgggggtcagttcggactctagctcgtggatatgagattttaatgggattgcttctgttcactccagttgctttcttggcatggtttccatttgtgtccgagttccaaactcgtatgttgttcaaccaagcattcagtagaggtcttcagatttctcgtattcttggtggtcagcgcaaagatcgggctaggaacaaggactagaattacagacatgaacaactacattaacattaatccttcaatcttgtcgttgttcattcccattgtaagctgcctttgtaattatgtagcgttaatggcagcactttttgacaatccaaattccattcttgtaaaagccatttgaaaattcctta

SEQ ID NO: 8778 - DNA, 6653 bp, Gossypium raimondii
ctcactccaccaatagcagttaaaaggaaaaaaaaaaaggaaaaagatagaagggaagagaccatagctgtgggttgtaatgtaaacttgtgtttttttcttagcttcactctcttttttgcttcctttgatgctaagtagcttaaagtagccgcccttctgtttctccctctctatatctggttttctcttctctcttagggtttttctctctgtgagctctctttctagttttgctttctaattttctcctcacattacctttactgtttcagtgtttaccctgttcctgtctatgcagatgatttaatagcttaaaatcttctttctagtgacctgggaagtgagtgtttttcccttttttctgttgagattctgggtggaagacgagggcaaaaatgtcctcgagcagggggtcagatcaatcacagccgatgaggcggatcacacgaacacagactgctggtaatctcggagaggccgcttttgatagtgaggtggtgccatcttctcttagcgagattgcacccattctccgtgttgccaatgaggttgaatcaagcaacccaagggtggcttacctctgccgattctatgcatttgagaaagctcacaggttggatcccacttctagtggacgtggcgttcgccaatttaaaactgcactccttcagcgtctcgaaagagagaatgatccaactctacagggaagggttaagaaaagtgatgctcgtgaaatgcaaagtttttatcaacactattacaaaaaatacatccaggccttgacaaatgctgccgataaggctgatcgggcacaactcacaaaagcataccagactgcaaatgttctctttgaggttttaaaggctgtcaatttgacgcagtctattgaagttgaccgcgagattctggaagctcaggataaagtagcagaacaaacacagattttggtcccctacaacatccttccgcttgatcctgatagtgcaaaccaggctattatgcaataccctgagatccaagcagctgtttatgctcttcgtaatacaaggggtcttccttggcccaatgatcacaagagaaagaaagatgaagacattctagattggcttcaagaaatgtttgggtttcagaaagataatgtggcaaatcaaagggagcacctgatcttattgcttgcaaatgtccacatacggcaatttccaaagcctgatcaacaacccaagttggatgaccatgcactgacagaagtgatgaagaaactttttaagaactacaaaaagtggtgcaagtacttggatcgcaaaagtagtctttggttgcccaccattcagcaggaagtgcaacagagaaaattattgtacatgggtctgtaccttttaatatggggtgaagctgcaaacttgcggttcatgccagaatgcctttgctacatctatcatcatatggcatttgaactttatggtatgctggctggaaatgtcagtccactgactggagagaatatccagccagcctatggaggagaggaggaagcttttctgaagaaagttgttacacctatctatgaagttattcgaagggaagctgaaaggagtaaacgagggaaatcaaagcattcacaatggagaaattatgatgatttaaatgaatacttctggtctgttgattgcttccgattgggctggccaatgcgtgctgatgctgatttcttttgcctgccaattgaacaacttgttgaaaaaaatggagataacaagccacaagctactagggaccgatgggtggggaaagttaactttgttgagatacgctcgttctggcatgtttttagaagctttgatcgaatgtggagcttttttattctctgcttgcaggttatgatcattgttgcttggaatggcaatggtcaaccaagttccatctttacgggtgatgtgttcaagaaagtgctgtctgtctttattactgctgctatattaaagcttggccaagctgtccttgatgtaatccttagttggaaagcacagcagagcatgtcatttcatgttaagttaagatacatattgaaagttgtttcagcagctgcatgggtgattgttctgcccgttacttatgcttatacttcagacaatccttcaggaattgcgcgaacaatccaaagctggtttggcagtgcctcaagttcaccttccttattcattttagctgttgtgatttacttgtcaccaaatatgctggctgcaatattgtttctctttccgtttgttcgtcgattccttgaaagttcacactacaagattgtgatgcttatgatgtggtggtcacagcctcgtctctatgttggtaggggaatgcatgagagcacattttctctcttcaagtatacaatgttttgggtcctacttatcatcactaagttggcattcagttattatattgagataaaacctttagttggtcccacaaaagctgttatgtctgttcggataacgcgtttccagtggcatgaatttttcccccaagcaaggaacaacataggcgttgtgattgctctttgggctccaatcattcttgtctattttatggatacccagatttggtatgcaatattctctacactatttggaggtatttatggtgcatttcgacgccttggagagattcgaacattaggaatgctccggtctcgttttggatcattgcctggtgcttttaatgcccgcttaattccgggggataagagcgagaaaaagaaaaagggattttggctttttttctctcgcagctttgggcagccacggtctaataaagagaaagaggcggcaaaatttgctcagttgtggaacaaaataatcagtagttttcgggaggaggatcttataagcaacaaggagatgaatctgttgcttgttccctattgggcagaccgtgatttagatcaaatccagtggccaccttttttgcttgctagcaagatcccaatagcattagacatggccaaggacagtgatagtagggatagagagctgcaaaagaggattgaagctgacccttacatgttctgtgcaattcgtgaatgctatgcttcattcagaagcattattaggtttctagttgaagggcagcgtgagaaaagagttatagatgacatattttccaaggttgacaaacgtatagccgatggtagtctgattaagacttacaaaatgagtgctcttcctagtctctatgaccacattgtgaagttgataaaacttttgttggaaaataagcaggacgaaaggggtcaagtggtactttgtttccaggacatgctggagattgtgacaaaggacataatggcggaggaagaattctccagcttggaacatggagggtctgggcatgatgggatgattgatccacttcatcaattatttgatacaaaaaagttagatcagttatttgcttctactggagctatcaaatttccaactcctgtttcagaagcatggagagaaaagatcaaccggctctatttattgcttaccacaaaggaatctgcaatggatgtaccctctaatatagatgctaggaggcgaatttctttcttctcaaattctttgtttatggacatgcctgctgcacctaaagttcgcaatatgctttctttctctgttttaactccttactacacagaagaagttctcttctccttgcaagaattggaagagccaaatgaagatggtgtttccattctgttttacttgcagaaaatctttccagatgaatggaataactttcttgaaagggtggaacgaaacaatgaagaagaacttaaagaatctcctgaattacaagaaaaacttcgtctgtgggcatcatatagggggcaaactttaacaagaactgttagaggtatgatgtactatcgagaagcattggagcttcaggctttccttgatatggccaaacatgaagatttgatggaaggctataaggccatagaactaaatacagaggatagtaaagagaacagatcactgaaggcacagtgtgaagctgtagctgatatgaaatttacgtatgtggtgtcttgccaacaatatggcattcagaagcgatctggtagtgagcgtgcacaggacattctgaggcttatgacaaaatacccatcactccgtgtagcatatattgatgagattgaacaacgtagtgaggataggtcgaagaagcttaatggcaaggttaattatttctcagtgctagtgagggctgtgccgaaatccattgattcttcagagcaaaatctagaccaggaaatttatcggataaagcttccaggacctgctatcttgggtgaaggaaaaccagaaaaccaaaaccatgctattatcttcacacgaggagaaggcttgcagacaatagacatgaaccaggataattacatggaagaggccttgaaaatgaggaatttgttgcaagaattcctcaaaaagcatgatggtgtaagatacccaaccatacttgggctcagagagcacatatttactggaagtgtttcttctctcgcgtggtttatgtcaaatcaggagaccagttttgttactattggtcagcgactgttagccaaccctctaaaggttcgattccattatggtcatccagatgtatttgataggctctttcaccttacaagaggaggtgtcagtaaagcatccaaagtcattaatttaagtgaagatatttttgctggcttcaattctacacttcgtgaaggcaatgtgactcatcatgaatacatacaagttgggaagggaagggatgtgggtctaaatcagatatctatgtttgaggccaaaatagctaatggcaatggtgagcagacattgagtcgagatatataccggctgggacatcgttttgactttttcagaatgctgtcttgttatttcactacagttggtttttatttcagtactctggtaacagtgctcaccgtctatgtgttcctttatgggcgcctctatcttgtactcagtggccttgaacaagaattgagtcaggaaccagcaatccgtgataataagcctcttcaagtggctcttgcttctcaatcttttgttcaaattggatttttgatggcactacccatgttgatggaaattggcttggaaaggggtttccgaactgcattgagtgaatttatattaatgcaactgcaactggcaccagtatttttcacattttctcttggaacaaaaacccactattatggaaggacattgcttcatggaggtgctaagtacaggcctacaggccgagggtttgtggtgttccatgcaaagtttgctgaaaactaccggctttattcacgtagccattttgttaagggtattgagatgatgatcttgcttatcgtgtaccaaatctttggtcatacttacagaagtacagttgcttatgtattgatcactgcatccttgtggtttatggtgggcacatggctttttgctcccttcctattcaatccttctggttttgagtggcagaagattgttgatgattggactgattggaataagtggataaacaaccgaggtggtataggtgtaccttcagaaaaaagttgggaatcgtggtgggaagaagagcaagagcatcttcaatattctggaaagcgtggtattattgctgagatattgttagctttacgtttctttatctaccagtatgggcttgtctatcacttgcatgttacaaggaaaaccaaaagttttttggtttatggtgcatcatggcttgtgattgttctaatattgtttgtaatgaagactgtatctgttggaaggcggaagttcagtgcaagctatcagcttgttttccggctcatcaagggattaatattcttgacatttttgtccattttggttattttggtcacacttgctcatatgacaattcaagacattatagtgtgtatttttatcttcatgcctacgggttggggaatgctcctgattgctcaggctttgaggcctgttgttaagaaagctggcttctggggatcagttcgaacacttgctcgtggatatgagattgtaatgggcttgcttcttttcactcctgttgcattccttgcctggtttccatttgtctctgagtttcagactcgaatgcttttcaaccaagcattcagcagaggtctgcagatttctcgtattctaggcggacaccgtaaagatcgcacatctcgtcacaaggagtaatatactaagcagccgcagtttgtaattatattgatgttattgatccctcgcatgaattcaatcttgaaaatctcgtcaattgttgtaattatattatggttatggatgtaagagggggcttggcaattttggcattttgaatgcaacagtcttatgatatggctgccaattgtttaaccctagcatggctctgaacaaaatttgtaagttttaccaatgtattattctgcttatctattacttttgtcggctgaacgccgctgggaaataggcatgaatgttatgaattgcttttcaagggcagagtcttaggcaattcaattcccttgcaccctgcattaatattgtgaacaataaagcgtgcttacgggttaggtttggcttagcggtggcaaataggcg

SEQ ID NO: 8779 - DNA, 6397 bp, Lactuca sativa
gtgctttctttctttctaagtagcttaaagttgcagtacacactcccatcccaccaccaccgtctctctaatctcacccttttctctctctcctagggtttgctacattcgctgaatcaaaccacaagtagacgaatgtaactagaaaacatcatttgtttgtgttaatctcttcgtattttgccgtttttgggtatttgtaagtttctttttttaaaaaaataaaaaataaattaaatgtgtgaactttaaagttctcggctttttgtttgttgatcttgaagtgggtttgaagtttaatgttggagcacggttgctgtatttgagttggtggtttgagagtgaagaaaaatgacgtcgagaggtggaggcagtggtccgtcggatcaaccgccgccgccgcagcggcggatcatgcggacacagacagcagggaatctcggagagtcgatatttgatagtgaggtggttccctcgtcgttggtcgagattgctcctattcttcgtgtggctaatgaagtcgagcctagtaaccccagggttgcttatctttgtcgattttatgcatttgagaaagctcataggttggatcccacttctagtggacgtggtgttcgtcaattcaaaactgcccttcttcagaggcttgaaagggaaaatgatccaaccttaatcgggagaatgaagaaaagtgatgcacgtgaaatgcagagtttttacagacattactactcaaagtacattcaagctttgcaaagtgctgctgataaggcagaccgtgctcagcttaccaaagcataccaaaccgctaatgttctctttgaggttttaaaagctgttaatcagacacaatcagtggaagttgatcgcgaggtattctggaaacacatgataaagttgcacagaagacagagatctatctcccctacaatattctacctcttgatcctgatagtgccaatcaggctattatgatattcccagagattcaagctgctgttgttgctcttcgtaacacaaggggtcttccatggcctagggaatacaagaagaaaaatgaagaggacattctagattggcttcaagctatgtttgggttccagaaagataatgtggcaaatcaacgggagcatctaattttattgcttgcaaatgttcatattcgccaaattccaaaacctgatcaacagcccaagttggatgaacgtgcattgaatgaagtgatgaagaaacttttcaagaactacaagaaatggtgcaagtatttggacagaaagagtagtctttggttgccaacaatacaacaagaagttcaacagcgtaaattgttatacatgggcttatatcttcttatatggggagaggctgcaaatttgagattcatgcccgagtgcctctgctacatctatcatcatatggcttttgaactatatggaatgctagctggtaatgtcagtccaatgactggtgagaatgtgaaaccagcttatggaggagatgaagaggctttcttgacaaaagtggtttctcctatttatgatgtcatagcacaggaagctgcctggagcaaagtagggaaatcgaaacattcccagtggagaaactatgatgatctaaatgaatatttctggtcagtagattgtttccggttagggtggccaatgcgtgctgattctgattttttctgtgggcccatgaaggccaatgagtctgataaaaatggggatggaaaatcatctggaggtcgaagggctgctaaagtgaattttgttgagatacgatcatattggcatgtttttagaagctttgacagaatgtggagtttctttatattatgcttacaggctatgattattgttgcttggaatggcgatggaaacccgaccaaaatatttgattctgatgtttttaagaaagtattgagtgtctttataactgcttcaatattgaaacttggtcaagctgttcttgatgtggtgctaaattggaaggcaagacaagcaatgcccttctatgtgaagctaagatacgttttgaaggttgtaacagctgctgcatgggttatagtcttacctgttacttatgcttatacatcaaaagatccagaaggattggctcagaccattaaagggtggtttgggaacagctcaggttccccatcattgttcattttggctgttgttgcctacttgtcacccaacatgcttgctgctgtgttgtttttgttcccctttataaggcgttaccttgagagttcagactacagaattgtcatgctcatgatgtggtggtctcagcctcggctttatgttggaaggggaatgcatgagagcacattttctcttttcaagtacacgacgttttggattctgctcattattacgaagctggcattcagttactatttagagatacaaccacttgtgagtcctacaaaagctatcatgagtgttcatatcaatacctatgcttggcatgagttcttcccccaggcaaggaacaatattggtgtggtggtggcactttgggctccaatcattcttgtgtattttatggatacccaaatctggtatgctatattctctacattatttggaggtgtgtatggtgcattccgtcgtcttggagagattcgaactttaggaatgttgagatcacgttttgagtcgttacctggtgcgtttaatggctgtttaattccacctgagaaaagcgatacagtgaaaaagaaaggacttaaagctaccttatctcgtaattatgaagcaatctcctcccataaagggaaagaagctgcaagatttgctcagttatggaacaaaatcatcacaagtttcagagaggaagatcttattaatgacagggagatgaacctcttgcttgttccatattgggcagaccgagagttggacctgatacagtggcctccttttctgttagctagcatgattcctattgcattggatatggcaaaagacagcaatgggaaagatcgtgagctgaaaaagagaatcgagaatgataattacatgtcttgtgctgttcgtgaatgctatgcttccttccgcaatatcattaagtttttggttcgtggaagacgagagcagaaggttatcaatgatatatttgaggaagttgacaaacatattgatgaaggagatatagtgagagaattcaaaatgagtgctctacctatcctctatgaccacgttgtcaagcttatcaattacttgttaacaaataagcaagaggaccgggatcaagttgtaatccttttccaggatatgcatgaagttgtgacaagagacataatggaagatcagtttcctaatttggatggaccaggctatgatgcggatgaacagtaccagttatttgcacctgcaggagcaatcatgttcccagctccagaatcagaagcttggaaggagaaaatcaataggttgtacttattgcttacagtgaaggagtctgccatggatgtgccatcaaacttggaagctagaagacgaatatccttcttctccaattcattgtttatggacatgccatcagcacccaaagttcgcaatatgctttccttctctgtcctcactccttattacacggaggaggtgctgttttcattgcatgatttagaagtccaaaatgaggatggggtgtcaatcctcttctatctacaaaagattttcccagatgagtggaacaactttcttgagagaatgggttgtgaaaatgaacatgacctaaaaggaaacaacgagttagaggatcaactacgtctctgggcttcatacagaggtcaaaccttgaccaagaccgttcggggaatgatgtattatcgtaaagccttggagcttcaggctttccttgatatggctaaagatgatgatctgatggaagggtacaaggcgattgaattgaatgaagatcagatgaagggagaaaggtcattgtgggcccagtgccaagctgtagctgatatgaagtttacatatgtggtgtcatgccaacaatatggtattcaaaagcgatctggggatgctcgtgcacagaatgtcctgaggctcatgacagagtatccatctctgcgtgtagcatacattgatgaggttgaggagccgagtaaagacacaactaaaaaaataaacaacaaggtttattactctgctttagtcaaagccatgccaaattctaatgcttccgaaacaggccaaaacttggatcaggttatttataggataaaattgcctggacctgcaatattgggagaaggaaagcctgagaatcagaatcatgctatcatcttcacacgtggagagggcttgcagacaattgacatgaaccaggacaattacatggaagaggccttaaaaatgaggaacttgctccaagaatttttgaaaaaacatgacgatgtgaggtaccctacaatattgggactgagggagcatattttcactggcagtgtttcttctcttgcatggttcatgtctaatcaggaaacaagttttgtaacaattggtcagagattgttagccaaccctttgaaagttcgttttcactatggtcatccagatgttttcgatagactctttcaccttacaagaggaggtgtcagcaaagcctcaaagatcataaacctaagcgaggacatttttgctggtttcaattctacacttcgtgaaggaaatgtgacacatcatgaatacatacaagttggtaaaggaagagatgtgggtctaaatcaaatctctttattcgaagccaaaattgctaacggaaatggggaacaaactcttagccgtgacctatatcgactcggacaccgattcgactttttcagaatgttatcatgttacttcaccacaatcggtttctactttagtaccttgataaccgtattgactgtgtatgtgttcctttacgggcgtctgtatatggttcttagtgggctagagaaaggtcttgcttcccaacctgcccttcgccacaataaaccacttcaagtggctcttgcttcacaatcctttgtgcaaatcggattcctaatggccttacctatgatgatggaaattggtctagaaagaggtttccggactgcattaagtgaattcattctcatgcaattacaacttgcccctgttttcttcaccttctcacttggaacaaaaactcactactatggtagaacactgcttcatggaggtgcaaagtacagggcaacagggcgtgggtttgttgtgtttcacgcaaaatttgctgaaaactatcggctttattcccgtagtcatttcgtgaaaggaatcgagcttatgatcttgcttcttgtttaccaaatatttggtgagtcatatagaggagctgttgcttatctgttgatcaccatttcgatatggttcatggttgggacttggctgtttgctccgtttctgttcaatccctcgggttttgagtggcagaagattgttgatgattggtcggattggaataagtggattagcaaccagggtggaattggagtcccccctgagaagagttgggaatcatggtgggaggaagaacaggaacacttgagatattctggaaaacgtggtgttatagttgagatactgttggcattacgttttttcatttatcagtatgggcttgtttatcatttgagtatgacaaagcatcagaagagtgtcctggtttatggcatatcatgggtcgtcatttttgcaattttgttggtggtaaaggctatatcgtttgggcggatgaaattcagtgcaaaattccaacttgttttccggctaatcaaaggggcgatcttcattatgtttgtgtcaattcttgtgatcctgattgcacttcctcatatgacactgcaagacattgttgtgtgcattcttgcctttatgcctactggatggggattactactgattgcacaggcgtgtaaaccggtggtgaaaacagctggattctggggatcagtgaggacacttgcacgtggatatgagatagtgatgggtctgcttctgttcacaccggttgcatttcttgcatggtttccgtttgtttcagagttccaaacacgtatgctcttcaatcaagccttcagtagaggtctgcagatatctcgtattcttggtggccataggaaagatcgatcagctaggaacaaagagtagtagtagtaacctacaaatgcaacatcatgaggtctctttgtgctgctgtgttttgttttttttgggtagctagttctttgtaattgtgcattcagcattgaaccactgctaattctgtcatcacttggagaatgcggaattgttaatgtatcattttaatttaaaaatgcatgttgagttttcgtattttcatgaatgctactcgtcatatttgcaag

SEQ ID NO: 8780 - DNA, 6412 bp, Solanum lycopersicum
caaaacacacttttatgttccgtgggtgtctttgttctgttgtacattttattggtttgatgcatatgtgtggtaaatgtattttttttcatttatttaatatcttgatcaccatatcaatgcttaatgcagctcttttgcttgcttcaatccatttgttctttgtttctttgcttaacttttctcattttcactcaatgcacgggaagattacttgatgttttttttaggttttaatcttatttacctgatgctaatgtgatcgcacaattatgtttatattcagcctcttaaagtgaagatataaaggtgtgaaagttgaatataatggcgtcaagagggggaccggagccgtcgctgcagcggcggattacacggacccaaacgatggggaacattggggagtcgatgattgacagtgaagtggtgccatcgtctctggcggagattgctcctattcttcgtgttgcgaatgaagttgagcccagtaacccccgtgtagcatatctatgtcgattttatgcttttgagaaagctcatcggttagatcccacttcaagtggacgtggtgttcgacaatttaaaacttccctcctgcagcgacttgaaagggaaaatgatccaactttgatcggaagggttaaaaaaagtgatgcacgtgaaatgcagagcttttaccagcattactacaagaagtacattcaagctttgcaaaatgctgctgagaaagcagatcgtgcacaacttaccaaggcataccaaactgcaaatgtactctttgaggttttgaaagcagttaatcagactcaagcagtagaagttgatcgggagattttggaagctcatgataaagttgccgagaagacacagatcttagtcccttataatattcttcctctggatcctgatagtgtaaatcaggcaattatgagatttcctgaggttcaggctgctgtttacgctctccgaaataccagaggtcttccatggcccaaggattacaagaagaagaaagatgaagatattcttgactggcttcaagctatgtttgggtttcagaaagatagtgttgcaaatcaaagggaacatctcattttgctgctagccaatgtacacatacgccagtatccaaagcctgaccaacaacccaagctggatgagcgtgctttgaatgaagtcatgaagaagcttttcaaaaactacaagaaatggtgcaagtacttggacaggaaaagcagtttatggctgccaacgatacaacaggaagtgcagcagcgtaagttattatatatgggattatatcttctcatatggggggaagctgcaaatttaagattcatgccggaatgcctttgctacatttaccatcatatggcatttgaactctatggcatgctagctggcaatgttagtcccatgacaggtgaaaatgttaagccagcttatggaggggaagaggaggctttcttgagaaaagttgttactcctatttatgaagtgattgcacgggaagctgcaagaagcagaagaggaaaagcaaagcattcccagtggaggaactatgatgatctaaatgaatacttttggtcagtggactgcttcagattaggttggcctatgcgtgctgatgctgatttcttttgccttcctgtagatgaagagcaagctgagagaaatggggacaacaaggctttaagtgatcgctggctgggaaaagttaattttgttgagatacgatcatatttgcacatctttaggagctttgacagaatgtggagcttcttcatattgtgtttacaggcaatgataattattgcttggaatggttcgggagacctgagcatggttttcacttcaaatgttttcaagaaagtattgagtgtgtttattacagctgcagttttgaagcttgggcaagccactcttgatgtgatgcttaattggaaagctaggcgaagcatgtcattctatgttaaactgcgatacatattgaaggtcatatctgcagctgcttgggtgatcattttacctgttacatatgcttacacatgggaaaatcctcctccatttgcccaagccattagaaattggtttggcagcaactcagattctccttcgctgtttatactggctgtggtaatctacttgtcacccaatatgcttgctgctctgctctttctttttcccttcgttcgccgattcctagagagatcacactacaaaattgtgatgctgatgatgtggtggtcacagcctcgtctttatgttggtagaggaatgcatgagagcactttctcattgttcaaatacactatgttctgggtacttctaattgcgacaaaactagcattcagtttttatgtggagataaagcctttagtggaaccaacaaaaaaagttatgaatgtccacattaccacttaccagtggcatgaatttttcccccatgcaagcagcaacattggtgttgttatcgctctttgggctccagttatccttgtttatttcatggatgctcagatatggtatgccatattctccacaatattcggtggtatttatggagcatttcgcaggcttggagagattcgaactttaggcatgctgaggtccaggttccagtctttgcccggtgcttttaatgcttgtttgataccagaggagaagagtgagcaacctaaaaagaaaggactaaaagcaacattctctcgaaatttcgccagggtgccatccaacaaggaaaaagaagctgcaaggtttgctcaattgtggaataaaataatcacaagttttagagaggaagatcttattagcaatcgtgagatggatcttttgcttgttccttactgggctgatcgtgagttggatctcgtgcaatggccaccatttttgcttgctagcaagattccaatagcagtggatatggctaaggatagcaacggaaaggaccgtgagctgaaaaagaggattgaggctgacccatatatgtcatctgctgtttgtgagtgctatgcttcatttcgcaatgtgataaaagttttggtttcaggtcgtcgtgagaaggaggttatagagtatatcttctcagaagttgacaagcatattgaggctggtaatttaattagtgagtacaagatgagttctcttcccagcctgtatgatctgtttgttaagctcataaaatacttgctagaaaataggcaggaggacagggatcaagttgtacttctattccaagacatgctggaagttgttacgcgagatataatgatggaagatcaactatcaagcttggtagattccatccatggagccccagggtatgaaggaatgatccctcttgatcagcaatatcagttatttgcttctgctggagctatcaaattcccccctcctgaatcagaagcttggaaagagaagatcaaaagattgtatttgctgcttacagtaaaggagtctgcaatggatgtaccatccaacttagaagctaggaggcgaatatccttcttctccaattcattgttcatggacatgcccacagcaccaaaagtccgcaatatgctttctttctctgtcttgaccccatactacacggaggaggtgcttttctcatcagatgatttggataaacaaaatgaagatggtgtttccattctgttctatttgcagaaaatttatccaggtttgtttgttcaccttggatttcaagatgtctgttgcatgctctactatgaatggaacaatttccttgaacgtgcggactgcataagtgaggacgaccttaggtttaaatggtctcctgagttagaagaaaatctccgtcattgggcttcatatagaggacagactttaactaggactgtgagagggatgatgtattaccgcagagctctagagcttcaatctttccttgacatggcccaggatgatgatttgatggaggggtataaggctatcgaattaaatgacgatcagatgaagggagaacggtctctgtgggcacaatgtcaagcagttgctgatatgaaatttacgtatgttgtttcatgccagctatatggtattcacaagcgatctggtgatcaacgtgcacaagatattctgcggcttatgactacgtacccatctatgcgtgttgcttatattgatgaaattgaagaaccaagcaaagataggtccaagaaagttaatccaaaggcctactattccactcttgtcaaagctgctctgccaaattcacattctactgagcctggtcaaaacttggatcaggttatctaccgcataaaacttccaggtcctgctatcttgggtgagggaaagcctgaaaaccagaatcatgctattatattcactcgtggagaggggctgcagactatagatatgaatcaggataactacatggaggaagccttaaaagtgaggaatttgctccaagaatttcttaagaaacatgatggtgtgaggttccctactatacttgggctgagagagcacatatttactggaagtgtttcttctctcgcttggtttatgtcaaatcaagagacaagttttgtgacaataggccagagactgttggcaaaccctctgaaggttcgattccattatggccaccctgatatttttgacagacttttccaccttacaaggggtgggattagcaaagcttctaagattatcaacttaagtgaggacatatttgctggctttaattctacacttcgtgaaggcaatgttactcatcatgagtacattcaagttggtaaagggagggatgtggggcttaatcaaatatctctatttgaagccaaaatagcgaatggcaatggagaacagaccctgagtcgggatttatacaggcttggacatcgtttcgattatttcagaatgttatcatgttatttcactaccatcggtttctatttcagtaccttgattacagttctcaccgtgtatgtgtttctctatggccgcctttaccttgtccttagtggacttgaggaaggactcagcaaagaaccagctattaaaaacaacaagcctcttcaagtggctcttgcttctcagtcgtttgtgcaaattgggtttttgatggccctccctatgatgatggagattgggttggaaaagggattccgcactgcactcagtgaatttatactgatgcaactgcagttggcacctgtattcttcacgttttcacttgggactaagacccattattatggaagaacattactccatggaggtgcaaagtataggcctactggtcgtggttttgtggtctttcatgcgaagtttgctgataactatcgcttctactcccgtagccacttcgtcaagggacttgagctaatgatattattactcgtgtatcaaatttttggtcaagaaaacagaggagctgttgcatatatcttaatcactgtctcaatgtggttcatggtgggaacctggctctttgctcccttcctcttcaacccctctggttttgaatggcaaaagatagttgatgattggactgattggaataagtggataagtaacagaggaggtattggtgtcccccctgagaaaagttgggaatcatggtgggaggaggaacaagaacatcttaggcattctggaatacgcggtattgttgctgaaattttgttgtctttgcgcttctttatctatcagtatgggctcgtctatcacttgaagatcacagtgaaaaatcagagttttctggtttatggtgcatcatggttagtaataattctggtactatttgtcatgaagacaatatctgttggtcgacgaaaattcagcgcaaatctccaactcgtgttccgtcttataaagggattgatattcttaacattcgtcgcaaccctggtgattctgatgacactgctcaagatgactcctgaagacatggttatatgtgttctcgctttcttgccaactggctggggcatgcttctgattgctcaagcattgaaacctgttgttcggagagctggattctggggatcagttcgaactctagctcgtggctatgagattgtgatgggattgcttctgttcactccggttgcttttctggcttggtttccatttgtatccgagtttcaaacacgtatgctgttcaaccaagcattcagtagaggtcttcagatttctcgtattcttggtggtcaacgtaaagatcgttcctctcgaaacaaggactagagtttcttgacatgaatagagctacatcattaacattcatccttcaatgcttgtaattgttgttcattcacattgtaagctgctgcctttgtaattatctagtggtgatagcagcatttttgggcaaataccatatcactttttttttttggtgaaaattccttaatggaatcattctcttacatttttt

SEQ ID NO: 8781 - DNA, 5891 bp, Brassica napus
tcattcgatagtgaagtcgttccctcatcccttgttgagattgcccctattctccgtgttgctaatgaggttgaatctagcaaccctagagttgcttatctctgtcggttctatgcgttcgagaaagctcacaggctggatcccacctcaagtggaagaggtgttcggcagtttaagactgcactcttacagcgtcttgaaagagaacatgatcctacactgatgggcagggttaagaaaagtgatgcccgtgagatgcagagcttttatcaacattactataagaagtatattcaagctttgcaaaatgctgctgataaggccgaccgtgctcagctgacgaaggcataccaaactgctaatgttttgtttgaggtgttgaaggctgttaatctcacacagtctattgaggttgaccgagagattttggaagctcaagataaggttgcagaaaagacacagttgtatgtccactataatatcctacctctcgatcctgacagtgcaaatcaagcgattatgagatatcctgagatccaagctgctgttctgggccttcgcaacactagaggtcttccttggccagaaggtcacaagaaaaagaaagatgaagacatgcttgattggcttcaagaaatgtttggatttcagaaagacaatgtggctaatcaaagggagcacctgatcttgttacttgctaatgtgcatataagacaatttcctaagcctgatcagcagccaaagttagatgatcaagcgctgacagatgtgatgaagaagctcttcaagaactacaagaaatggtgcaaataccttggtcgaaagagtagtctttggttgccaactatacagcaggaaatgcaacagcgcaagctattgtatatggccctatatcttctaatctggggtgaagcagcgaacttgagattcatgccagagtgtctgtgctacatttatcatcatatggcgtttgaactttatggtatgctggctgggaatgttagtcccatgactggggaaaatgtgaagccagcttatggaggagaggaagatgcattcttgaggaaagttgtgacacctatttatgaagtgattgccatggaggcacaaaggagcaagaaagggaagtccaagcactctcagtggaggaactatgatgatttgaatgaatacttttggtcagttgattgtttccgattaggttggccaatgcgagctgatgctgatttcttttatccgcctgttgaggagaccaatatagaaaaagatggggataacagcaagcctgctgtcgctagggatagatgggtgggaaagttaattttgttgagattcgttccttctggcatgtcttcagaagtttcgatcgaatgtggagcttctatattctgtgccttcaggcgatgattattatggcttgggatggcggagaaccaagttcggtctttgacgctggtgtattcaagaaagttctgagtgtgttcatcacagctgcaataatgaagcttggacaagctactcttgacgtgatccttaatttcaaagctcatcgaagcatgtcgctacatgttaaactaagatacatcctgaaggtgatatctgctgcagcatgggttattattctgcctgttacttacgcttacagctggaaagaccctccagcatttgccagaactatcaagagctggtttgggagtgccatgcactcgccttcactgtttataattgctgtggttttctatctggcgcctaatatgcttgcagccgtactgtttatgttccctatgctacgtcggtttcttgagagggccaacttcagaattgttatgctaatgatgtggtggtctcagcctagactctatgttggcagaggaatgcatgagggtgcatttgccctcttgaaatataccatgttctgggtgtcgcttattgcaacgaagctggcgttcagttactacattgagatcaagcctttagttgctccaacacaagccatcatgagggcgcgtgtgactaactttcagtggcatgagttctttcctcgtgccaaaaacaatattggtgtcgtcattgccctctgggcccctattattctggtgtactttatggatagccagatttggtatgctatatattccacaatatttggaggtatatacggtgcattccgccgccttggagagattcgtacactgggaatgcttagatcacggtttgaatcactgcctggagctttcaatgaccgcttaatccctgatggaaaccagcaaaggaagaagggattaagggcaactttatctcataactttacagaggataaggtacctgttaacaaagagaaagaggctgcaagatttgcgcagttgtggaacactataatcagtagttttagagaggaggatcttataagtgatagggagatggatctgttgcttgttccatattgggctgaccgtgatttggatcttattcagtggcctccgttcttattggctagcaagattccaatagcattggatatggccaaagacagtaatgggaaggacagagagctcatgaagaggattgagagtgactcttatatgaaatgtgccgtccgtgagtgctatgcgtcattcaaaaatatcataaatttcttggttcagggaaaccgtgaaaaagaggtgatagagattatcttttccgaggttgacaaacatatagacacaggtgctttgattcaagagtacaggatgagtgctcttcctagcctctatgaccactttgtcaagctgatcaaatatttgctggacaataatgtggaggatagagatcatgttgtaattctcttccaagacatgctggaagttgtaacacgagacattatgatggaggattacaatatatcgagcttggtggattcgagtcagggtggcgcttggcatgggggaatggtccctctcgaacaacaatatcagctgtttgcatcttcaggtgccattagatttccaattgaaccagtaacagaagcttggaaagaaaagatcaaacggctgcatctgttgctgactactaaagagtctgctatggatgtcccctctaacttggaagcaagaaggcgtatctctttcttctcaaattcattgttcatggacatgcctgcagcaccgaaagttcgcaacatgctatcattttctgttttgactccatattacactgaagaggtcctcttttccatgcatgacctggacacaccaaatgaagatggtgtctcgatcctcttttacctacaaaagatatttccagatgaatggaacaattttcttgagcgggtgaagtgctacagtgaagaggaaattaaagagtctgttgatttagaggaagaacttcgtttatgggcttcttatagggggcagactttgactagaactgttagaggaatgatgtactatcgaaaagcattggagctccaggcattccttgacatggctatgcacgaagatttgatggaaggctacaaggctgtagaactaaactcagaggacacttcaagaggggaaagatcattgtgggcacagtgccaagctgttgctgacatgaagtttacatatgttgtttcatgccaacagtatggtattcataaacgatccggtgatcagcgtgcacaggatatattgaggcttatgacaagatacccttcactccgcgttgcatatattgatgaggtcgaagaaacagtgaaagacacgtcaaagaaagggaaccagaaagtgtattattctgtgttggtaaaggtgcctaagtcaactgatcactccagcttagcacaaaatctggaccaggttatctataggataaagctccctggacctgccattcttggagagggaaagccagaaaaccaaaaccatgctattattttctctcgtggagaaggtttacagacaatcgatatgaatcaggataattacatggaggaagcattaaagatgaggaatctgcttcaagaatttcttacaaagcatgatggtgtgaggcatccatccattcttggactcagggaacatatatttactggatccgtttcctcccttgcttggttcatgtcaaatcaagagactagttttgttaccattggtcagagattactcgcaaatcctttgagggtccgtttccattatggtcacccagatgtgtttgatagactgtttcatctaacaagaggtggtgttagcaaagcatccaaagtaatcaacctcagtgaagatatatttgcagggttcaactctacgctacgtgaaggaaacgttactcatcatgaatacatacaagttggtaaaggaagagacgtcggtctcaatcagatctcaatgtttgaggccaagattgctaacggaaacggagagcaaacattgagccgtgacatttacaggcttggacaccgttttgactttttccgaatgatgtcgtgttacttcaccaccgttggcttttacttcagcaccctgattaccgttctcactgtctatatcttcctttatggacgtctctatcttgtcttgagtgggctcgaacaaggcttaagcacacagaagggcatccgagacaatacgcctttgcagatagctctcgcttcacagtcctttgttcagattggtttcctcatggctttacccatgcttatggagattggactagagaggggtttcaggactgccttgagtgagtttgtgctgatgcagcttcagctggcgccggtgttcttcacattctctcttggcactaagactcactactacggaagaaccttacttcacggaggcgccaagtacaggtccacaggcagagggttcgtcgtcttccacgccaaattcgctgataactacagactctactccagaagccattttgtgaaagggcttgagatgctgctgctgctcgttgtgtaccaaatcttcggaagcgcttacagaggcgtgcttgcgtatcttctgatcaccatatctatgtggttcatggtcggcacttggctttttgcgccgttcctgttcaatccgtctggttttgagtggcagaagattgttgatgattggactgattggaacaagtggataaacaacatcggtgggattggtgtaccggcggagaagagttgggagtcgtggtgggaggaagagcaagagcatcttagacattcgggaaagcgtgggatagttgttgagattttgttgtctctgcggttctttatctatcagtacgggcttgtttatcatctcacaatcactgagaggactaaaaactttctggtttatggagtgtcgtggctggtcattttcttgatattgtttgtgatgaagactatttcggttggaaggaggaagttcagtgcgagtttccagctgatgttccggttgataaaggggctaatattcatgacatttatcgcaattattgtgatattaatcacacttgctcacatgacgattcaagatattattgtgtgcatccttgcgtttatgcctacaggctggggtatgctcttgattgcgcaggcgtgtaagccagtggtgcatagagcaggattctggggatcagtgaggacactagctcgtggatatgagatagtgatgggactgctgctgttcacgccggtggcgttcttggcttggtttccttttgtgtctgagtttcagacgcgtatgctattcaatcaggcgtttagtagaggtcttcagatctctcgtatccttggagggcataggaaggatcgttcttctcgaaacaaggagtgaagcacttgttctctacttcactgtaatgcagagatgtttagtttatctttttagttgttgttgttgtcggtacaagtagagaatcgtagcgcaagagcaatgtagtatgttttaactttt

SEQ ID NO: 8782 - DNA, 6412 bp, Eucalyptus grandis
atgtgctttaagggcttcgggggaggaaaatgtccacctccgcgaggaggggccgaccagccaacgcagccgccgcgcggcggctcgttcggactcagaccgctggcgccctcggaagagtccagcttcgacagtgaggttgtgccgtcttcgctggtggagatcgcgccgattctgcgtgtggctaatgaagtcgagagcagcaaccccagagtggcttatctctgccgattttatgcttttgagaaggctcataggttggatcccacttctagtggacgtggtgttcgtcaatttaagactgctctccttcagcgtcttgaaagggaaaatgatccaaccttaaagggaagggttaaaaaaagtgatgcacgtgaaatgcaaagtttttatcagcattattataaaaaatacattcaagctttgcaaaatgctgctgataaagctgatcgtgctcagcttaccaaggcttaccaaactgctaatgtactttttgaggtgttgaaagctgttaatatgacgcaatccatggaagttgataaggagattttggaggctcagtttaaagtagaagaaaaaacacagatttacgttccttacaacattcttcctctggatcctgatagtgcaaatcaggcgatcatgaaatatcctgagatcatagctgctgttgtggcacttcgaaacacgaggggccttccatggccaaaggattacaagaagaaggactatgacattcttgattggcttcaggcaatgtttggatttcagaaggataatgtggcaaaccaaagggaacatttgatcttattgcttgcaaatgtgcacattcggagatttccaaaccccaaccagccacccaagttggatgatcaggcactcacagaagtgatgaagaaacttttcaagaactataaaaaatggtgcaagttcttggataggaagagcagtctttggttaccgacgatccagcaggaggtgcagcagcgtaaacttctctacatgggtctatatcttcttatttggggcgaagcagcaaatctgagattcatgcctgaatgcctttgctatatttatcatcatatggctttcgaactgtatggcatgctagctggtaatgtcagtcccatgactggagaaaatgtaaagcctgcttatggaggtgaagacgaggcctttttgacgaaagttgttactcctatatatcaagtgattgcaaaggaagcggaaaggagtaagcgcggaagatcaaagcattctcaatggaggaactatgatgatttaaatgaatacttttggtccgctgaatgtttccggttgggttggccaatgcgtacaaatgctggtttttttcaccttcccgctgagcggcaaccgtttgagaaatctgaggactcaaagcctccacatcgagatcaatgggttgggaaggtgaattttgttgagatacggtctttctggcacattttcagaagctttgatcggatgtggagcttctttattctatgcttacaggcaatgataatcgttgcttggaatggctctggggatccaactgctgtctttactccggatgtttttaagaaagtgttgtctatttttataaccgctgcgatactgaagctaggacaagctgtgcttgatgtaattctaagctggaaagcacaacagagcatgtcttattttgtgaagctaagatatatcttgaaggttgtttcggctgcttcttgggttattattctgccagtaacatatgcttatacttgggaaaatcctcctggattcgctcaaaccatcaaaagctggttcggcaatggctcaaagtcaccatccttgtttatcttggctgttgtggtttacctctctccaaatatgcttgctgcattgttgtttctcttcccttcggtccgtcgatacctagagagttcgcattacaagattgtgacgctcatgatgtggtggtcacagcctcggctctatgttgggaggggaatgcatgaaagcacattctctctcttcaagtacacattgttttgggttcttctaataattacgaagttggcattcagttattacatagagataaagcctttggtgggtcctacaaaagctataatgagtgctcatgtaactaatttccagtggcacgaattctttccacaagcgaaaaacaatattggtgttgtgattgctgtgtgggcccctgttatcttggtctactttatggatactcagatatggtatgccatattctccactttatttggaggaatttacggtgcgtttcgtcggcttggagagatacggacattgggaatgcttagatctcgtttcgaaactttgccacatgttttcaatgcctgtttaattccggacgagaagactgagcggaagaaaagaggattcttctcacgaaattatgatgctaaggacccgaataacaaagagaaagtcgaagcaagatttgctcaattatggaacacaataattgacagcttcagagaagaagatcttattagcaatagggagaagaaccttctgcttgttccatattgggctgatcgtgaactagaagacattatccaatggcctccatttttactagccagcaagatacctatagcactagacatggctaaagacagcaatggtaatgaccgggagctcagaaagagaattgattctgacacctatatgtcttgtgctattcgtgaatgctatgctcagtttagaaacatcatcatggttttggttcaaggacagcgcgagaaacgggttattgaagatatcttctctcaagttgacaaacatatacgagaaaacactctgataagggacagggaactcaggatgagtgctcttccaagcctgtataacaaatttgttgagctcatcaaatgtctgttactcaataatccagaggacagggataaagttgtgattctcttccaagatatgcttgaagttgtcacacgagacatgatggaagagtatacaagtccaattgactcaatccatggtggatccgggaatgatggaattactccacttgacagccagcaacaccaactgttcgcatctgaaggggctattaaatttcctattgaacgacaaacagaagcttggaaggagaagattaagcggcttgatttattgcttaccacaaaggaatcggccatggatgtaccttccaacttggaggccagaaggcgcatttccttcttttccaattcattgtttatggaaatgccagctgctcctaaagttcgcaatatgctttccttttccgttttgactccttactacacggaagatgttctcttctcgctgaaggacttggaatcgcaaaatgaagatggtgtttcaatcctcttttacttgcagaaaatttttccagatgaatggaccaattttcttgagcggatgggatgtacaaatgaagacgaactcaaagaaactgatgaacttgaggaaaaccttcgtctttgggcatcatatagaggccagaccttaactaaaactgtaagaggtatgatgtattaccggaaagctttggagcttcaggcttttcttgatatggccaaagatgaagatttaatggaaggttataaggctgtagagctaaacacagagagaggtgatcggtcactgtgggcccaatgtcaagcagtagctgacatgaagttcgcatatgtggtctcatgtcagcaatatggtattgacaaaagatcggggcatcaaagtgcacatgatattttgaggctcatgaccacgtacccatcagtccgtgtggcttttattgatgaggtcgaagaacctagcaaggatgggggtaggattaactcgaaggcttactattcaactctagtgaaggctgctttgccaaagtcgattgacccttcagagcctgttcagaacttggatcaggttatatataggataaagcttcccggaaatgctatattgggtgaaggaaaacctgaaaatcagaatcatgccattatatttacacgtggagaaggcttgcaaacaatcgatatgaaccaggataactacatggaagaagcactgaaaatgaggaatttgctgcaagaatttctcaaaaaggatgatggtgtgaggaatccgacaattcttggacttcgggagcatattttcactggaagtgtttcatctctagcttggttcatgtcaaatcaggagactagttttgttactattggccaaagactgttggccaaccccttgaaggttcgtttccattatggtcatcctgatgtcttcgatcggctgtttcaccttactagaggtggtgtcagcaaggcttcaaaggttatcaatttgagtgaagacatatttgctggcttcaattctacacttcgtgaaggcaatgtaactcatcatgagtatatacaagtgggaaaagggagggacgtgggtctaaaccagatatccatgttcgaggctaaaatagccaatggaaatggggagcagactttgagtagagatatataccgacttggacatcgttttgatttcttcagaatgttatcatgttacttcaccaccattggcttttatttcagtactctgattaccgtgcttacagtatatgtcttcctttatggccgtctttatttagttcttagtgggcttgaaaaggaattgagtgctcagcctggaattagggacaataagcctctccaggtggctcttgcctcccaatcatttgtccaaattggatttttgatggcactgcctatgttgatggaaataggattggagaggggatttagaactgcacttagtgattttgtgctgatgcaattgcaacttgcccctgtatttttcacattttctcttggaacaaagacgcactattatggaagaactttactccacggaggcgcaaaatacagagctactggtcgtggttttgttgtgttccatgccaagtttgcagacaattatagaatgtactcccgcagtcattttgttaaaggatttgagttaatggtattgctgcttgtgtatgaaatctttggtcaatcatataggggcgctgttgcttatatcctgatcacaatatccatgtggttcatggttgggacttggctttttgctccattcctatttaatccttctggtttcgagtggcaaaagattgtagatgattggacagattggaataaatggataggcaaccgaggtggaataggtgtacctccagaaaaaagttgggagtcatggtgggaggaggaacaggagcatctgcgtcattctggaaaacgtggtatcatagctgagattctattggcactgcgatttttcatatatcagtatgggcttgtgtatcacttgagcatcacacatacgagaagtgtcctggtgtatggcatatcgtggcttgtgatcttccttatattgtttgtgatgaagactatttctgttggtagacgaaaattcagtgcagatttccagcttgtcttccggctgatcaagggactgatattcttgacttttgtctccattttggtgacgttgattgcactcccacacatgacaattcgagacataattgtttgcgttcttgctttcatgccgactggatggggaatgcttttgattgcacaagcgtgcaaacctctcgtcgtcaaagctggaatttggggatcagttcggactcttgcccgtggttttgagattatcatgggtttacttctattcactccagttgcattcctggcttggtttccatttgtctcagaattccagacccgtatgctcttcaaccaagccttcagcagaggcttgcagatttcacgtattcttggtggacaaaggaaagataaggatcggtctgccaacagcaagtaatgaagatgagagaagcatttacttatgtttgctcaagaacttttgtgtgagaattcatctcaatctgtatctctgacctggtgatatccatttctcattcgaaggtaaaggaggggagcttcctcgtatgtacatagaatcgaacttgaaagctggagtcgtgttagggttaccttttaggatcttggtcggagcttatctattcagccaatttttgtcgccaatgcattggcatttggagtgatggatcaggtcagtgattgagaattgagtgcaaattgtgggttatgtaattattggtttgctatggcgctctatcttgatggtcttcaagaagcaatgacactttttatcatcctttggtctgcaatgagaattgagtgcaaattgtgaacactagctcgcgcattgtaatttaagagctggttatggggacaaaaagaaattttggttttaatagtatttacccaaaaaaaaggaggaatttgaaggatatgaaacaaggaatgaaaagtaagttttctcacgtcacatg

SEQ ID NO: 8783 - DNA, 6090 bp, Brassica rapa
atgtcggcttcgagaggtggtggtcctgaccaaggaccgtcccagcctcagcagcgacggatcatgcggactcagaccgttggtaacctcggtgaatcattcgatagtgaagtcgttccctcatcccttgttgagattgcccctattctccgtgttgctaatgaggttgtcggttctatgcgttcgagaaagctcacaggctggatcccacctccagtggaagaggtgttcggcagtttaagactgcactcttacagcgtcttgaaagagagcatgatcctacactgatggggagggttaagaaaagtgatgcccgtgagatgcagagcttttatcaacattactataagaagtatattcaagctttgcaaaatgctgctgataaggccgaccgtgctcagctgacgaaggcataccaaactgctaatgttttgtttgaggtgttgaaggctgttaatctcacacagtctattgaggttgaccgagagattttggaagctcaagataaggttgcagaaaagacacagttgtatgtccactataacatcctacctctcgatcctgacagtgcaaatcaagcgattatgagatatcctgagatccaagctgctgttcttggccttcgcaacactagaggtcttccttggcctgaaggtcacaagaaaaagaaagatgaagacatgcttgattggcttcaagaaatgtttggctttcagaaagacaatgtggctaatcaaagggagcacctgatcttgttacttgctaatgtgcatataagacaatttcctaagcctgatcagcagccaaagttagatgatcaagcgctgacagatgtgatgaagaagctcttcaagaactacaagaaatggtgcaaataccttggtcgaaagagtagtctttggttgccaactatacagcaggaaatgcaacagcgcaagctattgtatatggccctatatcttctaatctggggtgaagcagcgaacttgagattcatgccagagtgtctctgctacatttatcatcatatggcatttgaactctatggtatgctggctgggaatgttagtcccatgactggggaaaatgtgaagccagcttatggtggcgaggaagatgcattcttgaggaaagttgtcactcctatttatgaagtgattgccatggaggctcaaaggagcaagaaagggaagtccaagcactcacagtggaggaactatgatgatttgaatgaatacttttggtcagttgattgtttccgattaggttggccaatgcgagctgatgctgatttcttttatccgcctgttgaggagaccaatatagaaaaagatggggataacagcaagcctgctgttgctagggatagatgggtggggaaagttaattttgttgagattcgttccttctggcatgtcttcagaagtttcgatcgaatgtggagcttctatattctgtgccttcaggtattattactctcccttaattgtcactgccccctctttatgcatattctcacaatgataaaattcggaaggcgatgattattatggcttgggatggcggagaaccaagttcggtctttgacgctggtgtattcaagaaagttctgagtgtgtttatcacagctgcaataatgaagcttggacaagctacccttgatgtgatccttaatttcaaagctcatcgaagcatgtcgctgcatgttaagctaagatacatcctgaaggtgatatctgctgcagcatgggttattattctgcctgttacttacgcttacagctggaaagaccctccagcgtttgccagaactatcaagagctggtttgggagtgccatgcactcgccttcactgtttataatagctgtggttttctatctggcgcctaatatgcttgcagccgtactgtttatgttccctatgctacgtcggtttcttgagagggccaacttcagaattgttatgctaatgatgtggtggtctcagcctagactctatgttggcagaggaatgcatgagggtgcatttgccctcttgaaatataccatgttctgggtgtcgcttattgcaacgaaactggcgttcagttactacattgagatcaagcctttagttgctccaacacaagccattatgagggcgcgtgtgactaactttcagtggcatgagttctttcctcgtgccaaaaacaatatcggtgtcgtcattgccctctgggcccctattattctggtgtactttatggatagccagatttggtatgctatatattccacaatatttggaggtatatacggtgcattccgccgccttggagagattcggacactgggaatgcttagatcacggtttgaatcactgcctggagctttcaatgaccgcttaatccctgatggaaaccagcaaaggaagaagggattaagggcaaccttatctcataactttacagaggtttaggtacctgttaacaaagagaaagaggctgcaagatttgcacagttgtggaacacaataatcagtagttttagagaggaagatcttataagtgatagggagatggatctgttgcttgttccatattgggcggaccgtgatttggatctcatacagtggcctccgttcttattggctagcaagattccaatagcattggatatggcaaaagacagtaatgggaaggatagagagctcatgaagaggattgagagtgactcttatatgaaatgtgccgtccgtgagtgctatgcttcattcaagaatatcataaattttttggttcagggaaaccgtgaaaaagaggtgatagagattatcttttccgaggttgacaaacatatagacacaggtgctttgattcaagagtacaggatgagtgctcttcctagcctctatgaccactttgtcaagctgatcaaatatttgctagacaataatgtggaggatagagatcatgttgtaattctcttccaagacatgctggaagttgtaacaagagacattatgatggaggattacaatatatcgagcttggtagattcgagtcagggtggcgcttggcatgggggaatggtccctctcgaacaacaataccagctgtttgcatcttcaggtgccattagatttccaattgaaccagtaacagaagcttggaaagaaaagatcaaacggctgcatctcttgctgactactaaagagtctgctatggatgtcccttctaatttggaagcaagaaggcgtatctctttcttctcaaattccttgttcatggacatgcctgcagcacccaaagttcgcaacatgctatcattttctgttttgactccatattatactgaagaggtcctcttttccatgcatgacctggacacaccaaatgaagatggtgtctcgatcctcttttacctacaaaagatatttccagatgaatggaacaattttcttgagcgggtgaagtgctacagtgaagaggaaattaaagagtctgttgacttagaggaggaacttcgtttatgggcttcttatagggggcagactttgactagaactgttagaggaatgatgtactatcgaaaagcattggagctccaggcattccttgacatggctatgcacgaagatttgatggaaggctacaaggctgtagaactaaactcagaggacacttcaagaggggaaagatcattgtgggcacagtgccaagctgttgctgacatgaagtttacatatgttgtttcatgtcaacagtatggtattcataaacgatccggtgatcagcgtgcacaggatatattgaggcttatgacaagatacccttcactccgtgttgcatatattgatgaggtcgaagaaacagtgaaagacacgtcaaagaaagggaaccagaaagtgtattattctgtgttggtaaaggtgcctaagtcaactgatcattccagcctagctcaaaatctggaccaggttatctataggattaagctccctggacctgccattcttggagagggaaagccagaaaaccaaaaccatgctattattttctctcgtggagaaggtttacagacaatcgatatgaatcaggataattacatggaagaagcattaaagatgaggaatttgcttcaagaatttcttacaaagcatgatggtgtgaggcatccatccattcttggtctcagggaacatatatttactggatccgtttcctcccttgcttggttcatgtcaaatcaagagactagttttgtcaccattggtcagagattactcgcaaatcctttgagggtccgtttccattatggtcacccagatgtgtttgatagactgtttcatctaacaagaggtggtgttagcaaagcatccaaagtaatcaacctcagtgaagatatatttgcagggttcaactctacgctacgtgaaggaaacgttactcatcatgaatacatacaagttggcaaaggaagagatgtcggactaaatcagatctccatgtttgaggccaagattgctaacggaaacggagagcaaacattaagtcgagacatttataggcttggacaccgtttcgactttttccgaatgatgtcgtgttacttcactaccgttggcttttacttcagcaccctgattaccgttctcaccgtctacatcttcctttatggacgtctctaccttgttctgagtgggctcgaacaaggactaagcacacagaaaggcatccgagacaatacgcctttgcagatagctctcgcttcactgtcctttgttcagattggtttcctcatggctttacccatgcttatggagattggactagagaggggtttcaggactgccttgagtgagtttgtgctgatgcagcttcagttagcgccagtgttcttcacattctctcttggcactaagactcactactacggaagaaccttacttcacggaggtgccaagtacaggtccacaggcagagggttcgtcgtcttccacgccaagttcgctgataactacagactctattccagaagccattttgtaaaagggcttgagatgatgctgctactcgttgtgtaccaaatcttcggaagcgcttacagaggcgtgcttgcgtatcttctgatcaccatatctatgtggttcatggtcgggacttggctctttgctccgttcctgttcaatccgtctggttttgagtggcagaagattgttgatgattggactgattggaacaagtggataaacaacatcggtgggattggtgtaccggcggagaagagttgggagtcttggtgggaggaagagcaagagcatcttagacattcgggaaagcgtggcatagttgttgagattctgttgtctctgcggttctttatctatcagtacggtcttgtttatcatctcacaatcactgagaggactaaaaactttctggtttatggagtgtcgtggctggtgattttcttgatattgtttgtgatgaagactatatcggttggaaggaggaagttcagtgcgagtttccagctgatgttccggttaataaaggggctaatattcatgacatttatcgcaatcattgtgatattaatcacacttgctcacatgacgattcaagatattattgtgtgcatccttgcgtttatgcctacaggctggggaatgctcttgatagcgcaagcatgtaagccagtggtgcatagagcagggttctggggatcagtgaggacactagctcgtggatatgagatagggatggggctgctgctgttcacgccggtggcgttcttggcttggtttccttttgtgtccgagtttcagacgcgtatgctcttcaatcaagcgtttagtagaggtcttcagatctctcgtatccttggagggcataggaaggatcgttcttctcgaaacaaggagtgaagcatttgttctccacttcactgtaatgcagggatgtctagtttatctttagttgttgttgttgttgtcggtacaagtagagaatcgtaccgtaaaagcaatgtagtatgttttaacttttaaccaaggaaaaatctactcttcaacgactcattagtttgtctaccaagaccattttgttt

SEQ ID NO: 8784 - DNA, 6301 bp, Solanum phureja
gctaagtagcttaaagttgcagcctccccaaaaactcccttctctcttactactagggtttgttttgctggctcttcttcactttccaccttttgcttttacaccattcttgaactaacaattaatgacttttaaagtgaaaaggtgtgaaagttaaatataatggcgtcaagagggggaccggagccgtcgctgcagcggcggattacacggacccaaacgatggggaacattggggagtcaatgattgacagtgaagtggtgccatcttctctggcggagattgctcctattcttcgtgttgcgaatgaagttgagcccagtaacccccgtgtcgcatatctatgtcggttttatgcttttgagaaagctcatcgattagatcccacttcaagtggacgtggtgttcgacaatttaaaacttccctcctgcagcgacttgaaagggaaaatgatccaactttgattggaagggttaaaaaaagtgatgcacgtgaaatgcagagcttttaccagcattactacaagaagtacattcaagctttgcaaaatgctgctgagaaagcagatcgtgcacaacttaccaaggcataccaaactgcaaatgtactctttgaggttttgaaagcagttaatcagactcaagcagtagaagttgatcgtgagattttggaagctcatgataaagttgctgagaagacacagatcttagtcccttataatattcttcctctggatcctgatagtgtaaatcaggcaattatgagatttcctgaggttcaggctgctgtttacgctctccgaaatactagaggtcttccatggcccaaggattacaagaagaagaaagatgaagatattcttgactggcttcaagctatgtttgggtttcagaaagatagtgttgcaaatcaaagggagcatctcattttgctactagccaatgtacacatacgccagtatccaaagcctgaccaacaacccaagttggatgagcgtgctttgaatgaagttatgaagaagcttttcaaaaactacaagaaatggtgcaagtacttggacaggaaaagcagtttatggctgccaacgatacaacaggaagtgcagcagcgtaagttattatatatgggattgtatcttctcatatggggggaagctgcaaatttaagattcatgccggaatgcctatgctatatttaccatcacatggcattcgaactctatggcatgctagctggcaatgttagtcccatgacaggtgaaaatgttaagccagcgtatggaggggaagaggaggctttcttgagaaaagttgttactcctatttatgaagtgattgcacgggaagctgcaagaagcagaagaggaaaagcaaagcattcccagtggaggaactatgatgatttaaatgaatacttttggtcagtggactgcttcagattaggttggcccatgcgggctgatgctgatttcttttgcctccctgtagatgtagagcaagctgagagaaatggggacaacaaggctttaagtgatcgctggctggggaaagttaattttgttgagatacgatcatatttgcacatctttaggagctttgacagaatgtggagcttcttcatattgtgtttacaggcaatgataattattgcttggaatggttcgggagacctgagcatggttttcacttcaaatgttttcaagaaagtattgagtgtgtttataacagctgcagttttgaagcttgggcaagccactcttgatgtgatgcttaattggaaagctaggcgaagcatgtcattctatgttaaactgcgatacatattgaaggtcatatctgcagctgcttgggtgatcattttacctgttacatatgcttatacatgggaaaatcctcctccatttgcccaagccattagaaattggtttggcagcaactcagattctccttcactgtttattctggctgtggtaatctacttgtcacccaatatgctcgctgctctgctctttctttttcccttcgttcgccgattcctagagagatcacactacaaaattgtgatgctgatgataaatctgataaattttttttatcaattgcagcctcgtctttatgttggtagaggaatgcatgagagcactttttcattgttcaaatacactatgttctgggtacttctaattgcgacaaaactagcattcagtttttatgtggagataaagcctttagtggaaccaacaaaaaaaattatgaatgtccacattaccatttaccagtggcatgaatttttcccccatgcaagcagcaacgttggtgttgttatcgctctttgggctccagttatccttgtttatttcatggatgctcagatatggtatgccatattctccacaatattcggtggtatttatggagcatttcgcaggcttggagagattcgaactttaggcatgctgaggtccaggttccagtctttgcctggtgcttttaatgcttgtttgataccagaggagaagagtgagcaacctaaaaagaaaggactaaaagcaacattctcacgaaattttgccagggtgccatccaacaaggaaaaggaagctgcaaggtttgctcaattgtggaacaaaataatcacaagttttagagaggaagatcttattagcaatcgtgagatggatcttttgcttgttccttactgggctgatcgtgagttggatctcgtgcaatggccaccatttttgcttgctagcaagattccaatagcagtggatatggctaaggatagcaacggaaaggaccgtgagctgaaaaagaggattgaggctgacccatatatgtcatctgctgtttgtgagtgctatgcttcatttcgcaatgtgataaaagttttggtttcaggtcgtcgtgagaaggaggttatagagtatatcttctcagaagttgacaagcatattgaggctggtaatttaattagtgagtacaagatgagtgctcttcccagtctctatgatctgtttgttaagctcataaaattcttggtaagttttcaaagtccactggaaaataggcaggaggacagggatcaagttgtacttctattccaagacatgctagaagttgttacgcgagatataatgatggaagatcaactatcaaggtttttctttggcctataatcgttaatcatgcagattccatccatggagccccagggtatgaaggaatgatccctcttgatcagcaatatcagttatttgcttctgctggagctatcaaattcccccctcctgaatcagaagcttggaaagagaagatcaaaagattgtatttgctgcttacagtaaaggagtctgcaatggatgtaccatccaacttagaagctaggaggcgaatatccttcttctccaattcattgttcatggacatgcccacagcaccaaaagtccgcaatatgctttctttctctgtcttgaccccatattacacggaggaggtgcttttctcatcagatgatttggataaacaaaatgaagatggtgtttccattctgttctatttgcagaaaatttatccaggtttgtttgttaaccttggatttcaagatgtctatgaatggaacaatttccttgagcgtgcggactgtacaagtgaagacgaccttaggtttaaatggtcttctgagttagaagaaaacctccgtcattgggcttcatatagaggacagactttaacaaggactgtgagaggaatgatgtattaccgcagagctctagagcttcaagctttccttgatatggcccaggatgatgatttgatggaggggtataaggctatcgaattaaatgaggatcagatgaagggagaacggtctctatgggcacaatgtcaagcagttgctgatatgaaatttacatatgttgtttcatgccagctatatggtattcacaagcgatctggtgatcaacgtgcacaagatattctgcggcttatgacaacgtacccatctatgcgtgttgcttatattgatgaaattgaagaaccaagcaaagataggtccaagaaagttaatccaaaggcctactattccactcttgtcaaagctgccctgccaaattcacattctactgagcctggtcaaaacttggatcaggttatctaccgcataaaacttcctggtcctgctatcttgggtgagggaaagcctgaaaaccagaatcatgctattatattcactcgtggagaggggctgcagactatagatatgaatcaggataactacatggaggaagccttaaaagtgaggaatttgctccaagaatttctgaagaaacatgatggtgtgaggttccctactatactcgggctgagagagcacatatttactggaagtgtttcttctctcgcttggtttatgtcaaatcaagagacaagttttgtgacaataggccagagactgttggcaaaccctctgaaggttcgattccattatggccaccctgatatttttgacagacttttccaccttacaaggggtgggattagcaaagcttctaagattatcaacttaagtgaggacatatttgctggctttaattctacacttcgtgaaggcaatgttactcaccatgaatacattcaagttggtaaagggagggatgtgggacttaatcaaatatctctatttgaggccaaaatagcaaatggcaatggagaacagaccctgagtcgggatttatacaggcttggacatcgttttgattatttcagaatgttatcatgttatttcactaccattggtttctatttcagtaccttgattacagtcctcaccgtgtatgtgtttctctatggtcgcctttaccttgtccttagtggacttgaggaagggcttagcaatgaaccagctataaaagacaacaagcctcttcaagtggctcttgcttctcagtcgtttgtgcaaattgggtttttgatggccctccctatgatgatggagattgggttggagaagggattccgcacagcactcagtgaatttatactgatgcaactgcagttggcgcctgtattcttcacgttttcacttggtactaagacccattattatggaagaacattactccatggaggtgcaaagtataggcctactggtcgtggttttgtggtctttcatgcgaagtttgctgataactatcgcttctactcccgtagccactttgtcaagggacttgagctaatgatattattactcgtgtatcaaatttttggtcaggaatacagaggagctgttgcatatatcttaatcactgtctcaatgtggttcatggtgggaacctggctctttgctcccttcctcttcaacccctctggttttgaatggcaaaagatagttgatgattggactgattggaataagtggataagtaacagaggaggtattggtgtcccccctgagaaaagttgggaatcatggtgggaggaggaacaagagcatcttaggcattctggaatacgcggtattgttgctgaaattctgttgtctttgcgcttctttatctatcagtatgggctcgtctatcacttgaagatcactttgaaaaatcagagttttctggtttatggtgcatcatggttagtaataattctggtactatttgtcatgaagacaatatctgttggtcgacgaaaattcagcgccaatctccaactcgtgttccgtcttataaagggattgatattcttagcatttgtcgcaaccctggtgattctgatgacactgctccaaatgactcctaaagacatggttgtgtgtattctcgctttcttgccaactggctggggcatgcttctgattgctcaagcattgaagcctgttgttcggagagctggattctggggatcagttcgaactctagctcgtggctatgagattgtgatgggattgcttctgttcacaccggttgcttttctggcttggtttccatttgtatccgagtttcaaacccgtatgctgttcaaccaagcattcagtagaggtcttcagatttctcgtattcttggtggtcaacgcaaagatcgttcctctcgaaacaaagactagaattttttacatgaatagggctacattattaacattcatccttctatgtttgtaattgttgttcattcacattgtaagctgctgcctttgtaattatctagtggtaatagcagcatttttgggcaatatcatatccctttttttgtaaaagccattgaaaaattccttaatggaatctctctcttacatttgtttca

SEQ ID NO: 8785 - DNA, 5875 bp, Valeriana officinalis
tgtcgattttattgctttgtagaaagactcatcgtttggtacccgtacttcgagtggacgtggtgttcgttcaatttaaaaccgtactctgcttcaacgtactggaaagggaaaagtagatccaacgttgatgggaagagttaaaaaaagtgatgcacgcgagatgcagagtttttatcagcattactacaaaaagtatattcaagctttgcaaaatgctgcagataaagctgatcgagcacagcttactaaagcatatcaaactgctaatgttctgtttgaggttttgaaagccgttaatcaaacacaagctatggaagtcgatcgtgagattttggaagctcatgataaagttgctgaaaaaactgaaatttatgctccttacaatatcctgccacttgatccagacagtgcaaaccaagcgattatgagatatcctgagattcaagctgctgtttatgctcttcgcaacactaggggtcttccatggcctaaggactacaagaagaaaaggatgaagatgttttagactggcttcaatcaatgtttggctttcagaaagataatgtggcgaaccaaagggagcacctcatattgttgcttgcaaatgttcatattcgtcaatttcccaagcctgatcaacaaccaaagttggatgagcgtgcattgaatgaagtgatgaagaaacttttcaagaactacaaaaaatggtgcaagtatttggaccgtaaaagtagtctgtggatgccaacgatacagcaagaagttcagcaaagaaagttgttgtacatgggtctctatcttcttatttggggagaagctgcaaatttaagattcatgcctgaatgcctttgctatatttatcatcatatggcatttgaactctatggtatgcttgctggaaatgttagtccgatgactggtgaaaatgttaaaccagcctatggaggagaagaagaggcttttttgaggaaagttgttactccgatatacgaagtaattgcaaaggaatcaacaaagggtaaaatagggagatcaaagcattcacaatggagaaactacgatgatttgaatgaatttttttggtcagttgattgttttcggttagggtggcctatgcgtgctgatgctgattttttttgtctccctgttgaacaacttcattctgagaatctgcagacgacaaaccacctaataaacatcgatgggttgggaaggttaactttgttgagatacgatcatattggcatatcttcaggagctttgacaggatgtgggttttcttgatattgtgcttacaggctatgataattgtggcttggaatggctctggaacacctggttcaatctttagaggtgatgtattcaagaaagttctaagtgtttttatcactgctgcagtattgaagcttggacaagctatgcttgatgtagtctttaattggaaagcaaggcatagcatgtcattccatgtcaagctaagatatattatgaaagttgtgtgtgctgctgcatgggttgtagttttgccggttacatacgcatatacatgggaacatcctcctggttttgctcaaactattaggagatggttcggcaatgactcaaactctccagcactgttcattttggccgttgttatttatttatcaccaaatatgcttgctgggttgctgttcctgttcccttttattcgtcgattcctagagagatcgaattacagggttgtaatgcttatgatgtggtgggcacagccacgactctatgttggaaggggaatgcatgagagcacattttctcttttcaaatacaccatgttttggattcttcttttaatgacaaagttggcattcagctactacatagagataaagcctcttatgggcccgaccaaggctataatgagtgtgcacatttcaacctatcaatggcatgaattttttccacgggcaaagaacaatatcggtgtagttattgcactctgggctccgattattcttgtatattttatggatactcaaatctggtatgcaatattctccacattatttggaggtatctatggggcatttcgacgacttggggagattcggactttgggaatgctgcgatcgcgctttcaatcattgcctgctgcttttaacgcgtgtttaatccccgaagagaaaagtgagctcccaaaaaagaaaggactcaaggcaacatttactcgcaactttgctgagatcccatctaataaagagaaagaagctgcaagatttgcgcaattatggaacaagataattactagttttagagaggaagatctaatcaataacagggaaatgaacctgttgcttgttccatactgggctgatagagaaatggacctcatacaatggcctccatttttgcttgctagcatgattccaatagcactagacatggctaaggacagcagtggaaaagatcgcgagctgaaaaagagaatcgaggctgataattatatgtcatgtgctgttcgtgagtgttatgcttcatttcgaaatattatcaaggttttggttcgaggtgaacatagaaaaaaatgttatagaagacatttttactgaagttgacaaacatatagaagatggtgatctcacacgtgaattcagaatgagtgctcttcctagtctctacgaccatttcgtcaagcttattaaatacttgttagataataaaccggaagacagggatcaggtcgtaattcttttccaggacatgttagaagttgttactagagatataatggaggaccatatccctagtttggatattaatggtgggttggggtatgagggaatgatcccacttgaacaacaatatcagttatttgcatctgccggagctatcatattccctgctccagaatcagaagcttggaaagagaagataaataggttatatttgttacttactgttaaagaatcagccatggatgtgccgtcaaacttggaagcaagaagacgcatttcatttttctcaaattcgttatttatggaaatgccttcggctcctaaagttcgaaacatgctgtctttctctgttttgacaccttattacactgaagaggttttgttctcattggatgacttggaagttgaaaatgaagatggcgtttctatcctcttttacttgcagaaaatctttccagatgaatggaacaattttctcgagagaatggactgtaagagtgaagaagaattaaaagacccagaaaagctcgaagagttgcgcctttgggcatcatttagaggacagactttaactaaaactgtgagaggcatgatgtactaccgaaaagccttggaacttcaagcgttcctagatatggccaaagatgaagatctaatggaaggctacaaggcaattgaattaaatgagaatcagatgaaggaagaaagatcattgtgggcccagtgtcaagcagtagctgatatgaaattcacatacgtcgtatcatgtcagaaatacggcattcacaaaagatctggcgatcatcgtgctcaagatatcttaaaacttatggcagcgtacccatctatgcgtgtagcttacattgatgaggtggaagaaccttccaaagataggaaaaatatgaataagaaagtttattattctgcattagtcaaagcggccatgccaaagtcaaatacttcagagcctgggcaaaatttggatcaggtaatttatcgtataaaacttcctggaccagcaatcttgggtgagggaaagcccgaaaatcagaaccatgctatcatttttactcgtggagaaggcttgcaaacaattgatatgaatcaggataactacatggaagaagcattgaaaatgaggaacttgcttcaagaatttcttacgaaacatgacggtgtgagatacccatctatacttggacttagagaacatatatttacaggaagtgtgtcttctcttgcttggttcatgtcaaatcaagaaacaagttttgtaactattggccagagattgttggcaaacccattgagggttcggtttcactacgggcatccagatgtttttgataggctatttcaccttacaagaggaggtgtcagcaaagcctcgaagattattaacttaagtgaagacatctttgctggctttaattctacactaagagaggggaatgttactcatcatgaatatatacaagtgggtaaaggaagagatgtgggacttaatcaaatttctttatttgaagctaaaatagcaaatggcaatggagagcaaacactgagtcgagatctttatagacttggtcatcgctttgactttttccgaatgttgtcttgttatttcactaccattggcttctacttcagtaccttgataactgttttgaccgtgtatgtatttctctatggccggctctatctcgtccttagtggacttgaaaagggtctaagtacctcgcccgcaattcgtgacaataagccacttcaagtagcacttgcatctcaatcatttgtccagatagggtttctaatggcattgcctatgatgatggaaattggattagaacggggtttcagaactgcattaagtgattttatactaatgcaattgcaactagcaccggtatttttcacattttcactcggaacaaaaacccactattacggccggactttgcttcatggtggtgcgaaataccgagccactggtcgagggtttgtcgtctttcatgccaaatttgctgaaaattatcggttatattctcgaagccattttgtgaaaggaatggagctgatgattctacttctagtataccagatattcggtcaatcttatagaggagtagtggcttacgtattaattactgtatctatatggtttatggttggcacttggctttttgccccgtttcttttcaatccgtctggatttgagtggcagaaaatcgttgatgattggacggattggaataagtggattagtaatagaggtggaatcggtgtgccgtcggaaaaaagttgggaatcgtggtgggaagaagaacaagaacatcttcgtcattcgggaaaacgtggaatcattgctgagattttgttggctttgcggtttttcatctaccaatatggccttgtttatcacttgaagtttaccgaaaatcacaagagctttttggtgtatggcatatcttggctggtgattattctgatactgtttgtgatgaagacgatttcagtcgggcgaaaaaagttcagtgcgaattttcagctaatgttccggctgataaaagggatgatatttattgcattcgtctcaattctggtaatattgatcgcccttcctcatatgacggttaaagacatcatagtctgtattcttgccttcttgcctaccggttggggtattcttctgatagcacaagcattgaagccagcggttcacaaggcccagttctggggatcagtaaagactttagcaagaggatacgaagtactaatgggactccttttattcacgccggttgcttttcttgcttggttcccatttgtctccgaattccaaactcgaatgttattcaaccaagctttcagtcgtggacttcaaatttctcgtattcttggtggtcacaaaaaggaccgatcagccagaaacaaggaatgagtgaatgattagtactaattaatctattattactattatcactgctaaaacttaagtaatcaactctaattatttttattattaacattattattgtggaagagattttaggtatgatgattttgtaaagcatgtacttgccaccactgtaattattagtattgttgttatgtagggtggttgtgaactatttactagtactagcatgtgtatcattatc

SEQ ID NO: 8786 - DNA, 6127 bp, Aquilegia formosa
gggtttttgtgtttgttaagatgtcttctagaagacctggaggcgaaccgcctccgcagaggcggattatgagaactcaaactgctggaaatctgggtgaaaccatctttgatagtgaagttgtaccatcttctcttgttgaaattgctccaattcttcgagttgctaatgaagttgaatctagtaaccctagagttgcttatttatgtcgattctacgccttcgagaaagcacacaggttggaccctacatctagtgggacgaggtggttcgccaaattcaagactgcacttctgcaacggtctggaaagggcttgtgcgtgtgtgtgagaataaaaatcttatctaagcttctcactttttttcattatgagaatgacccaacattaatgggcagagtaaagaagagtgatgctcgggaaatgcagagtttttatcaacattattataaaaaatatatccaagcgttacagaatgctgcagataaagctgaccgtgcacaacttaccaaagcctatcaaacggctgctgtcctttttgaggttttgaaagctgtcaatctgacacaatctcttgaagttgatcgtgaggttttggaaactcataacaaagttgctgaaaagaccgaggtctatgtgccatacaacattcttcctctagaccctgatactgttgtggttgcgcttcgtaataccaggggtcttccatggccaacagggtataaaaagaaaccagatgaagatatccttgattggctgcaggctatgtttggatttcagaaagatagtgtggccaaccaaagggaacatttgattttacttcttgcgaatgtgcacatacgacaattcccaaagcctgaccaacaacccaagctggatgagagggccctgactgaagtcatgaaaaagcttttcaaaaattacaagaagtggtgcaagtatttggatcgaaagagtagtctttggttgccaactatacaacaggaggtgcagcagcgcaaattactttacatgggtctatatcttctcatttggggggaagctgcaaacttaagattcatgcctgagtgcctgtgctatatctatcatcatatggcgttcgaactttatggtatgctagctggcaatgtcagtcccatgactggtgaaaatgtgaagccagcctatgggggcgaggaagaggctttcttgagaaaagttataactccaatttatgaaacaatagccaaggaagctgaaaggagcaaaagaggcaaatccaaacattcccagtggaggaactacgatgatttgaacgagtacttttggtcggttgactgtttccggctaggatggcccatgcgtgctgactcggatttcttttgcgagccttcaagccagcttcgattggacaaaaatggggagagcaaaccagcggcaagggaccgatgggtgggaaaaattaattttgtggaaattcgctcattctggcatattttcagaagctttgatagaatgtggagttttttcatactgtgtttacaggcaatgataattattggttggaatggatccggacaaccaagtgctatctttgaggctgatgttatcaaaaaagtcttgagcatcttcatcactgcggcgatcttgaagcttggacaagctgtccttgatgtaatcctgagctggaaagctaggcggagcatgtcattccaagttaagctacgatatattctgaaggttgtttcagctgctgcgtgggtgattattttaccagtaacgtatgcgtatacttgggagaatcctcctggatttgcattaaagatcaggaaattgtttgggaacagtccaagttcacctacattatatatattggctgttgtcatatacctggcaccaaacatgcttgctggagtattgtttttgttccccttcattagacgatttttggagaagacagactataggattgtgatgtttatgatgtggtggtctcagcctcgactctatgtaggaaggggaatgcatgagagcgcgttttcccttttcaagtatactatgttctgggttcttcttataataacaaagttggcgttcagttattacattgagatcaagccgcttgtgggtccaacaaaaacaatcatgaaagctcacataacaaattaccaatggcatgaattctttccacgagcgaagaacaatcttggtgttgtgattgcactttgggctccaattattcttgtatatttcatggatatacagatatggtatgctattttttcaacactgtttggtggtatctacggggcattccgtcgtctaggagagattcgaacacttggaatgctgagatcccgatttcaatcattgccgggtgcttttaatgcgcgcttgattccagtggataagactgcagctaagaagaagaaagggctaaaggctacgttctctcgcaaatttgaggagattccttccaataaagagaaggaggcagcaaagtttgctcagttgtggaacagaataatcagcagtttcagagaggaagatttaataagtgacagggaaatggatttgttgcttgtcccatattgggccgatcgtgatttggatcttatccagtggcctccattcttgcttgctagcaagatccccattgcattagatatggccaaagacagcaatggtaaggaccgagagctgaagaagagaatcagtgcagacaactatatgcattgtgcagtgcgcgaatgttatgcgtcatttaggaacattataaatttcttagttgaaggagatcctgaaaaaactgttataaagcatatgtttgatgagattgacaaacatatagaagcagacagtctaataagtcagttgaagatgagtgccctgcctagcctttatgaacactttgttaagctcatcaaaattttgttggaaaacaagcaagaggacagggatcaggtggtaattcttttccaggacatgcttgaggttgtcactcgagatataatggaggacgaagaatctactatcttagattcaatccatgggggactgacgtatgagggaatgacgccccttgatcaacaagttcagttatttgcttcccctggagccatcaagttccctatagaagaaacagaagcgtggaaggagaagatcaaaaggctttttctgttgcttactgtgaaggagtcagcaatggatgtgccgtccaatttggaggctagaaggcgaatttcttttttctcaaattcattgtttatggagatgcctgcagcaccaaaagtccgcaacatgctttcattttccgtcttaaccccctactatacggaagacgttcttttctccatacatgagttagaagtacagaatgaagatggtgtttctattcttttttacttgcagaaaatatttccagatgaatggaccaactttcttgagcggatcgggtgtagcaatgaggaggaactcagaaaagctgatgcgctagaagaagagctccgtctctgggcatcttatagaggccagacgttgtctcgaactgtgaggggcatgatgtattaccggaaggctttggagctccaagcgtttcttgatatggcaaaggatgaagatcttatgaaaggctacaaggctgctgaatttactactgaggaacactcaaaagatgaaagatcattgtggacacagtgtcaggctgttgctgatatgaagttctcatatgttgtttcatgccagcaatatggggttcacaaacgatccggagatcctcgtgcccatgacattctgaagcttatgtcaacgtacccatctctccgtgttgcttatattgatgaggttgatgtgactgtcaaagataaatccaaaaagggtaatcagaagatctattattctgctcttgtgaaagctgctcccaagcccattaattcttcggaacctcaaccagtacagaatttagaccaggttatttatcgcataaagcttcctgggcctgctattttaggtgaagggaaaccagaaaatcaaaatcatgctatagtttttacacgtggtgaagggctgcaaacaattgatatgaaccaggataactacatggaagaagccttcaaaatgaggaacctgctggatgaatttcttaaaaaacacgacggcgtgcgctatccatcaattcttggacttcgggaacacatatttactggcagtgtttcttctcttgcctggtttatgtcaaatcaggagacaagttttgtaactattgggcagcgattgttggcaaatcctttgaaggtccggttccactatggtcatcccgatgtttttgataggttgtttcacttgacgagagggggtatcagcaaagcttctaaaattatcaatttaagcgaggacatttttgcaggtttcaattctacacttcgtgaaggaaatgttactcaccatgaatacatgcaagttggtaaagggagagatgtgggccttaatcagatttccttgtttgaagcaaaaatagctaatggaaatggcgagcagacattgagccgtgacatatacaggcttgggcatcgttttgatttcttcagaatgttatcatgttatttcaccacagttggtttctactttagcaccctggtgacagtgctcacagtgtacgtatttttgtatggtcgtctataccttgttctaagcggactagaagaaggattgagcacacaacctgcaattcgagacaataaacctctacaagttgctcttgcttctcagtcgatcgtgcagcttggatttcttatggccctgcctatgatgatggaaattggcttggagagaggattccgaactgctctgagtgaatttattctgatgcaattgcagctagcccctgtatttttcacattttctcttggcacaaaaacccattattatggaaggaccctgcttcatggtggtgcagaatatagagctacaggtcgtggatttgttgtgttccatgccaaattcgcagacaactataggttttattctcgcagtcactttgtgaaaggaattgagattatgattctacttgttgtgtaccagatctttggtcatacatatagaagtgccttggcatatgttttgatcactatatctatgtggtttatggtgggaacttggctttttgctcccttcctatttaatccttctggatttgaatggcaaaagattgtggatgactggactgactggaacaagtggataagcaatcgaggagggattggtgtcctccctgagaaaagttgggagtcgtggtgggagaaagagcaggaacatcttcgtcattctggaaaacgtggtattattgctgagatagtgttagctctgcgattttttatctatcagtatggactagtttatcacttgaatttgacaaaaaacaccaaaagtgtattggtttatggtgcctcgtggcttgtgattgctgttattttgcttgtaatgaagacggtttctgttggacgacgaaaattcagtgctgactttcagcttgtgtttcgattaatcaaggggcttattttcttgacatttattggtattcttatcactttggtggcagttccgcacatgactcctcaagatattgtagtatgtgttcttgcattcatgcctagtggttggggtcttcttttgattgcacaagcgtgtaaacctgttgtccagcgggctggcttttggggatcagttcgaacactggctcgtggctatgaagttatcatgggtttgcttttgttcacgccggttgcatttctggcctggttcccttttgtttccgaattccaaactcgcatgctctttaaccaagcatttagtcgaggtttacagatctcacgtattcttggagggcagaaaaaagagcggtcagctagcaacaaagagtagatctcctgaaacacttttaacatttatgctggatgacaactgttcagttagcagtatctcttgttcagaaattattgtagttagaaactgccgaaagttgacaaatttaaaaagggatcaggcaatcagcaatctggttgagtcatcagttttaaaattgtggtgtactcatgtactgtatatatacatctcatctcgtgtgacttttgtcaccattgagtttagtaaaa

SEQ ID NO: 8787 - DNA, 6355 bp, Arabidopsis lyrata
ctttgcgtacttagcagctaagtagcttaaaagttgtggctccgccattgttagggtttctggatctccatctctctgaggcttaggaaaccttaaaaaaaaaacgattaacctggaggaggttttagggtacaaggaatgtctgctacgagaggaggtcctgaacaaggaccgtctcagcctcagcagcggcggatcgtacgaactcagactgctggtaatctaggagagtctttcgatagtgaagttgttccttcatcgcttgttgagattgctcccattcttcgtgttgctaatgaggttgaatctagtaaccctagggttgcttatctctgtcggttttatgcatttgagaaagctcatagattggatcctacctccagtggaagaggtgttcggcagtttaagactgcacttctacagcgtcttgaaagagaacatgatccaacactgatgggcagggttaagaaaagtgacgcccgtgaaatgcaaagcttttatcaacattactataagaagtatattcaagctttgcacaatgctgcagataaggctgaccgtgcccagctgacaaaggcataccaaactgccaatgttttgtttgaggtgttgaaggctgttaatctcacacagtcgattgaggttgaccgggagattctggaagctcaagataaggttgcagaaaagacacagttgtatgtcccctataatatcctacctctcgatcctgatagtgcaaatcaagcgattatgagatatcctgagatccaagctgctgttcttgctctccgcaatactagaggtcttccttggccagaaggtcacaagaaaaagaaagatgaggacatgcttgattggcttcaagaaatgtttggatttcagaaagacaatgtggctaatcaaagggagcatctgatcttattacttgctaatgtgcatataagacaatttcctaagcctgatcagcagccaaagtttatccttttgtctgttctcattatgacaacccattgtgctctcacagttagatgatcaagcattgacagaagtgatgaagaagcttttcaagaactataagaagtggtgcaaataccttggtcgaaagagtagtctttggttgccaactatacagcaagaaatgcaacagcgcaaactattgtatatggccctgtatcttctaatttggggtgaagcagcgaacttgagattcatgcctgagtgtctctgctacatttatcatcatatggcatttgaactctatggtatgctggctgggaatgttagtcctatgactggggaaaatgtgaagcctgcttatggaggcgaggaagatgcattcttgaggaaagttgtgactcctatttatgaagtgattcagatggaggctcaaagaagcaaaaaagggaagtctaagcactctcagtggaggaactacgatgatttgaatgaatacttttggtcagttgattgttttcgattaggttggccaatgcgagctgatgctgatttcttttgtctgcctgttgctgtacccaatacagaaaaggacggggataacagcaagcctactgtcgccagggatagatgggttggaaaagttaattttgttgagattcgttccttctggcatgtcttcagaagtttcgatcgaatgtggagcttctatattctgtgccttcaggccatgattattatggcctgggatggcggacaaccaagttcagtctttggagctgatgtattcaagaaagttctgagcgtgtttatcacagctgcaataatgaagcttggacaagctgttcttgatgtgatccttaatttcaaagctcatcaaagcatgacactacatgttaaactaagatacattctgaaagtgttatctgctgctgcctgggttattattctgcctgttacttacgcctacagctggaaagatcctccagcatttgccagaactatcaagagttggtttgggaatgccatgcactcaccttcactatttataatagctgtcgttttctatttgtcgcctaacatgctcgcggaaactaatgaaaaacacccgatgtgtttttttgctgatgcgaccataattagttatattttttacaccttgcagcccagactctatgttggtagaggaatgcacgagagcgcattttccctcttcaaatataccatgttttgggtgttgcttattgcaacaaagctggcattcagttactacattgagatcaagcctttagttgccccaacacaagccattatgaaggcccgtgtgacaaattttcagtggcatgagttctttcctcgtgccaaaaacaatattggtgttgttatcgccctctgggcccccattattctggtatattttatggatagtcagatttggtatgctatattttccacattatttggaggtatttacggtgcattccgccgccttggagagattcgtacactgggaatgcttagatcacggtttgaatcactgcctggagcttttaatgaccgcttaattccagatggaaagaaccagcaaaagaagaagggaataagggcaactttatctcataactttacggaggataaggtacctgtgaacaaagagaaagaggctgcaagatttgcacagttgtggaacacaataatcagtagttttagagaggaagatcttataagtgatagggagatggatctgttgcttgttccatattgggctgaccgtgatttggatctcatacagtggcctcccttcttattggctagcaagattccaatagcattagacatggcaaaagacagtaatgggaaagacagagagctcaagaagaggattgagagtgacacttacatgaaatgtgctgtccgtgaatgctatgcttcattcaagaatatcataaaatttgtggttcagggaaaccgtgaaaaagaggtgatagagatcatatttgccgaggtggacaaacatatagatacaggggatttgattcaagaatacaagatgagtgctcttcctagcctctatgatcactttgtcaagttgatcaaatatttggtaaatgttcttcttgtgctagacaataaggaggaagatagagatcacgttgtaattctcttccaagacatgctggaagttgtaacaagagacattatgatggaggattacaatatatcaaggttggcaactttctaccgcaatgtcttgccatatgaacatcaaaatctcatatatctagttgtctctgtagcttggtagattcgagtcatggtggcacttggcatgggggaatgatccctctcgaacaacaatatcagctgtttgcatcctcaggtgccattagatttcctattgaaccagtaacagaagcttggaaagagaagatcaaacggatatatcttttgttgactactaaagagtctgctatggatgtcccctctaacttggaagcaagaaggcggatctctttcttctcaaattcgttgttcatggacatgcctatggcacctaaagttcgcaacatgctatcgttttctgttttgactccatattacactgaagaggtcctcttctccttgagggatctggaaacaccaaatgaagatggtgtttcgatcctcttttacttacaaaagatttttccaggtgatttttgttcatatgctgttaacgttgtagcctaaattctcgaatcacttcttgaacctgaccattgatctctagatgaatggaacaattttcttgagcgggtgaagtgcttaagcgaagaggaacttaaggagtctgatgaattagaggaggaacttcgtttatgggcttcatatagagggcaaactttgactagaactgtaagaggaatgatgtactatcgaaaagcattggaacttcaggcattccttgacatggctatgcatgaagatttgatggaaggttacaaggctgtagaactaaattcagagaacaattcaagaggtgaaagatcactctgggcacagtgccaagccgttgctgacatgaagtttacatatgttgtatcatgtcaacaatatggtatccataaacgatccggtgatcctcgtgctcaggatatattgaggcttatgacaagatacccttcgctccgtgttgcatatattgatgaggtcgaagaaccagtgaaagacaagtcaaagaaagggaaccagaaagtgtattattctgtgttggtaaaggtgcctaagtcaactgatcattctagcttagcacaaaatctggaccaggttatctataggattaggcttcctggacctgctattcttggagaaggaaagccagaaaaccaaaatcatgctatcatcttttctcgtggagaaggtttacagacaatcgatatgaatcaggataattacatggaagaagcgttaaagatgaggaatttgcttcaagaatttcttacaaagcatgatggtgttaggcatccatccattcttggacttagggaacatatatttactggatctgtttcctcccttgcttggttcatgtcaaatcaagagactagttttgttaccattggtcagagattattggcaaacccattgagggttcgtttccattatggtcatccagatgtgtttgatagactgtttcatctaacaagaggtggtgttagcaaagcatccaaggtaatcaacctcagtgaagatatatttgcaggtttcaattctacacttcgtgagggaaatgttacccatcatgaatacatacaagttggtaaaggaagagatgtcggtctaaatcagatatctatgtttgaggccaagattgctaacggcaatggagagcagacattaagtcgggatatttacaggcttggacaccgttttgactttttccgaatgatgtcatgttacttcaccactgtcggcttttacttcagcaccttgattactgttctcactgtctatatcttcctttatggacgtctctatcttgttttgagtggcctcgaacaaggcttaagtacacagaaaggcatccgagacaatacacctttgcaaatagctctggcttcacagtcttttgtccagattggtttcctgatggctttacctatgcttatggaaattggattagagaggggttttaggactgccttgagtgaatttgtgctgatgcagcttcagttggcgccagtgttctttacgttctctcttgggacaaagactcactactatgggaggacgttacttcatggcggtgccaagtacaggtccacaggaagaggatttgtcgtctttcatgccaaatttgctgataattacagactgtattcccggagccattttgtaaaggggcttgagatgatgctgctacttgttgtgtatcaaattttcggaagtgcttacagaggcgtccttgcatatcttttgatcaccatatctatgtggttcatggtcgggacttggctttttgctcccttcctcttcaatccttctggttttgagtggcagaaaattgttgatgattggactgattggaataaatggataaacaacatcgggggtattggtgttccggcagaaaaaagttgggaatcctggtgggaggaagagcaagaacatctccgatattccggaaaacgtggtatagttgttgagattttgctggcactgcggttctttatctatcaatatgggcttgtttatcatctcacgataacagagaggactaaaaactttctggtttatggagtatcatggctggtgattttcttgatattgtttgtgatgaagactgtttcggttggaaggcggagattcagcgcgagttttcagctgatgttccggttgataaaggggctaatattcatgacgtttatcgcaatcattgtgatattgatcacactggctcacatgacgatacaagacataattgtgtgtatccttgcctttatgcccacaggttgggggatgctcttgattgcgcaagcgtgtaagccggtggttcatagagcaggattctggggatcagtgaggacactagctcgtggatacgagatagtaatgggactgttgctgtttacgccagtggcgttcttggcatggtttccatttgtgtcggagttccaaacgcgtatgctctttaatcaagctttcagtagaggtcttcagatctctcgtatcctcggaggacacaggaaggatcgctcttctcgtaacaaggaatgattcatctcttcattgtaatgacagggatgtctaatttatccctttttatcttatggattgattagtgttaatgtaatttagttttcaacatgtcgcttaggtaaaaacattgtagtagtcttccttaaattagacgtaatctatc

SEQ ID NO: 8788 - DNA, 6081 bp, Nicotiana benthamiana
tgtaggtcggttttatgcttttgagaaagctcatcggttagatcccacttctagtggacgtggtgttcggcaatttaaaacgtccctcctgcagcggcttgaaagggaaaatgatccaaccttgattggaagggttaaaaaaagtgatgcacgtgaaatgcagagcttttaccagcattactacaaaaagtacattcaagctttgcaaaatgctgctgagaaagcagaccgtgcacaacttactaaggcataccaaactgcaaacgtactctttgaggttttgaaagcagttaaccagacgcaagcggtagaagtcgaccgtgagattttggaagctcatgataaagttgctgagaagacacagattttagtcccctataatattcttcctttggatcctgatagtgtaaatcaggcaattatgagatttcctgagattcaggctgctgtttacgctctcagaaacacaagaggtcttccatggcccaaggattacaagaagaagaaagatgaagatattcttgattggcttcaagcaatgtttgggtttcagaaagataatgttgcaaatcagagggagcatctcattttgctacttgcaaatgtacacattcgccagtatccaaagcctgaccagcaacccaagttggatgagcgtgctttgaatgaagccatgaagaagcttttcaaaaactacaagaaatggtgcaaatatttggacaggaaaagcagtttatggttgccaaccatacaacaggaagtacagcagcgtaaattattatatatgggattgtatcttctcatatggggggaagctgcaaatttaagattcatgccagaatgcctatgctacatttaccatcacatggcatttgaactctatggcatgctagctggcaatgttagtcccatgaccggtgaaaatgttaagccagcttatggaggagaagaggaggctttcttgagaaaagttgttactcctatttatgaagtgattgcacgggaagctgctaggagcagaagaggaaaagcaaagcattcccagtggaggaactatgatgatttgaatgaatacttttggtcagtggactgcttcaggttaggttggcccatgcgcgctgatgctgatttcttttgcctccctgtggaagaacttcgtgctgagagaaatggggaaaacaagccttctagagatcgctgggtggggaaagttaatttcgttgagatacgatcatatttgcatatctttaggagctttgacagaatgtggagcttcttcatattgtgcttgcaggcaatgataattattgcttggaatggttcaggagagctgagcatggttttcacttcagatgttttcaagaaagtattgagtgtgtttataacagctgcagttttgaagcttgggcaagccgctcttgatgtggttcttaattggaaagctaggcacagcatgtcattctatgttaaactacgatacatattgaaggtcatatccgcagctgcttgggtggtcattttacctgttacatatgcttatacatgggaaaatcctccttcatttgcccaaaccattaaaaattggtttggtaacaactcaaattctccttcactgtttatactggctgtggtaatctacttgtcgcccaatatgcttgctgctctgctctttctttttcccttcgtccgtcgattcctagagagatcacactacaaaattgtgatgctgatgataaatcttatacggcttttattgtcaattgcagcctcggctttatgttggtaggggaatgcatgagagcactttttctttgttcaaatacactatgttctgggtacttttaattgcgacaaaactagcattcagtttctatgtagagataaagcctttagtggatccaacaaaaaagattatggatgtccacattaccacttatcagtggcatgagttttttccccacgcaagcagcaacattggtgttgttattgctctttgggctccagttatccttgtttacttcatggatgctcagatatggtatgccatattctccacactattcggtggtatttatggagcatttcgtaggcttggagagattcgaaccttaggaatgctgaggtccaggttccagtctttgccaagtgcttttaatgcctgtttgataccggaggaaaagggcgaccaaccaaaaaagaaaggactaaaagcaacattttcccgaaagttcaacagggtgccatccaacaaggaaaaggaagctgcaaggtttgctcaattgtggaataaaataataacaagttttagggaggaagatcttattagcaatcgtgagatggaccttttgcttgttccttactgggctgatcgtgagttggatctcgtgcagtggccgccatttttgcttgctagcaagattccaatagcagtggatatggctaaggatagcaatggaaaggaccgtgagctgaaaaagaggatagaggccgacccttatatgtcatctgctgtttgtgagtgctatgcttcatttcgcaatgtgataaaagttttggtttctggtcatcgtgagaaggaggttatagagtatatcttttcagaagttgacaagcatattgaggctggtgacttaactagtgaactcaagatgagtgctcttcccagtctatatgagctgtttgttaagcttatcaagtacttgctagacaataggcaggaggacagggatcaagttgtacttctattccaggacatgttagaagttgttacgcgagatataatgatggaagatcatgtatcaaggtttttctcttgcctataattgttaatcttccacattccatccatggagtctcaggatatgaaggaatggttcctcttgataagcaatatcagttatttgcttcagctggagctatcaaatttcctactcctgaatcagaagcttggaaagagaaaatcaaaaggttgtacttgctgcttacagtaaaggagtcggcaatggatgtaccgtccaacttagaagctaggaggcgtatatcctttttctccaattcattgttcatggaaatgcccaccgcaccaaaagtccgaaacatgctttctttctctgtcttgaccccatactacacggaagaggtccttttctcatcagatgatttggatagagaaaatgaagatggcgtttccattctgttctatttacagaaaatttatccaggtttgcttgttgacttcatttatttagttttttatgaatggctcaatttcattgagcgtgtggattgtaccagtgaagacgacctcaggtttaaatggtctcctgatttagaagaaaaactccgccattgggcttcatatagggggcagactttaacaaggacagtgagagggatgatgtattaccgcagagctctggaacttcaatctttccttgatatggcccaggatgatgatttgttggaggggtacaaggctattgagttaaacgaggatcagatgaagggagagaggtctctttgggcacaatgtcaagcagtggctgatatgaaattcacatatgttgtctcatgccagctatatggtatacacaagcgatctggtgatcaacgtgcacaagatattctccggcttatgacaacgtacccatccatgcgtgttgcttatattgatgaaattgaagaaccaagcaaagataggtccaagaaagttaatccaaaggtctactattccacccttgccaaagctgccatttcaaattcttccgagcctggtcaaaacttggatcaggatatctaccgtataaaacttccaggccctgctatcttgggtgagggaaagcctgaaaaccagaatcatgctattatcttcactcgtggagaagggctgcaaaccatagatatgaatcaggataactacatggaggaagccttaaaaatgaggaatttgcttcaagagtttcttaagaaacacgatggtgtgaggttccctagtatactggggctgagggagcacatatttactggaagtgtttcttctctcgcgtggtttatgtcaaatcaagagacaagttttgtgacaattggtcagagacttttggctaaccctctgaaggttcgattccattatgggcacccagatatttttgacagattgttccaccttacaaggggtggagtcagcaaagcttctaagattatcaacttaagtgaggacatatttgctggctttaattctacactacgtgaaggcaatgttactcaccatgagtacattcaagttggtaaaggaagggacgtgggacttaatcagatatctctatttgaggccaaaatagccaatggcaatggagaacagaccctgagtcgggatttatacaggcttggacatcgttttgactttttcagaatgttatcgtgttatttcactaccattggtttctatttcagtaccttgattactgtcctcactgtatatgtgttcctctacggccgcctttaccttgtccttagtggacttgaggaagggctgagtaagcaaccatctgtcaagaacaacaaagctcttcaagtggctctagcttctcagtcttttgtgcaaattgggtttttgatggccctccctatgatgatggagattggcttggaaaagggattccgcacagcactcagtgaatttgtactgatgcaactgcagttggcaccagtattcttcacattttcacttggaacgaagacccattattatggaagaacattgctccatggaggtgcaaaatataggcctactggtcgtggttttgtggtctttcatgcgaagtttgctgataactatcgcttctactcccgtagccactttgtcaagggacttgagctaatgatactattgctcgtttatcaaatttttgggcaaggttatagaggagctgttgcatatgtcttgatcactgtatctatgtggttcatggtgggaacctggctctttgctccgttcctcttcaatccctctggttttgaatggcaaaagatagttgatgattggactgattggaataagtggatgagcaacagaggaggtattggtgtccccccagagaaaagttgggaatcatggtgggaggaggaacaagagcatcttaggcattctggaatacgcggtattgttgctgaaattctgttgtctttgcgcttctttatctatcagtatgggcttgtctatcacttgaagatcacagtgacaaatcagagttttctggtttacggtgcttcatggttagtaatatttctggtactttttgtgatgaagacaatatctgttggtcgacgaaaattcagtgcgaatctccaactcgtgttccgtattataaagggattgatattcttaacatttgttgcgacactggtgattctgatgacgctgctccatatgactcctaaagacatggtggtgtgtgttcttgctttcttgccaactggctggggcatgcttctgattgctcaagcattgaagcctgttgttcgaagagctggattctggggatcagtacggactctagctcgtggatatgagattttaatgggattgcttctgttcactccagttgctttcttggcatggtttccatttgtgtccgagttccaaactcgtatgttgttcaaccaagcattcagtagaggtcttcagatttctcgtattcttggtggtcaacgcaaagatcggtctaggaacaaggactagaattacagacatgaacaactacatttacattaatccttcaatcttgtgactgttcattcccattgtaagctgcctttgtaattatgtagtgttaatggcagcactttttgacaatccaaaatccattttgtaaaagccattcgaaaattacttggtggaacttttctatatttttttgaaaaagccatgatctctactggattgttcatttggattggatatccaaatcgatctgctcaatttcggatattcggatcggatttcggattggtataattttattacgacctgaaatccgaaattattagggcatgtataaatactaaacattaattttggatagc

SEQ ID NO: 8789 - DNA, 2304 bp, Phaseolus vulgaris
gtagcaagtaaggtgaagaaaatgtggaggctgaagataggagatggagggaagaatccatacatatttagcacaaacaattttgtaggaagacaaatttgggagtttgattctgaagcaggaactgatgaagaacgagcccaagtggaagcagctcgtcaagatttctatcaaaatcgctttaagctcaaggcttgtggtgatcgactatggcgttttcagattttgagggaaaagaagttcaaacaaaaaacaaggaaagtgaagatagaagatgatgaagaaataacatgggagaaggctactctcaccctaaagaggacctctcattacctctccgcactgcaaacaagtgatggccattggcctgctcatctcgggggttctcactttttcattcctatcatggtcatttctatctacattacgggacatcttgattctgtacttccgaaagaatatcgtaaagaaattctccgttacttatataatcatcagaacgaagatggagggtggggattgcacatagagggtcctagcaccatgtatggtaccacactgaattatataagtatgagacttctcggagaaggagctaatggaggtcataacaatgcttgtgctaaggctagaaagtggattcatgatcatggtagcgtaacacatgtgccttcatggggaaaattttggctttcggcacttggtatagttgattggagtggatgcaacccattgccgcctgaattttggatacttcccacttttctccccatgcatcctgctaaaatgtggtattattgtcgacatgtatatatgcctatgtcatatatatatggaaaaagatttgcgtgtccaatcacaccattgattaaagatttaagagaagaactctttactcaaccgtatgatgaaagtatgtggaagaaagcacgtcacaaatgtgccaaggaagatctctattatccccatcattggatacaagatctaatatgtgatagtgcttatttagttactgagccacttcttacacgttggcctttcaataagttgattagagaacaaacacttcaactaacaatgaagcttattcactatgaagatgaaaatactcgatatatagatggtggatgtgtgaacaaggctttggctatgcttgcatgttgggtagaagatccaaatggagatgcttttaagaagcacgttgcaagggtcccagattatttatggctttcagaagatggaatgtgtacacatggacttagtacgcaatcatgggatgttggttttattgttcaagctcttcttgctactaatctaatcgatgatcttggtcccacacttgcaaaagcacatgattttatcaagaaatctcaagtagtagaaaatcgtttaggagattttaagagtatgtttcatcaaatttctaaagggtcttggacctttgctgatagagaccatgcattacaactttctgatggcactgcagaatgtatgaagtgttgtttacttttatccatgttaccagaagagattgtgggagaaaaattagaacctgaaaggttatatgattcggtcaattttttattgtcacttcagagtaaaaatggaggtgtaagtgtgtgggagccagcaatagctcaaaagtggttggaacatctgaatcccgcggaatttctggctgacatagtaattgagcacgaatatcttgagtgtactggatcaacaattcaggctttagtgttgttcaaaaaactatatccaaatcatagaagggaagagatagataatttcattgtgaaagcggcacaattcattgaagatgaacaattaccaaacggaaattggcatgggaactggggagtttgcttcacttacggttcctggtttgcagttggaggtttagctgctgctggaaagtcttacagtaattgtgttgccattcgtaaagctgtgaagtttctactctcaatacaaaatgaggatggtggttggggagaaagttatctttcatgtccaatgaagacctacgtgcatcttgaagggaatcgatcaaatgttggtcaaacagcttgggctctactagctttgattcttggtggtcaggctgagagagatccaactcctcttcaccgtgctgcaaagttactcattaattctcaattagaagatggtgattggccccaacaagaagcattgggagtgtacaagagaagttgcttgcttcattacccattctatagaactgtttttccgttgcaggctttgtctgaatatcgtaacaatgttttagtgccatccacttga

SEQ ID NO: 8790 - DNA, 2289 bp, Phaseolus vulgaris
atgtggaggttgaagataggagatggagggaagaatccatacatatttagcacaaacaattttgtgggaagacaaatatgggagtttgattctgaagcaggaactgatgaggaacgagctcaggtggaagcagctcgtcaacatttccatcaaaatcgctttaagctcaaggcttgtgctgatcgactatggcgatttcagattttgagggaaaagaaattcaaacaaaaaataaggaaagtgaagatagaagatgatgaagaaataacatgggagaaggctactctcaccctaaagagaacctctcattacctgtcggcactgcaaactagtgatggtcattggcctgctcacgtagggggttctcacttttttcttcctatcatggttatttctgtctacagtacgggacatcttgattctgtatttctggaagaatatcgtaaagaaattctccgttacttatataatcatcaaaacgaagatggtgggtggggattgcacatagagggtcctagcacgatgtatggtaccacactgaattatataagtatgagaattcttggagaaggagctaatggaggtcataacaatgcttgtgctaaggccagaaagtggattcatgatcatggtagtgtaacacatgtaccttcatggggaaaattttggctttcggtacttggtatagttgattggagtggatgcaacccactgccccctgaattttggatacttcccactattctccccatgcatcctgcaaaaatgtggtattattgtcgacacgtatatatgcccatgtcatatatatatggaaaaagatttgtgtgtccaatcacaccattgatcacaaatttaagagaagaactctttagtcaactgtatgatgaaagtatgtggaagaaagcacgtcacaaatgcgctaaggaagatctctattatccccatcattggatacaagatctaatatgggatagtgcttatttagttgctgagccacttcttacacgttggcctttcaataagttgattagagaaaaagcacttgaagtaacaatgaagcttattcactatgaagatgaaaatacactgtatataaccggtgggtgtgtgaacaaggctctatctatgcttgcatgttgggtagaagatccaaatggagatgcttttaagaagcacgttgcaaggatcccagattatttatggctttcagaagatggaatgtgtatccagggaattaattcgcaatcatgggatgctggtttcattgttcaagctcttcttgctactaatctaattgatgatcttggtcccacacttgcaaaagcgcatgattttatcaagagatctcaggtagtggaaaatcgtacgggagattttaagagtatgtttcatcacatttctaaaggggcttggacctttgctgacagagaccatacggtacaaatttctgactgcactgcagaatatatgaagtgttgtttacttttatcgatgttgccagaagaaattgtgggagaaaaattgaaacttgaaaggttatatgattcagttaattttatattgtcacatcagagtaaaaatggaggtgtatttgtgtgggagcctgcaatagctcaaaaatggttggaacatctgaatccggcggaatttcttgctgacatagtaattgagcacgagtatattgagtgtactggagcgataattcgggctttagtgttgtttgaaaaactatatccaaatcatagaagggaagaaatagataatttcattgtcaaagcagcacaattcattgaagatgaacaattaccaaacggaacttggcatggtaactggggagtttgcttcacttacagttcctggttagcagtaggaggtttagttgctgctggaaagtcttacactaattgtgttgccattcgtaaagctgtgaagtttctactctcaatacaaaatgaggatggtggttggggagaaagttatctttcatgttcaatgaagacgtacgtgcctcttgaaggaaatcgatcaaatgttggtcaaacagcttgggctctaatggttttgattcgtgctggtcagtctgagagagatccaagtccccttcactatgctgcaaagttactcattaattcacaattagaagatggcgattggccacaacaagaagccttgggagcgtacaagagaagttgcttgataaattatcccttttatagaactgtttttccgatgtgggctttgaccgaatatcgtaacaatgttttaatgccgtctacttttgcttaa

SEQ ID NO: 8791 - DNA, 2310 bp, Phaseolus vulgaris
ggaacaagtaaggttaagaaaatgtggaggttgaagataggagatggagggaagaatccatacatatttagcacaaacaattttgtgggaagacaaatatgggagtttgattctgaagcaggaactgatgaggaacgagctcaggtggaagcagctcgtcaacatttccatcaaaatcgctttaagctcaaggcttgtgctgatcgactatggcgatttcagattttgagggaaaagaaattcaaacaaaaaataaggaaagtgaagatagaagatgatgaagaaataacatgggagaaggctactctcaccctaaagagaacctctcattacctgtcggcactgcaaactagtgatggtcattggcctgctcacgtagggggttctcacttttttcttcctatcatggttatttctgtctacagtacgggacatcttgattctgtatttctggaagaatatcgtaaagaaattctccgttacttatataatcatcaaaacgaagatggtgggtggggattgcacatagagggtcctagcacgatgtatggtaccacactgaattatataagtatgagaattcttggagaaggagctaatggaggtcataacaatgcttgtgctaaggccagaaagtggattcatgatcatggtagtgtaacacatgtaccttcatggggaaaattttggctttcggtacttggtatagttgattggagtggatgcaacccactgccccctgaattttggatacttcccactattctccccatgcatcctgcaaaaatgtggtattattgtcgacacgtatatatgcccatgtcatatatatatggaaaaagatttgtgtgtccaatcacaccattgatcacaaatttaagagaagaactctttagtcaactgtatgatgaaagtatgtggaagaaagcacgtcacaaatgcgctaaggaagatctctattatccccatcattggatacaagatctaatatgggatagtgcttatttagttgctgagccacttcttacacgttggcctttcaataagttgattagagaaaaagcacttgaagtaacaatgaagcttattcactatgaagatgaaaatacactgtatataaccggtgggtgtgtgaacaaggctctatctatgcttgcatgttgggtagaagatccaaatggagatgcttttaagaagcacgttgcaaggatcccagattatttatggctttcagaagatggaatgtgtatccagggaattaattcgcaatcatgggatgctggtttcattgttcaagctcttcttgctactaatctaattgatgatcttggtcccacacttgcaaaagcgcatgattttatcaagagatctcaggtagtggaaaatcgtacgggagattttaagagtatgtttcatcacatttctaaaggggcttggacctttgctgacagagaccatacggtacaaatttctgactgcactgcagaatatatgaagtgttgtttacttttatcgatgttgccagaagaaattgtgggagaaaaattgaaacttgaaaggttatatgattcagttaattttatattgtcacatcagagtaaaaatggaggtgtatttgtgtgggagcctgcaatagctcaaaaatggttggaacatctgaatccggcggaatttcttgctgacatagtaattgagcacgagtatattgagtgtactggagcgataattcgggctttagtgttgtttgaaaaactatatccaaatcatagaagggaagaaatagataatttcattgtcaaagcagcacaattcattgaagatgaacaattaccaaacggaacttggcatggtaactggggagtttgcttcacttacagttcctggttagcagtaggaggtttagttgctgctggaaagtcttacactaattgtgttgccattcgtaaagctgtgaagtttctactctcaatacaaaatgaggatggtggttggggagaaagttatctttcatgttcaatgaagacgtacgtgcctcttgaaggaaatcgatcaaatgttggtcaaacagcttgggctctaatggttttgattcgtgctggtcagtctgagagagatccaagtccccttcactatgctgcaaagttactcattaattcacaattagaagatggcgattggccacaacaagaagccttgggagcgtacaagagaagttgcttgataaattatcccttttatagaactgtttttccgatgtgggctttgaccgaatatcgtaacaatgttttaatgccgtctacttttgcttaa

SEQ ID NO: 8792 - DNA, 2307 bp, Phaseolus vulgaris
atgtggaggttgaagataggagatggagggaagaatccatacatatttagcacaaacaattttgtaggaagacaaatatgggagtttgattctgaagcaggaactgatgaggaacgagctcaggtggaagcagctcgtcaacatttccatcaaaatcgctttaagctcaaggcttgtgctgatcgactatggcgatttcagattttgagggaaaagaaattcaaacaaaaaataaggaaagtgaagatagaagatgatgaagaaataacatgggagaaggctactctcaccctaaagagaacctctcattacctgtcggcactgcaaactagtgatggtcattggcctgctcacgtagggggttctcacttttttcttcctatcatgttaaatttatttaataaggataaattaagaaataaccctcatgttgtagtgattttccatttatttcttaagggtagaagatatttaattacgggacatcttgattctatttttccggaagaatattgtaaagaaattctccgttacttatataatcatcagaacgaagatggagggtggggattgcacatagagggtgctagcacgatgtatggtaccacactgaattatgtaagtatgagaattcttggagaaggagcaaatgataatgcttgtgctaaggctagaaagtggattcatgatcatggtagcgtaacacatgtgccttcatggggaaaattttggctttcggtacttggtatagttgattggagtggatgcaacccattgccccctgaattttggatacttcccacttttctccccatgcatcctggaaaaatgtggtattattgtcgacacgtatatatgcccatgtcatatatatatggaaaaagatttgtgtgtccaatcacaccattgatcacaaatttaagaaaagaactctttactcaaccgtatgatgaaagtacgtggaagaaagcacgccacaaatgtgctaaggaagatctctattatccccatcattggatacaagatctaatatgggatagtgcttatttagttactgagccacttcttacacgttggcctttcaataagttgattagagaaaaagcacttgaagtaacaatgaagcttattcactatgaagatgaaaatacacggtatataactggtgggtgtgtgaacaaggctttatctatgcttgcatgttgggtagaagatccaaatggagatgcttttaagaagcacattgcaaggatcccagattatttatggctttcagaagatggaatgtgtatacaaggaattaattcacaatcttgggatgctggtttcattgttcaagctcttcttgctactaatctaattgatgatcttggtcccacacttgcaaaagcgcatgattttatcaagaaatctcaggtagtggaaaatcgttcaggagattttaagagtatgtttcatcacatttctaaagggtcttggacctttgctgacagagaccatgcattacaagtttctgacgacactgcagagtgtatgaagtgttgtttacttttatctatgttgccagaagagattgtgggagaaaatttggaacttgaaagattatatgattcagtcaattttatattgtcacatcagagtaaaaacggaggtgtatctgtgtgggagccagcaatagctcaaaagtggttggaacatctaaatcctgcggaatttcttgctgacatagtaattgagcatgagtatcttgagagtaatggagcaacaattcaagctttagcgctgtttaaaaaaatatatccaaagcatagaagggaagagatagagaatttcattgtgaaagcagcacaattcattgaagatgaacaattaccaaatggaacttggcatggaaactggggaatttgcttcacttacagttcctggtttgcggtaggaggtttagttgctgctggaaagtcttacaataattgtgttgccattcgtaaagctgtgaagtttctactctcaatacaaaatgaggatgggaatcgatcaaatattggtcaaacagcttgggctctattagctttgattcttgctagtcaggctgagagagatccaactccccttcaccgtgctgcaaagttactcattaattctcaattagaagatggcgattggccacaacaagaaaccttgggggcgtataagagaaactgtttgcttcattatccattatatagaattgtttttccgatgtgggctttgactgaatatcgtaacaatgttttagtatcatccacttctgtttaacttgagaagttg

SEQ ID NO: 8793 - DNA, 2237 bp, Phaseolus vulgaris
gggagtgaacacttgaagatctgtcatcaggaacaagtaaggttaagaaaatgtggaggttgaagataggagatggagggaagaatccatacatatttagcacaaacaattttgtgggaagacaaacatgggagtttgattctgaagcaggaactgatgaagaaagagcccaggtggaagctgctcgtcaagatttctatcaaaaccgctttaagctcaaggcttgtggtgatcgactatggcgatttcaggttttttccatctacgttacaggacatcttgattttgtatttccaaaagaatattgtaaagaaattcttcgttatttatataatcatcagaacgaagatggagggtggggattgcacattgagggtcctagcaccatgtatggtaccacactgaattatataagtatgagaattctcggagaaggagctaatggaggtcataacaatgcttgtgctaaggccagaaagtggattcatgatcatggtagcgtaacacatgtaccttcatggggaaaattttggctttcggtacttggtatagttgattggagtggatgcaacccactgccccctgaattttggatacttcccacttttctccccatgcatcctgctaaaatgtggtattattgtcgatctgtatacctgcccatgtcatatatatatggaaaaagatttgtatgtccaaccacaccattaatcacagatttaagagaagaactatttactcaaccatatgatgaaagtacttggaagaaagcacgtcacaaatgcgcaaaggaagatctctattatccccatcattggatacaagatctaatatgggatagtgcttatttatttactgaaccactccttacacgttggcctttcaataagttggttagagaaaaagcacttgaagtaacaatgaagcttattcactatgaagatgaaaatagtcgatataccgatggtgggtgtgtgaacaaggctttatctatgcttgcatgttgggtagaagatccaaatggagatgcttttaagaagcatgttgtaaggatcccagattttttatggctttcagaagatggaatgtgtgtacagggactttattcgcaatcatgggatgctggtttcattgttcaagctcttcttgctactaatctaattgatgatcttggtcccacacttgcaaaagcacatgattttatcaagaaatctcaggtagtagaaaatcgttcaggagattttaagagtatgtttcataacatttctaaagggtcttggacccttgccgacagagaccatgggttacaaatttctgacggcactgcaggatgtatgaagtgttgtttacttttatccatgttgccacaagagattgtgggagaaaaattggaacctgaaagattatatgattcgatcaattttatattgtcacttcagagtaaaaatggaggtgtatctgtgtgggagccagcaaaagctcaaaagtggttggaacatctgaatcccgcggaatttcttgctgacatagtaattgagcacgagtatattgagtgtactggagcaaccattcaggctttagcgttgttcaaaaaactatatccaaaacatagaagacaagagatagaaaatttcattgtcaaagcagcacaattcattgaagatgaacaattaccaaatggaacttggcatggaaactggggaatttgcttcacttacagttcctggttagcagtaggaggtctagttgctgttggaaagtcttacagtaattgtgttgccattcgtaaagctatgaaatttctactctcaatacaaaatgaggatggtggttggggagaaagttatctttcatgttcaatgaagacgtacgtgcctcttgaagggaatcgatcaaatattggtcaaacagcttgggctctaataactttgattcgtgctggtcaggctgagagagatccaactcctattcaccgtgctgcaaagttactcattaattctcagttagaagatggcgattggccacaacaagaagccttgggggcgttcaagggaagttgcttgcttcattacccattctaccgaactgttttttcaatgtgggctttaactgaatatcgtaacaatgttttagtgtcatccacttctgtttaacttgataagttgtaaggtaaaaaagacaaagtcatacccatacaaaaattcgaatatataaaatcaaaggtggtgatcaacttt

SEQ ID NO: 8794 - DNA, 3740 bp, Setaria italica
ggtgcccgtccgcgcccgcgcaaccggcacgcaaacccttggcccctccgccccgccgcaccaaacccaccccatcccaacgctatccgctgcctcctcaggctcgcccgcgccgcgccccctcctcctcttccccctcatccgccaccttcctccctccccatccatcctaccccacccaccccgccccgccgccgccgaggagaaggcgcgcgcccccacccccgccacgcgaggcagcagggatccctctcgtgccagcatggagctcccactcgcctccgcgaagccctcgccccgggcggcgggggccgcctgcccgccgctcctcttctcgccgcttaaacccttcccgctcctccgcttcccgccgcggaggcccgccgcggcgcggctccgcctccgcccccgcgcggccgccgccggcgaggcgtcctcccccggcgaggaggtgttcggcgggcggaaggagctgacgggcgtgcaaccgctggtggaggcgctcccgcccgccgcgcggacggcggcggagctggcggtcgccgcggcggccatcgcggccgggtacggcatcgggctgcgcgcgggcggcgggtcgcgcgccgtggcggtggcgggggcggcggtgctcggcgcggccagcgtggcgggcgcggccgcggtgaactccgtggtgcccgaggtcgccgccgtcgggctccacaactacgtcgccggccacgacgaccccaccaacctggacaacggcgaggtggaggccatcgcgaagaaatatggagttagtacacaggatgcagcttttaaagcagagctatgtgacttgtatgccaggtatatttactcagtacttcctccaggagatgaagatctcaaaggtagtgaggttcaggctattacaaaatttaaaagagctcttgggcttgatgatgtggatgctgctaacatgcacatggagattggtagacacatatacagagagaggctagaaacaagtgaccgtgatgctgacatggaacaaaggcgggcatttcaaaagttaatttacgtgtcaaatcttgtcttcggagatcaatctgcgttcctacttccatggaaacgtcttttcggggtgactgagtctcagattgacattgctatgagggaaaatgccaagaatttatactcgtcgcagctcaagtctatcgggagaggtcttgacataggcacactcattgatgtaaggagagcgcaactcgcatataaactttctgatgagattgctgctgagatgttccgggagcatgcaaagaagctagttgaagaaaacatttcatcagccttagacatcatgaagtctcgtatcccggatagtctaactaaggctgtggaagaggtgaagagtgttattagatttaatagtttgcttacaatattaagcaagcaccctcaggctgatcgatttgctcgtggtcttggccctatttcgttaggtggtgagtatgatcatgataggagggctgatgatctcaagatactctacaaggcctatgctacagaagtactttcagatggaattgttgatgatgagaagcttgctcctttgaatgaactgagaaatgtatttggactggggaagcgtgaagcagaaggaatcttgtctgatgtcaaagctcacatatacagaaggacacttgctaaagcgtttaataccgaattggcttcagtccctagcaaagcagcattcctccaaattctctgtgaaaagttgcaatttgatcctgaacttgctagcaagatgcatgaagaaatttacagacagaagcttcagcagtttgtagctgacggtgagctgagcaaggaggaagtggaagctctgatggcattccaagtgcgtctctgcatccctcaagaaactgtggatgctgctcatactgagatctgtggccaattgttcgaaaaggttgtcaaggaagccattgcatccgttgatggatatgatgctgatagacgagaggctgttaggaaggcagcacaaagtctaaacttgaaaaaggaggctgccatggtgatctttagtaaagcggtacgtaagttgttcctgagctacattcagagagcaaaagaagctgataaccccattgaaactgcaaaagagctgaagaagctaatttccttcaacacagttgttgttagtgagcttttagctgacattaaaggagagctgtcttctactgctgaaactgaagcatcaagcgcggcctcggaatctgagggagaggatgatgaatacgaatgggaatcattggatacattgagaaagactagacctgataaagagcttaaggaaaagctgagaaagtcaatccagaaagagataaccctcaaggatgacattccgttgagagacaggactgagctgtatgagacatacttgaagttctgcatcagtggggagacgacgaacgtatcatttggaacagcaatctccacgaagaaagacaattcagagtttttaatgctaaagcagttgggtgacatacttggtttaactcgcaaagaagcacaagatgttcacattaagttcacagaaaaagcttttgtgcaacaggcagaagtaattcttgctgatgggaagttaacagaggccaaggctgaacagcttgcaaagattcaaaagcagtttggtttgcctactgaaaatgcacagaaaatcattaagggtatcacaacaacaaagttgtcatctgcaatagaagcttctgttgctcggggtcagatcggtatacagcaggtcagaggattgaaagatgctaacttccaactggatagtttgattgcggaaccactacgggaaagcatttacaggaaaactgttgaggagatcttttcatcaggcacaggagattttgatgaagaggaagtgtacgtaaagatcccagctgatctcatcataagtgctgagaaggccaagtcaattgttcaggatattgcaaaggttaggttggagaactcccttgttcaggctattgccttgcttcggcagaagaagagagatgatgtgctttcttctctgaatgacttgctcgcgtgcgatgccgctgtccctgcaccacaacctctgtcatggcccacaccgggagagctagatgacctgtatgccatctacctgaagggcaccccgaagccagagaagctatcaaggttgcagtacctgctcggcataagtaacgagacggctaacaagatccgggacacggcctccgagggaacgctgccgattgctgcagctgacgagaaagaggagttggcgttctaggaaggggcgcaattttgttagggtagccagcagagttgctattgtagccaggcgcatacatgtttttggaaaaggaaagtgacgcgtcatcctgacaagcataactatttgtatagacaagtctctgacaccaaatttggtgacactcttcttctgctgttgcattcttccagaccacactgaaagcgtctttttgtttaatgttcccccccttttgttcaacatgtatcaccctcacagctatgactgcaaccctcaattagtactctatcataggttgtttttggcttttctaggtttataggtattattatgtatctagatgtataggtattattatgcatctagatgtagtgtatgtttaaatgcataataatatctatgaatcttaaaaagctaaaacgatctaaattttttaagctaaaatgacctacagtttggaacg

SEQ ID NO: 8795 - DNA, 3765 bp, Setaria italica
acggggagactgcccgaaatagggtgcccgtccgcgcccgcgcaaccggcacgcaaacccttggcccctccgccccgccgcaccaaacccaccccatcccaacgctatccgctgcctcctcaggctcgcccgcgccgcgccccctcctcctcttccccctcatccgccaccttcctccctccccatccatcctaccccacccaccccgccccgccgccgccgaggagaaggcgcgcgcccccacccccgccacgcgaggcagcagggatccctctcgtgccagcatggagctcccactcgcctccgcgaagccctcgccccgggcggcgggggccgcctgcccgccgctcctcttctcgccgcttaaacccttcccgctcctccgcttcccgccgcggaggcccgccgcggcgcggctccgcctccgcccccgcgcggccgccgccggcgaggcgtcctcccccggcgaggaggtgttcggcgggcggaaggagctgacgggcgtgcaaccgctggtggaggcgctcccgcccgccgcgcggacggcggcggagctggcggtcgccgcggcggccatcgcggccgggtacggcatcgggctgcgcgcgggcggcgggtcgcgcgccgtggcggtggcgggggcggcggtgctcggcgcggccagcgtggcgggcgcggccgcggtgaactccgtggtgcccgaggtcgccgccgtcgggctccacaactacgtcgccggccacgacgaccccaccaacctggacaacggcgaggtggaggccatcgcgaagaaatatggagttagtacacaggatgcagcttttaaagcagagctatgtgacttgtatgccaggtatatttactcagtacttcctccaggagatgaagatctcaaaggtagtgaggttcaggctattacaaaatttaaaagagctcttgggcttgatgatgtggatgctgctaacatgcacatggagattggtagacacatatacagagagaggctagaaacaagtgaccgtgatgctgacatggaacaaaggcgggcatttcaaaagttaatttacgtgtcaaatcttgtcttcggagatcaatctgcgttcctacttccatggaaacgtcttttcggggtgactgagtctcagattgacattgctatgagggaaaatgccaagaatttatactcgtcgcagctcaagtctatcgggagaggtcttgacataggcacactcattgatgtaaggagagcgcaactcgcatataaactttctgatgagattgctgctgagatgttccgggagcatgcaaagaagctagttgaagaaaacatttcatcagccttagacatcatgaagtctcgtatcccggatagtctaactaaggctgtggaagaggtgaagagtgttattagatttaatagtttgcttacaatattaagcaagcaccctcaggctgatcgatttgctcgtggtcttggccctatttcgttaggtggtgagtatgatcatgataggagggctgatgatctcaagatactctacaaggcctatgctacagaagtactttcagatggaattgttgatgatgagaagcttgctcctttgaatgaactgagaaatgtatttggactggggaagcgtgaagcagaaggaatcttgtctgatgtcaaagctcacatatacagaaggacacttgctaaagcgtttaataccgaattggcttcagtccctagcaaagcagcattcctccaaattctctgtgaaaagttgcaatttgatcctgaacttgctagcaagatgcatgaagaaatttacagacagaagcttcagcagtttgtagctgacggtgagctgagcaaggaggaagtggaagctctgatggcattccaagtgcgtctctgcatccctcaagaaactgtggatgctgctcatactgagatctgtggccaattgttcgaaaaggttgtcaaggaagccattgcatccgttgatggatatgatgctgatagacgagaggctgttaggaaggcagcacaaagtctaaacttgaaaaaggaggctgccatggtgatctttagtaaagcggtacgtaagttgttcctgagctacattcagagagcaaaagaagctgataaccccattgaaactgcaaaagagctgaagaagctaatttccttcaacacagttgttgttagtgagcttttagctgacattaaaggagagctgtcttctactgctgaaactgaagcatcaagcgcggcctcggaatctgagggagaggatgatgaatacgaatgggaatcattggatacattgagaaagactagacctgataaagagcttaaggaaaagctgagaaagtcaatccagaaagagataaccctcaaggatgacattccgttgagagacaggactgagctgtatgagacatacttgaagttctgcatcagtggggagacgacgaacgtatcatttggaacagcaatctccacgaagaaagacaattcagagtttttaatgctaaagcagttgggtgacatacttggtttaactcgcaaagaagcacaagatgttcacattaagttcacagaaaaagcttttgtgcaacaggcagaagtaattcttgctgatgggaagttaacagaggccaaggctgaacagcttgcaaagattcaaaagcagtttggtttgcctactgaaaatgcacagaaaatcattaagggtatcacaacaacaaagttgtcatctgcaatagaagcttctgttgctcggggtcagatcggtatacagcaggtcagaggattgaaagatgctaacttccaactggatagtttgattgcggaaccactacgggaaagcatttacaggaaaactgttgaggagatcttttcatcaggcacaggagattttgatgaagaggaagtgtacgtaaagatcccagctgatctcatcataagtgctgagaaggccaagtcaattgttcaggatattgcaaaggttaggttggagaactcccttgttcaggctattgccttgcttcggcagaagaagagagatgatgtgctttcttctctgaatgacttgctcgcgtgcgatgccgctgtccctgcaccacaacctctgtcatggcccacaccgggagagctagatgacctgtatgccatctacctgaagggcaccccgaagccagagaagctatcaaggttgcagtacctgctcggcataagtaacgagacggctaacaagatccgggacacggcctccgagggaacgctgccgattgctgcagctgacgagaaagaggagttggcgttctaggaaggggcgcaattttgttagggtagccagcagagttgctattgtagccaggcgcatacatgtttttggaaaaggaaagtgacgcgtcatcctgacaagcataactatttgtatagacaagtctctgacaccaaatttggtgacactcttcttctgctgttgcattcttccagaccacactgaaagcgtctttttgtttaatgttcccccccttttgttcaacatgtatcaccctcacagctatgactgcaaccctcaattagtactctatcataggttgtttttggcttttctaggtttataggtattattatgtatctagatgtataggtattattatgcatctagatgtagtgtatgtttaaatgcataataatatctatgaatcttaaaaagctaaaacgatctaaattttttaagctaaaatgacctacagtttggaacggag

SEQ ID NO: 8796 - DNA, 3256 bp, Panicum virgatum
cccgccgcgcggacggccgcggagctggcggttgccgcggcggccatcgcggccggctacggcatcgggctccgcgcgggcggcgggtcgcgcgccgtggcggtcgcgggggcggccgtgctcggagcggccagcttggcgggcgcggccgcggtgaactccgtggtgcccgaggtcgccgccgtggggctccacaactacgtcgccggccacgacgaccccaccaacatggagagcggcgaggtggaggccatcgcgaagaaatatggagttagcacacaggatgcagccttcaaagcagagctctgtgacttgtatgccaggtatgtttactcagtacttcctccaggagatgaagatctcaaaggtagcgaggttcaggctattataaaatttaaaagagctcttgggcttgatgatgtagatgctgctaacatgcacatggagattggtagacgcatatacagagagaggctagaaacgagtgaccgtgatgctgacatggaacaaaggcgggcatttcaaaagttaatttatgtgtcaaatcttgtctttggagatcaatctgcattcttacttccatggaaacgtctcttcggggtgactgattctcagattgacattgctatgagggaaaatgccaagagtttatactcgtcgcagctcaagtctattgggagaggtcttgacataggcacgctcattgatgtaaggagagcacaacttgcatataaactttctgatgagattgctactgagatgttccgggagcatgcgaagaagctagttgaagaaaacatttcatcagcgttagacatcttgaatctaactcaggctgtggaagaagtgaatattgttattaagtttaatagcttgcttacaacattaagcaagcacccccaggctgatcggtttgctcgtggacttggccctatttcattaggtggagagtatgatcatgataggagggctgatgatctcaagatactctacaaggcctatgctacagaagtactttcagacggaattgttgatgatgagaagcttgcgcctttgaatgaactcagaaatatatttggactggggaagcgtgaagcagaaggaatattgtctgatgtcaaatctaacatatacagaaggacacttgctaaagcatttaacactgaactggcttcagtccctagcaaagcagcattcctccaaattctctgtgaaaagttgcaatttgatcctgaacttgctagtaagatgcatgaagaaatttacagacagaagcttcaacagtttgtagctgacggagagctgagcaaggaggaagtggaagctctgatggcattccaaatgcgtctctgcatccctcaagaaactgtggatgctgctcatgctgagatctgtggccaattgttcgaaaaggttgtcaaggaagcaattgcatccgttgatggatatgatgctgacagacgagaggctgttaagaaggcagcacaaagtctaaacttgaaaaaggaggctgtcatggctatctttagtaaagcagtacgaaagttgttcctgagctacattcagagagcaaaagaagctgggaaccgcattgaaactgcaaaagagctgaagaagctaatttccttcaacacagttgttgttagtgagcttttagcggacattaaaggagagctgtctccaactgctgaaactgaggcatcaagcgtgacttcggaatctgagggagaggatgatgaatatgaatgggaatcattggagacattaagaaagactagacctgataaagagcttaaagaaaagctgagaaagtcagtccagaaagagataaccctcaaggatgacattccattgagagacaggactgaactctatgagacatacttgatgttctgcatcactggggagacaacgaacgtatcatttggaacagcaatctccacaaagaaagacgattcagagtttttaatgctgaaacagttgggtgacatacttggtttaactcgcaaagaagctcaagatgtccacattaagtttacagaaaaagcttttgtgcaacaggccgaagtaattcttgctgatgggaaattaaccgaggccaaggccgaccagcttgcaaagattcaaaagcagtttggtttgcctactgaaaatgcgcagaaaatcattaagggtatcacaacaacaaagttgtcttctgcaattgaagcttctgttgctcggggtcagattggtatacagcaggtccgaggattgaaagaagcaaacttccaactagatagcttgatttcggaatcactacgggaaagcatttacagaaaaactgttgaggagatcttttcgtcaggcacaggagattttgatgaagaggaagtgtatgtaaaggtcccagctgatctcatcataagtgctgagaaggccaagtcaattgttcaggatattgcaaaggttaggttggagaactcccttgttcaggctattgccttgcttcggcagaagaagagagacaatgtgctttcttctctgaatgacttgctcgcgtgcgacaccgctgtccctgcatcacaacctctgtcatggcccacaccgggagagctagatgacctgtatgccatctacctgaagagcataccaaagccagagaagctatcaaggttgcagtacctgctcggcataagcaacgagaaggctaacaagatccgggacgcggcctcggagggaacactgccgattgctgcagctgaagagaaagaggagttgacgttctaggaaggggcgcaattttgttaggttagccagcagagctgaggtaccttgccagccaaccaacgaacgaacttggtgatgtggccaacagctgccattgtagctaggggcatatatgtttttggaaaaggaaagcgacgccacatccggacatatgactatctgtatagacaagtttgtgacaccaaatttggtgacgctcttttgctgttgcatttttccagaccacactgaaagcatttttgttttgtttaatgatttcctctcttcgttcaacatgtattacaataacagatatgactgcaacccttgcttataacctggttttgttaacccatcataagtgccaagctatccatgtttctttggtgcgtataagccaccacacgcatcttttcctatatactccttctgttccaaattattagttgttttgacctttttagattcatagcttttcatatgcatctacatatatattatatatatg

SEQ ID NO: 8797 - DNA, 3856 bp, Oryza sativa
acaccggacgccatcacctggcgacaacccgctctcccggtgcaccgcacgtctaccgctggtcgcaggcgcccacccaaccccaacccttccctttggtccagccgcccctgccccgacctcaccaatccccgcctcgtaacgctatcccatctcctcctcctccacctcgcctcttccgcctcatccaccaccacctcctcccccccaccacccgtcgccacccttcgccgccgccgccgacgaggaccaccaccaccacgacggtggagtagccgcccgcgaacaccgaggcggcaggggatccatcatcccacgacaacgaccatggagctcgccctggcctccgcgaagccctcgccctcgcccgcgcccgcgcccctcctcttcgcgccgctcaagcccctccccctcctccgcttccctccccggagaccccgcgcctcctcttcctccgtgggggcgaggctccgcgctgggaggcgcgggctgaggctgctgtgccgcgcggcggtgggggcgggggaggaggtgttcgggccgaggagggagctggcgggggtgcagccgctggtggaggcgctgccgcccgcggcgaggacggcggcggagctggcggtggccgcggcggcggtggcggcggggtacggcatcgggctccgcgcgggtggggggtcgagggccgtggcggtcgcgggcgccgcggtgctcggggcggccagcgtcgccggggccgccgcggtgaactccgtcgtgccggaggtcgccgccgtcgggctgcacaactacgtcgccggatgcgacgaccccaccaagctggagagcggcgaggtggaggccctcgcgaccaaatatggagttagtacacaggacgcagccttcaaagcagagctctgtgatttgtatgccaggtttctttactcagtacttcctccaggagatgaagatctcaaaggtgatgaggttcagaccattataaaatttaaaaatgctcttgggctcgatgatgtagatgctgcaaatatgcacatggagattggtaggcgcatatacagagaaaggctggaaacaagggaccgggatgccgacatggaacagcggcgggcatttcaaaaactcatatatgtatcaaatcttgtctttggggatgcatcaacattcctgcttccatggaaacgtctttttggggtcactgattctcagattgatattgctatgcgggaaaatgccaaaatcttatatgcatcacaactcaagtctattgggagaggtcttgacataggcacgcttatcgaagtaaggagagcacaacttgcatacaaactttctgatgagattgctgctgagatgttcaaggagcatgcaaagaagttggttcaagaaaacatttcgtcagctttggacatcgtaaagtcgcgtaccaaagcagcgaatagcccaacacaggttattgaagatgtgaagagcatccttgcttttaatagcttgctcataacactaagcaaacaccctgatcaagatagatttattcgtggtcttggacctatttcgttaggtggagagagtgatcatgataggagggctgatgatctcaagctactatatagggcctatgcaacagaagtactatcagatggacatctggatgatgagaagctcgctcctttgaatcaactgaggaatatatttggactgggcaagcgtgaagcagaatcaatcatgtcagatgtcaaagctcaagtatacagaaagagacttgctaaatcatttaatagtgagttggctgcggcccctagcaaagcagcattcctccaaaatatctgtgaagagttacagtttgatccggaacttgctagtaagatgcatgaagacatttacaggcagaagcttcagcagtttgtagcggatggagagctgaacaaggacgaagtggaagctttgatggcattccaagtgcgtctctgcattccacaagaaactgttgatgctgtccattcagaaatctgtggcaagttgtttgaaaaggttgtcgtggaagcaatttcatctgttgatggatatgacactaatagacgacaggctgttaagaaggcagcacaaggtctgaatttgaaaaacgagtctgtcatggccattttcagcaaagtggtacggaagttattcctgaactacattcagagagcaaaagcagctgggaaccgcattgaaactgcaaaagagctgaaaaagatgatatccttcaacacagtagttgtgagtgagcttttagctgacattaaaggagaaccaacaactgctgaacctcaaacatcagatgcaacctcagaacctgaagtcagcgagtctgagggggatgatgaatacgaatgggaacagctggagacattaaggaaaactaggcctgataaagagctcagagagaaactggcaaagtcaagccagaaagagataaccctcaaagatgacattccattgagagacagagctgagctgtatgaaacatatttggtgttctgtgtcactggggagacgaccaatgtttcatttggaacagcaatctccacaaagaaagataattcagagtatttaatgctgaagcaattaggagacatacttggtttaacccgcaaggaagctcagaatgttcacattaagatggcagaaaaggcatttgtgcaacaggctgaagtgattcttgctgatgggaagttaacagaggccaaggctgaccagcttgcaaagatacagaagcaagttggtcttcctactgagtatgcacagaaaataatcaagaatatcacaacaacaaagttgtcttctgcaattgaagcctctatttctcgaggacagattggtatacagcaggtccgaggattgaaagaagcaaattttcaattggacagcttgattgcagaaccacttcgagaaaacatttacaaaaaatccgttgaggagatcttttcgtcaggcacaggtgaatttgatgaagaggaagtgtatgtaaagatcccagctgatctcatcattaatgctgagaaggccaagtcgattgtccaggacattgcgaagattaggttggataacgcccttgtccaagctgttgctctgcttcggcagaagaagaaagatgaagtggtcgcatccttgaacgacttgcttgcatgcgacgcggctgtgcctgcttcgaagcccctatcatggcctacatcaggagagctggatgatctgtacggcatttacatgaagagcattccgaagcctgaaaagctgtcaaggttgcagtatctgcttggcataagcgacgagaaggccggccagattcgggatgccgcatcggcaggcacactatccgttgcaactgaagaggaggatgaattggtattctagggagggagatgtgaaggtctttttttgttaggtagccagcagagttgaggacctaccatacttggtgctgtggcgccaaccgctgctattgtagctaggcgctggcatatggttttgagaagcaacgcataatcctgacgtgcgttaactgtttgtatagacagaaattggcaccgaatttggtgacaaatctcttttgctgcatttttcattttcagaccatagcgagagcttttttttttgtattttttttcttccccttttcattatgtatcacagtcgccactgctacctcagtcataaaatccgattttgttgtagctcaactgcagcatatgatatgtgtccctttgtatgggtcattgtagccaatatgtttcagcaatttttctttcagtttacattatcaaactgagtgtgtacaccacacaccaaatgctatgcgatgggatttcaaattccaattcct

SEQ ID NO: 8798 - DNA, 3724 bp, Oryza sativa
aatccccgcctcgtaacgctatcccatctcctcctcctccacctcgcctcttccgcctcatccaccaccacctcctcccccccaccacccgccgccacccttcgccgccgccgccgacgaggaccaccaccaccacgacggtggagtagccgcccgcgaacaccgaggcggcaggggatccatcatcccacgacaacgcccatggagctcgccctggcctccgcgaagccctcgccctcgcccgcgcccgcgcccctcctcttcgcgccgctcaagcccctccccctcctccgcttccctccccggagaccccgcgcctcctcttcctccgtgggggcgaggctccgcgctgggaggcgcgggctgaggctgctgtgccgcgcggcggtgggggcgggggaggaggtgttcgggccgaggagggagctggcgggggtgcagccgctggtggaggcgctgccgcccgcggcgaggacggcggcggagctggcggtggccgcggcggcggtggcggcggggtacggcatcgggctccgcgcgggtggggggtcgagggccgtggcggtcgcgggcgccgcggtgctcggggcggccagcgtcgccggggccgccgcggtgaactccgtcgtgccggaggtcgccgccgtcgggctgcacaactacgtcgccggatgcgacgaccccaccaagctggagagcggcgaggtggaggccctcgcgaccaaatatggagttagtacacaggacgcagccttcaaagcagagctctgtgatttgtatgccaggtttctttactcagtacttcctccaggagatgaagatctcaaaggtgatgaggttcagaccattataaaatttaaaaatgctcttgggctcgatgatgtagatgctgcaaatatgcacatggagattggtaggcgcatatacagagaaaggctggaaacaagggaccgggatgccgacatggaacagcggcgggcatttcaaaaactcatatatgtatcaaatcttgtctttggggatgcatcaacattcctgcttccatggaaacgtctttttggggtcactgattctcagattgatattgctatgcgggaaaatgccaaaatcttatatgcatcacaactcaagtctattgggagaggtcttgacataggcacgcttatcgaagtaaggagagcacaacttgcatacaaactttctgatgagattgctgctgagatgttcaaggagcatgcaaagaagttggttcaagaaaacatttcgtcagctttggacatcgtaaagtcgcgtaccaaagcagcgaatagcccaacacaggttattgaagatgtgaagagcatccttgcttttaatagcttgctcataacactaagcaaacaccctgatcaagatagatttattcgtggtcttggacctatttcgttaggtggagagagtgatcatgataggagggctgatgatctcaagctactatatagggcctatgcaacagaagtactatcagatggacatctggatgatgagaagctcgctcctttgaatcaactgaggaatatatttggactgggcaagcgtgaagcagaatcaatcatgtcagatgtcaaagctcaagtatacagaaagagacttgctaaatcatttaatagtgagttggctgcggcccctagcaaagcagcattcctccaaaatatctgtgaagagttacagtttgatccggaacttgctagtaagatgcatgaagacatttacaggcagaagcttcagcagtttgtagcggatggagagctgaacaaggacgaagtggaagctttgatggcattccaagtgcgtctctgcattccacaagaaactgttgatgctgtccattcagaaatctgtggcaagttgtttgaaaaggttgtcgtggaagcaatttcatctgttgatggatatgacactaatagacgacaggctgttaagaaggcagcacaaggtctgaatttgaaaaacgagtctgtcatggccattttcagcaaagtggtacggaagttattcctgaactacattcagagagcaaaagcagctgggaaccgcattgaaactgcaaaagagctgaaaaagatgatatccttcaacacagtagttgtgagtgagcttttagctgacattaaaggagaaccaacaactgctgaagctcaaacatcagatgcaacctcagaacctgaagtcagcgagtctgagggggatgatgaatacgaatgggaacagctggagacattaaggaaaactaggcctgataaagagctcagagagaaactggcaaagtcaagccagaaagagataaccctcaaagatgacattccattgagagacagagctgagctgtatgaaacatatttggtgttctgtgtcactggggagacgaccaatgtttcatttggaacagcaatctccacaaagaaagataattcagagtatttaatgctgaagcaattaggagacatacttggtttaacccgcaaggaagctcagaatgttcacattaagatggcagaaaaggcatttgtgcaacaggctgaagtgattcttgctgatgggaagttaacagaggccaaggctgaccagcttgcaaagatacagaagcaagttggtcttcctactgagtatgcacagaaaataatcaagaatatcacaacaacaaagttgtcttctgcaattgaagcctctatttctcgaggacagattggtatacagcaggtccgaggattgaaagaagcaaattttcaattggacagcttgattgcagaaccacttcgagaaaacatttacaaaaaatccgttgaggagatcttttcgtcaggcacaggtgaatttgatgaagaggaagtgtatgtaaagatcccagctgatctcatcattaatgctgagaaggccaagtcgattgtccaggacattgcgaagattaggttggataacgcccttgtccaagctgttgctctgcttcggcagaagaagaaagatgaagtggtcgcatccttgaacgacttgcttgcatgcgacgcggctgtgcctgcttcgaagcccctatcatggcctacatcaggagagctggatgatctgtacggcatttacatgaagagcattccgaagcctgaaaagctgtcaaggttgcagtatctgcttggcataagcgacgagaaggccgggcagattcgggatgccgcatcggcaggcacactatccgttgcaactgaagaggaggatgaattggtattctagggagggagatgtgaaggtctttttttgttaggtagccagcagagttgaggacctaccatacttggtgctgtggcgccaaccgctgctattgtagctaggcgctggcatatggttttgagaagcaacgcataatcctgacgtgcgttaactgtttgtatagacagaaattggcaccgaatttggtgacaaatctcttttgctgcatttttcattttcagaccatagcgagagctttttttttttgtatttttttcttccccttttcattatgtatcacagtcgccactgctacctcagtcataaaatccgattttgttgtagctcaactgcagcatatgatatgtgtccctttgtatgggtcattgtagccaatatgtttcagcaatttttctttcagtttacattatcaaactgagtgtgtacaccacacaccaaatgctatgcgatgggatttcaaattcca

SEQ ID NO: 8799 - DNA, 3121 bp, Brachypodium distachyon
tcttacaatggagctctcgctcgtctccgcgaagccctcgccctcgccgcgtgccgccgcctccgcgctcctcttcgccccgcttaaacccttcccgctcctccgcttcccgccgcggcgagccgcccccttcgcccgcctcaggagccagcggttccagttccgccgcgcggcggggtctggtgacggggagggcgagagcgacgcgacggcccggggggaggtgttcgggggccggagggaggaggtgttcggggggcggaaggagctcaccggcgtgcagccgctcgtggagtcgctgccgcccgcggctcggacggcggcggagctcgcggtggccgcggctgccgtggcggcgggctacggcatcgggctccgcctcggcggcggctcccgggccgcagcggtcgcgggcgcggccgtgctcggggcagctagcgtcgcaggggccgccgcggtaaactctgttgtgccggaggttgccgccgtggggctgcacaactacgtcgtcggctgcgacgaccccaccaagctggagaccagcgaggtggaggccatcgcgagcaagtatggagttagtacacaagatgcagccttcaaagcagagctctgtgacttgtatgccagctttctttactcagtactgcctcctggagatgaagatctcaaaggtaatgaggttgaggttattacgaaatttaaaagtgctcttggactcgatgatgtagatgctgcaaatatgcacatggagattggtagacgcttatacagggaaaggctggaaacaagggatcgcgatgctgacatggaacagcggcgggcgtttcaaaagctaatctatgtgtcaaatcttgtcttcggagatgcatcagccttcctacttccatggaagaggcttttcgggatcactgattctcagatagacattgctatgcgggacaatgccaaaaatttatacacgtcacagctcaagtctattgggagagatcttgacattggcacactcattgaagtaaggagagcacaacttgcgtataaactttctgatgagatcgctgctgatatgttcagggagcatgcaaagaagttgattcaagaaaacatttcatcagcattagacatcttgaagtcacgtaccaaagcagcgaatagcccaacacaggttattgaagaagtgaagattgttcttgcatttaacagtttgctaacagtactaagcaagcaccctcaaggcgatcgatttgtgcgtggacttggacctatttcgttagctggagagcttgatcatgataggagggctggtgatctgaagatactctatagggcctatgcaacagaagtgctttcagacggcccccttgataatgagaagctcattcctttgaatgaactgaggaatatatttggactggggaagcgtgaagcagaagcaatcatctcagatgtcaaatctcaagtatacagaaagagacttgcaaaatgctttaacactgagttggctgcggctcctagcaaagcatcattcctccaaaatctctgtgaagagttagagtttgaccctgaacttgctagcaagatgcatgaagacatttatagacagaagcttcagcagtttgtagctgacggagagctgagcaaggatgaaactgaagctttgatggcgttccaagtgcgtctctgcattcctcaagaaactgtcgatgctgctcatactgatatctgcggccaattgtttgaaaaggttgtcaaggaagcaattgtgtctgttgatggatacaacgctgataggcgagatgcggttaggaaggcagcacaaggtctaaacttgaaaaaggaggctgctatgaccatatttagtaaagcagtacggaaattattcctgaactacattcagagagcaaaagcagctgggaaccgcattgaacaggcaaaagaactgaagaagttaatttccttcaatacagttgttgtaagtgagcttttagctgacattaaaggagagccgactgcaactgctgaacctgcaacatcaagtacgacctcagaacctgaaaccactgaatcagagggagaggatgactatgaatgggaatcactggaaacattaaaaaagactaggcctgataaagagctaaaagaaaagctagacaagtcaagtcagaaggagataaccctcaaagatgatcttccattgagagacagagctgagctgtatcaaacatatttgatgttctgtatcactggggagacgactaatgtttcgtttggaacagcaatctcgacgaagaaagacaattcagagtatttaatgctaaagcaattgggaaacatacttggtttaacccgcaaggaagctcaagatgtccacattaagctagcagaaaaagcatttgtgcaacaggctgaagtggttctagctgatggcaagttaacagaatccaaggctgaccagcttgcaaagatacagaagcaggttggtctgcctgatgagcacgcacagaaaatcattaaaagcatcacaacgacgaagttatcttctgcaattgaagcttctatagctcgagggcagattggtatccaacaggtccgaggattgaaagaagcaaattttcagttggatagcttgattgcagaaccgttgcgagaaaccatttacaaaaagtctgccgaggagatcttttcatcaggcacaggcgaatttgatgaagaggaagtgtatgtcaagatgccagctgatcttatcataaatgctgagaaggccaagtcgattgtgcaggacattgcaaaggttaggttggagaacgcccttgttcaggctgttgctttgcttcggcagaaaaagaaagatggtgtgatctcgtcattgaatgacttactagcatgtgacgctgccgtgcctgcttcaaagccgttgtcatggccctcaccaggagagctggatgatttgtactgcctttacttgaagagtatcccgaagcctgagaagttatcaaggttgcagtacttgctggacataagtgccgagaaggctggccagcttcgggatgccgcatcagctggcacactgccagtcgcgtcccaagaggaggaagaattggcgttctaggagagatgagatgag

SEQ ID NO: 8800 - DNA, 4945 bp, Brachypodium distachyon
cttctgcccaacccccttgtcttcgcccaacccccttttcctttgtccagccacccctcccccgccccaccaatcccccccatccatcgtcgcaacgctatccacaccctccgcctcggtacctcctccgccgccgccggcgagaagaagcacccatccactacctccgctgacaggccagatcttacaatggagctctcgctcgtctccgcgaagccctcgccctcgccgcgtgccgccgcctccgcgctcctcttcgccccgcttaaacccttcccgctcctccgcttcccgccgcggcgagccgcccccttcgcccgcctcaggagccagcggttccagttccgccgcgcggcggggtctggtgacggggagggcgagagcgacgcgacggcccggggggaggtgttcgggggccggagggaggaggtgttcggggggcggaaggagctcaccggcgtgcagccgctcgtggagtcgctgccgcccgcggctcggacggcggcggagctcgcggtggccgcggctgccgtggcggcgggctacggcatcgggctccgcctcggcggcggctcccgggccgcagcggtcgcgggcgcggccgtgctcggggcagctagcgtcgcaggggccgccgcggtaaactctgttgtgccggaggttgccgccgtggggctgcacaactacgtcgtcggctgcgacgaccccaccaagctggagaccagcgaggtggaggccatcgcgagcaagtatggagttagtacacaagatgcagccttcaaagcagagctctgtgacttgtatgccagctttctttactcagtactgcctcctggagatgaagatctcaaaggtaatgaggttgaggttattacgaaatttaaaagtgctcttggactcgatgatgtagatgctgcaaatatgcacatggagattggtagacgcttatacagggaaaggctggaaacaagggatcgcgatgctgacatggaacagcggcgggcgtttcaaaagctaatctatgtgtcaaatcttgtcttcggagatgcatcagccttcctacttccatggaagaggcttttcgggatcactgattctcagatagacattgctatgcgggacaatgccaaaaatttatacacgtcacagctcaagtctattgggagagatcttgacattggcacactcattgaagtaaggagagcacaacttgcgtataaactttctgatgagatcgctgctgatatgttcagggagcatgcaaagaagttgattcaagaaaacatttcatcagcattagacatcttgaagtcacgtaccaaagcagcgaatagcccaacacaggttattgaagaagtgaagattgttcttgcatttaacagtttgctaacagtactaagcaagcaccctcaaggcgatcgatttgtgcgtggacttggacctatttcgttagctggagagcttgatcatgataggagggctggtgatctgaagatactctatagggcctatgcaacagaagtgctttcagacggcccccttgataatgagaagctcattcctttgaatgaactgaggaatatatttggactggggaagcgtgaagcagaagcaatcatctcagatgtcaaatctcaagtatacagaaagagacttgcaaaatgctttaacactgagttggctgcggctcctagcaaagcatcattcctccaaaatctctgtgaagagttagagtttgaccctgaacttgctagcaagatgcatgaagacatttatagacagaagcttcagcagtttgtagctgacggagagctgagcaaggatgaaactgaagctttgatggcgttccaagtgcgtctctgcattcctcaagaaactgtcgatgctgctcatactgatatctgcggccaattgtttgaaaaggttgtcaaggaagcaattgtgtctgttgatggatacaacgctgataggcgagatgcggttaggaaggcagcacaaggtctaaacttgaaaaaggaggctgctatgaccatatttagtaaagcagtacggaaattattcctgaactacattcagagagcaaaagcagctgggaaccgcattgaacaggcaaaagaactgaagaagttaatttccttcaatacagttgttgtaagtgagcttttagctgacattaaaggagagccgactgcaactgctgaacctgcaacatcaagtacgacctcagaacctgaaaccactgaatcagagggagaggatgactatgaatgggaatcactggaaacattaaaaaagactaggcctgataaagagctaaaagaaaagctagacaagtcaagtcagaaggagataaccctcaaagatgatcttccattgagagacagagctgagctgtatcaaacatatttgatgttctgtatcactggggagacgactaatgtttcgtttggaacagcaatctcgacgaagaaagacaattcagagtatttaatgctaaagcaattgggaaacatacttggtttaacccgcaaggaagctcaagatgtccacattaagctagcagaaaaagcatttgtgcaacaggctgaagtggttctagctgatggcaagttaacagaatccaaggctgaccagcttgcaaagatacagaagcaggttggtctgcctgatgagcacgcacagaaaatcattaaaagcatcacaacgacgaagttatcttctgcaattgaagcttctatagctcgagggcagattggtatccaacaggtccgaggattgaaagaagcaaattttcagttggatagcttgattgcagaaccgttgcgagaaaccatttacaaaaagtctgccgaggagatcttttcatcaggcacaggcgaatttgatgaagaggaagtgtatgtcaagatgccagctgatcttatcataaatgctgagaaggccaagtcgattgtgcaggacattgcaaaggttaggttggagaacgcccttgttcaggctgttgctttgcttcggcagaaaaagaaagatggtgtgatctcgtcattgaatgacttactagcatgtgacgctgccgtgcctgcttcaaagccgttgtcatggccctcaccaggagagctggatgatttgtactgcctttacttgaagagtatcccgaagcctgagaagttatcaaggttgcagtacttgctggacataagtgccgagaaggctggccagcttcgggatgccgcatcagctggcacactgccagtcgcgtcccaagaggaggaagaattggcgttctaggagagatgagatgagaaacttttttgttaggtagccagcagagtcgagctcctgccagacgcagtgctgtggcgcccaatagctgctgtgttgtagctaggcatgcttttgtgaagcgacgcataatcctgacatgcataattatttgtatagacaatggacacgaactgtggtgacagttttttgctgcattctttcagaccatactggcattgttttctgtttctccttgatcctgacatgcataattatttgtatacaacagttgttattgcaatcccttggtaataaatgtggttttgttgttactcgtctcaattaccaaggatgtagttcaggaaacacaaataaatcttatatgatcaataattccaagtgatcttgtcaatcaacgaacaattgttgtacaacatactcctgatgatcaataatacctctacagtgcagaagcatctattactggggtcaattttaacaacatttagacaggaagtgtgcagcagaaacggtacaaaaaagtagtgaaaaactactgaaacgccaataagctgtgcaatggccttataaggtgacgccagcaggtgaaaccactattaggtttgtggtttatacattatcaggccaaaattccctgaagaaagctatttcgaattccttctcttgtaatcgcttctcctcttcctgcatcttccgtatcctctttgcagccaactttgccttcttcgttgacatcgtgtcctgctgataattaggacatagtcagatgccttcagaagaagtaacaactaaaagtaacttgttgatgatacagtaatgtgcaaggaacaacacatctgtattgtcccctaaaccaagctaacattctgcagtatctgatgcaaggtgttatgtttatctaacacaaataccatttccaattactgcacaaagaactcagtagttaacaatccggattaaaattattttgtcaaatcaacagaacttgtaaactattacgacatcaaaattttcagaatcataacaagaatttttgcaattaaggtaacaagaacgatgtatcaagcaatataatgttgcaaatctcatcctttgctcaccttgggccttttaggagccttttcaacttcgtcctcgaccagtggctttggctttggttctttggaacccaaaccacgcttgttgttcttaacacgagtctctactggttccaacctcccctgctcctgcgcccctaggccggtgccctccttccacccggacttcttcagcagctgcagcaatccaaacgcacacgcacgccgtcaggttcaaaaacagcaatcaaccacatcaaagcatcaaaccctaatccaccacgataggggggatgggcaggagaggaagcgacggaaggacctggaagccgatgttggaggagccgatggaggccatctccgcccctccacccagcgaagcgaacgcgccgccctctgcctctgcctccgccgcttgccggccgcgcttctccctctctctttcttaccctctccggcctcttcccgtttcaggcgtctacacgtagcttggtcgcgtttggtttacttcagagttcagactccatcctggttgtgtcgtgtccggtacggatttccgctggttcacgagtcggttccggccc

SEQ ID NO: 8801 - DNA, 2960 bp, Saccharum officinarum
cgcgggccacgacgaccccaccaacctggactacggcgaggtggaggcaatcgcgaagaaatacggaattagcacacaggatgaagccttcaaagcagagctctgtgacttgtatgccaggtatgtttactcagtacttcctccaggagatgaagatctcaaaggtacggaggttcaggcaattataaaatttaaaagagctcttgggcttgatgatgtagatgctgctaacatgcacatggagattggtagacacatatacagagagaggctggaaacaagtgatcgtgatgctgacatggaacaaaggcgggcatttcagaagttaatttatgtgtccaatcttgtctttggagatgcatctgcattcctacttccttggaagcgtctttttggagtgactgaatctcagatggacattgctatgagggaaaatgccaagagtttatactcggtgcagctcaagtctattggaagaggtcttgacataggcacgctcattgatctaaggggagcgcaacttgcatataaactttctgatgagattgctgctgagatgttccgcgagcacgtgaagaagctagttcaagaaaacatttcatcagcattagacatcttgaagtcacgtattccggatagtctaactcaggctgtggaagaagtgaacattgttattaaatttaatagtttgcttacaacattaagcaaacaccctcaagctgatcgttttgctcgtggtcttggccctatttcattagctggagagcatgatcacgataggagagctgatgatctcaagatactctataaggcctatgctacagaagtactttcagatggaattgtggacgatgagaagctttcccctcttaatgaactgagaaacatatttggactggggaagcgggagacagaaagaatcttgtctgatgtcaaagctcacatatacagaaagacacttgctaaatcattcaacactgaattggcttcagtccctagcaaagcagcattcctccaaattctttgcgagaagttacagtttgatcctgaactggctagcaagatgcatgaagaaatttacagacagaagcttcagcagtttgtagctgatggagagctgagcaaggaggaagtggaagctttgatggcattccaagtgcgtctctgcatccctcaagaaactgtggacgctgctcatactgagatctgtggacaactgttcgaaaaggttatcaaggaagccattgcatctgttgatggatataatgctgatagacgagaggctgttaggaaggcagcacaaagtctaaacctgaaaccggaggctgccatggcgatctttagtaaagcagtacggaagttattcttgagctacattcagagagcaaaagaagctgggaaccgcatcgaaactgcaaaagagctgaagaagttaatttccttcaacattgttgttgttagtgagcttttagctgacattaaaggagagatatctccagttgctgaaactgaagcatcaagtgcagcatcagaatccgagggagaggatgatgaacatgaatgggaatcattggacacactgagaaagactagacctgataaagagctcaaagaaaagctgagaaagtcgagccgaaagagataactctcaggatgacattccattgagggatagggctgagttgtatgaaacatacttgatgttctgcatcaccggcgagacgactaacgtatcatttggaacagctatctctacaaagaaagacgattccgagtttttaatgctaaagcaattgggtgacatacttggtttgactcgcaaagaagctcaagatgttcacattaagtttgcagagaaagcttttgtgcaacaggcggaagtaattcttgctgatgggaaattaacagaggctaaggctgaccagcttgctaagattcaaaagcaggtcggtttgcctactgaacatgcacagaaaatcattaagggtattacaactacaaagttatcttctgctattgaagcctctgttgctaggggtcagatcggtatacagcaggtccgaggattgagagaagcaaacttccaactggatagcttgattgcggagccgcagcgagaaagcatttataggaaaactgttgaagagatcttttcttcaggtacaggggatttcgatgaagaggaaatgtatgtaaagattccagctgatctcataataagttctgagaaggccaagtcaattgttcaggatattgcaaaggttaggttggagaactcccttgttcaggctattgccttgcttcgtcagaagaagagagatgatgtggtttcatctctgaatgacatgctcgcatgtgacgctgcggtccctgcatcgcaacccttgtcatggcccacaccaggagagctagatgatctatatgccatctacctaaagagcattccgaggcctgagaagctatcaaggttgcagtacctgctgggcataagcaacgagaaggctaacaaaattcgggacgcggcctcagagggatcgctgccaattgcagctgaagagaaagaggagttggccttctaggaaggggcacagttttgttagggtagccaccagagttgaggtcccttgccaatgaacgaacgaacttggtgctgtggccaacagctgctattgtagctaggcgcatacatgtttttggaataggaaagcgacgtgtgatcctgacatattgcatagctatctgtatagacaagtctgacaccaaaatttggtgagtcttcatttgctgttgcattccaccagaccacactgaaagccttttgttttctggtttattgtttctcttttcgttcaacaatgtatcacagctatgactgcaacccttgcttataacctggatttgtggttccacacacaccaccccaccaccccccccatcatccatcaaaagggggggcgccc

SEQ ID NO: 8802 - DNA, 8692 bp, Brachypodium distachyon
gggagccatacttggaagccgcaaactcacccatcgctccatctatttcgccgcgcagccatatgatgtcgccgttaaagcccatggaagccgccgcgaccatacatcgttcgaccgacgcaggggtgatcgcccaaggcccaagctagctagcagcaatggagttctcgctcgtatccgccaagccctcgccccgcgctgccgctgccgccgcgtccgccccgcggagcagccccactgccgcccgcctccgcggccggcggttccgctgcgcggcggcggccaagggtgaacaggtgttcggcggccggaaggagctcacgggcgtgcagccgctggtggaggcgctgccgcccgcggcgcgggcggtggtggagctcgcggtcgtcgcggccgcggcgacggccgggtacggcctcgggaccaaatacggcggtggctcgcggaccgcggcggtcgcgggcgcggccgtgctgggggcggccagcctcgcgggggctgccgcggtgaattccgtggtgcccgaggtcgccgccgtggggctgcacaactacgtcgccggctgcgacgaccccaccaagctggagaccggcgacgtggaggccatcgcgaagaaatatggagttagtacagaagacgcagccttcaaatcagagctctgcgacttgtatggcagctttgtttactcagtacttcctccaggacatgaagatctcaaaggtaatgaggtggaggctattataaaatttaaaagagctcttggactcaatgatgtagatgctgcaaatatgcacatggcgattggtagacgcttatacaaagagaggctcaatgcattccagaagttaatttttgtgtcaaatcttgtcttcggagatgcatcagacttcctacttccatggaaacatctttttgggatcacggattatcagatcgatattgctatgcgggagaatgctaaaactttatacgcatcggaactcaagtctattggaagaggtcttgacataggcacgctcattgaactaaggagatcacaactcgcgtataaactttttgatgaggttgctgctgacatgttcagggagcatgcgaagaaattgattctagaaaacattgcatcagctttagccatattgaagtcgcaacccagtacagtgatcaccccagcgcaggttattgatgaagtgaatagcatcattgcgtttaatagtctgctaagagttctaagcaagttccctcaaggcgatcgattcgcacgtgggcttggacctatttcgttaggtggagagtatgatcatgagttgatggttgatgatctaaagatactctatacggcctatgcaagagaagtactttcagatagccttgatgatgagaagcttgtttctttgattgaactgaggaatatatttggactggggaagcttgaagcagaagaaatcattgcaaatgtcaaatccagagtactagcatgatgctcatgcttggctctaggttaaaaggttttatcgtttgttcaaaatactgttttccttgttgaattctgacaagcagagagagagagcaatgtaatttgaactgttgctgaatttcagcaagttaccaggtaacagtttcatgaaacataaaagaaacatgcctgataacgatttactctctctgttccaaattattagatgatctagctttgccctatgtcaacttcttaaagtttgatcatgtttatagactctaccaacattttcaactcagagagtaacatggataacttgtatgattttacaaatcttcggctgttcacccgtcgccgcacgacgaacttacaacccaatggaaattcgcaacaccacacacttgcgcagtagtccgccgaccacaagcggtttcgcaatcttccaatccccagcggaacgacagattacgctcgaaatttcagtagataacaaacaccctatcgaaacgaatgtggtgtataggattccagatgaatgcttctcgcaatcaacaagagtctcgaaaatagctaaaacgtggtctcaccctgttgtaatataataaaatccttacatgggccgggccgtaatcctacgtgacggcgaccaagtcaacaaatcccaaaaaccgatcaatttgccaacaaggcgtagccatgccaactaggcgccggtcaaaggagtcaacaagtcaagtcgctcatgccttggttaaaggagaaggggagcttgagtaggggccaagaaaggtgtaggatgagtttaccactttgccctcactttccctctccctcaagggtagccatggtcttttgttatgaacctctaggctataaataccccccatgggggcatgtatcattcactctccattggaataagatcaaaggggagagggctagagcaacctaaggagcccgctctcgagtgcttgggtcgagcctaatctcgactcgacctcggggacgtgacttaggaagcctagtttcgaggtttcgggccgtctagtacgacctcgactcgaagtagagggatcgggttagagtctcgagggtatcccaacctcgctacttgggaagacaagttcggtccaagtccgaggcggcccctagagatctctcgccataggtgatttgggaagatgcgttcaacccaaacacccggctaacgaccccctcaaagtctctcctaacataggactaagtcgtgcccgcagggttgactgaacctattaaaaaaatattgacgtgtcaaacttgtccaaatgtacggcgaccttcactataaggccggcgtacacatcctacatactattcttacacttgagccatctagcattggcaccccgtactcctgttgttttctagaacaacaacacaccctaaacctagacgtaccccttgtttatatagacgaggagtagcccaaactcaatacagactccgactaactcaaactagaattcgactcagactcaaactagaactagaattccactcagactcaaacatcgactcgcagatccgggtgctccttagacgtgtcgaactcgtcgtaggctgtcctagtgcgcctcatattcgtactcgacttgtggtgcatcctgggcatatcatccttgtcattggttgccccttgcacacaaagacattcttctaacttgtatccttcatcttcacttttggtgcgcctgcctccctctcctccctcgcgcatatcttgatgtaggatatcaacacttgagtatccgtaccctcatcacttggtcacgggaaaccagaggccaatgtccaccttgttctccttgagcttaggacacaaagtcttcggcttaatcagcctacctggcacagtttaaagtgatgagttgccatcctttcaatctcctgttctagaagtgatcccaagaagtgtaagtttttggctggattcctgtatacaaaagaattccaacagtggacacaatcgccaagaaagttattttccaggcctaggtcggttcggttttgagaaaaaactttctaaagaaacgatgaacaatcggttccccttcaatatgttaataaaaaaatcggtgcaccaaaaatttggtttggttctctgttcttctcgagcagaaccgaaacaaaccgacgggcggcgcacgagaaaacaagttgtggaaattgcctctggcatgagaaaacaagttgtagaagcagggctcaatacttgagagaagaaagagaggcagagagaagtggtcatcccacttgtggttttggagaaggcaatgcaatggccatggcggtgcactgtggcaagcaggtgggagtcgatgagttgagagaaggaagttgaggtcgggtgatcaccatacaagggatgggcggcgtgcgtatgggacaatgtgggctcagggcacctctagtatggatggcgtcttggactagggttagcagctacgggaataaggagaaaagaaatcggggtcagacggattgatcgatagggagagagaccaatttgagaaagggtttctttcttttttggtttgagagttcatttttcggtccatatgtccaaccctagtattgagaaagacaaatggtgccctttctgccataacacataggaaaaagcgtaccatctcctcattgattgtgcttttgctcgttcgatatgaatatgagtggcaaattggatcaaaatcagggaattcagtcgctaggtggattttgaacgtgactcttaggcaatggtggctcaatcggggcgaggaaaagtttaagtagaaagagtgcgaatggattagcagtgctactgctctctttgattcatttcgaaggaaagaaacaaccacatcttccaacacaagttgctatccttcttgaaagttgttaacaatgttaaagcggaagttgaatacattagatattggatctttgatcttaggattggacatgtggttcggtcaccttagcttgatcttcaccttctcccttccttgacattccttttatttttccttttgtatggttcttatataattttctatgtcagatccgtttcgactctcgtgttgtttcgtaaaataaaaaagtgtcggagtattaaaaactgaacgacaactcaaaccaccgaaagacctaaagatggatatcattacgtgaattcacttgcatgaaaaattaaggtgtctgagttagagatagccatgacattgtgcacagagcaagcatgaatttctcttttaagaagccccaatttcttatttatgtttagcggtatcattatcgagttcaaggtcgagtcgtgcagtagcatggagctactcgtcactgcacagttgttttagctgtaatagtgccctttgtctctaaaagaaaaagacactaatgcagtaatactactatctcctctctcaagttcaaaatgaagaaaagaaaaatcccttctctctctgtttctaaaaaaagcagtcccccgccccaccggtccgagaaattcacgttctgccttctgcccaacccccttgtcttcgcccaacccccttttcctttgtccagccacccctcccccgccccaccaatcccccccatctatcgtcgcaacgctatccacaccctccgcctcggtacctcctccgccgccgccggcgagaagaagcacccatccactacctccggtgacaggccagatcttacaatggagctctcgctcgtctccgcgaagccctcgccctcgccgcgtgccgccgcctccgcgctcctcttcgccccgcttaaacccttcccgctcctccgcttcccgccgcggcgagccgcccccttcgcccgcctcaggagccagcggttccagttccgccgcgcggcggggtctggtgatggggagggcgagagcgacgcgacggcccggggggaggtgttcgggggccggagggaggaggtgttcggggggcggaaggagctcaccggcgtgcagccgctcgtggagtcgctgccgcccgcggctcggacggtggcggagctcgcggtggccgcggctgccgtggcggcgggctacggcatcgggctccgcctcggcggcggctcccgggccgcagcggtcgcgggcgcggccgtgctcggggcagctagcgtcgcgggggccgccgcggtaaactctgttgtgccggaggttgccgccgtggggctgcacaactacgtcgtcggctgcgacgaccccaccaagctggagaccagcgaggtggaggccatcgcgagcaagtatggagttagtacacaagatgcagccttcaaagcagagctctgtgacttgtatgccagctttctttactcagtactgcctcctggagatgaagatctcaaaggtaatgaggttgaggttattacgaaatttaaaagtgctcttggactcgatgatgtagatgctgcaaatatgcacatggagattggtagacgcttatacagagaaaggctcataggcgtttcaaaagctaatctatgtgtcaaatcttgtcttcggagatgcatcagccttcctacttccatggaagaggcttttcgggatcactgattctcagatagacattgctatgcgggacaatgccaaaaatttatacacgtcacagctcaagtctattgggagagatcttgacattggcacactcattgaagtaaggagagcacaacttgcgtataaactttctgatgagatcgctgctgatatgttcagggagcatgcaaagaagttgattcaagaaaacatttcatcagcattagacatcttgaagtcacgtaccaaagcagcgaatagcccaacacaggttattgaagaagtgaagattgttcttgcatttaacagtttgctaacagtactaagcaagcaccctcaaggcgatcgatttgtgcgtggacttggacctatttcgttagctggagagcttgatcatgataggagggctggtgatctgaagatactctatagggcctatgcaacagaagtgctttcagacggcccccttgataatgagaagctcattcctttgaatgaactgaggaatatatttggactggggaagcgtgaagcagaagcaatcatctcagatgtcaaatctcaagtatacagaaagagacttgcaaaatgctttaacactgagttggctgcggctcctagcaaagcatcattcctccaaaatctctgtgaagagttagagtttgaccctgaacttgctagcaagatgcatgaagacatttatagacagaagcttcagcagtttgtagctgacggagagctgagcaaggatgaaactgaagctttgatggcgttccaagtgcgtctctgcattcctcaagaaactgtcgatgctgctcatactgatatctgcggccaattgtttgaaaaggttgtcaaggaagcaattgtgtctgttgatggatacaacgctgataggcgagatgcggttaggaaggcagcacaaggtctaaacttgaaaaaggaggctgctatgaccatatttagtaaagcagtacggaaattattcctgaactacattcagagagcaaaagcagctgggaaccgcattgaacaggcaaaagaactgaagaagttaatttccttcaatacagttgttgtaagtgagcttttagctgacattaaaggagagccgactgcaactgctgaacctgcaacatcaagtacgacctcagaacctgaaaccactgaatcagagggagaggatgactatgaatgggaatcactggaaacattaaaaaagactaggcctgataaagagctaaaagaaaagctagacaagtcaagtcagaaggagataaccctcaaagatgatcttccattgagagacagagctgagctgtatcaaacatatttgatgttctgtatcactggggagacgactaatgtttcgtttggaacagcaatctcgacgaagaaagacaattcagagtatttaatgctaaagcaattgggaaacatacttggtttaacccgcaaggaagctcaagatgtccacattaagctagcagaaaaagcatttgtgcaacaggctgaagtggttctagctgatggcaagttaacagaatccaaggctgaccagcttgcaaagatacagaagcaggttggtctgcctgatgagcacgcacagaaaatcattaaaagcatcacaacgacgaagttatcttctgcaattgaagcttctatagctcgagggcagattggtatccaacaggtccgaggattgaaagaagcaaattttcagttggatagcttgattgcagaaccgttgcgagaaaccatttacaaaaagtctgccgaggagatcttttcatcaggcacaggcgaatttgatgaagaggaagtgtatgtcaagatgccagctgatcttatcataaatgctgagaaggccaagtcgatcgtgcaggacattgcaaaggttaggttggagaacgcccttgttcaggctgttgctttgcttcggcagaaaaagaaagatggtgtgatctcgtcattgaatgacttactagcatgtgacgctgccgtgcctgcttcaaagccgttgtcatggccctcaccaggagagctggatgatttgtactgcctttacttgaagagtatcccgaagcctgagaagttatcaaggttgcagtacttgctggacataagtgccgagaaggctggccagcttcgggatgccgcatcagctggcacactgccagtcgcgtcccaagaggaggaagaattggcgttctaggagagatgagatgagaaacttttttgttaggtagccagcagagtcgagctcctgccagacgcagtgctgtggcgcccaatagctgctgtgttgtagctaggcatgcttttgtgaagcgacgcataatcctgacatgcataattatttgtatagacaatggacacgaactgtggtgacagttttttgctgcattctttcagaccatactggcattgttttctgtttctccttgatcctgacatgcataattatttgtatacaacagttgttattgcaatcccttggtaataaatgtggttttgttgttactcgtctcaattaccaaggatgtagttcaggaaacacaaataaatcttatatgatcaataattccaagtgatcttgtcaatcaacgaacaattgttgtacaacatactcctgatgatcaataatacctctacagtgc

SEQ ID NO: 8803 - DNA, 1638 bp, Saccharum officinarum
cgcctcgcctctcagccccctcaaccccggcgccggcggccaaaagtcgaagcaccgaaccagcggcagcggcggcggcgcggcaagtggtgaccatggcggagctcaagcgtctgtcggagagccgggacctgacgcggattgagcgcatcggcgcgcactcccacattcggggtctagggttggactcctccatggaggcgcgcgatgcctcggaaggcatggtcgggcagctccccgcgcgccgcgccgcggggctcatactccagctcatccgccagggcaagatcgccggccgcgctgtgctccttgcgggccagcccggcaccggcaagaccgcgctcgccatgggcatcgccaagtcgcttggagcggagacgcccttcgcctctgtcgctgcctcggagctcttctcgcttgacctctccaagacggaggcgctcacgcaggccttccgccgcgccatcggcgtacgcatcaaggaggaggcggagatcatcgagggcgaggtcgtggagatctcaatcgaccgccctttgtcggcctctggcgctggcggcagctcggctgccccttccggtgctactgcggctggtaagtcagggcggctcacgctgaagactacggacatggagacggtgtacgagctcgggggaaagatgattgaggctcttgggaaggagaaggtgcagagcggggatgtgattgcgcttgacaaggcctccgggaaggtcacaaagcttggccgctctattgggaggtcgcgggattatgatgctgttggcccgcacaccaagtttgtcaagtgtcctgatggtgagctccagaagcgcaaggaggtcgtgcactgtgttaccttacatgagattgatgtcatcaatagcaggacacagggttttcttgcactgttcactggtgacactggtgaaattcgtgcagaggttcgggagcagattgacacaaaagttgcagagtggagagaagaaggaaaagctgagattgtccctggtgttctgttcatcgatgaagtccacatgctagacatcgagtgcttctccttcctcaaccgcgcattggaaaatgacatggctccgatcctagtaatcgcaacaaacagagggatcacatccatccgtgggacaaactaccgttcaccgcacgggatcccgccagacttccttgaccggttactgatcatcacgacgcagccctacacggaggacgagatccggaagatcctggatatccggtgcgatgaggaggacgtggagatgtccgcggatgccaaggtcctgctcaccaagatcggcgtggagacctcgctgcggtacgccatcaaccttatcacatccgccgcactagcctgccagaggcgcaaggggaaggtggtcgagatggaggacattagccgggtgtaccagctgttcctggacgtgaagcggtcgacgcagtacctgatggagtaccagagccagtacatgttcaacgaagtgcccggggaaggtgatggagaggacgccatgcaaacctagatgaactttcctttacaaggtgtctgggactatgtactgcgtcgtgatttctgatgcgtcttgctttgttagggtgcttgtaccctgacaaggcgtggtgtgtgcg

SEQ ID NO: 8804 - DNA, 1983 bp, Sorghum bicolor
cgcctacagccttccagctaggtccactgacaaaaccctggctcgttccccgcgctaaacctaaacctcacctcgcctccgctctccctcaaccccggcggcccaaagtcgaagcaccgaaccagcggcggcggcgggcggcgggcggcgcggcaagtggtgaccatggcggagctcaagcggctgtcggagagccgtgacctgacgcggattgagcgcataggcgcgcactcccacatccgggggctagggttggactcctccatggaggcgcgcgatgcctcggagggcatggtcgggcagctcccggcgcgccgcgccgcggggctcatactccagctcatccgccagggcaagatcgccggccgcgctgtcctccttgcgggccagcccggcaccggcaagactgcgctcgccatgggcatcgccaagtcgcttggcgcggagacgcccttcgcctccgtcgcggcctcggagctcttctcgctcgacctctccaagacggaggcgctcacgcaggccttccgccgcgccatcggcgtacgcatcaaggaggaggcggagatcattgagggtgaggtcgtggagatctcaatcgaccgccctttgtcggcctctggcgctggcggcagctcggctgccccttctggtgctactgcggctggtaagtcagggcggctcacgctgaagaccacggacatggagacagtgtacgagctcgggggaaagatgatcgaggctcttgggaaggagaaggtgcagagtggggatgtgattgcgcttgacaaggcctccggtaaggtcaccaagcttggccgctccattgggaggtcgcgggattatgatgctgttggcccgcacaccaagtttgtcaagtgtcctgatggtgagctccagaagcgcaaggaggtcgtgcactgtgttaccttacatgagattgatgtcatcaatagcaggacacagggttttcttgcactgttcactggtgacactggtgaaattcgtgcagaggttagggagcagattgacacaaaagttgcagagtggagagaggaaggaaaagctgagattgtccctggtgttttgttcatcgatgaagtccacatgctagacattgagtgcttctccttcctcaaccgcgcattggaaaatgacatggctccgatcctagtaattgcaacaaacagagggatcacatccatccgtgggacaaactaccgctcaccgcacgggataccgccagacttccttgaccggttgctgatcatcacaacacagccctacacggaggaggagatccggaagatcctggatatccggtgcgatgaggaggacgtggagatgtctgcggatgccaaggtcctgctcaccaagatcggcgtggagacctcgctgcggtacgccatcaaccttatcacatccgccgctttagcctgccagaggcgcaaggggaaggtggtcgagatggaggacattagccgggtgtaccagctgttcctggacgtgaagcggtcgacgcagtacctgatggagtaccagagccagtacatgttcaatgaggtgccgggggaggcagatggagatggagaggacgctatgcaatcctagatgaacttccctttacacaggtgtctgggttagtatgtactgcgtcgtgtatttctgatgcgtcttgcttgtttaggttgctgttaccctgtcaaggcgtggtgtgtgcgatggactgtctgttagctgatgtaggtgactatgcaactcaatctatcttattaaaattcacaccttcaccccagttggagtgccgtggtttgtttaaatttgtgccaccatctcatactgtatttcgacatatatgcatgctagatttgtccaggatgcgtgaagtaaggtcagttctaatgtaggcgtcgagccgttgtatggtatagactgaaagggtcagatgcttatgctgatttgttatgaaaaaaaacattactgaga

SEQ ID NO: 8805 - DNA, 1887 bp, Sorghum bicolor
accctggctcgttccccgcgctaaacctaaacctcacctcgcctccgctctccctcaaccccggcggcccaaagtcgaagcaccgaaccagcggcggcggcgggcggcgggcggcgcggcaagtggtgaccatggcggagctcaagcggctgtcggagagccgtgacctgacgcggattgagcgcataggcgcgcactcccacatccgggggctagggttggactcctccatggaggcgcgcgatgcctcggagggcatggtcgggcagctcccggcgcgccgcgccgcggggctcatactccagctcatccgccagggcaagatcgccggccgcgctgtcctccttgcgggccagcccggcaccggcaagactgcgctcgccatgggcatcgccaagtcgcttggcgcggagacgcccttcgcctccgtcgcggcctcggagctcttctcgctcgacctctccaagacggaggcgctcacgcaggccttccgccgcgccatcggcgtacgcatcaaggaggaggcggagatcattgagggtgaggtcgtggagatctcaatcgaccgccctttgtcggcctctggcgctggcggcagctcggctgccccttctggtgctactgcggctggtaagtcagggcggctcacgctgaagaccacggacatggagacagtgtacgagctcgggggaaagatgatcgaggctcttgggaaggagaaggtgcagagtggggatgtgattgcgcttgacaaggcctccggtaaggtcaccaagcttggccgctccattgggaggtcgcgggattatgatgctgttggcccgcacaccaagtttgtcaagtgtcctgatggtgagctccagaagcgcaaggaggtcgtgcactgtgttaccttacatgagattgatgtcatcaatagcaggacacagggttttcttgcactgttcactggtgacactggtgaaattcgtgcagaggttagggagcagattgacacaaaagttgcagagtggagagaggaaggaaaagctgagattgtccctggtgttttgttcatcgatgaagtccacatgctagacattgagtgcttctccttcctcaaccgcgcattggaaaatgacatggctccgatcctagtaattgcaacaaacagagggatcacatccatccgtgggacaaactaccgctcaccgcacgggataccgccagacttccttgaccggttgctgatcatcacaacacagccctacacggaggaggagatccggaagatcctggatatccggtgcgatgaggaggacgtggagatgtctgcggatgccaaggtcctgctcaccaagatcggcgtggagacctcgctgcggtacgccatcaaccttatcacatccgccgctttagcctgccagaggcgcaaggggaaggtggtcgagatggaggacattagccgggtgtaccagctgttcctggacgtgaagcggtcgacgcagtacctgatggagtaccagagccagtacatgttcaatgaggtgccgggggaggcagatggagatggagaggacgctatgcaatcctagatgaacttccctttacacaggtgtctgggttagtatgtactgcgtcgtgtatttctgatgcgtcttgcttgtttaggttgctgttaccctgtcaaggcgtggtgtgtgcgatggactgtctgttagctgatgtaggtgactatgcaactcaatctatcttattaaaattcacaccttcaccccagttggagtgccgtggtttgtttaaatttgtgccaccatctcatactgtatttcgacatatatgcatgctagatttgtccaggatgcgtgaagtaaggtcagttctaatgtaggcgtcgagccgttgtat

SEQ ID NO: 8806 - DNA, 1794 bp, Zea mays
cgcctaccgcattctagcttggtccattgacaaaaaccctgggtctctccttcgaggcttcaacctaaacctcgtctcgcctccttcagtccatcccctcaaccccggcggccaaaagccggcgcaccgaagcggcgggccggcggcaagcggtggccatggcggagctaaagcggctgtcagagagccgggacctgacgcggatcgagcgcatcggcgcgcactcccacatccgggggctagggctggactcctccatggaggcgcgcgacgcctcggagggcatggtcgggcagctgcccgcgcgccgcgccgcggggctcatactccagctcatccgccagggcaagatcgccggccgcgccgttctcctcgcgggccagcccggcaccggcaagaccgcgctcgccatgggcatcgccaagtcgctcggcgcggagacgcccttcgcctccgtcgccgcctcggagctcttctcgctcgacctctccaagacggaggcgctcacgcaggccttccgccgcgccatcggcgtgcgcatcaaggaggagacggaaatcatcgagggcgaggtcgtggagatcttgatcgaccgccctttgtcggcctctgccgctggcggcagctcggctgcccctacaggtgctactgcggctggtaagtcgggtcggctcacgctgaagaccacggacatggaaacggtgtacgagctcgggggaaagatgattgaggctcttgggaaggagaaggtgcagagcggggatgtgattgcgcttgacaaggcctccgggaaggtcaccaagcttggacgctccattgggaggtcgcgggattatgatgccgttggcccgcacaccaagtttgtcaagtgtcctgatggcgagctccagaagcgcaaggagatcgtgcactgtgttaccttacatgagattgatgtcattaatagcaggacacagggttttcttgcactgttcactggtgacaccggtgaaattcgtgcagaggttcgggagcagattgacacaaaagtcgcagagtggagagaggaaggaaaagctgatattgtccctggtgttctgttcatcgatgaagttcacatgctagacattgagtgcttctccttcctcaaccgagcattggaaaatgacatggctccgatcctagtaatcgcaacaaacagagggatcacatccattcgtgggacaaactaccgctcgccacacgggatcccgccagacttccttgaccggttactgatcatcacgacgcagccctacacggaggacgagatcaggaagatcctggacatccggtgcgatgaggaggatgtggagatgtccgcggacgccaaggtcctgctcaccaaaatcggcgtggagacctcgctgcggtacgccatcaaccttatcacatctgccgcactagcctgccagaggcgcaaggggaaggtggtcgacatggaggacattagccgggtgtaccagttgttcctggacgtgaagcggtcgacgcagtacctgatggagtaccagagccagtacatgttcaacgaagtgcccggggaagcagatggagaggacgcgatgcaatcctagatgaacttttcttcaccaggtgtctgtgttagtatgtactgcgtgtctgcgtcgtctatttctggtgcatcttgcttgtttagttgctgttatttcctgacaaggcgtggtgtgtgcgatggactgcctgaaagctgatttaggtaactatatatgcaattcagatgtatcttagtaaaattcaccccagttggagtga
